United States Patent 7,709,616 (MICRORNAS AND USES THEREOF) - sequence listing, part 17

SEQ ID NO: 504478 - RNA, 64 nt, hsa
ugcaaggaccaccuugugggaucaccuuuucccagcuggcuagggcugaggcuggggucucugc

SEQ ID NO: 504479 - RNA, 64 nt, hsa
cagccugacuugacuuuugaguccuagggaugcugcuggcuagagaugaggcuuuaccucagac

SEQ ID NO: 504480 - RNA, 64 nt, hsa
gggaaccaucucuccugcucuccuugggaugauggcuggcuagucagccuugcauguauuccuu

SEQ ID NO: 504481 - RNA, 64 nt, hsa
ccacccaccccuagcccaggucagcuuuccuggagcuggcuaaugaaagccuccucaccucuuc

SEQ ID NO: 504482 - RNA, 64 nt, hsa
gcugugagaagucacucacacuggccacaaggacgcuggcuacugucuauuaaaauucugaugu

SEQ ID NO: 504483 - RNA, 64 nt, hsa
aggccuggagcugcugaagacugcgauugggaaagcuggcuacacugauaaggugaucgucagc

SEQ ID NO: 504484 - RNA, 64 nt, hsa
acaggaaaaggcaaacuugaggggaucgucgccugcuggcuaagaccagggagcuaaaaacuug

SEQ ID NO: 504485 - RNA, 64 nt, hsa
ggacccugcggggcuggguacuguguacccccaggcuggcuagcccuucccuccauccuguagg

SEQ ID NO: 504486 - RNA, 64 nt, hsa
ugggucucccuccccauccugguuuccaccccgggcuggcuagcucuguugguuugaagacuga

SEQ ID NO: 504487 - RNA, 64 nt, hsa
cugugccaacugaaguaggagacugacugugagugcuggcuaaaagcccuggguggugaggcuc

SEQ ID NO: 504488 - RNA, 64 nt, hsa
guaugugaaggaagcagggaugucgcaggaauccgcuggcuaacaucugcucuugguuucugcu

SEQ ID NO: 504489 - RNA, 64 nt, hsa
uuucgauguguuguaguugcuuagaguugauucugcuggcuagauuguacugauuaauagauuu

SEQ ID NO: 504490 - RNA, 64 nt, hsa
uccggccuuugggagaggcauguucuugggcagggcuggcuacggcaagagggaaccaauuccu

SEQ ID NO: 504491 - RNA, 64 nt, hsa
cacugcccucagaggcugcucccuuccccuggaggcuggcuagaaaccccaaagagggggaugg

SEQ ID NO: 504492 - RNA, 64 nt, hsa
gugcagcccagcccacgguggcuguuccaugaaugcuggcuaccuaugugugugguaccuguug

SEQ ID NO: 504493 - RNA, 64 nt, hsa
aucucaaaacucauuauguugucagagcccuagagcuggcuaguguaacacugacuaugaguag

SEQ ID NO: 504494 - RNA, 64 nt, hsa
agaagagaugggacuauuucuauauuuaaaugcugcuggcuauuccuuuguauauaaaugaaaa

SEQ ID NO: 504495 - RNA, 64 nt, hsa
caguuuggcacuggaaccaagagcacaugucguggcuggcuacaagguuguaaagcagaaaauc

SEQ ID NO: 504496 - RNA, 64 nt, hsa
caagcaacaacuccgcaggcaguuaccaaguacggcuggcuacaacugcuccauccgugccucu

SEQ ID NO: 504497 - RNA, 64 nt, hsa
uacuccucuuauuauuuuuccauuaaaaauaauagcuggcuauuauagaaaauuuagaccauac

SEQ ID NO: 504498 - RNA, 64 nt, hsa
ugugacuacaaaauauuuuauuugcuuuaaauuugcuggcuacccuagauguguuuuuauuccu

SEQ ID NO: 504499 - RNA, 64 nt, hsa
uccaagcuagauuuccgacagcauuauucugagagcuggcuaccauuacccuucuugcuauugg

SEQ ID NO: 504500 - RNA, 64 nt, hsa
accucaaaacucauuauguugucagagcccuagagcuggcuaguguaacacugacuaugaguag

SEQ ID NO: 504501 - RNA, 64 nt, hsa
gccugugaacagauaacuuucaucaauuaggauggcuggcuaguggcagggacuucauauaaag

SEQ ID NO: 504502 - RNA, 64 nt, hsa
cacgcccccacugcccccgcacgaaucaccuccugcuggcuaccggggcaggcaugcacccggu

SEQ ID NO: 504503 - RNA, 64 nt, hsa
ugguuuuguuucucgaucuuuuguuuggagaacagcuggcuaaggaugacucuaaguguacugu

SEQ ID NO: 504504 - RNA, 64 nt, hsa
uggccugucucccuagggaauuccugcuaugacagcuggcuagcauuccucaggaaggacaugg

SEQ ID NO: 504505 - RNA, 64 nt, hsa
gauaaagaaaaagguuuguuuggcucacaauuuugcuggcuagaagguugggcauccggugaaa

SEQ ID NO: 504506 - RNA, 64 nt, hsa
acaaacagcaggauaccucacaggaccuggaguugcuggcuaccuuaccgcagguacaucuaca

SEQ ID NO: 504507 - RNA, 64 nt, hsa
uugagaauaguauauguaacauuaaaaaaaaguugcuggcuauaggaaauguuauuuuguuuuc

SEQ ID NO: 504508 - RNA, 64 nt, hsa
gcauuccacccaaggugggauuggccuuccuuaggcuggcuacuugucaccaucaccgacauca

SEQ ID NO: 504509 - RNA, 64 nt, hsa
cccacacucccaagguuggagcccagggcaucuugcuggcuacgccucuucugucccuguuaga

SEQ ID NO: 504510 - RNA, 64 nt, hsa
cauuuguucccgccuucagauggauggacaguuugcuggcuauugauaggaguggggacugggu

SEQ ID NO: 504511 - RNA, 64 nt, hsa
uuuaugauguacggaaaaaaaccaugcugauacagcuggcuauucagggucacccagcaguccu

SEQ ID NO: 504512 - RNA, 64 nt, hsa
aguugccuaccagcacccauucucuuuuaguucagcuggcuaauaguauuggaauacauuggga

SEQ ID NO: 504513 - RNA, 64 nt, hsa
guuuauuuguuuugcaauaaaggauaugaagguggcuggcuaggaagggaagggccacagccuu

SEQ ID NO: 504514 - RNA, 64 nt, hsa
agggucccugccuggugauucaccccagaagcuagcuggcuagaggguuagccuggcuggggcc

SEQ ID NO: 504515 - RNA, 64 nt, hsa
gucccgucgcuucgggcaccuccgggccccggcggcuggcuaauguuuuguuugaaagaucggu

SEQ ID NO: 504516 - RNA, 64 nt, hsa
aaugcauuuuaaacaguguuucugaaauuggauggcuggcuaauagacacugaaucacccggag

SEQ ID NO: 504517 - RNA, 64 nt, hsa
cauagucuauacauagaugcauauuuuacccccagcuggcuagagauuuauuuguuguaaaugc

SEQ ID NO: 504518 - RNA, 64 nt, hsa
uuuggagucagguuuguguucagaauccagcccugcuggcuacuaacuaacugggagaccuuag

SEQ ID NO: 504519 - RNA, 64 nt, hsa
uaucguugcugcugaaaccaccuauaaaagacuugcuggcuaaugugcauugucauauaaugua

SEQ ID NO: 504520 - RNA, 64 nt, hsa
ucuuagagcaucuuccacaucaacuccccuggcugcuggcuaccgauuaaauucauuaguguga

SEQ ID NO: 504521 - RNA, 64 nt, hsa
uucuuacuuuuuucccuuuuccuuuuuuggggaggcuggcuaguagugugugagaaaagaauag

SEQ ID NO: 504522 - RNA, 64 nt, hsa
uugccuacuuuagucacccagcagagccacuggagcuggcuaguccagcccagccauggugcau

SEQ ID NO: 504523 - RNA, 64 nt, hsa
uaggcauuugauuuccuguuuuagcuuuaguaaggcuggcuaacuucccccucuucaagcuagg

SEQ ID NO: 504524 - RNA, 64 nt, hsa
ucaucaaccacauuucaagugcucaaagccacgugcuggcuaggggccacagcguuagacagug

SEQ ID NO: 504525 - RNA, 64 nt, hsa
uaauguaaauaaguguguggccuucuuuaaaauagcuggcuaacauaggaggcacuucuuuuca

SEQ ID NO: 504526 - RNA, 64 nt, hsa
cgagagaauuuugagcacuagccgucucucggucgcuggcuaauaaaggacuccucaauucguc

SEQ ID NO: 504527 - RNA, 64 nt, hsa
ugcucugaauaaguucuagugagugaguuauggugcuggcuauauuuugcuaaacugcccucuc

SEQ ID NO: 504528 - RNA, 64 nt, hsa
uggacaaggaagaauaguggcagaugcagccagcgcuggcuagggcugggaggguuuugcucuc

SEQ ID NO: 504529 - RNA, 64 nt, hsa
ugcugucccugaguccuccauucuguacuggggggcuggcuaggaccuggggcuguggccucuc

SEQ ID NO: 504530 - RNA, 64 nt, hsa
ugaucucagcaguugauauggugguugugccucugcuggcuacugggugugcuguccccauguu

SEQ ID NO: 504531 - RNA, 64 nt, hsa
gucuuuugggugaguagcuauagguuugagagaggcuggcuacuccuaguuccugugcuucuuc

SEQ ID NO: 504532 - RNA, 64 nt, hsa
cauccuacccggccugggcugacccauggggaaggcuggcuaauuucagugcuucugcuugguu

SEQ ID NO: 504533 - RNA, 64 nt, hsa
aggguuggauggugaccuugggcaagucccuggggcuggcuaggccuccacuuguccaucugug

SEQ ID NO: 504534 - RNA, 64 nt, hsa
uuccaaaauguaaauccagucgcggugugaccgagcuggcuaacaggcuugucugccugguuuu

SEQ ID NO: 504535 - RNA, 64 nt, hsa
agaugccugcauggguccuggcgauuauuuuaaugcuggcuacacccccacaggugacuuggau

SEQ ID NO: 504536 - RNA, 64 nt, hsa
ggggagacagagagagugaauggaggaguaccgagcuggcuauggacuugggugucuggcaaac

SEQ ID NO: 504537 - RNA, 64 nt, hsa
uuccaguuacaagauauuuguuuuauuaauauuugcuggcuaaaaacaaaugugguuuuuauau

SEQ ID NO: 504538 - RNA, 64 nt, hsa
uaccugcaacuuggacguuguuuccacgugcucugcuggcuacgauucuugcauucuggguuug

SEQ ID NO: 504539 - RNA, 64 nt, hsa
uuugcacaaaagacugccaaggacaugaccagcagcuggcuacagccucgauuuauauuucugu

SEQ ID NO: 504540 - RNA, 64 nt, hsa
auucuguuggcuaaaauaaugcucuuuacaauaugcuggcuacaaaauggucuuacucuugaau

SEQ ID NO: 504541 - RNA, 64 nt, hsa
cuaugacuggagucaggagaaguuaguguaauaagcuggcuacacagaaccccacuacuuacca

SEQ ID NO: 504542 - RNA, 64 nt, hsa
uuaaacaaaauuuuuaucuuuuuucaagaauauagcuggcuaucuuuaagaaagaugauauauc

SEQ ID NO: 504543 - RNA, 64 nt, hsa
gaagcuccugaaugcuggacuagacaaacuacaugcuggcuaaacauucuccacugaagauaca

SEQ ID NO: 504544 - RNA, 64 nt, hsa
ugaaagccccuccucuuaugacagccagguuccugcuggcuagaccagccuauucagcgcuuug

SEQ ID NO: 504545 - RNA, 64 nt, hsa
acauugguugaucuaagucaagagaagaagaggagcuggcuagucaggaacuuauucauuaacc

SEQ ID NO: 504546 - RNA, 64 nt, hsa
auccagcuguuagauaugcaggaaaagauaguuugcuggcuagcucuauucauuuauguuagca

SEQ ID NO: 504547 - RNA, 64 nt, hsa
aucuuuuguuuucuuaaugcguuuggaccauuuugcuggcuauaaaauaacugauuaauauaau

SEQ ID NO: 504548 - RNA, 64 nt, hsa
uuccuguuguccuaccaccccuugcucuuugagggcuggcuauugagaacuggaaagaguaaaa

SEQ ID NO: 504549 - RNA, 64 nt, hsa
ccuggugccaaagggggccagccagaacugaggugcuggcuagcucaugugugaauucacauaa

SEQ ID NO: 504550 - RNA, 64 nt, hsa
caccucaccuccagcucaggggccgcaccccgccgcuggcuaagccuugugacccaucaggcca

SEQ ID NO: 504551 - RNA, 64 nt, hsa
cugggagaccccuucugugugggagggagcgggggcuggcuagcgggccccccagccagggauc

SEQ ID NO: 504552 - RNA, 64 nt, hsa
gugagacagagagaaugugauauagagaaaucuggcuggcuacaguguagaucaguauuaggaa

SEQ ID NO: 504553 - RNA, 64 nt, hsa
gggggacugucaccuggcaccacuggggcacucugcuggcuacaacucauacguccuguggugg

SEQ ID NO: 504554 - RNA, 64 nt, hsa
cuuagaacauugaagaaaauauuccuaagcugaugcuggcuaaaccgcuuuaaaguuuuauuug

SEQ ID NO: 504555 - RNA, 64 nt, hsa
guacaaggaauccuuuauugguaacaucuugguggcuggcuagcuaguuucuacagaacauaau

SEQ ID NO: 504556 - RNA, 64 nt, hsa
guauuuuguaucaaggacacggaggggguguggugcuggcuagaggucccugccccugucugga

SEQ ID NO: 504557 - RNA, 64 nt, hsa
caaauuaugcauggguccuaaucacacauauaaggcuggcuaccagcuuugacacagcacuguu

SEQ ID NO: 504558 - RNA, 64 nt, hsa
ccauggguccugggcacccaggccugcccugccugcuggcuacuuccuggcuuaccuucuaccc

SEQ ID NO: 504559 - RNA, 64 nt, hsa
gauaaccccuagaaagaagaggacaugaaaggaugcuggcuauauauguuaaugagcaaaagga

SEQ ID NO: 504560 - RNA, 64 nt, hsa
ugggccccccauggcagugcugccucuuguaggugcuggcuaagggccaggccaggaugaguuu

SEQ ID NO: 504561 - RNA, 64 nt, hsa
acaaaugaucaccauguuagccuuagacgaagaagcuggcuaguccuuucugugaagcuaauac

SEQ ID NO: 504562 - RNA, 64 nt, hsa
cuagcucuuaccaaaacagaugguagagagaguugcuggcuauuuaaaaagcucuuucaucuuu

SEQ ID NO: 504563 - RNA, 64 nt, hsa
gugauagcccaagcuggucaggagagacagaagugcuggcuaggaggucucagccucgggcacu

SEQ ID NO: 504564 - RNA, 64 nt, hsa
ccuccuaauuaagggccacugcaaagagagacgggcuggcuaacccaugggauuuagcuuauaa

SEQ ID NO: 504565 - RNA, 64 nt, hsa
aggggagggcagaggccugcaguuuggcuucacggcuggcuauguggacagcaagagucguuuu

SEQ ID NO: 504566 - RNA, 64 nt, hsa
aaggaaucuucuugaccguucuugggcacuggaggcuggcuaggaguucaguaauaaacguggc

SEQ ID NO: 504567 - RNA, 64 nt, hsa
uaaaccagggccugcggcacuugcgggccucccugcuggcuacugaugccaguaccagaggagc

SEQ ID NO: 504568 - RNA, 64 nt, hsa
aaugaucauccugcgcaaauucagauuacuguuugcuggcuaauugacaguauuucucagcauc

SEQ ID NO: 504569 - RNA, 64 nt, hsa
uccuguuccccgacaccaagacccuggcgcagcggcuggcuauccucacaggcaccguagaggu

SEQ ID NO: 504570 - RNA, 64 nt, hsa
cucagcucccagacacaggguaggaggggggacugcuggcuacugcagagacccuuggcuauuu

SEQ ID NO: 504571 - RNA, 64 nt, hsa
uccuuuaauagcccacaaucaguguucuguucuagcuggcuacugcuucacuggauugagaauc

SEQ ID NO: 504572 - RNA, 64 nt, hsa
uuugagaagcagugguuggggcauuuuuaagauggcuggcuacucuuguuuucccucaugauaa

SEQ ID NO: 504573 - RNA, 64 nt, hsa
uccacaagauucccagagacaggaaaauccucuggcuggcuaacuggaagcauguaggagaauc

SEQ ID NO: 504574 - RNA, 64 nt, hsa
gagaagcuccuggaaccauaacuguaaguuccuagcuggcuagggauugaaguccuggacagug

SEQ ID NO: 504575 - RNA, 64 nt, hsa
cucuuuuugggcuuucauaguguucauugaugcugcuggcuaagcauuuaucaaagcauaagcu

SEQ ID NO: 504576 - RNA, 64 nt, hsa
auuaaguacuguauaucgcccuguacuuggauaggcuggcuaacucguaggaagagagcacugu

SEQ ID NO: 504577 - RNA, 64 nt, hsa
agaagcaauggagugaaccucugcuccccacacagcuggcuacacugcucaggcuucaggccca

SEQ ID NO: 504578 - RNA, 64 nt, hsa
aaaaagaauaaugccuacagauuauccuucagaugcuggcuagaauccccuuugacuucuagcc

SEQ ID NO: 504579 - RNA, 64 nt, hsa
uguugacauuagucucagugaagacuaugaaaaugcuggcuauagaugucuuuucccauuuauc

SEQ ID NO: 504580 - RNA, 64 nt, hsa
acacccgcagcagaauguuggaguggaaaugauggcuggcuaugaagaggaggucaacgugugu

SEQ ID NO: 504581 - RNA, 64 nt, hsa
gcucagggacgaagcuuguggcaaggaaacuccagcuggcuaugccggccugugccagugagug

SEQ ID NO: 504582 - RNA, 64 nt, hsa
ccaggauucaguauuccuggcccagagggcccuugcuggcuacuggguguuaguuugcaguccu

SEQ ID NO: 504583 - RNA, 64 nt, hsa
augcagucuuaaauucaauggacaaaaauaaaaugcuggcuaccucuggaucaucuggcugagc

SEQ ID NO: 504584 - RNA, 64 nt, hsa
cuuaaggauauacagccgaagauugucugagguugcuggcuaacuuuauuuuucacugaguuac

SEQ ID NO: 504585 - RNA, 64 nt, hsa
agcaccgugaacgacugcaaugcaagcgggucuugcuggcuaaaaugccagguaaaggguuggu

SEQ ID NO: 504586 - RNA, 64 nt, hsa
aucucuuaugggcaaagcauuguggguaauuggugcuggcuaacauugcauggucggauagaga

SEQ ID NO: 504587 - RNA, 64 nt, hsa
ugaucaaggugugaauaacugaagaaaauaacuugcuggcuauauaggaaaaugcuguggaaau

SEQ ID NO: 504588 - RNA, 64 nt, hsa
cucauucuggccaguucuuuccaguagccauggggcuggcuacaagaagcaaaacugcccaugc

SEQ ID NO: 504589 - RNA, 64 nt, hsa
cgaguagcugggauuacaggugcaugccaucacagcuggcuaauuuuuguauuuuuaguagaga

SEQ ID NO: 504590 - RNA, 64 nt, hsa
cugacagcucccacacagaacagucugaggugaugcuggcuacagcccuggcagcccauggcaa

SEQ ID NO: 504591 - RNA, 64 nt, hsa
acugggaaaagugcuucggaaggcugggcuguccgcuggcuauguggacgcuggggcagagcca

SEQ ID NO: 504592 - RNA, 64 nt, hsa
uguaguaugaucauuuacugaaguaguuugauuggcuggcuaacuuagaauuauuguuucuugu

SEQ ID NO: 504593 - RNA, 64 nt, hsa
caaguagcugggacuacaggugugcaccaccacagcuggcuaauucuauuuuuuuauagaggcg

SEQ ID NO: 504594 - RNA, 64 nt, hsa
caaguagcugggauuacaggugugugccacuacggcuggcuaauuuuuguauuuuuaguagaga

SEQ ID NO: 504595 - RNA, 64 nt, hsa
cugccaggcugagucuccacccaugcugguuggugcuggcuaggcugagggggccaccacuuuu

SEQ ID NO: 504596 - RNA, 64 nt, hsa
agcucgauggugggcccagccucugcuguccaaggcuggcuagcugcggugcuccuugcugguu

SEQ ID NO: 504597 - RNA, 64 nt, hsa
agcagcagaggugagaacucagaagagaaauacagcuggcuaucuacuaccagaagggcuucaa

SEQ ID NO: 504598 - RNA, 64 nt, hsa
guccuauuugcuaguaacaugagcacugugauuggcuggcuauaaccaccccaguuaaaccauu

SEQ ID NO: 504599 - RNA, 64 nt, hsa
guggaggaggcccagguaaaggcugggggcuguugcuggcuauccucuuugcuucuggaaguuu

SEQ ID NO: 504600 - RNA, 64 nt, hsa
gagggggaggacaaggggcagagaguagggucuagcuggcuaucucuggccuuacuaacacccc

SEQ ID NO: 504601 - RNA, 64 nt, hsa
cccuccugggcugccaggauuuagcagggagguggcuggcuacagcaacagcagcugggcaagc

SEQ ID NO: 504602 - RNA, 64 nt, hsa
ucuccuccugcuccugcguggagggggaaugugugcuggcuaggguggaggacugagcaccuga

SEQ ID NO: 504603 - RNA, 64 nt, hsa
gaagccgauucugaauuccuguggacccacaggggcuggcuaaggcgagggauacccaaagaga

SEQ ID NO: 504604 - RNA, 64 nt, hsa
aacagcuagagggccuccccgccugcccgccuuggcuggcuagcucgccucuccugugcguaug

SEQ ID NO: 504605 - RNA, 64 nt, hsa
acagcuacuuacgcgaacacagcagguugguguggcuggcuaacuaggaccucucgaaagucuc

SEQ ID NO: 504606 - RNA, 64 nt, hsa
ugguucucaguccccagacaugugccccuuugcugcuggcuaccacucuuccccagagcagcag

SEQ ID NO: 504607 - RNA, 64 nt, hsa
gcagccuccccaggaccuagggcgccugcccucugcuggcuaggaccgggcccagcccagcccu

SEQ ID NO: 504608 - RNA, 64 nt, hsa
ccggcugacauuuggaccccaucccagaggagaugcuggcuaccagcuggggcgaccccaaggg

SEQ ID NO: 504609 - RNA, 64 nt, hsa
gggccagcucaguugccgaaacucuggaguggcggcuggcuagaaauuggucuguagaaaugac

SEQ ID NO: 504610 - RNA, 64 nt, hsa
cccugcagggcccuggcuggggggauggagaggggcuggcuauccccccagagccccucuucag

SEQ ID NO: 504611 - RNA, 50 nt, hsa
auuucuccaaacacaauuaggcuggcuaacggauagugagcuugugcccc

SEQ ID NO: 504612 - RNA, 64 nt, hsa
uauuugagauugguugaaucugcacauauggagggcuggcuauaaagggcaccacaaggaagaa

SEQ ID NO: 504613 - RNA, 64 nt, hsa
guggguuggcuugcugauggcugcuggaggggacgcuggcuaaaguggguaggccuuggcccac

SEQ ID NO: 504614 - RNA, 64 nt, hsa
ucacagaugauuuuggacaagauuuuccaaccuugcuggcuacuuuaguuugggaccuguuuuu

SEQ ID NO: 504615 - RNA, 64 nt, hsa
aauauacucguauuuuuuauauuucuuccauguggcuggcuauauuccaagaaaagcauuuuaa

SEQ ID NO: 504616 - RNA, 64 nt, hsa
acuugucucugcagggcgcuuuggugguuguucagcuggcuaaagguucaccggugaaggcagg

SEQ ID NO: 504617 - RNA, 64 nt, hsa
gaugacgucuguguuccuguccaucacugaugcugcuggcuacugcaugugccacaccugucug

SEQ ID NO: 504618 - RNA, 64 nt, hsa
cuucauagcugacccuucuugugaccgccugacugcuggcuacuauccaugcacacgcugucuu

SEQ ID NO: 504619 - RNA, 64 nt, hsa
uuuaacacuuguccagcuacagugggguacaguagcuggcuauucacaggcaucaucauagccc

SEQ ID NO: 504620 - RNA, 64 nt, hsa
gugagggcagagggacagaugaggggaggagggugcuggcuaaacaggaacugaaugaauggcc

SEQ ID NO: 504621 - RNA, 64 nt, hsa
aaagaaccagaggggcaggggaggacuggggagggcuggcuagccagaggaguuggcuguauca

SEQ ID NO: 504622 - RNA, 64 nt, hsa
acaacaacuccccagugcugucugagcgcucccugcuggcuaugcaagaggacgcggccccggg

SEQ ID NO: 504623 - RNA, 64 nt, hsa
gagcuaccacuggcuacucagaggaggcucauuagcuggcuacaugcuucgcaggaagugggaa

SEQ ID NO: 504624 - RNA, 64 nt, hsa
acuccagaucagaugugaacuuaaccuguuucuggcuggcuagccaaccagcauggaaaacaga

SEQ ID NO: 504625 - RNA, 64 nt, hsa
cgguuuuguagccuguuggaggaagcuacuuuuagcuggcuacacaugaggccacuuguuuuag

SEQ ID NO: 504626 - RNA, 64 nt, hsa
uguacaaacauguauuuucugcaaaucucauuaugcuggcuagagugaugcagacuuguucuuc

SEQ ID NO: 504627 - RNA, 64 nt, hsa
aguacagcaagacacucuggccaccauaaaaaacgcagaaaagaaaaaaagguuaagcauaaaa

SEQ ID NO: 504628 - RNA, 64 nt, hsa
acaaaaugaaaauguaguaguacaaccaguuguagcagaaaauauuccuguaauaccacugagu

SEQ ID NO: 504629 - RNA, 64 nt, hsa
auccucaacagggucaccaaccagcccgcucaaugcagaaaaacuagaaucugaagguaaggag

SEQ ID NO: 504630 - RNA, 64 nt, hsa
accggaugaagaaguacauggcaagaaggaaauggcagaaaacgggcaaugcugugagagccau

SEQ ID NO: 504631 - RNA, 64 nt, hsa
auauacaauaguggucccauaaaauuauaauggagcagaaaaucuauugccucaugauguuuua

SEQ ID NO: 504632 - RNA, 64 nt, hsa
aggcaguaauuuccuuuuggaaaggacucugaaggcagaaaagaagggagagaaccucaugggc

SEQ ID NO: 504633 - RNA, 64 nt, hsa
uuuaauacaggccaaaguaacguggaagcgcacagcagaaaaucuucagaaagacaucagguuu

SEQ ID NO: 504634 - RNA, 64 nt, hsa
aauaauaaagagaaaagguguuucguuggguauugcagaaaagaggaccaauuucauauaguac

SEQ ID NO: 504635 - RNA, 64 nt, hsa
uuaucuugaaaacgguacauauuuuaguauuugugcagaaaaacaaguccuaaaguauuuguuu

SEQ ID NO: 504636 - RNA, 64 nt, hsa
cugaugguaugugccauuuguaaaauaaaauagagcagaaaaacacaaaaagagaacacugguu

SEQ ID NO: 504637 - RNA, 64 nt, hsa
ugacuuccaaccgacaguugcuagaauucacagggcagaaaagggguugaccuucuccccuucu

SEQ ID NO: 504638 - RNA, 64 nt, hsa
ucguuuuuauuccuccucucccagauuggcuccagcagaaaagucccucgugcacaggcagcuc

SEQ ID NO: 504639 - RNA, 64 nt, hsa
caucauagaggucuguuuugugaggguuuggggugcagaaaacuuugauuaaaucuuaauggga

SEQ ID NO: 504640 - RNA, 64 nt, hsa
ccuuuguagggacagcaaaaggggaaaauuugcugcagaaaauuccaaaagauugcuguagcuc

SEQ ID NO: 504641 - RNA, 64 nt, hsa
uugcauggauggcagcauuguucugaagggguuugcagaaaaaaaagauuuucuuuacauaaag

SEQ ID NO: 504642 - RNA, 64 nt, hsa
gguggugauuucucuuugaccaaugcauaguuuggcagaaaaaucagccguucauuuagaagaa

SEQ ID NO: 504643 - RNA, 64 nt, hsa
uauugucucugcuaucugacugccaguaauuagugcagaaaacuaagacaggaugauacagguu

SEQ ID NO: 504644 - RNA, 64 nt, hsa
augcaugucaaauauuucucccaugcuucucuuagcagaaaaguuuuuaccuauaagacagggc

SEQ ID NO: 504645 - RNA, 64 nt, hsa
uuggcauaauggccagaaaauauuguauugcuuggcagaaaagaaaauaaggucuaaaggaaag

SEQ ID NO: 504646 - RNA, 64 nt, hsa
gggauaucuuuuuuauauuuuuuuccaugaaucugcagaaaauuacugagcuguuguuacccuc

SEQ ID NO: 504647 - RNA, 64 nt, hsa
cuuuguaacuacauauagaacuguuacaaugguagcagaaaauccuauugauuucaucucaccc

SEQ ID NO: 504648 - RNA, 64 nt, hsa
uuuuuuagcuugaauuuguuagcaaauauuaauggcagaaaaccaaaaacuaaauuuaugguau

SEQ ID NO: 504649 - RNA, 64 nt, hsa
agaauuagagacaucugauuuguuuaucaccuuagcagaaaaaccacaguccaaaagacaagca

SEQ ID NO: 504650 - RNA, 64 nt, hsa
auacuacaaauaauuuucuuaaaagucuaagauagcagaaaauacaguaaaaacacaggagaag

SEQ ID NO: 504651 - RNA, 64 nt, hsa
auuuaaauuauuacuacacuuuauuacuacacuugcagaaaagaaacauguuaaaaucauggca

SEQ ID NO: 504652 - RNA, 64 nt, hsa
uagaugcagacuggcagcauccuccuugauaaaagcagaaaagcaaagagguaauuggaguuga

SEQ ID NO: 504653 - RNA, 64 nt, hsa
uauuuaccugaugagcagaggggaccacugauuggcagaaaacuucccuacguucaguuguuag

SEQ ID NO: 504654 - RNA, 64 nt, hsa
acugaacacuuggaagucaccuuuacuugccuuugcagaaaacagaacuuagccaaaccuaagu

SEQ ID NO: 504655 - RNA, 64 nt, hsa
uauauguuuuaaucucccuugucccucagaauaagcagaaaauauaacugcagcuguaugucgu

SEQ ID NO: 504656 - RNA, 64 nt, hsa
augacuuaccauuccagcugcaugggaaagcaaagcagaaaacagugccccaaauggaaaaaag

SEQ ID NO: 504657 - RNA, 64 nt, hsa
gcccccagaauugucuggcccaaauugaauagaagcagaaaaacauuuagggauaacaucaggc

SEQ ID NO: 504658 - RNA, 64 nt, hsa
guugggagcuauccuuguuuaugccucacuauuggcagaaaagaccccauuuaaaacccagaga

SEQ ID NO: 504659 - RNA, 64 nt, hsa
cagaaaauucacacaagagaaaggccuuaugaaugcagaaaauaugucaucuuguucauccuca

SEQ ID NO: 504660 - RNA, 64 nt, hsa
caccuuuaugugccucagaggggaccaaaggauggcagaaaacuguucucagucuaguuugacc

SEQ ID NO: 504661 - RNA, 64 nt, hsa
gagagcacaaaaaugggagaaaaugcaaacaugagcagaaaauauuuucccacugguguguagc

SEQ ID NO: 504662 - RNA, 64 nt, hsa
cuccguuugaaguaucaccuucucauaacuaaaagcagaaaagcuaacaaaagcuucucagcug

SEQ ID NO: 504663 - RNA, 64 nt, hsa
gaggaaaggacucauucaugucacgcuuccuugagcagaaaagagcacugagagcacuugggac

SEQ ID NO: 504664 - RNA, 64 nt, hsa
caaccgacagcaaacagcuuucuccggccucagggcagaaaaagggaauggcagggaguaagag

SEQ ID NO: 504665 - RNA, 64 nt, hsa
ggaccuguuuuuuuucucauuugauuuugcuugugcagaaaauaguuuccagcacauggauuga

SEQ ID NO: 504666 - RNA, 64 nt, hsa
ccaacuuccuuagauuuuuuuuuuuaagcuguuugcagaaaacugggugguagcgugucugaac

SEQ ID NO: 504667 - RNA, 64 nt, hsa
uaaaauucuuuuuaauuaaaaauauuucaaauaugcagaaaaauaauaauauaaaugcccuugu

SEQ ID NO: 504668 - RNA, 64 nt, hsa
auugguacaucuuggcuucuggcccaaaccccaagcagaaaagaaaauggaauaauggagcauu

SEQ ID NO: 504669 - RNA, 64 nt, hsa
gccccaacgcgugcuagagaggcccaauccaggggcagaaaacagggggccuaaagaauguccc

SEQ ID NO: 504670 - RNA, 64 nt, hsa
uuuuuuuuuuuuuggccaaaucucgugguguuucgcagaaaaaaauccagaaaauuucaaaugc

SEQ ID NO: 504671 - RNA, 64 nt, hsa
aaagggacucagguaagcccagccugggaugagagcagaaaagcauucaagauuugcaggccuu

SEQ ID NO: 504672 - RNA, 64 nt, hsa
agcaaaggcuucaagagagggcagaauguauucggcagaaaagggacucagguaagcccagccu

SEQ ID NO: 504673 - RNA, 64 nt, hsa
acaaguguucuauuuauuucuuguauuguuuggaagaaaaaaugaugauagagucccaaaaaga

SEQ ID NO: 504674 - RNA, 64 nt, hsa
gaagaaaaaaugaugauagagucccaaaaagaagagaaaaaaaaugcccaaguugcccuuuaaa

SEQ ID NO: 504675 - RNA, 64 nt, hsa
cagccugggcgacagagcgagagucugucucaaaagaaaaaaaaaagcaccgccuccaaaugcc

SEQ ID NO: 504676 - RNA, 64 nt, hsa
agccugagcaacagagugagacccugucucuuaaagaaaaaaaaagucagacugcugggacugg

SEQ ID NO: 504677 - RNA, 64 nt, hsa
caucugucacggacccacgcccagaggaacgugcagaaaaaagcagagcuacauggcugugggc

SEQ ID NO: 504678 - RNA, 64 nt, hsa
augggacaaaaaagaacgauccuccacuugaccaagaaaaaagugauucucccagaagcacaaa

SEQ ID NO: 504679 - RNA, 64 nt, hsa
uguuagcauaguagauaaauuguuaugaaauaccagaaaaaaaaaucuguaucuuuuacugaga

SEQ ID NO: 504680 - RNA, 64 nt, hsa
aaaauuguguaaaauuacauuuuuuuuccaggggagaaaaaaacaucaaacaaaaacaucuaaa

SEQ ID NO: 504681 - RNA, 64 nt, hsa
uaagcugccucaaggaauuuuuuuaacuuaagggagaaaaaaagggaucuggggaugggguggg

SEQ ID NO: 504682 - RNA, 64 nt, hsa
cuguucagcuacucccacucccggccugucauucagaaaaaaauaaauguucuaauaagcucca

SEQ ID NO: 504683 - RNA, 64 nt, hsa
aagacaguucagugcauauauaguagaagccuuaagaaaaaagaaaaugagcaagcaaauauuu

SEQ ID NO: 504684 - RNA, 64 nt, hsa
uuugaagaaauguauaaaaccauagauuucuuucagaaaaaaaaaacaggcauaggaacaguuu

SEQ ID NO: 504685 - RNA, 64 nt, hsa
uacaaaagccagcaauaauucuucaagauccaaaagaaaaaaauauacuaccucagauuuucaa

SEQ ID NO: 504686 - RNA, 64 nt, hsa
ugguagauacaguuuaaaagugcuuacccaggcaagaaaaaacacagcuaggcuaagucaacaa

SEQ ID NO: 504687 - RNA, 64 nt, hsa
uguuuuuguccuaauguugcuacucccauggcaaagaaaaaaaaaagaaugaaaaaaagaaaaa

SEQ ID NO: 504688 - RNA, 64 nt, hsa
ucccauggcaaagaaaaaaaaaagaaugaaaaaaagaaaaaaauuuggaaaaaaaaaucaggcu

SEQ ID NO: 504689 - RNA, 64 nt, hsa
agaaaauucccccuacuucuaauuugcugaaugaagaaaaaaaaaaaucuuuuauuugugauau

SEQ ID NO: 504690 - RNA, 63 nt, hsa
cuaguaugguguauuuaaauaauaaaaacuuaaaagaaaaaauauuuaaugguguuuggguuu

SEQ ID NO: 504691 - RNA, 64 nt, hsa
agcccaaaaccaagucaagugaaaaaggaggaagagaaaaaauauuuuccugccaggcauggug

SEQ ID NO: 504692 - RNA, 64 nt, hsa
agugagacccugucucaaaaaaagaaaaagaaaaagaaaaaauauuuucccuauuagagaagag

SEQ ID NO: 504693 - RNA, 64 nt, hsa
gggcuuuauuaucuugucagucacuaccuccuaaagaaaaaaaaaaaggcuagaagaaaaaaca

SEQ ID NO: 504694 - RNA, 64 nt, hsa
ucacuaccuccuaaagaaaaaaaaaaaggcuagaagaaaaaacauuacauucauguucuaauua

SEQ ID NO: 504695 - RNA, 64 nt, hsa
aaguugaaacaaacuaacaugacaagaaagcuauagaaaaaauaaacauugaacucaguucuuc

SEQ ID NO: 504696 - RNA, 64 nt, hsa
gagcuccuaaaaaugagaaauauuuauugaaauaagaaaaaagcccucagacauguugaauauu

SEQ ID NO: 504697 - RNA, 64 nt, hsa
uaaaauuguauguuacuuauuuccagaaucucgaagaaaaaagaaaaaagagugguauuauuau

SEQ ID NO: 504698 - RNA, 64 nt, hsa
guauguuacuuauuuccagaaucucgaagaaaaaagaaaaaagagugguauuauuaugggcaaa

SEQ ID NO: 504699 - RNA, 64 nt, hsa
gaguucuaauaauccauguucaguuuguagggaaagaaaaaauaauuuuuccuucuacccacuu

SEQ ID NO: 504700 - RNA, 64 nt, hsa
agaagcugcaaaagggaucuucgaaacugggcagagaaaaaauaaaguggaauauuaaguaaaa

SEQ ID NO: 504701 - RNA, 64 nt, hsa
aauguucuuuauacagccuaguuaauguuuaaaaagaaaaaaauagcuugguuuuauuugucau

SEQ ID NO: 504702 - RNA, 64 nt, hsa
aacauugaaagguaaaaucugauuauuuagcaugagaaaaaaaaauccaacucugcuuuugguc

SEQ ID NO: 504703 - RNA, 64 nt, hsa
ugguuuaacaaaaaaaaaaagcuuuaaaaaaaaaagaaaaaaaggaaaagguuuuuagcucauu

SEQ ID NO: 504704 - RNA, 64 nt, hsa
gacagacuugagaacuugacaaguugcgacggagagaaaaaagaaguguccgagaacuaaagcc

SEQ ID NO: 504705 - RNA, 64 nt, hsa
ugaagagagaccgucgggggcugaggggcaacgaagaaaaaaaauaacacagagagacagacuu

SEQ ID NO: 504706 - RNA, 64 nt, hsa
cuccagccuggguggcagagcaacacuuugucucagaaaaaaaaaaaaaaaccaaaaagccaag

SEQ ID NO: 504707 - RNA, 64 nt, hsa
gccaaaauuaguuguuuaagugaaguuuugugacagaaaaaagguuguuuuaauaucuacuugg

SEQ ID NO: 504708 - RNA, 64 nt, hsa
acgggguaggagaaguuucuuuaaagacguaaaaagaaaaaaaccauaggcugcucugccugug

SEQ ID NO: 504709 - RNA, 64 nt, hsa
guagguucaugcccaagcccugagaguggguacuagaaaaaacgagauugcacaguuggagaga

SEQ ID NO: 504710 - RNA, 64 nt, hsa
uuugaggguuugccuucuaaagucugcaacuucaagaaaaaaaaucgacacuguggauugacuu

SEQ ID NO: 504711 - RNA, 64 nt, hsa
uuaaacuagcucuuuuacuacugaccuuucacagagaaaaaauauuucccuugaaaaaaacugg

SEQ ID NO: 504712 - RNA, 64 nt, hsa
caaaggaacauuuuaacuguaaaggcuggagacaagaaaaaauaaguagaucguuuuaauaaca

SEQ ID NO: 504713 - RNA, 64 nt, hsa
augccgaagaguugaugucaaucuuuuuuuccuaagaaaaaaaguccgcgaguauuaaauauuu

SEQ ID NO: 504714 - RNA, 64 nt, hsa
caucugaacagaagugcacaggcuacuuguacagagaaaaaauuaauacucaaaggaaaucuuc

SEQ ID NO: 504715 - RNA, 64 nt, hsa
aguuuccugacucagugcuuuugcauaaggaacuagaaaaaaaaaguaaggaaaauuggagaug

SEQ ID NO: 504716 - RNA, 64 nt, hsa
gugaagcaacuucaguucuuuuacugcaaagaacagaaaaaagaaagaaagcaaacaagaagac

SEQ ID NO: 504717 - RNA, 64 nt, hsa
ccccacccccuuucucuuucucucucucucucaaagaaaaaaaaaaugggagugcaaaaaaaac

SEQ ID NO: 504718 - RNA, 64 nt, hsa
guguugcuagagaaaauuagggaaaaggugaaaaagaaaaaaugguaguaauugagcagaaaaa

SEQ ID NO: 504719 - RNA, 64 nt, hsa
aaaggugaaaaagaaaaaaugguaguaauugagcagaaaaaaauuaauuuauauauguauugau

SEQ ID NO: 504720 - RNA, 64 nt, hsa
ccugcaccguuacgcugugauggcaacuggggauagaaaaaaaauggggaaagacaggaauccu

SEQ ID NO: 504721 - RNA, 64 nt, hsa
gcccaggcaacaagagugaaacccugucucaaaaagaaaaaaaaaguugaccuugagaauuuau

SEQ ID NO: 504722 - RNA, 64 nt, hsa
gccugggcaacauggcuaaacucugucucuauuaagaaaaaaaauguuaacauuaugauuuaaa

SEQ ID NO: 504723 - RNA, 64 nt, hsa
ccagaacugugaaaaauaaauuuguuauuuaaaaagaaaaaaaaaaaaacaaaaaccugaguuu

SEQ ID NO: 504724 - RNA, 64 nt, hsa
gugcccagcacacauuaauguuagcuucuuucugagaaaaaaauaccucuuccaggcccugaaa

SEQ ID NO: 504725 - RNA, 64 nt, hsa
acauuugcugugaagauugaaaaugaacaaaguuagaaaaaaaaacagcaaaaucagugauuua

SEQ ID NO: 504726 - RNA, 64 nt, hsa
agccuauuccaucaacugugaaagcuggggaauuagaaaaaauaauaagucgcugucaggugug

SEQ ID NO: 504727 - RNA, 64 nt, hsa
cccaggcacuguacuaaccuacagagaugcuaagagaaaaaaaagacuuguuucugaucuaaua

SEQ ID NO: 504728 - RNA, 64 nt, hsa
ugcccaacuuuucuaagugagcuuagcaaugagaagaaaaaaaaacaugaauucuuuuucugga

SEQ ID NO: 504729 - RNA, 64 nt, hsa
ucagaaguauuuuaaagggcuuaaugugccaaaaagaaaaaaagcuagagacccuuuuugcaaa

SEQ ID NO: 504730 - RNA, 64 nt, hsa
ccacugcaagcucugaaucaguuuuuuaaaaaaaagaaaaaaaaaaaaaaggagcugugcccca

SEQ ID NO: 504731 - RNA, 64 nt, hsa
caccugggcaacauaguaagaucuugucucuuaaagaaaaaaaaaaaagguacuuagaggucgc

SEQ ID NO: 504732 - RNA, 57 nt, hsa
uccugaaaaacaucaaguagaaaguacagaaaaaagccacaugugggacucaaaugc

SEQ ID NO: 504733 - RNA, 64 nt, hsa
agcaucuuaccuucauaugcaguaaaagaaagaaagaaaaaaaaaggaaaaaaaaaaaaaaacc

SEQ ID NO: 504734 - RNA, 64 nt, hsa
ucucuaaaggguuaaauguaucaauuggaaaggaagaaaaaaggccuugaauugacaaauuaac

SEQ ID NO: 504735 - RNA, 64 nt, hsa
gcagguuaaaugagaccuguccucugcugcacucagaaaaaauaggcagucccugaugcucaga

SEQ ID NO: 504736 - RNA, 64 nt, hsa
agcagugguauugagguuuuucgaauauuuauauagaaaaaaagucuuuucacaugacaaauga

SEQ ID NO: 504737 - RNA, 64 nt, hsa
acagcagaagccauggcacagacuuguauagaggagaaaaaauguacagagagcacccaggagg

SEQ ID NO: 504738 - RNA, 64 nt, hsa
cagaaagcaguagugagagugagaguaacaauaaagaaaaaaaaauacaaaggaagaaaagaaa

SEQ ID NO: 504739 - RNA, 64 nt, hsa
agaucgacuggagaagaaaaaaaagaaaaaagauagaaaaaagaaaaaguuucagaagagcaga

SEQ ID NO: 504740 - RNA, 64 nt, hsa
uacaggaaauuagaucgacuggagaagaaaaaaaagaaaaaagauagaaaaaagaaaaaguuuc

SEQ ID NO: 504741 - RNA, 64 nt, hsa
uuucccaauuacaggaaauuagaucgacuggagaagaaaaaaaagaaaaaagauagaaaaaaga

SEQ ID NO: 504742 - RNA, 64 nt, hsa
auugauaaaaagugacucucagauugguaaugccagaaaaaauuuuaagaggacucaccaaaag

SEQ ID NO: 504743 - RNA, 64 nt, hsa
uuagcuguaacauccgauucuguauaagccacauagaaaaaaguugccuuucuuuuuuuaugac

SEQ ID NO: 504744 - RNA, 64 nt, hsa
aggaaacaaagaaugccgaaaagaaugaaaacagagaaaaaauguaugugcuugaaaguaaaau

SEQ ID NO: 504745 - RNA, 64 nt, hsa
gcaguugaaaaaugcuaaucucuuugacuuagucagaaaaaaacagaggauaauuaagauacua

SEQ ID NO: 504746 - RNA, 64 nt, hsa
aauaaaaaggacuacuuaaacauuugucauauuaagaaaaaaaguuuaucuagcacuugugaca

SEQ ID NO: 504747 - RNA, 64 nt, hsa
cuggguuuucugaagucugaggaacaaugccuuaagaaaaaacaaacagcaggaaucgguggga

SEQ ID NO: 504748 - RNA, 64 nt, hsa
gacaauuuauuuuugccaucauuuuuuuaauuaaagaaaaaauuuccagaagaggaaaaaaaaa

SEQ ID NO: 504749 - RNA, 64 nt, hsa
cacagaaguuuaagacuaugaguuuuuagggugaagaaaaaacuguacaguuuaaaugaaaaug

SEQ ID NO: 504750 - RNA, 64 nt, hsa
uacuggguuugcuuuucuuaaaacauaccaaaaaagaaaaaaauagaaaaaaaaaaaaaaaaag

SEQ ID NO: 504751 - RNA, 64 nt, hsa
gcuuuucuuaaaacauaccaaaaaagaaaaaaauagaaaaaaaaaaaaaaaaagcuugaucucu

SEQ ID NO: 504752 - RNA, 64 nt, hsa
guacuugccacaaaaucaauaaaagauguuuuugagaaaaaaaggaagaaaccaacucauucag

SEQ ID NO: 504753 - RNA, 64 nt, hsa
caagacacucuggccaccauaaaaaacgcagaaaagaaaaaaagguuaagcauaaaaagaaagg

SEQ ID NO: 504754 - RNA, 64 nt, hsa
aagagacugguagcucaucauccuaccauaaaagagaaaaaaauucggaaagugaucagagcac

SEQ ID NO: 504755 - RNA, 64 nt, hsa
agcagggccaaauggaaagaacacauaauaaacaagaaaaaaacagaggugaagaaaaauccaa

SEQ ID NO: 504756 - RNA, 64 nt, hsa
auugaugacaagcaaguuacucaggaaucaaaagagaaaaaaguuucugaaaacaaugaaacca

SEQ ID NO: 504757 - RNA, 64 nt, hsa
gauuuaaauguguucuauuauuagaguagaucgaagaaaaaauuagucucagaaagagcuuuua

SEQ ID NO: 504758 - RNA, 64 nt, hsa
aucauucuuuacaguuuugcauugcugaggagagagaaaaaacaauuuuuuugcaagagauguu

SEQ ID NO: 504759 - RNA, 64 nt, hsa
aaaguuuaauugaaagaauguaaagcaaccaaaaagaaaaaaaaaaagaaagaaagaggaaaag

SEQ ID NO: 504760 - RNA, 64 nt, hsa
ugcaaacuauuuaaagaaauauguauucuguaaaagaaaaaaaaaaugcggccuuuucaugagg

SEQ ID NO: 504761 - RNA, 64 nt, hsa
acaauucaagaaacugaguauuuaugggcauugaagaaaaaauguugagauaaaauugcugugc

SEQ ID NO: 504762 - RNA, 64 nt, hsa
uugaagaaaaaauguugagauaaaauugcugugcagaaaaaaguguuaaugaagccgaccugac

SEQ ID NO: 504763 - RNA, 64 nt, hsa
cacacaauauaugaaauaguacccucuaaaaaagagaaaaaaaaaaucaggcggucaaacuuag

SEQ ID NO: 504764 - RNA, 64 nt, hsa
aacauugucuuauuaaagcauaguuuauuucacuagaaaaaauuuaauaucaaggacuauuaca

SEQ ID NO: 504765 - RNA, 64 nt, hsa
acauggagaagcccugucucuacaaaauacagagagaaaaaaucagccagucaugguggccuac

SEQ ID NO: 504766 - RNA, 64 nt, hsa
guuuggguaaaggaugagcagacaagucaacuaaagaaaaaagaaaagcaaggaggaggguuga

SEQ ID NO: 504767 - RNA, 64 nt, hsa
uucuuuuguauuuuguuauaaucuuaagcaacaaagaaaaaacccuaauauuugaaucuauuua

SEQ ID NO: 504768 - RNA, 64 nt, hsa
uucugagguacauuuugaaugacagcauauuguaagaaaaaaaaaggugaauaaaauuugacau

SEQ ID NO: 504769 - RNA, 64 nt, hsa
uuugauuuauauacucuguuuuacagauuuagcuagaaaaaaaaugucaguguuuuggugcacc

SEQ ID NO: 504770 - RNA, 64 nt, hsa
aaaagguuaaacuggauuuuuuuuuuuaaaaaaaagaaaaaaaaagaagaaaaguauaccagau

SEQ ID NO: 504771 - RNA, 64 nt, hsa
gguauaguggugaauacucgcugauaugaaucccagaaaaaaauuuccuguuuuuaauguucuu

SEQ ID NO: 504772 - RNA, 64 nt, hsa
uuauugcuguuuugucuuucuuuuuucuaaaaaaagaaaaaaaagaaaaaaaggaaaagaagaa

SEQ ID NO: 504773 - RNA, 64 nt, hsa
uuuugucuuucuuuuuucuaaaaaaagaaaaaaaagaaaaaaaggaaaagaagaacaaagaaac

SEQ ID NO: 504774 - RNA, 64 nt, hsa
uaauuuuagaucugaucagguaguagcuaaaauuagaaaaaaacaaaauagaugcuuaaagaau

SEQ ID NO: 504775 - RNA, 64 nt, hsa
gguaaaaucaguuuuuugauaguguguguauauaagaaaaaauagauacacacauucuuuuuuc

SEQ ID NO: 504776 - RNA, 64 nt, hsa
auaccauucucuguggccuguuuuuccuggaagaagaaaaaaaaagguuuggcaggccaucuuu

SEQ ID NO: 504777 - RNA, 64 nt, hsa
cauagugcuuuaaacgugaugcauguuuuaauggagaaaaaauagcugguuucuauuaauuaua

SEQ ID NO: 504778 - RNA, 64 nt, hsa
ucuuguuuguaaaaaaaaaaaaaaaaaaagaaaaagaaaaaaguguauuuuacuguuuucugua

SEQ ID NO: 504779 - RNA, 64 nt, hsa
uuaagggcucuguccuguuauacauauuuaaggcagaaaaaaaguuacaugucgauuagguacu

SEQ ID NO: 504780 - RNA, 64 nt, hsa
ccuggcuaucuuaaacaaguucauacauuugaaaagaaaaaaaaauguuguuuaaaaaauguuu

SEQ ID NO: 504781 - RNA, 64 nt, hsa
gacgugacguccugccagaaagagaaugaaugacagaaaaaaaaaagagagacaaacucuagga

SEQ ID NO: 504782 - RNA, 64 nt, hsa
gaauaucauugauuuuauaauuggugcuauuugaagaaaaaaauguacauuuauucauagauag

SEQ ID NO: 504783 - RNA, 64 nt, hsa
ugaaccaaaugguucuuacuuuuccuggacuuaaagaaaaaaagagguuuaaguuuguuguggc

SEQ ID NO: 504784 - RNA, 64 nt, hsa
caaaacacagcuuaucuaaucuaaugagaaacucagaaaaaaauguuuugaugaauacaaugua

SEQ ID NO: 504785 - RNA, 64 nt, hsa
uuuuuuuuuuuaaguaagaagggaacuguaaaagagaaaaaaagaaauucaugcauagcuucug

SEQ ID NO: 504786 - RNA, 64 nt, hsa
aaaaagaggaaaaaaaggcaaaaaauauugugaaagaaaaaaaacaacuuaauauauuuuggau

SEQ ID NO: 504787 - RNA, 64 nt, hsa
cauuugguucaugugcauuguuuacaaagcaaaaagaaaaaagaggaaaaaaaggcaaaaaaua

SEQ ID NO: 504788 - RNA, 64 nt, hsa
aagucuuaaacaucuaagacucaguuguaguugcagaaaaaaauuaaagucaccucuacugaac

SEQ ID NO: 504789 - RNA, 64 nt, hsa
cuggagagcagagcaagacucugucucaaaaaaaagaaaaaaguuuuauuauccuuacuuuuuu

SEQ ID NO: 504790 - RNA, 64 nt, hsa
uuucugaaaugauggauaagagucuacaucuucuagaaaaaauacauaaaggaguaguuaagcu

SEQ ID NO: 504791 - RNA, 64 nt, hsa
cuuuugugccccuuaaauguagauaugugcugaaagaaaaaaaaaacgcccaacucuugaaguc

SEQ ID NO: 504792 - RNA, 64 nt, hsa
cuuccguagauaauguggaaaucaaauuuaaccaagaaaaaaagauuggaacaaaugcucucuu

SEQ ID NO: 504793 - RNA, 64 nt, hsa
gugacaaaaaaaaaaaaaaaaaaaagaaaaaaaaagaaaaaacagaaauauauccagcuaacaa

SEQ ID NO: 504794 - RNA, 64 nt, hsa
acaguguucugugacaaaaaaaaaaaaaaaaaaaagaaaaaaaaagaaaaaacagaaauauauc

SEQ ID NO: 504795 - RNA, 64 nt, hsa
aggaacccaccaaaccaaccaaucaaccaaacaaagaaaaaauuccacaaugaaagaauguauu

SEQ ID NO: 504796 - RNA, 64 nt, hsa
ugaacuuugguucuucaugagugcauuuugaaaaagaaaaaaaguacacauucagaaucuggcc

SEQ ID NO: 504797 - RNA, 64 nt, hsa
agaagcucaaagaaaagaaguacguuaaagaaaaagaaaaaaccucacuuuuccuuuauagugu

SEQ ID NO: 504798 - RNA, 64 nt, hsa
ugacuugaguguggcaaaaaguuaacaaaaaaggagaaaaaaugaacaaucguuugugguuucu

SEQ ID NO: 504799 - RNA, 64 nt, hsa
gccacaguaaaaaaaaaaaaaaaaaaaaaaaaaaagaaaaaaaaaucaaaauguauaaauauug

SEQ ID NO: 504800 - RNA, 64 nt, hsa
ccuagacaacauagugagacuuggucucuaaaaaagaaaaaaaaaaauaaaacugauguaauga

SEQ ID NO: 504801 - RNA, 64 nt, hsa
guaugauaccacuuuuaaaaaaagauaaauuuauagaaaaaaguuuauaugacugacaacaaug

SEQ ID NO: 504802 - RNA, 64 nt, hsa
guuauguuuuuggcaugaacaaaagaaacaagagagaaaaaaaucaaaauaauuaaaauaaauu

SEQ ID NO: 504803 - RNA, 64 nt, hsa
cucuuugaauguaugucaaacucaguuacuccagagaaaaaacugccuuucccuucaaagugcu

SEQ ID NO: 504804 - RNA, 54 nt, hsa
caucuucugaggucaauuaaaaggagaaaaaauacaauuucucacuuugcauuu

SEQ ID NO: 504805 - RNA, 64 nt, hsa
aaaaauacaauuucucacuuugcauuuagucaaaagaaaaaaugcuuuauagcaaaaugaaaga

SEQ ID NO: 504806 - RNA, 64 nt, hsa
aagguaauucagggucccaaagacaaacuuacuaagaaaaaaucauuaauaguuuucucccaau

SEQ ID NO: 504807 - RNA, 64 nt, hsa
uaaagaaucgauaaauucaccuguauuuguuguuagaaaaaaacugggugucuguacauuuugu

SEQ ID NO: 504808 - RNA, 64 nt, hsa
auagcuuuuccuucugaaccacguucuauguaaaagaaaaaaaauagcuuugauuuucucacug

SEQ ID NO: 504809 - RNA, 64 nt, hsa
uaauuacuaauauuuauguagcaacuuuugugccagaaaaaagacuguuaauuuguuuuuucuu

SEQ ID NO: 504810 - RNA, 64 nt, hsa
cugaaauguauaagagaagaaccaagucuuacauagaaaaaaaagguagauaugaaaagaaaaa

SEQ ID NO: 504811 - RNA, 64 nt, hsa
acugaaacauaaucaauggauucagaaaugacucagaaaaaagaagcugccaguucuuggaaug

SEQ ID NO: 504812 - RNA, 64 nt, hsa
aagccagugccuauugaguauaucaaaccaaaaaagaaaaaaaaaaguuuuaagaggggucagg

SEQ ID NO: 504813 - RNA, 64 nt, hsa
gugauuuuucaauuucuuuuauauuuacggaaguagaaaaaauguucugucuuuuugaaugcca

SEQ ID NO: 504814 - RNA, 64 nt, hsa
aaaaaaaaaaaaaucugccuaugcauguuuuuuaagaaaaaaaaaauggcuguaucggccugua

SEQ ID NO: 504815 - RNA, 64 nt, hsa
uuaggcagucuuaaaaaaaaaaaaaaacagaaaaagaaaaaaaagaacguugcaaauuuguuaa

SEQ ID NO: 504816 - RNA, 64 nt, hsa
cucuuuuggguaugccuuuuaaaaaugcuuauagagaaaaaaaauuuuaaaaagaaagcuaaug

SEQ ID NO: 504817 - RNA, 64 nt, hsa
uggccaaacuuauuuaugcugcuaaaugaaagaaagaaaaaagcaaauuauuuuuuuuuauuuu

SEQ ID NO: 504818 - RNA, 64 nt, hsa
cuucccccugcaaaaagaaaaaaagaaaagaaaaagaaaaaaaucccuuguucucaguggugca

SEQ ID NO: 504819 - RNA, 64 nt, hsa
agacgauauacucccugcccuucccccugcaaaaagaaaaaaagaaaagaaaaagaaaaaaauc

SEQ ID NO: 504820 - RNA, 64 nt, hsa
agaccccauccuccaccccccccaaaaaauagaaagaaaaaaaaaguuugcacuaauugaggua

SEQ ID NO: 504821 - RNA, 64 nt, hsa
uccugcuugcauaacugaucauauugcuugucucagaaaaaaacaccaucagcaaagugggccu

SEQ ID NO: 504822 - RNA, 64 nt, hsa
gaaucaguaugaagacacugucaaugagguuaugagaaaaaaacagcaggggcauuaguuucag

SEQ ID NO: 504823 - RNA, 64 nt, hsa
gggaagcauuacuuuguagauguauuuucaauaaagaaaaaaauaguuuuacauuaacaucuuu

SEQ ID NO: 504824 - RNA, 64 nt, hsa
aaauuuuaagugccacagguuuuaaggauucugcagaaaaaaaagaaaaaaguccuucaguuua

SEQ ID NO: 504825 - RNA, 64 nt, hsa
gugccacagguuuuaaggauucugcagaaaaaaaagaaaaaaguccuucaguuuagaaccuaca

SEQ ID NO: 504826 - RNA, 64 nt, hsa
aacccacagauuaaaccaaccacagaucaaaaauagaaaaaaaaaaaaaaagaaaaaaagaaug

SEQ ID NO: 504827 - RNA, 64 nt, hsa
caaccacagaucaaaaauagaaaaaaaaaaaaaaagaaaaaaagaauguaaaauuuuaaaaaua

SEQ ID NO: 504828 - RNA, 64 nt, hsa
ugaauuguucuuaaggcaucauaucuagaagcaaagaaaaaagaaaaauaacaauuuaaguugu

SEQ ID NO: 504829 - RNA, 64 nt, hsa
uaaaccaacccaguuacuuauauuaauaauauucagaaaaaaaaaaaaagaaaaggaaaaagaa

SEQ ID NO: 504830 - RNA, 64 nt, hsa
ucuagggaaaagggaagacugguuaaugaugaguagaaaaaacuuguaagcuaaucauucacug

SEQ ID NO: 504831 - RNA, 64 nt, hsa
ugaaauguaauauucaucagaacaaggaucacugagaaaaaauauucagaaacaacuuuaauaa

SEQ ID NO: 504832 - RNA, 64 nt, hsa
auaaauagguaagcacaaagagcucuucaaaaucagaaaaaacaauaggaguccuuccuugucu

SEQ ID NO: 504833 - RNA, 64 nt, hsa
aguuuauaguuuuauauuuggaccuugaaagguaagaaaaaaccagguucuccaaaguuaggaa

SEQ ID NO: 504834 - RNA, 64 nt, hsa
cuagcagggaaguuuccuugagccuaaaauaaaaagaaaaaauuaaaaagaaucaguuuuuuua

SEQ ID NO: 504835 - RNA, 64 nt, hsa
agggggaagaugguucaaagauacaagaaaaaguagaaaaaaaaauaacacuuaacuaaaaccc

SEQ ID NO: 504836 - RNA, 64 nt, hsa
guguuucaaaggguaaauuauaaauguuucaugaagaaaaaauuuuaaaaaucuacgucuuuau

SEQ ID NO: 504837 - RNA, 64 nt, hsa
aauaauguagauagaacaaauuacagacaaggaaagaaaaaacuugaaugaaauggauuuuaca

SEQ ID NO: 504838 - RNA, 64 nt, hsa
ccucuguaaagaucagaugguaaucuuucaaauaagaaaaaaauaaagacguauguuugaccaa

SEQ ID NO: 504839 - RNA, 64 nt, hsa
aaaaaaacuuagguauaacuguugaugaaaaaccagaaaaaaguccagaacucuuuggugacuc

SEQ ID NO: 504840 - RNA, 64 nt, hsa
guuaaauaauggguaguaaauuauagaauguauaagaaaaaauauaaaggagaaaaucaauuau

SEQ ID NO: 504841 - RNA, 64 nt, hsa
aauauauuagucuagggccacuuaauuuagaggaagaaaaaaaaucaacccauccauagaaaua

SEQ ID NO: 504842 - RNA, 64 nt, hsa
gacacguuguaaaugcugcuuccuauuggagcccagaaaaaaggaaaaggaaaguuuaggcuuu

SEQ ID NO: 504843 - RNA, 64 nt, hsa
cauugucuagguaugaaauccucaagcaauaacaagaaaaaaggcccacaauuagaaaaauuua

SEQ ID NO: 504844 - RNA, 64 nt, hsa
acuuaauguauguuguaagaaaagaaaaaagaaaagaaaaaaagggaaaaaagaaaagcaagga

SEQ ID NO: 504845 - RNA, 64 nt, hsa
aucugauucacgacuuaauguauguuguaagaaaagaaaaaagaaaagaaaaaaagggaaaaaa

SEQ ID NO: 504846 - RNA, 64 nt, hsa
gugcaucagcagaguuacugaaagccucugauugagaaaaaaccuccgucugccuaaaucacuu

SEQ ID NO: 504847 - RNA, 64 nt, hsa
gugcuucucuuguguccuguagauguugugaaaaagaaaaaaacaaaaaauacaccacacugua

SEQ ID NO: 504848 - RNA, 64 nt, hsa
aagucuacuauuguaagaguucuucuguuugugaagaaaaaaacaaguuaaaaacugaauguac

SEQ ID NO: 504849 - RNA, 64 nt, hsa
uauggauguucuugaacauuucagaaggagugguagaaaaaaacacacauucagccaaccacuu

SEQ ID NO: 504850 - RNA, 64 nt, hsa
uuuuuuucaggacugcucuaugguuuccuuuaaaagaaaaaaacuucuguuuguuuuuagcagu

SEQ ID NO: 504851 - RNA, 64 nt, hsa
aucaguuuuuuauaaaaauauauauuuuuguccaagaaaaaaaaaagcauacauaugugauuau

SEQ ID NO: 504852 - RNA, 64 nt, hsa
gcacuagagagggagggggaagagcagaaguuagagaaaaaaagccaccggaggaaaggaaaaa

SEQ ID NO: 504853 - RNA, 64 nt, hsa
uccuuccuccaaagaauuaauaggcaacagugggagaaaaaaaaggcauaauggcaaauccuuc

SEQ ID NO: 504854 - RNA, 64 nt, hsa
aggcagggagaagggccgggggggguaggagaggagaaaaaaaaagugaaaaaaagaaacgaaa

SEQ ID NO: 504855 - RNA, 64 nt, hsa
ucaguggagggcgagugguuucggaaaaaaaaaaagaaaaaaagaaaaaaaaagaaaaaaaaaa

SEQ ID NO: 504856 - RNA, 64 nt, hsa
gggcgagugguuucggaaaaaaaaaaagaaaaaaagaaaaaaaaagaaaaaaaaaagauuuuuu

SEQ ID NO: 504857 - RNA, 64 nt, hsa
uuucggaaaaaaaaaaagaaaaaaagaaaaaaaaagaaaaaaaaaagauuuuuuucuucucuua

SEQ ID NO: 504858 - RNA, 64 nt, hsa
caaggccacaaaaacaauguuugggggaaaaaaaagaaaaaaucaugccagcuaaucaugucaa

SEQ ID NO: 504859 - RNA, 64 nt, hsa
agacaguuguggaguaucccauucugaugaguacagaaaaaaaaagaaaaagaaaagaagagaa

SEQ ID NO: 504860 - RNA, 64 nt, hsa
augaguacagaaaaaaaaagaaaaagaaaagaagagaaaaaauuaagaaaaaaaucaaaaaagg

SEQ ID NO: 504861 - RNA, 64 nt, hsa
aaaaaaaagaaaaagaaaagaagagaaaaaauuaagaaaaaaaucaaaaaaggaagaaaacuaa

SEQ ID NO: 504862 - RNA, 64 nt, hsa
gugucagauucaucaaacaaaaaauaaaucucgaagaaaaaaaaugcacuuacaugugcuuauu

SEQ ID NO: 504863 - RNA, 63 nt, hsa
agcaacaacagcagaguugauuaagaaaaaugaagaaaaaacgcaaaaagagaacacauguag

SEQ ID NO: 504864 - RNA, 64 nt, hsa
ucugccacucuugcugugaaauugaagugcauguagaaaaaaccuuuuacuauaugaaacuuua

SEQ ID NO: 504865 - RNA, 64 nt, hsa
uugggaaggaggguaauaaugaacaaaaaguuugagaaaaaaaugcuuuaauggguuuuacagg

SEQ ID NO: 504866 - RNA, 64 nt, hsa
ugcagaauuuggcauaucgaugcaugcaauggaaagaaaaaaaauuuguuaaaauuuguaaaug

SEQ ID NO: 504867 - RNA, 64 nt, hsa
uugaaagcaucaagauuccacucaauuguggagaagaaaaaaggugcuguagaaagugcaccag

SEQ ID NO: 504868 - RNA, 64 nt, hsa
guaaacaggcuuuagucauuaaugugagagacuuagaaaaaaugcuuagaguggacuauuaaau

SEQ ID NO: 504869 - RNA, 64 nt, hsa
gucacugcugccauguguguacuguauuauuuucagaaaaaaauauaauagucugaguccaagu

SEQ ID NO: 504870 - RNA, 64 nt, hsa
aaaacuugucuauaauuaugucaucuauguaccuagaaaaaaguaaauaaauuucuucaguuga

SEQ ID NO: 504871 - RNA, 64 nt, hsa
uauugcauuuuugggggaagcaaauugacuuuaaagaaaaaaguuguggcaaaagaugcuaaga

SEQ ID NO: 504872 - RNA, 64 nt, hsa
uuuuuucauuagggccauaucuccaaaaaaagaaagaaaaaauacaaaaaacaaaaacaaaaaa

SEQ ID NO: 504873 - RNA, 64 nt, hsa
uauuucaagauaauguaguuuaaaaaaaaaaaaaagaaaaaaacuugauguaaauuccuccuuu

SEQ ID NO: 504874 - RNA, 64 nt, hsa
agccagaccuugucucaaaaaaaaaaaaaaaaaaagaaaaaagaaaguacugucugucuuaaau

SEQ ID NO: 504875 - RNA, 64 nt, hsa
gaaauucuauuuugguauguuuguauuagccuuuagaaaaaacacuccguuucagaauuguuca

SEQ ID NO: 504876 - RNA, 64 nt, hsa
uacauaggggaacugugggcuaggcaaacaaaauagaaaaaagugugaaaaacaguaaaguugg

SEQ ID NO: 504877 - RNA, 64 nt, hsa
gaccaucgaggaagccgaaaauaugcaaagaccaagaaaaaauaaagaaaagaugauuuaccuc

SEQ ID NO: 504878 - RNA, 64 nt, hsa
gaauagagacauauuaaaauaauguuuacaucuuagaaaaaacauagauagugcuaguaauauu

SEQ ID NO: 504879 - RNA, 64 nt, hsa
aaagucuuuacaaugcuuguuucaaagaaccaacagaaaaaaaagcuaagaaaacugagaacua

SEQ ID NO: 504880 - RNA, 64 nt, hsa
uauggaaauguugucuuuuauacuuaguuauauaagaaaaaagggaguuaugcaauuaauaucu

SEQ ID NO: 504881 - RNA, 64 nt, hsa
uagcauugcaugugaauaagaaaauaauguuuaaagaaaaaaaaaaaaaagcaaaccuccaaaa

SEQ ID NO: 504882 - RNA, 64 nt, hsa
uuuucucucacuauaguauaagaaucuauuuuggagaaaaaaagaaaauaugagggucucgaag

SEQ ID NO: 504883 - RNA, 64 nt, hsa
acaaaagcaaaaaaaaaaagcaaaaaaagaaaagagaaaaaaagaaaaaaugcaaauggaauaa

SEQ ID NO: 504884 - RNA, 64 nt, hsa
aaaaaaaaaaagcaaaaaaagaaaagagaaaaaaagaaaaaaugcaaauggaauaauuuucuau

SEQ ID NO: 504885 - RNA, 64 nt, hsa
cagccugggugauagagcaagacugucucaaaaaagaaaaaaaagaaaaaauuuuaauuuaauc

SEQ ID NO: 504886 - RNA, 64 nt, hsa
ugauagagcaagacugucucaaaaaagaaaaaaaagaaaaaauuuuaauuuaauccuucuguag

SEQ ID NO: 504887 - RNA, 64 nt, hsa
aaauuguaaaaccugucaaugauacagucccuaaagaaaaaaaaucauugcuuugaagcaguug

SEQ ID NO: 504888 - RNA, 64 nt, hsa
augauguguugugauagcuaacauuuuaaauaaaagaaaaaauaucuugaagauuuuugucaca

SEQ ID NO: 504889 - RNA, 64 nt, hsa
ggcaacagagcaagagucugucucaaaaaaaaaaagaaaaaaagaaaaaaagaaaaaagaaaaa

SEQ ID NO: 504890 - RNA, 64 nt, hsa
agcaagagucugucucaaaaaaaaaaagaaaaaaagaaaaaaagaaaaaagaaaaaucucauua

SEQ ID NO: 504891 - RNA, 64 nt, hsa
ucugucucaaaaaaaaaaagaaaaaaagaaaaaaagaaaaaagaaaaaucucauuauuucaaaa

SEQ ID NO: 504892 - RNA, 64 nt, hsa
aaguagcuugucaucaauccccuugucgaaaacuagaaaaaaaggaguugacccauauaaauua

SEQ ID NO: 504893 - RNA, 64 nt, hsa
cccaaaauuauuaauuuuauuaggcuuuuggaaaagaaaaaaaacuuuuugauguuuuagguga

SEQ ID NO: 504894 - RNA, 64 nt, hsa
cuccagccugggcgacagagugagacuccaucucagaaaaaaaaaaaaaaaaaaacagaaucuc

SEQ ID NO: 504895 - RNA, 64 nt, hsa
cacauuuaauuccuauuaaguacagccgcaagaaagaaaaaaugaugaaguugcaaauggcagu

SEQ ID NO: 504896 - RNA, 64 nt, hsa
ugcauaaaagggucaaaccuguagaugcagaaaaagaaaaaaacuauaaauacaaaucuguaua

SEQ ID NO: 504897 - RNA, 64 nt, hsa
uuuccuuccucuguaagauaucccagcuuuaaaaagaaaaaaaaagaauuaccaagagaagggg

SEQ ID NO: 504898 - RNA, 64 nt, hsa
gauaugcuccaugaugcuguguguuuugguaguaagaaaaaaaaauugggaggcuuuucaaagg

SEQ ID NO: 504899 - RNA, 64 nt, hsa
aaacuacuuacugauuuaagaucuuuugaauuuuagaaaaaacauaugaaucagauggaacaau

SEQ ID NO: 504900 - RNA, 64 nt, hsa
ugaucaaaucauauuucuguacauuuucagugguagaaaaaaaagguuuuaaaaauuguauccu

SEQ ID NO: 504901 - RNA, 64 nt, hsa
ucacagagagacagugcaguguagcuuuaguuuaagaaaaaaaaauauuccuccccacugcaug

SEQ ID NO: 504902 - RNA, 64 nt, hsa
cagcuuaaugugauauaugacuaucuugaacaagagaaaaaacuaggagauguuucuccugaag

SEQ ID NO: 504903 - RNA, 64 nt, hsa
uaaaagaugaaguuuuauacacacagcaaaaaggagaaaaaauucuaguauauuuuaagagaug

SEQ ID NO: 504904 - RNA, 64 nt, hsa
uaacucaaauacugugaacuaucucuaaaacacuagaaaaaagaaauguuaguaucucaauuac

SEQ ID NO: 504905 - RNA, 64 nt, hsa
uuacccgugucaauuaacauuuaaacuggcauauagaaaaaaaggaggauuuuucugcauugua

SEQ ID NO: 504906 - RNA, 64 nt, hsa
ggauggaauaucagaaguauaucuguacagaucaagaaaaaaagggagaauaaaauuccuaucu

SEQ ID NO: 504907 - RNA, 64 nt, hsa
ugacguuucuucuuucuagagcaguuggccaagcagaaaaaaaagugucucaaaggagcuuucu

SEQ ID NO: 504908 - RNA, 64 nt, hsa
ucuaaaaggaaaaauaauuuuaaguaaagaaaaaagaaaaaaaaggaagacuaaacagaaacca

SEQ ID NO: 504909 - RNA, 64 nt, hsa
ugaacuuucuaaaaggaaaaauaauuuuaaguaaagaaaaaagaaaaaaaaggaagacuaaaca

SEQ ID NO: 504910 - RNA, 64 nt, hsa
ggcuuuagauuuaaaguaaauugaaauguuuuaaagaaaaaaguauucacagauuuaauaccua

SEQ ID NO: 504911 - RNA, 64 nt, hsa
uguugaauguuucuaaaaaugccuuuuuaaggagagaaaaaaaaaucaaagggcagucucaaua

SEQ ID NO: 504912 - RNA, 64 nt, hsa
uuuuguucuccacugaaguaauacuuaacaucucagaaaaaauuuugcauguucuguaguuuug

SEQ ID NO: 504913 - RNA, 64 nt, hsa
ggggagagagaaauucauaacaaauccgacuaccagaaaaaaaaaauuguuuuggaggaggggc

SEQ ID NO: 504914 - RNA, 64 nt, hsa
gaauaauauugugaaaaugaaucuguuaugauaaagaaaaaauaaaguggaaacuuuuagagua

SEQ ID NO: 504915 - RNA, 64 nt, hsa
acuaguagggccaaaaaaaaaaagaaaaagaaaaagaaaaaagaaaaaaaaagaaaaaacuggg

SEQ ID NO: 504916 - RNA, 64 nt, hsa
gggccaaaaaaaaaaagaaaaagaaaaagaaaaaagaaaaaaaaagaaaaaacugggaccuaag

SEQ ID NO: 504917 - RNA, 64 nt, hsa
aaaaaagaaaaagaaaaagaaaaaagaaaaaaaaagaaaaaacugggaccuaaguauaaauauc

SEQ ID NO: 504918 - RNA, 64 nt, hsa
gacaaagaucacuacagaccaaaacagaagaagaagaaaaaaaagaaaaagaaaucuaagcaac

SEQ ID NO: 504919 - RNA, 64 nt, hsa
cgaaaagaccaagaucaaauaauagcugggguggagaaaaaaauagcucaagacacaguuaauc

SEQ ID NO: 504920 - RNA, 64 nt, hsa
aguuugauccugaguaugcuugguguuugccuucagaaaaaaaaaaauacauuguaaauaaccu

SEQ ID NO: 504921 - RNA, 64 nt, hsa
ccagccugugcaacaagagugaaacuccauuucaagaaaaaaaaaaaaaaaagaauaugcacag

SEQ ID NO: 504922 - RNA, 64 nt, hsa
gaccacaaaauuucaaagggacucauacaauuugagaaaaaacagucaaccugauuugagaaau

SEQ ID NO: 504923 - RNA, 64 nt, hsa
uuuuugaaagacuuuuguauaaaguugaguacuuagaaaaaagacaaaccagauguaauauauu

SEQ ID NO: 504924 - RNA, 64 nt, hsa
aaaagaaaaugcacucuaacuuaugugaacugagagaaaaaaaucagguuuuaaacaggaaaac

SEQ ID NO: 504925 - RNA, 64 nt, hsa
ccaucucuguaggaucguaaaaaaauagaaaaaaagaaaaaaaaaagaaagaaagagggaaaaa

SEQ ID NO: 504926 - RNA, 64 nt, hsa
cagcuggaccaucucuguaggaucguaaaaaaauagaaaaaaagaaaaaaaaaagaaagaaaga

SEQ ID NO: 504927 - RNA, 64 nt, hsa
uaugaagccuuucagauaccaauuuaguuuaugcagaaaaaaauugaacaaaacaggguaccag

SEQ ID NO: 504928 - RNA, 64 nt, hsa
ugaaaaccaccuuccuauguuuguaaaauauuuaagaaaaaauuggcaaacaauuaaugcuuaa

SEQ ID NO: 504929 - RNA, 64 nt, hsa
uuuuuuuaagacucugucuuaaaaaaaacuaaaaagaaaaaaagaagccccuucacucuacagg

SEQ ID NO: 504930 - RNA, 56 nt, hsa
aaaaagcaggaaagauguaaaucagcagaaaaaaaacaccgagacguuucugugac

SEQ ID NO: 504931 - RNA, 64 nt, hsa
uacuuaagaaaaaagauuugauuaucaucacagcagaaaaaagucauugcauaucugaucaaua

SEQ ID NO: 504932 - RNA, 64 nt, hsa
aguuaucaaagauaaauuggcaagucaguacuuaagaaaaaagauuugauuaucaucacagcag

SEQ ID NO: 504933 - RNA, 64 nt, hsa
auugaucacuuaauccuguuucucauguccagccagaaaaaagaacuucagugaagguaagaua

SEQ ID NO: 504934 - RNA, 64 nt, hsa
ggccuuacuuugugauuauacguuaucuccggcuagaaaaaaauaaugguaguaaagaaacuga

SEQ ID NO: 504935 - RNA, 64 nt, hsa
auuaucaccuuagcaacuuagaauaguuugaaauagaaaaaaaguauuuaauuuggaucuggau

SEQ ID NO: 504936 - RNA, 64 nt, hsa
ugaaagaaguauuaaaaagagugaggauggauuuagaaaaaaacaugaauuuagaaauauucaa

SEQ ID NO: 504937 - RNA, 64 nt, hsa
ggcuauggaaagacagcuuuuccuacacugauaaagaaaaaaaaugaggaaauuauuucauccc

SEQ ID NO: 504938 - RNA, 64 nt, hsa
uuuuauguucaaugccuaauuucucaaaagugccagaaaaaaauguauauuagcuauuuugauu

SEQ ID NO: 504939 - RNA, 64 nt, hsa
guguaaucuuuuaaaaauauuaucuugcagauaaagaaaaaaauuaagaguguguuuacaacug

SEQ ID NO: 504940 - RNA, 64 nt, hsa
aaacugauaauaucuguaaugacaucagaaugaaagaaaaaaaauuguacaguguauauuccuu

SEQ ID NO: 504941 - RNA, 64 nt, hsa
ucaucccuuccuauaaccucuagguaaaaagaaaagaaaaaaagaaauuucgagauauuuucaa

SEQ ID NO: 504942 - RNA, 64 nt, hsa
aacauuguuagaguuugggcuaaaaugagcaaggagaaaaaaaccaccaagaacauuuccuggg

SEQ ID NO: 504943 - RNA, 64 nt, hsa
acuuucaaguaaauauagcauuccuuuggcaaaaagaaaaaaaaaguaaaagaaaagaaaaaaa

SEQ ID NO: 504944 - RNA, 64 nt, hsa
uccuuuggcaaaaagaaaaaaaaaguaaaagaaaagaaaaaaaauguauuaccacccgaugagc

SEQ ID NO: 504945 - RNA, 64 nt, hsa
uaaaaaaagaaaaaaugaaaaaaaaaggaaaaaaagaaaaaaggaaaaaaacaguuugaacaca

SEQ ID NO: 504946 - RNA, 64 nt, hsa
uccaguguguaacccaguuugaaaucuuaaaaaaagaaaaaaugaaaaaaaaaggaaaaaaaga

SEQ ID NO: 504947 - RNA, 64 nt, hsa
auuuauguuagcauuaaugcacauuuuuaaaaaaagaaaaaaacauggucuuguuuuuacuacc

SEQ ID NO: 504948 - RNA, 64 nt, hsa
ugacuguugccugcaaaaauaaaagggaaaaaaaagaaaaaagaaacaaaaaggaacuucuuau

SEQ ID NO: 504949 - RNA, 64 nt, hsa
aagagguacuuuccuggaauaauugucuaccugaagaaaaaaaauuuauauauacauugugugu

SEQ ID NO: 504950 - RNA, 64 nt, hsa
cuuuuuggucaguaaaacuuaaugaaaaaagcaaagaaaaaaauauucugaacaaagcuauagg

SEQ ID NO: 504951 - RNA, 64 nt, hsa
aacaaguccccaagaaaaaauucacucuauguagagaaaaaauauuuucucucauguuaguaca

SEQ ID NO: 504952 - RNA, 64 nt, hsa
uuuuuagccuucccuggagaaaaacaaguccccaagaaaaaauucacucuauguagagaaaaaa

SEQ ID NO: 504953 - RNA, 64 nt, hsa
uucuaaguuaaaucauuuucauuaaaaggaaaaaagaaaaaaaauuuuguaugucaauaacuuu

SEQ ID NO: 504954 - RNA, 64 nt, hsa
auuuacagaauauuauauaacccacugcugaaaaagaaaaaaaugauuguuuuagaaguuaaag

SEQ ID NO: 504955 - RNA, 64 nt, hsa
uuuuuaaaaguuauuuuugguaaggucuucuuuuagaaaaaaauuaaucucaaggguuuuuugu

SEQ ID NO: 504956 - RNA, 64 nt, hsa
ccuacuuauaaacuacuuuuuuauaauuguuuucagaaaaaaaguuuacagucuuaaggaaaau

SEQ ID NO: 504957 - RNA, 64 nt, hsa
uacaggcugcauucuugccuuacuguauagaaaaagaaaaaaggcuggguuuacuauugcacau

SEQ ID NO: 504958 - RNA, 64 nt, hsa
uucuguacaucuuacuggguuuaauuaaaaaaaaagaaaaaacucuguuguaaaaacaguuuaa

SEQ ID NO: 504959 - RNA, 64 nt, hsa
auuaugggauuggaagaaacacguggucaugaauagaaaaaaaacaaacccaaagguaggaagg

SEQ ID NO: 504960 - RNA, 64 nt, hsa
cugaauuggaaaggaaaagaggcccaagugcaaaagaaaaaacauuuuagaaacggacagcuua

SEQ ID NO: 504961 - RNA, 64 nt, hsa
caguuguuugaugcauuaaaagaaaauaaaaaaaagaaaaaagagaaaagaaaaaaaaagaaaa

SEQ ID NO: 504962 - RNA, 64 nt, hsa
auuaaaagaaaauaaaaaaaagaaaaaagagaaaagaaaaaaaaagaaaaaaguuguaggcgaa

SEQ ID NO: 504963 - RNA, 64 nt, hsa
aauaaaaaaaagaaaaaagagaaaagaaaaaaaaagaaaaaaguuguaggcgaaucauuuguuc

SEQ ID NO: 504964 - RNA, 64 nt, hsa
aagacugaaauuuauuauuagacaaauucauuauagaaaaaaccuguggcaaaaacguuucuuu

SEQ ID NO: 504965 - RNA, 64 nt, hsa
ugguuucuaacagacuacuuccaaaaacaguuugagaaaaaaacugucugauuuuaagucucua

SEQ ID NO: 504966 - RNA, 64 nt, hsa
guguucagcaaaaugugauguuuuuuucuuuuaaagaaaaaaagugaaaauauauagugccaaa

SEQ ID NO: 504967 - RNA, 64 nt, hsa
caaaucuacuguacugucagcuucacuccaccugagaaaaaagaaaaaaaaauugauagcucaa

SEQ ID NO: 504968 - RNA, 64 nt, hsa
acuguacugucagcuucacuccaccugagaaaaaagaaaaaaaaauugauagcucaaaugcaug

SEQ ID NO: 504969 - RNA, 64 nt, hsa
gaaauaauaccaggcuuuuauaaacuuuucuagaagaaaaaagauggaacuuuuccaauucagu

SEQ ID NO: 504970 - RNA, 64 nt, hsa
uggaagacagagugagaccccaucucaggaaaaaagaaaaaaaaaaagaugucauucagcaggu

SEQ ID NO: 504971 - RNA, 64 nt, hsa
auagggcuuuuugacagcuuuuugagaccucuuaagaaaaaauaaaaaguaaaaaaugaaagga

SEQ ID NO: 504972 - RNA, 64 nt, hsa
ccaaugacuacucaguuuuaggacuuucuguggaagaaaaaagggagaagaaaucaauuccacu

SEQ ID NO: 504973 - RNA, 64 nt, hsa
aucuacgauucaacuaaucgaaggauuaaacuaaagaaaaaacuaagaagaacaaugaaccuuu

SEQ ID NO: 504974 - RNA, 64 nt, hsa
uccacauuaaugaaggauccauguuuguagugagagaaaaaaaccccaagguaacccgauauga

SEQ ID NO: 504975 - RNA, 64 nt, hsa
gccuguuuccucuuagcuuucuagacuucuuaacagaaaaaacaguuuggguucaauagcauuu

SEQ ID NO: 504976 - RNA, 64 nt, hsa
ccagccugggcgacagagcaagauuccguucccaagaaaaaaaaauuguucaacaauaagggca

SEQ ID NO: 504977 - RNA, 64 nt, hsa
aggggcugguagacaagaacugugaaagagagagagaaaaaaccucaacuguguauuuugucac

SEQ ID NO: 504978 - RNA, 64 nt, hsa
uacucaacuguguuuaauacucugaauuuuaauuagaaaaaaauacaauagcagcaaggcccug

SEQ ID NO: 504979 - RNA, 64 nt, hsa
uccccccaggcaucuucacucagcaggauauaaaagaaaaaaauguucaaaugagagagcuuuc

SEQ ID NO: 504980 - RNA, 64 nt, hsa
acuuuagucuguuauuuuguuucuuuuuauacaaagaaaaaaaauucagcuuucauguuucuga

SEQ ID NO: 504981 - RNA, 58 nt, hsa
caucuccagcaguggccugaagaggaagagaaaaaaaacaaaaaacagaaaccaaucg

SEQ ID NO: 504982 - RNA, 64 nt, hsa
ccgagguguuuuuuacauuuaagaaaaaaaaaaaagaaaaaaagauuguuuaaaaaaaaaagga

SEQ ID NO: 504983 - RNA, 64 nt, hsa
ugucucugcuguaccgagguguuuuuuacauuuaagaaaaaaaaaaaagaaaaaaagauuguuu

SEQ ID NO: 504984 - RNA, 64 nt, hsa
uuuucauuguuauuuuuagaaagauuuuuugcuaagaaaaaaauuaaacauauuuacauauuuu

SEQ ID NO: 504985 - RNA, 64 nt, hsa
acuguuuguauaaaaaauagaaaaaaaaaagaaaagaaaaaaggcauaaaucuuuauugcagau

SEQ ID NO: 504986 - RNA, 64 nt, hsa
gugcaauacuguuuguacuguuuguauaaaaaauagaaaaaaaaaagaaaagaaaaaaggcaua

SEQ ID NO: 504987 - RNA, 64 nt, hsa
uuaguuaauaugaacacagcacagauuuguuagaagaaaaaaaauuugcuguaauaccaaaacu

SEQ ID NO: 504988 - RNA, 64 nt, hsa
gcuguaauaccaaaacuaaccucaucaaagauacagaaaaaaagaaauauagugagcccuaaag

SEQ ID NO: 504989 - RNA, 64 nt, hsa
gaucaucgccguugaaaugaaaagagagacagagagaaaaaaaaaaagagaacccacaugaagc

SEQ ID NO: 504990 - RNA, 64 nt, hsa
gacucauuuguguggaugcgugaccaugggaaaaagaaaaaaaaaaagauccauuuuuuagguu

SEQ ID NO: 504991 - RNA, 64 nt, hsa
uuauuacaacuuuguacugguuguaacuugcauuagaaaaaaaagagauauauacaccacaaag

SEQ ID NO: 504992 - RNA, 64 nt, hsa
uuguuuaaaaaaaugcaaaucauucuuuaccuuaagaaaaaaaaaauacccuuugcuuugugcc

SEQ ID NO: 504993 - RNA, 64 nt, hsa
gcaugaauauaaaucuauauuauuugcuaaaaaaagaaaaaacauuuguguuuuaguuucuuuu

SEQ ID NO: 504994 - RNA, 64 nt, hsa
ugauacuuuugaaacagaugugaaaaacagaaaaagaaaaaauugucugaaauguuuauuuugc

SEQ ID NO: 504995 - RNA, 64 nt, hsa
cuauuaauuugcucagugcacuuuuuucaaauacagaaaaaagauucuccauuauaguuacaaa

SEQ ID NO: 504996 - RNA, 64 nt, hsa
uguuacagcaauccuaggaagcuaauacucugacagaaaaaaaucuuggauaauaugcaugaga

SEQ ID NO: 504997 - RNA, 64 nt, hsa
agauuuaacuguuugauuauaacugugcaaauacagaaaaaaagaaggcuggcugaaaguugag

SEQ ID NO: 504998 - RNA, 64 nt, hsa
uuaugaauagaagguagugaagaaaagcaagcuaagaaaaaauucuguuuauaaaagaaggaaa

SEQ ID NO: 504999 - RNA, 64 nt, hsa
gauuacccaaaaacugucuuuaaaagagagagagagaaaaaaaaaauaguauuugcauaacccu

SEQ ID NO: 505000 - RNA, 64 nt, hsa
aguuuauuuuuaaagauagauccuuuuauaggugagaaaaaaacaaucuggaagaaaaaaacca

SEQ ID NO: 505001 - RNA, 64 nt, hsa
gauccuuuuauaggugagaaaaaaacaaucuggaagaaaaaaaccacacaaagacauugauuca

SEQ ID NO: 505002 - RNA, 64 nt, hsa
ucucggccuaagcacuucuuucuaaauguaucggagaaaaaaucaaauggacuacaagcacgug

SEQ ID NO: 505003 - RNA, 64 nt, hsa
augguauuaaacuaucauagaaguagacagaaaaagaaaaaaggacucauggcauuauuaauau

SEQ ID NO: 505004 - RNA, 64 nt, hsa
uauagaaaauauuugagaauuucuuauacuaucaagaaaaaauucugugaauuaagauguaauu

SEQ ID NO: 505005 - RNA, 64 nt, hsa
caaccugagugacagagcaacacucugucuuaaaagaaaaaaaaaaaagagagagauaguaauc

SEQ ID NO: 505006 - RNA, 64 nt, hsa
auggcggaaucuuaaagugauacaugcuaacuguagaaaaaaauagaaaaugcacauaagcaaa

SEQ ID NO: 505007 - RNA, 64 nt, hsa
aaauuguauaaaauuagguacuucgauuaguaaaagaaaaaaauuugaauguuuuuuuuuuuua

SEQ ID NO: 505008 - RNA, 64 nt, hsa
cauuauaaaagagcacuucuguggcucauuuaaaagaaaaaaaagguuaagucuuuuaaauuuu

SEQ ID NO: 505009 - RNA, 64 nt, hsa
gauuuuuaucuaaaaaaauucauuuuuauaucgaagaaaaaauauuuuauucaaacauuagauu

SEQ ID NO: 505010 - RNA, 64 nt, hsa
ugaaaagauuaggaaucuacgcauacacugagagagaaaaaagugagaggaagacuauaaaaau

SEQ ID NO: 505011 - RNA, 64 nt, hsa
auauccagguuagcugguaagaggauuuuuuuggagaaaaaaaugauauuuagaaaguuaauuu

SEQ ID NO: 505012 - RNA, 64 nt, hsa
ugaauugauaauaaacuguccucuuucagaaaacagaaaaaaaacacacacacacacaacaaaa

SEQ ID NO: 505013 - RNA, 64 nt, hsa
guauauauacauaacaggguaaauuauucaguuaagaaaaaaauaauuuuaugaacugcaugua

SEQ ID NO: 505014 - RNA, 64 nt, hsa
cagccuuugugccacuucagugcuagaaaguuaaagaaaaaaaaacuuuugugauuuaauaaua

SEQ ID NO: 505015 - RNA, 64 nt, hsa
aguuguacagauaguuuauaagcacaauauuuuaagaaaaaaaaguggcuggucuacuaggcag

SEQ ID NO: 505016 - RNA, 64 nt, hsa
uuagaauugugucauuuaucaaaccuuuuauuacagaaaaaaaucugaacugagaaaggagcuc

SEQ ID NO: 505017 - RNA, 64 nt, hsa
auuucucagugccuucucagggucuggugugaacagaaaaaacaguguuccugcauuuaccaua

SEQ ID NO: 505018 - RNA, 64 nt, hsa
uucuguaucucguaauuguguauagcaugguaaaagaaaaaaaaaaagacagguaaauguuaua

SEQ ID NO: 505019 - RNA, 54 nt, hsa
auagugaaacacauuguuaaggggagaaaaaaagccacuucugcuucuguguuu

SEQ ID NO: 505020 - RNA, 64 nt, hsa
agccuaugaacuuauaauaaaacaaacuguagguagaaaaaaugagaguacucauuguuacauu

SEQ ID NO: 505021 - RNA, 64 nt, hsa
auuaaagugagagacaugguuacuguguaauaaaagaaaaaauacuuguucagguaauucuaau

SEQ ID NO: 505022 - RNA, 64 nt, hsa
aaauuuaaaugggaagggaagaaaacaccaaauaagaaaaaaauuugccuuuaagaguuacuuu

SEQ ID NO: 505023 - RNA, 64 nt, hsa
gacagugcaagacucugucuccaaaaaaaaaaaaagaaaaaagaaaaucccccuucauccccca

SEQ ID NO: 505024 - RNA, 64 nt, hsa
guacuagauguacuuuuucuaaaaaggaaaggacagaaaaaaaugaagaaaggaaaggaagaca

SEQ ID NO: 505025 - RNA, 64 nt, hsa
gaaaaagagaaaaauuuuaaaauccugcuauaggagaaaaaaagagaaaaaaauaaaaaucaaa

SEQ ID NO: 505026 - RNA, 64 nt, hsa
aaaauuuuaaaauccugcuauaggagaaaaaaagagaaaaaaauaaaaaucaaaaaaaaaaaaa

SEQ ID NO: 505027 - RNA, 64 nt, hsa
gucuugaauucucuguuuaugcaaugugcucgaaagaaaaaaauguuaaaaauauaucuauaau

SEQ ID NO: 505028 - RNA, 63 nt, hsa
auuuaguucuuuuggacuaauacaauucaggaaagaaaaaacccaaaaaccaaccucauucac

SEQ ID NO: 505029 - RNA, 64 nt, hsa
aacaauuagguguacuucuauuuuaaaacauuucagaaaaaaauauauguuauagcaauacucu

SEQ ID NO: 505030 - RNA, 64 nt, hsa
uugucaguggcguugggagggggagaaaaggaaaagaaaaaaaaaagaagaagaagaagaaaag

SEQ ID NO: 505031 - RNA, 64 nt, hsa
aaaaaaaaaagaagaagaagaagaaaagagaagaagaaaaaaacgaaaacagucaaccaacccc

SEQ ID NO: 505032 - RNA, 64 nt, hsa
agccgacggaggaggaggagccuuccaaacagagagaaaaaaaugaggccgaaaauuuagagga

SEQ ID NO: 505033 - RNA, 64 nt, hsa
cgcuacacuguccuggcagaaaacaaaagugacgagaaaaaaaaaucaggagucagcucugaca

SEQ ID NO: 505034 - RNA, 64 nt, hsa
uccagccugggcgacaagagcaagacucugucucagaaaaaaaaaaaaaaaagagagagagaga

SEQ ID NO: 505035 - RNA, 64 nt, hsa
uuuauucuucaacucucacuuucuuagaguuuacagaaaaaauauuuauauacgacucuuuaaa

SEQ ID NO: 505036 - RNA, 64 nt, hsa
uccuuucauuuuuuuucuuuguaaugcaccugacagaaaaaaaagaaaaaugaauuucucuuua

SEQ ID NO: 505037 - RNA, 64 nt, hsa
uguguuuuguuguuuugugcuacaauuuuuaaaaagaaaaaaguuuuguuuuguuuuuuggggu

SEQ ID NO: 505038 - RNA, 64 nt, hsa
ugacuaauagaccucagccucaaaaggcuuggaaagaaaaaacaaauacaacaagcaaacaaca

SEQ ID NO: 505039 - RNA, 64 nt, hsa
caauauaaaaauuguuuuaauggcauuuguugaaagaaaaaagcauggcuaaaauguauaaaau

SEQ ID NO: 505040 - RNA, 64 nt, hsa
uuauacugcaugaaguauguuaagcuaagcacagagaaaaaaaggcagcaagacauguuuuaua

SEQ ID NO: 505041 - RNA, 64 nt, hsa
aaaauaucacauaagacaucaugauaacauuugaagaaaaaauaaaacuguagacccuaacagu

SEQ ID NO: 505042 - RNA, 64 nt, hsa
agucaaagaaagagaaaaaagauaaaguagaaaaagaaaaaagugaaaaggaaacaacuagcaa

SEQ ID NO: 505043 - RNA, 64 nt, hsa
cagcaguuugugccuccuacacagucaaagaaagagaaaaaagauaaaguagaaaaagaaaaaa

SEQ ID NO: 505044 - RNA, 64 nt, hsa
auacuaucauaguaauauuauuauugucaucccaagaaaaaauauauuaaaaagauauuugaaa

SEQ ID NO: 505045 - RNA, 64 nt, hsa
auacuaucauguuaauacuauuauugucaucccaagaaaaaagauauuuuaaaaauuuauuuga

SEQ ID NO: 505046 - RNA, 64 nt, hsa
uuuaggaccaaucucauuuuuaauaagguuaaaaagaaaaaaaaagucuagcgaaaaaacuccu

SEQ ID NO: 505047 - RNA, 64 nt, hsa
ugagguccuucuggacuaaaagccaaaaaaagaaagaaaaaaauaauuuuucuuuucuguuuua

SEQ ID NO: 505048 - RNA, 64 nt, hsa
uguauuauauacaaguguaauacaugcauauaauagaaaaaaaacauggaauuucaaauauacu

SEQ ID NO: 505049 - RNA, 64 nt, hsa
uuugaaugcuuauauauuuguucaaucuguugauagaaaaaauuguucauuuuccucagucuca

SEQ ID NO: 505050 - RNA, 64 nt, hsa
cugucucaaaaaaaaaaaaagaaaaaagaaagaaagaaaaaaggcagaagcccuggauucaaau

SEQ ID NO: 505051 - RNA, 64 nt, hsa
ugacagagcgaaccucugucucaaaaaaaaaaaaagaaaaaagaaagaaagaaaaaaggcagaa

SEQ ID NO: 505052 - RNA, 64 nt, hsa
uauaagaauuaagggguaaagcacuaaacagaaaagaaaaaaaaaauagcaacucuggugagca

SEQ ID NO: 505053 - RNA, 64 nt, hsa
cuccuaacagcacuacaaaguaccuuuuuuuaucagaaaaaaauuuuaccauuaggacucaauu

SEQ ID NO: 505054 - RNA, 64 nt, hsa
caguuuugaaccaagaauuggugauuuguuuauaagaaaaaaacuggcuucauuucugugaaau

SEQ ID NO: 505055 - RNA, 64 nt, hsa
uuucuaccagaaauuuccagagcauuauguagguagaaaaaaaugcaagcaagcuguuaaagau

SEQ ID NO: 505056 - RNA, 64 nt, hsa
aaucaaauuauauaaacaguaccaauaucauuauagaaaaaaauaacauuuuaauguauauugu

SEQ ID NO: 505057 - RNA, 64 nt, hsa
uuaauaaaauucuauugcaaaaauuucuuuuucuagaaaaaauaaauacaaaaaaaaaaaagaa

SEQ ID NO: 505058 - RNA, 64 nt, hsa
uaagaaaguacuugacuaaaaaaaaaagaaaaaaagaaaaaaaagaaagcauagacauauuuuu

SEQ ID NO: 505059 - RNA, 64 nt, hsa
uguuucuuuaagaaaguacuugacuaaaaaaaaaagaaaaaaagaaaaaaaagaaagcauagac

SEQ ID NO: 505060 - RNA, 64 nt, hsa
cuguugaucuuuuaucaauaauguucuauagaaaagaaaaaaaaaauauauauauauauauauc

SEQ ID NO: 505061 - RNA, 64 nt, hsa
uguagggauuuacuggcaugguaucauuccuagaagaaaaaaagagagaaacuugacugcacau

SEQ ID NO: 505062 - RNA, 64 nt, hsa
ggaaaaaccaacaaacaauaguucuagggagaugagaaaaaaauucaccuuacagugcuaagaa

SEQ ID NO: 505063 - RNA, 64 nt, hsa
aagcaaccccaaaagaguugauguguguuuuaaaagaaaaaacccaaugaggaacaauuggaga

SEQ ID NO: 505064 - RNA, 64 nt, hsa
caaaagcgaaacucugucucaaaaaagaaaaaaaagaaaaaaaagcacgugaccuuaugaggcu

SEQ ID NO: 505065 - RNA, 64 nt, hsa
ccugggcaacaaaagcgaaacucugucucaaaaaagaaaaaaaagaaaaaaaagcacgugaccu

SEQ ID NO: 505066 - RNA, 64 nt, hsa
agcuuuuggcucucuguuucauuuuuuuccauuaagaaaaaaaaaaguccccuuuuaaaacaag

SEQ ID NO: 505067 - RNA, 64 nt, hsa
gucuuuucaaaaugagaggcuuucauugaagaaaagaaaaaaacaacaguuaaaagcuuuuggc

SEQ ID NO: 505068 - RNA, 64 nt, hsa
gcacugauaaacagaauacuuuuaaaacaccuugagaaaaaaagauaauacauacacaugaaca

SEQ ID NO: 505069 - RNA, 64 nt, hsa
guaagaauaaaaacuaccaaagugauauacagagagaaaaaaagacuuagagaagaggaagaga

SEQ ID NO: 505070 - RNA, 64 nt, hsa
aaucccgaguggagagauuagauacagaaaaagaagaaaaaaucaaugaacuugaagaguaaga

SEQ ID NO: 505071 - RNA, 64 nt, hsa
uuaugcaauuuuaaguauacacucagcaauaauuagaaaaaaaggagagagaaaagugauuuaa

SEQ ID NO: 505072 - RNA, 64 nt, hsa
aaaccaaagaaacaaugaucuacucaaacauuggagaaaaaaacugccagaggaggaguugcca

SEQ ID NO: 505073 - RNA, 64 nt, hsa
caauaauaauaauaauaauaaugaugauacucuaagaaaaaaaucucaacauacuucauuuaau

SEQ ID NO: 505074 - RNA, 64 nt, hsa
gccugggugaaaaagacaggcugugucuccaaaaagaaaaaaaaaagucaaauucaaauaucau

SEQ ID NO: 505075 - RNA, 64 nt, hsa
ggaaacgacccuguggcugugagaaagugaaaaaagaaaaaaaaaaaggcauuggcauuuucuu

SEQ ID NO: 505076 - RNA, 64 nt, hsa
uauuaggacagaauuaaugaugcuuaaagagaaaagaaaaaaagagagaagaaaaaggagagau

SEQ ID NO: 505077 - RNA, 64 nt, hsa
uacuuucaaugugaggaaugaaugauaaauuaagagaaaaaaauaucaggaaggucaauauaug

SEQ ID NO: 505078 - RNA, 64 nt, hsa
auaucagugucaaaagcccaagaaaagacaaaaaagaaaaaaacaauccccagggguucuauga

SEQ ID NO: 505079 - RNA, 64 nt, hsa
uuuagauguauagaaaaguaagaaaaucuuacuuagaaaaaagccccuugaaacuugcaggauu

SEQ ID NO: 505080 - RNA, 64 nt, hsa
aaauagcauucuuauucacuuuaugccgguauuuagaaaaaauaaauuauagcaaguaugauuu

SEQ ID NO: 505081 - RNA, 64 nt, hsa
aucacugaggaugaaacugacuuuugucuuuuggagaaaaaaaacuguacugcuuguucaagag

SEQ ID NO: 505082 - RNA, 64 nt, hsa
ggauauuuagaaauuuuguguauuauauggaaaaagaaaaaaagcuuaagucuguagucuuuau

SEQ ID NO: 505083 - RNA, 64 nt, hsa
caucuuuuuaaaacaaggaaaagggaaaaaaaggagaaaaaacgaugcaucaagcuuguuuguc

SEQ ID NO: 505084 - RNA, 64 nt, hsa
auagagauugauaagauuuagcaacugguguuggagaaaaaaagaaaagcaaaugaguguuuuc

SEQ ID NO: 505085 - RNA, 64 nt, hsa
aaaaaaaaaaaaaaaaaaaaaggaaaaaaaaaaaagaaaaaaaaccauauguguauuaggguga

SEQ ID NO: 505086 - RNA, 64 nt, hsa
auuugggaaguuuuacuuuuguuuucuucuaugaagaaaaaaaugcaggcugggcgcgguggcu

SEQ ID NO: 505087 - RNA, 64 nt, hsa
auuugaaauaaaaggaaauuuuagcaaggauuaaagaaaaaagcuaucagcuguauguuaagag

SEQ ID NO: 505088 - RNA, 64 nt, hsa
auauaguucugauuggguauuaauuacuugauuaagaaaaaauuaacauuauagauacucuggc

SEQ ID NO: 505089 - RNA, 64 nt, hsa
acuuugcagucagacauucgucaugggaaaguucagaaaaaaauaaaguccuuuuaagggaacu

SEQ ID NO: 505090 - RNA, 64 nt, hsa
uuugcguaaguacuuugauuauuuaauauuuguaagaaaaaacuuucauuuuccuacagaggaa

SEQ ID NO: 505091 - RNA, 64 nt, hsa
acaaaaaucuucaaagacugguuucuuuuuuaaaagaaaaaacuugaaagaacacuucuaagcc

SEQ ID NO: 505092 - RNA, 64 nt, hsa
uaacuaaaacauugaaaacagaacaaaugagaaaagaaaaaaaaccugccgauuaacaagacug

SEQ ID NO: 505093 - RNA, 64 nt, hsa
ccauaaucugcaacuucauuuucccccauagaagagaaaaaagagcaccaccauuauuaccacc

SEQ ID NO: 505094 - RNA, 64 nt, hsa
caauucauuugcaaauugcaauaaaacacauuuuagaaaaaaggaaccuucaauuauuagcuuu

SEQ ID NO: 505095 - RNA, 64 nt, hsa
ugguaauuauauauuuauuauuuagcaaaacugaagaaaaaaagcacagaauuguuucaacaga

SEQ ID NO: 505096 - RNA, 64 nt, hsa
uuuaauuuacuauuucagauuuuuaaaauaguauagaaaaaaguaggagugauagagaacaaaa

SEQ ID NO: 505097 - RNA, 64 nt, hsa
uuauauuugucacuuuaaaaaauccauuucuuuuagaaaaaauuagggugauaggauauucauu

SEQ ID NO: 505098 - RNA, 64 nt, hsa
ucaauacaauuguaauguagaaauauaagaauuuagaaaaaaguaaacuugccauuugguuaag

SEQ ID NO: 505099 - RNA, 64 nt, hsa
uccaugcaacuaugagucucuaaaucucucuguaagaaaaaaauuucaaaguaaagauuuuacu

SEQ ID NO: 505100 - RNA, 61 nt, hsa
ccaaagucggaaucuacugaacaaucagaaaagaaaaaaauguaaugcaaauuuuaagaaa

SEQ ID NO: 505101 - RNA, 64 nt, hsa
auuccacguuuggauaugcucauuuaauuucuacagaaaaaauuuuaaauuauuucacauuagc

SEQ ID NO: 505102 - RNA, 64 nt, hsa
guauagcuuacucuaccugcagacagaaaaugaaagaaaaaaauggacuugccuagaauaauau

SEQ ID NO: 505103 - RNA, 64 nt, hsa
ucuugcauccagaaaggccagauuuuaccuaccaagaaaaaaagauauuuuuccagagaguuag

SEQ ID NO: 505104 - RNA, 64 nt, hsa
guguuaaaacaugaaaaugcuggugagcugagguagaaaaaaaacaagaaaaaaauuuuaaaaa

SEQ ID NO: 505105 - RNA, 64 nt, hsa
gaaaaugcuggugagcugagguagaaaaaaaacaagaaaaaaauuuuaaaaauagcguuaaaau

SEQ ID NO: 505106 - RNA, 64 nt, hsa
uaaauggagauaaaacuuguauuuaguauguaauagaaaaaauucuguuauucgcagauuguua

SEQ ID NO: 505107 - RNA, 64 nt, hsa
aaugugucucugguacagaauaguugauauuaacagaaaaaaaaaaaucuguagcuucaugaau

SEQ ID NO: 505108 - RNA, 64 nt, hsa
aacuauauuucaaaugaauuuaaauaucuuuuaaagaaaaaaacaccuaaaaauaaaucuuaac

SEQ ID NO: 505109 - RNA, 64 nt, hsa
aacuggacaccuuuuauuugaagaaacaaacugaagaaaaaaugcuuccuuaagugcugacagc

SEQ ID NO: 505110 - RNA, 64 nt, hsa
cucaugggaaaguguucacaccauauuauuaaagagaaaaaacagauuauaaagcaauaugcau

SEQ ID NO: 505111 - RNA, 64 nt, hsa
uaaagcaauaugcauacaauguaguaguucuguaagaaaaaaguauuaugugcauuuuaacugg

SEQ ID NO: 505112 - RNA, 64 nt, hsa
auuauguaaaaaacaaaacuacaacaacaaaaaaagaaaaaaguuaaaaaagaaaaaaacacca

SEQ ID NO: 505113 - RNA, 64 nt, hsa
aacuacaacaacaaaaaaagaaaaaaguuaaaaaagaaaaaaacaccaaaaaacaaaaacaaac

SEQ ID NO: 505114 - RNA, 64 nt, hsa
acagugggguuuaguacuccaaaugaacucuuaaagaaaaaaacuaaucuuggcauccuaucac

SEQ ID NO: 505115 - RNA, 64 nt, hsa
aaguuaacuguaauuacuguauuuugugggacaaagaaaaaaggacuccaguauuuguggccug

SEQ ID NO: 505116 - RNA, 64 nt, hsa
aaaaaguuuuauuuuucuaaaaaaagaaaaaagaagaaaaaauuuaaaggguguacuuauaucc

SEQ ID NO: 505117 - RNA, 64 nt, hsa
uuguacaaaaaaaaaguuuuauuuuucuaaaaaaagaaaaaagaagaaaaaauuuaaagggugu

SEQ ID NO: 505118 - RNA, 64 nt, hsa
uuauaucaaaggugcaucgugaccaaauuguuuaagaaaaaaaaacaaaaaaaacaaaaucuag

SEQ ID NO: 505119 - RNA, 64 nt, hsa
cugcuaagcuguuaaauguauuuauaguaaaggaagaaaaaaagacugucauuuccuuauaagu

SEQ ID NO: 505120 - RNA, 64 nt, hsa
auuaauaacugaauaaaaaauaaauaaaauggauagaaaaaaacuaaaguugaaaauacauucu

SEQ ID NO: 505121 - RNA, 64 nt, hsa
auaugcuccuagagaggagaaaggggugauugaaagaaaaaaaaauacuuaaauauuuguaauu

SEQ ID NO: 505122 - RNA, 64 nt, hsa
ugcauggauuccuuugaagaaaaaaaagaaaaagagaaaaaaaucacaaaaacaaacuuuuuuu

SEQ ID NO: 505123 - RNA, 64 nt, hsa
aaauuucugauccacaaugcauggauuccuuugaagaaaaaaaagaaaaagagaaaaaaaucac

SEQ ID NO: 505124 - RNA, 64 nt, hsa
aagauaaaugugaagucugaguaagguugcucucagaaaaaaaaaaaaagcauauauauauaua

SEQ ID NO: 505125 - RNA, 64 nt, hsa
gguguuguguaaugcauaaugcuuucucaccaacagaaaaaaggaaaaaaauuguuuucaguua

SEQ ID NO: 505126 - RNA, 64 nt, hsa
auguaccuuuuuguuagugaauuuggaaauaaaaagaaaaaaaaaacaaaaacaaacaggcugc

SEQ ID NO: 505127 - RNA, 64 nt, hsa
agaaaaaaagugcuuaauauuguuauugcuuugcagaaaaaaaaaaaaucacauuucugaccug

SEQ ID NO: 505128 - RNA, 64 nt, hsa
aaggggauugcuacaccauguagaaaaaguauguagaaaaaaagugcuuaauauuguuauugcu

SEQ ID NO: 505129 - RNA, 64 nt, hsa
aauaaucgagaaugccugggcauuuuacaaaacaagaaaaaaaauacccuuuucuuuuccuuga

SEQ ID NO: 505130 - RNA, 64 nt, hsa
uguauccagaaaagcuuuaagcaguuaaagaaacagaaaaaaaccgacacuuugucgacacuga

SEQ ID NO: 505131 - RNA, 64 nt, hsa
uguuauuagaagaaaaguacuguacugaaaauucagaaaaaaaaucucaaccuuaugccaaaau

SEQ ID NO: 505132 - RNA, 64 nt, hsa
aguugugaaaaaggaagagaaucauuaaagaaaaagaaaaaagauuuuaagaccguugaaauca

SEQ ID NO: 505133 - RNA, 64 nt, hsa
aauacaaaagcccacugauacuaauuauauaaugagaaaaaaauguauccaacuaggacacaua

SEQ ID NO: 505134 - RNA, 64 nt, hsa
auuaucugaagacacaaaccugacaggagggagaagaaaaaacaaaacacuugaaccaagaaac

SEQ ID NO: 505135 - RNA, 64 nt, hsa
aguaugcccagaagcuuuccuucauaaaauagaaagaaaaaaacauuuggcuuauuuuucacug

SEQ ID NO: 505136 - RNA, 64 nt, hsa
auuaauaauccaacuuuaauaguauacauuuaaaagaaaaaaaacaaaagcccuggaaguugag

SEQ ID NO: 505137 - RNA, 64 nt, hsa
cagggcuugucuggaucagcaccaacgauuuuaaagaaaaaaggaagaguuucuuagaugagua

SEQ ID NO: 505138 - RNA, 64 nt, hsa
gggcuuaggggauuggaacugggguuuggcugaaagaaaaaaaaaaaaauguaacugaugaauc

SEQ ID NO: 505139 - RNA, 64 nt, hsa
aggcccaggacacuugucagaaggaugcaaaaaaagaaaaaaguacauccacccucuuaauccc

SEQ ID NO: 505140 - RNA, 64 nt, hsa
guuuuguuucuguuguuguucaaaugcaaaaaaaagaaaaaaaaagaaaaaaaaaggugacuca

SEQ ID NO: 505141 - RNA, 64 nt, hsa
uguuguuguucaaaugcaaaaaaaagaaaaaaaaagaaaaaaaaaggugacucacauuguuaca

SEQ ID NO: 505142 - RNA, 64 nt, hsa
acaaaaauaggugcaaaugauggggggcaauagaagaaaaaauuugcauuuuggaaaauugggu

SEQ ID NO: 505143 - RNA, 64 nt, hsa
gccaacaugaugaaaccccgucucuaccaaaaauagaaaaaaauauagccgggccugguggcgc

SEQ ID NO: 505144 - RNA, 54 nt, hsa
ggaugaaauugucaguguaaaaccagaaaaaaugcagcucuucuagaauuguuu

SEQ ID NO: 505145 - RNA, 64 nt, hsa
ucaguaagauuccuguaagaaauacugcuuuuuaagaaaaaaaauaacaugcugaggggugacc

SEQ ID NO: 505146 - RNA, 64 nt, hsa
aaaaaaaaaaaaaaaaaaaaaaaaaaaagaaaaaagaaaaaaaaaauccaaaagagagaagagu

SEQ ID NO: 505147 - RNA, 64 nt, hsa
aaaagccaaaaaaaaaaaaaaaaaaaaaaaaaaaagaaaaaagaaaaaaaaaauccaaaagaga

SEQ ID NO: 505148 - RNA, 64 nt, hsa
cuuauuuuguauugaaacuuuuaaacaauacugaagaaaaaaaaacuuuuccgacaucuguucu

SEQ ID NO: 505149 - RNA, 64 nt, hsa
guuauacaaaaaucuagaaauaauagauuuguacagaaaaaaaugauaauaaaugagaacacaa

SEQ ID NO: 505150 - RNA, 64 nt, hsa
uuucuuacgaauauaccaacauccugaaaguuaaagaaaaaaaucuaauguaugaaugugacuc

SEQ ID NO: 505151 - RNA, 64 nt, hsa
accuaaaaauaauucucuuguauuuuggagaugaagaaaaaagucauucaccugggagggauuu

SEQ ID NO: 505152 - RNA, 64 nt, hsa
uauuuacacuaauuuuuuuaucuuuauugcuaccagaaaaaaaugcgaacgaaugcauugcuuu

SEQ ID NO: 505153 - RNA, 64 nt, hsa
ugauagucuugaauauuuuauuuuuuuaaugaaaagaaaaaacaagaaaguuauguuucauaau

SEQ ID NO: 505154 - RNA, 64 nt, hsa
augcuuugauaucugguucagacuaucaucaggaagaaaaaaaaaucccacaguaccugaaaug

SEQ ID NO: 505155 - RNA, 64 nt, hsa
caguaacccagcugcaauaccugucuguaauaugagaaaaaaaaaaugaaucuauuuaaucauu

SEQ ID NO: 505156 - RNA, 64 nt, hsa
cuuccuuauauuuuuuuccucaacaguuuuaaaaagaaaaaaaggucuauuuuuuuuucuccua

SEQ ID NO: 505157 - RNA, 64 nt, hsa
aauuauauucuuggccaauuuuguccaacggacaagaaaaaagcaaagucaacgacaccauuau

SEQ ID NO: 505158 - RNA, 64 nt, hsa
cuuuguuuauugaaaaaaaaagaaaaagaaagcaagaaaaaaagauacuauggggucaagugua

SEQ ID NO: 505159 - RNA, 64 nt, hsa
uugucaguuuugagggggacauguguuaaaucacagaaaaaaauggugccuucuucugcguuug

SEQ ID NO: 505160 - RNA, 64 nt, hsa
caaggaaggacagaggguuuugauuuuaaaaagaagaaaaaaaaaccuuauuuuuucuuucuug

SEQ ID NO: 505161 - RNA, 64 nt, hsa
uggacuuuguaauuauuuuuuuagcaguaauuaaagaaaaaaguccucugugaggaauauucuc

SEQ ID NO: 505162 - RNA, 64 nt, hsa
guauuuuuguacagauuugcuuucucuuacaaaaagaaaaaaaaaauccuguuguauuaacauu

SEQ ID NO: 505163 - RNA, 64 nt, hsa
caaauugauaguuguucuagcagugaagagauaaagaaaaaaaaguacaaccaaaugccaguca

SEQ ID NO: 505164 - RNA, 64 nt, hsa
aggaaacauguaaugauaggcggacucccagcacagaaaaaaagguagaucugaaugcugaucc

SEQ ID NO: 505165 - RNA, 64 nt, hsa
ucgagcacuuuucuaacuaaugagcucugugguaagaaaaaaugaacucuuucaauugagauua

SEQ ID NO: 505166 - RNA, 64 nt, hsa
uuuuuucaguguagcugaaccuauguuguaaaauagaaaaaaauuuuuauaaucaucaaaaugu

SEQ ID NO: 505167 - RNA, 64 nt, hsa
cuucucauauauuguguuuuuuuuuuuuuuuccuagaaaaaauauuuaaagcauuguuugacag

SEQ ID NO: 505168 - RNA, 64 nt, hsa
ggaguggggugagagcuaaacauugcacagggaaagaaaaaaaauaacugcacugacuuuauau

SEQ ID NO: 505169 - RNA, 64 nt, hsa
uugcaaguuuaauuugauuuauuucagagaaaauagaaaaaacaauguuagaagguuauuuaaa

SEQ ID NO: 505170 - RNA, 64 nt, hsa
gauacauaaucuacaauaagggucuuagugcuuuagaaaaaaguuaaaauuggaagucauuaaa

SEQ ID NO: 505171 - RNA, 64 nt, hsa
gaaacuuugcuaguuaaaaaaaaaagaaaaaaaaagaaaaaaaaucccuuucuuguaaacuuac

SEQ ID NO: 505172 - RNA, 64 nt, hsa
aaguauaauagaaacuuugcuaguuaaaaaaaaaagaaaaaaaaagaaaaaaaaucccuuucuu

SEQ ID NO: 505173 - RNA, 64 nt, hsa
aaagagcugcagaguauuuauaaaacugucuuuuagaaaaaaaacaagcaagaagaccauuuga

SEQ ID NO: 505174 - RNA, 64 nt, hsa
aaguuauuaaauuaauuauauguuuaaaaguuaaagaaaaaagagcugcagaguauuuauaaaa

SEQ ID NO: 505175 - RNA, 64 nt, hsa
uuagagggaacuaacauuuuaggaaugcuuauucagaaaaaaauccuagaguugauucauuguu

SEQ ID NO: 505176 - RNA, 64 nt, hsa
uauguauguugcauuuuauccauaagaaauaaagagaaaaaaacuaaaaacauuguaugagaau

SEQ ID NO: 505177 - RNA, 64 nt, hsa
uaugagagaaaaggaaaaaggaaucaaagguggaagaaaaaaaaagccaaauucuguuuacggu

SEQ ID NO: 505178 - RNA, 64 nt, hsa
cgccuaaugaacaagcacaguuuuucaauggugaagaaaaaagcaccagacuuuuuuucuuuuu

SEQ ID NO: 505179 - RNA, 64 nt, hsa
guuccauuuugaggaauggggaaggcuauucuaaagaaaaaaaugggauuuguuuucucggcag

SEQ ID NO: 505180 - RNA, 64 nt, hsa
gcuaagaauaucaaguauuucucuggcucuugacagaaaaaaaucaguugacuuaacccuuugc

SEQ ID NO: 505181 - RNA, 64 nt, hsa
cuugguucagaagccuaacagauugcuagacaagagaaaaaacuugaagaaaaaagaagcuuaa

SEQ ID NO: 505182 - RNA, 64 nt, hsa
ccuaacagauugcuagacaagagaaaaaacuugaagaaaaaagaagcuuaauuucaugcuucau

SEQ ID NO: 505183 - RNA, 64 nt, hsa
ucuaaaaacaucugcauaguuuucaacuggaaaaagaaaaaacuuaaaaaugggauguccuaaa

SEQ ID NO: 505184 - RNA, 64 nt, hsa
cuggggccuccuuccauugcaucauuuuaaaggaagaaaaaagcagcuaaaaaagaguggacca

SEQ ID NO: 505185 - RNA, 64 nt, hsa
caaagggaaauaucauuuauuuuuuacauuauuaagaaaaaaagauuuauuuauuuaagacagu

SEQ ID NO: 505186 - RNA, 64 nt, hsa
ugauguaccaugaaacaaagcugcaggcuguuuaagaaaaaauaacacacauauaaacaucaca

SEQ ID NO: 505187 - RNA, 64 nt, hsa
ccagaaaggagccacagcugacgccaaaaagaaaagaaaaaagauauauauauauauauauaua

SEQ ID NO: 505188 - RNA, 64 nt, hsa
guguuccuucagggaaacuggucuugaaaaagcaagaaaaaaaagcaaaaaaaaaaaaaaaaaa

SEQ ID NO: 505189 - RNA, 64 nt, hsa
gguuuuguuuuguuuucauuuuuccaaaaaaaaaagaaaaaaaaauagaaaaaaaaggaguaaa

SEQ ID NO: 505190 - RNA, 64 nt, hsa
uuuucauuuuuccaaaaaaaaaagaaaaaaaaauagaaaaaaaaggaguaaaaggggcggguuu

SEQ ID NO: 505191 - RNA, 64 nt, hsa
cuuucuauaaauacauauuguuuaaaaaaaagcaagaaaaaaaggaaaacaaaggaaaauaucc

SEQ ID NO: 505192 - RNA, 64 nt, hsa
gaaucugcuucuuaggaguggguugagcugauagagaaaaaacggccuucagcccaggcuggga

SEQ ID NO: 505193 - RNA, 64 nt, hsa
uuuuuguggguguugcaugcaaaucaaguggacaagaaaaaauaacaaaacaaaaaacaagaaa

SEQ ID NO: 505194 - RNA, 64 nt, hsa
aaguggacaagaaaaaauaacaaaacaaaaaacaagaaaaaaaaaacacaaaaccccguaaaau

SEQ ID NO: 505195 - RNA, 64 nt, hsa
ugccucaaagacucuuguccucuugucccuccugagaaaaaagaaaacgaaaagugggguuuuu

SEQ ID NO: 505196 - RNA, 64 nt, hsa
uuaauuguaacauuuuuagaaaaagaacaaaaaaagaaaaaaaaaagaaagaaacacagcaacu

SEQ ID NO: 505197 - RNA, 64 nt, hsa
aagggaccuugcagggaccucucccuccaaaaaaagaaaaaaagaaaaagaaagaaaaaauaaa

SEQ ID NO: 505198 - RNA, 64 nt, hsa
cucucccuccaaaaaaagaaaaaaagaaaaagaaagaaaaaauaaaugaggaaacguguugcag

SEQ ID NO: 505199 - RNA, 64 nt, hsa
gagggcaacaggagauguggggacguguuaggagagaaaaaaaaaaaaacaaaaauauauaugg

SEQ ID NO: 505200 - RNA, 64 nt, hsa
gagaguuuuccuaucuuuguauguuaagagauuaagaaaaaaaaauucuauuuuuguuguaaug

SEQ ID NO: 505201 - RNA, 64 nt, hsa
aaauuccaaugucacaaaagcaauaaaacaaacuagaaaaaaaaaagguuuuacaaaaugaaag

SEQ ID NO: 505202 - RNA, 64 nt, hsa
aacagaaacccgagaaagagagagacagagagagagaaaaaaaaucacccaccacccccccaaa

SEQ ID NO: 505203 - RNA, 64 nt, hsa
caagagugagacuuagucucaaaaaaaaaaaaaaagaaaaaaaaaucagggauauaguucauau

SEQ ID NO: 505204 - RNA, 64 nt, hsa
gccucacccuaucagucaguagagagagauguccagaaaaaauaucuuucaggaaaguucuccc

SEQ ID NO: 505205 - RNA, 64 nt, hsa
caaaacaaaaggcucauaacaacaagaacguuucagaaaaaaacaaaaaguuuuaaaaaaauug

SEQ ID NO: 505206 - RNA, 64 nt, hsa
agaaaaaaaaaagacaaaaaaaaaaaaaaagaaaagaaaaaaaaucucaucacuugaagccacc

SEQ ID NO: 505207 - RNA, 64 nt, hsa
ccccauugcuguaaauauuucaacgaaauggaaaagaaaaaaaaaagacaaaaaaaaaaaaaaa

SEQ ID NO: 505208 - RNA, 64 nt, hsa
auuuucuggggcuccucacauagcuacccaaaagagaaaaaaaauuaagacaagccuggcaaca

SEQ ID NO: 505209 - RNA, 64 nt, hsa
uugcaaaggucuuuuuaaaccaguuuagauuucaagaaaaaauaaauggaaaucaucgaaaauu

SEQ ID NO: 505210 - RNA, 64 nt, hsa
cagacaaauugaagaacuggugggauuuuuuucaagaaaaaaaauuauauaauaacuauaaucc

SEQ ID NO: 505211 - RNA, 64 nt, hsa
cagcagcaagacacgcacagucaaccauuuuccgagaaaaaaagaaaauuccccacuuggaaag

SEQ ID NO: 505212 - RNA, 64 nt, hsa
ugggguuuuguaauuuagcagaacucuuacugguagaaaaaauagaccugaauuauguguaacu

SEQ ID NO: 505213 - RNA, 64 nt, hsa
guggaaucuacuuucauuguuaacacugagcuaaagaaaaaaagccguguguuuuaugaaugac

SEQ ID NO: 505214 - RNA, 64 nt, hsa
auuuaugcacugauuuaaaacaaaccaaaaaaaaagaaaaaaacaaaaaaaaaaaucccuccuu

SEQ ID NO: 505215 - RNA, 64 nt, hsa
cagggagaagagaaggcauuaguaagaaaaaaauagaaaaaaauaugaacagacucagcuuugg

SEQ ID NO: 505216 - RNA, 64 nt, hsa
gccacaggggcagggagaagagaaggcauuaguaagaaaaaaauagaaaaaaauaugaacagac

SEQ ID NO: 505217 - RNA, 64 nt, hsa
agugccaagucagaaaguguguauuaccuuguaaagaaaaaaauuacaaagcagggguuuagag

SEQ ID NO: 505218 - RNA, 64 nt, hsa
acguuucuuuguugagcugugucuugaaggcaaaagaaaaaaaauuucuacaguagucuuucuu

SEQ ID NO: 505219 - RNA, 64 nt, hsa
aagcuaagagagcuugcaaaaaaaaaaagaaaaaagaaaaaaaaaaaccacguuucuuuguuga

SEQ ID NO: 505220 - RNA, 64 nt, hsa
aaugcacaagcuaagagagcuugcaaaaaaaaaaagaaaaaagaaaaaaaaaaaccacguuucu

SEQ ID NO: 505221 - RNA, 64 nt, hsa
aguguuuacuuccugcagugaauuugaauaaaugagaaaaaaugcauugucucugguuugaaau

SEQ ID NO: 505222 - RNA, 64 nt, hsa
cguuguggaagguuuggagccuuagagguaugucagaaaaaauauguugguauucucccuuggg

SEQ ID NO: 505223 - RNA, 64 nt, hsa
aaauauaugcuuacauuuuucacuuuugcuaaaaagaaaaaaaaaagguguuuauuuuuaacuc

SEQ ID NO: 505224 - RNA, 64 nt, hsa
uuaaaguuucaaugaaaguuucuucuggaucuacagaaaaaauuuuuuuuuuucaaucuaaaaa

SEQ ID NO: 505225 - RNA, 64 nt, hsa
agccugggcaacagagcgagacucagucucaaaaagaaaaaagaaauuuauugcugaucacaag

SEQ ID NO: 505226 - RNA, 64 nt, hsa
agcagauaucauguaggaaagagaggauaaacaaagaaaaaagaaaaaaaaauaagcucauacc

SEQ ID NO: 505227 - RNA, 64 nt, hsa
aucauguaggaaagagaggauaaacaaagaaaaaagaaaaaaaaauaagcucauacccaaauuc

SEQ ID NO: 505228 - RNA, 64 nt, hsa
acauuuugaaugaguauggaaccuccaugggcucagaaaaaagaugcuaauauauuuaucucau

SEQ ID NO: 505229 - RNA, 64 nt, hsa
uguaagaaggcagggcaggggggcuuuuuacaggagaaaaaaaaaugacuuauaagagaaagag

SEQ ID NO: 505230 - RNA, 64 nt, hsa
uguuuuuuaaccuuuuguuccgccauuuaaaaaaagaaaaaaaaaaagcuuauguuucuuguca

SEQ ID NO: 505231 - RNA, 64 nt, hsa
ccccgccaccuguacucacccucacgcucuuugaagaaaaaaaaaaaaaucaccuuguguguug

SEQ ID NO: 505232 - RNA, 64 nt, hsa
agacaguuuccuucuggaguuccaaaugcaauauagaaaaaaaaacccugugacucuggauuuu

SEQ ID NO: 505233 - RNA, 64 nt, hsa
caagacuccuaccuugagaucuuagucuagguaaagaaaaaaaaaaaaaggucaugaaacacaa

SEQ ID NO: 505234 - RNA, 64 nt, hsa
cagccugggugacagagugagauccugucucugaagaaaaaaaaaaccugccuggcaagguccu

SEQ ID NO: 505235 - RNA, 64 nt, hsa
uaacaccuccaccagggggaaggcuggcacaaggagaaaaaaaaagcaagcaucagcgaauagu

SEQ ID NO: 505236 - RNA, 64 nt, hsa
auuaugcuagagcaauuagacacccauggcgaggagaaaaaagaaccucuacuuaaaccucaca

SEQ ID NO: 505237 - RNA, 64 nt, hsa
agcgaggcuaugacuuacuuaucucaauggcuaaagaaaaaauagugaaaauaccaaauacuga

SEQ ID NO: 505238 - RNA, 64 nt, hsa
aaagagaaaaaagaaaaaaaaugagaaaaaaguaagaaaaaaaaaaauccuguccuaggcuuuu

SEQ ID NO: 505239 - RNA, 64 nt, hsa
cuaucuauaaaaaagagaaaaaagaaaaaaaaugagaaaaaaguaagaaaaaaaaaaauccugu

SEQ ID NO: 505240 - RNA, 64 nt, hsa
aaaauauacuugcuaucuauaaaaaagagaaaaaagaaaaaaaaugagaaaaaaguaagaaaaa

SEQ ID NO: 505241 - RNA, 64 nt, hsa
augagaaaaaauauacuugcuaucuauaaaaaagagaaaaaagaaaaaaaaugagaaaaaagua

SEQ ID NO: 505242 - RNA, 64 nt, hsa
gaaagaaguuauagaaucuucauagaguucuaugagaaaaaauauacuugcuaucuauaaaaaa

SEQ ID NO: 505243 - RNA, 64 nt, hsa
uauagugauauaucaguguuugagagugaccucuagaaaaaagaaaaguguuuuuagaaaugcg

SEQ ID NO: 505244 - RNA, 64 nt, hsa
gugaguuuaaacaaaaaccacaaacagacaaacaagaaaaaaagcuuuuauugguguuuucacu

SEQ ID NO: 505245 - RNA, 64 nt, hsa
uuccucaaguuacuuuccuucauuuucuuaaaaaagaaaaaaaauuauuaaauguuucucacau

SEQ ID NO: 505246 - RNA, 64 nt, hsa
aaggucaguucaggaaagcuuaagcaucgaaaaaagaaaaaaagccaugauguacccuccgaga

SEQ ID NO: 505247 - RNA, 64 nt, hsa
aaucuuuggucuuaguuuucuagaaaaaaggaguagaaaaaacaauucuggcuuuauauuaaau

SEQ ID NO: 505248 - RNA, 64 nt, hsa
acacaauuucuucaaucuuuggucuuaguuuucuagaaaaaaggaguagaaaaaacaauucugg

SEQ ID NO: 505249 - RNA, 64 nt, hsa
cauuuuagacauucagacuaaaaauacaccguuuagaaaaaacaauuuuugaaaaagagauuuu

SEQ ID NO: 505250 - RNA, 64 nt, hsa
guaacacuaaucaauacgugaucucuguuacaaaagaaaaaagcaaguacaaguuccaacaugc

SEQ ID NO: 505251 - RNA, 64 nt, hsa
ugauuuagauacuucucccugagguggggauaaaagaaaaaaaaaaacaacuucuuuuuuucuu

SEQ ID NO: 505252 - RNA, 64 nt, hsa
aucccucuguuauugucggcaggcggugagggguagaaaaaaaacaaacaaacaaacagaaaaa

SEQ ID NO: 505253 - RNA, 64 nt, hsa
cggugagggguagaaaaaaaacaaacaaacaaacagaaaaaaaaaccaaaaaaaaccacccuga

SEQ ID NO: 505254 - RNA, 64 nt, hsa
guacaaaaaugcagacacuuaacaaaaagcaaacagaaaaaaaaguguggaauguguuguauuu

SEQ ID NO: 505255 - RNA, 64 nt, hsa
cagccugggcgacaagagcgagacucucucaaaaagaaaaaagaagacacaagagagguggcuu

SEQ ID NO: 505256 - RNA, 64 nt, hsa
cuuuuagggagagaacaauaccuaagauugucugagcuuccaucuuucucauauuuccuaagca

SEQ ID NO: 505257 - RNA, 64 nt, hsa
ugagugaguuaguacauauuaauccugguuguugagcuuccagacuaccccguccaaaguuuga

SEQ ID NO: 505258 - RNA, 64 nt, hsa
caagaccuguggcuacugguagagaauuggaauaagcuuccaacaauggacuguagagauuaau

SEQ ID NO: 505259 - RNA, 64 nt, hsa
augguguaaagccaacucgaggggaaucugaauaagcuuccaaaauuuuuuuuuuuaagaaaua

SEQ ID NO: 505260 - RNA, 64 nt, hsa
cacacccagaagaggccuuucccaucuggagagaagcuuccagaccagcccuucacacaccaca

SEQ ID NO: 505261 - RNA, 64 nt, hsa
cacagccaggagaggccuuuaccaccuggagagaagcuuccagaccagccccucacaccacagc

SEQ ID NO: 505262 - RNA, 64 nt, hsa
cacagccaggagaggccguuccugccuggagagaagcuuccagaccagcccuucacaccacagc

SEQ ID NO: 505263 - RNA, 64 nt, hsa
ucuguaguugguuuccuuccugugucccuuugcaagcuuccaggcgaucuaaggugucauuucu

SEQ ID NO: 505264 - RNA, 64 nt, hsa
uuuacacuagcuuguguuuugugcuacguauaccagcuuccaaaauuagcaucucauugagcca

SEQ ID NO: 505265 - RNA, 64 nt, hsa
cauuuuuuuuuucuuaaauaugaucaaggaaaauagcuuccagaauguggugguucugggcaac

SEQ ID NO: 505266 - RNA, 64 nt, hsa
gucccuguuucccuuguaucaagacaccuuccucagcuuccaugccuuuggaucuuccauguuc

SEQ ID NO: 505267 - RNA, 64 nt, hsa
ccuccagggaauggccuccaugaggggcagggccagcuuccaucccuucuccagcccuuggggc

SEQ ID NO: 505268 - RNA, 64 nt, hsa
uuucuguucagauuggcagugugcacuauuaaaaagcuuccaucucccggcugggcacgguggc

SEQ ID NO: 505269 - RNA, 64 nt, hsa
aaacucugucucaaaaauaauaauaauaaaaaaaagcuuccaucucccagcccuucuugcaagc

SEQ ID NO: 505270 - RNA, 64 nt, hsa
uaaaaucuuagcgguggaccugggagauuugagaagcuuccagaaacaguuuaaacaagccagc

SEQ ID NO: 505271 - RNA, 64 nt, hsa
gugccgcggccggaggaguuuuguuguugguuuuagcuuccaguggcuucuuucugcggggcau

SEQ ID NO: 505272 - RNA, 64 nt, hsa
ccccgaggcgugcuuccuuccugauugucucuagagcuuccaaguccugggaaugugcggggcc

SEQ ID NO: 505273 - RNA, 64 nt, hsa
cucuggucaggaacccucagggacccaggaacucagcuuccaaacaucugcaccuugaccggac

SEQ ID NO: 505274 - RNA, 64 nt, hsa
guuggccccaggaccugaucugaguucugcuggcagcuuccagaggauugccuuuuuugaggac

SEQ ID NO: 505275 - RNA, 64 nt, hsa
gaucucaggcgaugcuugugaugaagcauuuuuuagcuuccaccacuuaccaggaacugccugu

SEQ ID NO: 505276 - RNA, 64 nt, hsa
auggccgugcccgaugugcaccucccagaagugcagcuuccaaaagucccagagaugaagcucc

SEQ ID NO: 505277 - RNA, 64 nt, hsa
ccgaaagugccagagaugaaagucccugagaugaagcuuccaaaggugccugagaugaaacuuc

SEQ ID NO: 505278 - RNA, 64 nt, hsa
ccugaagugaagcuccccaaggcuccugaggucaagcuuccaaaagugcccgaggcagcccuuc

SEQ ID NO: 505279 - RNA, 64 nt, hsa
gauguuuaugauauggugucuuuuucuugaaacaagcuuccaagggcuagaaauaaaauagcca

SEQ ID NO: 505280 - RNA, 64 nt, hsa
cugcuguuccaucccagcuugaauuggugccacaagcuuccaaguuggcauuuuuucuagaacc

SEQ ID NO: 505281 - RNA, 64 nt, hsa
cauccucucccugcaguuuguccugggcacagacagcuuccaccugggcuacacggagaccggg

SEQ ID NO: 505282 - RNA, 64 nt, hsa
ccgccuucuauccagccggcacccuaugcucuacagcuuccagacaucucugcccaagcuuccu

SEQ ID NO: 505283 - RNA, 64 nt, hsa
cagaaugcaccagucaucagcuauucaguugguaagcuuccaggaaaaaggacaggcagaaaga

SEQ ID NO: 505284 - RNA, 64 nt, hsa
cuugauacuuguuuucaaaccaguauacaagauaagcuuccaggcugcauagaaggaggagagg

SEQ ID NO: 505285 - RNA, 64 nt, hsa; identical to SEQ ID NO: 87537

SEQ ID NO: 505286 - RNA, 64 nt, hsa; identical to SEQ ID NO: 87538

SEQ ID NO: 505287 - RNA, 64 nt, hsa; identical to SEQ ID NO: 87539

SEQ ID NO: 505288 - RNA, 64 nt, hsa; identical to SEQ ID NO: 87540

SEQ ID NO: 505289 - RNA, 64 nt, hsa; identical to SEQ ID NO: 87541

SEQ ID NO: 505290 - RNA, 64 nt, hsa; identical to SEQ ID NO: 87542

SEQ ID NO: 505291 - RNA, 64 nt, hsa; identical to SEQ ID NO: 87543

SEQ ID NO: 505292 - RNA, 64 nt, hsa; identical to SEQ ID NO: 87544

SEQ ID NO: 505293 - RNA, 64 nt, hsa; identical to SEQ ID NO: 87545

SEQ ID NO: 505294 - RNA, 64 nt, hsa; identical to SEQ ID NO: 87546

SEQ ID NO: 505295 - RNA, 64 nt, hsa; identical to SEQ ID NO: 87547

SEQ ID NO: 505296 - RNA, 64 nt, hsa; identical to SEQ ID NO: 87548

SEQ ID NO: 505297 - RNA, 64 nt, hsa; identical to SEQ ID NO: 87549

SEQ ID NO: 505298 - RNA, 64 nt, hsa; identical to SEQ ID NO: 87550

SEQ ID NO: 505299 - RNA, 64 nt, hsa; identical to SEQ ID NO: 87551

SEQ ID NO: 505300 - RNA, 64 nt, hsa; identical to SEQ ID NO: 87552

SEQ ID NO: 505301 - RNA, 64 nt, hsa; identical to SEQ ID NO: 87553

SEQ ID NO: 505302 - RNA, 64 nt, hsa; identical to SEQ ID NO: 87554

SEQ ID NO: 505303 - RNA, 64 nt, hsa; identical to SEQ ID NO: 87555

SEQ ID NO: 505304 - RNA, 64 nt, hsa; identical to SEQ ID NO: 87556

SEQ ID NO: 505305 - RNA, 64 nt, hsa; identical to SEQ ID NO: 87557

SEQ ID NO: 505306 - RNA, 64 nt, hsa; identical to SEQ ID NO: 87558

SEQ ID NO: 505307 - RNA, 64 nt, hsa; identical to SEQ ID NO: 87559

SEQ ID NO: 505308 - RNA, 64 nt, hsa; identical to SEQ ID NO: 87560

SEQ ID NO: 505309 - RNA, 64 nt, hsa; identical to SEQ ID NO: 87561

SEQ ID NO: 505310 - RNA, 64 nt, hsa; identical to SEQ ID NO: 87562

SEQ ID NO: 505311 - RNA, 64 nt, hsa; identical to SEQ ID NO: 87563

SEQ ID NO: 505312 - RNA, 64 nt, hsa; identical to SEQ ID NO: 87564

SEQ ID NO: 505313 - RNA, 64 nt, hsa; identical to SEQ ID NO: 87565

SEQ ID NO: 505314 - RNA, 64 nt, hsa; identical to SEQ ID NO: 87566

SEQ ID NO: 505315 - RNA, 64 nt, hsa; identical to SEQ ID NO: 87567

SEQ ID NO: 505316 - RNA, 64 nt, hsa; identical to SEQ ID NO: 87568

SEQ ID NO: 505317 - RNA, 64 nt, hsa; identical to SEQ ID NO: 87569

SEQ ID NO: 505318 - RNA, 64 nt, hsa; identical to SEQ ID NO: 87570

SEQ ID NO: 505319 - RNA, 64 nt, hsa; identical to SEQ ID NO: 87571

SEQ ID NO: 505320 - RNA, 64 nt, hsa; identical to SEQ ID NO: 87572

SEQ ID NO: 505321 - RNA, 64 nt, hsa; identical to SEQ ID NO: 87573

SEQ ID NO: 505322 - RNA, 64 nt, hsa; identical to SEQ ID NO: 87574

SEQ ID NO: 505323 - RNA, 64 nt, hsa; identical to SEQ ID NO: 87575

SEQ ID NO: 505324 - RNA, 64 nt, hsa; identical to SEQ ID NO: 87576

SEQ ID NO: 505325 - RNA, 64 nt, hsa; identical to SEQ ID NO: 87577

SEQ ID NO: 505326 - RNA, 64 nt, hsa; identical to SEQ ID NO: 87578

SEQ ID NO: 505327 - RNA, 64 nt, hsa; identical to SEQ ID NO: 87579

SEQ ID NO: 505328 - RNA, 64 nt, hsa; identical to SEQ ID NO: 87580

SEQ ID NO: 505329 - RNA, 62 nt, hsa; identical to SEQ ID NO: 87581

SEQ ID NO: 505330 - RNA, 64 nt, hsa; identical to SEQ ID NO: 87582

SEQ ID NO: 505331 - RNA, 64 nt, hsa; identical to SEQ ID NO: 87583

SEQ ID NO: 505332 - RNA, 64 nt, hsa; identical to SEQ ID NO: 87584

SEQ ID NO: 505333 - RNA, 64 nt, hsa; identical to SEQ ID NO: 87585

SEQ ID NO: 505334 - RNA, 64 nt, hsa; identical to SEQ ID NO: 87586

SEQ ID NO: 505335 - RNA, 64 nt, hsa; identical to SEQ ID NO: 87587

SEQ ID NO: 505336 - RNA, 64 nt, hsa; identical to SEQ ID NO: 87588

SEQ ID NO: 505337 - RNA, 64 nt, hsa; identical to SEQ ID NO: 87589

SEQ ID NO: 505338 - RNA, 64 nt, hsa; identical to SEQ ID NO: 87590

SEQ ID NO: 505339 - RNA, 64 nt, hsa; identical to SEQ ID NO: 87591

SEQ ID NO: 505340 - RNA, 64 nt, hsa; identical to SEQ ID NO: 87592

SEQ ID NO: 505341 - RNA, 64 nt, hsa; identical to SEQ ID NO: 87593

SEQ ID NO: 505342 - RNA, 64 nt, hsa; identical to SEQ ID NO: 87594

SEQ ID NO: 505343 - RNA, 64 nt, hsa; identical to SEQ ID NO: 87595

SEQ ID NO: 505344 - RNA, 64 nt, hsa; identical to SEQ ID NO: 87596

SEQ ID NO: 505345 - RNA, 64 nt, hsa; identical to SEQ ID NO: 87597

SEQ ID NO: 505346 - RNA, 64 nt, hsa; identical to SEQ ID NO: 87598

SEQ ID NO: 505347 - RNA, 50 nt, hsa; identical to SEQ ID NO: 87599

SEQ ID NO: 505348 - RNA, 64 nt, hsa; identical to SEQ ID NO: 87600

SEQ ID NO: 505349 - RNA, 64 nt, hsa; identical to SEQ ID NO: 87601

SEQ ID NO: 505350 - RNA, 64 nt, hsa; identical to SEQ ID NO: 87602

SEQ ID NO: 505351 - RNA, 64 nt, hsa; identical to SEQ ID NO: 87603

SEQ ID NO: 505352 - RNA, 64 nt, hsa; identical to SEQ ID NO: 87604

SEQ ID NO: 505353 - RNA, 64 nt, hsa; identical to SEQ ID NO: 87605

SEQ ID NO: 505354 - RNA, 56 nt, hsa; identical to SEQ ID NO: 87606

SEQ ID NO: 505355 - RNA, 64 nt, hsa; identical to SEQ ID NO: 87607

SEQ ID NO: 505356 - RNA, 64 nt, hsa; identical to SEQ ID NO: 87608

SEQ ID NO: 505357 - RNA, 64 nt, hsa; identical to SEQ ID NO: 87609

SEQ ID NO: 505358 - RNA, 64 nt, hsa; identical to SEQ ID NO: 87610

SEQ ID NO: 505359 - RNA, 64 nt, hsa; identical to SEQ ID NO: 87611

SEQ ID NO: 505360 - RNA, 64 nt, hsa; identical to SEQ ID NO: 87612

SEQ ID NO: 505361 - RNA, 55 nt, hsa; identical to SEQ ID NO: 87613

SEQ ID NO: 505362 - RNA, 64 nt, hsa; identical to SEQ ID NO: 87614

SEQ ID NO: 505363 - RNA, 64 nt, hsa; identical to SEQ ID NO: 87615

SEQ ID NO: 505364 - RNA, 64 nt, hsa; identical to SEQ ID NO: 87616

SEQ ID NO: 505365 - RNA, 64 nt, hsa; identical to SEQ ID NO: 87617

SEQ ID NO: 505366 - RNA, 64 nt, hsa; identical to SEQ ID NO: 87618

SEQ ID NO: 505367 - RNA, 64 nt, hsa; identical to SEQ ID NO: 87619

SEQ ID NO: 505368 - RNA, 64 nt, hsa; identical to SEQ ID NO: 87620

SEQ ID NO: 505369 - RNA, 64 nt, hsa; identical to SEQ ID NO: 87621

SEQ ID NO: 505370 - RNA, 64 nt, hsa; identical to SEQ ID NO: 87622

SEQ ID NO: 505371 - RNA, 64 nt, hsa; identical to SEQ ID NO: 87623

SEQ ID NO: 505372 - RNA, 64 nt, hsa; identical to SEQ ID NO: 87624

SEQ ID NO: 505373 - RNA, 64 nt, hsa; identical to SEQ ID NO: 87625

SEQ ID NO: 505374 - RNA, 64 nt, hsa; identical to SEQ ID NO: 87626

SEQ ID NO: 505375 - RNA, 64 nt, hsa; identical to SEQ ID NO: 87627

SEQ ID NO: 505376 - RNA, 64 nt, hsa; identical to SEQ ID NO: 87628

SEQ ID NO: 505377 - RNA, 64 nt, hsa; identical to SEQ ID NO: 87629

SEQ ID NO: 505378 - RNA, 64 nt, hsa; identical to SEQ ID NO: 87630

SEQ ID NO: 505379 - RNA, 64 nt, hsa; identical to SEQ ID NO: 87631

SEQ ID NO: 505380 - RNA, 64 nt, hsa; identical to SEQ ID NO: 87632

SEQ ID NO: 505381 - RNA, 64 nt, hsa; identical to SEQ ID NO: 87633

SEQ ID NO: 505382 - RNA, 64 nt, hsa; identical to SEQ ID NO: 87634

SEQ ID NO: 505383 - RNA, 64 nt, hsa; identical to SEQ ID NO: 87635

SEQ ID NO: 505384 - RNA, 64 nt, hsa; identical to SEQ ID NO: 87636

SEQ ID NO: 505385 - RNA, 64 nt, hsa; identical to SEQ ID NO: 87637

SEQ ID NO: 505386 - RNA, 64 nt, hsa; identical to SEQ ID NO: 87638

SEQ ID NO: 505387 - RNA, 64 nt, hsa; identical to SEQ ID NO: 87639

SEQ ID NO: 505388 - RNA, 64 nt, hsa; identical to SEQ ID NO: 87640

SEQ ID NO: 505389 - RNA, 64 nt, hsa; identical to SEQ ID NO: 87641

SEQ ID NO: 505390 - RNA, 64 nt, hsa; identical to SEQ ID NO: 87642

SEQ ID NO: 505391 - RNA, 64 nt, hsa; identical to SEQ ID NO: 87643

SEQ ID NO: 505392 - RNA, 64 nt, hsa; identical to SEQ ID NO: 87644

SEQ ID NO: 505393 - RNA, 64 nt, hsa; identical to SEQ ID NO: 87645

SEQ ID NO: 505394 - RNA, 64 nt, hsa; identical to SEQ ID NO: 87646

SEQ ID NO: 505395 - RNA, 64 nt, hsa; identical to SEQ ID NO: 87647

SEQ ID NO: 505396 - RNA, 64 nt, hsa; identical to SEQ ID NO: 87648

SEQ ID NO: 505397 - RNA, 64 nt, hsa; identical to SEQ ID NO: 87649

SEQ ID NO: 505398 - RNA, 64 nt, hsa; identical to SEQ ID NO: 87650

SEQ ID NO: 505399 - RNA, 64 nt, hsa; identical to SEQ ID NO: 87651

SEQ ID NO: 505400 - RNA, 64 nt, hsa; identical to SEQ ID NO: 87652

SEQ ID NO: 505401 - RNA, 64 nt, hsa; identical to SEQ ID NO: 87653

SEQ ID NO: 505402 - RNA, 64 nt, hsa; identical to SEQ ID NO: 87654

SEQ ID NO: 505403 - RNA, 64 nt, hsa; identical to SEQ ID NO: 87655

SEQ ID NO: 505404 - RNA, 64 nt, hsa; identical to SEQ ID NO: 87656

SEQ ID NO: 505405 - RNA, 64 nt, hsa; identical to SEQ ID NO: 87657

SEQ ID NO: 505406 - RNA, 64 nt, hsa; identical to SEQ ID NO: 87658

SEQ ID NO: 505407 - RNA, 64 nt, hsa; identical to SEQ ID NO: 87659

SEQ ID NO: 505408 - RNA, 64 nt, hsa; identical to SEQ ID NO: 87659

SEQ ID NO: 505409 - RNA, 64 nt, hsa; identical to SEQ ID NO: 87661

SEQ ID NO: 505410 - RNA, 64 nt, hsa; identical to SEQ ID NO: 87662

SEQ ID NO: 505411 - RNA, 64 nt, hsa; identical to SEQ ID NO: 87661

SEQ ID NO: 505412 - RNA, 64 nt, hsa; identical to SEQ ID NO: 87659

SEQ ID NO: 505413 - RNA, 64 nt, hsa; identical to SEQ ID NO: 87665

SEQ ID NO: 505414 - RNA, 64 nt, hsa; identical to SEQ ID NO: 87666

SEQ ID NO: 505415 - RNA, 64 nt, hsa; identical to SEQ ID NO: 87667

SEQ ID NO: 505416 - RNA, 64 nt, hsa; identical to SEQ ID NO: 87668

SEQ ID NO: 505417 - RNA, 64 nt, hsa; identical to SEQ ID NO: 87669

SEQ ID NO: 505418 - RNA, 63 nt, hsa; identical to SEQ ID NO: 87670

SEQ ID NO: 505419 - RNA, 64 nt, hsa; identical to SEQ ID NO: 87671

SEQ ID NO: 505420 - RNA, 64 nt, hsa; identical to SEQ ID NO: 87672

SEQ ID NO: 505421 - RNA, 64 nt, hsa; identical to SEQ ID NO: 87673

SEQ ID NO: 505422 - RNA, 64 nt, hsa; identical to SEQ ID NO: 87674

SEQ ID NO: 505423 - RNA, 64 nt, hsa; identical to SEQ ID NO: 87675

SEQ ID NO: 505424 - RNA, 64 nt, hsa; identical to SEQ ID NO: 87676

SEQ ID NO: 505425 - RNA, 64 nt, hsa; identical to SEQ ID NO: 87677

SEQ ID NO: 505426 - RNA, 64 nt, hsa; identical to SEQ ID NO: 87678

SEQ ID NO: 505427 - RNA, 64 nt, hsa; identical to SEQ ID NO: 87679

SEQ ID NO: 505428 - RNA, 64 nt, hsa; identical to SEQ ID NO: 87680

SEQ ID NO: 505429 - RNA, 64 nt, hsa; identical to SEQ ID NO: 172974

SEQ ID NO: 505430 - RNA, 64 nt, hsa; identical to SEQ ID NO: 172975

SEQ ID NO: 505431 - RNA, 64 nt, hsa; identical to SEQ ID NO: 172976

SEQ ID NO: 505432 - RNA, 64 nt, hsa; identical to SEQ ID NO: 172977

SEQ ID NO: 505433 - RNA, 64 nt, hsa; identical to SEQ ID NO: 172978

SEQ ID NO: 505434 - RNA, 64 nt, hsa; identical to SEQ ID NO: 172979

SEQ ID NO: 505435 - RNA, 64 nt, hsa; identical to SEQ ID NO: 172980

SEQ ID NO: 505436 - RNA, 64 nt, hsa; identical to SEQ ID NO: 172981

SEQ ID NO: 505437 - RNA, 64 nt, hsa; identical to SEQ ID NO: 172982

SEQ ID NO: 505438 - RNA, 64 nt, hsa; identical to SEQ ID NO: 172983

SEQ ID NO: 505439 - RNA, 64 nt, hsa; identical to SEQ ID NO: 172984

SEQ ID NO: 505440 - RNA, 64 nt, hsa; identical to SEQ ID NO: 172985

SEQ ID NO: 505441 - RNA, 64 nt, hsa; identical to SEQ ID NO: 172986

SEQ ID NO: 505442 - RNA, 64 nt, hsa; identical to SEQ ID NO: 172987

SEQ ID NO: 505443 - RNA, 64 nt, hsa; identical to SEQ ID NO: 172988

SEQ ID NO: 505444 - RNA, 54 nt, hsa; identical to SEQ ID NO: 172989

SEQ ID NO: 505445 - RNA, 64 nt, hsa; identical to SEQ ID NO: 172990

SEQ ID NO: 505446 - RNA, 64 nt, hsa; identical to SEQ ID NO: 172991

SEQ ID NO: 505447 - RNA, 64 nt, hsa; identical to SEQ ID NO: 172992

SEQ ID NO: 505448 - RNA, 64 nt, hsa; identical to SEQ ID NO: 172993

SEQ ID NO: 505449 - RNA, 64 nt, hsa; identical to SEQ ID NO: 172994

SEQ ID NO: 505450 - RNA, 64 nt, hsa; identical to SEQ ID NO: 172995

SEQ ID NO: 505451 - RNA, 64 nt, hsa; identical to SEQ ID NO: 172996

SEQ ID NO: 505452 - RNA, 64 nt, hsa; identical to SEQ ID NO: 172997

SEQ ID NO: 505453 - RNA, 64 nt, hsa; identical to SEQ ID NO: 172998

SEQ ID NO: 505454 - RNA, 64 nt, hsa; identical to SEQ ID NO: 172999

SEQ ID NO: 505455 - RNA, 64 nt, hsa; identical to SEQ ID NO: 173000

SEQ ID NO: 505456 - RNA, 64 nt, hsa; identical to SEQ ID NO: 173001

SEQ ID NO: 505457 - RNA, 64 nt, hsa; identical to SEQ ID NO: 173002

SEQ ID NO: 505458 - RNA, 64 nt, hsa; identical to SEQ ID NO: 173003

SEQ ID NO: 505459 - RNA, 64 nt, hsa; identical to SEQ ID NO: 173004

SEQ ID NO: 505460 - RNA, 61 nt, hsa; identical to SEQ ID NO: 173005

SEQ ID NO: 505461 - RNA, 64 nt, hsa; identical to SEQ ID NO: 173006

SEQ ID NO: 505462 - RNA, 64 nt, hsa; identical to SEQ ID NO: 173007

SEQ ID NO: 505463 - RNA, 64 nt, hsa; identical to SEQ ID NO: 173008

SEQ ID NO: 505464 - RNA, 64 nt, hsa; identical to SEQ ID NO: 173009

SEQ ID NO: 505465 - RNA, 64 nt, hsa; identical to SEQ ID NO: 104217

SEQ ID NO: 505466 - RNA, 64 nt, hsa; identical to SEQ ID NO: 104218

SEQ ID NO: 505467 - RNA, 64 nt, hsa; identical to SEQ ID NO: 104219

SEQ ID NO: 505468 - RNA, 64 nt, hsa; identical to SEQ ID NO: 104220

SEQ ID NO: 505469 - RNA, 64 nt, hsa; identical to SEQ ID NO: 104221

SEQ ID NO: 505470 - RNA, 64 nt, hsa; identical to SEQ ID NO: 104222

SEQ ID NO: 505471 - RNA, 64 nt, hsa; identical to SEQ ID NO: 104223

SEQ ID NO: 505472 - RNA, 64 nt, hsa; identical to SEQ ID NO: 104224

SEQ ID NO: 505473 - RNA, 64 nt, hsa; identical to SEQ ID NO: 104225

SEQ ID NO: 505474 - RNA, 64 nt, hsa; identical to SEQ ID NO: 104226

SEQ ID NO: 505475 - RNA, 64 nt, hsa; identical to SEQ ID NO: 104227

SEQ ID NO: 505476 - RNA, 64 nt, hsa; identical to SEQ ID NO: 104228

SEQ ID NO: 505477 - RNA, 64 nt, hsa; identical to SEQ ID NO: 104229

SEQ ID NO: 505478 - RNA, 64 nt, hsa; identical to SEQ ID NO: 104230

SEQ ID NO: 505479 - RNA, 64 nt, hsa; identical to SEQ ID NO: 104231

SEQ ID NO: 505480 - RNA, 64 nt, hsa; identical to SEQ ID NO: 104232

SEQ ID NO: 505481 - RNA, 64 nt, hsa; identical to SEQ ID NO: 296587

SEQ ID NO: 505482 - RNA, 64 nt, hsa; identical to SEQ ID NO: 296588

SEQ ID NO: 505483 - RNA, 64 nt, hsa; identical to SEQ ID NO: 96836

SEQ ID NO: 505484 - RNA, 64 nt, hsa; identical to SEQ ID NO: 96837

SEQ ID NO: 505485 - RNA, 64 nt, hsa; identical to SEQ ID NO: 96838

SEQ ID NO: 505486 - RNA, 64 nt, hsa; identical to SEQ ID NO: 96839

SEQ ID NO: 505487 - RNA, 64 nt, hsa; identical to SEQ ID NO: 96840

SEQ ID NO: 505488 - RNA, 64 nt, hsa; identical to SEQ ID NO: 96841

SEQ ID NO: 505489 - RNA, 64 nt, hsa; identical to SEQ ID NO: 96842

SEQ ID NO: 505490 - RNA, 64 nt, hsa; identical to SEQ ID NO: 96843

SEQ ID NO: 505491 - RNA, 64 nt, hsa; identical to SEQ ID NO: 96844

SEQ ID NO: 505492 - RNA, 64 nt, hsa; identical to SEQ ID NO: 96845

SEQ ID NO: 505493 - RNA, 64 nt, hsa; identical to SEQ ID NO: 96846

SEQ ID NO: 505494 - RNA, 64 nt, hsa; identical to SEQ ID NO: 96847

SEQ ID NO: 505495 - RNA, 64 nt, hsa; identical to SEQ ID NO: 96848

SEQ ID NO: 505496 - RNA, 64 nt, hsa; identical to SEQ ID NO: 96849

SEQ ID NO: 505497 - RNA, 64 nt, hsa; identical to SEQ ID NO: 96850

SEQ ID NO: 505498 - RNA, 64 nt, hsa; identical to SEQ ID NO: 96851

SEQ ID NO: 505499 - RNA, 64 nt, hsa; identical to SEQ ID NO: 96852

SEQ ID NO: 505500 - RNA, 64 nt, hsa; identical to SEQ ID NO: 96853

SEQ ID NO: 505501 - RNA, 64 nt, hsa; identical to SEQ ID NO: 96854

SEQ ID NO: 505502 - RNA, 64 nt, hsa; identical to SEQ ID NO: 96855

SEQ ID NO: 505503 - RNA, 64 nt, hsa; identical to SEQ ID NO: 96856

SEQ ID NO: 505504 - RNA, 64 nt, hsa; identical to SEQ ID NO: 96857

SEQ ID NO: 505505 - RNA, 64 nt, hsa; identical to SEQ ID NO: 96858

SEQ ID NO: 505506 - RNA, 64 nt, hsa; identical to SEQ ID NO: 96859

SEQ ID NO: 505507 - RNA, 64 nt, hsa; identical to SEQ ID NO: 96860

SEQ ID NO: 505508 - RNA, 64 nt, hsa; identical to SEQ ID NO: 96861

SEQ ID NO: 505509 - RNA, 64 nt, hsa; identical to SEQ ID NO: 96862

SEQ ID NO: 505510 - RNA, 64 nt, hsa; identical to SEQ ID NO: 96863

SEQ ID NO: 505511 - RNA, 64 nt, hsa; identical to SEQ ID NO: 96864

SEQ ID NO: 505512 - RNA, 64 nt, hsa; identical to SEQ ID NO: 96865

SEQ ID NO: 505513 - RNA, 64 nt, hsa; identical to SEQ ID NO: 96866

SEQ ID NO: 505514 - RNA, 64 nt, hsa; identical to SEQ ID NO: 96867

SEQ ID NO: 505515 - RNA, 64 nt, hsa; identical to SEQ ID NO: 96868

SEQ ID NO: 505516 - RNA, 64 nt, hsa; identical to SEQ ID NO: 96869

SEQ ID NO: 505517 - RNA, 64 nt, hsa; identical to SEQ ID NO: 96870

SEQ ID NO: 505518 - RNA, 64 nt, hsa; identical to SEQ ID NO: 96871

SEQ ID NO: 505519 - RNA, 64 nt, hsa; identical to SEQ ID NO: 96872

SEQ ID NO: 505520 - RNA, 64 nt, hsa; identical to SEQ ID NO: 96873

SEQ ID NO: 505521 - RNA, 64 nt, hsa; identical to SEQ ID NO: 96874

SEQ ID NO: 505522 - RNA, 64 nt, hsa; identical to SEQ ID NO: 96875

SEQ ID NO: 505523 - RNA, 64 nt, hsa; identical to SEQ ID NO: 91745

SEQ ID NO: 505524 - RNA, 64 nt, hsa; identical to SEQ ID NO: 91746

SEQ ID NO: 505525 - RNA, 64 nt, hsa; identical to SEQ ID NO: 91747

SEQ ID NO: 505526 - RNA, 64 nt, hsa; identical to SEQ ID NO: 91748

SEQ ID NO: 505527 - RNA, 64 nt, hsa; identical to SEQ ID NO: 91749

SEQ ID NO: 505528 - RNA, 64 nt, hsa; identical to SEQ ID NO: 91750

SEQ ID NO: 505529 - RNA, 64 nt, hsa; identical to SEQ ID NO: 91751

SEQ ID NO: 505530 - RNA, 64 nt, hsa; identical to SEQ ID NO: 91752

SEQ ID NO: 505531 - RNA, 64 nt, hsa; identical to SEQ ID NO: 91753

SEQ ID NO: 505532 - RNA, 64 nt, hsa; identical to SEQ ID NO: 91754

SEQ ID NO: 505533 - RNA, 64 nt, hsa; identical to SEQ ID NO: 91755

SEQ ID NO: 505534 - RNA, 64 nt, hsa; identical to SEQ ID NO: 91756

SEQ ID NO: 505535 - RNA, 64 nt, hsa; identical to SEQ ID NO: 91757

SEQ ID NO: 505536 - RNA, 64 nt, hsa; identical to SEQ ID NO: 91758

SEQ ID NO: 505537 - RNA, 64 nt, hsa; identical to SEQ ID NO: 91759

SEQ ID NO: 505538 - RNA, 64 nt, hsa; identical to SEQ ID NO: 91760

SEQ ID NO: 505539 - RNA, 64 nt, hsa; identical to SEQ ID NO: 91761

SEQ ID NO: 505540 - RNA, 64 nt, hsa; identical to SEQ ID NO: 91762

SEQ ID NO: 505541 - RNA, 64 nt, hsa; identical to SEQ ID NO: 91763

SEQ ID NO: 505542 - RNA, 64 nt, hsa; identical to SEQ ID NO: 91764

SEQ ID NO: 505543 - RNA, 64 nt, hsa; identical to SEQ ID NO: 91765

SEQ ID NO: 505544 - RNA, 64 nt, hsa; identical to SEQ ID NO: 91766

SEQ ID NO: 505545 - RNA, 64 nt, hsa; identical to SEQ ID NO: 91767

SEQ ID NO: 505546 - RNA, 64 nt, hsa; identical to SEQ ID NO: 91768

SEQ ID NO: 505547 - RNA, 64 nt, hsa; identical to SEQ ID NO: 91769

SEQ ID NO: 505548 - RNA, 64 nt, hsa; identical to SEQ ID NO: 91770

SEQ ID NO: 505549 - RNA, 64 nt, hsa; identical to SEQ ID NO: 91771

SEQ ID NO: 505550 - RNA, 64 nt, hsa; identical to SEQ ID NO: 91772

SEQ ID NO: 505551 - RNA, 64 nt, hsa; identical to SEQ ID NO: 91773

SEQ ID NO: 505552 - RNA, 64 nt, hsa; identical to SEQ ID NO: 91774

SEQ ID NO: 505553 - RNA, 64 nt, hsa; identical to SEQ ID NO: 91775

SEQ ID NO: 505554 - RNA, 64 nt, hsa; identical to SEQ ID NO: 91776

SEQ ID NO: 505555 - RNA, 64 nt, hsa; identical to SEQ ID NO: 91777

SEQ ID NO: 505556 - RNA, 64 nt, hsa; identical to SEQ ID NO: 91778

SEQ ID NO: 505557 - RNA, 64 nt, hsa; identical to SEQ ID NO: 91779

SEQ ID NO: 505558 - RNA, 64 nt, hsa; identical to SEQ ID NO: 91780

SEQ ID NO: 505559 - RNA, 64 nt, hsa; identical to SEQ ID NO: 91781

SEQ ID NO: 505560 - RNA, 64 nt, hsa; identical to SEQ ID NO: 91782

SEQ ID NO: 505561 - RNA, 64 nt, hsa; identical to SEQ ID NO: 91783

SEQ ID NO: 505562 - RNA, 64 nt, hsa; identical to SEQ ID NO: 91784

SEQ ID NO: 505563 - RNA, 64 nt, hsa; identical to SEQ ID NO: 91785

SEQ ID NO: 505564 - RNA, 64 nt, hsa; identical to SEQ ID NO: 91786

SEQ ID NO: 505565 - RNA, 64 nt, hsa; identical to SEQ ID NO: 91787

SEQ ID NO: 505566 - RNA, 64 nt, hsa; identical to SEQ ID NO: 91788

SEQ ID NO: 505567 - RNA, 64 nt, hsa; identical to SEQ ID NO: 91789

SEQ ID NO: 505568 - RNA, 64 nt, hsa; identical to SEQ ID NO: 91790

SEQ ID NO: 505569 - RNA, 64 nt, hsa; identical to SEQ ID NO: 91791

SEQ ID NO: 505570 - RNA, 64 nt, hsa; identical to SEQ ID NO: 91792

SEQ ID NO: 505571 - RNA, 64 nt, hsa; identical to SEQ ID NO: 91793

SEQ ID NO: 505572 - RNA, 64 nt, hsa; identical to SEQ ID NO: 91794

SEQ ID NO: 505573 - RNA, 64 nt, hsa; identical to SEQ ID NO: 91795

SEQ ID NO: 505574 - RNA, 64 nt, hsa; identical to SEQ ID NO: 91796

SEQ ID NO: 505575 - RNA, 64 nt, hsa; identical to SEQ ID NO: 91797

SEQ ID NO: 505576 - RNA, 64 nt, hsa; identical to SEQ ID NO: 91798

SEQ ID NO: 505577 - RNA, 64 nt, hsa; identical to SEQ ID NO: 91799

SEQ ID NO: 505578 - RNA, 64 nt, hsa; identical to SEQ ID NO: 91800

SEQ ID NO: 505579 - RNA, 54 nt, hsa; identical to SEQ ID NO: 91801

SEQ ID NO: 505580 - RNA, 64 nt, hsa
ccagcuaacucuugggcucaggcacccuugcacaggguugcauuucuuuagucuucuguggguc

SEQ ID NO: 505581 - RNA, 64 nt, hsa
ugcugccgucaccgccuccugggucguccgccacggguugcacugccguggcagacagcuggac

SEQ ID NO: 505582 - RNA, 64 nt, hsa
aguguucuacucagaaaugucucacagcccagcuggguugcaauuccagaaugcugggaguuuu

SEQ ID NO: 505583 - RNA, 64 nt, hsa
caaacuaauuuuucacuguugacaagcgaggcaaggguugcacuggaccaaaggcugaggcuug

SEQ ID NO: 505584 - RNA, 64 nt, hsa
auuugcugaauacagaggcaacugcauuggcuuuggguugcaggaccucaggugagaagcagag

SEQ ID NO: 505585 - RNA, 64 nt, hsa
uguagauauugugaaguacauauuaggaaaauauggguugcauuuggucaagauuuugaaugcu

SEQ ID NO: 505586 - RNA, 64 nt, hsa
auccacuggauuaauggguuauuuucagugggcaggguugcacaguguaauccuacaccuuuug

SEQ ID NO: 505587 - RNA, 64 nt, hsa
aaaaguuauuuuccagagaauguagcuguuuccaggguugcaacuugaauuaagaccaaacaga

SEQ ID NO: 505588 - RNA, 64 nt, hsa
uauucuguaaaaaguuaguggacugcagcccuggggguugcaggcugcggugccucaggccccu

SEQ ID NO: 505589 - RNA, 64 nt, hsa
ggagguuuggaugggagugagacagaaguaagugggguugcaaccacugcaacggcuuagacuu

SEQ ID NO: 505590 - RNA, 64 nt, hsa
gauagugcgauguuucaggaggcuggaggaagggggguugcaguggagagggacagcccacuga

SEQ ID NO: 505591 - RNA, 64 nt, hsa
uacuauaaaaaguuaaaaaaaaaacuuacuuuguggguugcaauacaaacugcucuugacaaug

SEQ ID NO: 505592 - RNA, 64 nt, hsa
uagccaugcugacucaugaacagguggaggaaagggguugcaggugaccagcaucuucaaucua

SEQ ID NO: 505593 - RNA, 64 nt, hsa
gaaaaaagccaaaggguuauagggguacacuuagggguugcaugcaagcuguuaccaaaaaauu

SEQ ID NO: 505594 - RNA, 64 nt, hsa
acaaaguguucuuccucauggaagaagugccucgggguugcagggcugcaaagugacaacugca

SEQ ID NO: 505595 - RNA, 64 nt, hsa
uugaggcucagggagagaucugccacaugucugaggguugcagagcccgcuguggagguaagau

SEQ ID NO: 505596 - RNA, 64 nt, hsa
uuuggacuuaccuaacaagaguauaaauugacuuggguugcaagcacugagcacuguuacuucu

SEQ ID NO: 505597 - RNA, 64 nt, hsa
gcagcacuucgaucacugugagagaacucaaaguggguugcaaucauuccuaacacaggcugaa

SEQ ID NO: 505598 - RNA, 64 nt, hsa
accagguaggagcuuuccuguuucauauguuucaggguugcacaguuggucucuuuaaugucgg

SEQ ID NO: 505599 - RNA, 64 nt, hsa
gaggcagcagaauugcuugaacccaggaggcagaggguugcagugagccgagauagcaccauug

SEQ ID NO: 505600 - RNA, 64 nt, hsa
acggaaacucccgaacuacagaccccucccugguggguugcaugaaugugucucauuacugcug

SEQ ID NO: 505601 - RNA, 64 nt, hsa
gggauuuuuaaaugucauaaauuugaagagugguggguugcauuuucuucauggguuuauguuu

SEQ ID NO: 505602 - RNA, 64 nt, hsa
cuggcuagucaggguggcuucacccaucacugguggguugcaggaacagcacccaggacucuga

SEQ ID NO: 505603 - RNA, 64 nt, hsa
ggauuugagaggaaagagaggaaaaugggggaauggguugcaaaauagaaaugagcuuaaucca

SEQ ID NO: 505604 - RNA, 64 nt, hsa
uaaccauuuacugucuggcuuugcccuuaaaauaggguugcaauuaaaaugugauuggcuuagg

SEQ ID NO: 505605 - RNA, 64 nt, hsa
ugcucccugccgagaaaguggaggacgugguacaggguugcagauguuuaguuuuaaaaauuca

SEQ ID NO: 505606 - RNA, 64 nt, hsa
auauauacauauaugcauauuugcacuuccagauggguugcauaagaaucagguccuuaaauac

SEQ ID NO: 505607 - RNA, 64 nt, hsa
cugaugagaauuuauaaauuauuaugacaccuuuggguugcaaucuggggauacuggcaaagca

SEQ ID NO: 505608 - RNA, 64 nt, hsa
aaagugaaggaauaaacauaacuuaccugagcuaggguugcagcagaaauugaguugcagcuug

SEQ ID NO: 505609 - RNA, 64 nt, hsa
cauuaauaccuaaguaaacauaacauuacuuggaggguugcaguuucuaagugaaacuguauuu

SEQ ID NO: 505610 - RNA, 64 nt, hsa
auaaaaacagcucggcccaacagacacuuccccuggguugcauccuggauguuuuaugauagcc

SEQ ID NO: 505611 - RNA, 64 nt, hsa
aaugagaggagagaggccugagucaccuagcauaggguugcagcaagcccuggauucagagugu

SEQ ID NO: 505612 - RNA, 64 nt, hsa
aagccgguguccagggacucaagaccuguaccugggguugcaggggcuccugcccugcuguauc

SEQ ID NO: 505613 - RNA, 64 nt, hsa
accauaaggauuucuuauguuaagucccaacuugggguugcaaaaucauuuuuucccuuaauac

SEQ ID NO: 505614 - RNA, 64 nt, hsa
ccgggcaauccaugagccugugcugagccccaguggguugcaccuccaccggcagucagcgagc

SEQ ID NO: 505615 - RNA, 64 nt, hsa
ugaagauaauauuaauaaugauggaaggaagacuggguugcagggacuguggucucuccugggg

SEQ ID NO: 505616 - RNA, 64 nt, hsa
acaucacacacaagguuuccacuucacacuuggaggguugcauggcggcugggcaaaggugcuc

SEQ ID NO: 505617 - RNA, 64 nt, hsa
auuuucucuuaaucguuuauuauacugggcauugggguugcaagauaaugcacaguccgagcuc

SEQ ID NO: 505618 - RNA, 64 nt, hsa
augcuaguuucaauuaccacaguauucuagagacggguugcaaugacaaggggggcaaaugaaa

SEQ ID NO: 505619 - RNA, 64 nt, hsa
gcugcuuuguuuuccuccugauucucuuaaauuuggguugcaaagcuaucccgccccccacccu

SEQ ID NO: 505620 - RNA, 64 nt, hsa
aacgcccuuccuccagacccugacaccugagcugggguugcaaagucacuggccacauccagcc

SEQ ID NO: 505621 - RNA, 64 nt, hsa
caaacaauaugaacuccuuuuucguauugccaucggguugcauggaaguuuuauucucuuguuu

SEQ ID NO: 505622 - RNA, 64 nt, hsa
uagauaagaaaacguagcuucagugggggcuccaggguugcagaguaugagugacacagaccgg

SEQ ID NO: 505623 - RNA, 64 nt, hsa
augcaagggcauaauguuagcugugaacaugccaggguugcauucacauuccuggguacccagu

SEQ ID NO: 505624 - RNA, 64 nt, hsa
uuuauauggcuuucucacuuuuauuuuguagcauggguugcaucgacuuuuuuacuagagaauu

SEQ ID NO: 505625 - RNA, 64 nt, hsa
gccacuggaaaucccugggccggcauuuguauugggguugcaaugacucccaagggccaaaaga

SEQ ID NO: 505626 - RNA, 64 nt, hsa
guucaagugagggaugaugguugcuugaaccaaaggguugcauguaguaagaaauugugauuua

SEQ ID NO: 505627 - RNA, 64 nt, hsa
uuccugcugcucgcuuuguuuuuaaaaguaacuuggguugcauucuucccucuggacuagagua

SEQ ID NO: 505628 - RNA, 64 nt, hsa
uuaucagggcugccuaacagaccaggagaucuggggguugcaccagggaaucgccauauuugac

SEQ ID NO: 505629 - RNA, 64 nt, hsa
uaaguuaacguuaggauaggaauugguguugaggggguugcaagaauauuuuauuuuaauuuuu

SEQ ID NO: 505630 - RNA, 64 nt, hsa
cuauuuugaaaaaagaguuuuuuuucuuucuaugggguugcagggaugguguacaacagguccu

SEQ ID NO: 505631 - RNA, 64 nt, hsa
caaauguuuaaaaauaccucaggcuauacugaaaggguugcaguuugguuaggaguggaaauau

SEQ ID NO: 505632 - RNA, 64 nt, hsa
ccucauggucaggugcuggugaggacccugaucuggguugcagacugcugacuucuuauugugu

SEQ ID NO: 505633 - RNA, 64 nt, hsa
aaaagucccgugggaaggguccugcaggggugcaggguugcacgcaugugggggugcacaggcg

SEQ ID NO: 505634 - RNA, 64 nt, hsa
uaggguggaaugaggaacaucuucugaguaaacaggguugcaaagguuaugauuauuucaacac

SEQ ID NO: 505635 - RNA, 64 nt, hsa
uauucaugaaacugucaaauagagugucuuucaaggguugcaggaucuuagagauagaaaguac

SEQ ID NO: 505636 - RNA, 64 nt, hsa
ccaauucuugcaaccacugcccuaccaaaccuguggguugcaaaucagaacuaaaauucuaagc

SEQ ID NO: 505637 - RNA, 64 nt, hsa
gcuuuuuuuccagauauaugauuucucaucgacaggguugcacagcccucuuuauuguucgugu

SEQ ID NO: 505638 - RNA, 64 nt, hsa
cguucaguaaagaacccaagguugagugcaacugggguugcacuucagcuucaucuccuuggca

SEQ ID NO: 505639 - RNA, 64 nt, hsa
ugugugaaggggccggcuucucuuggugccugcuggguugcaggggcaggaagcguguggacug

SEQ ID NO: 505640 - RNA, 64 nt, hsa
cugccaaugcaacagcccuggaagaaacccuagaggguugcauagucuagaaaggagugugacc

SEQ ID NO: 505641 - RNA, 64 nt, hsa
aacuugaagcccugccucccugaaggcuaauuaaggguugcaguccuccuucugggcuaacucc

SEQ ID NO: 505642 - RNA, 64 nt, hsa
ugacuauugcccagagaaggcuuaccccucucuaggguugcaguugcuuucuuuguaauaagua

SEQ ID NO: 505643 - RNA, 64 nt, hsa
ggugacgacuuaaaucuggguucccucagacauuggguugcaccccaacaaauauuaaauggcu

SEQ ID NO: 505644 - RNA, 64 nt, hsa
gacuuccuuccucaagaauacagucuauucugggggguugcaggacagcugaaaaagaaaacgu

SEQ ID NO: 505645 - RNA, 64 nt, hsa
uaauguacauuguaaucuuuuaaaagaaaaaucaggguugcacuugcaacuuuuaaaaaaccga

SEQ ID NO: 505646 - RNA, 64 nt, hsa
ugucacaaacugccacuacuauguaccugcagugggguugcagagaugggggagacucaagucu

SEQ ID NO: 505647 - RNA, 64 nt, hsa
uuuuuuuuuuuuuuguuccuguguauucucauugggguugcaacaauaauucaucaaguaauca

SEQ ID NO: 505648 - RNA, 64 nt, hsa
uguacuggguacacaguaggcgcccaggacaaguggguugcaagacaggaagaaaggaaaagga

SEQ ID NO: 505649 - RNA, 64 nt, hsa
augacaagauuauaaugcuuuuggcuuaggugcaggguugcaaagggaucagaaaaaaaaaauc

SEQ ID NO: 505650 - RNA, 64 nt, hsa
gguccccuugagggccaucacacccagacccaacggguugcagccuccugagcaggccuaggca

SEQ ID NO: 505651 - RNA, 64 nt, hsa
cugaggcacgagaaucacuugaacccaggaagcgggguugcagugagccaaagguacaccacua

SEQ ID NO: 505652 - RNA, 64 nt, hsa
guaaguggcacaugacgguaucccagucauaagaggguugcaugauuccuuugaguguuugauu

SEQ ID NO: 505653 - RNA, 64 nt, hsa
aguggccuuugcucucagggaacauggugauggaggguugcaucagcuccacccauggccaaca

SEQ ID NO: 505654 - RNA, 64 nt, hsa
cuggcuucuggccaggaagcuuuggugagaaccuggguugcagacaggaaucuuaagguguagc

SEQ ID NO: 505655 - RNA, 64 nt, hsa
aucaggacuggugcugcuuccagagacuuccuugggguugcaaccuggggaagccacaucccac

SEQ ID NO: 505656 - RNA, 64 nt, hsa
uuaugaguugguuuuugcaauugaguuucccucuggguugcauugagggcuucuccuagcaccc

SEQ ID NO: 505657 - RNA, 64 nt, hsa
cuuuauacguuacguacccaaggacauugccucaggguugcaaacucuuuaaaggaaaauuuau

SEQ ID NO: 505658 - RNA, 64 nt, hsa
uuauaagaaauuaaccuucuuuucuuuuugccaaggguugcaugugaauuauaccuuucuuaau

SEQ ID NO: 505659 - RNA, 64 nt, hsa
gccgacuuccuggcugcuucaccuuugcauagcuggguugcagcugcgaaccucauucugacug

SEQ ID NO: 505660 - RNA, 64 nt, hsa
uagaaauuaugccuucauucucuuacauuuguguggguugcaagagggggagauuauucuggaa

SEQ ID NO: 505661 - RNA, 64 nt, hsa
cuacacggaggaacugcugcggcacguggccccuggguugcaccuggagcuucgggggccacag

SEQ ID NO: 505662 - RNA, 64 nt, hsa
cugcuggccacagaggcuccuguucuucugccuuggguugcacccuaccuauggggccuggguu

SEQ ID NO: 505663 - RNA, 64 nt, hsa
gggggcuuuuguuaguaaggguggguggggugauggguugcagacggaggucaggucuuccucu

SEQ ID NO: 505664 - RNA, 64 nt, hsa
cuggagcaucuggcagccccacaccugcccuuggggguugcaggcugcccccuuccugccagac

SEQ ID NO: 505665 - RNA, 64 nt, hsa
ucacacccuuaaccuuuaagccaguuagaucaggggguugcaacaauuggguuaaacuuugggu

SEQ ID NO: 505666 - RNA, 64 nt, hsa
gagagagccagagggccuccuuggugguaaaagaggguugcauuucuugcagccagaaggcaga

SEQ ID NO: 505667 - RNA, 64 nt, hsa
acuugaagguggcuacaaagaugacuguggacguggguugcacuggccacccaaggaugucugc

SEQ ID NO: 505668 - RNA, 64 nt, hsa
ugaggcgggagaaucaugugaacccgggacgcagggguugcagugagcggagaucgcaucauug

SEQ ID NO: 505669 - RNA, 64 nt, hsa
ccacccagacccgcguccaccugggaggcauuugggguugcaggaccgagacccacauccucuc

SEQ ID NO: 505670 - RNA, 64 nt, hsa
aguccugggccuguaaugaaugucggcggcgcugggguugcagggaaaagacaaauccucaaag

SEQ ID NO: 505671 - RNA, 64 nt, hsa
guagccagucauaaauacauaaauguuaaccuucggguugcaaccuugucucuugcaguuuaag

SEQ ID NO: 505672 - RNA, 64 nt, hsa
ugaggcacgagaaucacuugaagccgggagguggggguugcagugagccgagaucacaccacug

SEQ ID NO: 505673 - RNA, 64 nt, hsa
gggaagcaaugcugggcagcguuuuugccauugaggguugcagaauuugcucuuuuugggaugg

SEQ ID NO: 505674 - RNA, 64 nt, hsa
gaccacagguuggcacuguguggucuuucacaucggguugcacuguccaugaaauagaaacacu

SEQ ID NO: 505675 - RNA, 64 nt, hsa
gugcccugccugccagcaccuaggacuucgaguuggguugcagcuuaugacaugcaugauaggu

SEQ ID NO: 505676 - RNA, 64 nt, hsa
acuggcagaaguaauaguugugccucagacuuggggguugcauguggcccugggggaguuacua

SEQ ID NO: 505677 - RNA, 64 nt, hsa
uuggaucauuuuuuacugggggcggacuugggggggguugcauacaaagauaacauauauaucc

SEQ ID NO: 505678 - RNA, 64 nt, hsa
ggccuugagugccacccccagggaagaacauaaaggguugcacaaugccacccauccacuccuu

SEQ ID NO: 505679 - RNA, 64 nt, hsa
ucaagggugucaguaggaaucaaaaguuggggguggguugcaaaauguucuuucaguuuuuaga

SEQ ID NO: 505680 - RNA, 64 nt, hsa
ucgacugcugcggguccaguguccgccaucuucaggguugcacagaauccuccaagauacuuug

SEQ ID NO: 505681 - RNA, 64 nt, hsa
uuccagcaugguauuauuaagggauuuaaaguuuggguugcaugccuguaaucccagcauuuug

SEQ ID NO: 505682 - RNA, 64 nt, hsa
guuucgaggggcgugugcuggaccccaccacuguggguugcaggcccaaugcagaagaguauua

SEQ ID NO: 505683 - RNA, 64 nt, hsa
aaguguggugacacagugaaugggagguggaggaggguugcagcucccaccucaguuuaguuuu

SEQ ID NO: 505684 - RNA, 64 nt, hsa
acagaggcaagaauccccaaggggugggcagucgggguugcaggacuguaauaaauggaucucu

SEQ ID NO: 505685 - RNA, 64 nt, hsa
uaaguggggcccggccccagcuggaucgaagggcggguugcagucccgacacggcuuuaggaag

SEQ ID NO: 505686 - RNA, 64 nt, hsa
gagugguguaauguaucuaacuuuuagcaaaggaggguugcagagcagcuuaaauuuuuuuuau

SEQ ID NO: 505687 - RNA, 64 nt, hsa
aaagauauccaaaacaaauuaaggggaaaagggaggguugcauaacagcauguaacauaacacu

SEQ ID NO: 505688 - RNA, 64 nt, hsa
auuagugucccccuuugacaaaugacagaacugaggguugcaauggggaaaugacuuauaaagu

SEQ ID NO: 505689 - RNA, 64 nt, hsa
acugaagacaaaaacugcccuagccagguacugaggguugcaugaaucugcaggagacagagau

SEQ ID NO: 505690 - RNA, 64 nt, hsa
cggcuugcggggggguuuguacuucucugcgaauggguugcagugcucagcauugcgggucucu

SEQ ID NO: 505691 - RNA, 64 nt, hsa
uugcauacaggagccuuuacaagaugauuauacaggguugcagauugggugacugaccagacuu

SEQ ID NO: 505692 - RNA, 64 nt, hsa
ugcuuucuucucucucuccugucucggcuguuguggguugcagguugggugcugcuguuguggu

SEQ ID NO: 505693 - RNA, 64 nt, hsa
uguccauguauaaacuugaagugguuguguuguaggguugcagguuuuuuguuacgcugcuguc

SEQ ID NO: 505694 - RNA, 64 nt, hsa
agcugacuccugauuuaaccgcuggcguaaccgcggguugcacgcaugcgugcugaaaagccuu

SEQ ID NO: 505695 - RNA, 50 nt, hsa
agaaacggcagagagacugaggguugcagacacauauauuuuugaggcug

SEQ ID NO: 505696 - RNA, 64 nt, hsa
auuugggggagcugcaugguaccagggguuuauuggguugcagauauauaaaugcccuaaacuu

SEQ ID NO: 505697 - RNA, 64 nt, hsa
gccccggguuugagcagaacgggcccagugcccuggguugcagacucaguagcguuuuagucgu

SEQ ID NO: 505698 - RNA, 64 nt, hsa
uuuguuggggauuaguuucaugcugcacauaaugggguugcacuggucugacccaggacuuugg

SEQ ID NO: 505699 - RNA, 64 nt, hsa
cagaguuaaagcagugacuggaggguggacugggggguugcagcaucuuuagaccuagaucugu

SEQ ID NO: 505700 - RNA, 64 nt, hsa
auggggugagcuuugaagugcuggugguccagagggguugcagauacgugacuuggagcacccg

SEQ ID NO: 505701 - RNA, 64 nt, hsa
ccugugugcgggcagcagcugugugcgggccuggggguugcaugugucaccuggagcugggcac

SEQ ID NO: 505702 - RNA, 64 nt, hsa
ucaaugaguaguuucauccucucccacaccagcuggguugcacacuguugauauggaagggagu

SEQ ID NO: 505703 - RNA, 64 nt, hsa
guuauucuuguccuuaguccuccagggggagcugggguugcagggcaacaguacagucgcgcuu

SEQ ID NO: 505704 - RNA, 64 nt, hsa
agacuggguaagggagcagggcuuacugagcaguggguugcaggaggaggagcugggcagggcc

SEQ ID NO: 505705 - RNA, 64 nt, hsa
aucuugcucgggcccuagcuguugggguucucauggguugcacugaccauacugcuuacgucuu

SEQ ID NO: 505706 - RNA, 64 nt, hsa
gaaauggaacccccguuguacagggguuggguggggguugcaggacuccacucacaagccuccu

SEQ ID NO: 505707 - RNA, 64 nt, hsa
ucugccuuaauaauucccacggccacaggcaaggggguugcaguggccgccugcaccuuggaug

SEQ ID NO: 505708 - RNA, 64 nt, hsa
gaagcaaauggaaaacaaacaaaaaaagaggcagggguugcaauccuagucucugauaaaacag

SEQ ID NO: 505709 - RNA, 64 nt, hsa
ucccugcccagcgagucuuccagaaggggugaaaggguugcaggucccgaccacugacccuucc

SEQ ID NO: 505710 - RNA, 64 nt, hsa
accuccgauaagcaaaaaaguccucacauucaauggguugcauacccaugaauucuaaaacuuc

SEQ ID NO: 505711 - RNA, 64 nt, hsa
cuaaaucuagacuugggguccacaccgggcagcgggguugcaacccagcaccugguaggcucca

SEQ ID NO: 505712 - RNA, 64 nt, hsa
ugaggugggaagaucucuugagcccaagggguggggguugcagugagccaagaugcacugcacc

SEQ ID NO: 505713 - RNA, 64 nt, hsa
auuggccuguggagucuccauccccgcucagccuggguugcacuggaggggaggaagaaaguug

SEQ ID NO: 505714 - RNA, 64 nt, hsa
aaaguacagccauaccucaaagauauuguggauuggguugcagcccaccacaauaaagcaaaua

SEQ ID NO: 505715 - RNA, 64 nt, hsa
ugaaagcagagagaccagugcagggcuguuaacaggguugcaggcgagagacuggggugcuggg

SEQ ID NO: 505716 - RNA, 64 nt, hsa
uuuaccucuuucccucagauggggagccaugacuggguugcaccucaggauacuguaauuugac

SEQ ID NO: 505717 - RNA, 64 nt, hsa
cuccugcagcaaagggcaaccacccucggaugauggguugcagccggccugcugcuuaaggugg

SEQ ID NO: 505718 - RNA, 64 nt, hsa
gauccagagauccccaucgaacugaaggaucacuggguugcagacacauugcaggucagcuucu

SEQ ID NO: 505719 - RNA, 64 nt, hsa
acagagacaaagaggagcucuuuuucugugagcuggguugcacaggaagaaugucacagggaac

SEQ ID NO: 505720 - RNA, 64 nt, hsa
gcuauggcuuuggacaacguggcuucggccccugggguugcagagcuugcauuggguuuaccuc

SEQ ID NO: 505721 - RNA, 64 nt, hsa
cucaccucuaggaacugagcccaaggaaauagcgggguugcaggcagacauugagcugcgagac

SEQ ID NO: 505722 - RNA, 64 nt, hsa
gugcaccucugagugucccuuuuguaaggcccagggguugcacugagucugcagaggccgcgac

SEQ ID NO: 505723 - RNA, 50 nt, hsa
gcgccugcagccuccucuagggguugcaccccagcgcucccaccuagaug

SEQ ID NO: 505724 - RNA, 64 nt, hsa
cauauuuggcauuuucaguucuguacgcaucugcggguugcagcccacgccgcuuacucucagc

SEQ ID NO: 505725 - RNA, 64 nt, hsa
gaaaagaauucuaaugaccagccgugaauguguaggguugcagcucuauucuccaaaacuguag

SEQ ID NO: 505726 - RNA, 64 nt, hsa
auaugggugaugaagaaaacugcacaaaauuaagggguugcagaaucacgggagcauaauaauu

SEQ ID NO: 505727 - RNA, 64 nt, hsa
aggaguccccuuucccugucccagccccaucuguggguugcacuuacaaacccccacccaccuu

SEQ ID NO: 505728 - RNA, 64 nt, hsa
gagaguggcuuaaguggaaugcuucaggggugguggguugcaaguggggggagcuuugccaaca

SEQ ID NO: 505729 - RNA, 64 nt, hsa
ggacuauggauugggccucugccucugugccuauggguugcacuucuuccucuguucccacacu

SEQ ID NO: 505730 - RNA, 64 nt, hsa
uuucauguauuccaguuuguuuauuacuuauuugggguugcaucagaaaugucuggagaauaau

SEQ ID NO: 505731 - RNA, 64 nt, hsa
gagggaguaauaguuauuacuaaugauuuugauuggguugcauuuuuguugcaauguuuauucc

SEQ ID NO: 505732 - RNA, 64 nt, hsa
uuuuccaggcucuggagagaagcccucacccugaggguugcagggaggcagggauaucaugggu

SEQ ID NO: 505733 - RNA, 64 nt, hsa
cuuuucccugcauucaccugguucccauccacauggguugcagauguccuugaagagagugagg

SEQ ID NO: 505734 - RNA, 64 nt, hsa
ugcacagaugcugcuuuggagaacuuuacaaccuggguugcagaacugagccuugguaaaccug

SEQ ID NO: 505735 - RNA, 64 nt, hsa
gaaaagaauucuaaugaccugccuugaaugcaugggguugcagcucuguucaaacacaauucua

SEQ ID NO: 505736 - RNA, 64 nt, hsa; identical to SEQ ID NO: 262404

SEQ ID NO: 505737 - RNA, 64 nt, hsa; identical to SEQ ID NO: 262405

SEQ ID NO: 505738 - RNA, 64 nt, hsa; identical to SEQ ID NO: 262406

SEQ ID NO: 505739 - RNA, 64 nt, hsa; identical to SEQ ID NO: 262407

SEQ ID NO: 505740 - RNA, 64 nt, hsa; identical to SEQ ID NO: 262408

SEQ ID NO: 505741 - RNA, 64 nt, hsa; identical to SEQ ID NO: 262409

SEQ ID NO: 505742 - RNA, 64 nt, hsa; identical to SEQ ID NO: 262410

SEQ ID NO: 505743 - RNA, 64 nt, hsa; identical to SEQ ID NO: 262411

SEQ ID NO: 505744 - RNA, 64 nt, hsa; identical to SEQ ID NO: 262412

SEQ ID NO: 505745 - RNA, 64 nt, hsa; identical to SEQ ID NO: 262413

SEQ ID NO: 505746 - RNA, 64 nt, hsa; identical to SEQ ID NO: 262414

SEQ ID NO: 505747 - RNA, 64 nt, hsa; identical to SEQ ID NO: 262415

SEQ ID NO: 505748 - RNA, 64 nt, hsa; identical to SEQ ID NO: 262416

SEQ ID NO: 505749 - RNA, 64 nt, hsa; identical to SEQ ID NO: 262417

SEQ ID NO: 505750 - RNA, 64 nt, hsa; identical to SEQ ID NO: 262418

SEQ ID NO: 505751 - RNA, 64 nt, hsa; identical to SEQ ID NO: 262419

SEQ ID NO: 505752 - RNA, 64 nt, hsa; identical to SEQ ID NO: 262420

SEQ ID NO: 505753 - RNA, 64 nt, hsa; identical to SEQ ID NO: 262421

SEQ ID NO: 505754 - RNA, 64 nt, hsa; identical to SEQ ID NO: 262422

SEQ ID NO: 505755 - RNA, 64 nt, hsa; identical to SEQ ID NO: 262423

SEQ ID NO: 505756 - RNA, 64 nt, hsa
aaauaccgucaccuguuacagguguacuuucuuaaugacugaaagauaaguggguagcaccguc

SEQ ID NO: 505757 - RNA, 64 nt, hsa
ucagccccugggugggguggggugguucaaauggaugacugaucuccugaguacacugaagcca

SEQ ID NO: 505758 - RNA, 64 nt, hsa
cacagaucaugacuuuuugacugugcuugauuucaugacugaugcacaaauuuuaaugauuaaa

SEQ ID NO: 505759 - RNA, 64 nt, hsa
uaauagaucucauacaccagaauucagaucaugaaugacugacagaauauuuuguugggcaguc

SEQ ID NO: 505760 - RNA, 64 nt, hsa
cggaauuuugaaucagcauuaauugaauugcuaaaugacugacauucauuccauuuaauugggg

SEQ ID NO: 505761 - RNA, 64 nt, hsa
aauuagugcaauuuccugcuuacuuuucauucucaugacugaacugugauuaggaaguugugau

SEQ ID NO: 505762 - RNA, 64 nt, hsa
caagaguaucaucuugauaguguuacuucagcauaugacugacugauuuuaugaagggaguuua

SEQ ID NO: 505763 - RNA, 64 nt, hsa
gaaauucccucucuccaaucaucuaaaauugaagaugacugaaucuauuuuaagaucuaaauua

SEQ ID NO: 505764 - RNA, 64 nt, hsa; identical to SEQ ID NO: 165047

SEQ ID NO: 505765 - RNA, 64 nt, hsa; identical to SEQ ID NO: 165048

SEQ ID NO: 505766 - RNA, 64 nt, hsa; identical to SEQ ID NO: 165049

SEQ ID NO: 505767 - RNA, 64 nt, hsa; identical to SEQ ID NO: 165050

SEQ ID NO: 505768 - RNA, 64 nt, hsa; identical to SEQ ID NO: 165051

SEQ ID NO: 505769 - RNA, 64 nt, hsa; identical to SEQ ID NO: 165052

SEQ ID NO: 505770 - RNA, 64 nt, hsa; identical to SEQ ID NO: 165053

SEQ ID NO: 505771 - RNA, 64 nt, hsa; identical to SEQ ID NO: 165054

SEQ ID NO: 505772 - RNA, 64 nt, hsa; identical to SEQ ID NO: 165055

SEQ ID NO: 505773 - RNA, 64 nt, hsa; identical to SEQ ID NO: 165056

SEQ ID NO: 505774 - RNA, 64 nt, hsa; identical to SEQ ID NO: 165057

SEQ ID NO: 505775 - RNA, 64 nt, hsa; identical to SEQ ID NO: 165058

SEQ ID NO: 505776 - RNA, 64 nt, hsa; identical to SEQ ID NO: 165059

SEQ ID NO: 505777 - RNA, 64 nt, hsa; identical to SEQ ID NO: 165060

SEQ ID NO: 505778 - RNA, 64 nt, hsa; identical to SEQ ID NO: 165061

SEQ ID NO: 505779 - RNA, 64 nt, hsa; identical to SEQ ID NO: 165062

SEQ ID NO: 505780 - RNA, 61 nt, hsa
gcauugugaagaggaggaaaagugaaucacggagagagaaaggaaaggauagaaucacagg

SEQ ID NO: 505781 - RNA, 61 nt, hsa
caugucugugacacaggacggugggaagccugagagagagugaaauuaugugauacacuga

SEQ ID NO: 505782 - RNA, 61 nt, hsa
gcccacagugguggccucugccucuuuccuggagagagaaggacagugcacggagagguuu

SEQ ID NO: 505783 - RNA, 61 nt, hsa
gcccuaccugucuuuccugaguguuugaggggagagagagacccacaucuccccaaagaga

SEQ ID NO: 505784 - RNA, 61 nt, hsa
ccuaccugucuuuccugaguguuugaggggagagagagacccacaucuccccaaagagaug

SEQ ID NO: 505785 - RNA, 61 nt, hsa
caggcucacugccaggccagccuccgagagggagagagagagagagaggacagcuugagcc

SEQ ID NO: 505786 - RNA, 61 nt, hsa
ggcucacugccaggccagccuccgagagggagagagagagagagaggacagcuugagccgg

SEQ ID NO: 505787 - RNA, 61 nt, hsa
cucacugccaggccagccuccgagagggagagagagagagagaggacagcuugagccgggc

SEQ ID NO: 505788 - RNA, 61 nt, hsa
cacugccaggccagccuccgagagggagagagagagagagaggacagcuugagccgggccc

SEQ ID NO: 505789 - RNA, 61 nt, hsa
cugccaggccagccuccgagagggagagagagagagagaggacagcuugagccgggccccu

SEQ ID NO: 505790 - RNA, 61 nt, hsa
agaucuuacagguaucaggcacaggcaggaagagagagagagagguucuggggaggaaggg

SEQ ID NO: 505791 - RNA, 61 nt, hsa
aucuuacagguaucaggcacaggcaggaagagagagagagagguucuggggaggaagggcc

SEQ ID NO: 505792 - RNA, 61 nt, hsa
cuuacagguaucaggcacaggcaggaagagagagagagagguucuggggaggaagggccag

SEQ ID NO: 505793 - RNA, 61 nt, hsa
agagagagagguucuggggaggaagggccaggagagagaucuagaaaguggguucacuaga

SEQ ID NO: 505794 - RNA, 61 nt, hsa
cccuuucccugucuggcuucucccuuaagaagagagagauacuuguagaauuggguggggg

SEQ ID NO: 505795 - RNA, 61 nt, hsa
uccuuccauuugggauauguuacauuagagugagagagagaauaaggagccuuucuuaugg

SEQ ID NO: 505796 - RNA, 61 nt, hsa
cuuccauuugggauauguuacauuagagugagagagagaauaaggagccuuucuuauggaa

SEQ ID NO: 505797 - RNA, 61 nt, hsa
augggaccucgaggcucgagcugaagcaggcgagagagaaacagcuacugcgugcgugcgc

SEQ ID NO: 505798 - RNA, 61 nt, hsa
cucugucgaagaaagaagcucugucaaguuagagagagacaauguguaggaaauguucuuu

SEQ ID NO: 505799 - RNA, 61 nt, hsa
aacucuccguccccccggggcccuccggagggagagagagaggaacugcuguuuaucucac

SEQ ID NO: 505800 - RNA, 61 nt, hsa
cucuccguccccccggggcccuccggagggagagagagaggaacugcuguuuaucucacuc

SEQ ID NO: 505801 - RNA, 61 nt, hsa
aaagagcauguacaugggagugagagaaaaagagagagagagacagaguggcgggggcggg

SEQ ID NO: 505802 - RNA, 61 nt, hsa
agagcauguacaugggagugagagaaaaagagagagagagacagaguggcgggggcgggga

SEQ ID NO: 505803 - RNA, 61 nt, hsa
agcauguacaugggagugagagaaaaagagagagagagacagaguggcgggggcggggagg

SEQ ID NO: 505804 - RNA, 61 nt, hsa
caguuccuaaaugauucucacaagcaacccugagagagacagucuugugagggagaucugg

SEQ ID NO: 505805 - RNA, 61 nt, hsa
caaacaaaaaacaauggaaaagaugaagcuggagagagaggaaccaguugccaagguagag

SEQ ID NO: 505806 - RNA, 61 nt, hsa
agcagcagccucagcagcugucuugguaaaggagagagagagacauggggccaguaauucc

SEQ ID NO: 505807 - RNA, 61 nt, hsa
cagcagccucagcagcugucuugguaaaggagagagagagacauggggccaguaauuccgg

SEQ ID NO: 505808 - RNA, 61 nt, hsa
gcagccucagcagcugucuugguaaaggagagagagagacauggggccaguaauuccgggg

SEQ ID NO: 505809 - RNA, 61 nt, hsa
ugaaacugaggagucugcaauuuggaauauggagagagagacugauuugcugaauuuccuu

SEQ ID NO: 505810 - RNA, 61 nt, hsa
aaacugaggagucugcaauuuggaauauggagagagagacugauuugcugaauuuccuucu

SEQ ID NO: 505811 - RNA, 61 nt, hsa
agaaccacaaugcacauuagcauauuagucugagagagaacuuauaguaaggaaacucacu

SEQ ID NO: 505812 - RNA, 61 nt, hsa
uccuggaaacuuugacaagcuuuauuaaguugagagagagagaggggaaaaaaaaaagccu

SEQ ID NO: 505813 - RNA, 61 nt, hsa
cuggaaacuuugacaagcuuuauuaaguugagagagagagaggggaaaaaaaaaagccuuu

SEQ ID NO: 505814 - RNA, 61 nt, hsa
ggaaacuuugacaagcuuuauuaaguugagagagagagaggggaaaaaaaaaagccuuucg

SEQ ID NO: 505815 - RNA, 61 nt, hsa
cggcggccgcggcugggcccugcaggagggagagagagacacagucauggcccccuuccuc

SEQ ID NO: 505816 - RNA, 61 nt, hsa
uucggcggccgcggcugggcccugcaggagggagagagagacacagucauggcccccuucc

SEQ ID NO: 505817 - RNA, 61 nt, hsa
ugaaauguccagaauaggcaaaucuguuugagagagagaaaguagaugaguacuugccuag

SEQ ID NO: 505818 - RNA, 61 nt, hsa
uaugaaauguccagaauaggcaaaucuguuugagagagagaaaguagaugaguacuugccu

SEQ ID NO: 505819 - RNA, 61 nt, hsa
gguucuccccccuacacccucugcagguggagagagagaagcugggcccagccgggccgug

SEQ ID NO: 505820 - RNA, 61 nt, hsa
aggguucuccccccuacacccucugcagguggagagagagaagcugggcccagccgggccg

SEQ ID NO: 505821 - RNA, 61 nt, hsa
gucucuagagguagaaauuugccuugcugcagagagagaaggaauggcgugggauggggga

SEQ ID NO: 505822 - RNA, 61 nt, hsa
gagacacaggucucccgucccugcaccagcugagagagacuugccgcaaagcacaaggcug

SEQ ID NO: 505823 - RNA, 61 nt, hsa
gaaauaaaaagaagagagggaggaagaaagggagagagaagaaaagaaaaaugaagaaaag

SEQ ID NO: 505824 - RNA, 61 nt, hsa
ccuagggucugcuuuagagaagggggauaaagagagagaaggacuguuaugaaaaacagaa

SEQ ID NO: 505825 - RNA, 61 nt, hsa
ugggacuccaggucuugaggagagagacagagagagagaauggauccucauaggucaggga

SEQ ID NO: 505826 - RNA, 61 nt, hsa
ucugggacuccaggucuugaggagagagacagagagagagaauggauccucauaggucagg

SEQ ID NO: 505827 - RNA, 61 nt, hsa
ggagcacuguucugggacuccaggucuugaggagagagacagagagagagaauggauccuc

SEQ ID NO: 505828 - RNA, 61 nt, hsa
gagagccccacaaaacuuuggggacaagggagagagagacucaucugacacuucuuuugga

SEQ ID NO: 505829 - RNA, 61 nt, hsa
gggagagccccacaaaacuuuggggacaagggagagagagacucaucugacacuucuuuug

SEQ ID NO: 505830 - RNA, 61 nt, hsa
agagacagaaagagagagagagagagagagagagagagauccucagaguggaaggaggggg

SEQ ID NO: 505831 - RNA, 61 nt, hsa
agagagacagaaagagagagagagagagagagagagagagauccucagaguggaaggaggg

SEQ ID NO: 505832 - RNA, 61 nt, hsa
agagagagacagaaagagagagagagagagagagagagagagauccucagaguggaaggag

SEQ ID NO: 505833 - RNA, 61 nt, hsa
agagagagagacagaaagagagagagagagagagagagagagagauccucagaguggaagg

SEQ ID NO: 505834 - RNA, 61 nt, hsa
agagagagagagacagaaagagagagagagagagagagagagagagauccucagaguggaa

SEQ ID NO: 505835 - RNA, 61 nt, hsa
gcagagagagagagacagaaagagagagagagagagagagagagagagauccucagagugg

SEQ ID NO: 505836 - RNA, 61 nt, hsa
uagcagagagagagagacagaaagagagagagagagagagagagagagagauccucagagu

SEQ ID NO: 505837 - RNA, 61 nt, hsa
gguagcagagagagagagacagaaagagagagagagagagagagagagagagauccucaga

SEQ ID NO: 505838 - RNA, 61 nt, hsa
aggguagcagagagagagagacagaaagagagagagagagagagagagagagagauccuca

SEQ ID NO: 505839 - RNA, 61 nt, hsa
gaaggguagcagagagagagagacagaaagagagagagagagagagagagagagagauccu

SEQ ID NO: 505840 - RNA, 61 nt, hsa
gggaaggguagcagagagagagagacagaaagagagagagagagagagagagagagagauc

SEQ ID NO: 505841 - RNA, 61 nt, hsa
ucugagggcagguugggaaggguagcagagagagagagacagaaagagagagagagagaga

SEQ ID NO: 505842 - RNA, 61 nt, hsa
ugucugagggcagguugggaaggguagcagagagagagagacagaaagagagagagagaga

SEQ ID NO: 505843 - RNA, 61 nt, hsa
agugucugagggcagguugggaaggguagcagagagagagagacagaaagagagagagaga

SEQ ID NO: 505844 - RNA, 61 nt, hsa
aaauguguguguguguucugugugugugugagagagagaguacuugauucauuaaaaaguc

SEQ ID NO: 505845 - RNA, 61 nt, hsa
aaaaauguguguguguguucugugugugugugagagagagaguacuugauucauuaaaaag

SEQ ID NO: 505846 - RNA, 61 nt, hsa
auuggagaaggacugggucagagaucuguuggagagagagaauaaagagauuauuuuucau

SEQ ID NO: 505847 - RNA, 61 nt, hsa
uggagaaggacugggucagagaucuguuggagagagagaauaaagagauuauuuuucauua

SEQ ID NO: 505848 - RNA, 61 nt, hsa
gcacacauaaaagcacaaagacagagacgcagagagagagagagagccacggagaggaaaa

SEQ ID NO: 505849 - RNA, 61 nt, hsa
acacauaaaagcacaaagacagagacgcagagagagagagagagccacggagaggaaaagc

SEQ ID NO: 505850 - RNA, 61 nt, hsa
acauaaaagcacaaagacagagacgcagagagagagagagagccacggagaggaaaagcag

SEQ ID NO: 505851 - RNA, 61 nt, hsa
auaaaagcacaaagacagagacgcagagagagagagagagccacggagaggaaaagcagau

SEQ ID NO: 505852 - RNA, 61 nt, hsa
cgcccagcaccccugcugauaccaccagacagagagagagagcacuugauucuucccgaga

SEQ ID NO: 505853 - RNA, 61 nt, hsa
cccagcaccccugcugauaccaccagacagagagagagagcacuugauucuucccgagaua

SEQ ID NO: 505854 - RNA, 61 nt, hsa
guccacagguggacaaagggauccccagccagagagagagagaccagccaacagcuugaua

SEQ ID NO: 505855 - RNA, 61 nt, hsa
ccacagguggacaaagggauccccagccagagagagagagaccagccaacagcuugauaga

SEQ ID NO: 505856 - RNA, 61 nt, hsa
acagguggacaaagggauccccagccagagagagagagaccagccaacagcuugauagacc

SEQ ID NO: 505857 - RNA, 61 nt, hsa
uguguguguguguguguguguguguguggcagagagagagaaagagagagagagagagaaa

SEQ ID NO: 505858 - RNA, 61 nt, hsa
uguguguguguguguguguguguguggcagagagagagaaagagagagagagagagaaauu

SEQ ID NO: 505859 - RNA, 61 nt, hsa
uguguguguguguguggcagagagagagaaagagagagagagagagaaauucuguuaaaau

SEQ ID NO: 505860 - RNA, 61 nt, hsa
uguguguguguguggcagagagagagaaagagagagagagagagaaauucuguuaaaaucu

SEQ ID NO: 505861 - RNA, 61 nt, hsa
uguguguguguggcagagagagagaaagagagagagagagagaaauucuguuaaaaucuau

SEQ ID NO: 505862 - RNA, 61 nt, hsa
uguguguguggcagagagagagaaagagagagagagagagaaauucuguuaaaaucuauuc

SEQ ID NO: 505863 - RNA, 61 nt, hsa
uguguguggcagagagagagaaagagagagagagagagaaauucuguuaaaaucuauucug

SEQ ID NO: 505864 - RNA, 61 nt, hsa
ggauagcagugaggucagaagucuuucccgggagagagauggccuggguuaucauugcuga

SEQ ID NO: 505865 - RNA, 61 nt, hsa
acauaggacugagccaaggaagagucugccugagagagacgcuuggccugugcuuugcugc

SEQ ID NO: 505866 - RNA, 61 nt, hsa
uuccaguuccguucugagagaaaaagagagagagagagaaaaagaccaugcugcauacauu

SEQ ID NO: 505867 - RNA, 61 nt, hsa
guuuccaguuccguucugagagaaaaagagagagagagagaaaaagaccaugcugcauaca

SEQ ID NO: 505868 - RNA, 61 nt, hsa
cuguuuccaguuccguucugagagaaaaagagagagagagagaaaaagaccaugcugcaua

SEQ ID NO: 505869 - RNA, 61 nt, hsa
ugcuguuuccaguuccguucugagagaaaaagagagagagagagaaaaagaccaugcugca

SEQ ID NO: 505870 - RNA, 61 nt, hsa
uuucugaaagaucuagugguucacacagagagagagagaguacugaaaaagcaacuccucu

SEQ ID NO: 505871 - RNA, 61 nt, hsa
gcuuucugaaagaucuagugguucacacagagagagagagaguacugaaaaagcaacuccu

SEQ ID NO: 505872 - RNA, 61 nt, hsa
aggcuuucugaaagaucuagugguucacacagagagagagagaguacugaaaaagcaacuc

SEQ ID NO: 505873 - RNA, 61 nt, hsa
uugggauguggauggaugugugcauaagagagagagagaauaugugugugugugugugcgu

SEQ ID NO: 505874 - RNA, 61 nt, hsa
uguugggauguggauggaugugugcauaagagagagagagaauaugugugugugugugugc

SEQ ID NO: 505875 - RNA, 61 nt, hsa
auuguugggauguggauggaugugugcauaagagagagagagaauaugugugugugugugu

SEQ ID NO: 505876 - RNA, 61 nt, hsa
gggaaaagagagagagagagagagagagagagagagagaaagauggaggagaagaacuugg

SEQ ID NO: 505877 - RNA, 61 nt, hsa
gggggaaaagagagagagagagagagagagagagagagagaaagauggaggagaagaacuu

SEQ ID NO: 505878 - RNA, 61 nt, hsa
gagggggaaaagagagagagagagagagagagagagagagagaaagauggaggagaagaac

SEQ ID NO: 505879 - RNA, 61 nt, hsa
gggagggggaaaagagagagagagagagagagagagagagagagaaagauggaggagaaga

SEQ ID NO: 505880 - RNA, 61 nt, hsa
aggggagggggaaaagagagagagagagagagagagagagagagagaaagauggaggagaa

SEQ ID NO: 505881 - RNA, 61 nt, hsa
agaggggagggggaaaagagagagagagagagagagagagagagagagaaagauggaggag

SEQ ID NO: 505882 - RNA, 61 nt, hsa
gcagaggggagggggaaaagagagagagagagagagagagagagagagagaaagauggagg

SEQ ID NO: 505883 - RNA, 61 nt, hsa
uugcagaggggagggggaaaagagagagagagagagagagagagagagagagaaagaugga

SEQ ID NO: 505884 - RNA, 61 nt, hsa
aauugcagaggggagggggaaaagagagagagagagagagagagagagagagagaaagaug

SEQ ID NO: 505885 - RNA, 61 nt, hsa
ugaauugcagaggggagggggaaaagagagagagagagagagagagagagagagagaaaga

SEQ ID NO: 505886 - RNA, 61 nt, hsa
agugaauugcagaggggagggggaaaagagagagagagagagagagagagagagagagaaa

SEQ ID NO: 505887 - RNA, 61 nt, hsa
gaagugaauugcagaggggagggggaaaagagagagagagagagagagagagagagagaga

SEQ ID NO: 505888 - RNA, 61 nt, hsa
gggaagugaauugcagaggggagggggaaaagagagagagagagagagagagagagagaga

SEQ ID NO: 505889 - RNA, 61 nt, hsa
aacucaucugaaucaucaguuccuugauggagagagagaaggagauggaaugugucuggua

SEQ ID NO: 505890 - RNA, 61 nt, hsa
ugaacucaucugaaucaucaguuccuugauggagagagagaaggagauggaaugugucugg

SEQ ID NO: 505891 - RNA, 61 nt, hsa
guucgacugggagguucuggaaagaaagagagagagagaaaagagguaaaggagggagcca

SEQ ID NO: 505892 - RNA, 61 nt, hsa
cuguucgacugggagguucuggaaagaaagagagagagagaaaagagguaaaggagggagc

SEQ ID NO: 505893 - RNA, 61 nt, hsa
uccuguucgacugggagguucuggaaagaaagagagagagagaaaagagguaaaggaggga

SEQ ID NO: 505894 - RNA, 61 nt, hsa
aggcuagaaaccuggcuggcugugagucagagagagagaggauggacgugggagaaagcaa

SEQ ID NO: 505895 - RNA, 61 nt, hsa
caaggcuagaaaccuggcuggcugugagucagagagagagaggauggacgugggagaaagc

SEQ ID NO: 505896 - RNA, 61 nt, hsa
gaucuagggguuucuuggccacauuucccuugagagagagugggauuugcccuauccacag

SEQ ID NO: 505897 - RNA, 61 nt, hsa
guucaaaaagaaaaaaauaauaaaaauaaaagagagagagaaucagaccuggguggaacuc

SEQ ID NO: 505898 - RNA, 61 nt, hsa
ucaaaaagaaaaaaauaauaaaaauaaaagagagagagaaucagaccuggguggaacucuc

SEQ ID NO: 505899 - RNA, 61 nt, hsa
ccugggguggacauucagcagagugcgaguggagagagagagaugguguuuacucagaacc

SEQ ID NO: 505900 - RNA, 61 nt, hsa
ugggguggacauucagcagagugcgaguggagagagagagaugguguuuacucagaaccug

SEQ ID NO: 505901 - RNA, 61 nt, hsa
ggguggacauucagcagagugcgaguggagagagagagaugguguuuacucagaaccugcu

SEQ ID NO: 505902 - RNA, 61 nt, hsa
ucaaggaaucauuguuuggcauugaaaauaggagagagaucaugagaaauuaccaaaaugu

SEQ ID NO: 505903 - RNA, 61 nt, hsa
ugaagucuuguucaggguauggggcuaggaugagagagaaugccacagaguaugaaggaag

SEQ ID NO: 505904 - RNA, 61 nt, hsa
caagucaacaaagaacuuaccuuggaggauagagagagagaagggaccaauuaugaggacu

SEQ ID NO: 505905 - RNA, 61 nt, hsa
agucaacaaagaacuuaccuuggaggauagagagagagaagggaccaauuaugaggacuga

SEQ ID NO: 505906 - RNA, 61 nt, hsa
ccuuaguguuuggguauauucauuucaaagggagagagagagguuuuuuucuguucugucu

SEQ ID NO: 505907 - RNA, 61 nt, hsa
uuaguguuuggguauauucauuucaaagggagagagagagguuuuuuucuguucugucuca

SEQ ID NO: 505908 - RNA, 61 nt, hsa
gguuuugaugcuagagaggaaaaaggacuuggagagagagaaggaauggcugguccagagg

SEQ ID NO: 505909 - RNA, 61 nt, hsa
uuuugaugcuagagaggaaaaaggacuuggagagagagaaggaauggcugguccagaggcu

SEQ ID NO: 505910 - RNA, 50 nt, hsa; identical to SEQ ID NO: 157121

SEQ ID NO: 505911 - RNA, 52 nt, hsa; identical to SEQ ID NO: 157122

SEQ ID NO: 505912 - RNA, 54 nt, hsa; identical to SEQ ID NO: 157123

SEQ ID NO: 505913 - RNA, 56 nt, hsa; identical to SEQ ID NO: 157124

SEQ ID NO: 505914 - RNA, 58 nt, hsa; identical to SEQ ID NO: 157125

SEQ ID NO: 505915 - RNA, 60 nt, hsa; identical to SEQ ID NO: 157126

SEQ ID NO: 505916 - RNA, 61 nt, hsa
guucacugagauggagugagagagagagagagagagagaugacaaggagcacaagaagugg

SEQ ID NO: 505917 - RNA, 61 nt, hsa
aagggaauaagcaaagggggaagaauugaaagagagagagaagaaagaauacagagagcuu

SEQ ID NO: 505918 - RNA, 61 nt, hsa
gggaauaagcaaagggggaagaauugaaagagagagagaagaaagaauacagagagcuuac

SEQ ID NO: 505919 - RNA, 61 nt, hsa
ucuuuauguguguguaugugugucagagaaagagagagagagagagagaagggaggaugag

SEQ ID NO: 505920 - RNA, 61 nt, hsa
uuuauguguguguaugugugucagagaaagagagagagagagagagaagggaggaugagaa

SEQ ID NO: 505921 - RNA, 61 nt, hsa
uauguguguguaugugugucagagaaagagagagagagagagagaagggaggaugagaacg

SEQ ID NO: 505922 - RNA, 61 nt, hsa
uguguguguaugugugucagagaaagagagagagagagagagaagggaggaugagaacgaa

SEQ ID NO: 505923 - RNA, 61 nt, hsa
uguguguaugugugucagagaaagagagagagagagagagaagggaggaugagaacgaaug

SEQ ID NO: 505924 - RNA, 61 nt, hsa
uguguaugugugucagagaaagagagagagagagagagaagggaggaugagaacgaauggg

SEQ ID NO: 505925 - RNA, 61 nt, hsa
aaagaaccaaaagagaucacaauacucaaaagagagagagagagaaaaaagagagaucuug

SEQ ID NO: 505926 - RNA, 61 nt, hsa
agaaccaaaagagaucacaauacucaaaagagagagagagagaaaaaagagagaucuugau

SEQ ID NO: 505927 - RNA, 61 nt, hsa
aaccaaaagagaucacaauacucaaaagagagagagagagaaaaaagagagaucuugaucc

SEQ ID NO: 505928 - RNA, 61 nt, hsa
ccaaaagagaucacaauacucaaaagagagagagagagaaaaaagagagaucuugauccac

SEQ ID NO: 505929 - RNA, 61 nt, hsa
gugugcagaaaucaaaugacagagaggaagugagagagagaggugucggggaggugccagg

SEQ ID NO: 505930 - RNA, 61 nt, hsa
gugcagaaaucaaaugacagagaggaagugagagagagaggugucggggaggugccaggcu

SEQ ID NO: 505931 - RNA, 61 nt, hsa
uggugcuacacagcuagaauagauauauuuagagagagagauauuuuuaagacaaagccca

SEQ ID NO: 505932 - RNA, 61 nt, hsa
gugcuacacagcuagaauagauauauuuagagagagagauauuuuuaagacaaagcccaca

SEQ ID NO: 505933 - RNA, 61 nt, hsa
ggcauuggaagcuuauucuuuuuguucacuggagagagagagaacuguuuacaguuaaucu

SEQ ID NO: 505934 - RNA, 61 nt, hsa
cauuggaagcuuauucuuuuuguucacuggagagagagagaacuguuuacaguuaaucugu

SEQ ID NO: 505935 - RNA, 61 nt, hsa
uuggaagcuuauucuuuuuguucacuggagagagagagaacuguuuacaguuaaucugugu

SEQ ID NO: 505936 - RNA, 61 nt, hsa
acaggaccaucacagcuucugaacugagccggagagagagaauggaauugcugaccccugg

SEQ ID NO: 505937 - RNA, 61 nt, hsa
aggaccaucacagcuucugaacugagccggagagagagaauggaauugcugaccccuggaa

SEQ ID NO: 505938 - RNA, 61 nt, hsa
uaaaaacauagacuggaggagguaauccauggagagagaaaaagaagagggcucaggacaa

SEQ ID NO: 505939 - RNA, 61 nt, hsa
auauugauggcaacagucaagauggugugaugagagagaugggaggggcacaaagaggagg

SEQ ID NO: 505940 - RNA, 61 nt, hsa
accuuguauuagcauccaagaaaugaugagagagagagaaauuauauacuaugaaaagugc

SEQ ID NO: 505941 - RNA, 61 nt, hsa
agaccuuguauuagcauccaagaaaugaugagagagagagaaauuauauacuaugaaaagu

SEQ ID NO: 505942 - RNA, 61 nt, hsa
ugagaccuuguauuagcauccaagaaaugaugagagagagagaaauuauauacuaugaaaa

SEQ ID NO: 505943 - RNA, 61 nt, hsa
agagugagacuccaucucaaaaaaaaaaagagagagagaugaaaagaguaggaaaaugaga

SEQ ID NO: 505944 - RNA, 61 nt, hsa
acagagugagacuccaucucaaaaaaaaaaagagagagagaugaaaagaguaggaaaauga

SEQ ID NO: 505945 - RNA, 61 nt, hsa
accugccccgaagacuccuaauaggucaagagagagagacccagacaagcaaacucaaaau

SEQ ID NO: 505946 - RNA, 61 nt, hsa
acaccugccccgaagacuccuaauaggucaagagagagagacccagacaagcaaacucaaa

SEQ ID NO: 505947 - RNA, 61 nt, hsa
uucauuaauaauaugagaaaugauaccuggagagagagauuaugagcaaauguauugcuuc

SEQ ID NO: 505948 - RNA, 61 nt, hsa
uuuucauuaauaauaugagaaaugauaccuggagagagagauuaugagcaaauguauugcu

SEQ ID NO: 505949 - RNA, 61 nt, hsa
agagcaagaaaagagaaaauauuaaaacgaggagagagaaaaauaauauuaacacaaaaaa

SEQ ID NO: 505950 - RNA, 61 nt, hsa
gguuuuguaggagcggguuugggggagucuggagagagacuggacaggggagugcuggaac

SEQ ID NO: 505951 - RNA, 61 nt, hsa
aaaaaaaaaaaagaugacaaagaaaaacagagagagagaauauuggagauguccugaauuu

SEQ ID NO: 505952 - RNA, 61 nt, hsa
uuaaaaaaaaaaaagaugacaaagaaaaacagagagagagaauauuggagauguccugaau

SEQ ID NO: 505953 - RNA, 61 nt, hsa
gcucuuaaaaaaaaaaaaaaaaaaaaaaaaagagagagagagaauaaauagaaaagaaugu

SEQ ID NO: 505954 - RNA, 61 nt, hsa
ucuuaaaaaaaaaaaaaaaaaaaaaaaaagagagagagagaauaaauagaaaagaaugugg

SEQ ID NO: 505955 - RNA, 61 nt, hsa
uuaaaaaaaaaaaaaaaaaaaaaaaaagagagagagagaauaaauagaaaagaauguggcu

SEQ ID NO: 505956 - RNA, 61 nt, hsa
caauaauguucaacugaaucucacagaugaggagagagaagaaacggaagaggaaguuuau

SEQ ID NO: 505957 - RNA, 61 nt, hsa
uggaauggaggaguuguuuggggagggaaaggagagagaaggaaaggagugagguauuucc

SEQ ID NO: 505958 - RNA, 61 nt, hsa
cugacaaauucaaaagagagagagagaucuugagagagaaaugcuguucguucaaaagugg

SEQ ID NO: 505959 - RNA, 61 nt, hsa
gcguaacuccaucugacaaauucaaaagagagagagagaucuugagagagaaaugcuguuc

SEQ ID NO: 505960 - RNA, 61 nt, hsa
cugcguaacuccaucugacaaauucaaaagagagagagagaucuugagagagaaaugcugu

SEQ ID NO: 505961 - RNA, 61 nt, hsa
accugcguaacuccaucugacaaauucaaaagagagagagagaucuugagagagaaaugcu

SEQ ID NO: 505962 - RNA, 61 nt, hsa
gacuguguugugauucauaguacauuaaaaagagagagagagagaaagaaucccacagggc

SEQ ID NO: 505963 - RNA, 61 nt, hsa
cuguguugugauucauaguacauuaaaaagagagagagagagaaagaaucccacagggcac

SEQ ID NO: 505964 - RNA, 61 nt, hsa
guguugugauucauaguacauuaaaaagagagagagagagaaagaaucccacagggcacua

SEQ ID NO: 505965 - RNA, 61 nt, hsa
guugugauucauaguacauuaaaaagagagagagagagaaagaaucccacagggcacuauu

SEQ ID NO: 505966 - RNA, 61 nt, hsa
ugacuucugcuagguagaggcauuugucuuagagagagagagagcgcgggagagagugaga

SEQ ID NO: 505967 - RNA, 61 nt, hsa
acuucugcuagguagaggcauuugucuuagagagagagagagcgcgggagagagugagaga

SEQ ID NO: 505968 - RNA, 61 nt, hsa
uucugcuagguagaggcauuugucuuagagagagagagagcgcgggagagagugagagaga

SEQ ID NO: 505969 - RNA, 61 nt, hsa
ucuuagagagagagagagcgcgggagagagugagagagagugagagcacaaagauaacgca

SEQ ID NO: 505970 - RNA, 61 nt, hsa
gagagagagugagagcacaaagauaacgcaggagagagagagagaaagaaugagaaagaaa

SEQ ID NO: 505971 - RNA, 61 nt, hsa
gagagagugagagcacaaagauaacgcaggagagagagagagaaagaaugagaaagaaaag

SEQ ID NO: 505972 - RNA, 61 nt, hsa
gagagugagagcacaaagauaacgcaggagagagagagagaaagaaugagaaagaaaagga

SEQ ID NO: 505973 - RNA, 61 nt, hsa
gagugagagcacaaagauaacgcaggagagagagagagaaagaaugagaaagaaaaggaau

SEQ ID NO: 505974 - RNA, 61 nt, hsa
aacaauagauuauuucuguuuuacuccaaaagagagagagagagugagugugagugugugu

SEQ ID NO: 505975 - RNA, 61 nt, hsa
caauagauuauuucuguuuuacuccaaaagagagagagagagugagugugagugugugugu

SEQ ID NO: 505976 - RNA, 61 nt, hsa
auagauuauuucuguuuuacuccaaaagagagagagagagugagugugagugugugugugu

SEQ ID NO: 505977 - RNA, 61 nt, hsa
gauccaaacuuccugcaacauuuucuuagaggagagagagaaauauuaaaagagaaaugaa

SEQ ID NO: 505978 - RNA, 61 nt, hsa
uccaaacuuccugcaacauuuucuuagaggagagagagaaauauuaaaagagaaaugaaac

SEQ ID NO: 505979 - RNA, 61 nt, hsa
gaagucgagacaccaucccagguguguguaagagagagagagagaacagggaggauacaga

SEQ ID NO: 505980 - RNA, 61 nt, hsa
agucgagacaccaucccagguguguguaagagagagagagagaacagggaggauacagaag

SEQ ID NO: 505981 - RNA, 61 nt, hsa
ucgagacaccaucccagguguguguaagagagagagagagaacagggaggauacagaagua

SEQ ID NO: 505982 - RNA, 61 nt, hsa
gagacaccaucccagguguguguaagagagagagagagaacagggaggauacagaaguauu

SEQ ID NO: 505983 - RNA, 61 nt, hsa
cuaagaugcauuuaauaaaaaaaaagagagagagagagaggugugagggacaaaaugcaaa

SEQ ID NO: 505984 - RNA, 61 nt, hsa
ugcuaagaugcauuuaauaaaaaaaaagagagagagagagaggugugagggacaaaaugca

SEQ ID NO: 505985 - RNA, 61 nt, hsa
uuugcuaagaugcauuuaauaaaaaaaaagagagagagagagaggugugagggacaaaaug

SEQ ID NO: 505986 - RNA, 61 nt, hsa
cuuuugcuaagaugcauuuaauaaaaaaaaagagagagagagagaggugugagggacaaaa

SEQ ID NO: 505987 - RNA, 61 nt, hsa
uuccuccccuugcuuccagggaagaugaagagagagagauuuggaaggggcucuggcuccc

SEQ ID NO: 505988 - RNA, 61 nt, hsa
ucuuccuccccuugcuuccagggaagaugaagagagagagauuuggaaggggcucuggcuc

SEQ ID NO: 505989 - RNA, 61 nt, hsa
uuuccucagugcccuuuggcuguugaggagugagagagagagagagagagagagagagaga

SEQ ID NO: 505990 - RNA, 61 nt, hsa
uccucagugcccuuuggcuguugaggagugagagagagagagagagagagagagagagaga

SEQ ID NO: 505991 - RNA, 61 nt, hsa
cucagugcccuuuggcuguugaggagugagagagagagagagagagagagagagagagaga

SEQ ID NO: 505992 - RNA, 61 nt, hsa
cagugcccuuuggcuguugaggagugagagagagagagagagagagagagagagagagaga

SEQ ID NO: 505993 - RNA, 61 nt, hsa
gugcccuuuggcuguugaggagugagagagagagagagagagagagagagagagagagaga

SEQ ID NO: 505994 - RNA, 61 nt, hsa
gcccuuuggcuguugaggagugagagagagagagagagagagagagagagagagagagaga

SEQ ID NO: 505995 - RNA, 61 nt, hsa
ccuuuggcuguugaggagugagagagagagagagagagagagagagagagagagagagaga

SEQ ID NO: 505996 - RNA, 61 nt, hsa
uuuggcuguugaggagugagagagagagagagagagagagagagagagagagagagagaca

SEQ ID NO: 505997 - RNA, 61 nt, hsa
uggcuguugaggagugagagagagagagagagagagagagagagagagagagagagacaag

SEQ ID NO: 505998 - RNA, 61 nt, hsa
gcuguugaggagugagagagagagagagagagagagagagagagagagagagagacaagca

SEQ ID NO: 505999 - RNA, 61 nt, hsa
uguugaggagugagagagagagagagagagagagagagagagagagagagagacaagcagg

SEQ ID NO: 506000 - RNA, 61 nt, hsa
uugaggagugagagagagagagagagagagagagagagagagagagagagacaagcaggag

SEQ ID NO: 506001 - RNA, 61 nt, hsa
gaggagugagagagagagagagagagagagagagagagagagagagagacaagcaggagcg

SEQ ID NO: 506002 - RNA, 61 nt, hsa
ggagugagagagagagagagagagagagagagagagagagagagagacaagcaggagcgug

SEQ ID NO: 506003 - RNA, 61 nt, hsa
agugagagagagagagagagagagagagagagagagagagagagacaagcaggagcguggc

SEQ ID NO: 506004 - RNA, 61 nt, hsa
ugagagagagagagagagagagagagagagagagagagagagacaagcaggagcguggcug

SEQ ID NO: 506005 - RNA, 61 nt, hsa
agagagagagagagagagagagagagagagagagagagagacaagcaggagcguggcugcu

SEQ ID NO: 506006 - RNA, 61 nt, hsa
agagagagagagagagagagagagagagagagagagagacaagcaggagcguggcugcucg

SEQ ID NO: 506007 - RNA, 61 nt, hsa
agucacauucgaauucggguggcauccuccggagagagagagaggaaggagauuccacaca

SEQ ID NO: 506008 - RNA, 61 nt, hsa
ucacauucgaauucggguggcauccuccggagagagagagaggaaggagauuccacacagg

SEQ ID NO: 506009 - RNA, 61 nt, hsa
acauucgaauucggguggcauccuccggagagagagagaggaaggagauuccacacagggg

SEQ ID NO: 506010 - RNA, 61 nt, hsa
aaccuagaaacguuuucauucgucauuccaagagagagagaggaaagaaaaauacaacuuu

SEQ ID NO: 506011 - RNA, 61 nt, hsa
ccuagaaacguuuucauucgucauuccaagagagagagaggaaagaaaaauacaacuuuca

SEQ ID NO: 506012 - RNA, 61 nt, hsa
cagccuagugggagagagugggggagaggaagagagagagagagcauguauacccguaugu

SEQ ID NO: 506013 - RNA, 61 nt, hsa
gccuagugggagagagugggggagaggaagagagagagagagcauguauacccguauguua

SEQ ID NO: 506014 - RNA, 61 nt, hsa
cuagugggagagagugggggagaggaagagagagagagagcauguauacccguauguuauc

SEQ ID NO: 506015 - RNA, 61 nt, hsa
gagagugaggagagugugugauagcuagaaagagagagagacagagagauggcaagcacug

SEQ ID NO: 506016 - RNA, 61 nt, hsa
gagugaggagagugugugauagcuagaaagagagagagacagagagauggcaagcacugag

SEQ ID NO: 506017 - RNA, 61 nt, hsa
auaaaagagccuugauuuuaaaaaaaaaagagagagagauguaauuuaaaaaguuuauuau

SEQ ID NO: 506018 - RNA, 61 nt, hsa
acauaaaagagccuugauuuuaaaaaaaaaagagagagagauguaauuuaaaaaguuuauu

SEQ ID NO: 506019 - RNA, 61 nt, hsa
ggccuuauuugacuucaaagaauccacaugagagagagacugcauaaauguaauaacugag

SEQ ID NO: 506020 - RNA, 61 nt, hsa
auggccuuauuugacuucaaagaauccacaugagagagagacugcauaaauguaauaacug

SEQ ID NO: 506021 - RNA, 60 nt, hsa
uggauaacagcaaaaaaacugaaaauaaagagagagagagaucuggguguuggugguugc

SEQ ID NO: 506022 - RNA, 61 nt, hsa
ucuggauaacagcaaaaaaacugaaaauaaagagagagagagaucuggguguuggugguug

SEQ ID NO: 506023 - RNA, 61 nt, hsa
agcuccauaucugcauuccacuggggaaagagagagagaaaagagcagauuuuaaaaaaaa

SEQ ID NO: 506024 - RNA, 61 nt, hsa
ucagcuccauaucugcauuccacuggggaaagagagagagaaaagagcagauuuuaaaaaa

SEQ ID NO: 506025 - RNA, 61 nt, hsa
gacaauggagagagaaagagagagagagcgcgagagagaucaagacccaaguuuugaaucu

SEQ ID NO: 506026 - RNA, 61 nt, hsa
aguuuuucuagagacaauggagagagaaagagagagagagcgcgagagagaucaagaccca

SEQ ID NO: 506027 - RNA, 61 nt, hsa
acaguuuuucuagagacaauggagagagaaagagagagagagcgcgagagagaucaagacc

SEQ ID NO: 506028 - RNA, 61 nt, hsa
uguccuugccacaguuuuucuagagacaauggagagagaaagagagagagagcgcgagaga

SEQ ID NO: 506029 - RNA, 61 nt, hsa
uugacauggugggcacacuggcgcccaguaagagagagagagagccaaagcuguccguuuu

SEQ ID NO: 506030 - RNA, 61 nt, hsa
gacauggugggcacacuggcgcccaguaagagagagagagagccaaagcuguccguuuugc

SEQ ID NO: 506031 - RNA, 61 nt, hsa
cauggugggcacacuggcgcccaguaagagagagagagagccaaagcuguccguuuugcag

SEQ ID NO: 506032 - RNA, 61 nt, hsa
gccaggacacagcucagcuugcucacgcccagagagagaaaaaguuaagcugcugacccug

SEQ ID NO: 506033 - RNA, 61 nt, hsa
ugucccaaagugaguaaaauccccuagagcagagagagagagagagagagagagugucuuc

SEQ ID NO: 506034 - RNA, 61 nt, hsa
ucccaaagugaguaaaauccccuagagcagagagagagagagagagagagagugucuucau

SEQ ID NO: 506035 - RNA, 61 nt, hsa
ccaaagugaguaaaauccccuagagcagagagagagagagagagagagagugucuucaugc

SEQ ID NO: 506036 - RNA, 61 nt, hsa
aaagugaguaaaauccccuagagcagagagagagagagagagagagagugucuucaugcca

SEQ ID NO: 506037 - RNA, 61 nt, hsa
agugaguaaaauccccuagagcagagagagagagagagagagagagugucuucaugccaac

SEQ ID NO: 506038 - RNA, 61 nt, hsa
ugaguaaaauccccuagagcagagagagagagagagagagagagugucuucaugccaacca

SEQ ID NO: 506039 - RNA, 61 nt, hsa
aguaaaauccccuagagcagagagagagagagagagagagagugucuucaugccaaccaca

SEQ ID NO: 506040 - RNA, 61 nt, hsa
uaaaauccccuagagcagagagagagagagagagagagagugucuucaugccaaccacagc

SEQ ID NO: 506041 - RNA, 61 nt, hsa
gccuuugggucgacauaguauggaaguauuugagagagagaaccuuuccacucccacugcc

SEQ ID NO: 506042 - RNA, 61 nt, hsa
cuuugggucgacauaguauggaaguauuugagagagagaaccuuuccacucccacugccag

SEQ ID NO: 506043 - RNA, 61 nt, hsa
gcaaauguacuuaagucaucauucagagugagagagagaaagcacggcugaggcugaguca

SEQ ID NO: 506044 - RNA, 61 nt, hsa
aagcaaauguacuuaagucaucauucagagugagagagagaaagcacggcugaggcugagu

SEQ ID NO: 506045 - RNA, 61 nt, hsa
ugcaaaugcuuuagaaaucucugauaauggagagagagacagaggacccuccucacuaccc

SEQ ID NO: 506046 - RNA, 61 nt, hsa
auugcaaaugcuuuagaaaucucugauaauggagagagagacagaggacccuccucacuac

SEQ ID NO: 506047 - RNA, 61 nt, hsa
cugaggagaaugguagagaggagaggagagagagagagaaugugauuuuuggccuuguggc

SEQ ID NO: 506048 - RNA, 61 nt, hsa
cacugaggagaaugguagagaggagaggagagagagagagaaugugauuuuuggccuugug

SEQ ID NO: 506049 - RNA, 61 nt, hsa
ggcacugaggagaaugguagagaggagaggagagagagagagaaugugauuuuuggccuug

SEQ ID NO: 506050 - RNA, 61 nt, hsa
cuggcacugaggagaaugguagagaggagaggagagagagagagaaugugauuuuuggccu

SEQ ID NO: 506051 - RNA, 61 nt, hsa
gagacuccaucucaaaaaaaaaaaagagagagagagagaaagaaauagaagagaagagcca

SEQ ID NO: 506052 - RNA, 61 nt, hsa
gugagacuccaucucaaaaaaaaaaaagagagagagagagaaagaaauagaagagaagagc

SEQ ID NO: 506053 - RNA, 61 nt, hsa
gagugagacuccaucucaaaaaaaaaaaagagagagagagagaaagaaauagaagagaaga

SEQ ID NO: 506054 - RNA, 61 nt, hsa
cagagugagacuccaucucaaaaaaaaaaaagagagagagagagaaagaaauagaagagaa

SEQ ID NO: 506055 - RNA, 61 nt, hsa
aagaagagggagggagagagaaagacgaagggagagagaaagcaguuuccaaggauauguu

SEQ ID NO: 506056 - RNA, 61 nt, hsa
uacugaagagaaaugggaaagaagagggagggagagagaaagacgaagggagagagaaagc

SEQ ID NO: 506057 - RNA, 61 nt, hsa
gugcacugaacucgggauguuggggauuggagagagagaauugccaaaguaacagcaaaaa

SEQ ID NO: 506058 - RNA, 61 nt, hsa
augugcacugaacucgggauguuggggauuggagagagagaauugccaaaguaacagcaaa

SEQ ID NO: 506059 - RNA, 61 nt, hsa
gcugugaucaugccacugcauuccagccugggagagagagaggaccugucuguugaaaaaa

SEQ ID NO: 506060 - RNA, 61 nt, hsa
ugugaucaugccacugcauuccagccugggagagagagaggaccugucuguugaaaaaaac

SEQ ID NO: 506061 - RNA, 61 nt, hsa
gugggcucagagcucaggagucgccuuaccugagagagauguucuagcugagagggccugg

SEQ ID NO: 506062 - RNA, 61 nt, hsa
ugucccuguccccagagggaggagcaggcaggagagagaggggaaggagguaugaauccca

SEQ ID NO: 506063 - RNA, 61 nt, hsa
guugacuuaagugagggggaaauaaaacccagagagagagagagagcgagagagagagaca

SEQ ID NO: 506064 - RNA, 61 nt, hsa
ugacuuaagugagggggaaauaaaacccagagagagagagagagcgagagagagagacaug

SEQ ID NO: 506065 - RNA, 61 nt, hsa
acuuaagugagggggaaauaaaacccagagagagagagagagcgagagagagagacauguu

SEQ ID NO: 506066 - RNA, 61 nt, hsa
uuaagugagggggaaauaaaacccagagagagagagagagcgagagagagagacauguuac

SEQ ID NO: 506067 - RNA, 61 nt, hsa
gggaaauaaaacccagagagagagagagagcgagagagagagacauguuacuaugaaagac

SEQ ID NO: 506068 - RNA, 61 nt, hsa
gaaauaaaacccagagagagagagagagcgagagagagagacauguuacuaugaaagacuu

SEQ ID NO: 506069 - RNA, 61 nt, hsa
aauaaaacccagagagagagagagagcgagagagagagacauguuacuaugaaagacuugu

SEQ ID NO: 506070 - RNA, 61 nt, hsa
ccagcaguggagugccgggacccucagaguggagagagagacccgggaugugugugcugua

SEQ ID NO: 506071 - RNA, 61 nt, hsa
agcaguggagugccgggacccucagaguggagagagagacccgggaugugugugcuguacc

SEQ ID NO: 506072 - RNA, 61 nt, hsa
gcccucgcggcgggcgcccccagggccaggagagagagacagggcuggcuccucucgcccc

SEQ ID NO: 506073 - RNA, 61 nt, hsa
ccgcccucgcggcgggcgcccccagggccaggagagagagacagggcuggcuccucucgcc

SEQ ID NO: 506074 - RNA, 61 nt, hsa
gaaccaggacacaaaagcagcaagaagcggggagagagagggauagaaaacaagcgcagga

SEQ ID NO: 506075 - RNA, 61 nt, hsa
ucacucauccugagacuuucuuuuugcaguggagagagagaauaaucuaguuggggcaaac

SEQ ID NO: 506076 - RNA, 61 nt, hsa
acucauccugagacuuucuuuuugcaguggagagagagaauaaucuaguuggggcaaacac

SEQ ID NO: 506077 - RNA, 61 nt, hsa
uugggagcugugugugucugugugugugugagagagagaucuugucugcgugugugugugu

SEQ ID NO: 506078 - RNA, 61 nt, hsa
guuugggagcugugugugucugugugugugugagagagagaucuugucugcgugugugugu

SEQ ID NO: 506079 - RNA, 61 nt, hsa
ucccgacauuuuuuuucuguuucuauucugagagagagaugaucaaguuuuaauuugggua

SEQ ID NO: 506080 - RNA, 61 nt, hsa
ugucccgacauuuuuuuucuguuucuauucugagagagagaugaucaaguuuuaauuuggg

SEQ ID NO: 506081 - RNA, 61 nt, hsa
cagugagccaagaucgcaccaccgcaugagagagagagauuacuauuucuugucccuuuuu

SEQ ID NO: 506082 - RNA, 61 nt, hsa
ugcagugagccaagaucgcaccaccgcaugagagagagagauuacuauuucuugucccuuu

SEQ ID NO: 506083 - RNA, 61 nt, hsa
guugcagugagccaagaucgcaccaccgcaugagagagagagauuacuauuucuugucccu

SEQ ID NO: 506084 - RNA, 61 nt, hsa
uguguguguguguguguguguguaugagagagagagagacuuugacgguuguagauauuuu

SEQ ID NO: 506085 - RNA, 61 nt, hsa
uguguguguguguguguguguguguaugagagagagagagacuuugacgguuguagauauu

SEQ ID NO: 506086 - RNA, 61 nt, hsa
uguguguguguguguguguguguguguaugagagagagagagacuuugacgguuguagaua

SEQ ID NO: 506087 - RNA, 61 nt, hsa
uguguguguguguguguguguguguguguaugagagagagagagacuuugacgguuguaga

SEQ ID NO: 506088 - RNA, 61 nt, hsa
gcagcgccuuugucugucuaucuggugacaagagagagacaaguaaaugggggccguuggg

SEQ ID NO: 506089 - RNA, 61 nt, hsa
gacuccaucucaaaaaauaaauaaauagaaagagagagagaggaaaaaaaaagaaaagaac

SEQ ID NO: 506090 - RNA, 61 nt, hsa
cuccaucucaaaaaauaaauaaauagaaagagagagagaggaaaaaaaaagaaaagaacac

SEQ ID NO: 506091 - RNA, 61 nt, hsa
ccuaucuccugcaaccucagugccucagccugagagagagaugagaugcucuuggacuccc

SEQ ID NO: 506092 - RNA, 61 nt, hsa
uaucuccugcaaccucagugccucagccugagagagagaugagaugcucuuggacucccca

SEQ ID NO: 506093 - RNA, 61 nt, hsa
agagacacagagagaaggagaaagagggagggagagagagaaagagagagaaagagagaga

SEQ ID NO: 506094 - RNA, 61 nt, hsa
agacacagagagaaggagaaagagggagggagagagagaaagagagagaaagagagagaga

SEQ ID NO: 506095 - RNA, 61 nt, hsa
agaaggagaaagagggagggagagagagaaagagagagaaagagagagagagagagagaga

SEQ ID NO: 506096 - RNA, 61 nt, hsa
agagggagggagagagagaaagagagagaaagagagagagagagagagagagagaaagcug

SEQ ID NO: 506097 - RNA, 61 nt, hsa
agggagggagagagagaaagagagagaaagagagagagagagagagagagagaaagcugaa

SEQ ID NO: 506098 - RNA, 61 nt, hsa
ggagggagagagagaaagagagagaaagagagagagagagagagagagagaaagcugaacg

SEQ ID NO: 506099 - RNA, 61 nt, hsa
agggagagagagaaagagagagaaagagagagagagagagagagagagaaagcugaacgug

SEQ ID NO: 506100 - RNA, 61 nt, hsa
ggagagagagaaagagagagaaagagagagagagagagagagagagaaagcugaacgugca

SEQ ID NO: 506101 - RNA, 61 nt, hsa
agagagagaaagagagagaaagagagagagagagagagagagagaaagcugaacgugcacu

SEQ ID NO: 506102 - RNA, 61 nt, hsa
agagagaaagagagagaaagagagagagagagagagagagagaaagcugaacgugcacucu

SEQ ID NO: 506103 - RNA, 61 nt, hsa
agagaaagagagagaaagagagagagagagagagagagagaaagcugaacgugcacucuga

SEQ ID NO: 506104 - RNA, 61 nt, hsa
agaaagagagagaaagagagagagagagagagagagagaaagcugaacgugcacucugaca

SEQ ID NO: 506105 - RNA, 61 nt, hsa
ccaggggcugguagacaagaacugugaaagagagagagaaaaaaccucaacuguguauuuu

SEQ ID NO: 506106 - RNA, 61 nt, hsa
ugccaggggcugguagacaagaacugugaaagagagagagaaaaaaccucaacuguguauu

SEQ ID NO: 506107 - RNA, 61 nt, hsa
agcagccaggcgcucuggagccagcuggagagagagagauccugauaccucuguggggacu

SEQ ID NO: 506108 - RNA, 61 nt, hsa
ggagcagccaggcgcucuggagccagcuggagagagagagauccugauaccucugugggga

SEQ ID NO: 506109 - RNA, 61 nt, hsa
cuggagcagccaggcgcucuggagccagcuggagagagagagauccugauaccucuguggg

SEQ ID NO: 506110 - RNA, 61 nt, hsa
gaaaugcaacuuguauaaaacaaaaaugggagagagagagguauuaaacaaauaccccccu

SEQ ID NO: 506111 - RNA, 61 nt, hsa
uagaaaugcaacuuguauaaaacaaaaaugggagagagagagguauuaaacaaauaccccc

SEQ ID NO: 506112 - RNA, 61 nt, hsa
ugugugugugugugagagagagagagagagagagagagaccagcaucuucaagagaaguau

SEQ ID NO: 506113 - RNA, 61 nt, hsa
ugugugugugugugugagagagagagagagagagagagagaccagcaucuucaagagaagu

SEQ ID NO: 506114 - RNA, 61 nt, hsa
ugugugugugugugugugagagagagagagagagagagagagaccagcaucuucaagagaa

SEQ ID NO: 506115 - RNA, 61 nt, hsa
ugugugugugugugugugugagagagagagagagagagagagagaccagcaucuucaagag

SEQ ID NO: 506116 - RNA, 61 nt, hsa
uuugugugugugugugugugugagagagagagagagagagagagagaccagcaucuucaag

SEQ ID NO: 506117 - RNA, 61 nt, hsa
uguuugugugugugugugugugugagagagagagagagagagagagagaccagcaucuuca

SEQ ID NO: 506118 - RNA, 61 nt, hsa
uguguuugugugugugugugugugugagagagagagagagagagagagagaccagcaucuu

SEQ ID NO: 506119 - RNA, 61 nt, hsa
uguguguuugugugugugugugugugugagagagagagagagagagagagagaccagcauc

SEQ ID NO: 506120 - RNA, 61 nt, hsa
uguguguguuugugugugugugugugugugagagagagagagagagagagagagaccagca

SEQ ID NO: 506121 - RNA, 61 nt, hsa
uguguguguguuugugugugugugugugugugagagagagagagagagagagagagaccag

SEQ ID NO: 506122 - RNA, 61 nt, hsa
aguauuuucaggauuuguuucuaugagacgagagagagaagccuccgcuccuuaaugugaa

SEQ ID NO: 506123 - RNA, 61 nt, hsa
ugaguauuuucaggauuuguuucuaugagacgagagagagaagccuccgcuccuuaaugug

SEQ ID NO: 506124 - RNA, 61 nt, hsa
cuuuuucaacaaaggaguguguucagaaaaggagagagaggcugagaucauucaggaguuu

SEQ ID NO: 506125 - RNA, 61 nt, hsa
gagagaacucagcaagccaaccugggaaucagagagagaaggagaaggaggggagccuguc

SEQ ID NO: 506126 - RNA, 61 nt, hsa
uucauauuucuaaaaggggccaaugcaaaaggagagagaaggacuggauuuaagccaguuu

SEQ ID NO: 506127 - RNA, 61 nt, hsa
cgaacuaauuuuuuuaaggauacugaaaaaugagagagaguggucgaaugccugaaauuuu

SEQ ID NO: 506128 - RNA, 61 nt, hsa
gagucuuuguugcuauauuuuguggggcugggagagagagauuagauuauuuugacauggg

SEQ ID NO: 506129 - RNA, 61 nt, hsa
gucuuuguugcuauauuuuguggggcugggagagagagauuagauuauuuugacaugggau

SEQ ID NO: 506130 - RNA, 61 nt, hsa
gaaaaagauuacccaaaaacugucuuuaaaagagagagagagaaaaaaaaaauaguauuug

SEQ ID NO: 506131 - RNA, 61 nt, hsa
aaaagauuacccaaaaacugucuuuaaaagagagagagagaaaaaaaaaauaguauuugca

SEQ ID NO: 506132 - RNA, 61 nt, hsa
aagauuacccaaaaacugucuuuaaaagagagagagagaaaaaaaaaauaguauuugcaua

SEQ ID NO: 506133 - RNA, 61 nt, hsa
aucgccuuuuccuuccaucaguugaguggcugagagagaagugccucaucccugagccaca

SEQ ID NO: 506134 - RNA, 61 nt, hsa
gggacaaaaccgguugaccagaaaaugggcagagagagaugaccucggaagcauuuccaca

SEQ ID NO: 506135 - RNA, 61 nt, hsa
aucucauggaugguucucaaagguaaaaaaagagagagaaagagagagagcuagcuguggg

SEQ ID NO: 506136 - RNA, 61 nt, hsa
ugguucucaaagguaaaaaaagagagagaaagagagagagcuagcugugggauucugugua

SEQ ID NO: 506137 - RNA, 61 nt, hsa
cccuguuuccugggcuagucuuggaccccacgagagagaaucguuccucagccucauggug

SEQ ID NO: 506138 - RNA, 61 nt, hsa
caucuccguaaaugugcucugcuccucagcugagagagaaaaaaauaaacuguauuuggcu

SEQ ID NO: 506139 - RNA, 61 nt, hsa
aacuggaaaagauguuaacaguaaagauggagagagagagugugugcguguguguguauau

SEQ ID NO: 506140 - RNA, 61 nt, hsa
uuaacuggaaaagauguuaacaguaaagauggagagagagagugugugcguguguguguau

SEQ ID NO: 506141 - RNA, 61 nt, hsa
ugcagaauucuuuugguucuuugguuccagagagagagaagaugcuugugccagguggcac

SEQ ID NO: 506142 - RNA, 61 nt, hsa
agugcagaauucuuuugguucuuugguuccagagagagagaagaugcuugugccagguggc

SEQ ID NO: 506143 - RNA, 61 nt, hsa
cuuaucucaaaaaaaaaaaaaaaaagagagagagagagaaaaagaaaugcuguguuuaauc

SEQ ID NO: 506144 - RNA, 61 nt, hsa
accuuaucucaaaaaaaaaaaaaaaaagagagagagagagaaaaagaaaugcuguguuuaa

SEQ ID NO: 506145 - RNA, 61 nt, hsa
agaccuuaucucaaaaaaaaaaaaaaaaagagagagagagagaaaaagaaaugcuguguuu

SEQ ID NO: 506146 - RNA, 61 nt, hsa
ugagaccuuaucucaaaaaaaaaaaaaaaaagagagagagagagaaaaagaaaugcugugu

SEQ ID NO: 506147 - RNA, 61 nt, hsa
guguguguguguguacucuguguguguaugagagagagaaaugcuaaccuuguagcaugug

SEQ ID NO: 506148 - RNA, 61 nt, hsa
guguguguguguguguacucuguguguguaugagagagagaaaugcuaaccuuguagcaug

SEQ ID NO: 506149 - RNA, 61 nt, hsa
uguauggcugagcaagagagagagagaaugagagagagacugugugugugugugugugugu

SEQ ID NO: 506150 - RNA, 61 nt, hsa
guuguauggcugagcaagagagagagagaaugagagagagacugugugugugugugugugu

SEQ ID NO: 506151 - RNA, 61 nt, hsa
cuggagggguguuguauggcugagcaagagagagagagaaugagagagagacugugugugu

SEQ ID NO: 506152 - RNA, 61 nt, hsa
uccuggagggguguuguauggcugagcaagagagagagagaaugagagagagacugugugu

SEQ ID NO: 506153 - RNA, 61 nt, hsa
cauccuggagggguguuguauggcugagcaagagagagagagaaugagagagagacugugu

SEQ ID NO: 506154 - RNA, 61 nt, hsa
caagaaaaauuuccaaaacuauugagagagagagagagaaaguauugaaauuuuguucugc

SEQ ID NO: 506155 - RNA, 61 nt, hsa
accaagaaaaauuuccaaaacuauugagagagagagagagaaaguauugaaauuuuguucu

SEQ ID NO: 506156 - RNA, 61 nt, hsa
guaccaagaaaaauuuccaaaacuauugagagagagagagagaaaguauugaaauuuuguu

SEQ ID NO: 506157 - RNA, 61 nt, hsa
ugguaccaagaaaaauuuccaaaacuauugagagagagagagagaaaguauugaaauuuug

SEQ ID NO: 506158 - RNA, 61 nt, hsa
auugguaccaagaaaaauuuccaaaacuauugagagagagagagagaaaguauugaaauuu

SEQ ID NO: 506159 - RNA, 61 nt, hsa
uuuugaaucuaucuuaaaauacugagguguggagagagagacaggaucaggagcgauagag

SEQ ID NO: 506160 - RNA, 61 nt, hsa
uugaaucuaucuuaaaauacugagguguggagagagagacaggaucaggagcgauagagag

SEQ ID NO: 506161 - RNA, 61 nt, hsa
aguguguguguguguguguguguguguguaugagagagagagagagagacaacagagacag

SEQ ID NO: 506162 - RNA, 61 nt, hsa
uguguguguguguguguguguguguguaugagagagagagagagagacaacagagacagag

SEQ ID NO: 506163 - RNA, 61 nt, hsa
uguguguguguguguguguguguguaugagagagagagagagagacaacagagacagagag

SEQ ID NO: 506164 - RNA, 61 nt, hsa
uguguguguguguguguguguguaugagagagagagagagagacaacagagacagagagag

SEQ ID NO: 506165 - RNA, 61 nt, hsa
uguguguguguguguguguguaugagagagagagagagagacaacagagacagagagaggc

SEQ ID NO: 506166 - RNA, 61 nt, hsa
uguguguguguguguguguaugagagagagagagagagacaacagagacagagagaggcag

SEQ ID NO: 506167 - RNA, 61 nt, hsa
acagagagaggcagagaggcauagagagacagagagagagacaagaaacagagauagacag

SEQ ID NO: 506168 - RNA, 61 nt, hsa
agagagaggcagagaggcauagagagacagagagagagacaagaaacagagauagacagaa

SEQ ID NO: 506169 - RNA, 61 nt, hsa
cugucucagaaaaaaaaaaaaaaaagagagagagagagaaagagaacaauauuugggagag

SEQ ID NO: 506170 - RNA, 61 nt, hsa
cucugucucagaaaaaaaaaaaaaaaagagagagagagagaaagagaacaauauuugggag

SEQ ID NO: 506171 - RNA, 61 nt, hsa
gacucugucucagaaaaaaaaaaaaaaaagagagagagagagaaagagaacaauauuuggg

SEQ ID NO: 506172 - RNA, 61 nt, hsa
aagacucugucucagaaaaaaaaaaaaaaaagagagagagagagaaagagaacaauauuug

SEQ ID NO: 506173 - RNA, 61 nt, hsa
ggugcuguucucaggugaaaagagagagagagagagagacauaagaaauuuagagaaaaau

SEQ ID NO: 506174 - RNA, 61 nt, hsa
uaggugcuguucucaggugaaaagagagagagagagagagacauaagaaauuuagagaaaa

SEQ ID NO: 506175 - RNA, 61 nt, hsa
uguaggugcuguucucaggugaaaagagagagagagagagagacauaagaaauuuagagaa

SEQ ID NO: 506176 - RNA, 61 nt, hsa
acuguaggugcuguucucaggugaaaagagagagagagagagagacauaagaaauuuagag

SEQ ID NO: 506177 - RNA, 61 nt, hsa
aaacuguaggugcuguucucaggugaaaagagagagagagagagagacauaagaaauuuag

SEQ ID NO: 506178 - RNA, 61 nt, hsa
ggaaacuguaggugcuguucucaggugaaaagagagagagagagagagacauaagaaauuu

SEQ ID NO: 506179 - RNA, 61 nt, hsa
guugaccaugauaaugcaaauaacagaaggagagagagaaugaacccuuucuggguguuuc

SEQ ID NO: 506180 - RNA, 61 nt, hsa
uuguugaccaugauaaugcaaauaacagaaggagagagagaaugaacccuuucuggguguu

SEQ ID NO: 506181 - RNA, 61 nt, hsa
agaggaggcugaauuucucaagccauuaggagagagagaaauugggagugguccccaaaga

SEQ ID NO: 506182 - RNA, 61 nt, hsa
cgagaggaggcugaauuucucaagccauuaggagagagagaaauugggagugguccccaaa

SEQ ID NO: 506183 - RNA, 61 nt, hsa
aagagagagagagaggagaaagagagagaaggagagagacaguagccaagagaaccccacg

SEQ ID NO: 506184 - RNA, 61 nt, hsa
uuccuagagaaagagagagagagaggagaaagagagagaaggagagagacaguagccaaga

SEQ ID NO: 506185 - RNA, 61 nt, hsa
cuucacaacagacauuuccuagagaaagagagagagagaggagaaagagagagaaggagag

SEQ ID NO: 506186 - RNA, 61 nt, hsa
ugcuucacaacagacauuuccuagagaaagagagagagagaggagaaagagagagaaggag

SEQ ID NO: 506187 - RNA, 61 nt, hsa
ccugcuucacaacagacauuuccuagagaaagagagagagagaggagaaagagagagaagg

SEQ ID NO: 506188 - RNA, 61 nt, hsa
gccacuugcuugauuuaucaugagagaagaggagagagagagagacugagcgcuaggagug

SEQ ID NO: 506189 - RNA, 61 nt, hsa
cacuugcuugauuuaucaugagagaagaggagagagagagagacugagcgcuaggagugug

SEQ ID NO: 506190 - RNA, 61 nt, hsa
cuugcuugauuuaucaugagagaagaggagagagagagagacugagcgcuaggagugugug

SEQ ID NO: 506191 - RNA, 61 nt, hsa
ugcuugauuuaucaugagagaagaggagagagagagagacugagcgcuaggagugugugua

SEQ ID NO: 506192 - RNA, 61 nt, hsa
agagguggggagggagacagagacagaaacagagagagacagagacagagagagacugagg

SEQ ID NO: 506193 - RNA, 61 nt, hsa
acagagacagaaacagagagagacagagacagagagagacugagggagagacucugaggac

SEQ ID NO: 506194 - RNA, 61 nt, hsa
gagagacugagggagagacucugaggacauggagagagacucaaagagacuccaagauuca

SEQ ID NO: 506195 - RNA, 61 nt, hsa
caagagagcgggagggagggaaggagggagggagagagauagagagagagagagagagaga

SEQ ID NO: 506196 - RNA, 61 nt, hsa
ggagggagggaaggagggagggagagagauagagagagagagagagagagaggaugugugg

SEQ ID NO: 506197 - RNA, 61 nt, hsa
agggagggaaggagggagggagagagauagagagagagagagagagagaggaugugugggc

SEQ ID NO: 506198 - RNA, 61 nt, hsa
ggagggaaggagggagggagagagauagagagagagagagagagagaggaugugugggccc

SEQ ID NO: 506199 - RNA, 61 nt, hsa
agggaaggagggagggagagagauagagagagagagagagagagaggaugugugggcccua

SEQ ID NO: 506200 - RNA, 61 nt, hsa
ggaaggagggagggagagagauagagagagagagagagagagaggaugugugggcccuaag

SEQ ID NO: 506201 - RNA, 61 nt, hsa
ggagggagagagauagagagagagagagagagagagagagaggaugugugggcccuaaggc

SEQ ID NO: 506202 - RNA, 61 nt, hsa
agggagagagauagagagagagagagagagagagagagaggaugugugggcccuaaggcug

SEQ ID NO: 506203 - RNA, 61 nt, hsa
aagaucgcaccacuugcacugcagccugagagagagagagccagaccuugucucaaaaaau

SEQ ID NO: 506204 - RNA, 61 nt, hsa
ucaagaucgcaccacuugcacugcagccugagagagagagagccagaccuugucucaaaaa

SEQ ID NO: 506205 - RNA, 61 nt, hsa
ggucaagaucgcaccacuugcacugcagccugagagagagagagccagaccuugucucaaa

SEQ ID NO: 506206 - RNA, 61 nt, hsa
ugugugugugugugugugugagagagagagagagagagaugggugguggugagaaguguug

SEQ ID NO: 506207 - RNA, 61 nt, hsa
ugugugugugugugugugugugagagagagagagagagagaugggugguggugagaagugu

SEQ ID NO: 506208 - RNA, 61 nt, hsa
ugugugugugugugugugugugugagagagagagagagagagaugggugguggugagaagu

SEQ ID NO: 506209 - RNA, 61 nt, hsa
ugugugugugugugugugugugugugagagagagagagagagagaugggugguggugagaa

SEQ ID NO: 506210 - RNA, 61 nt, hsa
ugugugugugugugugugugugugugugagagagagagagagagagaugggugguggugag

SEQ ID NO: 506211 - RNA, 61 nt, hsa
agugugugugugugugugugugugugugugagagagagagagagagagaugggugguggug

SEQ ID NO: 506212 - RNA, 61 nt, hsa
gaagugugugugugugugugugugugugugugagagagagagagagagagauggguggugg

SEQ ID NO: 506213 - RNA, 61 nt, hsa
cacacacacacacacacacacacgaaggagagagagagaaaacugauggggaaaacaagcu

SEQ ID NO: 506214 - RNA, 61 nt, hsa
cacacacacacacacacacacacacgaaggagagagagagaaaacugauggggaaaacaag

SEQ ID NO: 506215 - RNA, 61 nt, hsa
cacacacacacacacacacacacacacgaaggagagagagagaaaacugauggggaaaaca

SEQ ID NO: 506216 - RNA, 61 nt, hsa
cccuggccuuuccuuuuguaauaagaaagaagagagagaacuugaugcaaaguccacgaaa

SEQ ID NO: 506217 - RNA, 61 nt, hsa
ucucugaccucccugcuugcauugggucugggagagagaguggaauauuugguagggaccu

SEQ ID NO: 506218 - RNA, 61 nt, hsa
ugucauuccccacacacguccuguucaccucgagagagagagagagagagcaccuuucuuc

SEQ ID NO: 506219 - RNA, 61 nt, hsa
ucauuccccacacacguccuguucaccucgagagagagagagagagagcaccuuucuuccg

SEQ ID NO: 506220 - RNA, 61 nt, hsa
auuccccacacacguccuguucaccucgagagagagagagagagagcaccuuucuuccguc

SEQ ID NO: 506221 - RNA, 61 nt, hsa
uccccacacacguccuguucaccucgagagagagagagagagagcaccuuucuuccgucug

SEQ ID NO: 506222 - RNA, 61 nt, hsa
cccacacacguccuguucaccucgagagagagagagagagagcaccuuucuuccgucuguu

SEQ ID NO: 506223 - RNA, 61 nt, hsa
cacacacguccuguucaccucgagagagagagagagagagcaccuuucuuccgucuguuca

SEQ ID NO: 506224 - RNA, 61 nt, hsa
gauuuuaaguguugaggagcagaggugagaagagagagagagagagaaagucaaauaaagu

SEQ ID NO: 506225 - RNA, 61 nt, hsa
uuuuaaguguugaggagcagaggugagaagagagagagagagagaaagucaaauaaaguca

SEQ ID NO: 506226 - RNA, 61 nt, hsa
uuaaguguugaggagcagaggugagaagagagagagagagagaaagucaaauaaagucaaa

SEQ ID NO: 506227 - RNA, 61 nt, hsa
aaguguugaggagcagaggugagaagagagagagagagagaaagucaaauaaagucaaaga

SEQ ID NO: 506228 - RNA, 61 nt, hsa
guguugaggagcagaggugagaagagagagagagagagaaagucaaauaaagucaaagacc

SEQ ID NO: 506229 - RNA, 61 nt, hsa
ccacccaagacauuuuaauaguaaauagagagagagagaagaguuaaugaacaugagguag

SEQ ID NO: 506230 - RNA, 61 nt, hsa
ccccacccaagacauuuuaauaguaaauagagagagagagaagaguuaaugaacaugaggu

SEQ ID NO: 506231 - RNA, 61 nt, hsa
acccccacccaagacauuuuaauaguaaauagagagagagagaagaguuaaugaacaugag

SEQ ID NO: 506232 - RNA, 61 nt, hsa
cgccuagaaauugaaaggcaaaaacuagagagagagagaauggaacgcgaacgcuuggaaa

SEQ ID NO: 506233 - RNA, 61 nt, hsa
agcgccuagaaauugaaaggcaaaaacuagagagagagagaauggaacgcgaacgcuugga

SEQ ID NO: 506234 - RNA, 61 nt, hsa
agagcgccuagaaauugaaaggcaaaaacuagagagagagagaauggaacgcgaacgcuug

SEQ ID NO: 506235 - RNA, 61 nt, hsa
ugaacgggaagaacgggaacgcuuacagagagagagagagcgccuagaaauugaaaggcaa

SEQ ID NO: 506236 - RNA, 61 nt, hsa
cgugaacgggaagaacgggaacgcuuacagagagagagagagcgccuagaaauugaaaggc

SEQ ID NO: 506237 - RNA, 61 nt, hsa
uucgugaacgggaagaacgggaacgcuuacagagagagagagagcgccuagaaauugaaag

SEQ ID NO: 506238 - RNA, 61 nt, hsa
acugauuuuugguagacgaagagagauugcagagagagagcgucgagagcgagaacgcauu

SEQ ID NO: 506239 - RNA, 61 nt, hsa
acagauggagauccuuucagggagagagagagagagagaggagaagacagagagauuaaag

SEQ ID NO: 506240 - RNA, 61 nt, hsa
caacagauggagauccuuucagggagagagagagagagagaggagaagacagagagauuaa

SEQ ID NO: 506241 - RNA, 61 nt, hsa
ugcaacagauggagauccuuucagggagagagagagagagagaggagaagacagagagauu

SEQ ID NO: 506242 - RNA, 61 nt, hsa
ggugcaacagauggagauccuuucagggagagagagagagagagaggagaagacagagaga

SEQ ID NO: 506243 - RNA, 61 nt, hsa
cuggugcaacagauggagauccuuucagggagagagagagagagagaggagaagacagaga

SEQ ID NO: 506244 - RNA, 61 nt, hsa
uccuggugcaacagauggagauccuuucagggagagagagagagagagaggagaagacaga

SEQ ID NO: 506245 - RNA, 61 nt, hsa
ugcauuuccugcugggguccugguuccucaggagagagagaccacagggugagagugagcc

SEQ ID NO: 506246 - RNA, 61 nt, hsa
cauuuccugcugggguccugguuccucaggagagagagaccacagggugagagugagccag

SEQ ID NO: 506247 - RNA, 61 nt, hsa
acauggccuuggcaguuauuuuuccaucaccgagagagagagacagagagagaaaauaaac

SEQ ID NO: 506248 - RNA, 61 nt, hsa
auggccuuggcaguuauuuuuccaucaccgagagagagagacagagagagaaaauaaacua

SEQ ID NO: 506249 - RNA, 61 nt, hsa
ggccuuggcaguuauuuuuccaucaccgagagagagagacagagagagaaaauaaacuacc

SEQ ID NO: 506250 - RNA, 61 nt, hsa
guuauuuuuccaucaccgagagagagagacagagagagaaaauaaacuaccccuccuauuc

SEQ ID NO: 506251 - RNA, 61 nt, hsa
agaaagagagugagagagagagagaaagagagagagagaugcuguugaaucagaaacagau

SEQ ID NO: 506252 - RNA, 61 nt, hsa
agagaaagagagugagagagagagagaaagagagagagagaugcuguugaaucagaaacag

SEQ ID NO: 506253 - RNA, 61 nt, hsa
agagagaaagagagugagagagagagagaaagagagagagagaugcuguugaaucagaaac

SEQ ID NO: 506254 - RNA, 61 nt, hsa
agagagugagagagagaaagagagugagagagagagagaaagagagagagagaugcuguug

SEQ ID NO: 506255 - RNA, 61 nt, hsa
ccagagagugagagagagaaagagagugagagagagagagaaagagagagagagaugcugu

SEQ ID NO: 506256 - RNA, 61 nt, hsa
agccagagagugagagagagaaagagagugagagagagagagaaagagagagagagaugcu

SEQ ID NO: 506257 - RNA, 61 nt, hsa
agagccagagagugagagagagaaagagagugagagagagagagaaagagagagagagaug

SEQ ID NO: 506258 - RNA, 61 nt, hsa
aguaaccaguuuccagagagccagagagugagagagagaaagagagugagagagagagaga

SEQ ID NO: 506259 - RNA, 61 nt, hsa
agaguaaccaguuuccagagagccagagagugagagagagaaagagagugagagagagaga

SEQ ID NO: 506260 - RNA, 61 nt, hsa
cugaggccgcugguagacuuuuguuaaaagagagagagacagagacagagaaauaagcauu

SEQ ID NO: 506261 - RNA, 61 nt, hsa
gccugaggccgcugguagacuuuuguuaaaagagagagagacagagacagagaaauaagca

SEQ ID NO: 506262 - RNA, 61 nt, hsa
acuuuacaaaggaaauuugaauaaauggagagagagagaagccuuguuguuggauaggaaa

SEQ ID NO: 506263 - RNA, 61 nt, hsa
ccacuuuacaaaggaaauuugaauaaauggagagagagagaagccuuguuguuggauagga

SEQ ID NO: 506264 - RNA, 61 nt, hsa
ggccacuuuacaaaggaaauuugaauaaauggagagagagagaagccuuguuguuggauag

SEQ ID NO: 506265 - RNA, 61 nt, hsa
agaagugcuggggcagggaggcccaggagaugagagagaagguccgaguaggugauagaag

SEQ ID NO: 506266 - RNA, 61 nt, hsa
cacggaguugccaggagcaaaccaaagugaagagagagauaggaagcugccucggggccac

SEQ ID NO: 506267 - RNA, 61 nt, hsa
gaaaggucuaaaugcccacuugaaugaagcugagagagagaucuagcaaaagcuaaaacuc

SEQ ID NO: 506268 - RNA, 61 nt, hsa
aaggucuaaaugcccacuugaaugaagcugagagagagaucuagcaaaagcuaaaacucau

SEQ ID NO: 506269 - RNA, 61 nt, hsa
cacuccggagugagaagcuuugcccuccuaagagagagagacagagagacagagagagaga

SEQ ID NO: 506270 - RNA, 61 nt, hsa
cuccggagugagaagcuuugcccuccuaagagagagagacagagagacagagagagagaaa

SEQ ID NO: 506271 - RNA, 61 nt, hsa
ugcccuccuaagagagagagacagagagacagagagagagaaagagagagugugugggucu

SEQ ID NO: 506272 - RNA, 61 nt, hsa
cccuccuaagagagagagacagagagacagagagagagaaagagagagugugugggucuau

SEQ ID NO: 506273 - RNA, 61 nt, hsa
aauuuaucucugugaccugccagggagaggggagagagagagagaugcuguugagcacaug

SEQ ID NO: 506274 - RNA, 61 nt, hsa
uuuaucucugugaccugccagggagaggggagagagagagagaugcuguugagcacaugac

SEQ ID NO: 506275 - RNA, 61 nt, hsa
uaucucugugaccugccagggagaggggagagagagagagaugcuguugagcacaugacaa

SEQ ID NO: 506276 - RNA, 61 nt, hsa
ucucugugaccugccagggagaggggagagagagagagaugcuguugagcacaugacaaaa

SEQ ID NO: 506277 - RNA, 61 nt, hsa
cugggagcuauuuacaaauguccaugugggagagagagagcaugagagcacaguagcccag

SEQ ID NO: 506278 - RNA, 61 nt, hsa
accugggagcuauuuacaaauguccaugugggagagagagagcaugagagcacaguagccc

SEQ ID NO: 506279 - RNA, 61 nt, hsa
aggcagagagacagagagggagagagggacagagagagauagagcaggaggucggggcacu

SEQ ID NO: 506280 - RNA, 61 nt, hsa
ggagacagagagggagagagagacagagggagagagagacagaggggaagagaggcagaga

SEQ ID NO: 506281 - RNA, 61 nt, hsa
gaggagacagagagggagagagagacagagggagagagagacagaggggaagagaggcaga

SEQ ID NO: 506282 - RNA, 61 nt, hsa
gagggagagaaacagaggagacagagagggagagagagacagagggagagagagacagagg

SEQ ID NO: 506283 - RNA, 61 nt, hsa
gagagggagagaaacagaggagacagagagggagagagagacagagggagagagagacaga

SEQ ID NO: 506284 - RNA, 61 nt, hsa
gagguggggagaggggagagagauaugaggagagagagacagaggaggcagagagggagag

SEQ ID NO: 506285 - RNA, 61 nt, hsa
gagagguggggagaggggagagagauaugaggagagagagacagaggaggcagagagggag

SEQ ID NO: 506286 - RNA, 61 nt, hsa
aggggagagagaaagagagguggggagaggggagagagauaugaggagagagagacagagg

SEQ ID NO: 506287 - RNA, 61 nt, hsa
aaaggaggagggagagagauggagaggaggggagagagaaagagagguggggagaggggag

SEQ ID NO: 506288 - RNA, 61 nt, hsa
uaaaugggggucagggagggaaaggaggagggagagagauggagaggaggggagagagaaa

SEQ ID NO: 506289 - RNA, 61 nt, hsa
ugccugauuggaaaaaaaaaaaaaagagagagagagagaagaagaagaagaagagacacaa

SEQ ID NO: 506290 - RNA, 61 nt, hsa
agugccugauuggaaaaaaaaaaaaaagagagagagagagaagaagaagaagaagagacac

SEQ ID NO: 506291 - RNA, 61 nt, hsa
agagugccugauuggaaaaaaaaaaaaaagagagagagagagaagaagaagaagaagagac

SEQ ID NO: 506292 - RNA, 61 nt, hsa
agagagugccugauuggaaaaaaaaaaaaaagagagagagagagaagaagaagaagaagag

SEQ ID NO: 506293 - RNA, 61 nt, hsa
aucagcaucuggcauccaaagcaacaucagagagagagaacacagaagaaaagcaauugcc

SEQ ID NO: 506294 - RNA, 61 nt, hsa
uuaucagcaucuggcauccaaagcaacaucagagagagagaacacagaagaaaagcaauug

SEQ ID NO: 506295 - RNA, 61 nt, hsa
aguuauuuggaaagaaagaaagaaagagagagagagagaaagaaagaaagaaaggcugccu

SEQ ID NO: 506296 - RNA, 61 nt, hsa
aaaguuauuuggaaagaaagaaagaaagagagagagagagaaagaaagaaagaaaggcugc

SEQ ID NO: 506297 - RNA, 61 nt, hsa
aaaaaguuauuuggaaagaaagaaagaaagagagagagagagaaagaaagaaagaaaggcu

SEQ ID NO: 506298 - RNA, 61 nt, hsa
ggaaaaaguuauuuggaaagaaagaaagaaagagagagagagagaaagaaagaaagaaagg

SEQ ID NO: 506299 - RNA, 61 nt, hsa
aaugggcagaggugagagagagagagagaaagagagagaaugaaugcaguugcauugauuc

SEQ ID NO: 506300 - RNA, 61 nt, hsa
gugccuuuugaaugggcagaggugagagagagagagagaaagagagagaaugaaugcaguu

SEQ ID NO: 506301 - RNA, 61 nt, hsa
cagugccuuuugaaugggcagaggugagagagagagagagaaagagagagaaugaaugcag

SEQ ID NO: 506302 - RNA, 61 nt, hsa
uccagugccuuuugaaugggcagaggugagagagagagagagaaagagagagaaugaaugc

SEQ ID NO: 506303 - RNA, 61 nt, hsa
acuccagugccuuuugaaugggcagaggugagagagagagagagaaagagagagaaugaau

SEQ ID NO: 506304 - RNA, 61 nt, hsa
ggacuccagugccuuuugaaugggcagaggugagagagagagagagaaagagagagaauga

SEQ ID NO: 506305 - RNA, 61 nt, hsa
cuauggacacggaguggggcgggcaucuggagagagagagggagcggaggcuaaggacugg

SEQ ID NO: 506306 - RNA, 61 nt, hsa
ugcuauggacacggaguggggcgggcaucuggagagagagagggagcggaggcuaaggacu

SEQ ID NO: 506307 - RNA, 61 nt, hsa
ggaauuucagugggucucuguguguguaugagagagagaguguguguuuguguguuucaag

SEQ ID NO: 506308 - RNA, 61 nt, hsa
gaggaauuucagugggucucuguguguguaugagagagagaguguguguuuguguguuuca

SEQ ID NO: 506309 - RNA, 61 nt, hsa
uacaaaguguugauccccuucuuucccaugagagagagaacuggugauacuccaacaccgu

SEQ ID NO: 506310 - RNA, 61 nt, hsa
ucuacaaaguguugauccccuucuuucccaugagagagagaacuggugauacuccaacacc

SEQ ID NO: 506311 - RNA, 61 nt, hsa
uagcaucuguaacagcauuaacugucuuaaagagagagagagagaauuccgaauuggggaa

SEQ ID NO: 506312 - RNA, 61 nt, hsa
gcaucuguaacagcauuaacugucuuaaagagagagagagagaauuccgaauuggggaaca

SEQ ID NO: 506313 - RNA, 61 nt, hsa
aucuguaacagcauuaacugucuuaaagagagagagagagaauuccgaauuggggaacaca

SEQ ID NO: 506314 - RNA, 61 nt, hsa
cuguaacagcauuaacugucuuaaagagagagagagagaauuccgaauuggggaacacacg

SEQ ID NO: 506315 - RNA, 61 nt, hsa
ugaacgggcccacccacacguuguauauucagagagagagagggagucaaggugugaccgu

SEQ ID NO: 506316 - RNA, 61 nt, hsa
aacgggcccacccacacguuguauauucagagagagagagggagucaaggugugaccgucg

SEQ ID NO: 506317 - RNA, 61 nt, hsa
ucugaaagaaagagagaaagaaagaaagaaagagagagaaagaaagaaagaaagaaaggga

SEQ ID NO: 506318 - RNA, 61 nt, hsa
auggaaggaaggaaggaaaaagaaagagaaagagagagagagagaaagaaaaagaaagaaa

SEQ ID NO: 506319 - RNA, 61 nt, hsa
ggaaggaaggaaggaaaaagaaagagaaagagagagagagagaaagaaaaagaaagaaaag

SEQ ID NO: 506320 - RNA, 61 nt, hsa
aaggaaggaaggaaaaagaaagagaaagagagagagagagaaagaaaaagaaagaaaagua

SEQ ID NO: 506321 - RNA, 61 nt, hsa
ggaaggaaggaaaaagaaagagaaagagagagagagagaaagaaaaagaaagaaaaguaag

SEQ ID NO: 506322 - RNA, 61 nt, hsa
acucgagcucaagaauucaagaccugggcaagagagagagacuuugucucuauuaaaaaua

SEQ ID NO: 506323 - RNA, 61 nt, hsa
ucgagcucaagaauucaagaccugggcaagagagagagacuuugucucuauuaaaaauaaa

SEQ ID NO: 506324 - RNA, 61 nt, hsa
uuagacacacaaaacaaacaaacacaugggggagagagacuuggaagaggaggaggaggag

SEQ ID NO: 506325 - RNA, 61 nt, hsa
cuuggaagaggaggaggaggaggagaaggaggagagagaggggaagagacaaagugggugu

SEQ ID NO: 506326 - RNA, 61 nt, hsa
acaccauuucccuccucuagaccucaucuuggagagagagauguuggauggggccaucuau

SEQ ID NO: 506327 - RNA, 61 nt, hsa
accauuucccuccucuagaccucaucuuggagagagagauguuggauggggccaucuauuc

SEQ ID NO: 506328 - RNA, 61 nt, hsa
cguggaaccccgaagccuggcgggagagagagagagagaagucuccucugcauuuuggguu

SEQ ID NO: 506329 - RNA, 61 nt, hsa
cccguggaaccccgaagccuggcgggagagagagagagagaagucuccucugcauuuuggg

SEQ ID NO: 506330 - RNA, 61 nt, hsa
gccccguggaaccccgaagccuggcgggagagagagagagagaagucuccucugcauuuug

SEQ ID NO: 506331 - RNA, 61 nt, hsa
gggccccguggaaccccgaagccuggcgggagagagagagagagaagucuccucugcauuu

SEQ ID NO: 506332 - RNA, 61 nt, hsa
augggccccguggaaccccgaagccuggcgggagagagagagagagaagucuccucugcau

SEQ ID NO: 506333 - RNA, 61 nt, hsa
gugcgcacgcccuuuugugcagugagagagagagagagauugcacacaugugucucuguag

SEQ ID NO: 506334 - RNA, 61 nt, hsa
gugugcgcacgcccuuuugugcagugagagagagagagagauugcacacaugugucucugu

SEQ ID NO: 506335 - RNA, 61 nt, hsa
gugugugcgcacgcccuuuugugcagugagagagagagagagauugcacacaugugucucu

SEQ ID NO: 506336 - RNA, 61 nt, hsa
gugugugugcgcacgcccuuuugugcagugagagagagagagagauugcacacaugugucu

SEQ ID NO: 506337 - RNA, 61 nt, hsa
gugugugugugcgcacgcccuuuugugcagugagagagagagagagauugcacacaugugu

SEQ ID NO: 506338 - RNA, 61 nt, hsa
aaaaaaaaaaagcgagcgagagagagagcgagagagagagcgagagcagaagaaauuccua

SEQ ID NO: 506339 - RNA, 61 nt, hsa
aaaaaaaaaaaaagcgagcgagagagagagcgagagagagagcgagagcagaagaaauucc

SEQ ID NO: 506340 - RNA, 61 nt, hsa
aaagacaaaaaaaaaaaaaaaaagcgagcgagagagagagcgagagagagagcgagagcag

SEQ ID NO: 506341 - RNA, 61 nt, hsa
gaaaagacaaaaaaaaaaaaaaaaagcgagcgagagagagagcgagagagagagcgagagc

SEQ ID NO: 506342 - RNA, 61 nt, hsa
ccagggucuggugauggcagggauggggggagagagagaaaauccacaaauuccaauguca

SEQ ID NO: 506343 - RNA, 61 nt, hsa
ccccagggucuggugauggcagggauggggggagagagagaaaauccacaaauuccaaugu

SEQ ID NO: 506344 - RNA, 61 nt, hsa
aaaacagaaacccgagaaagagagagacagagagagagaaaaaaaaucacccaccaccccc

SEQ ID NO: 506345 - RNA, 61 nt, hsa
agaaaacagaaacccgagaaagagagagacagagagagagaaaaaaaaucacccaccaccc

SEQ ID NO: 506346 - RNA, 61 nt, hsa
aaccaaaaagagaaaacagaaacccgagaaagagagagacagagagagagaaaaaaaauca

SEQ ID NO: 506347 - RNA, 61 nt, hsa
gcagagagagagagagagaaagagagagagagagagagaaggggcccaagagagacagcac

SEQ ID NO: 506348 - RNA, 61 nt, hsa
cagcagagagagagagagagaaagagagagagagagagagaaggggcccaagagagacagc

SEQ ID NO: 506349 - RNA, 61 nt, hsa
ggcagcagagagagagagagagaaagagagagagagagagagaaggggcccaagagagaca

SEQ ID NO: 506350 - RNA, 61 nt, hsa
cgggcagcagagagagagagagagaaagagagagagagagagagaaggggcccaagagaga

SEQ ID NO: 506351 - RNA, 61 nt, hsa
cccgggcagcagagagagagagagagaaagagagagagagagagagaaggggcccaagaga

SEQ ID NO: 506352 - RNA, 61 nt, hsa
uccccgggcagcagagagagagagagagaaagagagagagagagagagaaggggcccaaga

SEQ ID NO: 506353 - RNA, 61 nt, hsa
ucccacccccuccccgggcagcagagagagagagagagaaagagagagagagagagagaag

SEQ ID NO: 506354 - RNA, 61 nt, hsa
ccucccacccccuccccgggcagcagagagagagagagagaaagagagagagagagagaga

SEQ ID NO: 506355 - RNA, 61 nt, hsa
gcccucccacccccuccccgggcagcagagagagagagagagaaagagagagagagagaga

SEQ ID NO: 506356 - RNA, 61 nt, hsa
cugcccucccacccccuccccgggcagcagagagagagagagagaaagagagagagagaga

SEQ ID NO: 506357 - RNA, 61 nt, hsa
gccugcccucccacccccuccccgggcagcagagagagagagagagaaagagagagagaga

SEQ ID NO: 506358 - RNA, 61 nt, hsa
uuccauuaaguacaugugccaggaaacaagagagagagaaaguaaaggcaguaaugccuuc

SEQ ID NO: 506359 - RNA, 61 nt, hsa
uuuuccauuaaguacaugugccaggaaacaagagagagagaaaguaaaggcaguaaugccu

SEQ ID NO: 506360 - RNA, 61 nt, hsa
uuauauauuauauagagagagggaggagagcgagagagagugaggacaccgaacugggcug

SEQ ID NO: 506361 - RNA, 61 nt, hsa
aagauacagagagucaaauagagagaauggagagagagaaacauauauuauauauuauaua

SEQ ID NO: 506362 - RNA, 61 nt, hsa
uaaagauacagagagucaaauagagagaauggagagagagaaacauauauuauauauuaua

SEQ ID NO: 506363 - RNA, 61 nt, hsa
gcugugacucaaggccacggcucuacuaaaagagagagaggaagcgagagagagagagaaa

SEQ ID NO: 506364 - RNA, 61 nt, hsa
ccacggcucuacuaaaagagagagaggaagcgagagagagagagaaaaaacaaaaaacaga

SEQ ID NO: 506365 - RNA, 61 nt, hsa
acggcucuacuaaaagagagagaggaagcgagagagagagagaaaaaacaaaaaacagaaa

SEQ ID NO: 506366 - RNA, 61 nt, hsa
ggcucuacuaaaagagagagaggaagcgagagagagagagaaaaaacaaaaaacagaaaac

SEQ ID NO: 506367 - RNA, 61 nt, hsa
cucuacuaaaagagagagaggaagcgagagagagagagaaaaaacaaaaaacagaaaacac

SEQ ID NO: 506368 - RNA, 61 nt, hsa
ucgcuuuaguuuucaaccuuguuggugcugagagagagaaccgagaggucccaguacaagg

SEQ ID NO: 506369 - RNA, 61 nt, hsa
ucucgcuuuaguuuucaaccuuguuggugcugagagagagaaccgagaggucccaguacaa

SEQ ID NO: 506370 - RNA, 61 nt, hsa
gcgccgccuccuagacucgagcagagccggagagagagacgagagggugggaggucccgga

SEQ ID NO: 506371 - RNA, 61 nt, hsa
cagcgccgccuccuagacucgagcagagccggagagagagacgagagggugggaggucccg

SEQ ID NO: 506372 - RNA, 61 nt, hsa
uccccuggugucugcacagccuuuauaaagagagagagagcuccgaagcaauaacaacacc

SEQ ID NO: 506373 - RNA, 61 nt, hsa
cuuccccuggugucugcacagccuuuauaaagagagagagagcuccgaagcaauaacaaca

SEQ ID NO: 506374 - RNA, 61 nt, hsa
uuagcacuguucacuacauuaacaugcaagagagagagaagccuuguuacauuuccugcua

SEQ ID NO: 506375 - RNA, 61 nt, hsa
uauuagcacuguucacuacauuaacaugcaagagagagagaagccuuguuacauuuccugc

SEQ ID NO: 506376 - RNA, 61 nt, hsa
uauucccagacugaggcagggcagguuugcagagagagacccagagugcacgugacccgca

SEQ ID NO: 506377 - RNA, 61 nt, hsa
cuccuuaccacccaccaggccagauuuacaggagagagaaauccacuccacucuuccuuaa

SEQ ID NO: 506378 - RNA, 61 nt, hsa
auuauaggauuuuuuuuucuucuuuuuuagagagagagauuagaaaacgacauuaggaauu

SEQ ID NO: 506379 - RNA, 61 nt, hsa
aaauuauaggauuuuuuuuucuucuuuuuuagagagagagauuagaaaacgacauuaggaa

SEQ ID NO: 506380 - RNA, 61 nt, hsa
gaagacagugguucugauggguucagcccuagagagagagagagaagcggggagaauaaga

SEQ ID NO: 506381 - RNA, 61 nt, hsa
agacagugguucugauggguucagcccuagagagagagagagaagcggggagaauaagagu

SEQ ID NO: 506382 - RNA, 61 nt, hsa
acagugguucugauggguucagcccuagagagagagagagaagcggggagaauaagagugc

SEQ ID NO: 506383 - RNA, 61 nt, hsa
agugguucugauggguucagcccuagagagagagagagaagcggggagaauaagagugcac

SEQ ID NO: 506384 - RNA, 61 nt, hsa
gagccagaaaguaacacagagcucaugcuuggagagagagagucuuggccauggcuuuccu

SEQ ID NO: 506385 - RNA, 61 nt, hsa
gccagaaaguaacacagagcucaugcuuggagagagagagucuuggccauggcuuuccugc

SEQ ID NO: 506386 - RNA, 61 nt, hsa
cucuccggaucugucgauuuggagaccuuccgagagagaaccaagggugcagucagcuuaa

SEQ ID NO: 506387 - RNA, 61 nt, hsa
cauauuuagaaguaaaacacaaaacaaaaaagagagagaaaagaaaagaaaucacaaugua

SEQ ID NO: 506388 - RNA, 61 nt, hsa
cucugggccuccagcgcuggguuugucgagugagagagagagaggagcuuggguugcuucc

SEQ ID NO: 506389 - RNA, 61 nt, hsa
cugggccuccagcgcuggguuugucgagugagagagagagaggagcuuggguugcuucccu

SEQ ID NO: 506390 - RNA, 61 nt, hsa
gggccuccagcgcuggguuugucgagugagagagagagaggagcuuggguugcuucccugu

SEQ ID NO: 506391 - RNA, 61 nt, hsa
uagaagagggaaggaaagagagaaggaaagagagagagaaagaaagucuccagaccaggaa

SEQ ID NO: 506392 - RNA, 61 nt, hsa
cauagaagagggaaggaaagagagaaggaaagagagagagaaagaaagucuccagaccagg

SEQ ID NO: 506393 - RNA, 61 nt, hsa
gucaaaauguuacaaccgcuguaaaaugacggagagagagagaaagaaucccagacauuaa

SEQ ID NO: 506394 - RNA, 61 nt, hsa
caaaauguuacaaccgcuguaaaaugacggagagagagagaaagaaucccagacauuaacg

SEQ ID NO: 506395 - RNA, 61 nt, hsa
aaauguuacaaccgcuguaaaaugacggagagagagagaaagaaucccagacauuaacggu

SEQ ID NO: 506396 - RNA, 64 nt, hsa; identical to SEQ ID NO: 90267

SEQ ID NO: 506397 - RNA, 64 nt, hsa; identical to SEQ ID NO: 90268

SEQ ID NO: 506398 - RNA, 64 nt, hsa; identical to SEQ ID NO: 90269

SEQ ID NO: 506399 - RNA, 64 nt, hsa; identical to SEQ ID NO: 90270

SEQ ID NO: 506400 - RNA, 64 nt, hsa; identical to SEQ ID NO: 90271

SEQ ID NO: 506401 - RNA, 64 nt, hsa; identical to SEQ ID NO: 90272

SEQ ID NO: 506402 - RNA, 64 nt, hsa; identical to SEQ ID NO: 90273

SEQ ID NO: 506403 - RNA, 64 nt, hsa; identical to SEQ ID NO: 90274

SEQ ID NO: 506404 - RNA, 64 nt, hsa; identical to SEQ ID NO: 90275

SEQ ID NO: 506405 - RNA, 64 nt, hsa; identical to SEQ ID NO: 90276

SEQ ID NO: 506406 - RNA, 64 nt, hsa; identical to SEQ ID NO: 90277

SEQ ID NO: 506407 - RNA, 64 nt, hsa; identical to SEQ ID NO: 90278

SEQ ID NO: 506408 - RNA, 64 nt, hsa; identical to SEQ ID NO: 90279

SEQ ID NO: 506409 - RNA, 64 nt, hsa; identical to SEQ ID NO: 90280

SEQ ID NO: 506410 - RNA, 64 nt, hsa; identical to SEQ ID NO: 90281

SEQ ID NO: 506411 - RNA, 64 nt, hsa; identical to SEQ ID NO: 90282

SEQ ID NO: 506412 - RNA, 64 nt, hsa; identical to SEQ ID NO: 90283

SEQ ID NO: 506413 - RNA, 64 nt, hsa; identical to SEQ ID NO: 90284

SEQ ID NO: 506414 - RNA, 64 nt, hsa; identical to SEQ ID NO: 90285

SEQ ID NO: 506415 - RNA, 64 nt, hsa; identical to SEQ ID NO: 90286

SEQ ID NO: 506416 - RNA, 64 nt, hsa; identical to SEQ ID NO: 90287

SEQ ID NO: 506417 - RNA, 64 nt, hsa; identical to SEQ ID NO: 175595

SEQ ID NO: 506418 - RNA, 64 nt, hsa; identical to SEQ ID NO: 175596

SEQ ID NO: 506419 - RNA, 64 nt, hsa; identical to SEQ ID NO: 175597

SEQ ID NO: 506420 - RNA, 64 nt, hsa; identical to SEQ ID NO: 175598

SEQ ID NO: 506421 - RNA, 64 nt, hsa; identical to SEQ ID NO: 175599

SEQ ID NO: 506422 - RNA, 64 nt, hsa; identical to SEQ ID NO: 175600

SEQ ID NO: 506423 - RNA, 64 nt, hsa; identical to SEQ ID NO: 175601

SEQ ID NO: 506424 - RNA, 64 nt, hsa; identical to SEQ ID NO: 175602

SEQ ID NO: 506425 - RNA, 64 nt, hsa; identical to SEQ ID NO: 175603

SEQ ID NO: 506426 - RNA, 64 nt, hsa; identical to SEQ ID NO: 175604

SEQ ID NO: 506427 - RNA, 64 nt, hsa; identical to SEQ ID NO: 175605

SEQ ID NO: 506428 - RNA, 64 nt, hsa; identical to SEQ ID NO: 175606

SEQ ID NO: 506429 - RNA, 64 nt, hsa; identical to SEQ ID NO: 175607

SEQ ID NO: 506430 - RNA, 64 nt, hsa; identical to SEQ ID NO: 175608

SEQ ID NO: 506431 - RNA, 64 nt, hsa; identical to SEQ ID NO: 175609

SEQ ID NO: 506432 - RNA, 64 nt, hsa; identical to SEQ ID NO: 175610

SEQ ID NO: 506433 - RNA, 64 nt, hsa; identical to SEQ ID NO: 175611

SEQ ID NO: 506434 - RNA, 64 nt, hsa; identical to SEQ ID NO: 175612

SEQ ID NO: 506435 - RNA, 64 nt, hsa; identical to SEQ ID NO: 175613

SEQ ID NO: 506436 - RNA, 64 nt, hsa; identical to SEQ ID NO: 175614

SEQ ID NO: 506437 - RNA, 64 nt, hsa; identical to SEQ ID NO: 175615

SEQ ID NO: 506438 - RNA, 64 nt, hsa; identical to SEQ ID NO: 175616

SEQ ID NO: 506439 - RNA, 64 nt, hsa; identical to SEQ ID NO: 175617

SEQ ID NO: 506440 - RNA, 64 nt, hsa; identical to SEQ ID NO: 175618

SEQ ID NO: 506441 - RNA, 64 nt, hsa; identical to SEQ ID NO: 283135

SEQ ID NO: 506442 - RNA, 64 nt, hsa; identical to SEQ ID NO: 283136

SEQ ID NO: 506443 - RNA, 64 nt, hsa; identical to SEQ ID NO: 283137

SEQ ID NO: 506444 - RNA, 64 nt, hsa; identical to SEQ ID NO: 283138

SEQ ID NO: 506445 - RNA, 64 nt, hsa; identical to SEQ ID NO: 283139

SEQ ID NO: 506446 - RNA, 64 nt, hsa; identical to SEQ ID NO: 283140

SEQ ID NO: 506447 - RNA, 64 nt, hsa; identical to SEQ ID NO: 283141

SEQ ID NO: 506448 - RNA, 64 nt, hsa; identical to SEQ ID NO: 283142

SEQ ID NO: 506449 - RNA, 64 nt, hsa; identical to SEQ ID NO: 283143

SEQ ID NO: 506450 - RNA, 64 nt, hsa; identical to SEQ ID NO: 283144

SEQ ID NO: 506451 - RNA, 64 nt, hsa; identical to SEQ ID NO: 283145

SEQ ID NO: 506452 - RNA, 64 nt, hsa; identical to SEQ ID NO: 283146

SEQ ID NO: 506453 - RNA, 64 nt, hsa; identical to SEQ ID NO: 283147

SEQ ID NO: 506454 - RNA, 64 nt, hsa; identical to SEQ ID NO: 283148

SEQ ID NO: 506455 - RNA, 64 nt, hsa; identical to SEQ ID NO: 283149

SEQ ID NO: 506456 - RNA, 64 nt, hsa; identical to SEQ ID NO: 283150

SEQ ID NO: 506457 - RNA, 64 nt, hsa; identical to SEQ ID NO: 283151

SEQ ID NO: 506458 - RNA, 64 nt, hsa; identical to SEQ ID NO: 283152

SEQ ID NO: 506459 - RNA, 64 nt, hsa; identical to SEQ ID NO: 283153

SEQ ID NO: 506460 - RNA, 64 nt, hsa; identical to SEQ ID NO: 283154

SEQ ID NO: 506461 - RNA, 64 nt, hsa; identical to SEQ ID NO: 283155

SEQ ID NO: 506462 - RNA, 64 nt, hsa; identical to SEQ ID NO: 283156

SEQ ID NO: 506463 - RNA, 64 nt, hsa; identical to SEQ ID NO: 283157

SEQ ID NO: 506464 - RNA, 64 nt, hsa; identical to SEQ ID NO: 283158

SEQ ID NO: 506465 - RNA, 64 nt, hsa; identical to SEQ ID NO: 283159

SEQ ID NO: 506466 - RNA, 64 nt, hsa; identical to SEQ ID NO: 283160

SEQ ID NO: 506467 - RNA, 64 nt, hsa; identical to SEQ ID NO: 283161

SEQ ID NO: 506468 - RNA, 64 nt, hsa; identical to SEQ ID NO: 283162

SEQ ID NO: 506469 - RNA, 64 nt, hsa; identical to SEQ ID NO: 283163

SEQ ID NO: 506470 - RNA, 64 nt, hsa; identical to SEQ ID NO: 283164

SEQ ID NO: 506471 - RNA, 64 nt, hsa; identical to SEQ ID NO: 283165

SEQ ID NO: 506472 - RNA, 64 nt, hsa; identical to SEQ ID NO: 283166

SEQ ID NO: 506473 - RNA, 64 nt, hsa; identical to SEQ ID NO: 283167

SEQ ID NO: 506474 - RNA, 64 nt, hsa; identical to SEQ ID NO: 237135

SEQ ID NO: 506475 - RNA, 64 nt, hsa; identical to SEQ ID NO: 237136

SEQ ID NO: 506476 - RNA, 64 nt, hsa; identical to SEQ ID NO: 237137

SEQ ID NO: 506477 - RNA, 64 nt, hsa; identical to SEQ ID NO: 237138

SEQ ID NO: 506478 - RNA, 64 nt, hsa; identical to SEQ ID NO: 237139

SEQ ID NO: 506479 - RNA, 64 nt, hsa; identical to SEQ ID NO: 237140

SEQ ID NO: 506480 - RNA, 64 nt, hsa; identical to SEQ ID NO: 237141

SEQ ID NO: 506481 - RNA, 64 nt, hsa; identical to SEQ ID NO: 237142

SEQ ID NO: 506482 - RNA, 64 nt, hsa; identical to SEQ ID NO: 237143

SEQ ID NO: 506483 - RNA, 64 nt, hsa; identical to SEQ ID NO: 237144

SEQ ID NO: 506484 - RNA, 64 nt, hsa; identical to SEQ ID NO: 237145

SEQ ID NO: 506485 - RNA, 64 nt, hsa; identical to SEQ ID NO: 237146

SEQ ID NO: 506486 - RNA, 64 nt, hsa; identical to SEQ ID NO: 237147

SEQ ID NO: 506487 - RNA, 64 nt, hsa; identical to SEQ ID NO: 237148

SEQ ID NO: 506488 - RNA, 64 nt, hsa; identical to SEQ ID NO: 237149

SEQ ID NO: 506489 - RNA, 64 nt, hsa; identical to SEQ ID NO: 237150

SEQ ID NO: 506490 - RNA, 64 nt, hsa; identical to SEQ ID NO: 120942

SEQ ID NO: 506491 - RNA, 64 nt, hsa; identical to SEQ ID NO: 120943

SEQ ID NO: 506492 - RNA, 64 nt, hsa; identical to SEQ ID NO: 120944

SEQ ID NO: 506493 - RNA, 64 nt, hsa; identical to SEQ ID NO: 120945

SEQ ID NO: 506494 - RNA, 64 nt, hsa; identical to SEQ ID NO: 120946

SEQ ID NO: 506495 - RNA, 64 nt, hsa; identical to SEQ ID NO: 120947

SEQ ID NO: 506496 - RNA, 64 nt, hsa; identical to SEQ ID NO: 120948

SEQ ID NO: 506497 - RNA, 64 nt, hsa; identical to SEQ ID NO: 120949

SEQ ID NO: 506498 - RNA, 64 nt, hsa; identical to SEQ ID NO: 120950

SEQ ID NO: 506499 - RNA, 64 nt, hsa; identical to SEQ ID NO: 120951

SEQ ID NO: 506500 - RNA, 64 nt, hsa; identical to SEQ ID NO: 120952

SEQ ID NO: 506501 - RNA, 64 nt, hsa; identical to SEQ ID NO: 120953

SEQ ID NO: 506502 - RNA, 64 nt, hsa; identical to SEQ ID NO: 120954

SEQ ID NO: 506503 - RNA, 64 nt, hsa; identical to SEQ ID NO: 120955

SEQ ID NO: 506504 - RNA, 64 nt, hsa; identical to SEQ ID NO: 120956

SEQ ID NO: 506505 - RNA, 64 nt, hsa; identical to SEQ ID NO: 120957

SEQ ID NO: 506506 - RNA, 64 nt, hsa; identical to SEQ ID NO: 120958

SEQ ID NO: 506507 - RNA, 64 nt, hsa; identical to SEQ ID NO: 120959

SEQ ID NO: 506508 - RNA, 64 nt, hsa; identical to SEQ ID NO: 120960

SEQ ID NO: 506509 - RNA, 64 nt, hsa; identical to SEQ ID NO: 120961

SEQ ID NO: 506510 - RNA, 64 nt, hsa; identical to SEQ ID NO: 120962

SEQ ID NO: 506511 - RNA, 64 nt, hsa; identical to SEQ ID NO: 120963

SEQ ID NO: 506512 - RNA, 64 nt, hsa; identical to SEQ ID NO: 120964

SEQ ID NO: 506513 - RNA, 62 nt, hsa; identical to SEQ ID NO: 120965

SEQ ID NO: 506514 - RNA, 64 nt, hsa; identical to SEQ ID NO: 120966

SEQ ID NO: 506515 - RNA, 64 nt, hsa; identical to SEQ ID NO: 120967

SEQ ID NO: 506516 - RNA, 64 nt, hsa; identical to SEQ ID NO: 120968

SEQ ID NO: 506517 - RNA, 64 nt, hsa; identical to SEQ ID NO: 120969

SEQ ID NO: 506518 - RNA, 64 nt, hsa; identical to SEQ ID NO: 120970

SEQ ID NO: 506519 - RNA, 64 nt, hsa; identical to SEQ ID NO: 120971

SEQ ID NO: 506520 - RNA, 64 nt, hsa; identical to SEQ ID NO: 210217

SEQ ID NO: 506521 - RNA, 64 nt, hsa; identical to SEQ ID NO: 210218

SEQ ID NO: 506522 - RNA, 64 nt, hsa; identical to SEQ ID NO: 210219

SEQ ID NO: 506523 - RNA, 64 nt, hsa; identical to SEQ ID NO: 210220

SEQ ID NO: 506524 - RNA, 64 nt, hsa; identical to SEQ ID NO: 210221

SEQ ID NO: 506525 - RNA, 64 nt, hsa; identical to SEQ ID NO: 210222

SEQ ID NO: 506526 - RNA, 64 nt, hsa; identical to SEQ ID NO: 210223

SEQ ID NO: 506527 - RNA, 64 nt, hsa; identical to SEQ ID NO: 210224

SEQ ID NO: 506528 - RNA, 64 nt, hsa; identical to SEQ ID NO: 210225

SEQ ID NO: 506529 - RNA, 64 nt, hsa; identical to SEQ ID NO: 210226

SEQ ID NO: 506530 - RNA, 64 nt, hsa; identical to SEQ ID NO: 210227

SEQ ID NO: 506531 - RNA, 64 nt, hsa; identical to SEQ ID NO: 210228

SEQ ID NO: 506532 - RNA, 64 nt, hsa; identical to SEQ ID NO: 210229

SEQ ID NO: 506533 - RNA, 64 nt, hsa; identical to SEQ ID NO: 210230

SEQ ID NO: 506534 - RNA, 64 nt, hsa; identical to SEQ ID NO: 210231

SEQ ID NO: 506535 - RNA, 64 nt, hsa; identical to SEQ ID NO: 210232

SEQ ID NO: 506536 - RNA, 64 nt, hsa
gucccucccccaaugcaggccacuucuccucccuccucucuaaauguaguccccucuccuccau

SEQ ID NO: 506537 - RNA, 64 nt, hsa
ugaugcuucucaguagccuuaucauucacaggugccucucuagccugcacaaaugauugacaag

SEQ ID NO: 506538 - RNA, 64 nt, hsa
aguucuucuuagccucugcuccuucccugggaacccucucuauauccucuucacaagucauggg

SEQ ID NO: 506539 - RNA, 64 nt, hsa
uccuucugcccugccugccucccugcaccugcggccucucuaggaagcuguuccuuucuaugcc

SEQ ID NO: 506540 - RNA, 64 nt, hsa
auccuccuuccucuuccccuuucuaguuccccuaccucucuaucuuucuauucucaccaauaau

SEQ ID NO: 506541 - RNA, 64 nt, hsa
cucaggacugagucaacccccuucaaccuccucaccucucuaaacaccauccauaguaacaugu

SEQ ID NO: 506542 - RNA, 64 nt, hsa
uuuuaaaacaaaguguguuacacuaaaaaccaguccucucuaaucucaggugggacuuggcgcu

SEQ ID NO: 506543 - RNA, 52 nt, hsa
acuuggaagcugguagcuagugccucucuaucaaaucaggguuugcaccuug

SEQ ID NO: 506544 - RNA, 64 nt, hsa
guugcauccugucaggaggcagauaaugcuggugccucucuauugguaauguuaagacugcugg

SEQ ID NO: 506545 - RNA, 64 nt, hsa
ccuagguccucugaggcacucaucuacugaaugaccucucuacuuccccuucuugccauuauua

SEQ ID NO: 506546 - RNA, 64 nt, hsa
uucugucagugccuuaucuuaugaagaaacagaaccucucuagcuaaugugugguuucuccuuc

SEQ ID NO: 506547 - RNA, 64 nt, hsa
cuuggccuccuuuccgcuucuccucucugcuguuccucucuacaagaaccugggaggccaacgc

SEQ ID NO: 506548 - RNA, 64 nt, hsa
ccuggguggggcuuguccaagaggggcaggugggccucucuaggaucagugucccacccagagg

SEQ ID NO: 506549 - RNA, 64 nt, hsa
cucugggcacugaggaguauuuccccucauucuaccucucuaaggcuaugcaacccuccccacg

SEQ ID NO: 506550 - RNA, 64 nt, hsa
gguucugaugaugauuauccaacaaacaucuggcccucucuacaucucuucccuccaucuccuu

SEQ ID NO: 506551 - RNA, 64 nt, hsa
guuugggaccaggcugggcaacacagggagacccccucucuacaaaaacauuuuuaaaaaauua

SEQ ID NO: 506552 - RNA, 64 nt, hsa
aacugcucagcaguugggccacuccacuauuccaccucucuaaaagaagguaauuuccucccca

SEQ ID NO: 506553 - RNA, 64 nt, hsa
auagagauacacauggaaagaggguuuaacagacccucucuaggacacaacuguuucugcuuug

SEQ ID NO: 506554 - RNA, 64 nt, hsa
guggcgugugagucaggagaccuagguuucagccccucucuacugucagcgagcugugcaacgu

SEQ ID NO: 506555 - RNA, 64 nt, hsa
uuauuuuggauuaaaagaaguuuuccauuugauaccucucuaaauuaaauaaauuauagaaugu

SEQ ID NO: 506556 - RNA, 64 nt, hsa
cuuuaauagccuccuucagaucccauaccugaccccucucuaacacaaaacuuauuggguaagu

SEQ ID NO: 506557 - RNA, 64 nt, hsa
cccuuucccuucuggcuguuccccugcucuguugccucucuaagguaacauuuauagaagaaau

SEQ ID NO: 506558 - RNA, 64 nt, hsa
ccucucccacccucuuccuacuggucucucuaugccucucuacagucucgucucuuuuacccug

SEQ ID NO: 506559 - RNA, 64 nt, hsa
auuucucuggauuugcaaccccaucauccucaggccucucuacaagcagcaggaaacauagaac

SEQ ID NO: 506560 - RNA, 64 nt, hsa
acuuucuugcucucuuuuucucaaucucccagccccucucuaccauauugggacccucaagagg

SEQ ID NO: 506561 - RNA, 64 nt, hsa
auuuguugcccugaugauaacugaugauuuucacccucucuagcugagguaacucagacagugc

SEQ ID NO: 506562 - RNA, 64 nt, hsa
cuggggaggggcccaguggguccucggccagagcccucucuaaggacagguuggggaggguugg

SEQ ID NO: 506563 - RNA, 64 nt, hsa
ugagauauagauccguagaauugucaggagugcaccucucuacuugggagguacaauugccaua

SEQ ID NO: 506564 - RNA, 64 nt, hsa
cacgucaauggcugugcugagcacaauggugggcccucucuagacacauacggaagugauggcc

SEQ ID NO: 506565 - RNA, 64 nt, hsa
uccaguuuuuuuuucuuuaaaaaagcgguuucuaccucucuaugugccugagugaugauacaau

SEQ ID NO: 506566 - RNA, 64 nt, hsa
gaacuccugaccucaggugauccacccaccuuggccucucuaaauacugggauuacaggcguga

SEQ ID NO: 506567 - RNA, 59 nt, hsa
uugaaguugcugucccuuaacuggcgccuccucucuacuuucauggacuuguuccuuug

SEQ ID NO: 506568 - RNA, 64 nt, hsa
aaccacguucuuagccuagauugagcuuagauugccucucuagacaacuaccccuuaguuauaa

SEQ ID NO: 506569 - RNA, 64 nt, hsa
gguggggaggggacaccaagggcccauuuccuccccucucuaccugcagugaguuccagaccug

SEQ ID NO: 506570 - RNA, 64 nt, hsa
uuaucccagacauguucuuucaagcccuuggagcccucucuaaauucacugucaucauuuagua

SEQ ID NO: 506571 - RNA, 64 nt, hsa
ucaguuugaugaaccaauucacaagaggcuaggcccucucuagcaaaguuaugggcugcuuuac

SEQ ID NO: 506572 - RNA, 64 nt, hsa
aauaaagaacugaaugaauucauccccccggccaccucucuacccguccagccugcccagaccc

SEQ ID NO: 506573 - RNA, 64 nt, hsa
uacuuccuuaugguuugagaggcuagaaacugagccucucuacuuuuggaaaaaugaacaugug

SEQ ID NO: 506574 - RNA, 64 nt, hsa
agcaucaguuuuuacuauauuaugauaaaagcaaccucucuauaaaucauauaauguaaaggau

SEQ ID NO: 506575 - RNA, 64 nt, hsa
uugugcugguggugaagaggcccucaaagccaggccucucuauuccuuugacugucuccucagc

SEQ ID NO: 506576 - RNA, 64 nt, hsa
aaugacagcuuuagcacaauuuuaagaaaaugccccucucuauuaccacauuuucucuuauuaa

SEQ ID NO: 506577 - RNA, 64 nt, hsa
cuuuuaauggcuguuuuccuuuuucuauuuaaauccucucuacuugacucaggggcucacaagg

SEQ ID NO: 506578 - RNA, 64 nt, hsa
guuauuuaaagcagacuuacauguaaaccggaauccucucuauacaaguuuauuaaagauuauu

SEQ ID NO: 506579 - RNA, 64 nt, hsa
uccuguauggaaaacgggagacuuuguacaguggccucucuaaaaguacaaaacauucauaaga

SEQ ID NO: 506580 - RNA, 64 nt, hsa
acuaucacaaaaagucuccauuuucauuuuacauccucucuauuggaggcagcacuuuucccuc

SEQ ID NO: 506581 - RNA, 64 nt, hsa
uccuuccucuuuaucccuccuguuuuacuuuauaccucucuauuccuugcucaaauuauugcaa

SEQ ID NO: 506582 - RNA, 64 nt, hsa
gugucacaaaagcaguuauuuuaaaaucugauccccucucuacccuaccacuuugguuugaauu

SEQ ID NO: 506583 - RNA, 64 nt, hsa
aggucagauggcagagcaagguugguccucagggccucucuaagccuuagggccccuccucucc

SEQ ID NO: 506584 - RNA, 64 nt, hsa
aucugaggcaauaucacuaggacuuuagcugugaccucucuaacacagagaagcacuaacuuag

SEQ ID NO: 506585 - RNA, 64 nt, hsa
uauuuuagccagugggucccuuccuuucuccuuuccucucuacugcucaagaacagauuugagg

SEQ ID NO: 506586 - RNA, 64 nt, hsa
cccuuuuugugccuucaugcccuacuucuuaaugccucucuaaagccaaaaaaaaaaaaaaaga

SEQ ID NO: 506587 - RNA, 64 nt, hsa
ugcaagcugagugacuguaggcagggaaccuuaaccucucuaagccacagcuucuucaucuuua

SEQ ID NO: 506588 - RNA, 64 nt, hsa
caacacucugucuugaauuuggcccucccucuccccucucuacuuuaauucauuggagcauggg

SEQ ID NO: 506589 - RNA, 64 nt, hsa
uuugauagccaucuauucaucuggaucaugggacccucucuaauccuuccaccaaucaaauaag

SEQ ID NO: 506590 - RNA, 64 nt, hsa
cucuaaggucucugacgguggguccaggaccagaccucucuacaaaaaauugccccaacuacag

SEQ ID NO: 506591 - RNA, 64 nt, hsa
aaaaccuagugauucugucuggucaucccacacaccucucuacugagugcuccagagucuuagc

SEQ ID NO: 506592 - RNA, 64 nt, hsa
acaugggaucauggguuggggugcucaggugagcccucucuauagugcuucccugggccaagcu

SEQ ID NO: 506593 - RNA, 64 nt, hsa
auuuuuuuguguguuuaccacugcaacuauugcaccucucuauuugaauuuacuguggaccaug

SEQ ID NO: 506594 - RNA, 64 nt, hsa
ccugcacaagggcagugagagacauuuacagccuccucucuauuuguuuuuuuaaggaaaaguc

SEQ ID NO: 506595 - RNA, 64 nt, hsa
cagcauggggaaggagguccccuuccccaagaguccucucuauccuggaugagcucaugaacau

SEQ ID NO: 506596 - RNA, 64 nt, hsa
ccucuggugccugaagaaaugagauuuuauuaucccucucuauuaugcaaaugaauuuaguuuu

SEQ ID NO: 506597 - RNA, 64 nt, hsa
aaaagccuggcugaaaucuuuagacuauuuguacccucucuacccacacuguuugugauuuauc

SEQ ID NO: 506598 - RNA, 64 nt, hsa
gcaaugccgugaucuccgcucacugccaccuccgccucucuaguucaagcgauuuuccugccuc

SEQ ID NO: 506599 - RNA, 64 nt, hsa
ugcccuccggcuggaaacugcagcucuguaaaugccucucuagguagcugcuggcggugguggg

SEQ ID NO: 506600 - RNA, 64 nt, hsa
cugaucaugaaucaaguaucugugguuucaugccccucucuauaccuuucaaagaacuccugaa

SEQ ID NO: 506601 - RNA, 64 nt, hsa
acuguugcccagucacuucugcuccaauucucuuccucucuaaauaguaguuuauuacugccac

SEQ ID NO: 506602 - RNA, 64 nt, hsa
aaugggaaaaaucuuuuuguagacucuauaguacccucucuauucacuagcuucugaaaaggga

SEQ ID NO: 506603 - RNA, 64 nt, hsa
agggaagcaacuccaggaacacuccuuccacuccccucucuaccaacagaugucaggacuguca

SEQ ID NO: 506604 - RNA, 64 nt, hsa
gugauggggagagccugaaaggcaggcucuguuaccucucuaaggagagcuaccagguugucac

SEQ ID NO: 506605 - RNA, 64 nt, hsa
cugagugucuugugguuuuaaacaagucucuuaaccucucuaagacugauuccucauuuauaac

SEQ ID NO: 506606 - RNA, 64 nt, hsa
uccugagguggccuuuacauacguaggaccaaacccucucuaccaugagggaagaagacacagc

SEQ ID NO: 506607 - RNA, 64 nt, hsa
auccaucaucagaaucacagugcucuccagaccuccucucuaaacugcuucauugaccuaaguc

SEQ ID NO: 506608 - RNA, 64 nt, hsa
ccuaaguuagaacacagccuuggcuggugggugcccucucuagacugguaucagcagccugugu

SEQ ID NO: 506609 - RNA, 64 nt, hsa
guguagcauacuggcuucaccaucaauccugauuccucucuaagugggcauugccauguggaag

SEQ ID NO: 506610 - RNA, 64 nt, hsa
uaggucagauggagguucucagagccaaguccucccucucuacuggaguggaaggucuauuggc

SEQ ID NO: 506611 - RNA, 64 nt, hsa
gauggcacauucaguguggcuaugaagagcgaauccucucuauuguuuaaauagauuacuguag

SEQ ID NO: 506612 - RNA, 64 nt, hsa
auaagaaauaaggacaagccuaacuucauagaaaccucucuauuuuuaaucaguuguuuaauaa

SEQ ID NO: 506613 - RNA, 64 nt, hsa
auuuucacacauucacgcauacuuggauaucaacccucucuacagguccguuuccuuacacauu

SEQ ID NO: 506614 - RNA, 64 nt, hsa
uucuguaagacugcuacagcuaggcucccccuccccucucuaaaccaaaguauaaaacaaaauc

SEQ ID NO: 506615 - RNA, 64 nt, hsa
auuuaauagccauuucaagaaaucccauaaagaaccucucuaugucccuuuuuuuaauuuaaaa

SEQ ID NO: 506616 - RNA, 64 nt, hsa
gcaugggcauauguaaaauguccuuuucugguugccucucuaugcuauuguguucagauacuua

SEQ ID NO: 506617 - RNA, 64 nt, hsa
ucagcuuuagcuuccauggcaguccucacccccaccucucuaaaagacacaggaggaugacaca

SEQ ID NO: 506618 - RNA, 64 nt, hsa
cauuggcccucuggacuccuuucuccuuuucuuuccucucuaggcugcuccugaauccuguucu

SEQ ID NO: 506619 - RNA, 64 nt, hsa
aaaaaggaucuccuuuuuucccagcccaaauucuccucucuaaaaguguccacaagaaggggug

SEQ ID NO: 506620 - RNA, 64 nt, hsa
ucauaaauucuuucccuauaacauuccuucucugccucucuauggcccacuuugaccacuaaca

SEQ ID NO: 506621 - RNA, 64 nt, hsa
ucuccggcagcccagauguucaguucucuuggccccucucuaccccuuacugggauccgguuuu

SEQ ID NO: 506622 - RNA, 64 nt, hsa
uuucuaguuuccuuuccuugucucucucugccugccucucuacuguucccccuuuucuaacaca

SEQ ID NO: 506623 - RNA, 64 nt, hsa
gcccagcccccaccacuccucagcugccccccaaccucucuauggcagagaggcagggaguggc

SEQ ID NO: 506624 - RNA, 64 nt, hsa
ccuccccaggaagggacugcagaggcgggcaagcccucucuauguguuuuuauccccaccuucc

SEQ ID NO: 506625 - RNA, 64 nt, hsa
gacccugggcugcuuccugggggcucuccagaccccucucuaggaccaagucacccgucgugcu

SEQ ID NO: 506626 - RNA, 64 nt, hsa
ugcucccuacuggcugucuugggggaaggcagcgccucucuagcuacucaagggagggggaugu

SEQ ID NO: 506627 - RNA, 64 nt, hsa
gaaggcaguaaacuaagggugucaagccccauucccucucuacucuugacagcaggauuggaug

SEQ ID NO: 506628 - RNA, 64 nt, hsa
auacuacuuuugugucacaauuuauuuuuaucacccucucuaggguaacguguauauuuuggug

SEQ ID NO: 506629 - RNA, 64 nt, hsa
uucgguccuuggcccuuucccggcccucuuguucccucucuaacuucugauuguucuuuuauuu

SEQ ID NO: 506630 - RNA, 64 nt, hsa
ucuuuaaacacuuuuuaaauuucuaaccacaagaccucucuauaaugguaaauguaagacauca

SEQ ID NO: 506631 - RNA, 64 nt, hsa
uuugucauggaagagaagcauggguucagcagugccucucuagcagcugugcggaauaaugugc

SEQ ID NO: 506632 - RNA, 64 nt, hsa
aguuugagaccagccuggccaacauggcgaaaccccucucuacuaaaaauacaaaaauuugcca

SEQ ID NO: 506633 - RNA, 64 nt, hsa
cuacgguacucuccccagagauaugucuugucagccucucuaguuccccuuggccugcauguac

SEQ ID NO: 506634 - RNA, 64 nt, hsa
aaaguaugaugguggugaauaaagaccaaaggguccucucuaccuuugaaaacucuccuggggu

SEQ ID NO: 506635 - RNA, 64 nt, hsa
aauuccacagcugccuccagaaacauuaaccaccccucucuagucuuacugguauuuuuuguuu

SEQ ID NO: 506636 - RNA, 64 nt, hsa
gauuuguuuccuaacgccauuggaggccuucaucccucucuacgauaagguugcagaaauggga

SEQ ID NO: 506637 - RNA, 64 nt, hsa
uguuaguauuauucacacauucaugacaauugagccucucuacugugagaaauguuuuagaggc

SEQ ID NO: 506638 - RNA, 64 nt, hsa
ggauuauuuguaggacaaccaaccuggaguuuugccucucuagaguaccacccaguaagucugg

SEQ ID NO: 506639 - RNA, 64 nt, hsa
augagagccaucucaccucacccaggagucacuuccucucuacaccccaacaccugguucauuu

SEQ ID NO: 506640 - RNA, 64 nt, hsa
acagugcauuaucuguucuuguauuucuauagcaccucucuauuggguuuaucaucaucaacaa

SEQ ID NO: 506641 - RNA, 64 nt, hsa
uauuccuccaggaaggagcaaaacgccucuuuucccucucuaggccuguugccucgggccuggg

SEQ ID NO: 506642 - RNA, 64 nt, hsa
agcaccgcacaucgacacacuguacuuauuugucccucucuaacauuuuaacuaaaaguugauu

SEQ ID NO: 506643 - RNA, 64 nt, hsa
aggcaugagccaccgcaccuggccuucccugcuuccucucuagaauccaauuagggauguuugu

SEQ ID NO: 506644 - RNA, 64 nt, hsa
ccccaaaaucggcccucccucaccccuuucccuuccucucuauuuauaaggucccugcuccacc

SEQ ID NO: 506645 - RNA, 64 nt, hsa
uacuaaaugguguguuaaaauuaggguuucuuugccucucuacacuacacuaaucugccuaaag

SEQ ID NO: 506646 - RNA, 64 nt, hsa
aagaacgauucaccuggguuugcaagaaucuaaaccucucuaggggaagcccacuggguuuaaa

SEQ ID NO: 506647 - RNA, 64 nt, hsa
cucacuaauuaucaacuuaugugcuaucagauauccucucuacccucacguuauuuugaagaaa

SEQ ID NO: 506648 - RNA, 64 nt, hsa
ccaguucccuuugcuugucuucuugacugucuucccucucuaucggggucacuugcaauuguua

SEQ ID NO: 506649 - RNA, 64 nt, hsa
ucccagucucagauugagugggugcucucauuggccucucuagcuaggccgucucccuggucag

SEQ ID NO: 506650 - RNA, 64 nt, hsa
aauguccaugacuauugcccagagaaggcuuaccccucucuaggguugcaguugcuuucuuugu

SEQ ID NO: 506651 - RNA, 64 nt, hsa
ugccuugacccagaagggaugagacgggcucuuaccucucuacaaccuucccuccccuucccac

SEQ ID NO: 506652 - RNA, 64 nt, hsa
auugauaaccaggacaaccagguagucacccaguccucucuaagcagggagcacuuguccuucu

SEQ ID NO: 506653 - RNA, 64 nt, hsa
gaggcuggcugcaccugcucucugaagacgccuuccucucuagguucauuguucaguguugcug

SEQ ID NO: 506654 - RNA, 64 nt, hsa
acagaggaugcugaaguacagucccagcacauuuccucucuaucuuuuuuuuaggcaaaaccuu

SEQ ID NO: 506655 - RNA, 64 nt, hsa
ggaugggcagugccacucaggucucugggguuucccucucuaauuuuaaguaaauugacauaua

SEQ ID NO: 506656 - RNA, 64 nt, hsa
cacagacaaggccuccagcacagauggccacaggccucucuauacacauuuacagaauuucaca

SEQ ID NO: 506657 - RNA, 64 nt, hsa
ugaacaguuucucuuggccuucaggaagaaagcgccucucuaccauacaguauuucaucccucc

SEQ ID NO: 506658 - RNA, 64 nt, hsa
ugcaggagcuguuuuuccauugcuaggccugaccccucucuaccugugagcguucagggggucc

SEQ ID NO: 506659 - RNA, 64 nt, hsa
uaccagggauaucuguucuacuguuuuaaaaguuccucucuauuuuauuuuuuauuuaacauga

SEQ ID NO: 506660 - RNA, 64 nt, hsa
cuccuaaauguagagaugccuguggcugagggggccucucuaccuguguccccacucacuccag

SEQ ID NO: 506661 - RNA, 64 nt, hsa
accagcauuacuaaggcaggugggcagacagugaccucucuagguguguccacagaguuuuuca

SEQ ID NO: 506662 - RNA, 64 nt, hsa
ccugaaaugggcagggaagaaaacagggauuuccccucucuagaucccugccaggucccucucc

SEQ ID NO: 506663 - RNA, 64 nt, hsa
ugggaaguaccaggggacuggcagaagcccaggcccucucuacuuuuaccagcaacugaucaug

SEQ ID NO: 506664 - RNA, 64 nt, hsa
aaucugaugaggccucugcucucugggauguggcccucucuaugcagguuacuccaaugauuag

SEQ ID NO: 506665 - RNA, 64 nt, hsa
ccuuguauccuggaauagcuccauuuccccuccuccucucuaccagacaaaggagugccugugu

SEQ ID NO: 506666 - RNA, 64 nt, hsa
uucauacugagacccagaugggggaaaacagcuuccucucuaaaaggaaaaacuugauauuuau

SEQ ID NO: 506667 - RNA, 64 nt, hsa
aauacauuuaaucauagggauauagauauaagcaccucucuaaagaaucuuuaguuuccgacgu

SEQ ID NO: 506668 - RNA, 64 nt, hsa
acucacaacaccuguauaaugugaugcaagucauccucucuaucauaaccccuccccccaacac

SEQ ID NO: 506669 - RNA, 64 nt, hsa
cuucacuacaaucuucacuacaaccuuuggccuuccucucuacauuuaagaguagcaauagaac

SEQ ID NO: 506670 - RNA, 64 nt, hsa
ggcuuugcugcuuuuaacucuucuuccuucugugccucucuaagugggucaguauccuaaggaa

SEQ ID NO: 506671 - RNA, 64 nt, hsa
cccugauugccacagacccagcacccagcaaaucccucucuaccucccaaggugauaugggcag

SEQ ID NO: 506672 - RNA, 64 nt, hsa
gaaaauuagacaguguuuaauuuucgaaaacuucccucucuagacaguagauaccaccuacuga

SEQ ID NO: 506673 - RNA, 64 nt, hsa
ccagcggaauuggccacauuuccaguguaugugcccucucuaaggaaagaugacaaagaaauca

SEQ ID NO: 506674 - RNA, 64 nt, hsa
guuauguguucuaacuauuaucaaaugaauaaauccucucuaucacaucccccaaaaauguucu

SEQ ID NO: 506675 - RNA, 64 nt, hsa
uaauagaagcuccaggggcuccuucccauucagaccucucuagacuauagucuaugcuuagaga

SEQ ID NO: 506676 - RNA, 64 nt, hsa
cuuauucugaaacuucagcuuccucuagcccggcccucucuaagggagcccucugcacucgugu

SEQ ID NO: 506677 - RNA, 64 nt, hsa
caagcuccuuugcuuuuaguguuaccgcucauugccucucuaauccugccugauuguguuuaca

SEQ ID NO: 506678 - RNA, 64 nt, hsa
ggcacgaucucagcucacugcacugcaauguccaccucucuaguucaagcgauucuccugucuc

SEQ ID NO: 506679 - RNA, 64 nt, hsa
gcauuuccagaaccauggauucugccuuuggaccccucucuauuaauauuaaaacucugggccu

SEQ ID NO: 506680 - RNA, 64 nt, hsa
gggaagaagguacagaagaaagauuggagaagggccucucuagcagucaacuccauuuguaaua

SEQ ID NO: 506681 - RNA, 52 nt, hsa
uuguggucuuccuugcuugaacccucucuacucugaggcacucuguuggggu

SEQ ID NO: 506682 - RNA, 64 nt, hsa
ccaccaaagcugcccacuguuucucuugagcuggccucucuagcacaauuugcacuaaaucaga

SEQ ID NO: 506683 - RNA, 64 nt, hsa
auguagauuaucucaggcauuguggccagcucugccucucuaaaacugaccagaaaaaucucuc

SEQ ID NO: 506684 - RNA, 64 nt, hsa
cucuccccucucccguucuuccucccauccaccuccucucuacucugccagucucagccuucaa

SEQ ID NO: 506685 - RNA, 64 nt, hsa
uacauaauucagagugguuucauugccuuccuacccucucuaauggccccuccauuuauuugac

SEQ ID NO: 506686 - RNA, 64 nt, hsa
ugccuuaguccugaauccuagcccuuacccccauccucucuagacgguauguccugacauaaca

SEQ ID NO: 506687 - RNA, 64 nt, hsa
ugccccucccccacuccucccaauuccuauggagccucucuauuuuaccucuuuccgugcaucc

SEQ ID NO: 506688 - RNA, 64 nt, hsa
uaucucaccauccaauuaucuacccaccugucuuccucucuagcaaucuauuuacuguuuauca

SEQ ID NO: 506689 - RNA, 64 nt, hsa
acagacauuccugcuagaaacugucagacaaauaccucucuaguucggaugcugcucacuuucc

SEQ ID NO: 506690 - RNA, 64 nt, hsa
ucccuucucccaaagggauuuuaaucauucuuggccucucuacucacucuuaaucaaagugugg

SEQ ID NO: 506691 - RNA, 64 nt, hsa
cucauuccuacaucucaagcuagccaggcagucuccucucuaucagaagaaagcacugguaauu

SEQ ID NO: 506692 - RNA, 64 nt, hsa
gguuccugucccugcgccuuuccuuuucgccuuuccucucuauauuucgggucgggggcaggug

SEQ ID NO: 506693 - RNA, 64 nt, hsa
ucauucauucuguucuguuucucuacuggguguuccucucuaaagaaacucuugcaagugaaac

SEQ ID NO: 506694 - RNA, 64 nt, hsa
ugaccaacaugccaggugacauuggccccuagacccucucuauagccaugagacuccuuguggc

SEQ ID NO: 506695 - RNA, 64 nt, hsa
cgucuucaugccaggggcacucauuucuuagcagccucucuacauacaucucucagguggugcc

SEQ ID NO: 506696 - RNA, 64 nt, hsa
ggacgugcaaagcccuuggaauuuucuggcacuuccucucuauugcccccaccaccaccacccc

SEQ ID NO: 506697 - RNA, 64 nt, hsa
uuuuaacuagaugauguuuuaaaaauuacuuuucccucucuauauaguuugauuuaagcauuag

SEQ ID NO: 506698 - RNA, 64 nt, hsa
aaguucacugucucagcaaaguugaacugggcuaccucucuacagcuguuuccucagagggaaa

SEQ ID NO: 506699 - RNA, 64 nt, hsa
uuuuuugcaaggcauuuuaaugcccuuucccagaccucucuagucccuccugccuucuguucuc

SEQ ID NO: 506700 - RNA, 64 nt, hsa
aaacuuggaacuuuuugauugacaaauuaauaaaccucucuaugccucaggcuccucaucugua

SEQ ID NO: 506701 - RNA, 64 nt, hsa
ucuuguggcacaggccauaauuguuccauagaccccucucuagcccugugacuguaguuaguua

SEQ ID NO: 506702 - RNA, 64 nt, hsa
gugggugugcuugcgugguaggauguggugcagcccucucuacgcucuucuauuuuugguauau

SEQ ID NO: 506703 - RNA, 64 nt, hsa
uugguuaguaaugaugucccagcauuugauguucccucucuaaugauaacaaguaaauauuuag

SEQ ID NO: 506704 - RNA, 64 nt, hsa
uguuuugauuaugcaacuaaguaggccuccagagccucucuaguggcagagcagcucacacucc

SEQ ID NO: 506705 - RNA, 64 nt, hsa
ucauauguaaauacugugaggugaugugcccaccccucucuaagaccccucgggggugaggggc

SEQ ID NO: 506706 - RNA, 64 nt, hsa
uuccuggcuuuucugauggaccuauuuaggacaaccucucuauccccagggagaccucccaaau

SEQ ID NO: 506707 - RNA, 64 nt, hsa
uugggaaacuugccucaccuucaggcuuguggggccucucuaugcccaaugaguccaggcaguc

SEQ ID NO: 506708 - RNA, 64 nt, hsa
uccaccagaggagcggacagugaaauguaauaucccucucuagagcagguauguauaugguaua

SEQ ID NO: 506709 - RNA, 64 nt, hsa
aacugcauguguaaacagcaucacauuauuaccaccucucuaugguauuauaguggcaguaugc

SEQ ID NO: 506710 - RNA, 64 nt, hsa
aucuccaucucccaauuaauuuuauugucucuuuccucucuauucgcuuucuccuguuuuuuuu

SEQ ID NO: 506711 - RNA, 64 nt, hsa
guaaccuauuacaccaaguuacuugcuuugcuuuccucucuaugaugugauaauacaguaaaag

SEQ ID NO: 506712 - RNA, 64 nt, hsa
ugaccgaaaguuacaaggaccccaaccccuuuguccucucuacccacagauggcccugggaauc

SEQ ID NO: 506713 - RNA, 64 nt, hsa
auacuguaaacugucuuccugaacuacuguagggccucucuaagaauuugaaauguauaaacca

SEQ ID NO: 506714 - RNA, 64 nt, hsa
gcagagguauuggguuuuuuuguuuuuuuccauuccucucuacuucuguuuccuagcuuuuucu

SEQ ID NO: 506715 - RNA, 64 nt, hsa
caugggugaagaggaggggaagaggccuguuuggccucucuauccucucuuccucuucccccaa

SEQ ID NO: 506716 - RNA, 64 nt, hsa
uuaucacucuuuuucuacuacuuuuucucaaauaccucucuaauccaagaggcacuuccaagaa

SEQ ID NO: 506717 - RNA, 64 nt, hsa
cuguccugcccgugagggugggggggaccgggccccucucuagggaccccucgccccagccuca

SEQ ID NO: 506718 - RNA, 64 nt, hsa
cccgugugaggggucugauacucccuuugucuucccucucuacuccucgcuacaccugagccag

SEQ ID NO: 506719 - RNA, 64 nt, hsa
gggacuuaccaggguuagcucugcccucuccucuccucucuacguggccgccgcucugucucuc

SEQ ID NO: 506720 - RNA, 64 nt, hsa
ccguuuccccuccacauccaaacagcacccugguccucucuauccccccucuccuggggucccu

SEQ ID NO: 506721 - RNA, 64 nt, hsa
gacaaaccaaacuaagugaauuuuagccugguagccucucuaaggaaacaguaauaauaacuuc

SEQ ID NO: 506722 - RNA, 64 nt, hsa
ggcuguauggaaaugcacccucccuccugccgcuccucucuagaaccuucuagaaccugggcug

SEQ ID NO: 506723 - RNA, 64 nt, hsa
agcgggauuggaccggcucggcugaugucugcucccucucuaggagcugucugcuggcuccggg

SEQ ID NO: 506724 - RNA, 64 nt, hsa
aaagccagaugcuagagccucugccugacagcauccucucuaugggccauauuccgcacugggc

SEQ ID NO: 506725 - RNA, 64 nt, hsa
uuuccccucacccuccaaguccuaaccccuccauccucucuaacuuuucaagccaaucccuuaa

SEQ ID NO: 506726 - RNA, 64 nt, hsa
gagggcuauggccucccuaugcuuucacuucccaccucucuaccuaaguuccuucccagcacau

SEQ ID NO: 506727 - RNA, 64 nt, hsa
gauguguguggccauuggacuaacuggcacggggccucucuagggaagucugguuguagagccu

SEQ ID NO: 506728 - RNA, 64 nt, hsa
ucugucuaugucacaguguuccucuacgacccgaccucucuauguaagcacacaugcgcacaca

SEQ ID NO: 506729 - RNA, 64 nt, hsa
ggguuucuuguggcgucugguguggaauggccuuccucucuaggugccugagguguccgcugac

SEQ ID NO: 506730 - RNA, 64 nt, hsa
ccucagcccugccccucugagacaauaaaacugcccucucuaaggccaacugucugcugucucg

SEQ ID NO: 506731 - RNA, 64 nt, hsa
guucgaaaccagccuggccaacauagugaaacccccucucuacuaaaaaugcaaaaauuagucc

SEQ ID NO: 506732 - RNA, 64 nt, hsa
cccuuuguccuccagcaucccuucacuuccucauccucucuaaccuccuuuuucuuuuuuuaau

SEQ ID NO: 506733 - RNA, 64 nt, hsa
gaagcuucucgacugcccagauagggaggugaguccucucuaucuccucuggcucuggaagcac

SEQ ID NO: 506734 - RNA, 64 nt, hsa
uuccuuggccuaggucuccccuccaggcugagggccucucuacuuccccagaugccugggugca

SEQ ID NO: 506735 - RNA, 64 nt, hsa
ugggcugggucuacccccagccaccagcccucauccucucuacccagugcucugguuuaugcuu

SEQ ID NO: 506736 - RNA, 64 nt, hsa
accauccaguacuuguggacacuacacguuucaaccucucuacuagcaccaucacccuugaaaa

SEQ ID NO: 506737 - RNA, 64 nt, hsa
caaugcuaucaagugugcugggaagggaggaaggccucucuacauauggaaaagcccaugcgug

SEQ ID NO: 506738 - RNA, 64 nt, hsa
cauaucccagucccagcccuucuuugcagcugggccucucuauaccccuggaugaacagcuugc

SEQ ID NO: 506739 - RNA, 64 nt, hsa
ucaucuugaccaaagcugcuguguggcagcucggccucucuacgaccccaucuugguggcugca

SEQ ID NO: 506740 - RNA, 64 nt, hsa
ugcaucagggcaggacggggucucagcccgccucccucucuacgucucuguaccgagccucugg

SEQ ID NO: 506741 - RNA, 64 nt, hsa
uuccucgucauagggguucucacucugaacuuucccucucuacuacccauggcaggaaccuagu

SEQ ID NO: 506742 - RNA, 64 nt, hsa
uguauucaguuuugacugugcuucauaucauguaccucucuagucaaagugguauuacagacau

SEQ ID NO: 506743 - RNA, 64 nt, hsa
uguguaaccacuugucgccuuagggccagauuccccucucuaguccccuuuuuuaaauguccau

SEQ ID NO: 506744 - RNA, 64 nt, hsa
cuggccuccaaauauaugcuccccccacauuuuaccucucuaccaaaugaacauaaguuguaau

SEQ ID NO: 506745 - RNA, 64 nt, hsa
uggggccacacagccgggguagaucugagcccguccucucuacuccugugcuguagcaccuuca

SEQ ID NO: 506746 - RNA, 64 nt, hsa
ccccaguacggcccccucuuugcaggcuuuuccuccucucuagaaccuccuucuguuggaggcc

SEQ ID NO: 506747 - RNA, 64 nt, hsa
gccuggaccgagaugugaguccuguugaagacuuccucucuaccccccaccuuggucccucuca

SEQ ID NO: 506748 - RNA, 64 nt, hsa
aaugaggugguggcacaggguggggcaaggagauccucucuaaggccucuggggucuuugccug

SEQ ID NO: 506749 - RNA, 64 nt, hsa
cacagcugggagccagcaagagagcuuggagucgccucucuagaccagaucuagccccacccuc

SEQ ID NO: 506750 - RNA, 64 nt, hsa
ccuccuccugucgugggcucauugugaccacuggccucucuacagcacggccuguggccuguuc

SEQ ID NO: 506751 - RNA, 64 nt, hsa
uucugcguuuggacauaggacucugcagggcugcccucucuaacuggccuggcucuggaagggc

SEQ ID NO: 506752 - RNA, 64 nt, hsa
cucuuuuccacugcccauccucugugaacccauaccucucuagauggagcagguggccacuggu

SEQ ID NO: 506753 - RNA, 64 nt, hsa
auuuugccugcaggaaaauucaaaagcuacucauccucucuauaauuuggagucaucuuacuaa

SEQ ID NO: 506754 - RNA, 64 nt, hsa
cuaaaggaugaauuuccuuuaggccuuugaucuuccucucuaguguauaacuuuaaauauuugc

SEQ ID NO: 506755 - RNA, 64 nt, hsa
cuguguguagcagcuguuaccugaagacgugcuaccucucuacaaaguguugauccccuucuuu

SEQ ID NO: 506756 - RNA, 64 nt, hsa
gcuccagaacccagcccagaucggaggacaaguuccucucuagaacccaauccaauuuggagcc

SEQ ID NO: 506757 - RNA, 64 nt, hsa
guucgagaucagccuggccaacauggugaaauccccucucuacuaaaaauauaaaaauuagcca

SEQ ID NO: 506758 - RNA, 64 nt, hsa
aucucauucuaacagcaaugagaacuuaggcuccccucucuacuaaaauacaaaaguuagcugg

SEQ ID NO: 506759 - RNA, 64 nt, hsa
ucccugccagcacccccacgcccucauuacggcuccucucuaaccuccuuuacccucaucuguc

SEQ ID NO: 506760 - RNA, 64 nt, hsa
acucagcggggaggcaggggaggcagaggggcagccucucuaaugcuuccuacucauuuuguuu

SEQ ID NO: 506761 - RNA, 64 nt, hsa
uguuggacaccuuuagguucuuugcugcauucugccucucuaggaccaugguuaagaguccaag

SEQ ID NO: 506762 - RNA, 64 nt, hsa
cucuggagcccacaauugucuuacccacuaugccccucucuagucaugguccccaagaggggcu

SEQ ID NO: 506763 - RNA, 64 nt, hsa
aaucaacccuucuuccccaccaaaccacccaacuccucucuacucuuauccuuuuauccucugu

SEQ ID NO: 506764 - RNA, 64 nt, hsa
gauccaugaaggaccauuaaccugugauaccuuuccucucuauuaauguugacuucccuugguu

SEQ ID NO: 506765 - RNA, 64 nt, hsa
agcugugcugugugagccugugcaagugacaugaccucucuaaaccuugguuuucugcucucug

SEQ ID NO: 506766 - RNA, 64 nt, hsa
uccacagcucagcaaagccucuguagccagacugccucucuagauuccuccucucugggcagcg

SEQ ID NO: 506767 - RNA, 64 nt, hsa
guuagagaucagccugggcaacauagccagaccuccucucuacaaaaagaaaaaagaaugacau

SEQ ID NO: 506768 - RNA, 64 nt, hsa
aguuaaaauguagguccacauuuuauuuaguugaccucucuaucucuauauuauaguacccaug

SEQ ID NO: 506769 - RNA, 64 nt, hsa
uuucccagccaccccucccccugaaauuucugccccucucuaccacccucacuccaugaccugu

SEQ ID NO: 506770 - RNA, 64 nt, hsa
gggaaacaaccaaaaucgcaauuuuaacaauaugccucucuacccccgugcacuuuuucugaca

SEQ ID NO: 506771 - RNA, 64 nt, hsa
ccuggcuggaccacauacuggccucuuucuucaaccucucuaauaugggcuccagacggaucuc

SEQ ID NO: 506772 - RNA, 64 nt, hsa
aguaauguggaucuuucccuuaaaacuccaaguuccucucuauuuuugcuaucuauaaaaugac

SEQ ID NO: 506773 - RNA, 64 nt, hsa
caugcaaguguguuugccagcucaggagcugucuccucucuaccuggcuaguaagaggugggac

SEQ ID NO: 506774 - RNA, 64 nt, hsa
aagaggggcaugagcugauucacauucugaaggaccucucuagcuggccagugcugaggagguu

SEQ ID NO: 506775 - RNA, 62 nt, hsa
caguccaggaaugggugugagcagcccagagcccucucuauccacuuggucuggccagccag

SEQ ID NO: 506776 - RNA, 64 nt, hsa
gucaccagcauaagaacaucaacaggaaugccgcccucucuacugucugaaccccuugucccug

SEQ ID NO: 506777 - RNA, 64 nt, hsa
aacauuugggaaaugacaaacucaggcuggcucuccucucuaaccucacugggcuauaaauguu

SEQ ID NO: 506778 - RNA, 64 nt, hsa
cacccacucccagccccagcuccagcugcccucaccucucuagcagcucucaccccucugaguc

SEQ ID NO: 506779 - RNA, 64 nt, hsa
cacaaaaaguccagaccccagggacgguacuuucccucucuaccuggugcuccucccuaaugcu

SEQ ID NO: 506780 - RNA, 64 nt, hsa
uauuuauacugcucuuuacaaaagcaccggugcuccucucuaggcagcgggugggcacagcccc

SEQ ID NO: 506781 - RNA, 64 nt, hsa
ggcgcugggacagucagggugaccccaccgccuaccucucuacaucuaaagagcccucugggcc

SEQ ID NO: 506782 - RNA, 64 nt, hsa
uguuuugacuuguuguaaccuguauacuggaaucccucucuagcuguauuaaaaauucccacag

SEQ ID NO: 506783 - RNA, 64 nt, hsa
ccccaaauccuuacuuauuuuaaaaagacuagacccucucuaaagacuguuccauuuuaacaug

SEQ ID NO: 506784 - RNA, 64 nt, hsa
gagacuugagcccagccuucugacugcauucagcccucucuaggacgcagcagccucuccccag

SEQ ID NO: 506785 - RNA, 64 nt, hsa
ccccuuauuaaggccccagaugaucccagucacuccucucuagggcagaagacuagaggccagg

SEQ ID NO: 506786 - RNA, 64 nt, hsa
agguagguaaauagguaggccucuaauugaaccaccucucuaaguuauguacguauauauaagc

SEQ ID NO: 506787 - RNA, 64 nt, hsa
guuccagaccagccugaccaaaauggugaaaccuccucucuacuaaaacuacaaaaauuaacug

SEQ ID NO: 506788 - RNA, 64 nt, hsa
cauuugccauuauucaccuugucccuugccugccccucucuauuaguaccucauccuccacuca

SEQ ID NO: 506789 - RNA, 64 nt, hsa
agacagacaucuaauuauucucucuuuuucccccccucucuauguguauauuucuaauggaucu

SEQ ID NO: 506790 - RNA, 64 nt, hsa
ccuucuaguaucucugccgggggcuucugguacuccucucuaaauaccagagggaagaugccca

SEQ ID NO: 506791 - RNA, 64 nt, hsa
gucacauugagaucauaaucccuccugucccacuccucucuaccaaccccacccuacuagcuag

SEQ ID NO: 506792 - RNA, 64 nt, hsa
aguccuuccauaauaguaacaacuccacagauuuccucucuaaauuuuuaugccugcuuuuagc

SEQ ID NO: 506793 - RNA, 64 nt, hsa
agauaguguaacccaauguaucugugggccuauuccucucuaccuuuaaggugcguucauuuug

SEQ ID NO: 506794 - RNA, 64 nt, hsa
gagccuuugugcucccacucaauacaaaaaggccccucucuacaucugggaaugcaccucuucu

SEQ ID NO: 506795 - RNA, 64 nt, hsa; identical to SEQ ID NO: 46290

SEQ ID NO: 506796 - RNA, 64 nt, hsa; identical to SEQ ID NO: 46291

SEQ ID NO: 506797 - RNA, 64 nt, hsa; identical to SEQ ID NO: 46292

SEQ ID NO: 506798 - RNA, 64 nt, hsa; identical to SEQ ID NO: 46293

SEQ ID NO: 506799 - RNA, 64 nt, hsa; identical to SEQ ID NO: 46294

SEQ ID NO: 506800 - RNA, 64 nt, hsa; identical to SEQ ID NO: 46295

SEQ ID NO: 506801 - RNA, 55 nt, hsa; identical to SEQ ID NO: 46296

SEQ ID NO: 506802 - RNA, 64 nt, hsa; identical to SEQ ID NO: 46297

SEQ ID NO: 506803 - RNA, 63 nt, hsa; identical to SEQ ID NO: 46298

SEQ ID NO: 506804 - RNA, 64 nt, hsa; identical to SEQ ID NO: 46299

SEQ ID NO: 506805 - RNA, 64 nt, hsa; identical to SEQ ID NO: 46300

SEQ ID NO: 506806 - RNA, 64 nt, hsa; identical to SEQ ID NO: 46301

SEQ ID NO: 506807 - RNA, 64 nt, hsa; identical to SEQ ID NO: 46302

SEQ ID NO: 506808 - RNA, 64 nt, hsa; identical to SEQ ID NO: 46303

SEQ ID NO: 506809 - RNA, 64 nt, hsa; identical to SEQ ID NO: 46304

SEQ ID NO: 506810 - RNA, 64 nt, hsa; identical to SEQ ID NO: 46305

SEQ ID NO: 506811 - RNA, 64 nt, hsa; identical to SEQ ID NO: 46306

SEQ ID NO: 506812 - RNA, 64 nt, hsa; identical to SEQ ID NO: 46307

SEQ ID NO: 506813 - RNA, 64 nt, hsa; identical to SEQ ID NO: 46308

SEQ ID NO: 506814 - RNA, 64 nt, hsa; identical to SEQ ID NO: 46309

SEQ ID NO: 506815 - RNA, 64 nt, hsa; identical to SEQ ID NO: 46310

SEQ ID NO: 506816 - RNA, 64 nt, hsa; identical to SEQ ID NO: 46311

SEQ ID NO: 506817 - RNA, 64 nt, hsa; identical to SEQ ID NO: 46312

SEQ ID NO: 506818 - RNA, 64 nt, hsa; identical to SEQ ID NO: 46313

SEQ ID NO: 506819 - RNA, 64 nt, hsa; identical to SEQ ID NO: 46314

SEQ ID NO: 506820 - RNA, 64 nt, hsa; identical to SEQ ID NO: 46315

SEQ ID NO: 506821 - RNA, 64 nt, hsa; identical to SEQ ID NO: 46316

SEQ ID NO: 506822 - RNA, 64 nt, hsa; identical to SEQ ID NO: 46317

SEQ ID NO: 506823 - RNA, 64 nt, hsa; identical to SEQ ID NO: 46318

SEQ ID NO: 506824 - RNA, 64 nt, hsa; identical to SEQ ID NO: 46319

SEQ ID NO: 506825 - RNA, 64 nt, hsa; identical to SEQ ID NO: 46320

SEQ ID NO: 506826 - RNA, 64 nt, hsa; identical to SEQ ID NO: 46321

SEQ ID NO: 506827 - RNA, 64 nt, hsa; identical to SEQ ID NO: 46322

SEQ ID NO: 506828 - RNA, 64 nt, hsa; identical to SEQ ID NO: 46323

SEQ ID NO: 506829 - RNA, 64 nt, hsa; identical to SEQ ID NO: 46324

SEQ ID NO: 506830 - RNA, 64 nt, hsa; identical to SEQ ID NO: 46325

SEQ ID NO: 506831 - RNA, 64 nt, hsa; identical to SEQ ID NO: 46326

SEQ ID NO: 506832 - RNA, 64 nt, hsa; identical to SEQ ID NO: 46327

SEQ ID NO: 506833 - RNA, 64 nt, hsa; identical to SEQ ID NO: 46328

SEQ ID NO: 506834 - RNA, 64 nt, hsa; identical to SEQ ID NO: 46329

SEQ ID NO: 506835 - RNA, 64 nt, hsa; identical to SEQ ID NO: 46330

SEQ ID NO: 506836 - RNA, 64 nt, hsa; identical to SEQ ID NO: 46331

SEQ ID NO: 506837 - RNA, 64 nt, hsa; identical to SEQ ID NO: 46332

SEQ ID NO: 506838 - RNA, 64 nt, hsa; identical to SEQ ID NO: 46333

SEQ ID NO: 506839 - RNA, 64 nt, hsa; identical to SEQ ID NO: 46334

SEQ ID NO: 506840 - RNA, 64 nt, hsa; identical to SEQ ID NO: 46335

SEQ ID NO: 506841 - RNA, 64 nt, hsa; identical to SEQ ID NO: 46336

SEQ ID NO: 506842 - RNA, 64 nt, hsa; identical to SEQ ID NO: 46337

SEQ ID NO: 506843 - RNA, 64 nt, hsa; identical to SEQ ID NO: 46338

SEQ ID NO: 506844 - RNA, 64 nt, hsa; identical to SEQ ID NO: 46339

SEQ ID NO: 506845 - RNA, 64 nt, hsa; identical to SEQ ID NO: 46340

SEQ ID NO: 506846 - RNA, 64 nt, hsa; identical to SEQ ID NO: 46341

SEQ ID NO: 506847 - RNA, 64 nt, hsa; identical to SEQ ID NO: 46342

SEQ ID NO: 506848 - RNA, 64 nt, hsa; identical to SEQ ID NO: 46343

SEQ ID NO: 506849 - RNA, 64 nt, hsa; identical to SEQ ID NO: 46344

SEQ ID NO: 506850 - RNA, 64 nt, hsa; identical to SEQ ID NO: 46345

SEQ ID NO: 506851 - RNA, 64 nt, hsa; identical to SEQ ID NO: 46346

SEQ ID NO: 506852 - RNA, 64 nt, hsa; identical to SEQ ID NO: 46347

SEQ ID NO: 506853 - RNA, 64 nt, hsa; identical to SEQ ID NO: 46348

SEQ ID NO: 506854 - RNA, 64 nt, hsa; identical to SEQ ID NO: 46349

SEQ ID NO: 506855 - RNA, 64 nt, hsa; identical to SEQ ID NO: 46350

SEQ ID NO: 506856 - RNA, 64 nt, hsa; identical to SEQ ID NO: 46351

SEQ ID NO: 506857 - RNA, 64 nt, hsa; identical to SEQ ID NO: 46352

SEQ ID NO: 506858 - RNA, 64 nt, hsa; identical to SEQ ID NO: 46353

SEQ ID NO: 506859 - RNA, 64 nt, hsa; identical to SEQ ID NO: 46354

SEQ ID NO: 506860 - RNA, 64 nt, hsa; identical to SEQ ID NO: 46355

SEQ ID NO: 506861 - RNA, 64 nt, hsa; identical to SEQ ID NO: 46356

SEQ ID NO: 506862 - RNA, 64 nt, hsa; identical to SEQ ID NO: 46357

SEQ ID NO: 506863 - RNA, 64 nt, hsa; identical to SEQ ID NO: 46358

SEQ ID NO: 506864 - RNA, 64 nt, hsa; identical to SEQ ID NO: 46359

SEQ ID NO: 506865 - RNA, 64 nt, hsa; identical to SEQ ID NO: 46360

SEQ ID NO: 506866 - RNA, 64 nt, hsa; identical to SEQ ID NO: 46361

SEQ ID NO: 506867 - RNA, 64 nt, hsa; identical to SEQ ID NO: 114692

SEQ ID NO: 506868 - RNA, 64 nt, hsa; identical to SEQ ID NO: 114693

SEQ ID NO: 506869 - RNA, 64 nt, hsa; identical to SEQ ID NO: 114694

SEQ ID NO: 506870 - RNA, 64 nt, hsa; identical to SEQ ID NO: 114695

SEQ ID NO: 506871 - RNA, 64 nt, hsa; identical to SEQ ID NO: 114696

SEQ ID NO: 506872 - RNA, 64 nt, hsa; identical to SEQ ID NO: 114697

SEQ ID NO: 506873 - RNA, 64 nt, hsa; identical to SEQ ID NO: 114698

SEQ ID NO: 506874 - RNA, 64 nt, hsa; identical to SEQ ID NO: 114699

SEQ ID NO: 506875 - RNA, 64 nt, hsa; identical to SEQ ID NO: 290844

SEQ ID NO: 506876 - RNA, 64 nt, hsa; identical to SEQ ID NO: 290845

SEQ ID NO: 506877 - RNA, 64 nt, hsa; identical to SEQ ID NO: 290846

SEQ ID NO: 506878 - RNA, 64 nt, hsa; identical to SEQ ID NO: 290847

SEQ ID NO: 506879 - RNA, 64 nt, hsa; identical to SEQ ID NO: 290848

SEQ ID NO: 506880 - RNA, 64 nt, hsa; identical to SEQ ID NO: 290849

SEQ ID NO: 506881 - RNA, 64 nt, hsa; identical to SEQ ID NO: 290850

SEQ ID NO: 506882 - RNA, 64 nt, hsa; identical to SEQ ID NO: 290851

SEQ ID NO: 506883 - RNA, 64 nt, hsa; identical to SEQ ID NO: 290852

SEQ ID NO: 506884 - RNA, 64 nt, hsa; identical to SEQ ID NO: 290853

SEQ ID NO: 506885 - RNA, 64 nt, hsa; identical to SEQ ID NO: 290854

SEQ ID NO: 506886 - RNA, 64 nt, hsa; identical to SEQ ID NO: 290855

SEQ ID NO: 506887 - RNA, 64 nt, hsa; identical to SEQ ID NO: 290856

SEQ ID NO: 506888 - RNA, 64 nt, hsa; identical to SEQ ID NO: 290857

SEQ ID NO: 506889 - RNA, 64 nt, hsa; identical to SEQ ID NO: 290858

SEQ ID NO: 506890 - RNA, 64 nt, hsa; identical to SEQ ID NO: 290859

SEQ ID NO: 506891 - RNA, 64 nt, hsa; identical to SEQ ID NO: 290860

SEQ ID NO: 506892 - RNA, 64 nt, hsa; identical to SEQ ID NO: 290861

SEQ ID NO: 506893 - RNA, 64 nt, hsa; identical to SEQ ID NO: 290862

SEQ ID NO: 506894 - RNA, 64 nt, hsa; identical to SEQ ID NO: 290863

SEQ ID NO: 506895 - RNA, 64 nt, hsa; identical to SEQ ID NO: 290864

SEQ ID NO: 506896 - RNA, 64 nt, hsa; identical to SEQ ID NO: 290865

SEQ ID NO: 506897 - RNA, 63 nt, hsa; identical to SEQ ID NO: 290866

SEQ ID NO: 506898 - RNA, 64 nt, hsa
cggggcuggguuucucuuuccucuuuuuggagaaaaggaacagggcaguggaaugaaaauuuuu

SEQ ID NO: 506899 - RNA, 64 nt, hsa
aaggacuucaaacuucugcugagaccuuggggucaaggaacauuucauugguuuuuuuugucca

SEQ ID NO: 506900 - RNA, 64 nt, hsa
auggaagagguucugauaauuuuuuuaacuuuuuaaggaacagauguggaauacacuggcccau

SEQ ID NO: 506901 - RNA, 64 nt, hsa
uuuaguccuauaauuuucagcuuaauuauaaacaaaggaacaaauaaguggaagggcagcuauu

SEQ ID NO: 506902 - RNA, 64 nt, hsa
uuguugcauuuccuugauaauauugacguguuuaaaggaacaucucaucuccauuagauuugcc

SEQ ID NO: 506903 - RNA, 64 nt, hsa
aagggauuaugacagguauuaccaaaaacaccaaaaggaacaaaggggccugcguuaaaaccua

SEQ ID NO: 506904 - RNA, 64 nt, hsa
aauauuauuaaacaaucaucaggcuuuuagcgacaaggaacacacacauuuuucuuaaaggccc

SEQ ID NO: 506905 - RNA, 64 nt, hsa
aaaaaugguauacaugaagucacauacuuuuuuaaaggaacacucagaacauucugucauucca

SEQ ID NO: 506906 - RNA, 64 nt, hsa
gcgagggacggugugugacaugucaugccuggagaaggaacaaggcuauuugaaaacagaaggc

SEQ ID NO: 506907 - RNA, 64 nt, hsa
acaaauuuguuacaugucagugagaccuuuuucaaaggaacauauucaauuuggcuuuuugugg

SEQ ID NO: 506908 - RNA, 64 nt, hsa
gcuucugucauaugaaugagauauacauuuauucaaggaacagcaaugucaacaggauggaaac

SEQ ID NO: 506909 - RNA, 64 nt, hsa
ccauuuuaugggcaugaaauaugugguuuagaauaaggaacaagcauuauuccuuugccaacag

SEQ ID NO: 506910 - RNA, 64 nt, hsa
uaaaagagcuccugaaggaagcacuaaacauggaaaggaacaacugauaccagccgcugcaaaa

SEQ ID NO: 506911 - RNA, 64 nt, hsa
auaguuggaaguaaagcacuccucagcaaauguaaaggaacaaaaauuauaacaaacugucucu

SEQ ID NO: 506912 - RNA, 64 nt, hsa
caucgauuuuugggcccuagaaaugcucaaagggugcuccuaggauuaucagagccuaucuuuc

SEQ ID NO: 506913 - RNA, 64 nt, hsa
ggcagcucccuagaucuuuagcuucuacucccacugcuccuaccacuccagcaacgccagauaa

SEQ ID NO: 506914 - RNA, 64 nt, hsa
ugugcccagaucguucugccacuugcacugugcuugcuccuaagcaaaagggaaaaggagcgcg

SEQ ID NO: 506915 - RNA, 64 nt, hsa
auccaggauguuauucuuccuucccaacucacugugcuccuaaaggcagcaaccauucaucuuu

SEQ ID NO: 506916 - RNA, 64 nt, hsa
uuaauaaggaaguacauuuuuaaauuuuucaaacugcuccuagcuuuugauuaggagaauauuu

SEQ ID NO: 506917 - RNA, 64 nt, hsa
cucugaaggagcuuuggcuccugauauuuuaucaugcuccuauauuuuuuuaauccuuggagca

SEQ ID NO: 506918 - RNA, 64 nt, hsa
auguguauuacaaauauuuugcuaguuuuugacuugcuccuaauguugaauuuugaugaacaaa

SEQ ID NO: 506919 - RNA, 64 nt, hsa
auuaccaguuuuccuaagugauuguaugaauuuaugcuccuaccggcaauguguggcaguccua

SEQ ID NO: 506920 - RNA, 64 nt, hsa
ugcccccuggguucuggacgugagugguggguccugcuccuaucucuccaaaccccauacccuu

SEQ ID NO: 506921 - RNA, 64 nt, hsa
ugauccugacuuucuagccauuaauaaagagaacugcuccuagcaccucagccucuaaccauca

SEQ ID NO: 506922 - RNA, 64 nt, hsa; identical to SEQ ID NO: 309371

SEQ ID NO: 506923 - RNA, 64 nt, hsa; identical to SEQ ID NO: 309372

SEQ ID NO: 506924 - RNA, 64 nt, hsa; identical to SEQ ID NO: 309373

SEQ ID NO: 506925 - RNA, 64 nt, hsa; identical to SEQ ID NO: 309374

SEQ ID NO: 506926 - RNA, 64 nt, hsa; identical to SEQ ID NO: 309375

SEQ ID NO: 506927 - RNA, 64 nt, hsa; identical to SEQ ID NO: 309376

SEQ ID NO: 506928 - RNA, 64 nt, hsa; identical to SEQ ID NO: 309377

SEQ ID NO: 506929 - RNA, 64 nt, hsa; identical to SEQ ID NO: 309378

SEQ ID NO: 506930 - RNA, 64 nt, hsa; identical to SEQ ID NO: 309379

SEQ ID NO: 506931 - RNA, 64 nt, hsa; identical to SEQ ID NO: 309380

SEQ ID NO: 506932 - RNA, 50 nt, hsa; identical to SEQ ID NO: 56892

SEQ ID NO: 506933 - RNA, 64 nt, hsa; identical to SEQ ID NO: 309382

SEQ ID NO: 506934 - RNA, 64 nt, hsa; identical to SEQ ID NO: 309383

SEQ ID NO: 506935 - RNA, 64 nt, hsa; identical to SEQ ID NO: 309384

SEQ ID NO: 506936 - RNA, 64 nt, hsa; identical to SEQ ID NO: 309385

SEQ ID NO: 506937 - RNA, 64 nt, hsa; identical to SEQ ID NO: 309386

SEQ ID NO: 506938 - RNA, 64 nt, hsa; identical to SEQ ID NO: 309387

SEQ ID NO: 506939 - RNA, 64 nt, hsa; identical to SEQ ID NO: 309388

SEQ ID NO: 506940 - RNA, 64 nt, hsa; identical to SEQ ID NO: 309389

SEQ ID NO: 506941 - RNA, 64 nt, hsa; identical to SEQ ID NO: 309390

SEQ ID NO: 506942 - RNA, 64 nt, hsa; identical to SEQ ID NO: 309391

SEQ ID NO: 506943 - RNA, 64 nt, hsa; identical to SEQ ID NO: 309392

SEQ ID NO: 506944 - RNA, 64 nt, hsa; identical to SEQ ID NO: 309393

SEQ ID NO: 506945 - RNA, 64 nt, hsa; identical to SEQ ID NO: 309394

SEQ ID NO: 506946 - RNA, 64 nt, hsa; identical to SEQ ID NO: 309395

SEQ ID NO: 506947 - RNA, 64 nt, hsa; identical to SEQ ID NO: 309396

SEQ ID NO: 506948 - RNA, 64 nt, hsa; identical to SEQ ID NO: 309397

SEQ ID NO: 506949 - RNA, 64 nt, hsa; identical to SEQ ID NO: 309398

SEQ ID NO: 506950 - RNA, 64 nt, hsa; identical to SEQ ID NO: 309399

SEQ ID NO: 506951 - RNA, 64 nt, hsa; identical to SEQ ID NO: 309400

SEQ ID NO: 506952 - RNA, 64 nt, hsa; identical to SEQ ID NO: 309401

SEQ ID NO: 506953 - RNA, 64 nt, hsa; identical to SEQ ID NO: 309402

SEQ ID NO: 506954 - RNA, 64 nt, hsa; identical to SEQ ID NO: 309403

SEQ ID NO: 506955 - RNA, 64 nt, hsa; identical to SEQ ID NO: 309404

SEQ ID NO: 506956 - RNA, 64 nt, hsa; identical to SEQ ID NO: 309405

SEQ ID NO: 506957 - RNA, 64 nt, hsa; identical to SEQ ID NO: 309406

SEQ ID NO: 506958 - RNA, 64 nt, hsa; identical to SEQ ID NO: 309407

SEQ ID NO: 506959 - RNA, 64 nt, hsa; identical to SEQ ID NO: 309408

SEQ ID NO: 506960 - RNA, 64 nt, hsa; identical to SEQ ID NO: 309409

SEQ ID NO: 506961 - RNA, 64 nt, hsa; identical to SEQ ID NO: 309410

SEQ ID NO: 506962 - RNA, 64 nt, hsa; identical to SEQ ID NO: 309411

SEQ ID NO: 506963 - RNA, 64 nt, hsa; identical to SEQ ID NO: 309412

SEQ ID NO: 506964 - RNA, 64 nt, hsa; identical to SEQ ID NO: 309413

SEQ ID NO: 506965 - RNA, 64 nt, hsa; identical to SEQ ID NO: 309414

SEQ ID NO: 506966 - RNA, 64 nt, hsa; identical to SEQ ID NO: 309415

SEQ ID NO: 506967 - RNA, 64 nt, hsa; identical to SEQ ID NO: 309416

SEQ ID NO: 506968 - RNA, 64 nt, hsa; identical to SEQ ID NO: 309417

SEQ ID NO: 506969 - RNA, 64 nt, hsa; identical to SEQ ID NO: 309418

SEQ ID NO: 506970 - RNA, 64 nt, hsa; identical to SEQ ID NO: 309419

SEQ ID NO: 506971 - RNA, 64 nt, hsa; identical to SEQ ID NO: 309420

SEQ ID NO: 506972 - RNA, 64 nt, hsa; identical to SEQ ID NO: 309421

SEQ ID NO: 506973 - RNA, 54 nt, hsa; identical to SEQ ID NO: 56933

SEQ ID NO: 506974 - RNA, 64 nt, hsa; identical to SEQ ID NO: 309423

SEQ ID NO: 506975 - RNA, 64 nt, hsa; identical to SEQ ID NO: 309424

SEQ ID NO: 506976 - RNA, 64 nt, hsa; identical to SEQ ID NO: 309425

SEQ ID NO: 506977 - RNA, 64 nt, hsa; identical to SEQ ID NO: 309426

SEQ ID NO: 506978 - RNA, 64 nt, hsa; identical to SEQ ID NO: 309427

SEQ ID NO: 506979 - RNA, 64 nt, hsa; identical to SEQ ID NO: 309428

SEQ ID NO: 506980 - RNA, 64 nt, hsa; identical to SEQ ID NO: 309429

SEQ ID NO: 506981 - RNA, 64 nt, hsa; identical to SEQ ID NO: 309430

SEQ ID NO: 506982 - RNA, 64 nt, hsa
aauuaaccauaugcuagaaugcccaccucuaagccaauuggauucuuuagcucucuuuuucuuu

SEQ ID NO: 506983 - RNA, 64 nt, hsa
cauauacagugcaucagucuguucucuuugaccacaauuggaauacauuucaagaugguaacag

SEQ ID NO: 506984 - RNA, 64 nt, hsa
aauugacuacaaaauuuguaguuaaauuugacuacaauuggaaaugccaaaaacucacuaauag

SEQ ID NO: 506985 - RNA, 64 nt, hsa
ucagcaaccagaaaauaagcugguacuaguuaaacaauuggauaucuuggcugcuguacaugau

SEQ ID NO: 506986 - RNA, 64 nt, hsa
uuuguaguuaaauuugaccucagugcccugacuacaauuggaaaugccaaaaacucgagucuuu

SEQ ID NO: 506987 - RNA, 64 nt, hsa
ucagcaaccagaaaauaagcugguacuaguuaaacaauuggauaauaucuuggcugcugcacau

SEQ ID NO: 506988 - RNA, 64 nt, hsa; identical to SEQ ID NO: 344304

SEQ ID NO: 506989 - RNA, 64 nt, hsa; identical to SEQ ID NO: 344305

SEQ ID NO: 506990 - RNA, 64 nt, hsa; identical to SEQ ID NO: 344306

SEQ ID NO: 506991 - RNA, 64 nt, hsa; identical to SEQ ID NO: 344307

SEQ ID NO: 506992 - RNA, 64 nt, hsa; identical to SEQ ID NO: 344308

SEQ ID NO: 506993 - RNA, 64 nt, hsa; identical to SEQ ID NO: 344309

SEQ ID NO: 506994 - RNA, 64 nt, hsa; identical to SEQ ID NO: 344310

SEQ ID NO: 506995 - RNA, 64 nt, hsa; identical to SEQ ID NO: 344311

SEQ ID NO: 506996 - RNA, 64 nt, hsa; identical to SEQ ID NO: 299712

SEQ ID NO: 506997 - RNA, 64 nt, hsa; identical to SEQ ID NO: 299713

SEQ ID NO: 506998 - RNA, 64 nt, hsa; identical to SEQ ID NO: 299714

SEQ ID NO: 506999 - RNA, 64 nt, hsa; identical to SEQ ID NO: 299715

SEQ ID NO: 507000 - RNA, 64 nt, hsa; identical to SEQ ID NO: 299716

SEQ ID NO: 507001 - RNA, 64 nt, hsa; identical to SEQ ID NO: 299717

SEQ ID NO: 507002 - RNA, 64 nt, hsa; identical to SEQ ID NO: 299718

SEQ ID NO: 507003 - RNA, 64 nt, hsa; identical to SEQ ID NO: 299719

SEQ ID NO: 507004 - RNA, 64 nt, hsa; identical to SEQ ID NO: 299720

SEQ ID NO: 507005 - RNA, 64 nt, hsa; identical to SEQ ID NO: 299721

SEQ ID NO: 507006 - RNA, 64 nt, hsa
ucagcugcugggccccaccuccccacugcacccagggggcaacuccaccuggacugaugggcac

SEQ ID NO: 507007 - RNA, 64 nt, hsa
cugaugggcacaggaggcaccaauagcgauuauugggggcaaugcgaggucuccuccuaugccc

SEQ ID NO: 507008 - RNA, 64 nt, hsa
cugaaaauuuuaacagucuucuuaaaaguauugagggggcaaaaauuaccaauuaugguauaca

SEQ ID NO: 507009 - RNA, 64 nt, hsa
ccacaguauucuagagacggguugcaaugacaaggggggcaaaugaaaucaaugcaagauuucu

SEQ ID NO: 507010 - RNA, 64 nt, hsa
gugaugcuccuuguagcaggauaccaggguacuggggggcaaugcuaugauuaacuugcuucaa

SEQ ID NO: 507011 - RNA, 64 nt, hsa
uggugccagcuucugagggccugcuuggccuccugggggcaaagccccucugcccgaagcaaua

SEQ ID NO: 507012 - RNA, 64 nt, hsa
aggucaguccucaccugcaggugucggggugugggggggcaaggaggggcaggcacacaccaug

SEQ ID NO: 507013 - RNA, 64 nt, hsa
ccugggguggccuguccugcaggggcccuggaaugggggcaagcagcugggugggcagaaugca

SEQ ID NO: 507014 - RNA, 64 nt, hsa
caaaggaccagguaauuggggaggggagagaggugggggcaagggggaaaugcccccccaucuc

SEQ ID NO: 507015 - RNA, 64 nt, hsa
uaccccuuccaugcucaucucacugcccagugaagggggcaagggcagcgaggggcaggacccc

SEQ ID NO: 507016 - RNA, 64 nt, hsa
uugguuggaccugcccacuccaaaaacccagugugggggcaaagggcgugggaagagcagggcu

SEQ ID NO: 507017 - RNA, 64 nt, hsa
uucuagguuugugaaugugaagccccaggccgcagggggcaaggggccaggugccccccaccag

SEQ ID NO: 507018 - RNA, 64 nt, hsa
acucucuuccucccacccccaagacugaguuuuggggggcaagguggagagagcuggcaacuac

SEQ ID NO: 507019 - RNA, 64 nt, hsa
uaaaaggagggaauaggaggagggcagggugagugggggcaauccuagguggugggggagucau

SEQ ID NO: 507020 - RNA, 64 nt, hsa; identical to SEQ ID NO: 182371

SEQ ID NO: 507021 - RNA, 64 nt, hsa; identical to SEQ ID NO: 182372

SEQ ID NO: 507022 - RNA, 64 nt, hsa; identical to SEQ ID NO: 182373

SEQ ID NO: 507023 - RNA, 64 nt, hsa; identical to SEQ ID NO: 182374

SEQ ID NO: 507024 - RNA, 64 nt, hsa; identical to SEQ ID NO: 182375

SEQ ID NO: 507025 - RNA, 64 nt, hsa; identical to SEQ ID NO: 182376

SEQ ID NO: 507026 - RNA, 64 nt, hsa; identical to SEQ ID NO: 182377

SEQ ID NO: 507027 - RNA, 64 nt, hsa; identical to SEQ ID NO: 182378

SEQ ID NO: 507028 - RNA, 64 nt, hsa; identical to SEQ ID NO: 182379

SEQ ID NO: 507029 - RNA, 64 nt, hsa; identical to SEQ ID NO: 182380

SEQ ID NO: 507030 - RNA, 64 nt, hsa; identical to SEQ ID NO: 182381

SEQ ID NO: 507031 - RNA, 64 nt, hsa; identical to SEQ ID NO: 182382

SEQ ID NO: 507032 - RNA, 64 nt, hsa; identical to SEQ ID NO: 182383

SEQ ID NO: 507033 - RNA, 64 nt, hsa; identical to SEQ ID NO: 182384

SEQ ID NO: 507034 - RNA, 64 nt, hsa; identical to SEQ ID NO: 182385

SEQ ID NO: 507035 - RNA, 64 nt, hsa; identical to SEQ ID NO: 182386

SEQ ID NO: 507036 - RNA, 64 nt, hsa; identical to SEQ ID NO: 182387

SEQ ID NO: 507037 - RNA, 64 nt, hsa; identical to SEQ ID NO: 182388

SEQ ID NO: 507038 - RNA, 64 nt, hsa; identical to SEQ ID NO: 182389

SEQ ID NO: 507039 - RNA, 64 nt, hsa; identical to SEQ ID NO: 182390

SEQ ID NO: 507040 - RNA, 64 nt, hsa; identical to SEQ ID NO: 182391

SEQ ID NO: 507041 - RNA, 64 nt, hsa; identical to SEQ ID NO: 182392

SEQ ID NO: 507042 - RNA, 64 nt, hsa; identical to SEQ ID NO: 182393

SEQ ID NO: 507043 - RNA, 64 nt, hsa; identical to SEQ ID NO: 182394

SEQ ID NO: 507044 - RNA, 64 nt, hsa; identical to SEQ ID NO: 182395

SEQ ID NO: 507045 - RNA, 64 nt, hsa; identical to SEQ ID NO: 182396

SEQ ID NO: 507046 - RNA, 64 nt, hsa; identical to SEQ ID NO: 182397

SEQ ID NO: 507047 - RNA, 64 nt, hsa; identical to SEQ ID NO: 182398

SEQ ID NO: 507048 - RNA, 64 nt, hsa; identical to SEQ ID NO: 182399

SEQ ID NO: 507049 - RNA, 64 nt, hsa; identical to SEQ ID NO: 182400

SEQ ID NO: 507050 - RNA, 64 nt, hsa; identical to SEQ ID NO: 182401

SEQ ID NO: 507051 - RNA, 64 nt, hsa; identical to SEQ ID NO: 182402

SEQ ID NO: 507052 - RNA, 64 nt, hsa; identical to SEQ ID NO: 182403

SEQ ID NO: 507053 - RNA, 64 nt, hsa; identical to SEQ ID NO: 182404

SEQ ID NO: 507054 - RNA, 64 nt, hsa; identical to SEQ ID NO: 182405

SEQ ID NO: 507055 - RNA, 64 nt, hsa; identical to SEQ ID NO: 182406

SEQ ID NO: 507056 - RNA, 64 nt, hsa; identical to SEQ ID NO: 182407

SEQ ID NO: 507057 - RNA, 64 nt, hsa; identical to SEQ ID NO: 182408

SEQ ID NO: 507058 - RNA, 64 nt, hsa; identical to SEQ ID NO: 182409

SEQ ID NO: 507059 - RNA, 64 nt, hsa; identical to SEQ ID NO: 182410

SEQ ID NO: 507060 - RNA, 64 nt, hsa; identical to SEQ ID NO: 182411

SEQ ID NO: 507061 - RNA, 64 nt, hsa; identical to SEQ ID NO: 182412

SEQ ID NO: 507062 - RNA, 64 nt, hsa; identical to SEQ ID NO: 182413

SEQ ID NO: 507063 - RNA, 64 nt, hsa; identical to SEQ ID NO: 182414

SEQ ID NO: 507064 - RNA, 64 nt, hsa; identical to SEQ ID NO: 182415

SEQ ID NO: 507065 - RNA, 64 nt, hsa; identical to SEQ ID NO: 182416

SEQ ID NO: 507066 - RNA, 64 nt, hsa; identical to SEQ ID NO: 182417

SEQ ID NO: 507067 - RNA, 64 nt, hsa; identical to SEQ ID NO: 182418

SEQ ID NO: 507068 - RNA, 64 nt, hsa; identical to SEQ ID NO: 182419

SEQ ID NO: 507069 - RNA, 64 nt, hsa; identical to SEQ ID NO: 182420

SEQ ID NO: 507070 - RNA, 64 nt, hsa; identical to SEQ ID NO: 182421

SEQ ID NO: 507071 - RNA, 64 nt, hsa; identical to SEQ ID NO: 182422

SEQ ID NO: 507072 - RNA, 64 nt, hsa; identical to SEQ ID NO: 182423

SEQ ID NO: 507073 - RNA, 64 nt, hsa; identical to SEQ ID NO: 182424

SEQ ID NO: 507074 - RNA, 64 nt, hsa; identical to SEQ ID NO: 182425

SEQ ID NO: 507075 - RNA, 64 nt, hsa; identical to SEQ ID NO: 182426

SEQ ID NO: 507076 - RNA, 64 nt, hsa; identical to SEQ ID NO: 182427

SEQ ID NO: 507077 - RNA, 64 nt, hsa; identical to SEQ ID NO: 182428

SEQ ID NO: 507078 - RNA, 64 nt, hsa; identical to SEQ ID NO: 182429

SEQ ID NO: 507079 - RNA, 64 nt, hsa; identical to SEQ ID NO: 206766

SEQ ID NO: 507080 - RNA, 64 nt, hsa; identical to SEQ ID NO: 206767

SEQ ID NO: 507081 - RNA, 64 nt, hsa; identical to SEQ ID NO: 225502

SEQ ID NO: 507082 - RNA, 64 nt, hsa; identical to SEQ ID NO: 225503

SEQ ID NO: 507083 - RNA, 64 nt, hsa; identical to SEQ ID NO: 225504

SEQ ID NO: 507084 - RNA, 64 nt, hsa; identical to SEQ ID NO: 225505

SEQ ID NO: 507085 - RNA, 64 nt, hsa; identical to SEQ ID NO: 225506

SEQ ID NO: 507086 - RNA, 64 nt, hsa; identical to SEQ ID NO: 225507

SEQ ID NO: 507087 - RNA, 64 nt, hsa; identical to SEQ ID NO: 225508

SEQ ID NO: 507088 - RNA, 64 nt, hsa; identical to SEQ ID NO: 225509

SEQ ID NO: 507089 - RNA, 64 nt, hsa; identical to SEQ ID NO: 225510

SEQ ID NO: 507090 - RNA, 64 nt, hsa; identical to SEQ ID NO: 225511

SEQ ID NO: 507091 - RNA, 64 nt, hsa; identical to SEQ ID NO: 225512

SEQ ID NO: 507092 - RNA, 64 nt, hsa
cagccaaaggccacgucugacuugggaggcagagggcagcuacugcagguuuccgagcagaggg

SEQ ID NO: 507093 - RNA, 64 nt, hsa
ccauggguccagaggauacuacugggaaggggauggcagcuacugccaccuuccagaugguucc

SEQ ID NO: 507094 - RNA, 64 nt, hsa
cauuaccucagcgggagggagcagagcugggacaggcagcuaaaaugagcagcucccaagaauc

SEQ ID NO: 507095 - RNA, 64 nt, hsa
ccacgguucuguugacggaugcugacuuuggagaggcagcuaagcagaagucccugacggucac

SEQ ID NO: 507096 - RNA, 64 nt, hsa; identical to SEQ ID NO: 256768

SEQ ID NO: 507097 - RNA, 64 nt, hsa; identical to SEQ ID NO: 256769

SEQ ID NO: 507098 - RNA, 64 nt, hsa; identical to SEQ ID NO: 256770

SEQ ID NO: 507099 - RNA, 64 nt, hsa; identical to SEQ ID NO: 256771

SEQ ID NO: 507100 - RNA, 64 nt, hsa; identical to SEQ ID NO: 256772

SEQ ID NO: 507101 - RNA, 64 nt, hsa; identical to SEQ ID NO: 256773

SEQ ID NO: 507102 - RNA, 64 nt, hsa; identical to SEQ ID NO: 256774

SEQ ID NO: 507103 - RNA, 64 nt, hsa; identical to SEQ ID NO: 256775

SEQ ID NO: 507104 - RNA, 64 nt, hsa; identical to SEQ ID NO: 256776

SEQ ID NO: 507105 - RNA, 64 nt, hsa; identical to SEQ ID NO: 256777

SEQ ID NO: 507106 - RNA, 64 nt, hsa; identical to SEQ ID NO: 256778

SEQ ID NO: 507107 - RNA, 64 nt, hsa; identical to SEQ ID NO: 256779

SEQ ID NO: 507108 - RNA, 64 nt, hsa; identical to SEQ ID NO: 256780

SEQ ID NO: 507109 - RNA, 64 nt, hsa; identical to SEQ ID NO: 256781

SEQ ID NO: 507110 - RNA, 64 nt, hsa
uuuugcagagggcaguaucaaaagaaagugguuuucuucaaauguauacuauuuuacuuccuga

SEQ ID NO: 507111 - RNA, 64 nt, hsa
ucacagucaaaaaaugaaaagguuuuugugcguuucuucaaaauucugcuuucuucaacaucaa

SEQ ID NO: 507112 - RNA, 64 nt, hsa
aaaaguaucucacgguacaaauuaagaaugacuuucuucaaaauaucugaauaggugcaguuuu

SEQ ID NO: 507113 - RNA, 64 nt, hsa
uagaacaaauaugggaggacaaagaaucgcaaauucuucaaaugacuauuaucaguauuauuaa

SEQ ID NO: 507114 - RNA, 64 nt, hsa
gaagaaaccaaauauauguguuuacuguagcaugucuucaaauuaguggaacuuaguucaggga

SEQ ID NO: 507115 - RNA, 64 nt, hsa
uacuccaaccccguuuuuaagcaauggaacucuuucuucaaacaaaagcuuaugcagaacaucu

SEQ ID NO: 507116 - RNA, 64 nt, hsa
ucucuaaaauucuaaaaagcauaaaucauucaaaucuucaaaccaaggcagaaauaauuuuaug

SEQ ID NO: 507117 - RNA, 64 nt, hsa
cuucaccuuaaugggucuugucuaucuucauuagucuucaaagaaaaaccauuugcuaccaaag

SEQ ID NO: 507118 - RNA, 64 nt, hsa
uuuuagauacugaaauugaaggaaagaaaaugcaucuucaaacauuuuuuggaaucucaccaca

SEQ ID NO: 507119 - RNA, 50 nt, hsa
agaagugccggguuuggugaucuucaaaagaagcauugcagcccuuggcu

SEQ ID NO: 507120 - RNA, 64 nt, hsa
uuaccaucuuacuugagccuuuaauggacuuauuucuucaaauccuuccaaaaauuauuauaag

SEQ ID NO: 507121 - RNA, 64 nt, hsa
aaacauaaauguguguaaugauaaaaagucauuuucuucaaagagacuacagcuagcugcacau

SEQ ID NO: 507122 - RNA, 64 nt, hsa
auaucuguucauaaaaauaaaaggaaaacauguuucuucaaauugcauaauggaacaaauggca

SEQ ID NO: 507123 - RNA, 64 nt, hsa
ucagaaugcuuucaaggguaaccagauuuaagaaucuucaaacaauacacuguuaccuuuugac

SEQ ID NO: 507124 - RNA, 64 nt, hsa
gcuucagaauuggaauguuuauauuauguagaaaucuucaaagguagcauuauuaaauagcaaa

SEQ ID NO: 507125 - RNA, 64 nt, hsa
ggguguguguguguguguuugugugugucagucaucuucaaaggcagauuauuagauuccagca

SEQ ID NO: 507126 - RNA, 64 nt, hsa
cuugaaaguuuuaacuaagugagaaauaagguagucuucaaaaucuuggucaucuguuuggaug

SEQ ID NO: 507127 - RNA, 64 nt, hsa
aaaggaaaguuucuucaaagggcucucuggcuaaucuucaaagccgcaguuaggcaaaaugaca

SEQ ID NO: 507128 - RNA, 64 nt, hsa
uuucaaguauuauucacaacacuaaaggaaaguuucuucaaagggcucucuggcuaaucuucaa

SEQ ID NO: 507129 - RNA, 64 nt, hsa
uaauauugauuggucuuuuuauuuggcuuggaguucuucaaagcauugaaguguguucauaguc

SEQ ID NO: 507130 - RNA, 64 nt, hsa
ggcagugcuugaaugagaaaaggcuccuggugcaucuucaaaaugaguccuaaagaacauacug

SEQ ID NO: 507131 - RNA, 64 nt, hsa
guaaauggggaaauuaacaggacuuucuucuucaucuucaaacucuucagaagcagcaacaggg

SEQ ID NO: 507132 - RNA, 64 nt, hsa
uucuuccuuguaauuauacuuaagaucuucaauuucuucaaaaaaugaaggaucaaaauuuucc

SEQ ID NO: 507133 - RNA, 64 nt, hsa
aauguuaaauauuuggauauagcaacuucuuuucucuucaaaugaaugccaagauuuuuuugua

SEQ ID NO: 507134 - RNA, 64 nt, hsa
guuaauguuugcucuuagaagucauacuccauggucuucaaagaccaaaaaaugagguuuugcu

SEQ ID NO: 507135 - RNA, 64 nt, hsa
guccauaaacaauaucugccaacucaaccuguugucuucaaaugcuaaaaaaggagaauggagg

SEQ ID NO: 507136 - RNA, 64 nt, hsa
ucaguuuuuccugaagaauuuucuuuaccauuagucuucaaauuggauacuguugugcaguggu

SEQ ID NO: 507137 - RNA, 64 nt, hsa
gaaagcucuguguucuuuugccuucaaucuguugucuucaaaacaaacaaacaaaaaaagcuuc

SEQ ID NO: 507138 - RNA, 64 nt, hsa
uccuggugcaacuuaauuuuuuuuuuuaaugcuaucuucaaaacguuagagaaaguucuucaaa

SEQ ID NO: 507139 - RNA, 64 nt, hsa
uuuuuaaugcuaucuucaaaacguuagagaaaguucuucaaaagugcagcccagagcugcuggg

SEQ ID NO: 507140 - RNA, 64 nt, hsa
agcuuaccagguucaaggguacaaacuucucaaaucuucaaaacauuuuagucaaaguguaaua

SEQ ID NO: 507141 - RNA, 64 nt, hsa
auuuugguuuuuuuucuuaagugaauaauaccagucuucaaagaaaacaaggugaagaccuauu

SEQ ID NO: 507142 - RNA, 64 nt, hsa
aagaaauuuugcaaauguaaagaauaugacaaggucuucaaacacaaguuuuucuaauaacuca

SEQ ID NO: 507143 - RNA, 64 nt, hsa
gagacuucacaauuauaauaaauguguggaaaagucuucaaaaaaauuucacaccuugcaaaag

SEQ ID NO: 507144 - RNA, 53 nt, hsa
aagauguccugaagucauagaugucuucaaaucccuguuccuauccuucuucu

SEQ ID NO: 507145 - RNA, 64 nt, hsa
aagucugagagucugugucuuuauuugaaaagauucuucaaauugcguacuuacuccuccauau

SEQ ID NO: 507146 - RNA, 64 nt, hsa
uacuaauguaacuaucuuaaguaauaguaauuccucuucaaaaauugagcgcuauguugcaaga

SEQ ID NO: 507147 - RNA, 64 nt, hsa
uuuugcaaaauuuggggaacuuucaacuauuauuucuucaaauauuuuuucaccccccagucuu

SEQ ID NO: 507148 - RNA, 64 nt, hsa
ggaggaggacgaaggccuagacucagcugaaggaucuucaaagcaggaugaagaccuagacuua

SEQ ID NO: 507149 - RNA, 64 nt, hsa
agacuuaccugaaggccuagacucagcugaaggaucuucaaagcaggaugaagaccuagacuua

SEQ ID NO: 507150 - RNA, 64 nt, hsa
aaagcaggaugaagaccuagacuuaccugaaggaucuucaaagcagaaugaagaccuaggcuua

SEQ ID NO: 507151 - RNA, 64 nt, hsa
aaagcagaaugaagaccuaggcuuaccugaaggaucuucaaagcaggaugaagaccuagacuua

SEQ ID NO: 507152 - RNA, 64 nt, hsa
gaaagauauaaaggaucuuguaguuuaugagaauucuucaaaucccgugugcacgcugaacgac

SEQ ID NO: 507153 - RNA, 64 nt, hsa
guaaacaugcagcugccgacgaggcuuugaaaauucuucaaaaaacacagcccacuuauccauc

SEQ ID NO: 507154 - RNA, 64 nt, hsa; identical to SEQ ID NO: 212887

SEQ ID NO: 507155 - RNA, 64 nt, hsa; identical to SEQ ID NO: 212888

SEQ ID NO: 507156 - RNA, 64 nt, hsa; identical to SEQ ID NO: 212889

SEQ ID NO: 507157 - RNA, 64 nt, hsa; identical to SEQ ID NO: 212890

SEQ ID NO: 507158 - RNA, 64 nt, hsa; identical to SEQ ID NO: 212891

SEQ ID NO: 507159 - RNA, 64 nt, hsa; identical to SEQ ID NO: 212892

SEQ ID NO: 507160 - RNA, 64 nt, hsa; identical to SEQ ID NO: 212893

SEQ ID NO: 507161 - RNA, 64 nt, hsa; identical to SEQ ID NO: 212894

SEQ ID NO: 507162 - RNA, 64 nt, hsa; identical to SEQ ID NO: 212895

SEQ ID NO: 507163 - RNA, 64 nt, hsa; identical to SEQ ID NO: 212896

SEQ ID NO: 507164 - RNA, 64 nt, hsa; identical to SEQ ID NO: 212897

SEQ ID NO: 507165 - RNA, 64 nt, hsa; identical to SEQ ID NO: 212898

SEQ ID NO: 507166 - RNA, 64 nt, hsa; identical to SEQ ID NO: 212899

SEQ ID NO: 507167 - RNA, 64 nt, hsa; identical to SEQ ID NO: 212900

SEQ ID NO: 507168 - RNA, 64 nt, hsa; identical to SEQ ID NO: 212901

SEQ ID NO: 507169 - RNA, 64 nt, hsa; identical to SEQ ID NO: 212902

SEQ ID NO: 507170 - RNA, 64 nt, hsa; identical to SEQ ID NO: 212903

SEQ ID NO: 507171 - RNA, 64 nt, hsa; identical to SEQ ID NO: 212904

SEQ ID NO: 507172 - RNA, 64 nt, hsa; identical to SEQ ID NO: 212905

SEQ ID NO: 507173 - RNA, 64 nt, hsa; identical to SEQ ID NO: 212906

SEQ ID NO: 507174 - RNA, 64 nt, hsa; identical to SEQ ID NO: 212907

SEQ ID NO: 507175 - RNA, 64 nt, hsa; identical to SEQ ID NO: 212908

SEQ ID NO: 507176 - RNA, 64 nt, hsa; identical to SEQ ID NO: 212909

SEQ ID NO: 507177 - RNA, 64 nt, hsa; identical to SEQ ID NO: 212910

SEQ ID NO: 507178 - RNA, 64 nt, hsa; identical to SEQ ID NO: 212911

SEQ ID NO: 507179 - RNA, 64 nt, hsa; identical to SEQ ID NO: 209092

SEQ ID NO: 507180 - RNA, 64 nt, hsa; identical to SEQ ID NO: 209093

SEQ ID NO: 507181 - RNA, 64 nt, hsa; identical to SEQ ID NO: 209094

SEQ ID NO: 507182 - RNA, 64 nt, hsa; identical to SEQ ID NO: 209095

SEQ ID NO: 507183 - RNA, 64 nt, hsa; identical to SEQ ID NO: 209096

SEQ ID NO: 507184 - RNA, 64 nt, hsa; identical to SEQ ID NO: 209097

SEQ ID NO: 507185 - RNA, 64 nt, hsa; identical to SEQ ID NO: 209098

SEQ ID NO: 507186 - RNA, 64 nt, hsa; identical to SEQ ID NO: 209099

SEQ ID NO: 507187 - RNA, 64 nt, hsa; identical to SEQ ID NO: 209100

SEQ ID NO: 507188 - RNA, 64 nt, hsa; identical to SEQ ID NO: 209101

SEQ ID NO: 507189 - RNA, 64 nt, hsa; identical to SEQ ID NO: 209102

SEQ ID NO: 507190 - RNA, 64 nt, hsa; identical to SEQ ID NO: 209103

SEQ ID NO: 507191 - RNA, 64 nt, hsa; identical to SEQ ID NO: 209104

SEQ ID NO: 507192 - RNA, 64 nt, hsa; identical to SEQ ID NO: 209105

SEQ ID NO: 507193 - RNA, 64 nt, hsa; identical to SEQ ID NO: 209106

SEQ ID NO: 507194 - RNA, 64 nt, hsa; identical to SEQ ID NO: 209107

SEQ ID NO: 507195 - RNA, 64 nt, hsa; identical to SEQ ID NO: 209108

SEQ ID NO: 507196 - RNA, 64 nt, hsa; identical to SEQ ID NO: 209109

SEQ ID NO: 507197 - RNA, 64 nt, hsa; identical to SEQ ID NO: 209110

SEQ ID NO: 507198 - RNA, 64 nt, hsa; identical to SEQ ID NO: 209111

SEQ ID NO: 507199 - RNA, 64 nt, hsa; identical to SEQ ID NO: 209112

SEQ ID NO: 507200 - RNA, 64 nt, hsa; identical to SEQ ID NO: 209113

SEQ ID NO: 507201 - RNA, 59 nt, hsa; identical to SEQ ID NO: 209114

SEQ ID NO: 507202 - RNA, 64 nt, hsa; identical to SEQ ID NO: 209115

SEQ ID NO: 507203 - RNA, 64 nt, hsa; identical to SEQ ID NO: 209116

SEQ ID NO: 507204 - RNA, 64 nt, hsa; identical to SEQ ID NO: 209117

SEQ ID NO: 507205 - RNA, 64 nt, hsa; identical to SEQ ID NO: 209118

SEQ ID NO: 507206 - RNA, 64 nt, hsa; identical to SEQ ID NO: 209119

SEQ ID NO: 507207 - RNA, 64 nt, hsa; identical to SEQ ID NO: 209120

SEQ ID NO: 507208 - RNA, 64 nt, hsa; identical to SEQ ID NO: 209121

SEQ ID NO: 507209 - RNA, 64 nt, hsa; identical to SEQ ID NO: 209122

SEQ ID NO: 507210 - RNA, 64 nt, hsa; identical to SEQ ID NO: 209123

SEQ ID NO: 507211 - RNA, 64 nt, hsa; identical to SEQ ID NO: 209124

SEQ ID NO: 507212 - RNA, 64 nt, hsa; identical to SEQ ID NO: 209125

SEQ ID NO: 507213 - RNA, 64 nt, hsa; identical to SEQ ID NO: 209126

SEQ ID NO: 507214 - RNA, 64 nt, hsa; identical to SEQ ID NO: 209127

SEQ ID NO: 507215 - RNA, 64 nt, hsa; identical to SEQ ID NO: 209128

SEQ ID NO: 507216 - RNA, 64 nt, hsa; identical to SEQ ID NO: 209129

SEQ ID NO: 507217 - RNA, 64 nt, hsa; identical to SEQ ID NO: 209130

SEQ ID NO: 507218 - RNA, 64 nt, hsa; identical to SEQ ID NO: 209131

SEQ ID NO: 507219 - RNA, 64 nt, hsa; identical to SEQ ID NO: 209132

SEQ ID NO: 507220 - RNA, 64 nt, hsa; identical to SEQ ID NO: 209133

SEQ ID NO: 507221 - RNA, 64 nt, hsa; identical to SEQ ID NO: 209134

SEQ ID NO: 507222 - RNA, 64 nt, hsa; identical to SEQ ID NO: 209135

SEQ ID NO: 507223 - RNA, 64 nt, hsa; identical to SEQ ID NO: 209136

SEQ ID NO: 507224 - RNA, 64 nt, hsa; identical to SEQ ID NO: 209137

SEQ ID NO: 507225 - RNA, 64 nt, hsa; identical to SEQ ID NO: 209138

SEQ ID NO: 507226 - RNA, 64 nt, hsa; identical to SEQ ID NO: 209139

SEQ ID NO: 507227 - RNA, 64 nt, hsa; identical to SEQ ID NO: 209140

SEQ ID NO: 507228 - RNA, 64 nt, hsa; identical to SEQ ID NO: 209141

SEQ ID NO: 507229 - RNA, 64 nt, hsa; identical to SEQ ID NO: 209142

SEQ ID NO: 507230 - RNA, 64 nt, hsa; identical to SEQ ID NO: 209143

SEQ ID NO: 507231 - RNA, 64 nt, hsa; identical to SEQ ID NO: 209144

SEQ ID NO: 507232 - RNA, 64 nt, hsa; identical to SEQ ID NO: 209145

SEQ ID NO: 507233 - RNA, 64 nt, hsa
aagagucaaaguaguuaguuuugguuauuucuaaaccacaaaaguuguuuaauaaguauaucuu

SEQ ID NO: 507234 - RNA, 64 nt, hsa
uugagcuuugcauuuaugauuucuccagaaauuuaccacaaaagcaaaauuuuuaaaacugcau

SEQ ID NO: 507235 - RNA, 64 nt, hsa
gaccccaguggaaaacaaagccaaacaaaacugaaccacaaaaaaaaaggcugguguucaccaa

SEQ ID NO: 507236 - RNA, 64 nt, hsa
ugcuggaagaaacuaaaaauauagcaaaugcagaaccacaaacaauucgaaugggguagaaaca

SEQ ID NO: 507237 - RNA, 64 nt, hsa
aguuuguuuugcuuuuaauuuaaaggaagcaguaaccacaaagcuuccgcucaggguuuuuucu

SEQ ID NO: 507238 - RNA, 64 nt, hsa
acagcaacaacacgaagaugauaccaaaacaaggaccacaaaacaacuagccaugaugggagac

SEQ ID NO: 507239 - RNA, 64 nt, hsa
augcuguucuguccuucuugagaaucuaaaacauaccacaaaaauacauccccagucuuuuguu

SEQ ID NO: 507240 - RNA, 64 nt, hsa
uucaguaaaagccugcucaauuuggagaaauagaaccacaaacacagaucacaggggccuuaca

SEQ ID NO: 507241 - RNA, 64 nt, hsa
gaaguuucugaagguugacgucacuggaagucugaccacaaacaaguuggcuguuacuguauuu

SEQ ID NO: 507242 - RNA, 64 nt, hsa
uugaacaacuuugcaggaauaaagcaacccccuaaccacaaaauaucccucuaaauuaguuccc

SEQ ID NO: 507243 - RNA, 64 nt, hsa
gcacacaggaucacucacauauguacauguacccaccacaaacgugcaagcuccugcacacaug

SEQ ID NO: 507244 - RNA, 64 nt, hsa
gcagccuccugcacacgugcacauucauguguacaccacaaaugaguucccagacguguaaaca

SEQ ID NO: 507245 - RNA, 64 nt, hsa
gcacaggcuccuacacacaugcacacacguguacaccacaaacgagcucccagacauguaaaca

SEQ ID NO: 507246 - RNA, 64 nt, hsa
gugagcucccacacguacacaugcacauguacgcaccacaaacacaugcgcaggcuccugcagg

SEQ ID NO: 507247 - RNA, 64 nt, hsa
auuucugcaagcaauguaugaccccaccugagcaaccacaaauaggcucucugugaaacuacaa

SEQ ID NO: 507248 - RNA, 64 nt, hsa
agaaaaauguauauagcugugaguuuaaacaaaaaccacaaacagacaaacaagaaaaaaagcu

SEQ ID NO: 507249 - RNA, 64 nt, hsa; identical to SEQ ID NO: 116369

SEQ ID NO: 507250 - RNA, 64 nt, hsa; identical to SEQ ID NO: 116370

SEQ ID NO: 507251 - RNA, 64 nt, hsa; identical to SEQ ID NO: 116371

SEQ ID NO: 507252 - RNA, 64 nt, hsa; identical to SEQ ID NO: 116372

SEQ ID NO: 507253 - RNA, 64 nt, hsa; identical to SEQ ID NO: 116373

SEQ ID NO: 507254 - RNA, 64 nt, hsa; identical to SEQ ID NO: 116374

SEQ ID NO: 507255 - RNA, 64 nt, hsa; identical to SEQ ID NO: 116375

SEQ ID NO: 507256 - RNA, 64 nt, hsa; identical to SEQ ID NO: 116376

SEQ ID NO: 507257 - RNA, 64 nt, hsa; identical to SEQ ID NO: 116377

SEQ ID NO: 507258 - RNA, 64 nt, hsa; identical to SEQ ID NO: 116378

SEQ ID NO: 507259 - RNA, 64 nt, hsa; identical to SEQ ID NO: 116379

SEQ ID NO: 507260 - RNA, 64 nt, hsa; identical to SEQ ID NO: 116380

SEQ ID NO: 507261 - RNA, 64 nt, hsa; identical to SEQ ID NO: 116381

SEQ ID NO: 507262 - RNA, 64 nt, hsa; identical to SEQ ID NO: 116382

SEQ ID NO: 507263 - RNA, 64 nt, hsa; identical to SEQ ID NO: 116383

SEQ ID NO: 507264 - RNA, 64 nt, hsa; identical to SEQ ID NO: 116384

SEQ ID NO: 507265 - RNA, 64 nt, hsa; identical to SEQ ID NO: 116385

SEQ ID NO: 507266 - RNA, 64 nt, hsa; identical to SEQ ID NO: 116386

SEQ ID NO: 507267 - RNA, 64 nt, hsa; identical to SEQ ID NO: 116387

SEQ ID NO: 507268 - RNA, 64 nt, hsa; identical to SEQ ID NO: 116388

SEQ ID NO: 507269 - RNA, 64 nt, hsa; identical to SEQ ID NO: 116389

SEQ ID NO: 507270 - RNA, 64 nt, hsa; identical to SEQ ID NO: 116390

SEQ ID NO: 507271 - RNA, 64 nt, hsa; identical to SEQ ID NO: 116391

SEQ ID NO: 507272 - RNA, 64 nt, hsa; identical to SEQ ID NO: 116392

SEQ ID NO: 507273 - RNA, 64 nt, hsa; identical to SEQ ID NO: 116393

SEQ ID NO: 507274 - RNA, 64 nt, hsa; identical to SEQ ID NO: 116394

SEQ ID NO: 507275 - RNA, 54 nt, hsa; identical to SEQ ID NO: 116395

SEQ ID NO: 507276 - RNA, 64 nt, hsa; identical to SEQ ID NO: 116396

SEQ ID NO: 507277 - RNA, 64 nt, hsa; identical to SEQ ID NO: 116397

SEQ ID NO: 507278 - RNA, 64 nt, hsa; identical to SEQ ID NO: 116398

SEQ ID NO: 507279 - RNA, 64 nt, hsa; identical to SEQ ID NO: 116399

SEQ ID NO: 507280 - RNA, 64 nt, hsa; identical to SEQ ID NO: 116400

SEQ ID NO: 507281 - RNA, 64 nt, hsa; identical to SEQ ID NO: 116401

SEQ ID NO: 507282 - RNA, 64 nt, hsa; identical to SEQ ID NO: 116402

SEQ ID NO: 507283 - RNA, 64 nt, hsa; identical to SEQ ID NO: 116403

SEQ ID NO: 507284 - RNA, 64 nt, hsa; identical to SEQ ID NO: 116404

SEQ ID NO: 507285 - RNA, 64 nt, hsa; identical to SEQ ID NO: 116405

SEQ ID NO: 507286 - RNA, 64 nt, hsa; identical to SEQ ID NO: 116406

SEQ ID NO: 507287 - RNA, 64 nt, hsa; identical to SEQ ID NO: 116407

SEQ ID NO: 507288 - RNA, 64 nt, hsa; identical to SEQ ID NO: 116408

SEQ ID NO: 507289 - RNA, 64 nt, hsa; identical to SEQ ID NO: 116409

SEQ ID NO: 507290 - RNA, 64 nt, hsa; identical to SEQ ID NO: 116410

SEQ ID NO: 507291 - RNA, 64 nt, hsa; identical to SEQ ID NO: 116411

SEQ ID NO: 507292 - RNA, 64 nt, hsa; identical to SEQ ID NO: 280098

SEQ ID NO: 507293 - RNA, 64 nt, hsa; identical to SEQ ID NO: 280099

SEQ ID NO: 507294 - RNA, 64 nt, hsa; identical to SEQ ID NO: 280100

SEQ ID NO: 507295 - RNA, 64 nt, hsa; identical to SEQ ID NO: 280101

SEQ ID NO: 507296 - RNA, 64 nt, hsa; identical to SEQ ID NO: 280102

SEQ ID NO: 507297 - RNA, 64 nt, hsa; identical to SEQ ID NO: 280103

SEQ ID NO: 507298 - RNA, 64 nt, hsa; identical to SEQ ID NO: 280104

SEQ ID NO: 507299 - RNA, 64 nt, hsa; identical to SEQ ID NO: 280105

SEQ ID NO: 507300 - RNA, 64 nt, hsa; identical to SEQ ID NO: 280106

SEQ ID NO: 507301 - RNA, 64 nt, hsa; identical to SEQ ID NO: 280107

SEQ ID NO: 507302 - RNA, 64 nt, hsa; identical to SEQ ID NO: 280108

SEQ ID NO: 507303 - RNA, 64 nt, hsa; identical to SEQ ID NO: 280109

SEQ ID NO: 507304 - RNA, 64 nt, hsa; identical to SEQ ID NO: 280110

SEQ ID NO: 507305 - RNA, 64 nt, hsa; identical to SEQ ID NO: 280111

SEQ ID NO: 507306 - RNA, 64 nt, hsa; identical to SEQ ID NO: 280112

SEQ ID NO: 507307 - RNA, 64 nt, hsa; identical to SEQ ID NO: 280113

SEQ ID NO: 507308 - RNA, 64 nt, hsa; identical to SEQ ID NO: 280114

SEQ ID NO: 507309 - RNA, 64 nt, hsa; identical to SEQ ID NO: 280115

SEQ ID NO: 507310 - RNA, 64 nt, hsa; identical to SEQ ID NO: 280116

SEQ ID NO: 507311 - RNA, 64 nt, hsa; identical to SEQ ID NO: 280117

SEQ ID NO: 507312 - RNA, 64 nt, hsa; identical to SEQ ID NO: 280118

SEQ ID NO: 507313 - RNA, 64 nt, hsa; identical to SEQ ID NO: 280119

SEQ ID NO: 507314 - RNA, 64 nt, hsa; identical to SEQ ID NO: 280120

SEQ ID NO: 507315 - RNA, 64 nt, hsa; identical to SEQ ID NO: 280121

SEQ ID NO: 507316 - RNA, 64 nt, hsa; identical to SEQ ID NO: 280122

SEQ ID NO: 507317 - RNA, 64 nt, hsa; identical to SEQ ID NO: 280123

SEQ ID NO: 507318 - RNA, 64 nt, hsa; identical to SEQ ID NO: 280124

SEQ ID NO: 507319 - RNA, 64 nt, hsa; identical to SEQ ID NO: 280125

SEQ ID NO: 507320 - RNA, 64 nt, hsa; identical to SEQ ID NO: 280126

SEQ ID NO: 507321 - RNA, 64 nt, hsa; identical to SEQ ID NO: 280127

SEQ ID NO: 507322 - RNA, 64 nt, hsa; identical to SEQ ID NO: 280128

SEQ ID NO: 507323 - RNA, 64 nt, hsa; identical to SEQ ID NO: 280129

SEQ ID NO: 507324 - RNA, 64 nt, hsa; identical to SEQ ID NO: 280130

SEQ ID NO: 507325 - RNA, 64 nt, hsa; identical to SEQ ID NO: 280131

SEQ ID NO: 507326 - RNA, 64 nt, hsa; identical to SEQ ID NO: 280132

SEQ ID NO: 507327 - RNA, 64 nt, hsa; identical to SEQ ID NO: 280133

SEQ ID NO: 507328 - RNA, 64 nt, hsa; identical to SEQ ID NO: 280134

SEQ ID NO: 507329 - RNA, 64 nt, hsa; identical to SEQ ID NO: 280135

SEQ ID NO: 507330 - RNA, 64 nt, hsa; identical to SEQ ID NO: 280136

SEQ ID NO: 507331 - RNA, 64 nt, hsa; identical to SEQ ID NO: 280137

SEQ ID NO: 507332 - RNA, 64 nt, hsa; identical to SEQ ID NO: 280138

SEQ ID NO: 507333 - RNA, 64 nt, hsa; identical to SEQ ID NO: 280139

SEQ ID NO: 507334 - RNA, 64 nt, hsa; identical to SEQ ID NO: 280140

SEQ ID NO: 507335 - RNA, 64 nt, hsa; identical to SEQ ID NO: 280141

SEQ ID NO: 507336 - RNA, 64 nt, hsa; identical to SEQ ID NO: 280142

SEQ ID NO: 507337 - RNA, 64 nt, hsa; identical to SEQ ID NO: 280143

SEQ ID NO: 507338 - RNA, 64 nt, hsa; identical to SEQ ID NO: 280144

SEQ ID NO: 507339 - RNA, 64 nt, hsa; identical to SEQ ID NO: 280145

SEQ ID NO: 507340 - RNA, 64 nt, hsa; identical to SEQ ID NO: 280146

SEQ ID NO: 507341 - RNA, 64 nt, hsa; identical to SEQ ID NO: 280147

SEQ ID NO: 507342 - RNA, 64 nt, hsa; identical to SEQ ID NO: 280148

SEQ ID NO: 507343 - RNA, 64 nt, hsa; identical to SEQ ID NO: 280149

SEQ ID NO: 507344 - RNA, 64 nt, hsa; identical to SEQ ID NO: 280150

SEQ ID NO: 507345 - RNA, 64 nt, hsa; identical to SEQ ID NO: 280151

SEQ ID NO: 507346 - RNA, 64 nt, hsa; identical to SEQ ID NO: 280152

SEQ ID NO: 507347 - RNA, 64 nt, hsa; identical to SEQ ID NO: 280153

SEQ ID NO: 507348 - RNA, 64 nt, hsa; identical to SEQ ID NO: 280154

SEQ ID NO: 507349 - RNA, 64 nt, hsa; identical to SEQ ID NO: 280155

SEQ ID NO: 507350 - RNA, 64 nt, hsa; identical to SEQ ID NO: 280156

SEQ ID NO: 507351 - RNA, 64 nt, hsa; identical to SEQ ID NO: 280157

SEQ ID NO: 507352 - RNA, 64 nt, hsa; identical to SEQ ID NO: 280158

SEQ ID NO: 507353 - RNA, 64 nt, hsa; identical to SEQ ID NO: 280159

SEQ ID NO: 507354 - RNA, 64 nt, hsa; identical to SEQ ID NO: 280160

SEQ ID NO: 507355 - RNA, 64 nt, hsa; identical to SEQ ID NO: 280161

SEQ ID NO: 507356 - RNA, 64 nt, hsa; identical to SEQ ID NO: 280162

SEQ ID NO: 507357 - RNA, 64 nt, hsa; identical to SEQ ID NO: 280163

SEQ ID NO: 507358 - RNA, 64 nt, hsa; identical to SEQ ID NO: 280164

SEQ ID NO: 507359 - RNA, 64 nt, hsa; identical to SEQ ID NO: 280165

SEQ ID NO: 507360 - RNA, 54 nt, hsa; identical to SEQ ID NO: 280166

SEQ ID NO: 507361 - RNA, 64 nt, hsa; identical to SEQ ID NO: 280167

SEQ ID NO: 507362 - RNA, 64 nt, hsa; identical to SEQ ID NO: 280168

SEQ ID NO: 507363 - RNA, 64 nt, hsa; identical to SEQ ID NO: 280169

SEQ ID NO: 507364 - RNA, 64 nt, hsa; identical to SEQ ID NO: 280170

SEQ ID NO: 507365 - RNA, 64 nt, hsa; identical to SEQ ID NO: 280171

SEQ ID NO: 507366 - RNA, 64 nt, hsa; identical to SEQ ID NO: 280172

SEQ ID NO: 507367 - RNA, 64 nt, hsa; identical to SEQ ID NO: 280173

SEQ ID NO: 507368 - RNA, 64 nt, hsa; identical to SEQ ID NO: 280174

SEQ ID NO: 507369 - RNA, 64 nt, hsa; identical to SEQ ID NO: 280175

SEQ ID NO: 507370 - RNA, 64 nt, hsa; identical to SEQ ID NO: 280176

SEQ ID NO: 507371 - RNA, 64 nt, hsa; identical to SEQ ID NO: 280177

SEQ ID NO: 507372 - RNA, 64 nt, hsa; identical to SEQ ID NO: 280178

SEQ ID NO: 507373 - RNA, 64 nt, hsa; identical to SEQ ID NO: 280179

SEQ ID NO: 507374 - RNA, 64 nt, hsa; identical to SEQ ID NO: 280180

SEQ ID NO: 507375 - RNA, 64 nt, hsa; identical to SEQ ID NO: 280181

SEQ ID NO: 507376 - RNA, 64 nt, hsa; identical to SEQ ID NO: 280182

SEQ ID NO: 507377 - RNA, 64 nt, hsa; identical to SEQ ID NO: 280183

SEQ ID NO: 507378 - RNA, 64 nt, hsa; identical to SEQ ID NO: 280184

SEQ ID NO: 507379 - RNA, 64 nt, hsa; identical to SEQ ID NO: 280185

SEQ ID NO: 507380 - RNA, 64 nt, hsa; identical to SEQ ID NO: 280186

SEQ ID NO: 507381 - RNA, 64 nt, hsa; identical to SEQ ID NO: 280187

SEQ ID NO: 507382 - RNA, 64 nt, hsa; identical to SEQ ID NO: 280188

SEQ ID NO: 507383 - RNA, 64 nt, hsa; identical to SEQ ID NO: 280189

SEQ ID NO: 507384 - RNA, 64 nt, hsa; identical to SEQ ID NO: 280190

SEQ ID NO: 507385 - RNA, 64 nt, hsa; identical to SEQ ID NO: 280191

SEQ ID NO: 507386 - RNA, 64 nt, hsa; identical to SEQ ID NO: 280192

SEQ ID NO: 507387 - RNA, 64 nt, hsa; identical to SEQ ID NO: 280193

SEQ ID NO: 507388 - RNA, 64 nt, hsa; identical to SEQ ID NO: 280194

SEQ ID NO: 507389 - RNA, 64 nt, hsa; identical to SEQ ID NO: 280195

SEQ ID NO: 507390 - RNA, 64 nt, hsa; identical to SEQ ID NO: 280196

SEQ ID NO: 507391 - RNA, 64 nt, hsa; identical to SEQ ID NO: 280197

SEQ ID NO: 507392 - RNA, 64 nt, hsa; identical to SEQ ID NO: 280198

SEQ ID NO: 507393 - RNA, 64 nt, hsa; identical to SEQ ID NO: 280199

SEQ ID NO: 507394 - RNA, 64 nt, hsa; identical to SEQ ID NO: 280200

SEQ ID NO: 507395 - RNA, 64 nt, hsa; identical to SEQ ID NO: 280201

SEQ ID NO: 507396 - RNA, 64 nt, hsa; identical to SEQ ID NO: 280202

SEQ ID NO: 507397 - RNA, 64 nt, hsa; identical to SEQ ID NO: 280203

SEQ ID NO: 507398 - RNA, 64 nt, hsa; identical to SEQ ID NO: 280204

SEQ ID NO: 507399 - RNA, 64 nt, hsa; identical to SEQ ID NO: 280205

SEQ ID NO: 507400 - RNA, 64 nt, hsa; identical to SEQ ID NO: 280206

SEQ ID NO: 507401 - RNA, 64 nt, hsa; identical to SEQ ID NO: 280207

SEQ ID NO: 507402 - RNA, 64 nt, hsa; identical to SEQ ID NO: 280208

SEQ ID NO: 507403 - RNA, 64 nt, hsa; identical to SEQ ID NO: 280209

SEQ ID NO: 507404 - RNA, 64 nt, hsa; identical to SEQ ID NO: 280210

SEQ ID NO: 507405 - RNA, 64 nt, hsa; identical to SEQ ID NO: 280211

SEQ ID NO: 507406 - RNA, 64 nt, hsa; identical to SEQ ID NO: 280212

SEQ ID NO: 507407 - RNA, 64 nt, hsa; identical to SEQ ID NO: 280213

SEQ ID NO: 507408 - RNA, 64 nt, hsa; identical to SEQ ID NO: 280214

SEQ ID NO: 507409 - RNA, 64 nt, hsa; identical to SEQ ID NO: 280215

SEQ ID NO: 507410 - RNA, 64 nt, hsa; identical to SEQ ID NO: 280216

SEQ ID NO: 507411 - RNA, 64 nt, hsa; identical to SEQ ID NO: 280217

SEQ ID NO: 507412 - RNA, 64 nt, hsa; identical to SEQ ID NO: 280218

SEQ ID NO: 507413 - RNA, 64 nt, hsa; identical to SEQ ID NO: 280219

SEQ ID NO: 507414 - RNA, 64 nt, hsa; identical to SEQ ID NO: 280220

SEQ ID NO: 507415 - RNA, 64 nt, hsa; identical to SEQ ID NO: 280221

SEQ ID NO: 507416 - RNA, 64 nt, hsa; identical to SEQ ID NO: 280222

SEQ ID NO: 507417 - RNA, 64 nt, hsa; identical to SEQ ID NO: 280223

SEQ ID NO: 507418 - RNA, 64 nt, hsa; identical to SEQ ID NO: 280224

SEQ ID NO: 507419 - RNA, 64 nt, hsa; identical to SEQ ID NO: 280225

SEQ ID NO: 507420 - RNA, 64 nt, hsa; identical to SEQ ID NO: 280226

SEQ ID NO: 507421 - RNA, 64 nt, hsa; identical to SEQ ID NO: 280227

SEQ ID NO: 507422 - RNA, 64 nt, hsa; identical to SEQ ID NO: 280228

SEQ ID NO: 507423 - RNA, 64 nt, hsa; identical to SEQ ID NO: 280229

SEQ ID NO: 507424 - RNA, 64 nt, hsa; identical to SEQ ID NO: 280230

SEQ ID NO: 507425 - RNA, 64 nt, hsa; identical to SEQ ID NO: 280231

SEQ ID NO: 507426 - RNA, 64 nt, hsa; identical to SEQ ID NO: 280232

SEQ ID NO: 507427 - RNA, 64 nt, hsa; identical to SEQ ID NO: 280233

SEQ ID NO: 507428 - RNA, 64 nt, hsa; identical to SEQ ID NO: 280234

SEQ ID NO: 507429 - RNA, 64 nt, hsa; identical to SEQ ID NO: 280235

SEQ ID NO: 507430 - RNA, 64 nt, hsa; identical to SEQ ID NO: 280236

SEQ ID NO: 507431 - RNA, 64 nt, hsa; identical to SEQ ID NO: 280237

SEQ ID NO: 507432 - RNA, 64 nt, hsa; identical to SEQ ID NO: 280238

SEQ ID NO: 507433 - RNA, 64 nt, hsa; identical to SEQ ID NO: 280239

SEQ ID NO: 507434 - RNA, 64 nt, hsa; identical to SEQ ID NO: 280240

SEQ ID NO: 507435 - RNA, 64 nt, hsa; identical to SEQ ID NO: 280241

SEQ ID NO: 507436 - RNA, 64 nt, hsa; identical to SEQ ID NO: 280242

SEQ ID NO: 507437 - RNA, 64 nt, hsa; identical to SEQ ID NO: 280243

SEQ ID NO: 507438 - RNA, 64 nt, hsa; identical to SEQ ID NO: 280244

SEQ ID NO: 507439 - RNA, 64 nt, hsa; identical to SEQ ID NO: 280245

SEQ ID NO: 507440 - RNA, 64 nt, hsa; identical to SEQ ID NO: 280246

SEQ ID NO: 507441 - RNA, 64 nt, hsa; identical to SEQ ID NO: 280247

SEQ ID NO: 507442 - RNA, 64 nt, hsa; identical to SEQ ID NO: 280248

SEQ ID NO: 507443 - RNA, 64 nt, hsa; identical to SEQ ID NO: 280249

SEQ ID NO: 507444 - RNA, 64 nt, hsa; identical to SEQ ID NO: 280250

SEQ ID NO: 507445 - RNA, 64 nt, hsa; identical to SEQ ID NO: 280251

SEQ ID NO: 507446 - RNA, 64 nt, hsa; identical to SEQ ID NO: 280252

SEQ ID NO: 507447 - RNA, 64 nt, hsa; identical to SEQ ID NO: 280253

SEQ ID NO: 507448 - RNA, 64 nt, hsa; identical to SEQ ID NO: 280254

SEQ ID NO: 507449 - RNA, 64 nt, hsa; identical to SEQ ID NO: 280255

SEQ ID NO: 507450 - RNA, 64 nt, hsa; identical to SEQ ID NO: 280256

SEQ ID NO: 507451 - RNA, 64 nt, hsa; identical to SEQ ID NO: 280257

SEQ ID NO: 507452 - RNA, 64 nt, hsa; identical to SEQ ID NO: 280258

SEQ ID NO: 507453 - RNA, 64 nt, hsa; identical to SEQ ID NO: 280259

SEQ ID NO: 507454 - RNA, 64 nt, hsa; identical to SEQ ID NO: 280260

SEQ ID NO: 507455 - RNA, 64 nt, hsa; identical to SEQ ID NO: 280261

SEQ ID NO: 507456 - RNA, 64 nt, hsa; identical to SEQ ID NO: 280262

SEQ ID NO: 507457 - RNA, 64 nt, hsa; identical to SEQ ID NO: 280263

SEQ ID NO: 507458 - RNA, 64 nt, hsa; identical to SEQ ID NO: 280264

SEQ ID NO: 507459 - RNA, 64 nt, hsa; identical to SEQ ID NO: 280265

SEQ ID NO: 507460 - RNA, 64 nt, hsa; identical to SEQ ID NO: 280266

SEQ ID NO: 507461 - RNA, 64 nt, hsa; identical to SEQ ID NO: 280267

SEQ ID NO: 507462 - RNA, 64 nt, hsa; identical to SEQ ID NO: 280268

SEQ ID NO: 507463 - RNA, 64 nt, hsa; identical to SEQ ID NO: 280269

SEQ ID NO: 507464 - RNA, 64 nt, hsa; identical to SEQ ID NO: 280270

SEQ ID NO: 507465 - RNA, 64 nt, hsa; identical to SEQ ID NO: 280271

SEQ ID NO: 507466 - RNA, 64 nt, hsa; identical to SEQ ID NO: 280272

SEQ ID NO: 507467 - RNA, 64 nt, hsa; identical to SEQ ID NO: 280273

SEQ ID NO: 507468 - RNA, 64 nt, hsa; identical to SEQ ID NO: 280274

SEQ ID NO: 507469 - RNA, 64 nt, hsa; identical to SEQ ID NO: 280275

SEQ ID NO: 507470 - RNA, 64 nt, hsa; identical to SEQ ID NO: 280276

SEQ ID NO: 507471 - RNA, 64 nt, hsa; identical to SEQ ID NO: 280277

SEQ ID NO: 507472 - RNA, 64 nt, hsa; identical to SEQ ID NO: 280278

SEQ ID NO: 507473 - RNA, 64 nt, hsa; identical to SEQ ID NO: 280279

SEQ ID NO: 507474 - RNA, 64 nt, hsa; identical to SEQ ID NO: 280280

SEQ ID NO: 507475 - RNA, 57 nt, hsa; identical to SEQ ID NO: 280281

SEQ ID NO: 507476 - RNA, 64 nt, hsa; identical to SEQ ID NO: 280282

SEQ ID NO: 507477 - RNA, 64 nt, hsa; identical to SEQ ID NO: 280283

SEQ ID NO: 507478 - RNA, 64 nt, hsa; identical to SEQ ID NO: 280284

SEQ ID NO: 507479 - RNA, 64 nt, hsa; identical to SEQ ID NO: 280285

SEQ ID NO: 507480 - RNA, 64 nt, hsa; identical to SEQ ID NO: 280286

SEQ ID NO: 507481 - RNA, 64 nt, hsa; identical to SEQ ID NO: 280287

SEQ ID NO: 507482 - RNA, 64 nt, hsa; identical to SEQ ID NO: 280288

SEQ ID NO: 507483 - RNA, 64 nt, hsa; identical to SEQ ID NO: 280289

SEQ ID NO: 507484 - RNA, 64 nt, hsa; identical to SEQ ID NO: 280290

SEQ ID NO: 507485 - RNA, 64 nt, hsa; identical to SEQ ID NO: 280291

SEQ ID NO: 507486 - RNA, 64 nt, hsa; identical to SEQ ID NO: 280292

SEQ ID NO: 507487 - RNA, 64 nt, hsa; identical to SEQ ID NO: 280293

SEQ ID NO: 507488 - RNA, 64 nt, hsa; identical to SEQ ID NO: 280294

SEQ ID NO: 507489 - RNA, 64 nt, hsa; identical to SEQ ID NO: 280295

SEQ ID NO: 507490 - RNA, 64 nt, hsa; identical to SEQ ID NO: 280296

SEQ ID NO: 507491 - RNA, 64 nt, hsa; identical to SEQ ID NO: 280297

SEQ ID NO: 507492 - RNA, 64 nt, hsa; identical to SEQ ID NO: 280298

SEQ ID NO: 507493 - RNA, 64 nt, hsa; identical to SEQ ID NO: 280299

SEQ ID NO: 507494 - RNA, 64 nt, hsa; identical to SEQ ID NO: 280300

SEQ ID NO: 507495 - RNA, 64 nt, hsa; identical to SEQ ID NO: 280301

SEQ ID NO: 507496 - RNA, 64 nt, hsa; identical to SEQ ID NO: 280302

SEQ ID NO: 507497 - RNA, 64 nt, hsa; identical to SEQ ID NO: 280303

SEQ ID NO: 507498 - RNA, 64 nt, hsa; identical to SEQ ID NO: 280304

SEQ ID NO: 507499 - RNA, 64 nt, hsa; identical to SEQ ID NO: 280305

SEQ ID NO: 507500 - RNA, 64 nt, hsa; identical to SEQ ID NO: 280306

SEQ ID NO: 507501 - RNA, 64 nt, hsa; identical to SEQ ID NO: 280307

SEQ ID NO: 507502 - RNA, 64 nt, hsa; identical to SEQ ID NO: 280308

SEQ ID NO: 507503 - RNA, 64 nt, hsa; identical to SEQ ID NO: 280309

SEQ ID NO: 507504 - RNA, 64 nt, hsa; identical to SEQ ID NO: 280310

SEQ ID NO: 507505 - RNA, 64 nt, hsa; identical to SEQ ID NO: 280311

SEQ ID NO: 507506 - RNA, 64 nt, hsa; identical to SEQ ID NO: 280312

SEQ ID NO: 507507 - RNA, 64 nt, hsa; identical to SEQ ID NO: 280313

SEQ ID NO: 507508 - RNA, 64 nt, hsa; identical to SEQ ID NO: 280314

SEQ ID NO: 507509 - RNA, 64 nt, hsa; identical to SEQ ID NO: 280315

SEQ ID NO: 507510 - RNA, 64 nt, hsa; identical to SEQ ID NO: 280316

SEQ ID NO: 507511 - RNA, 64 nt, hsa; identical to SEQ ID NO: 280317

SEQ ID NO: 507512 - RNA, 64 nt, hsa; identical to SEQ ID NO: 280318

SEQ ID NO: 507513 - RNA, 64 nt, hsa; identical to SEQ ID NO: 280319

SEQ ID NO: 507514 - RNA, 64 nt, hsa; identical to SEQ ID NO: 280320

SEQ ID NO: 507515 - RNA, 64 nt, hsa; identical to SEQ ID NO: 280321

SEQ ID NO: 507516 - RNA, 64 nt, hsa; identical to SEQ ID NO: 280322

SEQ ID NO: 507517 - RNA, 64 nt, hsa; identical to SEQ ID NO: 280323

SEQ ID NO: 507518 - RNA, 64 nt, hsa; identical to SEQ ID NO: 280324

SEQ ID NO: 507519 - RNA, 64 nt, hsa; identical to SEQ ID NO: 280325

SEQ ID NO: 507520 - RNA, 64 nt, hsa; identical to SEQ ID NO: 280326

SEQ ID NO: 507521 - RNA, 64 nt, hsa; identical to SEQ ID NO: 280327

SEQ ID NO: 507522 - RNA, 64 nt, hsa; identical to SEQ ID NO: 280328

SEQ ID NO: 507523 - RNA, 64 nt, hsa; identical to SEQ ID NO: 280329

SEQ ID NO: 507524 - RNA, 64 nt, hsa; identical to SEQ ID NO: 280330

SEQ ID NO: 507525 - RNA, 64 nt, hsa; identical to SEQ ID NO: 280331

SEQ ID NO: 507526 - RNA, 64 nt, hsa; identical to SEQ ID NO: 280332

SEQ ID NO: 507527 - RNA, 64 nt, hsa; identical to SEQ ID NO: 280333

SEQ ID NO: 507528 - RNA, 64 nt, hsa; identical to SEQ ID NO: 280334

SEQ ID NO: 507529 - RNA, 64 nt, hsa; identical to SEQ ID NO: 280335

SEQ ID NO: 507530 - RNA, 64 nt, hsa; identical to SEQ ID NO: 280336

SEQ ID NO: 507531 - RNA, 64 nt, hsa; identical to SEQ ID NO: 280337

SEQ ID NO: 507532 - RNA, 64 nt, hsa; identical to SEQ ID NO: 280338

SEQ ID NO: 507533 - RNA, 64 nt, hsa; identical to SEQ ID NO: 280339

SEQ ID NO: 507534 - RNA, 64 nt, hsa; identical to SEQ ID NO: 280340

SEQ ID NO: 507535 - RNA, 64 nt, hsa; identical to SEQ ID NO: 280341

SEQ ID NO: 507536 - RNA, 64 nt, hsa; identical to SEQ ID NO: 280342

SEQ ID NO: 507537 - RNA, 64 nt, hsa; identical to SEQ ID NO: 280343

SEQ ID NO: 507538 - RNA, 64 nt, hsa; identical to SEQ ID NO: 280344

SEQ ID NO: 507539 - RNA, 64 nt, hsa; identical to SEQ ID NO: 280345

SEQ ID NO: 507540 - RNA, 64 nt, hsa; identical to SEQ ID NO: 280346

SEQ ID NO: 507541 - RNA, 64 nt, hsa; identical to SEQ ID NO: 280347

SEQ ID NO: 507542 - RNA, 64 nt, hsa; identical to SEQ ID NO: 280348

SEQ ID NO: 507543 - RNA, 64 nt, hsa; identical to SEQ ID NO: 280349

SEQ ID NO: 507544 - RNA, 64 nt, hsa; identical to SEQ ID NO: 280350

SEQ ID NO: 507545 - RNA, 64 nt, hsa; identical to SEQ ID NO: 280351

SEQ ID NO: 507546 - RNA, 64 nt, hsa; identical to SEQ ID NO: 280352

SEQ ID NO: 507547 - RNA, 64 nt, hsa; identical to SEQ ID NO: 280353

SEQ ID NO: 507548 - RNA, 64 nt, hsa; identical to SEQ ID NO: 280354

SEQ ID NO: 507549 - RNA, 64 nt, hsa; identical to SEQ ID NO: 280355

SEQ ID NO: 507550 - RNA, 64 nt, hsa; identical to SEQ ID NO: 280356

SEQ ID NO: 507551 - RNA, 64 nt, hsa; identical to SEQ ID NO: 280357

SEQ ID NO: 507552 - RNA, 64 nt, hsa; identical to SEQ ID NO: 280358

SEQ ID NO: 507553 - RNA, 64 nt, hsa; identical to SEQ ID NO: 280359

SEQ ID NO: 507554 - RNA, 64 nt, hsa; identical to SEQ ID NO: 280360

SEQ ID NO: 507555 - RNA, 64 nt, hsa; identical to SEQ ID NO: 280361

SEQ ID NO: 507556 - RNA, 64 nt, hsa; identical to SEQ ID NO: 280362

SEQ ID NO: 507557 - RNA, 64 nt, hsa; identical to SEQ ID NO: 280363

SEQ ID NO: 507558 - RNA, 64 nt, hsa; identical to SEQ ID NO: 280364

SEQ ID NO: 507559 - RNA, 64 nt, hsa; identical to SEQ ID NO: 280365

SEQ ID NO: 507560 - RNA, 64 nt, hsa; identical to SEQ ID NO: 280366

SEQ ID NO: 507561 - RNA, 64 nt, hsa; identical to SEQ ID NO: 280367

SEQ ID NO: 507562 - RNA, 64 nt, hsa; identical to SEQ ID NO: 280368

SEQ ID NO: 507563 - RNA, 64 nt, hsa; identical to SEQ ID NO: 280369

SEQ ID NO: 507564 - RNA, 64 nt, hsa; identical to SEQ ID NO: 280370

SEQ ID NO: 507565 - RNA, 64 nt, hsa; identical to SEQ ID NO: 280371

SEQ ID NO: 507566 - RNA, 64 nt, hsa; identical to SEQ ID NO: 280372

SEQ ID NO: 507567 - RNA, 64 nt, hsa; identical to SEQ ID NO: 280373

SEQ ID NO: 507568 - RNA, 64 nt, hsa; identical to SEQ ID NO: 280374

SEQ ID NO: 507569 - RNA, 64 nt, hsa; identical to SEQ ID NO: 280375

SEQ ID NO: 507570 - RNA, 64 nt, hsa; identical to SEQ ID NO: 280376

SEQ ID NO: 507571 - RNA, 64 nt, hsa; identical to SEQ ID NO: 280377

SEQ ID NO: 507572 - RNA, 64 nt, hsa; identical to SEQ ID NO: 280378

SEQ ID NO: 507573 - RNA, 64 nt, hsa; identical to SEQ ID NO: 280379

SEQ ID NO: 507574 - RNA, 64 nt, hsa; identical to SEQ ID NO: 280380

SEQ ID NO: 507575 - RNA, 64 nt, hsa; identical to SEQ ID NO: 280381

SEQ ID NO: 507576 - RNA, 64 nt, hsa; identical to SEQ ID NO: 280382

SEQ ID NO: 507577 - RNA, 64 nt, hsa; identical to SEQ ID NO: 280383

SEQ ID NO: 507578 - RNA, 64 nt, hsa; identical to SEQ ID NO: 280384

SEQ ID NO: 507579 - RNA, 64 nt, hsa; identical to SEQ ID NO: 280385

SEQ ID NO: 507580 - RNA, 64 nt, hsa; identical to SEQ ID NO: 280386

SEQ ID NO: 507581 - RNA, 64 nt, hsa; identical to SEQ ID NO: 280387

SEQ ID NO: 507582 - RNA, 64 nt, hsa; identical to SEQ ID NO: 280388

SEQ ID NO: 507583 - RNA, 64 nt, hsa; identical to SEQ ID NO: 280389

SEQ ID NO: 507584 - RNA, 64 nt, hsa; identical to SEQ ID NO: 280390

SEQ ID NO: 507585 - RNA, 64 nt, hsa; identical to SEQ ID NO: 280391

SEQ ID NO: 507586 - RNA, 64 nt, hsa; identical to SEQ ID NO: 280392

SEQ ID NO: 507587 - RNA, 64 nt, hsa; identical to SEQ ID NO: 280393

SEQ ID NO: 507588 - RNA, 64 nt, hsa; identical to SEQ ID NO: 280394

SEQ ID NO: 507589 - RNA, 64 nt, hsa; identical to SEQ ID NO: 280395

SEQ ID NO: 507590 - RNA, 64 nt, hsa; identical to SEQ ID NO: 280396

SEQ ID NO: 507591 - RNA, 64 nt, hsa; identical to SEQ ID NO: 280397

SEQ ID NO: 507592 - RNA, 64 nt, hsa; identical to SEQ ID NO: 280398

SEQ ID NO: 507593 - RNA, 64 nt, hsa; identical to SEQ ID NO: 280399

SEQ ID NO: 507594 - RNA, 64 nt, hsa; identical to SEQ ID NO: 280400

SEQ ID NO: 507595 - RNA, 64 nt, hsa; identical to SEQ ID NO: 280401

SEQ ID NO: 507596 - RNA, 64 nt, hsa; identical to SEQ ID NO: 280402

SEQ ID NO: 507597 - RNA, 64 nt, hsa; identical to SEQ ID NO: 280403

SEQ ID NO: 507598 - RNA, 64 nt, hsa; identical to SEQ ID NO: 280404

SEQ ID NO: 507599 - RNA, 64 nt, hsa; identical to SEQ ID NO: 280405

SEQ ID NO: 507600 - RNA, 64 nt, hsa; identical to SEQ ID NO: 280406

SEQ ID NO: 507601 - RNA, 64 nt, hsa; identical to SEQ ID NO: 280407

SEQ ID NO: 507602 - RNA, 64 nt, hsa; identical to SEQ ID NO: 280408

SEQ ID NO: 507603 - RNA, 64 nt, hsa; identical to SEQ ID NO: 280409

SEQ ID NO: 507604 - RNA, 64 nt, hsa; identical to SEQ ID NO: 280410

SEQ ID NO: 507605 - RNA, 64 nt, hsa; identical to SEQ ID NO: 280411

SEQ ID NO: 507606 - RNA, 64 nt, hsa; identical to SEQ ID NO: 280412

SEQ ID NO: 507607 - RNA, 64 nt, hsa; identical to SEQ ID NO: 280413

SEQ ID NO: 507608 - RNA, 64 nt, hsa; identical to SEQ ID NO: 280414

SEQ ID NO: 507609 - RNA, 64 nt, hsa; identical to SEQ ID NO: 280415

SEQ ID NO: 507610 - RNA, 64 nt, hsa; identical to SEQ ID NO: 280416

SEQ ID NO: 507611 - RNA, 64 nt, hsa; identical to SEQ ID NO: 280417

SEQ ID NO: 507612 - RNA, 64 nt, hsa; identical to SEQ ID NO: 280418

SEQ ID NO: 507613 - RNA, 64 nt, hsa; identical to SEQ ID NO: 280419

SEQ ID NO: 507614 - RNA, 64 nt, hsa; identical to SEQ ID NO: 280420

SEQ ID NO: 507615 - RNA, 64 nt, hsa; identical to SEQ ID NO: 280421

SEQ ID NO: 507616 - RNA, 64 nt, hsa; identical to SEQ ID NO: 280422

SEQ ID NO: 507617 - RNA, 64 nt, hsa; identical to SEQ ID NO: 280423

SEQ ID NO: 507618 - RNA, 64 nt, hsa; identical to SEQ ID NO: 280424

SEQ ID NO: 507619 - RNA, 64 nt, hsa; identical to SEQ ID NO: 280425

SEQ ID NO: 507620 - RNA, 64 nt, hsa; identical to SEQ ID NO: 280426

SEQ ID NO: 507621 - RNA, 64 nt, hsa; identical to SEQ ID NO: 280427

SEQ ID NO: 507622 - RNA, 64 nt, hsa; identical to SEQ ID NO: 280428

SEQ ID NO: 507623 - RNA, 64 nt, hsa; identical to SEQ ID NO: 280429

SEQ ID NO: 507624 - RNA, 64 nt, hsa; identical to SEQ ID NO: 280430

SEQ ID NO: 507625 - RNA, 64 nt, hsa; identical to SEQ ID NO: 280431

SEQ ID NO: 507626 - RNA, 64 nt, hsa; identical to SEQ ID NO: 280432

SEQ ID NO: 507627 - RNA, 64 nt, hsa; identical to SEQ ID NO: 280433

SEQ ID NO: 507628 - RNA, 64 nt, hsa; identical to SEQ ID NO: 280434

SEQ ID NO: 507629 - RNA, 64 nt, hsa; identical to SEQ ID NO: 280435

SEQ ID NO: 507630 - RNA, 64 nt, hsa; identical to SEQ ID NO: 280436

SEQ ID NO: 507631 - RNA, 64 nt, hsa; identical to SEQ ID NO: 280437

SEQ ID NO: 507632 - RNA, 64 nt, hsa; identical to SEQ ID NO: 280438

SEQ ID NO: 507633 - RNA, 64 nt, hsa; identical to SEQ ID NO: 280439

SEQ ID NO: 507634 - RNA, 64 nt, hsa; identical to SEQ ID NO: 280440

SEQ ID NO: 507635 - RNA, 64 nt, hsa; identical to SEQ ID NO: 280441

SEQ ID NO: 507636 - RNA, 64 nt, hsa; identical to SEQ ID NO: 280442

SEQ ID NO: 507637 - RNA, 64 nt, hsa; identical to SEQ ID NO: 280443

SEQ ID NO: 507638 - RNA, 64 nt, hsa; identical to SEQ ID NO: 280444

SEQ ID NO: 507639 - RNA, 64 nt, hsa; identical to SEQ ID NO: 280445

SEQ ID NO: 507640 - RNA, 64 nt, hsa; identical to SEQ ID NO: 280446

SEQ ID NO: 507641 - RNA, 64 nt, hsa; identical to SEQ ID NO: 280447

SEQ ID NO: 507642 - RNA, 64 nt, hsa; identical to SEQ ID NO: 280448

SEQ ID NO: 507643 - RNA, 64 nt, hsa; identical to SEQ ID NO: 280449

SEQ ID NO: 507644 - RNA, 64 nt, hsa; identical to SEQ ID NO: 280450

SEQ ID NO: 507645 - RNA, 64 nt, hsa; identical to SEQ ID NO: 280451

SEQ ID NO: 507646 - RNA, 64 nt, hsa; identical to SEQ ID NO: 280452

SEQ ID NO: 507647 - RNA, 64 nt, hsa; identical to SEQ ID NO: 280453

SEQ ID NO: 507648 - RNA, 64 nt, hsa; identical to SEQ ID NO: 280454

SEQ ID NO: 507649 - RNA, 64 nt, hsa; identical to SEQ ID NO: 280455

SEQ ID NO: 507650 - RNA, 64 nt, hsa; identical to SEQ ID NO: 280456

SEQ ID NO: 507651 - RNA, 64 nt, hsa; identical to SEQ ID NO: 280457

SEQ ID NO: 507652 - RNA, 64 nt, hsa; identical to SEQ ID NO: 280458

SEQ ID NO: 507653 - RNA, 64 nt, hsa; identical to SEQ ID NO: 280459

SEQ ID NO: 507654 - RNA, 64 nt, hsa; identical to SEQ ID NO: 280460

SEQ ID NO: 507655 - RNA, 64 nt, hsa; identical to SEQ ID NO: 280461

SEQ ID NO: 507656 - RNA, 64 nt, hsa; identical to SEQ ID NO: 280462

SEQ ID NO: 507657 - RNA, 64 nt, hsa; identical to SEQ ID NO: 280463

SEQ ID NO: 507658 - RNA, 64 nt, hsa; identical to SEQ ID NO: 280464

SEQ ID NO: 507659 - RNA, 64 nt, hsa; identical to SEQ ID NO: 280465

SEQ ID NO: 507660 - RNA, 64 nt, hsa; identical to SEQ ID NO: 280466

SEQ ID NO: 507661 - RNA, 64 nt, hsa; identical to SEQ ID NO: 280467

SEQ ID NO: 507662 - RNA, 64 nt, hsa; identical to SEQ ID NO: 280468

SEQ ID NO: 507663 - RNA, 64 nt, hsa; identical to SEQ ID NO: 280469

SEQ ID NO: 507664 - RNA, 64 nt, hsa; identical to SEQ ID NO: 280470

SEQ ID NO: 507665 - RNA, 64 nt, hsa; identical to SEQ ID NO: 280471

SEQ ID NO: 507666 - RNA, 64 nt, hsa; identical to SEQ ID NO: 280472

SEQ ID NO: 507667 - RNA, 64 nt, hsa; identical to SEQ ID NO: 280473

SEQ ID NO: 507668 - RNA, 64 nt, hsa; identical to SEQ ID NO: 280474

SEQ ID NO: 507669 - RNA, 64 nt, hsa; identical to SEQ ID NO: 280475

SEQ ID NO: 507670 - RNA, 64 nt, hsa; identical to SEQ ID NO: 280476

SEQ ID NO: 507671 - RNA, 64 nt, hsa; identical to SEQ ID NO: 280477

SEQ ID NO: 507672 - RNA, 64 nt, hsa; identical to SEQ ID NO: 280478

SEQ ID NO: 507673 - RNA, 64 nt, hsa; identical to SEQ ID NO: 280479

SEQ ID NO: 507674 - RNA, 64 nt, hsa; identical to SEQ ID NO: 280480

SEQ ID NO: 507675 - RNA, 64 nt, hsa; identical to SEQ ID NO: 280481

SEQ ID NO: 507676 - RNA, 64 nt, hsa; identical to SEQ ID NO: 280482

SEQ ID NO: 507677 - RNA, 64 nt, hsa; identical to SEQ ID NO: 280483

SEQ ID NO: 507678 - RNA, 54 nt, hsa; identical to SEQ ID NO: 280484

SEQ ID NO: 507679 - RNA, 64 nt, hsa; identical to SEQ ID NO: 280485

SEQ ID NO: 507680 - RNA, 64 nt, hsa; identical to SEQ ID NO: 280486

SEQ ID NO: 507681 - RNA, 64 nt, hsa; identical to SEQ ID NO: 280487

SEQ ID NO: 507682 - RNA, 64 nt, hsa; identical to SEQ ID NO: 280488

SEQ ID NO: 507683 - RNA, 64 nt, hsa; identical to SEQ ID NO: 280489

SEQ ID NO: 507684 - RNA, 64 nt, hsa; identical to SEQ ID NO: 280490

SEQ ID NO: 507685 - RNA, 64 nt, hsa; identical to SEQ ID NO: 280491

SEQ ID NO: 507686 - RNA, 64 nt, hsa; identical to SEQ ID NO: 280492

SEQ ID NO: 507687 - RNA, 64 nt, hsa; identical to SEQ ID NO: 280493

SEQ ID NO: 507688 - RNA, 64 nt, hsa; identical to SEQ ID NO: 280494

SEQ ID NO: 507689 - RNA, 64 nt, hsa; identical to SEQ ID NO: 280495

SEQ ID NO: 507690 - RNA, 64 nt, hsa; identical to SEQ ID NO: 280496

SEQ ID NO: 507691 - RNA, 64 nt, hsa; identical to SEQ ID NO: 280497

SEQ ID NO: 507692 - RNA, 64 nt, hsa; identical to SEQ ID NO: 280498

SEQ ID NO: 507693 - RNA, 64 nt, hsa; identical to SEQ ID NO: 280499

SEQ ID NO: 507694 - RNA, 64 nt, hsa; identical to SEQ ID NO: 280500

SEQ ID NO: 507695 - RNA, 64 nt, hsa; identical to SEQ ID NO: 280501

SEQ ID NO: 507696 - RNA, 64 nt, hsa; identical to SEQ ID NO: 280502

SEQ ID NO: 507697 - RNA, 64 nt, hsa; identical to SEQ ID NO: 280503

SEQ ID NO: 507698 - RNA, 64 nt, hsa; identical to SEQ ID NO: 280504

SEQ ID NO: 507699 - RNA, 64 nt, hsa; identical to SEQ ID NO: 280505

SEQ ID NO: 507700 - RNA, 64 nt, hsa; identical to SEQ ID NO: 280506

SEQ ID NO: 507701 - RNA, 64 nt, hsa; identical to SEQ ID NO: 280507

SEQ ID NO: 507702 - RNA, 64 nt, hsa; identical to SEQ ID NO: 280508

SEQ ID NO: 507703 - RNA, 64 nt, hsa; identical to SEQ ID NO: 280509

SEQ ID NO: 507704 - RNA, 64 nt, hsa; identical to SEQ ID NO: 280510

SEQ ID NO: 507705 - RNA, 64 nt, hsa; identical to SEQ ID NO: 280511

SEQ ID NO: 507706 - RNA, 64 nt, hsa; identical to SEQ ID NO: 280512

SEQ ID NO: 507707 - RNA, 64 nt, hsa; identical to SEQ ID NO: 280513

SEQ ID NO: 507708 - RNA, 64 nt, hsa; identical to SEQ ID NO: 280514

SEQ ID NO: 507709 - RNA, 64 nt, hsa; identical to SEQ ID NO: 280515

SEQ ID NO: 507710 - RNA, 64 nt, hsa; identical to SEQ ID NO: 280516

SEQ ID NO: 507711 - RNA, 64 nt, hsa; identical to SEQ ID NO: 280517

SEQ ID NO: 507712 - RNA, 64 nt, hsa; identical to SEQ ID NO: 280518

SEQ ID NO: 507713 - RNA, 64 nt, hsa; identical to SEQ ID NO: 280519

SEQ ID NO: 507714 - RNA, 64 nt, hsa; identical to SEQ ID NO: 280520

SEQ ID NO: 507715 - RNA, 64 nt, hsa; identical to SEQ ID NO: 280521

SEQ ID NO: 507716 - RNA, 64 nt, hsa; identical to SEQ ID NO: 280522

SEQ ID NO: 507717 - RNA, 64 nt, hsa; identical to SEQ ID NO: 280523

SEQ ID NO: 507718 - RNA, 64 nt, hsa; identical to SEQ ID NO: 280524

SEQ ID NO: 507719 - RNA, 64 nt, hsa; identical to SEQ ID NO: 280525

SEQ ID NO: 507720 - RNA, 64 nt, hsa; identical to SEQ ID NO: 280526

SEQ ID NO: 507721 - RNA, 64 nt, hsa; identical to SEQ ID NO: 280527

SEQ ID NO: 507722 - RNA, 64 nt, hsa; identical to SEQ ID NO: 280528

SEQ ID NO: 507723 - RNA, 64 nt, hsa; identical to SEQ ID NO: 280529

SEQ ID NO: 507724 - RNA, 64 nt, hsa; identical to SEQ ID NO: 280530

SEQ ID NO: 507725 - RNA, 64 nt, hsa; identical to SEQ ID NO: 280531

SEQ ID NO: 507726 - RNA, 64 nt, hsa; identical to SEQ ID NO: 280532

SEQ ID NO: 507727 - RNA, 64 nt, hsa; identical to SEQ ID NO: 280533

SEQ ID NO: 507728 - RNA, 64 nt, hsa; identical to SEQ ID NO: 280534

SEQ ID NO: 507729 - RNA, 64 nt, hsa; identical to SEQ ID NO: 280535

SEQ ID NO: 507730 - RNA, 64 nt, hsa; identical to SEQ ID NO: 280536

SEQ ID NO: 507731 - RNA, 64 nt, hsa; identical to SEQ ID NO: 280537

SEQ ID NO: 507732 - RNA, 64 nt, hsa; identical to SEQ ID NO: 280538

SEQ ID NO: 507733 - RNA, 64 nt, hsa; identical to SEQ ID NO: 280539

SEQ ID NO: 507734 - RNA, 64 nt, hsa; identical to SEQ ID NO: 280540

SEQ ID NO: 507735 - RNA, 64 nt, hsa; identical to SEQ ID NO: 280541

SEQ ID NO: 507736 - RNA, 64 nt, hsa; identical to SEQ ID NO: 280542

SEQ ID NO: 507737 - RNA, 64 nt, hsa; identical to SEQ ID NO: 280543

SEQ ID NO: 507738 - RNA, 64 nt, hsa; identical to SEQ ID NO: 280544

SEQ ID NO: 507739 - RNA, 64 nt, hsa; identical to SEQ ID NO: 280545

SEQ ID NO: 507740 - RNA, 64 nt, hsa; identical to SEQ ID NO: 280546

SEQ ID NO: 507741 - RNA, 64 nt, hsa; identical to SEQ ID NO: 280547

SEQ ID NO: 507742 - RNA, 64 nt, hsa; identical to SEQ ID NO: 280548

SEQ ID NO: 507743 - RNA, 64 nt, hsa; identical to SEQ ID NO: 280549

SEQ ID NO: 507744 - RNA, 64 nt, hsa; identical to SEQ ID NO: 280550

SEQ ID NO: 507745 - RNA, 64 nt, hsa; identical to SEQ ID NO: 280551

SEQ ID NO: 507746 - RNA, 64 nt, hsa; identical to SEQ ID NO: 280552

SEQ ID NO: 507747 - RNA, 64 nt, hsa; identical to SEQ ID NO: 280553

SEQ ID NO: 507748 - RNA, 64 nt, hsa; identical to SEQ ID NO: 280554

SEQ ID NO: 507749 - RNA, 64 nt, hsa; identical to SEQ ID NO: 280555

SEQ ID NO: 507750 - RNA, 64 nt, hsa; identical to SEQ ID NO: 280556

SEQ ID NO: 507751 - RNA, 64 nt, hsa; identical to SEQ ID NO: 280557

SEQ ID NO: 507752 - RNA, 64 nt, hsa; identical to SEQ ID NO: 280558

SEQ ID NO: 507753 - RNA, 64 nt, hsa; identical to SEQ ID NO: 280559

SEQ ID NO: 507754 - RNA, 60 nt, hsa; identical to SEQ ID NO: 280560

SEQ ID NO: 507755 - RNA, 64 nt, hsa; identical to SEQ ID NO: 280561

SEQ ID NO: 507756 - RNA, 64 nt, hsa; identical to SEQ ID NO: 280562

SEQ ID NO: 507757 - RNA, 64 nt, hsa; identical to SEQ ID NO: 280563

SEQ ID NO: 507758 - RNA, 64 nt, hsa; identical to SEQ ID NO: 280564

SEQ ID NO: 507759 - RNA, 64 nt, hsa; identical to SEQ ID NO: 280565

SEQ ID NO: 507760 - RNA, 64 nt, hsa; identical to SEQ ID NO: 280566

SEQ ID NO: 507761 - RNA, 64 nt, hsa; identical to SEQ ID NO: 280567

SEQ ID NO: 507762 - RNA, 64 nt, hsa; identical to SEQ ID NO: 280568

SEQ ID NO: 507763 - RNA, 64 nt, hsa; identical to SEQ ID NO: 280569

SEQ ID NO: 507764 - RNA, 64 nt, hsa; identical to SEQ ID NO: 280570

SEQ ID NO: 507765 - RNA, 64 nt, hsa; identical to SEQ ID NO: 280571

SEQ ID NO: 507766 - RNA, 64 nt, hsa; identical to SEQ ID NO: 280572

SEQ ID NO: 507767 - RNA, 64 nt, hsa; identical to SEQ ID NO: 280573

SEQ ID NO: 507768 - RNA, 64 nt, hsa; identical to SEQ ID NO: 280574

SEQ ID NO: 507769 - RNA, 64 nt, hsa; identical to SEQ ID NO: 280575

SEQ ID NO: 507770 - RNA, 64 nt, hsa; identical to SEQ ID NO: 280576

SEQ ID NO: 507771 - RNA, 64 nt, hsa; identical to SEQ ID NO: 280577

SEQ ID NO: 507772 - RNA, 64 nt, hsa; identical to SEQ ID NO: 280578

SEQ ID NO: 507773 - RNA, 64 nt, hsa; identical to SEQ ID NO: 280579

SEQ ID NO: 507774 - RNA, 64 nt, hsa; identical to SEQ ID NO: 280580

SEQ ID NO: 507775 - RNA, 64 nt, hsa; identical to SEQ ID NO: 280581

SEQ ID NO: 507776 - RNA, 64 nt, hsa; identical to SEQ ID NO: 280582

SEQ ID NO: 507777 - RNA, 64 nt, hsa; identical to SEQ ID NO: 280583

SEQ ID NO: 507778 - RNA, 64 nt, hsa; identical to SEQ ID NO: 280584

SEQ ID NO: 507779 - RNA, 64 nt, hsa; identical to SEQ ID NO: 280585

SEQ ID NO: 507780 - RNA, 64 nt, hsa; identical to SEQ ID NO: 280586

SEQ ID NO: 507781 - RNA, 64 nt, hsa; identical to SEQ ID NO: 280587

SEQ ID NO: 507782 - RNA, 64 nt, hsa; identical to SEQ ID NO: 280588

SEQ ID NO: 507783 - RNA, 64 nt, hsa; identical to SEQ ID NO: 280589

SEQ ID NO: 507784 - RNA, 64 nt, hsa; identical to SEQ ID NO: 280590

SEQ ID NO: 507785 - RNA, 64 nt, hsa; identical to SEQ ID NO: 280591

SEQ ID NO: 507786 - RNA, 64 nt, hsa; identical to SEQ ID NO: 280592

SEQ ID NO: 507787 - RNA, 64 nt, hsa; identical to SEQ ID NO: 280593

SEQ ID NO: 507788 - RNA, 64 nt, hsa; identical to SEQ ID NO: 280594

SEQ ID NO: 507789 - RNA, 64 nt, hsa; identical to SEQ ID NO: 280595

SEQ ID NO: 507790 - RNA, 64 nt, hsa; identical to SEQ ID NO: 280596

SEQ ID NO: 507791 - RNA, 64 nt, hsa; identical to SEQ ID NO: 280597

SEQ ID NO: 507792 - RNA, 64 nt, hsa; identical to SEQ ID NO: 280598

SEQ ID NO: 507793 - RNA, 64 nt, hsa; identical to SEQ ID NO: 280599

SEQ ID NO: 507794 - RNA, 64 nt, hsa; identical to SEQ ID NO: 280600

SEQ ID NO: 507795 - RNA, 64 nt, hsa; identical to SEQ ID NO: 280601

SEQ ID NO: 507796 - RNA, 64 nt, hsa; identical to SEQ ID NO: 280602

SEQ ID NO: 507797 - RNA, 64 nt, hsa; identical to SEQ ID NO: 280603

SEQ ID NO: 507798 - RNA, 64 nt, hsa; identical to SEQ ID NO: 280604

SEQ ID NO: 507799 - RNA, 64 nt, hsa; identical to SEQ ID NO: 280605

SEQ ID NO: 507800 - RNA, 64 nt, hsa; identical to SEQ ID NO: 280606

SEQ ID NO: 507801 - RNA, 64 nt, hsa; identical to SEQ ID NO: 280607

SEQ ID NO: 507802 - RNA, 64 nt, hsa; identical to SEQ ID NO: 280608

SEQ ID NO: 507803 - RNA, 64 nt, hsa; identical to SEQ ID NO: 280609

SEQ ID NO: 507804 - RNA, 64 nt, hsa; identical to SEQ ID NO: 280610

SEQ ID NO: 507805 - RNA, 64 nt, hsa; identical to SEQ ID NO: 280611

SEQ ID NO: 507806 - RNA, 64 nt, hsa; identical to SEQ ID NO: 280612

SEQ ID NO: 507807 - RNA, 64 nt, hsa; identical to SEQ ID NO: 280613

SEQ ID NO: 507808 - RNA, 64 nt, hsa; identical to SEQ ID NO: 280614

SEQ ID NO: 507809 - RNA, 64 nt, hsa; identical to SEQ ID NO: 280615

SEQ ID NO: 507810 - RNA, 64 nt, hsa; identical to SEQ ID NO: 280616

SEQ ID NO: 507811 - RNA, 64 nt, hsa; identical to SEQ ID NO: 280617

SEQ ID NO: 507812 - RNA, 64 nt, hsa; identical to SEQ ID NO: 280618

SEQ ID NO: 507813 - RNA, 64 nt, hsa; identical to SEQ ID NO: 280619

SEQ ID NO: 507814 - RNA, 64 nt, hsa; identical to SEQ ID NO: 280620

SEQ ID NO: 507815 - RNA, 64 nt, hsa; identical to SEQ ID NO: 280621

SEQ ID NO: 507816 - RNA, 64 nt, hsa; identical to SEQ ID NO: 280622

SEQ ID NO: 507817 - RNA, 64 nt, hsa; identical to SEQ ID NO: 280623

SEQ ID NO: 507818 - RNA, 64 nt, hsa; identical to SEQ ID NO: 280624

SEQ ID NO: 507819 - RNA, 64 nt, hsa; identical to SEQ ID NO: 280625

SEQ ID NO: 507820 - RNA, 64 nt, hsa; identical to SEQ ID NO: 280626

SEQ ID NO: 507821 - RNA, 64 nt, hsa; identical to SEQ ID NO: 280627

SEQ ID NO: 507822 - RNA, 64 nt, hsa; identical to SEQ ID NO: 280628

SEQ ID NO: 507823 - RNA, 64 nt, hsa; identical to SEQ ID NO: 280629

SEQ ID NO: 507824 - RNA, 64 nt, hsa; identical to SEQ ID NO: 280630

SEQ ID NO: 507825 - RNA, 64 nt, hsa; identical to SEQ ID NO: 280631

SEQ ID NO: 507826 - RNA, 64 nt, hsa; identical to SEQ ID NO: 280632

SEQ ID NO: 507827 - RNA, 64 nt, hsa; identical to SEQ ID NO: 280633

SEQ ID NO: 507828 - RNA, 64 nt, hsa; identical to SEQ ID NO: 280634

SEQ ID NO: 507829 - RNA, 64 nt, hsa; identical to SEQ ID NO: 280635

SEQ ID NO: 507830 - RNA, 64 nt, hsa; identical to SEQ ID NO: 280636

SEQ ID NO: 507831 - RNA, 64 nt, hsa; identical to SEQ ID NO: 280637

SEQ ID NO: 507832 - RNA, 64 nt, hsa; identical to SEQ ID NO: 280638

SEQ ID NO: 507833 - RNA, 64 nt, hsa; identical to SEQ ID NO: 280639

SEQ ID NO: 507834 - RNA, 64 nt, hsa; identical to SEQ ID NO: 280640

SEQ ID NO: 507835 - RNA, 64 nt, hsa; identical to SEQ ID NO: 280641

SEQ ID NO: 507836 - RNA, 64 nt, hsa; identical to SEQ ID NO: 280642

SEQ ID NO: 507837 - RNA, 64 nt, hsa; identical to SEQ ID NO: 280643

SEQ ID NO: 507838 - RNA, 64 nt, hsa; identical to SEQ ID NO: 280644

SEQ ID NO: 507839 - RNA, 64 nt, hsa; identical to SEQ ID NO: 280645

SEQ ID NO: 507840 - RNA, 64 nt, hsa; identical to SEQ ID NO: 280646

SEQ ID NO: 507841 - RNA, 64 nt, hsa; identical to SEQ ID NO: 280647

SEQ ID NO: 507842 - RNA, 64 nt, hsa; identical to SEQ ID NO: 280648

SEQ ID NO: 507843 - RNA, 64 nt, hsa; identical to SEQ ID NO: 280649

SEQ ID NO: 507844 - RNA, 64 nt, hsa; identical to SEQ ID NO: 280650

SEQ ID NO: 507845 - RNA, 64 nt, hsa; identical to SEQ ID NO: 280651

SEQ ID NO: 507846 - RNA, 64 nt, hsa; identical to SEQ ID NO: 280652

SEQ ID NO: 507847 - RNA, 64 nt, hsa; identical to SEQ ID NO: 280653

SEQ ID NO: 507848 - RNA, 64 nt, hsa; identical to SEQ ID NO: 280654

SEQ ID NO: 507849 - RNA, 64 nt, hsa; identical to SEQ ID NO: 280655

SEQ ID NO: 507850 - RNA, 64 nt, hsa; identical to SEQ ID NO: 280656

SEQ ID NO: 507851 - RNA, 64 nt, hsa; identical to SEQ ID NO: 280657

SEQ ID NO: 507852 - RNA, 64 nt, hsa; identical to SEQ ID NO: 280658

SEQ ID NO: 507853 - RNA, 64 nt, hsa; identical to SEQ ID NO: 280659

SEQ ID NO: 507854 - RNA, 64 nt, hsa; identical to SEQ ID NO: 280660

SEQ ID NO: 507855 - RNA, 64 nt, hsa; identical to SEQ ID NO: 280661

SEQ ID NO: 507856 - RNA, 64 nt, hsa; identical to SEQ ID NO: 280662

SEQ ID NO: 507857 - RNA, 64 nt, hsa; identical to SEQ ID NO: 280663

SEQ ID NO: 507858 - RNA, 64 nt, hsa; identical to SEQ ID NO: 280664

SEQ ID NO: 507859 - RNA, 64 nt, hsa; identical to SEQ ID NO: 280665

SEQ ID NO: 507860 - RNA, 64 nt, hsa; identical to SEQ ID NO: 280666

SEQ ID NO: 507861 - RNA, 64 nt, hsa; identical to SEQ ID NO: 280667

SEQ ID NO: 507862 - RNA, 64 nt, hsa; identical to SEQ ID NO: 280668

SEQ ID NO: 507863 - RNA, 64 nt, hsa; identical to SEQ ID NO: 280669

SEQ ID NO: 507864 - RNA, 64 nt, hsa; identical to SEQ ID NO: 280670

SEQ ID NO: 507865 - RNA, 64 nt, hsa; identical to SEQ ID NO: 280671

SEQ ID NO: 507866 - RNA, 64 nt, hsa; identical to SEQ ID NO: 280672

SEQ ID NO: 507867 - RNA, 64 nt, hsa; identical to SEQ ID NO: 280673

SEQ ID NO: 507868 - RNA, 64 nt, hsa; identical to SEQ ID NO: 280674

SEQ ID NO: 507869 - RNA, 64 nt, hsa; identical to SEQ ID NO: 280675

SEQ ID NO: 507870 - RNA, 64 nt, hsa; identical to SEQ ID NO: 280676

SEQ ID NO: 507871 - RNA, 64 nt, hsa; identical to SEQ ID NO: 280677

SEQ ID NO: 507872 - RNA, 64 nt, hsa; identical to SEQ ID NO: 280678

SEQ ID NO: 507873 - RNA, 64 nt, hsa; identical to SEQ ID NO: 280679

SEQ ID NO: 507874 - RNA, 64 nt, hsa; identical to SEQ ID NO: 280680

SEQ ID NO: 507875 - RNA, 64 nt, hsa; identical to SEQ ID NO: 280681

SEQ ID NO: 507876 - RNA, 64 nt, hsa; identical to SEQ ID NO: 280682

SEQ ID NO: 507877 - RNA, 64 nt, hsa; identical to SEQ ID NO: 280683

SEQ ID NO: 507878 - RNA, 64 nt, hsa; identical to SEQ ID NO: 280684

SEQ ID NO: 507879 - RNA, 64 nt, hsa; identical to SEQ ID NO: 280685

SEQ ID NO: 507880 - RNA, 64 nt, hsa; identical to SEQ ID NO: 280686

SEQ ID NO: 507881 - RNA, 64 nt, hsa; identical to SEQ ID NO: 280687

SEQ ID NO: 507882 - RNA, 64 nt, hsa; identical to SEQ ID NO: 280688

SEQ ID NO: 507883 - RNA, 64 nt, hsa; identical to SEQ ID NO: 280689

SEQ ID NO: 507884 - RNA, 64 nt, hsa; identical to SEQ ID NO: 280690

SEQ ID NO: 507885 - RNA, 64 nt, hsa; identical to SEQ ID NO: 280691

SEQ ID NO: 507886 - RNA, 64 nt, hsa; identical to SEQ ID NO: 280692

SEQ ID NO: 507887 - RNA, 64 nt, hsa; identical to SEQ ID NO: 280693

SEQ ID NO: 507888 - RNA, 64 nt, hsa; identical to SEQ ID NO: 280694

SEQ ID NO: 507889 - RNA, 64 nt, hsa; identical to SEQ ID NO: 280695

SEQ ID NO: 507890 - RNA, 64 nt, hsa; identical to SEQ ID NO: 280696

SEQ ID NO: 507891 - RNA, 64 nt, hsa; identical to SEQ ID NO: 280697

SEQ ID NO: 507892 - RNA, 64 nt, hsa; identical to SEQ ID NO: 280698

SEQ ID NO: 507893 - RNA, 64 nt, hsa; identical to SEQ ID NO: 280699

SEQ ID NO: 507894 - RNA, 64 nt, hsa; identical to SEQ ID NO: 280700

SEQ ID NO: 507895 - RNA, 64 nt, hsa; identical to SEQ ID NO: 280701

SEQ ID NO: 507896 - RNA, 64 nt, hsa; identical to SEQ ID NO: 280702

SEQ ID NO: 507897 - RNA, 64 nt, hsa; identical to SEQ ID NO: 280703

SEQ ID NO: 507898 - RNA, 64 nt, hsa; identical to SEQ ID NO: 280704

SEQ ID NO: 507899 - RNA, 64 nt, hsa; identical to SEQ ID NO: 280705

SEQ ID NO: 507900 - RNA, 64 nt, hsa; identical to SEQ ID NO: 280706

SEQ ID NO: 507901 - RNA, 64 nt, hsa; identical to SEQ ID NO: 280707

SEQ ID NO: 507902 - RNA, 64 nt, hsa; identical to SEQ ID NO: 280708

SEQ ID NO: 507903 - RNA, 64 nt, hsa; identical to SEQ ID NO: 280709

SEQ ID NO: 507904 - RNA, 64 nt, hsa; identical to SEQ ID NO: 280710

SEQ ID NO: 507905 - RNA, 64 nt, hsa; identical to SEQ ID NO: 280711

SEQ ID NO: 507906 - RNA, 64 nt, hsa; identical to SEQ ID NO: 280712

SEQ ID NO: 507907 - RNA, 64 nt, hsa; identical to SEQ ID NO: 280713

SEQ ID NO: 507908 - RNA, 64 nt, hsa; identical to SEQ ID NO: 280714

SEQ ID NO: 507909 - RNA, 64 nt, hsa; identical to SEQ ID NO: 280715

SEQ ID NO: 507910 - RNA, 64 nt, hsa; identical to SEQ ID NO: 280716

SEQ ID NO: 507911 - RNA, 64 nt, hsa; identical to SEQ ID NO: 280717

SEQ ID NO: 507912 - RNA, 64 nt, hsa; identical to SEQ ID NO: 280718

SEQ ID NO: 507913 - RNA, 64 nt, hsa; identical to SEQ ID NO: 280719

SEQ ID NO: 507914 - RNA, 64 nt, hsa; identical to SEQ ID NO: 280720

SEQ ID NO: 507915 - RNA, 64 nt, hsa; identical to SEQ ID NO: 280721

SEQ ID NO: 507916 - RNA, 64 nt, hsa; identical to SEQ ID NO: 280722

SEQ ID NO: 507917 - RNA, 64 nt, hsa; identical to SEQ ID NO: 280723

SEQ ID NO: 507918 - RNA, 64 nt, hsa; identical to SEQ ID NO: 280724

SEQ ID NO: 507919 - RNA, 64 nt, hsa; identical to SEQ ID NO: 280725

SEQ ID NO: 507920 - RNA, 64 nt, hsa; identical to SEQ ID NO: 280726

SEQ ID NO: 507921 - RNA, 64 nt, hsa; identical to SEQ ID NO: 280727

SEQ ID NO: 507922 - RNA, 64 nt, hsa; identical to SEQ ID NO: 280728

SEQ ID NO: 507923 - RNA, 64 nt, hsa; identical to SEQ ID NO: 280729

SEQ ID NO: 507924 - RNA, 64 nt, hsa; identical to SEQ ID NO: 280730

SEQ ID NO: 507925 - RNA, 64 nt, hsa; identical to SEQ ID NO: 280731

SEQ ID NO: 507926 - RNA, 64 nt, hsa; identical to SEQ ID NO: 280732

SEQ ID NO: 507927 - RNA, 64 nt, hsa; identical to SEQ ID NO: 280733

SEQ ID NO: 507928 - RNA, 64 nt, hsa; identical to SEQ ID NO: 280734

SEQ ID NO: 507929 - RNA, 64 nt, hsa; identical to SEQ ID NO: 280735

SEQ ID NO: 507930 - RNA, 64 nt, hsa; identical to SEQ ID NO: 280736

SEQ ID NO: 507931 - RNA, 64 nt, hsa; identical to SEQ ID NO: 280737

SEQ ID NO: 507932 - RNA, 64 nt, hsa; identical to SEQ ID NO: 280738

SEQ ID NO: 507933 - RNA, 64 nt, hsa; identical to SEQ ID NO: 280739

SEQ ID NO: 507934 - RNA, 64 nt, hsa; identical to SEQ ID NO: 280740

SEQ ID NO: 507935 - RNA, 64 nt, hsa; identical to SEQ ID NO: 280741

SEQ ID NO: 507936 - RNA, 64 nt, hsa; identical to SEQ ID NO: 280742

SEQ ID NO: 507937 - RNA, 64 nt, hsa; identical to SEQ ID NO: 280743

SEQ ID NO: 507938 - RNA, 64 nt, hsa; identical to SEQ ID NO: 280744

SEQ ID NO: 507939 - RNA, 64 nt, hsa; identical to SEQ ID NO: 280745

SEQ ID NO: 507940 - RNA, 64 nt, hsa; identical to SEQ ID NO: 280746

SEQ ID NO: 507941 - RNA, 64 nt, hsa; identical to SEQ ID NO: 280747

SEQ ID NO: 507942 - RNA, 64 nt, hsa; identical to SEQ ID NO: 280748

SEQ ID NO: 507943 - RNA, 64 nt, hsa; identical to SEQ ID NO: 280749

SEQ ID NO: 507944 - RNA, 64 nt, hsa; identical to SEQ ID NO: 280750

SEQ ID NO: 507945 - RNA, 64 nt, hsa; identical to SEQ ID NO: 280751

SEQ ID NO: 507946 - RNA, 64 nt, hsa; identical to SEQ ID NO: 280752

SEQ ID NO: 507947 - RNA, 64 nt, hsa; identical to SEQ ID NO: 280753

SEQ ID NO: 507948 - RNA, 64 nt, hsa; identical to SEQ ID NO: 280754

SEQ ID NO: 507949 - RNA, 64 nt, hsa; identical to SEQ ID NO: 280755

SEQ ID NO: 507950 - RNA, 64 nt, hsa; identical to SEQ ID NO: 280756

SEQ ID NO: 507951 - RNA, 64 nt, hsa; identical to SEQ ID NO: 280757

SEQ ID NO: 507952 - RNA, 64 nt, hsa; identical to SEQ ID NO: 280758

SEQ ID NO: 507953 - RNA, 64 nt, hsa; identical to SEQ ID NO: 280759

SEQ ID NO: 507954 - RNA, 64 nt, hsa; identical to SEQ ID NO: 280760

SEQ ID NO: 507955 - RNA, 64 nt, hsa; identical to SEQ ID NO: 280761

SEQ ID NO: 507956 - RNA, 64 nt, hsa; identical to SEQ ID NO: 280762

SEQ ID NO: 507957 - RNA, 64 nt, hsa; identical to SEQ ID NO: 280763

SEQ ID NO: 507958 - RNA, 64 nt, hsa; identical to SEQ ID NO: 280764

SEQ ID NO: 507959 - RNA, 64 nt, hsa; identical to SEQ ID NO: 280765

SEQ ID NO: 507960 - RNA, 64 nt, hsa; identical to SEQ ID NO: 280766

SEQ ID NO: 507961 - RNA, 64 nt, hsa; identical to SEQ ID NO: 280767

SEQ ID NO: 507962 - RNA, 64 nt, hsa; identical to SEQ ID NO: 280768

SEQ ID NO: 507963 - RNA, 64 nt, hsa; identical to SEQ ID NO: 280769

SEQ ID NO: 507964 - RNA, 64 nt, hsa; identical to SEQ ID NO: 280770

SEQ ID NO: 507965 - RNA, 64 nt, hsa; identical to SEQ ID NO: 280771

SEQ ID NO: 507966 - RNA, 64 nt, hsa; identical to SEQ ID NO: 280772

SEQ ID NO: 507967 - RNA, 64 nt, hsa; identical to SEQ ID NO: 280773

SEQ ID NO: 507968 - RNA, 64 nt, hsa; identical to SEQ ID NO: 280774

SEQ ID NO: 507969 - RNA, 64 nt, hsa; identical to SEQ ID NO: 280775

SEQ ID NO: 507970 - RNA, 64 nt, hsa; identical to SEQ ID NO: 280776

SEQ ID NO: 507971 - RNA, 64 nt, hsa; identical to SEQ ID NO: 280777

SEQ ID NO: 507972 - RNA, 64 nt, hsa; identical to SEQ ID NO: 280778

SEQ ID NO: 507973 - RNA, 64 nt, hsa; identical to SEQ ID NO: 280779

SEQ ID NO: 507974 - RNA, 64 nt, hsa; identical to SEQ ID NO: 280780

SEQ ID NO: 507975 - RNA, 64 nt, hsa; identical to SEQ ID NO: 280781

SEQ ID NO: 507976 - RNA, 64 nt, hsa; identical to SEQ ID NO: 280782

SEQ ID NO: 507977 - RNA, 64 nt, hsa; identical to SEQ ID NO: 280783

SEQ ID NO: 507978 - RNA, 64 nt, hsa; identical to SEQ ID NO: 280784

SEQ ID NO: 507979 - RNA, 64 nt, hsa; identical to SEQ ID NO: 280785

SEQ ID NO: 507980 - RNA, 64 nt, hsa; identical to SEQ ID NO: 280786

SEQ ID NO: 507981 - RNA, 64 nt, hsa; identical to SEQ ID NO: 280787

SEQ ID NO: 507982 - RNA, 64 nt, hsa; identical to SEQ ID NO: 280788

SEQ ID NO: 507983 - RNA, 64 nt, hsa; identical to SEQ ID NO: 280789

SEQ ID NO: 507984 - RNA, 64 nt, hsa; identical to SEQ ID NO: 280790

SEQ ID NO: 507985 - RNA, 64 nt, hsa; identical to SEQ ID NO: 280791

SEQ ID NO: 507986 - RNA, 64 nt, hsa; identical to SEQ ID NO: 280792

SEQ ID NO: 507987 - RNA, 64 nt, hsa; identical to SEQ ID NO: 280793

SEQ ID NO: 507988 - RNA, 64 nt, hsa; identical to SEQ ID NO: 280794

SEQ ID NO: 507989 - RNA, 64 nt, hsa; identical to SEQ ID NO: 280795

SEQ ID NO: 507990 - RNA, 64 nt, hsa; identical to SEQ ID NO: 280796

SEQ ID NO: 507991 - RNA, 64 nt, hsa; identical to SEQ ID NO: 280797

SEQ ID NO: 507992 - RNA, 64 nt, hsa; identical to SEQ ID NO: 280798

SEQ ID NO: 507993 - RNA, 64 nt, hsa; identical to SEQ ID NO: 280799

SEQ ID NO: 507994 - RNA, 64 nt, hsa; identical to SEQ ID NO: 280800

SEQ ID NO: 507995 - RNA, 64 nt, hsa; identical to SEQ ID NO: 280801

SEQ ID NO: 507996 - RNA, 64 nt, hsa; identical to SEQ ID NO: 280802

SEQ ID NO: 507997 - RNA, 64 nt, hsa; identical to SEQ ID NO: 280803

SEQ ID NO: 507998 - RNA, 64 nt, hsa; identical to SEQ ID NO: 280804

SEQ ID NO: 507999 - RNA, 64 nt, hsa; identical to SEQ ID NO: 280805

SEQ ID NO: 508000 - RNA, 64 nt, hsa; identical to SEQ ID NO: 280806

SEQ ID NO: 508001 - RNA, 64 nt, hsa; identical to SEQ ID NO: 280807

SEQ ID NO: 508002 - RNA, 64 nt, hsa; identical to SEQ ID NO: 280808

SEQ ID NO: 508003 - RNA, 64 nt, hsa; identical to SEQ ID NO: 280809

SEQ ID NO: 508004 - RNA, 64 nt, hsa; identical to SEQ ID NO: 280810

SEQ ID NO: 508005 - RNA, 64 nt, hsa; identical to SEQ ID NO: 280811

SEQ ID NO: 508006 - RNA, 64 nt, hsa; identical to SEQ ID NO: 280812

SEQ ID NO: 508007 - RNA, 64 nt, hsa; identical to SEQ ID NO: 280813

SEQ ID NO: 508008 - RNA, 64 nt, hsa; identical to SEQ ID NO: 280814

SEQ ID NO: 508009 - RNA, 64 nt, hsa; identical to SEQ ID NO: 280815

SEQ ID NO: 508010 - RNA, 64 nt, hsa; identical to SEQ ID NO: 280816

SEQ ID NO: 508011 - RNA, 64 nt, hsa; identical to SEQ ID NO: 280817

SEQ ID NO: 508012 - RNA, 64 nt, hsa; identical to SEQ ID NO: 280818

SEQ ID NO: 508013 - RNA, 64 nt, hsa; identical to SEQ ID NO: 280819

SEQ ID NO: 508014 - RNA, 64 nt, hsa; identical to SEQ ID NO: 280820

SEQ ID NO: 508015 - RNA, 64 nt, hsa; identical to SEQ ID NO: 280821

SEQ ID NO: 508016 - RNA, 64 nt, hsa; identical to SEQ ID NO: 280822

SEQ ID NO: 508017 - RNA, 64 nt, hsa; identical to SEQ ID NO: 280823

SEQ ID NO: 508018 - RNA, 64 nt, hsa; identical to SEQ ID NO: 280824

SEQ ID NO: 508019 - RNA, 64 nt, hsa; identical to SEQ ID NO: 280825

SEQ ID NO: 508020 - RNA, 64 nt, hsa; identical to SEQ ID NO: 280826

SEQ ID NO: 508021 - RNA, 64 nt, hsa; identical to SEQ ID NO: 280827

SEQ ID NO: 508022 - RNA, 64 nt, hsa; identical to SEQ ID NO: 280828

SEQ ID NO: 508023 - RNA, 64 nt, hsa; identical to SEQ ID NO: 280829

SEQ ID NO: 508024 - RNA, 64 nt, hsa; identical to SEQ ID NO: 280830

SEQ ID NO: 508025 - RNA, 64 nt, hsa; identical to SEQ ID NO: 280831

SEQ ID NO: 508026 - RNA, 64 nt, hsa; identical to SEQ ID NO: 280832

SEQ ID NO: 508027 - RNA, 64 nt, hsa; identical to SEQ ID NO: 280833

SEQ ID NO: 508028 - RNA, 64 nt, hsa; identical to SEQ ID NO: 280834

SEQ ID NO: 508029 - RNA, 64 nt, hsa; identical to SEQ ID NO: 280835

SEQ ID NO: 508030 - RNA, 64 nt, hsa; identical to SEQ ID NO: 280836

SEQ ID NO: 508031 - RNA, 64 nt, hsa; identical to SEQ ID NO: 280837

SEQ ID NO: 508032 - RNA, 64 nt, hsa; identical to SEQ ID NO: 280838

SEQ ID NO: 508033 - RNA, 64 nt, hsa; identical to SEQ ID NO: 280839

SEQ ID NO: 508034 - RNA, 64 nt, hsa; identical to SEQ ID NO: 280840

SEQ ID NO: 508035 - RNA, 64 nt, hsa; identical to SEQ ID NO: 280841

SEQ ID NO: 508036 - RNA, 58 nt, hsa; identical to SEQ ID NO: 280842

SEQ ID NO: 508037 - RNA, 53 nt, hsa; identical to SEQ ID NO: 280843

SEQ ID NO: 508038 - RNA, 64 nt, hsa; identical to SEQ ID NO: 280820

SEQ ID NO: 508039 - RNA, 64 nt, hsa; identical to SEQ ID NO: 280819

SEQ ID NO: 508040 - RNA, 64 nt, hsa; identical to SEQ ID NO: 280846

SEQ ID NO: 508041 - RNA, 64 nt, hsa; identical to SEQ ID NO: 280847

SEQ ID NO: 508042 - RNA, 64 nt, hsa; identical to SEQ ID NO: 280848

SEQ ID NO: 508043 - RNA, 64 nt, hsa; identical to SEQ ID NO: 280849

SEQ ID NO: 508044 - RNA, 64 nt, hsa; identical to SEQ ID NO: 280850

SEQ ID NO: 508045 - RNA, 64 nt, hsa; identical to SEQ ID NO: 280851

SEQ ID NO: 508046 - RNA, 64 nt, hsa; identical to SEQ ID NO: 280852

SEQ ID NO: 508047 - RNA, 64 nt, hsa; identical to SEQ ID NO: 280853

SEQ ID NO: 508048 - RNA, 64 nt, hsa; identical to SEQ ID NO: 280854

SEQ ID NO: 508049 - RNA, 64 nt, hsa; identical to SEQ ID NO: 280855

SEQ ID NO: 508050 - RNA, 64 nt, hsa; identical to SEQ ID NO: 280856

SEQ ID NO: 508051 - RNA, 64 nt, hsa; identical to SEQ ID NO: 280857

SEQ ID NO: 508052 - RNA, 64 nt, hsa; identical to SEQ ID NO: 280858

SEQ ID NO: 508053 - RNA, 64 nt, hsa; identical to SEQ ID NO: 280859

SEQ ID NO: 508054 - RNA, 64 nt, hsa; identical to SEQ ID NO: 280860

SEQ ID NO: 508055 - RNA, 64 nt, hsa; identical to SEQ ID NO: 280861

SEQ ID NO: 508056 - RNA, 64 nt, hsa; identical to SEQ ID NO: 280862

SEQ ID NO: 508057 - RNA, 64 nt, hsa; identical to SEQ ID NO: 280863

SEQ ID NO: 508058 - RNA, 64 nt, hsa; identical to SEQ ID NO: 280864

SEQ ID NO: 508059 - RNA, 64 nt, hsa; identical to SEQ ID NO: 280865

SEQ ID NO: 508060 - RNA, 64 nt, hsa; identical to SEQ ID NO: 280866

SEQ ID NO: 508061 - RNA, 64 nt, hsa; identical to SEQ ID NO: 280867

SEQ ID NO: 508062 - RNA, 64 nt, hsa; identical to SEQ ID NO: 280868

SEQ ID NO: 508063 - RNA, 64 nt, hsa; identical to SEQ ID NO: 280869

SEQ ID NO: 508064 - RNA, 64 nt, hsa; identical to SEQ ID NO: 280870

SEQ ID NO: 508065 - RNA, 64 nt, hsa; identical to SEQ ID NO: 280871

SEQ ID NO: 508066 - RNA, 64 nt, hsa; identical to SEQ ID NO: 280872

SEQ ID NO: 508067 - RNA, 64 nt, hsa; identical to SEQ ID NO: 280873

SEQ ID NO: 508068 - RNA, 64 nt, hsa; identical to SEQ ID NO: 280874

SEQ ID NO: 508069 - RNA, 64 nt, hsa; identical to SEQ ID NO: 280875

SEQ ID NO: 508070 - RNA, 64 nt, hsa; identical to SEQ ID NO: 280876

SEQ ID NO: 508071 - RNA, 64 nt, hsa; identical to SEQ ID NO: 280877

SEQ ID NO: 508072 - RNA, 64 nt, hsa; identical to SEQ ID NO: 280878

SEQ ID NO: 508073 - RNA, 64 nt, hsa; identical to SEQ ID NO: 280879

SEQ ID NO: 508074 - RNA, 60 nt, hsa; identical to SEQ ID NO: 280880

SEQ ID NO: 508075 - RNA, 64 nt, hsa; identical to SEQ ID NO: 280881

SEQ ID NO: 508076 - RNA, 64 nt, hsa; identical to SEQ ID NO: 280882

SEQ ID NO: 508077 - RNA, 64 nt, hsa; identical to SEQ ID NO: 280883

SEQ ID NO: 508078 - RNA, 64 nt, hsa; identical to SEQ ID NO: 280884

SEQ ID NO: 508079 - RNA, 64 nt, hsa; identical to SEQ ID NO: 280885

SEQ ID NO: 508080 - RNA, 64 nt, hsa; identical to SEQ ID NO: 280886

SEQ ID NO: 508081 - RNA, 64 nt, hsa; identical to SEQ ID NO: 280887

SEQ ID NO: 508082 - RNA, 64 nt, hsa; identical to SEQ ID NO: 280888

SEQ ID NO: 508083 - RNA, 64 nt, hsa; identical to SEQ ID NO: 280889

SEQ ID NO: 508084 - RNA, 64 nt, hsa; identical to SEQ ID NO: 280890

SEQ ID NO: 508085 - RNA, 64 nt, hsa; identical to SEQ ID NO: 280891

SEQ ID NO: 508086 - RNA, 64 nt, hsa; identical to SEQ ID NO: 280892

SEQ ID NO: 508087 - RNA, 64 nt, hsa; identical to SEQ ID NO: 280893

SEQ ID NO: 508088 - RNA, 64 nt, hsa; identical to SEQ ID NO: 280894

SEQ ID NO: 508089 - RNA, 64 nt, hsa; identical to SEQ ID NO: 280895

SEQ ID NO: 508090 - RNA, 64 nt, hsa; identical to SEQ ID NO: 280896

SEQ ID NO: 508091 - RNA, 64 nt, hsa; identical to SEQ ID NO: 280897

SEQ ID NO: 508092 - RNA, 64 nt, hsa; identical to SEQ ID NO: 280898

SEQ ID NO: 508093 - RNA, 64 nt, hsa; identical to SEQ ID NO: 280899

SEQ ID NO: 508094 - RNA, 64 nt, hsa; identical to SEQ ID NO: 280900

SEQ ID NO: 508095 - RNA, 64 nt, hsa; identical to SEQ ID NO: 280901

SEQ ID NO: 508096 - RNA, 64 nt, hsa; identical to SEQ ID NO: 280902

SEQ ID NO: 508097 - RNA, 64 nt, hsa; identical to SEQ ID NO: 280903

SEQ ID NO: 508098 - RNA, 64 nt, hsa; identical to SEQ ID NO: 280904

SEQ ID NO: 508099 - RNA, 64 nt, hsa; identical to SEQ ID NO: 280905

SEQ ID NO: 508100 - RNA, 64 nt, hsa; identical to SEQ ID NO: 280906

SEQ ID NO: 508101 - RNA, 64 nt, hsa; identical to SEQ ID NO: 280907

SEQ ID NO: 508102 - RNA, 64 nt, hsa; identical to SEQ ID NO: 280908

SEQ ID NO: 508103 - RNA, 64 nt, hsa; identical to SEQ ID NO: 280909

SEQ ID NO: 508104 - RNA, 64 nt, hsa; identical to SEQ ID NO: 280910

SEQ ID NO: 508105 - RNA, 64 nt, hsa; identical to SEQ ID NO: 280911

SEQ ID NO: 508106 - RNA, 64 nt, hsa; identical to SEQ ID NO: 280912

SEQ ID NO: 508107 - RNA, 64 nt, hsa; identical to SEQ ID NO: 280913

SEQ ID NO: 508108 - RNA, 64 nt, hsa; identical to SEQ ID NO: 280914

SEQ ID NO: 508109 - RNA, 64 nt, hsa; identical to SEQ ID NO: 280915

SEQ ID NO: 508110 - RNA, 64 nt, hsa; identical to SEQ ID NO: 280916

SEQ ID NO: 508111 - RNA, 64 nt, hsa; identical to SEQ ID NO: 280917

SEQ ID NO: 508112 - RNA, 64 nt, hsa; identical to SEQ ID NO: 280918

SEQ ID NO: 508113 - RNA, 64 nt, hsa; identical to SEQ ID NO: 280919

SEQ ID NO: 508114 - RNA, 64 nt, hsa; identical to SEQ ID NO: 280920

SEQ ID NO: 508115 - RNA, 64 nt, hsa; identical to SEQ ID NO: 280921

SEQ ID NO: 508116 - RNA, 64 nt, hsa; identical to SEQ ID NO: 280922

SEQ ID NO: 508117 - RNA, 64 nt, hsa; identical to SEQ ID NO: 280923

SEQ ID NO: 508118 - RNA, 64 nt, hsa; identical to SEQ ID NO: 280924

SEQ ID NO: 508119 - RNA, 64 nt, hsa; identical to SEQ ID NO: 280925

SEQ ID NO: 508120 - RNA, 64 nt, hsa; identical to SEQ ID NO: 280926

SEQ ID NO: 508121 - RNA, 64 nt, hsa; identical to SEQ ID NO: 280927

SEQ ID NO: 508122 - RNA, 64 nt, hsa; identical to SEQ ID NO: 280928

SEQ ID NO: 508123 - RNA, 64 nt, hsa; identical to SEQ ID NO: 280929

SEQ ID NO: 508124 - RNA, 64 nt, hsa; identical to SEQ ID NO: 280930

SEQ ID NO: 508125 - RNA, 64 nt, hsa; identical to SEQ ID NO: 280931

SEQ ID NO: 508126 - RNA, 64 nt, hsa; identical to SEQ ID NO: 280932

SEQ ID NO: 508127 - RNA, 64 nt, hsa; identical to SEQ ID NO: 280933

SEQ ID NO: 508128 - RNA, 64 nt, hsa; identical to SEQ ID NO: 280934

SEQ ID NO: 508129 - RNA, 64 nt, hsa; identical to SEQ ID NO: 280935

SEQ ID NO: 508130 - RNA, 64 nt, hsa; identical to SEQ ID NO: 280936

SEQ ID NO: 508131 - RNA, 64 nt, hsa; identical to SEQ ID NO: 280937

SEQ ID NO: 508132 - RNA, 64 nt, hsa; identical to SEQ ID NO: 280938

SEQ ID NO: 508133 - RNA, 64 nt, hsa; identical to SEQ ID NO: 280939

SEQ ID NO: 508134 - RNA, 64 nt, hsa; identical to SEQ ID NO: 280940

SEQ ID NO: 508135 - RNA, 64 nt, hsa; identical to SEQ ID NO: 280941

SEQ ID NO: 508136 - RNA, 64 nt, hsa; identical to SEQ ID NO: 280942

SEQ ID NO: 508137 - RNA, 64 nt, hsa; identical to SEQ ID NO: 280943

SEQ ID NO: 508138 - RNA, 64 nt, hsa; identical to SEQ ID NO: 280944

SEQ ID NO: 508139 - RNA, 64 nt, hsa; identical to SEQ ID NO: 280945

SEQ ID NO: 508140 - RNA, 64 nt, hsa; identical to SEQ ID NO: 280946

SEQ ID NO: 508141 - RNA, 64 nt, hsa; identical to SEQ ID NO: 280947

SEQ ID NO: 508142 - RNA, 64 nt, hsa; identical to SEQ ID NO: 280948

SEQ ID NO: 508143 - RNA, 64 nt, hsa; identical to SEQ ID NO: 280949

SEQ ID NO: 508144 - RNA, 64 nt, hsa; identical to SEQ ID NO: 280950

SEQ ID NO: 508145 - RNA, 64 nt, hsa; identical to SEQ ID NO: 280951

SEQ ID NO: 508146 - RNA, 64 nt, hsa; identical to SEQ ID NO: 280952

SEQ ID NO: 508147 - RNA, 64 nt, hsa; identical to SEQ ID NO: 280953

SEQ ID NO: 508148 - RNA, 64 nt, hsa; identical to SEQ ID NO: 280954

SEQ ID NO: 508149 - RNA, 64 nt, hsa; identical to SEQ ID NO: 280955

SEQ ID NO: 508150 - RNA, 64 nt, hsa; identical to SEQ ID NO: 280956

SEQ ID NO: 508151 - RNA, 64 nt, hsa; identical to SEQ ID NO: 280957

SEQ ID NO: 508152 - RNA, 64 nt, hsa; identical to SEQ ID NO: 280958

SEQ ID NO: 508153 - RNA, 64 nt, hsa; identical to SEQ ID NO: 280959

SEQ ID NO: 508154 - RNA, 64 nt, hsa; identical to SEQ ID NO: 280960

SEQ ID NO: 508155 - RNA, 64 nt, hsa; identical to SEQ ID NO: 280961

SEQ ID NO: 508156 - RNA, 64 nt, hsa; identical to SEQ ID NO: 280962

SEQ ID NO: 508157 - RNA, 64 nt, hsa; identical to SEQ ID NO: 280963

SEQ ID NO: 508158 - RNA, 64 nt, hsa; identical to SEQ ID NO: 280964

SEQ ID NO: 508159 - RNA, 64 nt, hsa; identical to SEQ ID NO: 280965

SEQ ID NO: 508160 - RNA, 64 nt, hsa; identical to SEQ ID NO: 280966

SEQ ID NO: 508161 - RNA, 64 nt, hsa; identical to SEQ ID NO: 280967

SEQ ID NO: 508162 - RNA, 64 nt, hsa; identical to SEQ ID NO: 280968

SEQ ID NO: 508163 - RNA, 64 nt, hsa; identical to SEQ ID NO: 280969

SEQ ID NO: 508164 - RNA, 64 nt, hsa; identical to SEQ ID NO: 280970

SEQ ID NO: 508165 - RNA, 64 nt, hsa; identical to SEQ ID NO: 280971

SEQ ID NO: 508166 - RNA, 64 nt, hsa; identical to SEQ ID NO: 280972

SEQ ID NO: 508167 - RNA, 64 nt, hsa; identical to SEQ ID NO: 280973

SEQ ID NO: 508168 - RNA, 64 nt, hsa; identical to SEQ ID NO: 280974

SEQ ID NO: 508169 - RNA, 64 nt, hsa; identical to SEQ ID NO: 280975

SEQ ID NO: 508170 - RNA, 64 nt, hsa; identical to SEQ ID NO: 280976

SEQ ID NO: 508171 - RNA, 64 nt, hsa; identical to SEQ ID NO: 280977

SEQ ID NO: 508172 - RNA, 64 nt, hsa; identical to SEQ ID NO: 280978

SEQ ID NO: 508173 - RNA, 64 nt, hsa; identical to SEQ ID NO: 280979

SEQ ID NO: 508174 - RNA, 64 nt, hsa; identical to SEQ ID NO: 280980

SEQ ID NO: 508175 - RNA, 64 nt, hsa; identical to SEQ ID NO: 280981

SEQ ID NO: 508176 - RNA, 64 nt, hsa; identical to SEQ ID NO: 280982

SEQ ID NO: 508177 - RNA, 64 nt, hsa; identical to SEQ ID NO: 280983

SEQ ID NO: 508178 - RNA, 64 nt, hsa; identical to SEQ ID NO: 280984

SEQ ID NO: 508179 - RNA, 64 nt, hsa; identical to SEQ ID NO: 280985

SEQ ID NO: 508180 - RNA, 64 nt, hsa; identical to SEQ ID NO: 280986

SEQ ID NO: 508181 - RNA, 64 nt, hsa; identical to SEQ ID NO: 280987

SEQ ID NO: 508182 - RNA, 64 nt, hsa; identical to SEQ ID NO: 280988

SEQ ID NO: 508183 - RNA, 64 nt, hsa; identical to SEQ ID NO: 280989

SEQ ID NO: 508184 - RNA, 64 nt, hsa; identical to SEQ ID NO: 280990

SEQ ID NO: 508185 - RNA, 64 nt, hsa; identical to SEQ ID NO: 280991

SEQ ID NO: 508186 - RNA, 64 nt, hsa; identical to SEQ ID NO: 280992

SEQ ID NO: 508187 - RNA, 64 nt, hsa; identical to SEQ ID NO: 280993

SEQ ID NO: 508188 - RNA, 64 nt, hsa; identical to SEQ ID NO: 280994

SEQ ID NO: 508189 - RNA, 64 nt, hsa; identical to SEQ ID NO: 280995

SEQ ID NO: 508190 - RNA, 64 nt, hsa; identical to SEQ ID NO: 280996

SEQ ID NO: 508191 - RNA, 64 nt, hsa; identical to SEQ ID NO: 280997

SEQ ID NO: 508192 - RNA, 64 nt, hsa; identical to SEQ ID NO: 280998

SEQ ID NO: 508193 - RNA, 64 nt, hsa; identical to SEQ ID NO: 280999

SEQ ID NO: 508194 - RNA, 64 nt, hsa; identical to SEQ ID NO: 281000

SEQ ID NO: 508195 - RNA, 64 nt, hsa; identical to SEQ ID NO: 281001

SEQ ID NO: 508196 - RNA, 64 nt, hsa; identical to SEQ ID NO: 281002

SEQ ID NO: 508197 - RNA, 64 nt, hsa; identical to SEQ ID NO: 281003

SEQ ID NO: 508198 - RNA, 64 nt, hsa; identical to SEQ ID NO: 281004

SEQ ID NO: 508199 - RNA, 64 nt, hsa; identical to SEQ ID NO: 281005

SEQ ID NO: 508200 - RNA, 64 nt, hsa; identical to SEQ ID NO: 281006

SEQ ID NO: 508201 - RNA, 64 nt, hsa; identical to SEQ ID NO: 281007

SEQ ID NO: 508202 - RNA, 64 nt, hsa; identical to SEQ ID NO: 281008

SEQ ID NO: 508203 - RNA, 64 nt, hsa; identical to SEQ ID NO: 281009

SEQ ID NO: 508204 - RNA, 64 nt, hsa; identical to SEQ ID NO: 281010

SEQ ID NO: 508205 - RNA, 64 nt, hsa; identical to SEQ ID NO: 281011

SEQ ID NO: 508206 - RNA, 64 nt, hsa; identical to SEQ ID NO: 281012

SEQ ID NO: 508207 - RNA, 64 nt, hsa; identical to SEQ ID NO: 281013

SEQ ID NO: 508208 - RNA, 64 nt, hsa; identical to SEQ ID NO: 281014

SEQ ID NO: 508209 - RNA, 64 nt, hsa; identical to SEQ ID NO: 281015

SEQ ID NO: 508210 - RNA, 64 nt, hsa; identical to SEQ ID NO: 281016

SEQ ID NO: 508211 - RNA, 64 nt, hsa; identical to SEQ ID NO: 281017

SEQ ID NO: 508212 - RNA, 64 nt, hsa; identical to SEQ ID NO: 281018

SEQ ID NO: 508213 - RNA, 64 nt, hsa; identical to SEQ ID NO: 281019

SEQ ID NO: 508214 - RNA, 64 nt, hsa; identical to SEQ ID NO: 281020

SEQ ID NO: 508215 - RNA, 64 nt, hsa; identical to SEQ ID NO: 281021

SEQ ID NO: 508216 - RNA, 64 nt, hsa; identical to SEQ ID NO: 281022

SEQ ID NO: 508217 - RNA, 64 nt, hsa; identical to SEQ ID NO: 281023

SEQ ID NO: 508218 - RNA, 64 nt, hsa; identical to SEQ ID NO: 281024

SEQ ID NO: 508219 - RNA, 64 nt, hsa; identical to SEQ ID NO: 281025

SEQ ID NO: 508220 - RNA, 64 nt, hsa; identical to SEQ ID NO: 281026

SEQ ID NO: 508221 - RNA, 64 nt, hsa; identical to SEQ ID NO: 281027

SEQ ID NO: 508222 - RNA, 64 nt, hsa; identical to SEQ ID NO: 281028

SEQ ID NO: 508223 - RNA, 64 nt, hsa; identical to SEQ ID NO: 281029

SEQ ID NO: 508224 - RNA, 64 nt, hsa; identical to SEQ ID NO: 281030

SEQ ID NO: 508225 - RNA, 64 nt, hsa; identical to SEQ ID NO: 281031

SEQ ID NO: 508226 - RNA, 64 nt, hsa; identical to SEQ ID NO: 281032

SEQ ID NO: 508227 - RNA, 64 nt, hsa; identical to SEQ ID NO: 281033

SEQ ID NO: 508228 - RNA, 64 nt, hsa; identical to SEQ ID NO: 281034

SEQ ID NO: 508229 - RNA, 64 nt, hsa; identical to SEQ ID NO: 281035

SEQ ID NO: 508230 - RNA, 64 nt, hsa; identical to SEQ ID NO: 281036

SEQ ID NO: 508231 - RNA, 64 nt, hsa; identical to SEQ ID NO: 281037

SEQ ID NO: 508232 - RNA, 64 nt, hsa; identical to SEQ ID NO: 281038

SEQ ID NO: 508233 - RNA, 64 nt, hsa; identical to SEQ ID NO: 281039

SEQ ID NO: 508234 - RNA, 64 nt, hsa; identical to SEQ ID NO: 281040

SEQ ID NO: 508235 - RNA, 64 nt, hsa; identical to SEQ ID NO: 281041

SEQ ID NO: 508236 - RNA, 64 nt, hsa; identical to SEQ ID NO: 281042

SEQ ID NO: 508237 - RNA, 64 nt, hsa; identical to SEQ ID NO: 281043

SEQ ID NO: 508238 - RNA, 64 nt, hsa; identical to SEQ ID NO: 281044

SEQ ID NO: 508239 - RNA, 64 nt, hsa; identical to SEQ ID NO: 281045

SEQ ID NO: 508240 - RNA, 64 nt, hsa; identical to SEQ ID NO: 281046

SEQ ID NO: 508241 - RNA, 64 nt, hsa; identical to SEQ ID NO: 281047

SEQ ID NO: 508242 - RNA, 64 nt, hsa; identical to SEQ ID NO: 281048

SEQ ID NO: 508243 - RNA, 64 nt, hsa; identical to SEQ ID NO: 281049

SEQ ID NO: 508244 - RNA, 64 nt, hsa; identical to SEQ ID NO: 281050

SEQ ID NO: 508245 - RNA, 64 nt, hsa; identical to SEQ ID NO: 281051

SEQ ID NO: 508246 - RNA, 64 nt, hsa; identical to SEQ ID NO: 281052

SEQ ID NO: 508247 - RNA, 64 nt, hsa; identical to SEQ ID NO: 281053

SEQ ID NO: 508248 - RNA, 64 nt, hsa; identical to SEQ ID NO: 281054

SEQ ID NO: 508249 - RNA, 64 nt, hsa; identical to SEQ ID NO: 281055

SEQ ID NO: 508250 - RNA, 64 nt, hsa; identical to SEQ ID NO: 281056

SEQ ID NO: 508251 - RNA, 64 nt, hsa; identical to SEQ ID NO: 281057

SEQ ID NO: 508252 - RNA, 64 nt, hsa; identical to SEQ ID NO: 281058

SEQ ID NO: 508253 - RNA, 64 nt, hsa; identical to SEQ ID NO: 281059

SEQ ID NO: 508254 - RNA, 64 nt, hsa; identical to SEQ ID NO: 281060

SEQ ID NO: 508255 - RNA, 64 nt, hsa; identical to SEQ ID NO: 281061

SEQ ID NO: 508256 - RNA, 64 nt, hsa; identical to SEQ ID NO: 281062

SEQ ID NO: 508257 - RNA, 64 nt, hsa; identical to SEQ ID NO: 281063

SEQ ID NO: 508258 - RNA, 64 nt, hsa; identical to SEQ ID NO: 281064

SEQ ID NO: 508259 - RNA, 64 nt, hsa; identical to SEQ ID NO: 281065

SEQ ID NO: 508260 - RNA, 64 nt, hsa; identical to SEQ ID NO: 281066

SEQ ID NO: 508261 - RNA, 64 nt, hsa; identical to SEQ ID NO: 281067

SEQ ID NO: 508262 - RNA, 64 nt, hsa; identical to SEQ ID NO: 281068

SEQ ID NO: 508263 - RNA, 64 nt, hsa; identical to SEQ ID NO: 281069

SEQ ID NO: 508264 - RNA, 64 nt, hsa; identical to SEQ ID NO: 281070

SEQ ID NO: 508265 - RNA, 64 nt, hsa; identical to SEQ ID NO: 281071

SEQ ID NO: 508266 - RNA, 64 nt, hsa; identical to SEQ ID NO: 281072

SEQ ID NO: 508267 - RNA, 64 nt, hsa; identical to SEQ ID NO: 281073

SEQ ID NO: 508268 - RNA, 64 nt, hsa; identical to SEQ ID NO: 281074

SEQ ID NO: 508269 - RNA, 64 nt, hsa; identical to SEQ ID NO: 281075

SEQ ID NO: 508270 - RNA, 64 nt, hsa; identical to SEQ ID NO: 281076

SEQ ID NO: 508271 - RNA, 64 nt, hsa; identical to SEQ ID NO: 281077

SEQ ID NO: 508272 - RNA, 64 nt, hsa; identical to SEQ ID NO: 281078

SEQ ID NO: 508273 - RNA, 64 nt, hsa; identical to SEQ ID NO: 281079

SEQ ID NO: 508274 - RNA, 64 nt, hsa; identical to SEQ ID NO: 281080

SEQ ID NO: 508275 - RNA, 64 nt, hsa; identical to SEQ ID NO: 281081

SEQ ID NO: 508276 - RNA, 64 nt, hsa; identical to SEQ ID NO: 281082

SEQ ID NO: 508277 - RNA, 64 nt, hsa; identical to SEQ ID NO: 281083

SEQ ID NO: 508278 - RNA, 64 nt, hsa; identical to SEQ ID NO: 281084

SEQ ID NO: 508279 - RNA, 64 nt, hsa; identical to SEQ ID NO: 281085

SEQ ID NO: 508280 - RNA, 64 nt, hsa; identical to SEQ ID NO: 281086

SEQ ID NO: 508281 - RNA, 64 nt, hsa; identical to SEQ ID NO: 281087

SEQ ID NO: 508282 - RNA, 64 nt, hsa; identical to SEQ ID NO: 281088

SEQ ID NO: 508283 - RNA, 64 nt, hsa; identical to SEQ ID NO: 281089

SEQ ID NO: 508284 - RNA, 64 nt, hsa; identical to SEQ ID NO: 281090

SEQ ID NO: 508285 - RNA, 64 nt, hsa; identical to SEQ ID NO: 281091

SEQ ID NO: 508286 - RNA, 64 nt, hsa; identical to SEQ ID NO: 281092

SEQ ID NO: 508287 - RNA, 64 nt, hsa; identical to SEQ ID NO: 281093

SEQ ID NO: 508288 - RNA, 64 nt, hsa; identical to SEQ ID NO: 281094

SEQ ID NO: 508289 - RNA, 64 nt, hsa; identical to SEQ ID NO: 281095

SEQ ID NO: 508290 - RNA, 64 nt, hsa; identical to SEQ ID NO: 281096

SEQ ID NO: 508291 - RNA, 64 nt, hsa; identical to SEQ ID NO: 281097

SEQ ID NO: 508292 - RNA, 64 nt, hsa; identical to SEQ ID NO: 281098

SEQ ID NO: 508293 - RNA, 64 nt, hsa; identical to SEQ ID NO: 281099

SEQ ID NO: 508294 - RNA, 64 nt, hsa; identical to SEQ ID NO: 281100

SEQ ID NO: 508295 - RNA, 64 nt, hsa; identical to SEQ ID NO: 281101

SEQ ID NO: 508296 - RNA, 64 nt, hsa; identical to SEQ ID NO: 281102

SEQ ID NO: 508297 - RNA, 64 nt, hsa; identical to SEQ ID NO: 281103

SEQ ID NO: 508298 - RNA, 64 nt, hsa; identical to SEQ ID NO: 265473

SEQ ID NO: 508299 - RNA, 64 nt, hsa; identical to SEQ ID NO: 265474

SEQ ID NO: 508300 - RNA, 64 nt, hsa; identical to SEQ ID NO: 265475

SEQ ID NO: 508301 - RNA, 64 nt, hsa; identical to SEQ ID NO: 265476

SEQ ID NO: 508302 - RNA, 64 nt, hsa; identical to SEQ ID NO: 265477

SEQ ID NO: 508303 - RNA, 64 nt, hsa; identical to SEQ ID NO: 265478

SEQ ID NO: 508304 - RNA, 64 nt, hsa; identical to SEQ ID NO: 265479

SEQ ID NO: 508305 - RNA, 64 nt, hsa; identical to SEQ ID NO: 265480

SEQ ID NO: 508306 - RNA, 64 nt, hsa; identical to SEQ ID NO: 265481

SEQ ID NO: 508307 - RNA, 60 nt, hsa; identical to SEQ ID NO: 265482

SEQ ID NO: 508308 - RNA, 64 nt, hsa; identical to SEQ ID NO: 265483

SEQ ID NO: 508309 - RNA, 64 nt, hsa; identical to SEQ ID NO: 265484

SEQ ID NO: 508310 - RNA, 64 nt, hsa; identical to SEQ ID NO: 265485

SEQ ID NO: 508311 - RNA, 64 nt, hsa; identical to SEQ ID NO: 265486

SEQ ID NO: 508312 - RNA, 64 nt, hsa; identical to SEQ ID NO: 265487

SEQ ID NO: 508313 - RNA, 64 nt, hsa; identical to SEQ ID NO: 265488

SEQ ID NO: 508314 - RNA, 64 nt, hsa; identical to SEQ ID NO: 265489

SEQ ID NO: 508315 - RNA, 64 nt, hsa; identical to SEQ ID NO: 265490

SEQ ID NO: 508316 - RNA, 64 nt, hsa; identical to SEQ ID NO: 265491

SEQ ID NO: 508317 - RNA, 64 nt, hsa; identical to SEQ ID NO: 265492

SEQ ID NO: 508318 - RNA, 64 nt, hsa; identical to SEQ ID NO: 265493

SEQ ID NO: 508319 - RNA, 64 nt, hsa; identical to SEQ ID NO: 265494

SEQ ID NO: 508320 - RNA, 64 nt, hsa; identical to SEQ ID NO: 265495

SEQ ID NO: 508321 - RNA, 64 nt, hsa; identical to SEQ ID NO: 265496

SEQ ID NO: 508322 - RNA, 64 nt, hsa; identical to SEQ ID NO: 265497

SEQ ID NO: 508323 - RNA, 64 nt, hsa; identical to SEQ ID NO: 265498

SEQ ID NO: 508324 - RNA, 64 nt, hsa; identical to SEQ ID NO: 265499

SEQ ID NO: 508325 - RNA, 64 nt, hsa; identical to SEQ ID NO: 265500

SEQ ID NO: 508326 - RNA, 64 nt, hsa; identical to SEQ ID NO: 265501

SEQ ID NO: 508327 - RNA, 64 nt, hsa; identical to SEQ ID NO: 265502

SEQ ID NO: 508328 - RNA, 64 nt, hsa; identical to SEQ ID NO: 265503

SEQ ID NO: 508329 - RNA, 64 nt, hsa; identical to SEQ ID NO: 265504

SEQ ID NO: 508330 - RNA, 64 nt, hsa; identical to SEQ ID NO: 265505

SEQ ID NO: 508331 - RNA, 64 nt, hsa; identical to SEQ ID NO: 265506

SEQ ID NO: 508332 - RNA, 64 nt, hsa; identical to SEQ ID NO: 265507

SEQ ID NO: 508333 - RNA, 64 nt, hsa; identical to SEQ ID NO: 265508

SEQ ID NO: 508334 - RNA, 64 nt, hsa; identical to SEQ ID NO: 265509

SEQ ID NO: 508335 - RNA, 64 nt, hsa; identical to SEQ ID NO: 265510

SEQ ID NO: 508336 - RNA, 64 nt, hsa; identical to SEQ ID NO: 265511

SEQ ID NO: 508337 - RNA, 64 nt, hsa; identical to SEQ ID NO: 265512

SEQ ID NO: 508338 - RNA, 64 nt, hsa; identical to SEQ ID NO: 265513

SEQ ID NO: 508339 - RNA, 64 nt, hsa; identical to SEQ ID NO: 265514

SEQ ID NO: 508340 - RNA, 64 nt, hsa; identical to SEQ ID NO: 265515

SEQ ID NO: 508341 - RNA, 64 nt, hsa; identical to SEQ ID NO: 265516

SEQ ID NO: 508342 - RNA, 64 nt, hsa; identical to SEQ ID NO: 265517

SEQ ID NO: 508343 - RNA, 64 nt, hsa; identical to SEQ ID NO: 265518

SEQ ID NO: 508344 - RNA, 64 nt, hsa; identical to SEQ ID NO: 265519

SEQ ID NO: 508345 - RNA, 64 nt, hsa; identical to SEQ ID NO: 265520

SEQ ID NO: 508346 - RNA, 64 nt, hsa; identical to SEQ ID NO: 265521

SEQ ID NO: 508347 - RNA, 64 nt, hsa; identical to SEQ ID NO: 265522

SEQ ID NO: 508348 - RNA, 64 nt, hsa; identical to SEQ ID NO: 265523

SEQ ID NO: 508349 - RNA, 64 nt, hsa; identical to SEQ ID NO: 265524

SEQ ID NO: 508350 - RNA, 64 nt, hsa; identical to SEQ ID NO: 265525

SEQ ID NO: 508351 - RNA, 64 nt, hsa; identical to SEQ ID NO: 265526

SEQ ID NO: 508352 - RNA, 64 nt, hsa; identical to SEQ ID NO: 265527

SEQ ID NO: 508353 - RNA, 64 nt, hsa; identical to SEQ ID NO: 265528

SEQ ID NO: 508354 - RNA, 64 nt, hsa; identical to SEQ ID NO: 265529

SEQ ID NO: 508355 - RNA, 64 nt, hsa; identical to SEQ ID NO: 265530

SEQ ID NO: 508356 - RNA, 64 nt, hsa; identical to SEQ ID NO: 265531

SEQ ID NO: 508357 - RNA, 64 nt, hsa; identical to SEQ ID NO: 265532

SEQ ID NO: 508358 - RNA, 64 nt, hsa; identical to SEQ ID NO: 265533

SEQ ID NO: 508359 - RNA, 64 nt, hsa; identical to SEQ ID NO: 265534

SEQ ID NO: 508360 - RNA, 64 nt, hsa; identical to SEQ ID NO: 265535

SEQ ID NO: 508361 - RNA, 64 nt, hsa; identical to SEQ ID NO: 265536

SEQ ID NO: 508362 - RNA, 64 nt, hsa; identical to SEQ ID NO: 265537

SEQ ID NO: 508363 - RNA, 64 nt, hsa; identical to SEQ ID NO: 265538

SEQ ID NO: 508364 - RNA, 64 nt, hsa; identical to SEQ ID NO: 265539

SEQ ID NO: 508365 - RNA, 64 nt, hsa; identical to SEQ ID NO: 265540

SEQ ID NO: 508366 - RNA, 64 nt, hsa; identical to SEQ ID NO: 265541

SEQ ID NO: 508367 - RNA, 64 nt, hsa; identical to SEQ ID NO: 265542

SEQ ID NO: 508368 - RNA, 64 nt, hsa; identical to SEQ ID NO: 265543

SEQ ID NO: 508369 - RNA, 64 nt, hsa; identical to SEQ ID NO: 265544

SEQ ID NO: 508370 - RNA, 64 nt, hsa; identical to SEQ ID NO: 265545

SEQ ID NO: 508371 - RNA, 64 nt, hsa; identical to SEQ ID NO: 265546

SEQ ID NO: 508372 - RNA, 64 nt, hsa; identical to SEQ ID NO: 265547

SEQ ID NO: 508373 - RNA, 64 nt, hsa; identical to SEQ ID NO: 265548

SEQ ID NO: 508374 - RNA, 64 nt, hsa; identical to SEQ ID NO: 265549

SEQ ID NO: 508375 - RNA, 64 nt, hsa; identical to SEQ ID NO: 265550

SEQ ID NO: 508376 - RNA, 64 nt, hsa; identical to SEQ ID NO: 265551

SEQ ID NO: 508377 - RNA, 64 nt, hsa; identical to SEQ ID NO: 265552

SEQ ID NO: 508378 - RNA, 64 nt, hsa; identical to SEQ ID NO: 265553

SEQ ID NO: 508379 - RNA, 64 nt, hsa; identical to SEQ ID NO: 265554

SEQ ID NO: 508380 - RNA, 64 nt, hsa; identical to SEQ ID NO: 265555

SEQ ID NO: 508381 - RNA, 64 nt, hsa; identical to SEQ ID NO: 265556

SEQ ID NO: 508382 - RNA, 64 nt, hsa; identical to SEQ ID NO: 265557

SEQ ID NO: 508383 - RNA, 64 nt, hsa; identical to SEQ ID NO: 265558

SEQ ID NO: 508384 - RNA, 64 nt, hsa; identical to SEQ ID NO: 265559

SEQ ID NO: 508385 - RNA, 64 nt, hsa; identical to SEQ ID NO: 265560

SEQ ID NO: 508386 - RNA, 64 nt, hsa; identical to SEQ ID NO: 265561

SEQ ID NO: 508387 - RNA, 64 nt, hsa; identical to SEQ ID NO: 265562

SEQ ID NO: 508388 - RNA, 64 nt, hsa; identical to SEQ ID NO: 265563

SEQ ID NO: 508389 - RNA, 64 nt, hsa; identical to SEQ ID NO: 265564

SEQ ID NO: 508390 - RNA, 64 nt, hsa; identical to SEQ ID NO: 265565

SEQ ID NO: 508391 - RNA, 64 nt, hsa; identical to SEQ ID NO: 265566

SEQ ID NO: 508392 - RNA, 64 nt, hsa; identical to SEQ ID NO: 265567

SEQ ID NO: 508393 - RNA, 64 nt, hsa; identical to SEQ ID NO: 265568

SEQ ID NO: 508394 - RNA, 64 nt, hsa; identical to SEQ ID NO: 265569

SEQ ID NO: 508395 - RNA, 64 nt, hsa; identical to SEQ ID NO: 265570

SEQ ID NO: 508396 - RNA, 64 nt, hsa; identical to SEQ ID NO: 265571

SEQ ID NO: 508397 - RNA, 64 nt, hsa; identical to SEQ ID NO: 265572

SEQ ID NO: 508398 - RNA, 64 nt, hsa; identical to SEQ ID NO: 265573

SEQ ID NO: 508399 - RNA, 64 nt, hsa; identical to SEQ ID NO: 265574

SEQ ID NO: 508400 - RNA, 64 nt, hsa
acauaucauguagcuucugaaaaacuccacuguacacuuauagaaugaagaaggcaaaaaacuu

SEQ ID NO: 508401 - RNA, 64 nt, hsa
acugaguggcuggaaugcuuuuuuuuuuuucuuucacuuauauaagggauaauuuuucuuuuuu

SEQ ID NO: 508402 - RNA, 64 nt, hsa
gacaguaaccauuucaguguauuguuuauuauaccacuuauaucaacuuauuuuucaccagguu

SEQ ID NO: 508403 - RNA, 64 nt, hsa
auguuccuuuauuuaggaaacaccauuauaaaaacacuuauaguaaauggggacauucacuaua

SEQ ID NO: 508404 - RNA, 64 nt, hsa; identical to SEQ ID NO: 99376

SEQ ID NO: 508405 - RNA, 64 nt, hsa; identical to SEQ ID NO: 99377

SEQ ID NO: 508406 - RNA, 64 nt, hsa; identical to SEQ ID NO: 99378

SEQ ID NO: 508407 - RNA, 64 nt, hsa; identical to SEQ ID NO: 99379

SEQ ID NO: 508408 - RNA, 64 nt, hsa; identical to SEQ ID NO: 99380

SEQ ID NO: 508409 - RNA, 64 nt, hsa; identical to SEQ ID NO: 99381

SEQ ID NO: 508410 - RNA, 64 nt, hsa; identical to SEQ ID NO: 99382

SEQ ID NO: 508411 - RNA, 64 nt, hsa; identical to SEQ ID NO: 99383

SEQ ID NO: 508412 - RNA, 64 nt, hsa; identical to SEQ ID NO: 99384

SEQ ID NO: 508413 - RNA, 64 nt, hsa; identical to SEQ ID NO: 99385

SEQ ID NO: 508414 - RNA, 64 nt, hsa; identical to SEQ ID NO: 99386

SEQ ID NO: 508415 - RNA, 64 nt, hsa; identical to SEQ ID NO: 99387

SEQ ID NO: 508416 - RNA, 64 nt, hsa; identical to SEQ ID NO: 99388

SEQ ID NO: 508417 - RNA, 64 nt, hsa; identical to SEQ ID NO: 99389

SEQ ID NO: 508418 - RNA, 64 nt, hsa; identical to SEQ ID NO: 99390

SEQ ID NO: 508419 - RNA, 64 nt, hsa; identical to SEQ ID NO: 99391

SEQ ID NO: 508420 - RNA, 64 nt, hsa; identical to SEQ ID NO: 99392

SEQ ID NO: 508421 - RNA, 64 nt, hsa; identical to SEQ ID NO: 99393

SEQ ID NO: 508422 - RNA, 64 nt, hsa; identical to SEQ ID NO: 99394

SEQ ID NO: 508423 - RNA, 64 nt, hsa; identical to SEQ ID NO: 99395

SEQ ID NO: 508424 - RNA, 64 nt, hsa; identical to SEQ ID NO: 99396

SEQ ID NO: 508425 - RNA, 64 nt, hsa; identical to SEQ ID NO: 99397

SEQ ID NO: 508426 - RNA, 64 nt, hsa; identical to SEQ ID NO: 99398

SEQ ID NO: 508427 - RNA, 64 nt, hsa; identical to SEQ ID NO: 99399

SEQ ID NO: 508428 - RNA, 64 nt, hsa; identical to SEQ ID NO: 99400

SEQ ID NO: 508429 - RNA, 64 nt, hsa; identical to SEQ ID NO: 99401

SEQ ID NO: 508430 - RNA, 64 nt, hsa; identical to SEQ ID NO: 99402

SEQ ID NO: 508431 - RNA, 64 nt, hsa; identical to SEQ ID NO: 99403

SEQ ID NO: 508432 - RNA, 64 nt, hsa; identical to SEQ ID NO: 99404

SEQ ID NO: 508433 - RNA, 64 nt, hsa; identical to SEQ ID NO: 99405

SEQ ID NO: 508434 - RNA, 64 nt, hsa; identical to SEQ ID NO: 99406

SEQ ID NO: 508435 - RNA, 64 nt, hsa; identical to SEQ ID NO: 99407

SEQ ID NO: 508436 - RNA, 64 nt, hsa; identical to SEQ ID NO: 99408

SEQ ID NO: 508437 - RNA, 64 nt, hsa; identical to SEQ ID NO: 99409

SEQ ID NO: 508438 - RNA, 64 nt, hsa; identical to SEQ ID NO: 99410

SEQ ID NO: 508439 - RNA, 64 nt, hsa; identical to SEQ ID NO: 99411

SEQ ID NO: 508440 - RNA, 64 nt, hsa; identical to SEQ ID NO: 99412

SEQ ID NO: 508441 - RNA, 64 nt, hsa; identical to SEQ ID NO: 99413

SEQ ID NO: 508442 - RNA, 64 nt, hsa; identical to SEQ ID NO: 99414

SEQ ID NO: 508443 - RNA, 64 nt, hsa; identical to SEQ ID NO: 99415

SEQ ID NO: 508444 - RNA, 64 nt, hsa; identical to SEQ ID NO: 99416

SEQ ID NO: 508445 - RNA, 64 nt, hsa; identical to SEQ ID NO: 99417

SEQ ID NO: 508446 - RNA, 64 nt, hsa; identical to SEQ ID NO: 99418

SEQ ID NO: 508447 - RNA, 64 nt, hsa; identical to SEQ ID NO: 99419

SEQ ID NO: 508448 - RNA, 64 nt, hsa; identical to SEQ ID NO: 99420

SEQ ID NO: 508449 - RNA, 64 nt, hsa; identical to SEQ ID NO: 99421

SEQ ID NO: 508450 - RNA, 64 nt, hsa; identical to SEQ ID NO: 99422

SEQ ID NO: 508451 - RNA, 64 nt, hsa; identical to SEQ ID NO: 99423

SEQ ID NO: 508452 - RNA, 64 nt, hsa; identical to SEQ ID NO: 99424

SEQ ID NO: 508453 - RNA, 64 nt, hsa; identical to SEQ ID NO: 99425

SEQ ID NO: 508454 - RNA, 64 nt, hsa; identical to SEQ ID NO: 99426

SEQ ID NO: 508455 - RNA, 64 nt, hsa; identical to SEQ ID NO: 99427

SEQ ID NO: 508456 - RNA, 64 nt, hsa; identical to SEQ ID NO: 99428

SEQ ID NO: 508457 - RNA, 64 nt, hsa; identical to SEQ ID NO: 99429

SEQ ID NO: 508458 - RNA, 64 nt, hsa; identical to SEQ ID NO: 99430

SEQ ID NO: 508459 - RNA, 64 nt, hsa; identical to SEQ ID NO: 99431

SEQ ID NO: 508460 - RNA, 64 nt, hsa; identical to SEQ ID NO: 99432

SEQ ID NO: 508461 - RNA, 64 nt, hsa; identical to SEQ ID NO: 99433

SEQ ID NO: 508462 - RNA, 64 nt, hsa; identical to SEQ ID NO: 99434

SEQ ID NO: 508463 - RNA, 64 nt, hsa; identical to SEQ ID NO: 99435

SEQ ID NO: 508464 - RNA, 64 nt, hsa; identical to SEQ ID NO: 99436

SEQ ID NO: 508465 - RNA, 64 nt, hsa; identical to SEQ ID NO: 99437

SEQ ID NO: 508466 - RNA, 64 nt, hsa; identical to SEQ ID NO: 99438

SEQ ID NO: 508467 - RNA, 64 nt, hsa; identical to SEQ ID NO: 99439

SEQ ID NO: 508468 - RNA, 64 nt, hsa; identical to SEQ ID NO: 99440

SEQ ID NO: 508469 - RNA, 64 nt, hsa; identical to SEQ ID NO: 99441

SEQ ID NO: 508470 - RNA, 64 nt, hsa; identical to SEQ ID NO: 99442

SEQ ID NO: 508471 - RNA, 64 nt, hsa; identical to SEQ ID NO: 99443

SEQ ID NO: 508472 - RNA, 64 nt, hsa; identical to SEQ ID NO: 99444

SEQ ID NO: 508473 - RNA, 64 nt, hsa; identical to SEQ ID NO: 99445

SEQ ID NO: 508474 - RNA, 64 nt, hsa; identical to SEQ ID NO: 99446

SEQ ID NO: 508475 - RNA, 64 nt, hsa; identical to SEQ ID NO: 99447

SEQ ID NO: 508476 - RNA, 64 nt, hsa; identical to SEQ ID NO: 99448

SEQ ID NO: 508477 - RNA, 64 nt, hsa; identical to SEQ ID NO: 99449

SEQ ID NO: 508478 - RNA, 64 nt, hsa; identical to SEQ ID NO: 99450

SEQ ID NO: 508479 - RNA, 64 nt, hsa; identical to SEQ ID NO: 99451

SEQ ID NO: 508480 - RNA, 64 nt, hsa; identical to SEQ ID NO: 99452

SEQ ID NO: 508481 - RNA, 64 nt, hsa; identical to SEQ ID NO: 99453

SEQ ID NO: 508482 - RNA, 64 nt, hsa; identical to SEQ ID NO: 99454

SEQ ID NO: 508483 - RNA, 64 nt, hsa; identical to SEQ ID NO: 99455

SEQ ID NO: 508484 - RNA, 64 nt, hsa; identical to SEQ ID NO: 99456

SEQ ID NO: 508485 - RNA, 64 nt, hsa; identical to SEQ ID NO: 99457

SEQ ID NO: 508486 - RNA, 64 nt, hsa; identical to SEQ ID NO: 99458

SEQ ID NO: 508487 - RNA, 64 nt, hsa; identical to SEQ ID NO: 99459

SEQ ID NO: 508488 - RNA, 64 nt, hsa; identical to SEQ ID NO: 99460

SEQ ID NO: 508489 - RNA, 64 nt, hsa; identical to SEQ ID NO: 99459

SEQ ID NO: 508490 - RNA, 64 nt, hsa; identical to SEQ ID NO: 99462

SEQ ID NO: 508491 - RNA, 64 nt, hsa; identical to SEQ ID NO: 99463

SEQ ID NO: 508492 - RNA, 64 nt, hsa; identical to SEQ ID NO: 99464

SEQ ID NO: 508493 - RNA, 64 nt, hsa; identical to SEQ ID NO: 99465

SEQ ID NO: 508494 - RNA, 64 nt, hsa; identical to SEQ ID NO: 99466

SEQ ID NO: 508495 - RNA, 64 nt, hsa; identical to SEQ ID NO: 99467

SEQ ID NO: 508496 - RNA, 64 nt, hsa; identical to SEQ ID NO: 99468

SEQ ID NO: 508497 - RNA, 64 nt, hsa; identical to SEQ ID NO: 99469

SEQ ID NO: 508498 - RNA, 64 nt, hsa; identical to SEQ ID NO: 99470

SEQ ID NO: 508499 - RNA, 64 nt, hsa; identical to SEQ ID NO: 99471

SEQ ID NO: 508500 - RNA, 64 nt, hsa; identical to SEQ ID NO: 99472

SEQ ID NO: 508501 - RNA, 64 nt, hsa; identical to SEQ ID NO: 99473

SEQ ID NO: 508502 - RNA, 64 nt, hsa; identical to SEQ ID NO: 99474

SEQ ID NO: 508503 - RNA, 64 nt, hsa; identical to SEQ ID NO: 99475

SEQ ID NO: 508504 - RNA, 64 nt, hsa; identical to SEQ ID NO: 99476

SEQ ID NO: 508505 - RNA, 64 nt, hsa; identical to SEQ ID NO: 99477

SEQ ID NO: 508506 - RNA, 64 nt, hsa; identical to SEQ ID NO: 99478

SEQ ID NO: 508507 - RNA, 64 nt, hsa; identical to SEQ ID NO: 99479

SEQ ID NO: 508508 - RNA, 64 nt, hsa; identical to SEQ ID NO: 99480

SEQ ID NO: 508509 - RNA, 64 nt, hsa; identical to SEQ ID NO: 99481

SEQ ID NO: 508510 - RNA, 64 nt, hsa; identical to SEQ ID NO: 99482

SEQ ID NO: 508511 - RNA, 64 nt, hsa; identical to SEQ ID NO: 99483

SEQ ID NO: 508512 - RNA, 64 nt, hsa; identical to SEQ ID NO: 99484

SEQ ID NO: 508513 - RNA, 64 nt, hsa; identical to SEQ ID NO: 99485

SEQ ID NO: 508514 - RNA, 64 nt, hsa; identical to SEQ ID NO: 99486

SEQ ID NO: 508515 - RNA, 64 nt, hsa; identical to SEQ ID NO: 99487

SEQ ID NO: 508516 - RNA, 64 nt, hsa
agccauucuccauguccccuucucccucuucucagaucaaaaucccuagggaguucuauuuuua

SEQ ID NO: 508517 - RNA, 64 nt, hsa
ugagagggcacagacuuguggagcugggcgucuggaucaaaacugcuuugggauggaaccucga

SEQ ID NO: 508518 - RNA, 64 nt, hsa
aacacuaguccugauaauaaacaucauuuuaaaagaucaaaacaaacaaacaaaaaaaacaagg

SEQ ID NO: 508519 - RNA, 64 nt, hsa
aagauggcaaaauuguuuacaccagugagagggagaucaaaagcuaagaacuacccuguagcca

SEQ ID NO: 508520 - RNA, 64 nt, hsa
cgaguacuguguuuauucucucuccaggaaagcagaucaaaagaaaguuagcagaucgaguguc

SEQ ID NO: 508521 - RNA, 64 nt, hsa
ucuagcccucucaguuaccagcucuuuggagaaggaucaaaauucagauggaaugugggauggg

SEQ ID NO: 508522 - RNA, 64 nt, hsa
auagcacuaaaugcccacaagggaaagcaggaaagaucaaaaacgcauacccuaacaucaccau

SEQ ID NO: 508523 - RNA, 64 nt, hsa
ucuuugcgcuucuaccuuuuggucuuuaaagugugaucaaaagagacuuagacucccacauagu

SEQ ID NO: 508524 - RNA, 64 nt, hsa
uagaacuuauaugaauuugauuuauauuuugcaagaucaaaaauuagauguuaaguaucagauu

SEQ ID NO: 508525 - RNA, 64 nt, hsa
gaauaagagaaacaaauuauaucaagguaaaacugaucaaaagcauaauugaaaguucugaaaa

SEQ ID NO: 508526 - RNA, 64 nt, hsa; identical to SEQ ID NO: 411751

SEQ ID NO: 508527 - RNA, 64 nt, hsa; identical to SEQ ID NO: 411752

SEQ ID NO: 508528 - RNA, 64 nt, hsa; identical to SEQ ID NO: 411753

SEQ ID NO: 508529 - RNA, 64 nt, hsa; identical to SEQ ID NO: 411754

SEQ ID NO: 508530 - RNA, 64 nt, hsa; identical to SEQ ID NO: 411755

SEQ ID NO: 508531 - RNA, 64 nt, hsa; identical to SEQ ID NO: 411756

SEQ ID NO: 508532 - RNA, 64 nt, hsa; identical to SEQ ID NO: 411757

SEQ ID NO: 508533 - RNA, 64 nt, hsa; identical to SEQ ID NO: 411758

SEQ ID NO: 508534 - RNA, 64 nt, hsa; identical to SEQ ID NO: 411759

SEQ ID NO: 508535 - RNA, 64 nt, hsa; identical to SEQ ID NO: 411760

SEQ ID NO: 508536 - RNA, 64 nt, hsa; identical to SEQ ID NO: 411761

SEQ ID NO: 508537 - RNA, 64 nt, hsa; identical to SEQ ID NO: 411762

SEQ ID NO: 508538 - RNA, 64 nt, hsa; identical to SEQ ID NO: 411763

SEQ ID NO: 508539 - RNA, 64 nt, hsa; identical to SEQ ID NO: 411764

SEQ ID NO: 508540 - RNA, 64 nt, hsa; identical to SEQ ID NO: 411765

SEQ ID NO: 508541 - RNA, 64 nt, hsa; identical to SEQ ID NO: 411766

SEQ ID NO: 508542 - RNA, 64 nt, hsa; identical to SEQ ID NO: 411767

SEQ ID NO: 508543 - RNA, 64 nt, hsa; identical to SEQ ID NO: 411768

SEQ ID NO: 508544 - RNA, 64 nt, hsa; identical to SEQ ID NO: 411769

SEQ ID NO: 508545 - RNA, 64 nt, hsa; identical to SEQ ID NO: 411770

SEQ ID NO: 508546 - RNA, 64 nt, hsa; identical to SEQ ID NO: 92076

SEQ ID NO: 508547 - RNA, 64 nt, hsa; identical to SEQ ID NO: 92077

SEQ ID NO: 508548 - RNA, 64 nt, hsa; identical to SEQ ID NO: 92078

SEQ ID NO: 508549 - RNA, 64 nt, hsa; identical to SEQ ID NO: 92079

SEQ ID NO: 508550 - RNA, 64 nt, hsa; identical to SEQ ID NO: 92080

SEQ ID NO: 508551 - RNA, 64 nt, hsa; identical to SEQ ID NO: 92081

SEQ ID NO: 508552 - RNA, 62 nt, hsa; identical to SEQ ID NO: 92082

SEQ ID NO: 508553 - RNA, 64 nt, hsa; identical to SEQ ID NO: 92083

SEQ ID NO: 508554 - RNA, 64 nt, hsa; identical to SEQ ID NO: 92084

SEQ ID NO: 508555 - RNA, 64 nt, hsa; identical to SEQ ID NO: 92085

SEQ ID NO: 508556 - RNA, 64 nt, hsa; identical to SEQ ID NO: 92086

SEQ ID NO: 508557 - RNA, 64 nt, hsa; identical to SEQ ID NO: 92087

SEQ ID NO: 508558 - RNA, 64 nt, hsa; identical to SEQ ID NO: 92088

SEQ ID NO: 508559 - RNA, 64 nt, hsa; identical to SEQ ID NO: 92089

SEQ ID NO: 508560 - RNA, 64 nt, hsa; identical to SEQ ID NO: 92090

SEQ ID NO: 508561 - RNA, 64 nt, hsa; identical to SEQ ID NO: 92091

SEQ ID NO: 508562 - RNA, 64 nt, hsa; identical to SEQ ID NO: 92092

SEQ ID NO: 508563 - RNA, 64 nt, hsa; identical to SEQ ID NO: 92093

SEQ ID NO: 508564 - RNA, 64 nt, hsa; identical to SEQ ID NO: 92094

SEQ ID NO: 508565 - RNA, 64 nt, hsa; identical to SEQ ID NO: 92095

SEQ ID NO: 508566 - RNA, 64 nt, hsa; identical to SEQ ID NO: 92096

SEQ ID NO: 508567 - RNA, 64 nt, hsa; identical to SEQ ID NO: 92097

SEQ ID NO: 508568 - RNA, 64 nt, hsa; identical to SEQ ID NO: 92098

SEQ ID NO: 508569 - RNA, 64 nt, hsa; identical to SEQ ID NO: 92099

SEQ ID NO: 508570 - RNA, 64 nt, hsa; identical to SEQ ID NO: 92100

SEQ ID NO: 508571 - RNA, 64 nt, hsa; identical to SEQ ID NO: 92101

SEQ ID NO: 508572 - RNA, 64 nt, hsa; identical to SEQ ID NO: 92102

SEQ ID NO: 508573 - RNA, 64 nt, hsa; identical to SEQ ID NO: 92103

SEQ ID NO: 508574 - RNA, 64 nt, hsa; identical to SEQ ID NO: 92104

SEQ ID NO: 508575 - RNA, 64 nt, hsa; identical to SEQ ID NO: 92105

SEQ ID NO: 508576 - RNA, 64 nt, hsa; identical to SEQ ID NO: 92106

SEQ ID NO: 508577 - RNA, 64 nt, hsa; identical to SEQ ID NO: 92107

SEQ ID NO: 508578 - RNA, 64 nt, hsa; identical to SEQ ID NO: 92108

SEQ ID NO: 508579 - RNA, 64 nt, hsa; identical to SEQ ID NO: 92109

SEQ ID NO: 508580 - RNA, 64 nt, hsa; identical to SEQ ID NO: 92110

SEQ ID NO: 508581 - RNA, 64 nt, hsa; identical to SEQ ID NO: 92111

SEQ ID NO: 508582 - RNA, 64 nt, hsa; identical to SEQ ID NO: 92112

SEQ ID NO: 508583 - RNA, 64 nt, hsa; identical to SEQ ID NO: 92113

SEQ ID NO: 508584 - RNA, 64 nt, hsa; identical to SEQ ID NO: 92114

SEQ ID NO: 508585 - RNA, 64 nt, hsa; identical to SEQ ID NO: 92115

SEQ ID NO: 508586 - RNA, 64 nt, hsa; identical to SEQ ID NO: 92116

SEQ ID NO: 508587 - RNA, 64 nt, hsa; identical to SEQ ID NO: 92117

SEQ ID NO: 508588 - RNA, 64 nt, hsa; identical to SEQ ID NO: 92118

SEQ ID NO: 508589 - RNA, 64 nt, hsa; identical to SEQ ID NO: 92119

SEQ ID NO: 508590 - RNA, 64 nt, hsa; identical to SEQ ID NO: 92120

SEQ ID NO: 508591 - RNA, 64 nt, hsa; identical to SEQ ID NO: 92121

SEQ ID NO: 508592 - RNA, 64 nt, hsa; identical to SEQ ID NO: 92122

SEQ ID NO: 508593 - RNA, 64 nt, hsa; identical to SEQ ID NO: 92123

SEQ ID NO: 508594 - RNA, 64 nt, hsa; identical to SEQ ID NO: 92124

SEQ ID NO: 508595 - RNA, 64 nt, hsa; identical to SEQ ID NO: 92125

SEQ ID NO: 508596 - RNA, 64 nt, hsa; identical to SEQ ID NO: 92126

SEQ ID NO: 508597 - RNA, 64 nt, hsa; identical to SEQ ID NO: 92127

SEQ ID NO: 508598 - RNA, 64 nt, hsa; identical to SEQ ID NO: 92128

SEQ ID NO: 508599 - RNA, 64 nt, hsa; identical to SEQ ID NO: 92129

SEQ ID NO: 508600 - RNA, 64 nt, hsa; identical to SEQ ID NO: 92130

SEQ ID NO: 508601 - RNA, 64 nt, hsa; identical to SEQ ID NO: 92131

SEQ ID NO: 508602 - RNA, 64 nt, hsa; identical to SEQ ID NO: 92132

SEQ ID NO: 508603 - RNA, 64 nt, hsa; identical to SEQ ID NO: 92133

SEQ ID NO: 508604 - RNA, 64 nt, hsa; identical to SEQ ID NO: 92134

SEQ ID NO: 508605 - RNA, 64 nt, hsa; identical to SEQ ID NO: 92135

SEQ ID NO: 508606 - RNA, 64 nt, hsa; identical to SEQ ID NO: 92136

SEQ ID NO: 508607 - RNA, 64 nt, hsa; identical to SEQ ID NO: 301439

SEQ ID NO: 508608 - RNA, 64 nt, hsa; identical to SEQ ID NO: 301440

SEQ ID NO: 508609 - RNA, 64 nt, hsa; identical to SEQ ID NO: 301441

SEQ ID NO: 508610 - RNA, 64 nt, hsa; identical to SEQ ID NO: 301442

SEQ ID NO: 508611 - RNA, 64 nt, hsa; identical to SEQ ID NO: 301443

SEQ ID NO: 508612 - RNA, 64 nt, hsa; identical to SEQ ID NO: 301444

SEQ ID NO: 508613 - RNA, 64 nt, hsa; identical to SEQ ID NO: 301445

SEQ ID NO: 508614 - RNA, 64 nt, hsa; identical to SEQ ID NO: 301446

SEQ ID NO: 508615 - RNA, 64 nt, hsa; identical to SEQ ID NO: 301447

SEQ ID NO: 508616 - RNA, 64 nt, hsa; identical to SEQ ID NO: 301448

SEQ ID NO: 508617 - RNA, 64 nt, hsa
uggagguugcagugagcugagaucgugccauugugauaugaauaugccuuauaugcugauauga

SEQ ID NO: 508618 - RNA, 64 nt, hsa
cgugccauugugauaugaauaugccuuauaugcugauaugaauaugccuuaaaauaaaguguuc

SEQ ID NO: 508619 - RNA, 64 nt, hsa
ccauuugaaaaaucuugguacugcuaaauuauuugauaugaacucaauccagcauuuguagcag

SEQ ID NO: 508620 - RNA, 64 nt, hsa
uuuuugucaccagcaaaacuuuucacuaauuagugauaugaaaugugauuuuuguguuguuaaa

SEQ ID NO: 508621 - RNA, 64 nt, hsa
gggcccccauacacuuaucccucaaauuuuaagugauaugaaauacuugucaugucuuuggcca

SEQ ID NO: 508622 - RNA, 64 nt, hsa
ugauaguugaacuguaauuucuacucuuaagugagauaugaagcauuauccuuuuguucaguug

SEQ ID NO: 508623 - RNA, 64 nt, hsa
agagucuugcuuauugggcugcauccccagagaggauaugaauuauuuuuugaaaagacagggu

SEQ ID NO: 508624 - RNA, 64 nt, hsa
ugggauuacaggcaugagccacugugccuggcuggauaugaaauuuuuuuuuuuuuuuuuuuug

SEQ ID NO: 508625 - RNA, 64 nt, hsa
gggauuacaggcaaaagccaacacacccggccuggauaugaauuuauaauacccuacagugcaa

SEQ ID NO: 508626 - RNA, 64 nt, hsa
ucuugucuugacaagaugcuugaaaaaccaagaggauaugaaaaucugucucuggagaaacaaa

SEQ ID NO: 508627 - RNA, 64 nt, hsa
gagguuagcauuugauaaaugauuuuuuaaaguagauaugaagauuuuguuaauuuauaauuua

SEQ ID NO: 508628 - RNA, 64 nt, hsa
uccuggaaagugaacugggugaccuaggaccucugauaugaaugugaucugagacuaaaguuug

SEQ ID NO: 508629 - RNA, 64 nt, hsa
ugauucacugaagaugaaaagauaggacggaugugauaugaaaaaaacccaaacauuuuggcau

SEQ ID NO: 508630 - RNA, 64 nt, hsa; identical to SEQ ID NO: 155373

SEQ ID NO: 508631 - RNA, 64 nt, hsa; identical to SEQ ID NO: 155374

SEQ ID NO: 508632 - RNA, 64 nt, hsa; identical to SEQ ID NO: 155375

SEQ ID NO: 508633 - RNA, 64 nt, hsa; identical to SEQ ID NO: 155376

SEQ ID NO: 508634 - RNA, 64 nt, hsa; identical to SEQ ID NO: 155377

SEQ ID NO: 508635 - RNA, 64 nt, hsa; identical to SEQ ID NO: 155378

SEQ ID NO: 508636 - RNA, 64 nt, hsa; identical to SEQ ID NO: 155379

SEQ ID NO: 508637 - RNA, 64 nt, hsa; identical to SEQ ID NO: 155380

SEQ ID NO: 508638 - RNA, 64 nt, hsa
caagaccuuuuuccuccguuuuuuuuuugagauggagucucacacagucacccgggauuggaau

SEQ ID NO: 508639 - RNA, 64 nt, hsa
ugguguaugagugucaaucaucugacccuucuuggagucucauauuucguggaacuccugugca

SEQ ID NO: 508640 - RNA, 64 nt, hsa
auucauguuuuuuauuuuuauuuuuuuugauacagagucucacucugucacucaggcuggagug

SEQ ID NO: 508641 - RNA, 64 nt, hsa
acccagcuauuuuuuuguauuuuuaguagagacagagucucaccacauugcccaggcuggucuc

SEQ ID NO: 508642 - RNA, 64 nt, hsa
aagacggggugggguggggagaugggcauuuggagagucucauguagcuggagacguuaagagc

SEQ ID NO: 508643 - RNA, 64 nt, hsa
auuuauuauuuauuuauuuauuuauuuagagacagagucucacccuguuggccaggcuggagug

SEQ ID NO: 508644 - RNA, 64 nt, hsa
caacuaauuuuauuuuuuauuuuuugcagagauggagucucacuguugcccaggcuggucuuga

SEQ ID NO: 508645 - RNA, 64 nt, hsa
agcauuaguaguuuguuuguuuguuuuugagacugagucucacuuuaucacccagacuggcgug

SEQ ID NO: 508646 - RNA, 64 nt, hsa
uuuacauuuuuguuguuguuguuguucugagauggagucucacucugucgcccaggcuagacug

SEQ ID NO: 508647 - RNA, 64 nt, hsa
auguauaugugauuuuuuuuuuuuuuuugagaccgagucucacucugucaccaggcuggagugc

SEQ ID NO: 508648 - RNA, 64 nt, hsa
agcgauuccuuuuuuuuuuuuuuuuuuugagacagagucucacucugucccccaggcuggagug

SEQ ID NO: 508649 - RNA, 64 nt, hsa
uuuuuuuuuuuuaaucuuuuauuuuuuugagacagagucucacucugucacccagacuggagug

SEQ ID NO: 508650 - RNA, 64 nt, hsa
gcugccccugaaggaugccaguacuguggugugugagucucagcagccgcccacacgcuccuaa

SEQ ID NO: 508651 - RNA, 64 nt, hsa
acaaagagaaugagaagacauggaugaucugggagagucucacuuuggaaucagaauuggaauc

SEQ ID NO: 508652 - RNA, 64 nt, hsa
caccggggaacccucacuagcaggacuggugguggagucucaccuggggccuagaguggaagug

SEQ ID NO: 508653 - RNA, 64 nt, hsa
gggggugccuggagaugaacuggaugggccacuggagucucaauaaagcucugcaccauccucg

SEQ ID NO: 508654 - RNA, 64 nt, hsa
aggagagcguuuuuuucuuuuucuuuuugagacagagucucacucuggcgccuggucacugugc

SEQ ID NO: 508655 - RNA, 64 nt, hsa
ccugauccaaaucuuuuuuuguuuguuugagauggagucucacucugucucccaggcuggagug

SEQ ID NO: 508656 - RNA, 64 nt, hsa
cauauauauauauauguucuuguuuuuugagacagagucucacacuguugcccaggcuggagug

SEQ ID NO: 508657 - RNA, 64 nt, hsa
ucuaguuccaaacauuuucuuuuuuucugagauggagucucacucugucacccagguucgaguu

SEQ ID NO: 508658 - RNA, 64 nt, hsa
gggggccucacucuguuuuccaggggagaaaccugagucucagagcaggggaguggcuucccaa

SEQ ID NO: 508659 - RNA, 64 nt, hsa
gcgucagacacccagaguuggagacagaacaacagagucucagggaaagagaaccacaauagaa

SEQ ID NO: 508660 - RNA, 64 nt, hsa
guaaggccaguucaguugggucaugccacuguuugagucucauagggccaugcugaauugaguu

SEQ ID NO: 508661 - RNA, 64 nt, hsa
gaugaaagucugagaaugcccaacucuucauuuugagucucaggcccugaagguuccugaggau

SEQ ID NO: 508662 - RNA, 64 nt, hsa
uuuuuuacucuuaucauuuuuuuuuuuugagguggagucucauucuguugcccaggcuggccug

SEQ ID NO: 508663 - RNA, 64 nt, hsa
ugucacaggccuagagucugagggaggggagugggagucucagcaaucucuuggucuuggcuuc

SEQ ID NO: 508664 - RNA, 64 nt, hsa
aggcagcagcuugggcugggaagaggugguggcagagucucaaagcugagaugcugagagagau

SEQ ID NO: 508665 - RNA, 64 nt, hsa; identical to SEQ ID NO: 96836

SEQ ID NO: 508666 - RNA, 64 nt, hsa; identical to SEQ ID NO: 96837

SEQ ID NO: 508667 - RNA, 64 nt, hsa; identical to SEQ ID NO: 96838

SEQ ID NO: 508668 - RNA, 64 nt, hsa; identical to SEQ ID NO: 96839

SEQ ID NO: 508669 - RNA, 64 nt, hsa; identical to SEQ ID NO: 96840

SEQ ID NO: 508670 - RNA, 64 nt, hsa; identical to SEQ ID NO: 96841

SEQ ID NO: 508671 - RNA, 64 nt, hsa; identical to SEQ ID NO: 96842

SEQ ID NO: 508672 - RNA, 64 nt, hsa; identical to SEQ ID NO: 96843

SEQ ID NO: 508673 - RNA, 64 nt, hsa; identical to SEQ ID NO: 96844

SEQ ID NO: 508674 - RNA, 64 nt, hsa; identical to SEQ ID NO: 96845

SEQ ID NO: 508675 - RNA, 64 nt, hsa; identical to SEQ ID NO: 96846

SEQ ID NO: 508676 - RNA, 64 nt, hsa; identical to SEQ ID NO: 96847

SEQ ID NO: 508677 - RNA, 64 nt, hsa; identical to SEQ ID NO: 96848

SEQ ID NO: 508678 - RNA, 64 nt, hsa; identical to SEQ ID NO: 96849

SEQ ID NO: 508679 - RNA, 64 nt, hsa; identical to SEQ ID NO: 96850

SEQ ID NO: 508680 - RNA, 64 nt, hsa; identical to SEQ ID NO: 96851

SEQ ID NO: 508681 - RNA, 64 nt, hsa; identical to SEQ ID NO: 96852

SEQ ID NO: 508682 - RNA, 64 nt, hsa; identical to SEQ ID NO: 96853

SEQ ID NO: 508683 - RNA, 64 nt, hsa; identical to SEQ ID NO: 96854

SEQ ID NO: 508684 - RNA, 64 nt, hsa; identical to SEQ ID NO: 96855

SEQ ID NO: 508685 - RNA, 64 nt, hsa; identical to SEQ ID NO: 96856

SEQ ID NO: 508686 - RNA, 64 nt, hsa; identical to SEQ ID NO: 96857

SEQ ID NO: 508687 - RNA, 64 nt, hsa; identical to SEQ ID NO: 96858

SEQ ID NO: 508688 - RNA, 64 nt, hsa; identical to SEQ ID NO: 96859

SEQ ID NO: 508689 - RNA, 64 nt, hsa; identical to SEQ ID NO: 96860

SEQ ID NO: 508690 - RNA, 64 nt, hsa; identical to SEQ ID NO: 96861

SEQ ID NO: 508691 - RNA, 64 nt, hsa; identical to SEQ ID NO: 96862

SEQ ID NO: 508692 - RNA, 64 nt, hsa; identical to SEQ ID NO: 96863

SEQ ID NO: 508693 - RNA, 64 nt, hsa; identical to SEQ ID NO: 96864

SEQ ID NO: 508694 - RNA, 64 nt, hsa; identical to SEQ ID NO: 96865

SEQ ID NO: 508695 - RNA, 64 nt, hsa; identical to SEQ ID NO: 96866

SEQ ID NO: 508696 - RNA, 64 nt, hsa; identical to SEQ ID NO: 96867

SEQ ID NO: 508697 - RNA, 64 nt, hsa; identical to SEQ ID NO: 96868

SEQ ID NO: 508698 - RNA, 64 nt, hsa; identical to SEQ ID NO: 96869

SEQ ID NO: 508699 - RNA, 64 nt, hsa; identical to SEQ ID NO: 96870

SEQ ID NO: 508700 - RNA, 64 nt, hsa; identical to SEQ ID NO: 96871

SEQ ID NO: 508701 - RNA, 64 nt, hsa; identical to SEQ ID NO: 96872

SEQ ID NO: 508702 - RNA, 64 nt, hsa; identical to SEQ ID NO: 96873

SEQ ID NO: 508703 - RNA, 64 nt, hsa; identical to SEQ ID NO: 96874

SEQ ID NO: 508704 - RNA, 64 nt, hsa; identical to SEQ ID NO: 96875

SEQ ID NO: 508705 - RNA, 64 nt, hsa; identical to SEQ ID NO: 361974

SEQ ID NO: 508706 - RNA, 64 nt, hsa; identical to SEQ ID NO: 361975

SEQ ID NO: 508707 - RNA, 64 nt, hsa; identical to SEQ ID NO: 361976

SEQ ID NO: 508708 - RNA, 64 nt, hsa; identical to SEQ ID NO: 361977

SEQ ID NO: 508709 - RNA, 64 nt, hsa; identical to SEQ ID NO: 361978

SEQ ID NO: 508710 - RNA, 64 nt, hsa; identical to SEQ ID NO: 361979

SEQ ID NO: 508711 - RNA, 64 nt, hsa; identical to SEQ ID NO: 361980

SEQ ID NO: 508712 - RNA, 64 nt, hsa; identical to SEQ ID NO: 361981

SEQ ID NO: 508713 - RNA, 64 nt, hsa; identical to SEQ ID NO: 361982

SEQ ID NO: 508714 - RNA, 64 nt, hsa; identical to SEQ ID NO: 361983

SEQ ID NO: 508715 - RNA, 64 nt, hsa; identical to SEQ ID NO: 361984

SEQ ID NO: 508716 - RNA, 64 nt, hsa; identical to SEQ ID NO: 361985

SEQ ID NO: 508717 - RNA, 64 nt, hsa; identical to SEQ ID NO: 361986

SEQ ID NO: 508718 - RNA, 64 nt, hsa; identical to SEQ ID NO: 361987

SEQ ID NO: 508719 - RNA, 64 nt, hsa; identical to SEQ ID NO: 361988

SEQ ID NO: 508720 - RNA, 64 nt, hsa; identical to SEQ ID NO: 361989

SEQ ID NO: 508721 - RNA, 64 nt, hsa; identical to SEQ ID NO: 361990

SEQ ID NO: 508722 - RNA, 64 nt, hsa; identical to SEQ ID NO: 361991

SEQ ID NO: 508723 - RNA, 64 nt, hsa; identical to SEQ ID NO: 361992

SEQ ID NO: 508724 - RNA, 64 nt, hsa; identical to SEQ ID NO: 361993

SEQ ID NO: 508725 - RNA, 64 nt, hsa; identical to SEQ ID NO: 361994

SEQ ID NO: 508726 - RNA, 64 nt, hsa; identical to SEQ ID NO: 361995

SEQ ID NO: 508727 - RNA, 64 nt, hsa; identical to SEQ ID NO: 361996

SEQ ID NO: 508728 - RNA, 64 nt, hsa; identical to SEQ ID NO: 361997

SEQ ID NO: 508729 - RNA, 64 nt, hsa; identical to SEQ ID NO: 361998

SEQ ID NO: 508730 - RNA, 64 nt, hsa
aacccugcagaugucaacugaaggccacaaaaaugaacuccaucuacaagugauuaccuaguug

SEQ ID NO: 508731 - RNA, 64 nt, hsa
gccagccuugagcaugaagcugagauggaccugggaacuccaacauaugaugaaaaccccauga

SEQ ID NO: 508732 - RNA, 64 nt, hsa
ccucugaccucaucaugguucuaguucucauacagaacuccagaauuuuuaaagaacucuauaa

SEQ ID NO: 508733 - RNA, 64 nt, hsa
gaccauguggcccaccagcagccuuuccaaaggggaacuccagagacauuucauaaugcaaaca

SEQ ID NO: 508734 - RNA, 64 nt, hsa
guguggagauaaggcuggacuggucuaucagauugaacuccaagaaugaucacacaaaauguuu

SEQ ID NO: 508735 - RNA, 64 nt, hsa
aaacccacagcuccagagaaggugaccauucucagaacuccagcuauucacucuccagggagaa

SEQ ID NO: 508736 - RNA, 64 nt, hsa; identical to SEQ ID NO: 199877

SEQ ID NO: 508737 - RNA, 64 nt, hsa; identical to SEQ ID NO: 199878

SEQ ID NO: 508738 - RNA, 64 nt, hsa; identical to SEQ ID NO: 199879

SEQ ID NO: 508739 - RNA, 64 nt, hsa; identical to SEQ ID NO: 199880

SEQ ID NO: 508740 - RNA, 64 nt, hsa; identical to SEQ ID NO: 199881

SEQ ID NO: 508741 - RNA, 64 nt, hsa; identical to SEQ ID NO: 199882

SEQ ID NO: 508742 - RNA, 64 nt, hsa; identical to SEQ ID NO: 199883

SEQ ID NO: 508743 - RNA, 64 nt, hsa; identical to SEQ ID NO: 199884

SEQ ID NO: 508744 - RNA, 64 nt, hsa; identical to SEQ ID NO: 199885

SEQ ID NO: 508745 - RNA, 64 nt, hsa; identical to SEQ ID NO: 199886

SEQ ID NO: 508746 - RNA, 64 nt, hsa; identical to SEQ ID NO: 199887

SEQ ID NO: 508747 - RNA, 64 nt, hsa; identical to SEQ ID NO: 199888

SEQ ID NO: 508748 - RNA, 64 nt, hsa; identical to SEQ ID NO: 199889

SEQ ID NO: 508749 - RNA, 64 nt, hsa; identical to SEQ ID NO: 199890

SEQ ID NO: 508750 - RNA, 64 nt, hsa; identical to SEQ ID NO: 199891

SEQ ID NO: 508751 - RNA, 64 nt, hsa; identical to SEQ ID NO: 199892

SEQ ID NO: 508752 - RNA, 64 nt, hsa; identical to SEQ ID NO: 199893

SEQ ID NO: 508753 - RNA, 64 nt, hsa; identical to SEQ ID NO: 199894

SEQ ID NO: 508754 - RNA, 64 nt, hsa; identical to SEQ ID NO: 199895

SEQ ID NO: 508755 - RNA, 64 nt, hsa; identical to SEQ ID NO: 199896

SEQ ID NO: 508756 - RNA, 64 nt, hsa; identical to SEQ ID NO: 199897

SEQ ID NO: 508757 - RNA, 64 nt, hsa; identical to SEQ ID NO: 140344

SEQ ID NO: 508758 - RNA, 64 nt, hsa; identical to SEQ ID NO: 140345

SEQ ID NO: 508759 - RNA, 64 nt, hsa; identical to SEQ ID NO: 140346

SEQ ID NO: 508760 - RNA, 64 nt, hsa; identical to SEQ ID NO: 140347

SEQ ID NO: 508761 - RNA, 64 nt, hsa
auaaggccugcuucccaguccaugggagauuccaaguggccacugcaggagucacucaccuccc

SEQ ID NO: 508762 - RNA, 64 nt, hsa
ccuuggaaaccuuucccaagccuuccuggcccacaguggccagugccauaggcagugcugugga

SEQ ID NO: 508763 - RNA, 56 nt, hsa
ucggggagggcacccccuaagaccacaguggccaagaucacaguggccacggccac

SEQ ID NO: 508764 - RNA, 64 nt, hsa
gggcacccccuaagaccacaguggccaagaucacaguggccacggccacggccacagucauggu

SEQ ID NO: 508765 - RNA, 64 nt, hsa
gggcagccuaugcaaguguuccggcaggaccagaaguggccacucaacacacguccucaccagu

SEQ ID NO: 508766 - RNA, 64 nt, hsa
gggcugacaguccuaaaaucaagugcuaggacacaguggccauugagcugggagcauucuuccc

SEQ ID NO: 508767 - RNA, 64 nt, hsa
ggggcaggugucucccuucgacauugagccuucgaguggccagcuucacucucugggggagugc

SEQ ID NO: 508768 - RNA, 64 nt, hsa
uucuaggcauuucugggaagccccagggacugcaaguggccauuaccaucucuaaggagagcuc

SEQ ID NO: 508769 - RNA, 64 nt, hsa
aucucuaaggagagcucugauugcagcacagagcaguggccaggccacccaaaggagcuccgcc

SEQ ID NO: 508770 - RNA, 64 nt, hsa
cccugcccagacucuucagccccugcucccauccaguggccagucgggggaggagaaagacgcg

SEQ ID NO: 508771 - RNA, 64 nt, hsa
ccagaguggccugcccccgggagccaaagaccccaguggccacacugggauaggguggggaggc

SEQ ID NO: 508772 - RNA, 64 nt, hsa
caccauuaucagagggugggaaaaggcacaugaaaguggccagcuccugucaauuuauuugcuu

SEQ ID NO: 508773 - RNA, 64 nt, hsa
acaguccaggucucuugcuguguguccugcagggaguggccaacucuccaccuuccagcaccau

SEQ ID NO: 508774 - RNA, 64 nt, hsa
caggucccauguugucccugcugccucccucuggaguggccacuuggccaaagcgcccauccac

SEQ ID NO: 508775 - RNA, 64 nt, hsa
agcagugagggucccaguguucccuccacucccgaguggccacaggcucgcgggcugggaagga

SEQ ID NO: 508776 - RNA, 64 nt, hsa
ugcuucugugaggugguuuagcuuuugcuuucgaaguggccagcugcggccaccaggucucagc

SEQ ID NO: 508777 - RNA, 64 nt, hsa
aaggagcauuggaaggcccaaacccucucccuugaguggccaccccagccugguuggcugguuu

SEQ ID NO: 508778 - RNA, 64 nt, hsa; identical to SEQ ID NO: 196032

SEQ ID NO: 508779 - RNA, 64 nt, hsa; identical to SEQ ID NO: 196033

SEQ ID NO: 508780 - RNA, 64 nt, hsa; identical to SEQ ID NO: 196034

SEQ ID NO: 508781 - RNA, 64 nt, hsa; identical to SEQ ID NO: 196035

SEQ ID NO: 508782 - RNA, 64 nt, hsa; identical to SEQ ID NO: 196036

SEQ ID NO: 508783 - RNA, 64 nt, hsa; identical to SEQ ID NO: 196037

SEQ ID NO: 508784 - RNA, 64 nt, hsa; identical to SEQ ID NO: 196038

SEQ ID NO: 508785 - RNA, 64 nt, hsa; identical to SEQ ID NO: 196039

SEQ ID NO: 508786 - RNA, 64 nt, hsa; identical to SEQ ID NO: 196040

SEQ ID NO: 508787 - RNA, 64 nt, hsa; identical to SEQ ID NO: 196041

SEQ ID NO: 508788 - RNA, 64 nt, hsa; identical to SEQ ID NO: 196042

SEQ ID NO: 508789 - RNA, 64 nt, hsa; identical to SEQ ID NO: 196043

SEQ ID NO: 508790 - RNA, 64 nt, hsa; identical to SEQ ID NO: 196044

SEQ ID NO: 508791 - RNA, 64 nt, hsa; identical to SEQ ID NO: 196045

SEQ ID NO: 508792 - RNA, 64 nt, hsa; identical to SEQ ID NO: 196046

SEQ ID NO: 508793 - RNA, 64 nt, hsa; identical to SEQ ID NO: 196047

SEQ ID NO: 508794 - RNA, 64 nt, hsa; identical to SEQ ID NO: 196048

SEQ ID NO: 508795 - RNA, 64 nt, hsa; identical to SEQ ID NO: 196049

SEQ ID NO: 508796 - RNA, 64 nt, hsa; identical to SEQ ID NO: 196050

SEQ ID NO: 508797 - RNA, 64 nt, hsa; identical to SEQ ID NO: 196051

SEQ ID NO: 508798 - RNA, 64 nt, hsa; identical to SEQ ID NO: 196052

SEQ ID NO: 508799 - RNA, 64 nt, hsa; identical to SEQ ID NO: 196053

SEQ ID NO: 508800 - RNA, 64 nt, hsa; identical to SEQ ID NO: 196054

SEQ ID NO: 508801 - RNA, 64 nt, hsa; identical to SEQ ID NO: 196055

SEQ ID NO: 508802 - RNA, 64 nt, hsa; identical to SEQ ID NO: 153638

SEQ ID NO: 508803 - RNA, 64 nt, hsa; identical to SEQ ID NO: 153639

SEQ ID NO: 508804 - RNA, 64 nt, hsa; identical to SEQ ID NO: 153640

SEQ ID NO: 508805 - RNA, 64 nt, hsa; identical to SEQ ID NO: 153641

SEQ ID NO: 508806 - RNA, 64 nt, hsa; identical to SEQ ID NO: 153642

SEQ ID NO: 508807 - RNA, 64 nt, hsa; identical to SEQ ID NO: 153643

SEQ ID NO: 508808 - RNA, 64 nt, hsa; identical to SEQ ID NO: 153644

SEQ ID NO: 508809 - RNA, 64 nt, hsa; identical to SEQ ID NO: 153645

SEQ ID NO: 508810 - RNA, 64 nt, hsa; identical to SEQ ID NO: 153646

SEQ ID NO: 508811 - RNA, 64 nt, hsa; identical to SEQ ID NO: 153647

SEQ ID NO: 508812 - RNA, 64 nt, hsa; identical to SEQ ID NO: 153648

SEQ ID NO: 508813 - RNA, 64 nt, hsa; identical to SEQ ID NO: 153649

SEQ ID NO: 508814 - RNA, 64 nt, hsa; identical to SEQ ID NO: 153650

SEQ ID NO: 508815 - RNA, 64 nt, hsa; identical to SEQ ID NO: 153651

SEQ ID NO: 508816 - RNA, 64 nt, hsa; identical to SEQ ID NO: 153652

SEQ ID NO: 508817 - RNA, 64 nt, hsa; identical to SEQ ID NO: 153653

SEQ ID NO: 508818 - RNA, 64 nt, hsa; identical to SEQ ID NO: 153654

SEQ ID NO: 508819 - RNA, 64 nt, hsa; identical to SEQ ID NO: 153655

SEQ ID NO: 508820 - RNA, 64 nt, hsa; identical to SEQ ID NO: 153656

SEQ ID NO: 508821 - RNA, 64 nt, hsa; identical to SEQ ID NO: 153657

SEQ ID NO: 508822 - RNA, 64 nt, hsa; identical to SEQ ID NO: 153658

SEQ ID NO: 508823 - RNA, 64 nt, hsa; identical to SEQ ID NO: 153659

SEQ ID NO: 508824 - RNA, 64 nt, hsa; identical to SEQ ID NO: 153660

SEQ ID NO: 508825 - RNA, 64 nt, hsa; identical to SEQ ID NO: 153661

SEQ ID NO: 508826 - RNA, 64 nt, hsa; identical to SEQ ID NO: 153662

SEQ ID NO: 508827 - RNA, 64 nt, hsa; identical to SEQ ID NO: 153663

SEQ ID NO: 508828 - RNA, 64 nt, hsa; identical to SEQ ID NO: 153664

SEQ ID NO: 508829 - RNA, 64 nt, hsa; identical to SEQ ID NO: 153665

SEQ ID NO: 508830 - RNA, 64 nt, hsa; identical to SEQ ID NO: 153666

SEQ ID NO: 508831 - RNA, 64 nt, hsa; identical to SEQ ID NO: 153667

SEQ ID NO: 508832 - RNA, 64 nt, hsa; identical to SEQ ID NO: 153668

SEQ ID NO: 508833 - RNA, 64 nt, hsa; identical to SEQ ID NO: 153669

SEQ ID NO: 508834 - RNA, 64 nt, hsa; identical to SEQ ID NO: 153670

SEQ ID NO: 508835 - RNA, 64 nt, hsa; identical to SEQ ID NO: 153671

SEQ ID NO: 508836 - RNA, 64 nt, hsa; identical to SEQ ID NO: 153672

SEQ ID NO: 508837 - RNA, 64 nt, hsa; identical to SEQ ID NO: 153673

SEQ ID NO: 508838 - RNA, 62 nt, hsa
uuccaucccacuccacuauguugucuauuuuuucugaggaauuaaggguuaccccacccugc

SEQ ID NO: 508839 - RNA, 62 nt, hsa
gaccuagauaggucaugcaagugagaaagacaucugaggaaaauggaagaccuaaggcagac

SEQ ID NO: 508840 - RNA, 62 nt, hsa
gcugaaaucgcagagacuuuugcagcaucagaucugaggaguaaaacggcaccucuggccuu

SEQ ID NO: 508841 - RNA, 62 nt, hsa
cacugguggguugcaggaacagcacccaggacucugaggagggacagagaagcaagggggcu

SEQ ID NO: 508842 - RNA, 62 nt, hsa
aacuguuacaacuuaguuuggauguaagaugcucugaggacccugcccacaccccugcgugc

SEQ ID NO: 508843 - RNA, 62 nt, hsa
agcccaggcucgcaguaucaauaaagcaguucucugaggaaugacuccugggcucuugucag

SEQ ID NO: 508844 - RNA, 62 nt, hsa
auccucucagcuacuccagggcaccugacugcucugaggagagggaagaaggccugcugggg

SEQ ID NO: 508845 - RNA, 62 nt, hsa
ccuguuuuaauuccuaaagauccugacuuuuaucugaggaagucuagguaguuuuccuuuug

SEQ ID NO: 508846 - RNA, 62 nt, hsa
agauaaggauaaaaauauauuugugaauuacuucugaggaaaugcuaacuuccacagcauug

SEQ ID NO: 508847 - RNA, 62 nt, hsa
cacugagccacugcgcccagccaacaauccgcucugaggaaagcguaagcaggaagaccucu

SEQ ID NO: 508848 - RNA, 62 nt, hsa
cuaguuguguuuggaaagggagagaagagaugucugaggaaggucauguucuuucagcuuau

SEQ ID NO: 508849 - RNA, 62 nt, hsa
aucacugacaaauaguggauauagguuucauuucugaggaucaauaaacagcuuguaauguu

SEQ ID NO: 508850 - RNA, 62 nt, hsa
uugcugaagccaaccagagaucuugaucucucucugaggaaaaaaccuagaaaugaugguua

SEQ ID NO: 508851 - RNA, 62 nt, hsa
uaugcuuuggggcugggguagcauggaaucccucugaggaccuggauacugguacuacgggg

SEQ ID NO: 508852 - RNA, 62 nt, hsa
ccggccagggcuggggcagugccagacucugaucugaggaccccgucgggguccagaucagg

SEQ ID NO: 508853 - RNA, 62 nt, hsa
auugcuauucuuccuguuguccaaaccauaaaucugaggauaaccugggcuuuucucuuucc

SEQ ID NO: 508854 - RNA, 62 nt, hsa
guguauaaaaccagauuagacuauauucuucaucugaggagcaucuauauguuuaauacacc

SEQ ID NO: 508855 - RNA, 62 nt, hsa
ugaucccagcugugcucuggacaggcauguucucugaggacacuaaccacgcuggaccuuga

SEQ ID NO: 508856 - RNA, 62 nt, hsa
ccccagcaagugagagcugggugucaagagggucugaggaauccagacccggcugcgugguu

SEQ ID NO: 508857 - RNA, 62 nt, hsa
guaaauuuaguuucuacuugggcagccaaaacucugaggaaggagauucugcuaguaaaaag

SEQ ID NO: 508858 - RNA, 62 nt, hsa
ucucucauuacuccuggucuugggaguugccuucugaggauacuccacuggggguaccugag

SEQ ID NO: 508859 - RNA, 62 nt, hsa
aagcagguuaaagccauugugcuaagaucuaaucugaggacacuauaauggcccugucguca

SEQ ID NO: 508860 - RNA, 62 nt, hsa
guacaauauggcucauugacuuuuccauuacaucugaggauuccagaguccucuguucaucc

SEQ ID NO: 508861 - RNA, 62 nt, hsa
guagcaggucacagaaguguucaccuguuucaucugaggauuucaguucugaagugaucuag

SEQ ID NO: 508862 - RNA, 62 nt, hsa
agucucuucaggaucuuuaguauuuuccugguucugaggaggcuugagacaggguuauggau

SEQ ID NO: 508863 - RNA, 64 nt, hsa; identical to SEQ ID NO: 45285

SEQ ID NO: 508864 - RNA, 64 nt, hsa; identical to SEQ ID NO: 45286

SEQ ID NO: 508865 - RNA, 64 nt, hsa; identical to SEQ ID NO: 45287

SEQ ID NO: 508866 - RNA, 64 nt, hsa; identical to SEQ ID NO: 45288

SEQ ID NO: 508867 - RNA, 64 nt, hsa; identical to SEQ ID NO: 45289

SEQ ID NO: 508868 - RNA, 64 nt, hsa; identical to SEQ ID NO: 45290

SEQ ID NO: 508869 - RNA, 64 nt, hsa; identical to SEQ ID NO: 45291

SEQ ID NO: 508870 - RNA, 64 nt, hsa; identical to SEQ ID NO: 45292

SEQ ID NO: 508871 - RNA, 64 nt, hsa; identical to SEQ ID NO: 45293

SEQ ID NO: 508872 - RNA, 64 nt, hsa; identical to SEQ ID NO: 45294

SEQ ID NO: 508873 - RNA, 64 nt, hsa; identical to SEQ ID NO: 45295

SEQ ID NO: 508874 - RNA, 64 nt, hsa; identical to SEQ ID NO: 45296

SEQ ID NO: 508875 - RNA, 64 nt, hsa; identical to SEQ ID NO: 45297

SEQ ID NO: 508876 - RNA, 64 nt, hsa; identical to SEQ ID NO: 45298

SEQ ID NO: 508877 - RNA, 64 nt, hsa; identical to SEQ ID NO: 45299

SEQ ID NO: 508878 - RNA, 64 nt, hsa; identical to SEQ ID NO: 45300

SEQ ID NO: 508879 - RNA, 64 nt, hsa; identical to SEQ ID NO: 45301

SEQ ID NO: 508880 - RNA, 64 nt, hsa; identical to SEQ ID NO: 45302

SEQ ID NO: 508881 - RNA, 64 nt, hsa; identical to SEQ ID NO: 45303

SEQ ID NO: 508882 - RNA, 64 nt, hsa; identical to SEQ ID NO: 45304

SEQ ID NO: 508883 - RNA, 64 nt, hsa; identical to SEQ ID NO: 45305

SEQ ID NO: 508884 - RNA, 64 nt, hsa; identical to SEQ ID NO: 45306

SEQ ID NO: 508885 - RNA, 64 nt, hsa; identical to SEQ ID NO: 45307

SEQ ID NO: 508886 - RNA, 64 nt, hsa; identical to SEQ ID NO: 45308

SEQ ID NO: 508887 - RNA, 64 nt, hsa; identical to SEQ ID NO: 45309

SEQ ID NO: 508888 - RNA, 64 nt, hsa; identical to SEQ ID NO: 45310

SEQ ID NO: 508889 - RNA, 64 nt, hsa; identical to SEQ ID NO: 45311

SEQ ID NO: 508890 - RNA, 64 nt, hsa; identical to SEQ ID NO: 45312

SEQ ID NO: 508891 - RNA, 64 nt, hsa; identical to SEQ ID NO: 45312

SEQ ID NO: 508892 - RNA, 64 nt, hsa; identical to SEQ ID NO: 45314

SEQ ID NO: 508893 - RNA, 64 nt, hsa; identical to SEQ ID NO: 45315

SEQ ID NO: 508894 - RNA, 64 nt, hsa; identical to SEQ ID NO: 45316

SEQ ID NO: 508895 - RNA, 64 nt, hsa; identical to SEQ ID NO: 45317

SEQ ID NO: 508896 - RNA, 64 nt, hsa; identical to SEQ ID NO: 45318

SEQ ID NO: 508897 - RNA, 64 nt, hsa; identical to SEQ ID NO: 45319

SEQ ID NO: 508898 - RNA, 64 nt, hsa
cucaguugaaagauuucuucuuugaaaggucaagaccgugaacugaaaaaaguguuggccuuuu

SEQ ID NO: 508899 - RNA, 64 nt, hsa
agcugagucagggauagggaguccccuggugcuaaccgugaacguagagacuuguucugaggac

SEQ ID NO: 508900 - RNA, 64 nt, hsa
ggaaaacacauuuugugcgcaugaugaagagagcaccgugaaucuagucuugacugccccuggu

SEQ ID NO: 508901 - RNA, 64 nt, hsa
agcacuuucuaggcuaggaguugggugcauuuguaccgugaaaagcauuccucaguuguggcuu

SEQ ID NO: 508902 - RNA, 64 nt, hsa
uggaucuguuccuaugcccaggaugauuuugugaaccgugaaguacgugagacuagaagacgcc

SEQ ID NO: 508903 - RNA, 64 nt, hsa
guuucucugaaaaauuuuagagcuagguauagugaccgugaacuuucuaacgcauaauauucug

SEQ ID NO: 508904 - RNA, 64 nt, hsa
uucuguaauaggagauguaaucaguguagagaaaaccgugaagagaugccuuuuggacacuuuc

SEQ ID NO: 508905 - RNA, 64 nt, hsa
ugccacacuguagggcccagguggucccauugccaccgugaagccaaauucuagcccaagucug

SEQ ID NO: 508906 - RNA, 64 nt, hsa
uuggucauaaacccugagccagaugaaaugagccaccgugaacagacaucugccaugcccccag

SEQ ID NO: 508907 - RNA, 64 nt, hsa
ucagccucuucccaggaaccaucgccuucuauaaaccgugaacucaagcaggcauuuuuuuuuu

SEQ ID NO: 508908 - RNA, 64 nt, hsa
uacaggcacccaucagaaaaagcauacugccguuaccgugaaacugguuguaaaagagaaacua

SEQ ID NO: 508909 - RNA, 64 nt, hsa
ccugaaccauuuggauguuacagacauacuuaucaccgugaaaauacuucaaguaucuccuaca

SEQ ID NO: 508910 - RNA, 64 nt, hsa
gucuauccugucccacuuccuacauucugggacuaccgugaagccuggaguagggagagcgagu

SEQ ID NO: 508911 - RNA, 64 nt, hsa
gcagcucuggaacgugaagagcuguuugguuugaaccgugaacaaaacuguguuuugaguuuag

SEQ ID NO: 508912 - RNA, 64 nt, hsa
cuguagcauaaggucugguaacugcagaaacauaaccgugaagcucuuccuacccuccuccccc

SEQ ID NO: 508913 - RNA, 64 nt, hsa
ccaggcccugggccugcuccuugccaccaaccgaaccgugaauguagggcccccagccucaccu

SEQ ID NO: 508914 - RNA, 64 nt, hsa
cuaccaagaacuuuaggauccaauuuuccaagccaccgugaagccucuuauggcuacuauuaua

SEQ ID NO: 508915 - RNA, 64 nt, hsa
gaggaggagaagucccggcuguuggagaaggagaaccgugaacuggaaaagaucauugcugagg

SEQ ID NO: 508916 - RNA, 64 nt, hsa
uuccagcucugcaaaaacaagaacaaacaacaucaccgugaauuggccuuuccugaaagugacu

SEQ ID NO: 508917 - RNA, 64 nt, hsa
cugggcugggugcugggaagggaggguugaaaccaccgugaaccagaggguguggcuuuccagg

SEQ ID NO: 508918 - RNA, 64 nt, hsa
aagugguaguuaugugaagucaccaagguucuugaccgugaaucuggagccguuugaguucaca

SEQ ID NO: 508919 - RNA, 64 nt, hsa
gcacgucucaaauuuagacuuguucccccucugaaccgugaaucagaccauuucagguagaagu

SEQ ID NO: 508920 - RNA, 64 nt, hsa
acgaggucaggagaucgagaccguccuggcuaacaccgugaaaccccaucucuacuaaaaauac

SEQ ID NO: 508921 - RNA, 64 nt, hsa
agaaacaauacacugccaaaauguuaaguugaccaccgugaaacuucucuauuggagugucugu

SEQ ID NO: 508922 - RNA, 64 nt, hsa
cuuuuuauuccagucauaauaggugacaguguuaaccgugaaaacuugagaggcacucugcccu

SEQ ID NO: 508923 - RNA, 64 nt, hsa
acaaggucaggagauugagacccuccuggcuaacaccgugaaaccccgucucuacuaaaaauac

SEQ ID NO: 508924 - RNA, 64 nt, hsa
uguacacuuagagguaacuaaggcuaguuugaaaaccgugaauuaagauauucuuaucaguaua

SEQ ID NO: 508925 - RNA, 64 nt, hsa
cagugcccaccugccucacuccucccuaucauguaccgugaaaacccccucugauggccucaag

SEQ ID NO: 508926 - RNA, 64 nt, hsa
auucauguaacauucuaaaauugugccagcgagcaccgugaacgacugcaaugcaagcgggucu

SEQ ID NO: 508927 - RNA, 64 nt, hsa
acuauagcaauauuuaaagaugcuuuggaaaccaaccgugaacacaucaacaccacgacgucua

SEQ ID NO: 508928 - RNA, 64 nt, hsa
accccaaggaacgauuucucagguugagaugaucaccgugaauccggcuuccucugagcauucg

SEQ ID NO: 508929 - RNA, 64 nt, hsa
cugacauuugaagaaaacguauaaaucuuucuuaaccgugaaagcaaaagccuuuggguuuauu

SEQ ID NO: 508930 - RNA, 64 nt, hsa
uucauggagcaggcaaaaccagacgucugggaagaccgugaacuuaaggagucugauucuccga

SEQ ID NO: 508931 - RNA, 64 nt, hsa
uggaguccugcaaaggcaaaagugccuaaggcucaccgugaaaaucauuacguggcccucagcc

SEQ ID NO: 508932 - RNA, 64 nt, hsa
uuugccacaacacacugcccgcagaaauggacuuaccgugaagccaauaaaguucaagcuucag

SEQ ID NO: 508933 - RNA, 64 nt, hsa
gagcagaaugugaggagcacgcgugagcuuauguaccgugaagaugaucagaggauaucuuauu

SEQ ID NO: 508934 - RNA, 64 nt, hsa
uuauucacuacgaagcuaaaauggccaaauauauaccgugaaaauugguuucauuuaacaaaag

SEQ ID NO: 508935 - RNA, 64 nt, hsa
aaaugcccucauaguagugggaagugugaaggugaccgugaacauccuuccucaucgggucugu

SEQ ID NO: 508936 - RNA, 64 nt, hsa
aguacagaggccauugaagccuuuugcuccucuuaccgugaaaaugaaauguuagccauuguau

SEQ ID NO: 508937 - RNA, 64 nt, hsa
acaaccugaaggccaucccgucggucugcacguaaccgugaagacguguggccgcgucccaccu

SEQ ID NO: 508938 - RNA, 64 nt, hsa
augagguucacaguagacuuugagugaccgucccaccgugaagugaauucucugagcugguggu

SEQ ID NO: 508939 - RNA, 64 nt, hsa
ccuucuggagaugacaacugaguggggaaaacagaccgugaacacaaaacaucaaguuccacac

SEQ ID NO: 508940 - RNA, 64 nt, hsa
caggaggguccuuguggacguggagaggggccgaaccgugaagggcuggaggccccggcggcua

SEQ ID NO: 508941 - RNA, 64 nt, hsa
uccagcugcccccgggaagccagccuccgcagccaccgugaagaggaagcggaagagccggugg

SEQ ID NO: 508942 - RNA, 64 nt, hsa
ugauugauuuuuaucuugcuauaaguucgaugacaccgugaaucuaauaagguucacuguugac

SEQ ID NO: 508943 - RNA, 64 nt, hsa
aggcucccucaggaccccauccuuuccugcccggaccgugaauucaucuccuugaagccauaac

SEQ ID NO: 508944 - RNA, 64 nt, hsa
aucaguaaaucagauucuguccucuucucugcauaccgugaauuuauaguuaaggaucccuuug

SEQ ID NO: 508945 - RNA, 64 nt, hsa
uaaaacagaguaaucuuguugguucaccauugagaccgugaagauacuuuguauuguccuauua

SEQ ID NO: 508946 - RNA, 64 nt, hsa
gccuuagagugauugcagugaacacuguuuacacaccgugaauccauucccaucaguccauucc

SEQ ID NO: 508947 - RNA, 64 nt, hsa
gcucguuagagccaguuuugaaacguuuggucuuaccgugaacggaggcuggcuuggcuuagcc

SEQ ID NO: 508948 - RNA, 64 nt, hsa
auuuugaggaaaaggaggaucagaaguucaagggaccgugaaagcccucagagucagcaccuag

SEQ ID NO: 508949 - RNA, 64 nt, hsa
uuuugauguauuauaggcaggaaguguuuuugcuaccgugaaaccuuuaccuagaucagccauc

SEQ ID NO: 508950 - RNA, 64 nt, hsa
auccacgccaugaucauguaucgccguaaacuggaccgugaagaaaucaagccugugaguugcg

SEQ ID NO: 508951 - RNA, 64 nt, hsa
gcaauguugaagugaccauaaaguggucacuuccaccgugaagcgaaagagccaguagugaauc

SEQ ID NO: 508952 - RNA, 64 nt, hsa
cagcaguggaguaaguauuuagaagugugaauucaccgugaaauaggugagauaaauuaaaaga

SEQ ID NO: 508953 - RNA, 64 nt, hsa
cuaaacauuuagcgugcgguuucccaucaguuuuaccgugaaugugaaaaggugaaacuggugc

SEQ ID NO: 508954 - RNA, 64 nt, hsa
cuucaccuccauccugguggacaugugguaccagaccgugaacaccugcuuccucccucgggca

SEQ ID NO: 508955 - RNA, 64 nt, hsa
agaggaagggaaaggcuaccgcgaagaggucuugaccgugaaggaaauuaccugagacccagag

SEQ ID NO: 508956 - RNA, 64 nt, hsa; identical to SEQ ID NO: 382042

SEQ ID NO: 508957 - RNA, 64 nt, hsa; identical to SEQ ID NO: 382043

SEQ ID NO: 508958 - RNA, 64 nt, hsa; identical to SEQ ID NO: 382044

SEQ ID NO: 508959 - RNA, 64 nt, hsa; identical to SEQ ID NO: 382045

SEQ ID NO: 508960 - RNA, 64 nt, hsa; identical to SEQ ID NO: 382046

SEQ ID NO: 508961 - RNA, 64 nt, hsa; identical to SEQ ID NO: 382047

SEQ ID NO: 508962 - RNA, 64 nt, hsa; identical to SEQ ID NO: 382048

SEQ ID NO: 508963 - RNA, 64 nt, hsa; identical to SEQ ID NO: 382049

SEQ ID NO: 508964 - RNA, 64 nt, hsa; identical to SEQ ID NO: 382050

SEQ ID NO: 508965 - RNA, 64 nt, hsa; identical to SEQ ID NO: 382051

SEQ ID NO: 508966 - RNA, 64 nt, hsa; identical to SEQ ID NO: 382052

SEQ ID NO: 508967 - RNA, 64 nt, hsa; identical to SEQ ID NO: 382053

SEQ ID NO: 508968 - RNA, 64 nt, hsa; identical to SEQ ID NO: 382054

SEQ ID NO: 508969 - RNA, 64 nt, hsa; identical to SEQ ID NO: 382055

SEQ ID NO: 508970 - RNA, 64 nt, hsa; identical to SEQ ID NO: 382056

SEQ ID NO: 508971 - RNA, 64 nt, hsa; identical to SEQ ID NO: 382057

SEQ ID NO: 508972 - RNA, 64 nt, hsa; identical to SEQ ID NO: 382058

SEQ ID NO: 508973 - RNA, 64 nt, hsa; identical to SEQ ID NO: 382059

SEQ ID NO: 508974 - RNA, 64 nt, hsa; identical to SEQ ID NO: 382060

SEQ ID NO: 508975 - RNA, 64 nt, hsa; identical to SEQ ID NO: 382061

SEQ ID NO: 508976 - RNA, 64 nt, hsa
caaguccuuguauucuaaaauagccaagcaaaaugauaguaaauucuuugucuuuguucuuuca

SEQ ID NO: 508977 - RNA, 64 nt, hsa
guggcuugccugugccucuggguggauuacauaugauaguaaagcccaccuguuuggaugggag

SEQ ID NO: 508978 - RNA, 64 nt, hsa
ugucuugagaaauuuacuugucacucuugcuucugauaguaaaggggauggugcgauagauuca

SEQ ID NO: 508979 - RNA, 64 nt, hsa
aacgccagaaacuuuucaguccagcuauucauuagauaguaauugaagauauguauaaauauua

SEQ ID NO: 508980 - RNA, 64 nt, hsa
aaugacaacauugagcccacacugcaguuuugaagauaguaacugauggcuggugggaaagagu

SEQ ID NO: 508981 - RNA, 64 nt, hsa
gauuacuaacccuuccugauccuggagaggcagggauaguaaauaaauugcucuuccuacccca

SEQ ID NO: 508982 - RNA, 64 nt, hsa
aggcuggaacauagugucugccucgcuuccuggagauaguaacugagcaggggcuacaaagagg

SEQ ID NO: 508983 - RNA, 64 nt, hsa
ccucugagcccgggucucuucauuaguugaaagggauaguaauaccuacuugcagguuguuguc

SEQ ID NO: 508984 - RNA, 64 nt, hsa
gcauguuucuucaugaaaaguauguuguuguuuugauaguaauaauaauaaauguaggcucagc

SEQ ID NO: 508985 - RNA, 64 nt, hsa
auggcacugucauguuuuaacauuugcaacuagggauaguaaguacaacauuuuuaacucucau

SEQ ID NO: 508986 - RNA, 64 nt, hsa
ucauuaauucuagaaacuauaaccagggcucugggauaguaagagaggugacaacccacccaga

SEQ ID NO: 508987 - RNA, 64 nt, hsa
auaggaugguaaugccagucccaggggagggugugauaguaaggaaggccacuguuagguuucc

SEQ ID NO: 508988 - RNA, 64 nt, hsa
cuuuaggguaaccaucauguaugcccacgagggugauaguaauucgugagacugaaguugcuua

SEQ ID NO: 508989 - RNA, 64 nt, hsa
gcuauaggaucuuauguaaacaguuuuuguuucugauaguaauggacuuuauucuaacuugaga

SEQ ID NO: 508990 - RNA, 64 nt, hsa
ccauaagugcuugugagguauuugcaaagugcaugauaguaaugcucggaguuuuuauaauuuu

SEQ ID NO: 508991 - RNA, 64 nt, hsa
uauauggcagaggugauggcugguggguaaaugugauaguaaauuguagaaaccucuucugauu

SEQ ID NO: 508992 - RNA, 64 nt, hsa
agcacaacuacauacauccaggaaucugaagucagauaguaaggaugugguaccaauccucccg

SEQ ID NO: 508993 - RNA, 64 nt, hsa
ucaauuguuaguuauaauuguuggaccuccuugagauaguaacaacaaaauaaagcaagcuauc

SEQ ID NO: 508994 - RNA, 64 nt, hsa
uguuucaucagaucuugaucaguuuacuaaagaugauaguaaacucaguauuucucccacagcu

SEQ ID NO: 508995 - RNA, 64 nt, hsa
ucagauaggacaacacugcuggguuuuacauccagauaguaauaaacaccauuucaucauuuuc

SEQ ID NO: 508996 - RNA, 64 nt, hsa
agacuuauucgacucauuaaugaggaaaccagcagauaguaaaccugguucaaaguacaauuca

SEQ ID NO: 508997 - RNA, 64 nt, hsa
ucccuuugaggucucuauggcucugauuguacaugauaguaaguguaagccauguaaaaaguaa

SEQ ID NO: 508998 - RNA, 64 nt, hsa
uaagcaggauugaauuuaccagaggcuaaguucagauaguaagaauaaugcauaugugauuguu

SEQ ID NO: 508999 - RNA, 64 nt, hsa
ugaguguaugaguagccaggguaagggguaaaaggauaguaagcauagaaaccacuagaaagug

SEQ ID NO: 509000 - RNA, 64 nt, hsa
acuauuacauugaauggagucccuuggauauuuugauaguaaaauuaauagccauaaaguccua

SEQ ID NO: 509001 - RNA, 64 nt, hsa
acccaacccaaacacaucagcuuucaaaugagaugauaguaaaugcggcaauguuaagacaaga

SEQ ID NO: 509002 - RNA, 64 nt, hsa
gcuuugaagaggaagccauuauggauggaugaaggauaguaaugcaauaccuccaccuuaauuu

SEQ ID NO: 509003 - RNA, 64 nt, hsa
uucucuaaaacucaaaaaaaaaaaaaaaacucaagauaguaaaagcaccuagugugauagauua

SEQ ID NO: 509004 - RNA, 64 nt, hsa
acuauuuaacuugagcuuuaaaaaucauuguauggauaguaaaauucuacuguauggaauacaa

SEQ ID NO: 509005 - RNA, 64 nt, hsa
auccugggcacaaagugccugaugucaaaaugaagauaguaaaacaagggaggaagcaguggau

SEQ ID NO: 509006 - RNA, 64 nt, hsa
ugaaaaauuccuuuguguuucuauugacuucaaugauaguaagaaaagugguuguuaguuauag

SEQ ID NO: 509007 - RNA, 64 nt, hsa
guuuuaaagugugcuuguguugucaaaaauaucagauaguaauacacagugagcauuuuuaaac

SEQ ID NO: 509008 - RNA, 64 nt, hsa
uaaaguuacaggaacacgaucccuaguuuucauugauaguaacgcuguuucuaauuugucuuaa

SEQ ID NO: 509009 - RNA, 64 nt, hsa
aauaaaagaaagucauauguaggaaacaaagucugauaguaaaacaagccagagaucuucuaac

SEQ ID NO: 509010 - RNA, 64 nt, hsa
caagaacuuugaaggucaaauuaggcaaauuccagauaguaaaacaaucccuaagccuuaaguc

SEQ ID NO: 509011 - RNA, 64 nt, hsa
gcuguuaaugcucugugaguuuagaaaaagucuugauaguaaaucuaguuuuugacacagugca

SEQ ID NO: 509012 - RNA, 64 nt, hsa
cagugcauggaaucuccaucauuguuauuuuaacgauaguaauucacaguccucagaagccuau

SEQ ID NO: 509013 - RNA, 64 nt, hsa
uuuuugucaacauugugauguauauuccuuugaagauaguaacuguagauggaaaaacuugugc

SEQ ID NO: 509014 - RNA, 64 nt, hsa
ugguacuuacuguggacuucauagcuuacugacagauaguaauuugauuuauuuauugacagac

SEQ ID NO: 509015 - RNA, 64 nt, hsa
gauauaguugacuaaauguauuuguucuuauauggauaguaauaugaaugugacaugcaccaau

SEQ ID NO: 509016 - RNA, 64 nt, hsa
ucagaaucuuugcuggucccuuuaaugcugauuugauaguaaaucaauuucagcugagacauaa

SEQ ID NO: 509017 - RNA, 64 nt, hsa
uuuauguuaacauuguguuagcuuuuauuuccuggauaguaacuggucaggauauauuuuaaug

SEQ ID NO: 509018 - RNA, 64 nt, hsa
caguuaaacugauuaguauucaggcacugagaaugauaguaauaggauacaauguauaagcuac

SEQ ID NO: 509019 - RNA, 64 nt, hsa
aggcccuugguuauuuaaaucuuggauuauuugugauaguaaucacaaauuuuuggcuaauuuu

SEQ ID NO: 509020 - RNA, 64 nt, hsa
ccuuuaccuuuuaauaucuaguuuuuccaaaaaugauaguaauaucuuuugaagaacuaugcuu

SEQ ID NO: 509021 - RNA, 64 nt, hsa
uugguguuugguuggugugcauuucuuuagugucgauaguaacuggauuuuucuuuuuccuuaa

SEQ ID NO: 509022 - RNA, 64 nt, hsa
auaguaaauauaaggucacugagauucuaaguaagauaguaaaucuaaggucacugagccaaau

SEQ ID NO: 509023 - RNA, 64 nt, hsa
gaaugcuguguuaaauaaaccucaaaaugucuaagauaguaacaaugaagauaaaaagacauuc

SEQ ID NO: 509024 - RNA, 64 nt, hsa
cugggggaugucuguccuaaaagcugacugcuaggauaguaaggaucaucuugccugggcuaug

SEQ ID NO: 509025 - RNA, 64 nt, hsa
cuuuugguacuaccauuuggggaagccaagcaaggauaguaaauugaccagaacacaguugugg

SEQ ID NO: 509026 - RNA, 64 nt, hsa
uauauggggugagaaguuugggcugaucgccagugauaguaaacaaaaucugugcagagggccu

SEQ ID NO: 509027 - RNA, 64 nt, hsa
auuauuuuuaauuuuucuggcugaauaucaaauugauaguaacaacagaagcauaauuuuagga

SEQ ID NO: 509028 - RNA, 64 nt, hsa
uugagggcuucuugaucacagaaaacucagaagagauaguaaugcucaggacaggagcggcagc

SEQ ID NO: 509029 - RNA, 64 nt, hsa
caaacacaaggaaagaucagaugaaacagaagaugauaguaaaagugauccuaaguaagaacau

SEQ ID NO: 509030 - RNA, 64 nt, hsa
gcagaaacaaaaacccaacauauaugggcuguuagauaguaauuguaauuucguauaaauagua

SEQ ID NO: 509031 - RNA, 64 nt, hsa
uauauggggugagaaguuuaggcugaucgccagugauaguaaacaaaaucugugcagagggccu

SEQ ID NO: 509032 - RNA, 64 nt, hsa
gguaauuggcagauucuaaauaauauaauuuccagauaguaauuuuaagaguacucaucgcucu

SEQ ID NO: 509033 - RNA, 64 nt, hsa
augguaaguacuugaguaaaucuaaagaaauauugauaguaaggcaauccuaagcaaaaagaac

SEQ ID NO: 509034 - RNA, 64 nt, hsa
augucucuuuuguuaacagaaaccacuuuuaaaggauaguaauuauucuuguuuauaacagugc

SEQ ID NO: 509035 - RNA, 64 nt, hsa
ugaagaaaggaggacuuuuaaaaauuuaagguaagauaguaauagcuucaaaagaacacauaca

SEQ ID NO: 509036 - RNA, 64 nt, hsa
augcugagaguagcagaugcuuuucuuuugggaggauaguaaaacaauuuagaaccagauaugc

SEQ ID NO: 509037 - RNA, 64 nt, hsa
caaagaaagguuguggaaauguuucagauuaaaugauaguaaaaacaccugacaacuaaacaua

SEQ ID NO: 509038 - RNA, 64 nt, hsa
ucauguuuuaaauaggaauuuauaaaauauuuaugauaguaauaaaguaguauuuuauguguuu

SEQ ID NO: 509039 - RNA, 64 nt, hsa
augcuuuguuuacguguaaaggaaaauaauguuugauaguaaauguccacuuaaaauacaugaa

SEQ ID NO: 509040 - RNA, 64 nt, hsa
cuugaucaucugcuuccuuuuugaauuuuuaacagauaguaaguaaauuuggugguuuuuuccc

SEQ ID NO: 509041 - RNA, 64 nt, hsa
accauggauuuaacuuaugaaaauccaaaugcaggauaguaauuuuuguuuacuuuuuuaacca

SEQ ID NO: 509042 - RNA, 64 nt, hsa
agaaaugauguugguuuaccuuuuccuaguugaagauaguaauuagguuucuaagcuguauacu

SEQ ID NO: 509043 - RNA, 64 nt, hsa
caacaucacuagauuuaaauauuuaguauauuuugauaguaaaggguuuuguuucuugaauauc

SEQ ID NO: 509044 - RNA, 64 nt, hsa
acauuaaagcuacgaaaacucauccuggcuguaggauaguaauaaaggaagaauuaugacuuca

SEQ ID NO: 509045 - RNA, 64 nt, hsa
ggagauuuaggguaagucauggguugaggugucagauaguaauaucuauuuguuuuguacaugu

SEQ ID NO: 509046 - RNA, 64 nt, hsa
uggacauuuuucuagcauucacccuugggcugcagauaguaauauauaaacacacacaaugauu

SEQ ID NO: 509047 - RNA, 64 nt, hsa
uugagggcuugagaugaagggaagacucuuaccagauaguaagacagcugaguuuuccucaguu

SEQ ID NO: 509048 - RNA, 64 nt, hsa
ugguuuaugaacuucccauaggaagcaccugagagauaguaaacugcagcaaguaacuaugugu

SEQ ID NO: 509049 - RNA, 64 nt, hsa
cacucugucuuaaaagaaaaaaaaaaaagagagagauaguaaucucuugggcaaaagguaucaa

SEQ ID NO: 509050 - RNA, 64 nt, hsa
gaaugagaauuauccaaaugcucagucuaccugagauaguaaauucauggcuuaugcuucuggu

SEQ ID NO: 509051 - RNA, 64 nt, hsa
uagccaggcuggccagagaggggugcagggguuagauaguaagugguggucguuuguggucagu

SEQ ID NO: 509052 - RNA, 64 nt, hsa
uaauuuuaauucuaagucaaaauacaaaugcauagauaguaaaugauaaaguagagacucauau

SEQ ID NO: 509053 - RNA, 64 nt, hsa
cuugcagggcaggggaugcccagaagaguggugagauaguaaaacacuuauucccucauccuuu

SEQ ID NO: 509054 - RNA, 64 nt, hsa
caguggccacguggaagcuuuguagcauugagcagauaguaaaauaucuuagaauuaaugaucu

SEQ ID NO: 509055 - RNA, 64 nt, hsa
aguuacaaggcugaauggugcagccgcuggaccugauaguaaggugcaaagguccaaaccuggg

SEQ ID NO: 509056 - RNA, 64 nt, hsa
ucaauugccauuauuuguauugaaguaucagauagauaguaaauacugcaacuaguagcuugau

SEQ ID NO: 509057 - RNA, 64 nt, hsa
aaaacuuuuagccauagggucuuuuauagacagggauaguaaaaugaaaauugagaaauauaag

SEQ ID NO: 509058 - RNA, 64 nt, hsa
uuaacauguuucaaauguuuuauacauuuuuggagauaguaaaaauuuaaaaauguaauaggga

SEQ ID NO: 509059 - RNA, 64 nt, hsa
ccuucuucauaaaucauggaaaacucacugcugagauaguaaaccaugaaaucgccuuuucagu

SEQ ID NO: 509060 - RNA, 64 nt, hsa
uuccucuuccaaaguaaaauugcugugcuuuauggauaguaagaauggcccuagagugggaguc

SEQ ID NO: 509061 - RNA, 64 nt, hsa
uuuucauaguaauucaaaugaacuuccuauuuuugauaguaaaugucauuuaauaguauacuug

SEQ ID NO: 509062 - RNA, 64 nt, hsa
uccggcagagaugggguuuauguauguucagccagauaguaaaugggauuuuuggagaaauaag

SEQ ID NO: 509063 - RNA, 64 nt, hsa
caaaaagcccacccaggacuuagccucaguugacgauaguaacaauggccuuaacaucuaccuu

SEQ ID NO: 509064 - RNA, 64 nt, hsa
agauaauacguuacacuaagaaaaggaaaauguggauaguaaaacccaccucucucauccuauu

SEQ ID NO: 509065 - RNA, 64 nt, hsa
uuaggagaacucggcuuuugaaauguucuuucucgauaguaauaaugugggcugccagccucuc

SEQ ID NO: 509066 - RNA, 64 nt, hsa
guguaaggugauguucccggucgcuguugcaccugauaguaagggacagauuuuuaaugaacau

SEQ ID NO: 509067 - RNA, 64 nt, hsa
augaaauagaacuuuauauuuuugcauauguauagauaguaauuauauuuaauguauaacuaua

SEQ ID NO: 509068 - RNA, 64 nt, hsa
aagagguccucgaucaugguguuagaauugacuggauaguaacagguggucugguggauagcgg

SEQ ID NO: 509069 - RNA, 64 nt, hsa
agagcaaagaaaagucuucugugugggaacacaagauaguaaacuuauuuaaaaaccuauuagu

SEQ ID NO: 509070 - RNA, 64 nt, hsa
uauguauuuuuucuucuuggagugaaaauccuuagauaguaaaacuguuauagauuauuguuua

SEQ ID NO: 509071 - RNA, 64 nt, hsa
aaaguguguccaguuuugccugucuauaaaagaugauaguaauuuaccaagugacauuugcaga

SEQ ID NO: 509072 - RNA, 64 nt, hsa
gcaaaaaauaaauaaaaaauaaaaauguaaauaugauaguaauaaaauagagcauaacgaaacu

SEQ ID NO: 509073 - RNA, 64 nt, hsa
cuuugggccucacuuucccuaucugaauaauaaggauaguaaucccuugccuuuucucaaacca

SEQ ID NO: 509074 - RNA, 64 nt, hsa
gaaggagaggaaacuugccuuuuuuauggcagaggauaguaaugaaaaugucucaguauuuuag

SEQ ID NO: 509075 - RNA, 64 nt, hsa
ccaggccucucccucccgagugcauuuuuggggagauaguaaauguuuuauucggguguaucau

SEQ ID NO: 509076 - RNA, 64 nt, hsa
ccauuucuggggccucaucacuguggaagacggggauaguaagagauaagugggugggaggcac

SEQ ID NO: 509077 - RNA, 64 nt, hsa
gcaggcuuggaggguuaauuuacccacagaaugugauaguaauaggggagggaggcugcugugg

SEQ ID NO: 509078 - RNA, 64 nt, hsa
uuuucaggugucuacaucagccuuagucauuauggauaguaaaucgaccuuuaagaauuccugg

SEQ ID NO: 509079 - RNA, 64 nt, hsa
cuuuuucgauaauuuuaguagguacaaaaagguugauaguaaccuguauuuauuucaaagaugc

SEQ ID NO: 509080 - RNA, 64 nt, hsa
ucagucagauuucugaaaagugagagguaguuuugauaguaaaaauuuuugguugugccuagaa

SEQ ID NO: 509081 - RNA, 64 nt, hsa
aauugucagauuccacuacccuuucuuccucauagauaguaauuaccaauguaacuaaguauuu

SEQ ID NO: 509082 - RNA, 64 nt, hsa
cugccuuuuauuuuuuaaccuuaaaaaguagccagauaguaacaagacuggcuggcugaugagc

SEQ ID NO: 509083 - RNA, 64 nt, hsa
uagcauuagcacccccauuauauuaauuuucagggauaguaaauacuccaaaaugaaauuggua

SEQ ID NO: 509084 - RNA, 64 nt, hsa
uguaaguucuauuuaauacuugcgacaacccugagauaguaaguauuauuauuguucucauuuu

SEQ ID NO: 509085 - RNA, 64 nt, hsa
uggcauauuaugauguaaugcuaauugcuuguaggauaguaaauggucaguauugaaaccuaau

SEQ ID NO: 509086 - RNA, 64 nt, hsa
cuguuggcugcaggacucagagcauggacagguggauaguaaaucaccaccacggggacagccg

SEQ ID NO: 509087 - RNA, 64 nt, hsa
augcugucucuugugaaauagaugaauaaaaugugauaguaacauaguagaguacucucuagca

SEQ ID NO: 509088 - RNA, 64 nt, hsa
ucccacccucaacuccaccaaaguaaauccuuucgauaguaaaaguuuaauaauuucuuguggg

SEQ ID NO: 509089 - RNA, 64 nt, hsa
gugggccauuuuccugaacucaccacuuacccgggauaguaaacaugauacacaucaauaaagg

SEQ ID NO: 509090 - RNA, 64 nt, hsa
ucccuuuucucuguaugcaguuggacucgucagagauaguaaaaucaucuuuuaguguuuuuuu

SEQ ID NO: 509091 - RNA, 64 nt, hsa
gagggacuagcuuggccuuugcgcuuugauuccagauaguaagaugaguggaaguguuuaucga

SEQ ID NO: 509092 - RNA, 64 nt, hsa
ucacauucagguuagauguuaccuccaccuauaugauaguaauuccuaauuuuauuuuuuauug

SEQ ID NO: 509093 - RNA, 64 nt, hsa
cuauauuuuuuucuuuuagggaaaacauaaaacagauaguaaaacuccuugcaaguguucgagc

SEQ ID NO: 509094 - RNA, 64 nt, hsa
guauggagagugggcagacuucuguggagggcccgauaguaaccauuugaagcuuucuggaccu

SEQ ID NO: 509095 - RNA, 64 nt, hsa
augaugcuuuucuucucagaacuuguguuaaguagauaguaaacagauugauucaugauaauug

SEQ ID NO: 509096 - RNA, 64 nt, hsa
ugccagucuguuuaucccuccagauacagucucugauaguaaacuuuucuuucucuuacacaaa

SEQ ID NO: 509097 - RNA, 64 nt, hsa
cugcgggagggggagggggagugggcgggcaguggauaguaagacuuacugcagucgauuuggg

SEQ ID NO: 509098 - RNA, 64 nt, hsa
acauggaauggagaaaaccaagauuccagauggggauaguaacuagaaggugcuucagaugcac

SEQ ID NO: 509099 - RNA, 64 nt, hsa
gaagcucucugcagcugucucauuccuucccaacgauaguaacaggaaaugacucuuuagcauc

SEQ ID NO: 509100 - RNA, 64 nt, hsa
guuuuaagggaaaaaaaaucagaagugcugguuagauaguaaaaacuuaggauaacuuagaaag

SEQ ID NO: 509101 - RNA, 64 nt, hsa
uuguguccaggauguacaaagaacucucaaaccggauaguaagaaaacaaacagcccaagugaa

SEQ ID NO: 509102 - RNA, 64 nt, hsa
uagugcuaugguuguuucuauaauucuaaccuuugauaguaaucagaauguauuacauuucauu

SEQ ID NO: 509103 - RNA, 64 nt, hsa
agccuuucucggcaucaucuuguauuccuuaucagauaguaaguaaccuguaaguuuggaguau

SEQ ID NO: 509104 - RNA, 64 nt, hsa
uccaauuuauuugcauuuuuaaacauuagccuaugauaguaauuuaauguagaaugaagauauu

SEQ ID NO: 509105 - RNA, 64 nt, hsa
cucagaggaaacaguaagaagggauaaucauuaagauaguaaaacaggcaaagcagaaucacau

SEQ ID NO: 509106 - RNA, 64 nt, hsa
uggauuuucaccagucauguguuaauuuacauuagauaguaaagaauggcuacacuaagacuga

SEQ ID NO: 509107 - RNA, 64 nt, hsa
uaagugaaaaaaauagguaacaaaacaaccaccugauaguaaguuuucugauaagacuauagau

SEQ ID NO: 509108 - RNA, 64 nt, hsa
cuucaaauuauugaccuggacaggguccaagucugauaguaaccuuuuacaagaaagaacaggg

SEQ ID NO: 509109 - RNA, 64 nt, hsa
cugaccccuucacuaugacuacacagaaucuccugauaguaaagggggcuggagacaaggauaa

SEQ ID NO: 509110 - RNA, 64 nt, hsa
uagugcugacagauuccacuagcaugcugaguaggauaguaaaucaggaugcucauaacuuugu

SEQ ID NO: 509111 - RNA, 64 nt, hsa; identical to SEQ ID NO: 156567

SEQ ID NO: 509112 - RNA, 64 nt, hsa; identical to SEQ ID NO: 156568

SEQ ID NO: 509113 - RNA, 64 nt, hsa; identical to SEQ ID NO: 156569

SEQ ID NO: 509114 - RNA, 64 nt, hsa; identical to SEQ ID NO: 156570

SEQ ID NO: 509115 - RNA, 64 nt, hsa; identical to SEQ ID NO: 156571

SEQ ID NO: 509116 - RNA, 64 nt, hsa; identical to SEQ ID NO: 156572

SEQ ID NO: 509117 - RNA, 64 nt, hsa; identical to SEQ ID NO: 156573

SEQ ID NO: 509118 - RNA, 64 nt, hsa; identical to SEQ ID NO: 156574

SEQ ID NO: 509119 - RNA, 64 nt, hsa; identical to SEQ ID NO: 156575

SEQ ID NO: 509120 - RNA, 64 nt, hsa; identical to SEQ ID NO: 156576

SEQ ID NO: 509121 - RNA, 64 nt, hsa; identical to SEQ ID NO: 156577

SEQ ID NO: 509122 - RNA, 64 nt, hsa; identical to SEQ ID NO: 156578

SEQ ID NO: 509123 - RNA, 64 nt, hsa; identical to SEQ ID NO: 156579

SEQ ID NO: 509124 - RNA, 64 nt, hsa; identical to SEQ ID NO: 156580

SEQ ID NO: 509125 - RNA, 64 nt, hsa; identical to SEQ ID NO: 156581

SEQ ID NO: 509126 - RNA, 64 nt, hsa; identical to SEQ ID NO: 156582

SEQ ID NO: 509127 - RNA, 64 nt, hsa; identical to SEQ ID NO: 156583

SEQ ID NO: 509128 - RNA, 64 nt, hsa; identical to SEQ ID NO: 156584

SEQ ID NO: 509129 - RNA, 64 nt, hsa; identical to SEQ ID NO: 156585

SEQ ID NO: 509130 - RNA, 64 nt, hsa; identical to SEQ ID NO: 156586

SEQ ID NO: 509131 - RNA, 64 nt, hsa; identical to SEQ ID NO: 156587

SEQ ID NO: 509132 - RNA, 64 nt, hsa; identical to SEQ ID NO: 156588

SEQ ID NO: 509133 - RNA, 64 nt, hsa; identical to SEQ ID NO: 156589

SEQ ID NO: 509134 - RNA, 64 nt, hsa; identical to SEQ ID NO: 156590

SEQ ID NO: 509135 - RNA, 64 nt, hsa; identical to SEQ ID NO: 156591

SEQ ID NO: 509136 - RNA, 64 nt, hsa; identical to SEQ ID NO: 156592

SEQ ID NO: 509137 - RNA, 64 nt, hsa; identical to SEQ ID NO: 156593

SEQ ID NO: 509138 - RNA, 64 nt, hsa; identical to SEQ ID NO: 156594

SEQ ID NO: 509139 - RNA, 64 nt, hsa; identical to SEQ ID NO: 156595

SEQ ID NO: 509140 - RNA, 64 nt, hsa; identical to SEQ ID NO: 156596

SEQ ID NO: 509141 - RNA, 64 nt, hsa; identical to SEQ ID NO: 156597

SEQ ID NO: 509142 - RNA, 64 nt, hsa; identical to SEQ ID NO: 156598

SEQ ID NO: 509143 - RNA, 64 nt, hsa; identical to SEQ ID NO: 156599

SEQ ID NO: 509144 - RNA, 64 nt, hsa; identical to SEQ ID NO: 156600

SEQ ID NO: 509145 - RNA, 64 nt, hsa; identical to SEQ ID NO: 156601

SEQ ID NO: 509146 - RNA, 64 nt, hsa; identical to SEQ ID NO: 156602

SEQ ID NO: 509147 - RNA, 64 nt, hsa; identical to SEQ ID NO: 156603

SEQ ID NO: 509148 - RNA, 64 nt, hsa; identical to SEQ ID NO: 156604

SEQ ID NO: 509149 - RNA, 64 nt, hsa; identical to SEQ ID NO: 156605

SEQ ID NO: 509150 - RNA, 64 nt, hsa; identical to SEQ ID NO: 156606

SEQ ID NO: 509151 - RNA, 64 nt, hsa; identical to SEQ ID NO: 156607

SEQ ID NO: 509152 - RNA, 64 nt, hsa
gucaggacuuuaucagcagggguaaaacuaccaccuggccuagccuaaguaggaagugaaaaga

SEQ ID NO: 509153 - RNA, 64 nt, hsa
caggcaaacauggucaguauucuguaaaguuccccuggccuaaaugauuacuugcucugggcaa

SEQ ID NO: 509154 - RNA, 64 nt, hsa
uuacugcagccauucugugugugugguucagacccuggccuagggccggugauguggaugagug

SEQ ID NO: 509155 - RNA, 64 nt, hsa
uucccugccaagcaucgugcaauaagugaauuuccuggccuacuucauaaucucuaaguuuggg

SEQ ID NO: 509156 - RNA, 64 nt, hsa
aagcucugggagcuugacuauggaccaaacagcucuggccuagggauugggccacccuacccag

SEQ ID NO: 509157 - RNA, 64 nt, hsa
caggcauggcugucuccugccccugccugcccaucuggccuauaccccagccguggggcccggg

SEQ ID NO: 509158 - RNA, 64 nt, hsa
aaagcacugggauuacaggcgugagccacccggccuggccuagaaugacuuuuaaaagaucaaa

SEQ ID NO: 509159 - RNA, 64 nt, hsa
aaagugcuggaauuacaggcauuagccaccaugccuggccuauucuggucucuuuaacucucuc

SEQ ID NO: 509160 - RNA, 64 nt, hsa
ggcccggucccaguccggugccuuccacccugcccuggccuaccacagcugccuccgggccucg

SEQ ID NO: 509161 - RNA, 64 nt, hsa
ccagugucuggcccagccauggcuggaugugcaucuggccuaugacccugugccuguguuucau

SEQ ID NO: 509162 - RNA, 64 nt, hsa; identical to SEQ ID NO: 166002

SEQ ID NO: 509163 - RNA, 64 nt, hsa; identical to SEQ ID NO: 166003

SEQ ID NO: 509164 - RNA, 64 nt, hsa; identical to SEQ ID NO: 166004

SEQ ID NO: 509165 - RNA, 64 nt, hsa; identical to SEQ ID NO: 166005

SEQ ID NO: 509166 - RNA, 64 nt, hsa; identical to SEQ ID NO: 166006

SEQ ID NO: 509167 - RNA, 64 nt, hsa; identical to SEQ ID NO: 166007

SEQ ID NO: 509168 - RNA, 64 nt, hsa; identical to SEQ ID NO: 166008

SEQ ID NO: 509169 - RNA, 64 nt, hsa; identical to SEQ ID NO: 166009

SEQ ID NO: 509170 - RNA, 64 nt, hsa; identical to SEQ ID NO: 166010

SEQ ID NO: 509171 - RNA, 60 nt, hsa; identical to SEQ ID NO: 166011

SEQ ID NO: 509172 - RNA, 64 nt, hsa; identical to SEQ ID NO: 166012

SEQ ID NO: 509173 - RNA, 64 nt, hsa
ccugagucugguggggacuuggagaaccuuuaugucuagcuaagggauuguaaauacaccgaug

SEQ ID NO: 509174 - RNA, 64 nt, hsa
gggacuuggagaaccuuuguguccacacucuguaucuagcuaaucuaguggggauguggagaac

SEQ ID NO: 509175 - RNA, 64 nt, hsa; identical to SEQ ID NO: 91216

SEQ ID NO: 509176 - RNA, 64 nt, hsa; identical to SEQ ID NO: 91217

SEQ ID NO: 509177 - RNA, 64 nt, hsa; identical to SEQ ID NO: 91218

SEQ ID NO: 509178 - RNA, 64 nt, hsa; identical to SEQ ID NO: 91219

SEQ ID NO: 509179 - RNA, 64 nt, hsa; identical to SEQ ID NO: 91220

SEQ ID NO: 509180 - RNA, 64 nt, hsa; identical to SEQ ID NO: 91221

SEQ ID NO: 509181 - RNA, 64 nt, hsa; identical to SEQ ID NO: 91222

SEQ ID NO: 509182 - RNA, 64 nt, hsa; identical to SEQ ID NO: 91223

SEQ ID NO: 509183 - RNA, 64 nt, hsa; identical to SEQ ID NO: 91224

SEQ ID NO: 509184 - RNA, 55 nt, hsa; identical to SEQ ID NO: 91225

SEQ ID NO: 509185 - RNA, 64 nt, hsa; identical to SEQ ID NO: 91226

SEQ ID NO: 509186 - RNA, 64 nt, hsa; identical to SEQ ID NO: 91227

SEQ ID NO: 509187 - RNA, 64 nt, hsa; identical to SEQ ID NO: 91228

SEQ ID NO: 509188 - RNA, 64 nt, hsa; identical to SEQ ID NO: 91229

SEQ ID NO: 509189 - RNA, 64 nt, hsa; identical to SEQ ID NO: 91230

SEQ ID NO: 509190 - RNA, 64 nt, hsa; identical to SEQ ID NO: 91231

SEQ ID NO: 509191 - RNA, 64 nt, hsa; identical to SEQ ID NO: 91232

SEQ ID NO: 509192 - RNA, 64 nt, hsa; identical to SEQ ID NO: 91233

SEQ ID NO: 509193 - RNA, 64 nt, hsa; identical to SEQ ID NO: 91234

SEQ ID NO: 509194 - RNA, 64 nt, hsa; identical to SEQ ID NO: 91235

SEQ ID NO: 509195 - RNA, 64 nt, hsa; identical to SEQ ID NO: 91236

SEQ ID NO: 509196 - RNA, 64 nt, hsa; identical to SEQ ID NO: 91237

SEQ ID NO: 509197 - RNA, 64 nt, hsa; identical to SEQ ID NO: 91238

SEQ ID NO: 509198 - RNA, 55 nt, hsa; identical to SEQ ID NO: 91239

SEQ ID NO: 509199 - RNA, 64 nt, hsa; identical to SEQ ID NO: 91240

SEQ ID NO: 509200 - RNA, 64 nt, hsa; identical to SEQ ID NO: 91241

SEQ ID NO: 509201 - RNA, 64 nt, hsa; identical to SEQ ID NO: 91242

SEQ ID NO: 509202 - RNA, 64 nt, hsa; identical to SEQ ID NO: 91243

SEQ ID NO: 509203 - RNA, 64 nt, hsa; identical to SEQ ID NO: 91244

SEQ ID NO: 509204 - RNA, 64 nt, hsa; identical to SEQ ID NO: 91245

SEQ ID NO: 509205 - RNA, 64 nt, hsa; identical to SEQ ID NO: 91246

SEQ ID NO: 509206 - RNA, 64 nt, hsa; identical to SEQ ID NO: 91247

SEQ ID NO: 509207 - RNA, 64 nt, hsa; identical to SEQ ID NO: 91248

SEQ ID NO: 509208 - RNA, 64 nt, hsa; identical to SEQ ID NO: 91249

SEQ ID NO: 509209 - RNA, 64 nt, hsa; identical to SEQ ID NO: 91250

SEQ ID NO: 509210 - RNA, 64 nt, hsa; identical to SEQ ID NO: 91251

SEQ ID NO: 509211 - RNA, 64 nt, hsa; identical to SEQ ID NO: 91252

SEQ ID NO: 509212 - RNA, 64 nt, hsa; identical to SEQ ID NO: 91253

SEQ ID NO: 509213 - RNA, 64 nt, hsa; identical to SEQ ID NO: 91254

SEQ ID NO: 509214 - RNA, 64 nt, hsa; identical to SEQ ID NO: 91255

SEQ ID NO: 509215 - RNA, 64 nt, hsa; identical to SEQ ID NO: 91256

SEQ ID NO: 509216 - RNA, 64 nt, hsa; identical to SEQ ID NO: 91257

SEQ ID NO: 509217 - RNA, 64 nt, hsa; identical to SEQ ID NO: 91258

SEQ ID NO: 509218 - RNA, 64 nt, hsa; identical to SEQ ID NO: 91259

SEQ ID NO: 509219 - RNA, 64 nt, hsa; identical to SEQ ID NO: 91260

SEQ ID NO: 509220 - RNA, 64 nt, hsa; identical to SEQ ID NO: 91261

SEQ ID NO: 509221 - RNA, 64 nt, hsa
augagaaugcucuuccuuauucugguagauuugacuuguuuauaauucugcacuuuagaagaaa

SEQ ID NO: 509222 - RNA, 64 nt, hsa
gugugugugcguguguguguucaagugccuaaaucuuguuuaccuaucacuuuaaaaaaauaau

SEQ ID NO: 509223 - RNA, 64 nt, hsa
ugcauuucuucacaccaguacauucuuaaguguacuuguuuauaaggaauaacauaaacuaauc

SEQ ID NO: 509224 - RNA, 64 nt, hsa
cagagaccacagaccacagugauuuuucuuuucccuuguuuaauuaggcaauacccuuguuaau

SEQ ID NO: 509225 - RNA, 64 nt, hsa
cacaugcugguuuguuugcuugcuuguuuacuugcuuguuuaccaauagaguugaccuguuauu

SEQ ID NO: 509226 - RNA, 64 nt, hsa
ccaguuuucugucacaugcugguuuguuugcuugcuuguuuacuugcuuguuuaccaauagagu

SEQ ID NO: 509227 - RNA, 64 nt, hsa
gucaucugacuucugaucaagcauuagauuuuaacuuguuuagauuuugucuuaaacaccagua

SEQ ID NO: 509228 - RNA, 64 nt, hsa
uuuagauuuugucuuaaacaccaguaauauggcucuuguuuaucagcuaaucuugaauuuauuc

SEQ ID NO: 509229 - RNA, 64 nt, hsa
uaaaaucacaaauguuuggaaaacacaaaaguaacuuguuuaucucagucuguacaaaaacagu

SEQ ID NO: 509230 - RNA, 64 nt, hsa
auauucucagaauguuaucaccuguuugucaaagcuuguuuaaauuauaaaacacuuuuaauua

SEQ ID NO: 509231 - RNA, 64 nt, hsa
aacuuuaagccuccuuuuagagauauuuuuaaaacuuguuuaaaauuuuugugcaauucauaua

SEQ ID NO: 509232 - RNA, 64 nt, hsa
acaaaaaaagaaaguuauucuuaguaaggaacuucuuguuuaauagcauuuuuguuuauuuuaa

SEQ ID NO: 509233 - RNA, 64 nt, hsa
agugguagaacuauaugucuggucccuugcugcucuuguuuaggccacuaucauagauauauuu

SEQ ID NO: 509234 - RNA, 64 nt, hsa
gaggugucaaaagacccaaauuaggugcauuuuacuuguuuaugauggcauaaccauugcuuua

SEQ ID NO: 509235 - RNA, 64 nt, hsa
caugacgugugagcagaaugccuuauuuuguaaucuuguuuaacuuguugcuacugggacuuga

SEQ ID NO: 509236 - RNA, 64 nt, hsa
aaauuuuaauuuuuuucuauuuugaaauuugaggcuuguuuacauugcuuagauaauuuagaau

SEQ ID NO: 509237 - RNA, 64 nt, hsa
ugaaaacauaagugucucuggccaucaaagugaucuuguuuacagcagugcuuuugugaaacaa

SEQ ID NO: 509238 - RNA, 64 nt, hsa
uucugcuuagaaucuaaagauguguuuagaaccucuuguuuaaaaauaauagacugcuuaucau

SEQ ID NO: 509239 - RNA, 64 nt, hsa
agcauaagagaaucgagaaauuugauagagguaacuuguuuaauguaaaucuaauaguacuugu

SEQ ID NO: 509240 - RNA, 64 nt, hsa
uagugcaauuugguucuugaaaauuaaauuuaaacuuguuuacaaagguuuaguuuuguaauaa

SEQ ID NO: 509241 - RNA, 64 nt, hsa
auuuccuauguuagcuguuaaagaaacagcaggacuuguuuacaaagaugucuucauucccaag

SEQ ID NO: 509242 - RNA, 64 nt, hsa
cauucauuaauguuaaggcuaauacauuuaagaucuuguuuaaacaauguuucuucugcaacug

SEQ ID NO: 509243 - RNA, 64 nt, hsa
gcaguuuuaaauuuuaugccaucaguuauuuauucuuguuuauucaaaugacugcaauaacaau

SEQ ID NO: 509244 - RNA, 64 nt, hsa
uaaagcacauuugacucuaagaaguauguagaaccuuguuuauaggugagaauaggcuguauua

SEQ ID NO: 509245 - RNA, 64 nt, hsa
aaaggauggcucuguacaacuucacagauggaaucuuguuuaaggcugugaaguuuuaaggaau

SEQ ID NO: 509246 - RNA, 64 nt, hsa
auaauuaaccuaaauuuuuguuauagcagaguuucuuguuuaaaaaaaaauaaaaucaucugaa

SEQ ID NO: 509247 - RNA, 64 nt, hsa
auaagucauuuaguaacagccuuugugaaaugaacuuguuuacuauuggagauaaccacacuua

SEQ ID NO: 509248 - RNA, 64 nt, hsa
aaauugacaaauuguguacaaacacuaaaaaaaacuuguuuaaauuguauuugcaauaaacaac

SEQ ID NO: 509249 - RNA, 64 nt, hsa
gacugucaucucauucuuguacaacguagaauuacuuguuuacauccaacaaaugguuagcuag

SEQ ID NO: 509250 - RNA, 64 nt, hsa
uuacucaagaauuagaaaacuuugcaagauuugacuuguuuaaaaaucacauuuauaagugaac

SEQ ID NO: 509251 - RNA, 64 nt, hsa
uaaauagaguuuuaucaaaccacagccaugcuuacuuguuuagcuauugacuauggcugcuuua

SEQ ID NO: 509252 - RNA, 64 nt, hsa
gcuaaugggucugggcagcaucccuucaugaauuuuuuuuuaauccaauauccguugauuugau

SEQ ID NO: 509253 - RNA, 64 nt, hsa
ucccccuuccugacccuacuugcacugcuguggauuuuuuuaagagaagcaaaaacaaaaguaa

SEQ ID NO: 509254 - RNA, 64 nt, hsa
gggaucguauuuuuauaucauauucacauauuuguuuuuuuaauugguguuagaugacaugauu

SEQ ID NO: 509255 - RNA, 64 nt, hsa
aguuuuuuuuuucuuuugaaaugucccuuuaagauuuuuuuauucuaaacaaaauaaagaaaau

SEQ ID NO: 509256 - RNA, 64 nt, hsa
ugacuuauauuuuggggagaugaggguuggguuuuuuuuuuaaugcuacgugacaguuugaaac

SEQ ID NO: 509257 - RNA, 64 nt, hsa
cuuuggcucaagauggccuucauuuacguuuaguuuuuuuuaaaaccguggagguugcccacgg

SEQ ID NO: 509258 - RNA, 64 nt, hsa
uguuagcuaauuccacuguguauauaaauuguauuuuuuuuaauuuguaaaaugcuauuuuuau

SEQ ID NO: 509259 - RNA, 64 nt, hsa
gguuuguuuguuggguuguuuuuuguuuuuugguuuuuuuuaaugacaaugaagugacacuuug

SEQ ID NO: 509260 - RNA, 64 nt, hsa
accaagggcgagauuuuauaugcacauuucuggauuuuuuuauacgguuuucauugacacucuu

SEQ ID NO: 509261 - RNA, 64 nt, hsa
gcacucugcauguuuuuguuuuguuuuucgggguuuuuuuuaauugaagcccuaaaccaggaau

SEQ ID NO: 509262 - RNA, 64 nt, hsa
gacugugauugugacuauaauacauuuuugguaauuuuuuuauaccuaauuuguauaggaagug

SEQ ID NO: 509263 - RNA, 64 nt, hsa
aguuguuuuuuuuuuuuuuuguaauauacagcuuuuuuuuuaaggcaucauuuucgagggucua

SEQ ID NO: 509264 - RNA, 64 nt, hsa
gggaaaaugauuguaauuuauuguucaugacuuuuuuuuuuaaauaaagugaguuucaacaaaa

SEQ ID NO: 509265 - RNA, 64 nt, hsa
uuucacucuauagacuguuuuaagaguuuugggguuuuuuuaauugggugguuuguaaccccuu

SEQ ID NO: 509266 - RNA, 64 nt, hsa
auuuuggugacaaaaaugaaggagcuuuguaaauuuuuuuuaaaauuaugaaucauaucaagua

SEQ ID NO: 509267 - RNA, 64 nt, hsa
agacaaaggaggacuaagguaaucaauuugcaccuuuuuuuauuuuuauuuuuuuucuuuuuuu

SEQ ID NO: 509268 - RNA, 64 nt, hsa
acuucuaaaggagagaaugucaaaaaguucuguauuuuuuuauauucuauauauuagguagguc

SEQ ID NO: 509269 - RNA, 64 nt, hsa
ucacugaaacuuaguagccugcuuuuuuuuuuuuuuuuuuuagagcuauugcguaucuucccug

SEQ ID NO: 509270 - RNA, 64 nt, hsa
guguuuuuuuuuuuguuguugguuuuuuuuuuuuuuuuuuuaacuugggaccaccaaguuguaa

SEQ ID NO: 509271 - RNA, 64 nt, hsa
aaaauuaaauuaauccuugauaagaguugcuuuuuuuuuuuaggaguuaguccuugaccacuag

SEQ ID NO: 509272 - RNA, 64 nt, hsa
ccuugguccugccucuuugaguauauuaguagguuuuuuuuauuuguuugagacagggucucac

SEQ ID NO: 509273 - RNA, 64 nt, hsa
cacacagcuaauuuuuuuuuuuuuuuuuuuuuuuuuuuuuuagacggagccuugcucuguugcc

SEQ ID NO: 509274 - RNA, 64 nt, hsa
auccuguuucagcuaaaugcagggaaacucaauguuuuuuuaaguuuuguuuucccuuuaaagc

SEQ ID NO: 509275 - RNA, 64 nt, hsa
auguuuuuuuaaguuuuguuuucccuuuaaagccuuuuuuuaggccacauugacaguggugggc

SEQ ID NO: 509276 - RNA, 64 nt, hsa
aguggcuggaaaguacaugguaaaacaaaguaaauuuuuuuauguucuuuuuuuuggucacagg

SEQ ID NO: 509277 - RNA, 64 nt, hsa
uuauggugcucaccaaacgaaggguaucagcuauuuuuuuuaaaauucaaaaagaauaucccuu

SEQ ID NO: 509278 - RNA, 64 nt, hsa
ggaaaugagguuucauaauucugccuuuugcagauuuuuuuacuuuaaagcugucagacucuuu

SEQ ID NO: 509279 - RNA, 64 nt, hsa
acccuuacgaauccugaaaauuaugcuagcaugauuuuuuuauauauagaaguuuaaaaauaaa

SEQ ID NO: 509280 - RNA, 64 nt, hsa
ucauaaaggauuauaaaauuuuuuuuuuuuuuuuuuuuuuuaaauuucuacuuaagggcaagua

SEQ ID NO: 509281 - RNA, 64 nt, hsa
cuugucugccauucugaauaugcuuauuaaaauauuuuuuuaaacauauuugccuacauaauac

SEQ ID NO: 509282 - RNA, 64 nt, hsa
uuuuaaauugguucuuuguuucugaagaaagaauuuuuuuuaacuucaugguuuuauuuauaau

SEQ ID NO: 509283 - RNA, 64 nt, hsa
uauuuuuauauauauuccuucaugaugguguaauuuuuuuuaauuguccuaugcuuuguucggu

SEQ ID NO: 509284 - RNA, 64 nt, hsa
auaauauaaaaauauuaaaagaacauaggcaggcuuuuuuuaaauuuggcuuuuuucuuuccuu

SEQ ID NO: 509285 - RNA, 64 nt, hsa
auuaaauaaauagaaccacugagacaauaauguauuuuuuuaaaguggcaaaugugguuuucuu

SEQ ID NO: 509286 - RNA, 64 nt, hsa
gcgcuuuuucaguauuuugaccauagggagauaauuuuuuuauaauacaaaaguaaccacuugg

SEQ ID NO: 509287 - RNA, 64 nt, hsa
augcucaauuagguaagauuguaaaagcauugauuuuuuuuaauguacagagguagauuucaau

SEQ ID NO: 509288 - RNA, 64 nt, hsa
gguauuuuaaaauaaugcuacuuucaaaguagcauuuuuuuaguuaguuuacagguuacauacc

SEQ ID NO: 509289 - RNA, 64 nt, hsa
guuaaaugugaccaaaaaaauuaaaaguucacaauuuuuuuaauguagccauuugggguuaucu

SEQ ID NO: 509290 - RNA, 64 nt, hsa
ucacugcuuucauucccacaaaaccaguauuacuuuuuuuuaaaaaaagaaagaaauuggaaau

SEQ ID NO: 509291 - RNA, 64 nt, hsa
cacgcccggcuauguuuuuuuuuuuuuuuuuuuuuuuuuuuaacaauggauauucuguaaaaua

SEQ ID NO: 509292 - RNA, 64 nt, hsa
gguuuucagugcaauuaaaccgagagaugucuuguuuuuuuaaaaagaauaguauuuaauaggu

SEQ ID NO: 509293 - RNA, 64 nt, hsa
uagcuuuaucaacuuuuaaacauuaauaaacugauuuuuuuaaagaucccuuugugaagagcau

SEQ ID NO: 509294 - RNA, 64 nt, hsa
uacauuguugaggaaguccuuuuuuuuuuuuuuuuuuuuuuaauugcucaagaaaugauucucu

SEQ ID NO: 509295 - RNA, 64 nt, hsa
aauaaugugguaacuuugucaauuucccauuuuauuuuuuuaaauaaauauaugaucuaaaagc

SEQ ID NO: 509296 - RNA, 64 nt, hsa
acucaguggaaagauaaacuaaguuuuaauguuauuuuuuuaaauuuaagcaaaauuuauuucu

SEQ ID NO: 509297 - RNA, 64 nt, hsa
uuuaaaagucuuucucucucugauucagcuuaaauuuuuuuaucgaaaaagccauuaagguggu

SEQ ID NO: 509298 - RNA, 64 nt, hsa
guggcccgagccugcuuccuauuuugauuuuuuuuuuuuuuaacugauagauggugcagcaugu

SEQ ID NO: 509299 - RNA, 64 nt, hsa
aucagaugagugaguuguucacagauauuuuauguuuuuuuaauuuucuccaagaauauuuaua

SEQ ID NO: 509300 - RNA, 64 nt, hsa
gauggaaagacuagagcuuauaaaaguacuuccauuuuuuuauucuccugaauaccaaaggcaa

SEQ ID NO: 509301 - RNA, 64 nt, hsa
gccugggacccacagggagacuauaaucuccuuauuuuuuuacuccuacuccccagaggggccc

SEQ ID NO: 509302 - RNA, 64 nt, hsa
ccuugauuuguguuguguccaguuugguuuugucuuuuuuuauuuggcaaguggaggaggcuuu

SEQ ID NO: 509303 - RNA, 64 nt, hsa
guguguguguguguguguguguauacagacauuuuuuuuuuaacuuguugauucagaugucuug

SEQ ID NO: 509304 - RNA, 64 nt, hsa
aaaaauuacagggaauuaaaauaauugccuuuuuuuuuuuuagaggguaagagauggguagaag

SEQ ID NO: 509305 - RNA, 64 nt, hsa
uaugaaucccaugauuuggggguuuuuuucuuuuuuuuuuuauaccaguuuuuagcugguguuu

SEQ ID NO: 509306 - RNA, 64 nt, hsa
uucugggguuuuguuuuuuaccuuuuuccccccuuuuuuuuaaauggagugugcuggaugucuc

SEQ ID NO: 509307 - RNA, 64 nt, hsa
cuugcuucacuccaucagagaaugacuaucaauuuuuuuuuaacuguccuaucacguccucucc

SEQ ID NO: 509308 - RNA, 64 nt, hsa
aggaacuucuagaauaacccagaugcgcuuuaauuuuuuuuaauauguuuugaucacagaacuu

SEQ ID NO: 509309 - RNA, 64 nt, hsa
uuaagauuacaaauuauguguuuuauuuguugcuuuuuuuuaaccuuuuaauguauauucuugu

SEQ ID NO: 509310 - RNA, 64 nt, hsa
aaggaauauggauauauuucuuuaagucugcagauuuuuuuauuauggugcagcuuuuuuuuaa

SEQ ID NO: 509311 - RNA, 64 nt, hsa
uuaagucugcagauuuuuuuauuauggugcagcuuuuuuuuaauuauguuuuuaaaauuauaca

SEQ ID NO: 509312 - RNA, 64 nt, hsa
auuuuuaaaugaagagcuauuuauauauauuauuuuuuuuuaagaaaggaggaaaagaaaccaa

SEQ ID NO: 509313 - RNA, 64 nt, hsa
uuuuuuuaagaaaggaggaaaagaaaccaaaaguuuuuuuuaagaaaaaaaauccuucaaggga

SEQ ID NO: 509314 - RNA, 64 nt, hsa
uaagugcaaacaaguauucauuuucauacaggaauuuuuuuaauauguuauuuuuuuaaaaguu

SEQ ID NO: 509315 - RNA, 64 nt, hsa
uucauuuucauacaggaauuuuuuuaauauguuauuuuuuuaaaaguucauuuuucauuugccu

SEQ ID NO: 509316 - RNA, 64 nt, hsa
ggacacaaucguuggaaccugaagaaucugaaguuuuuuuuaccaccaucuuuuucuacucugu

SEQ ID NO: 509317 - RNA, 64 nt, hsa
agaauguggcacuaaaugcaguuucagauuuuauuuuuuuuaaucauaugaacuaaaauuguca

SEQ ID NO: 509318 - RNA, 64 nt, hsa
augauaagauucuuuauuuaaauaugagagaauuuuuuuuuauccuuuauauucucucaauauc

SEQ ID NO: 509319 - RNA, 64 nt, hsa
gaccuaggcuagaagauaagacuguuuuugacaauuuuuuuaucaagaaagagcaaauaaaaag

SEQ ID NO: 509320 - RNA, 64 nt, hsa
ucccccccaacaaaguuuuuuuguuuuuuguuuuuuuuuuuaaguagaaauucccuccaguuuu

SEQ ID NO: 509321 - RNA, 64 nt, hsa
aguagcauggaaaacguuugcuguuuuucccuuuuuuuuuuaauugcuuuuguuuaaaauuuga

SEQ ID NO: 509322 - RNA, 64 nt, hsa
gagcauuaucuuuaguuacuugaagaguuucuaguuuuuuuaaaauacaguuuauguuaaaaua

SEQ ID NO: 509323 - RNA, 64 nt, hsa
aggagggagaacuuuguaagaagcugcccucuguuuuuuuuauccacucguaaaucuggauuua

SEQ ID NO: 509324 - RNA, 64 nt, hsa
guuucugcuguuugcuuuaaauacccuugggguuuuuuuuuaaacccuuacaaggggagcauca

SEQ ID NO: 509325 - RNA, 64 nt, hsa
cuuuaauuuucagauuuuuuuuuuaaacaaaguauuuuuuuaggugcgauaacccagaaagggc

SEQ ID NO: 509326 - RNA, 64 nt, hsa
cguuguguuuuuuuuuucuuuaauuuucagauuuuuuuuuuaaacaaaguauuuuuuuaggugc

SEQ ID NO: 509327 - RNA, 64 nt, hsa
ggugccugguuuagugcuguaauugucuuauuauuuuuuuuauauauauauuucuuggaguaaa

SEQ ID NO: 509328 - RNA, 64 nt, hsa
agaggcagaaacuuugagcaaucuagguuuuuuuuuuuuuuaaguuuuuucuuucuuccucucc

SEQ ID NO: 509329 - RNA, 64 nt, hsa
agugggacaccauucugaauuuuuuuucugaauuuuuuuuuaacaucucuuucucauuagagau

SEQ ID NO: 509330 - RNA, 64 nt, hsa
uuguguccuguaaccucaucgggauugucuuuuuuuuuuuuaauuauuuucugagacuuggauu

SEQ ID NO: 509331 - RNA, 64 nt, hsa
cuaaauguuauucaagauugaguucucacuaguguuuuuuuaauccuaaaaaaguaauguuuug

SEQ ID NO: 509332 - RNA, 64 nt, hsa
uaaauuuaauuuuauuacacauaacauguacuauuuuuuuuaauugacuaauugcccugcuguu

SEQ ID NO: 509333 - RNA, 64 nt, hsa
uaguuauuuaacacagauuuuuuuauuuuuuauuuuuuuuuauuuugagacggaguuuugcucu

SEQ ID NO: 509334 - RNA, 64 nt, hsa
cauucaauuuucaacuuuaguuauuuaacacagauuuuuuuauuuuuuauuuuuuuuuauuuug

SEQ ID NO: 509335 - RNA, 64 nt, hsa
cuauaaaauugucaagcuagcaaaaaaacucuuguuuuuuuaauugggagagaagagaccugcc

SEQ ID NO: 509336 - RNA, 64 nt, hsa
agguacuuuaauuuuucauauauauuuguuuuuuuuuuuuuaaugaaggcucauuuacuugaaa

SEQ ID NO: 509337 - RNA, 64 nt, hsa
uuauuuguuuucagggggguuuuuugggggaaaauuuuuuuaaauggaagcuucuagcaagccc

SEQ ID NO: 509338 - RNA, 64 nt, hsa
uuguuuuuuguuugggguuuuaccauuguugggauuuuuuuauuuguuuucagggggguuuuuu

SEQ ID NO: 509339 - RNA, 64 nt, hsa
auauguauacauauauaugauaugcagaagucacuuuuuuuaucaggcuuuauucuccuuacaa

SEQ ID NO: 509340 - RNA, 64 nt, hsa
uuuacauuuaaugcuucacuuaaugagacauucuuuuuuuuauaagucuauuuuucuacucagu

SEQ ID NO: 509341 - RNA, 64 nt, hsa
uguaaguguuuuuuuuaaaaucacauggaacgguuuuuuuuauacuaaaaaguggagggagauu

SEQ ID NO: 509342 - RNA, 64 nt, hsa
ggcagaguacuauucuaucuagauguguaaguguuuuuuuuaaaaucacauggaacgguuuuuu

SEQ ID NO: 509343 - RNA, 64 nt, hsa
gccaguuugaauuggauguaaauuugaaauucuuuuuuuuuaagccacauuaaauuaucuguuu

SEQ ID NO: 509344 - RNA, 64 nt, hsa
gugguuacaagcuaguaaguagcagagccaagauuuuuuuuaauauagagacaggugucucacu

SEQ ID NO: 509345 - RNA, 64 nt, hsa
auuuaccuuguguuuuuuuuuuuauuguuguuuuuuuuuuuaagacagagauucagucugucac

SEQ ID NO: 509346 - RNA, 64 nt, hsa
gaccaagacauacaucugauuuaccuuguguuuuuuuuuuuauuguuguuuuuuuuuuuaagac

SEQ ID NO: 509347 - RNA, 64 nt, hsa
caugguaagaaagaaucuuugcuaauuuuuuuuuuuuuuuuacgaagccaguaucuugaaacua

SEQ ID NO: 509348 - RNA, 64 nt, hsa
cugaaaguuuuaagaauuguuccuuggggaaaaauuuuuuuaaaauucaccuagaaucauaggg

SEQ ID NO: 509349 - RNA, 64 nt, hsa
aagguacuuuaaauguagcagccacugacauuucuuuuuuuaaaaaaaauuugagaagucuacu

SEQ ID NO: 509350 - RNA, 64 nt, hsa
acagguagccauauacagacaguauaugcccuauuuuuuuuaacugacucuuaaugaaacuuua

SEQ ID NO: 509351 - RNA, 64 nt, hsa
gucuuugugcauuuaguuccgcauaugaugguuuuuuuuuuacauuaaagaguauaugugucuu

SEQ ID NO: 509352 - RNA, 64 nt, hsa
gcuuggcauuugaguagcuucuccaugcuauguauuuuuuuaagcaacaucaugaauuuuaucu

SEQ ID NO: 509353 - RNA, 64 nt, hsa
gcaauguuuguuuuuguuuuuuguuuuuuguuuuuuuuuuuaaucugaagccccugauuuuauu

SEQ ID NO: 509354 - RNA, 64 nt, hsa
uuuuugaaguacuggaucgaaaucuaauugcuuuuuuuuuuaauuguuggggagaggaggauga

SEQ ID NO: 509355 - RNA, 64 nt, hsa
gagggaagguggaccagaaugaaaacuguaaauauuuuuuuaaccuaauaucacuuaaaucgag

SEQ ID NO: 509356 - RNA, 64 nt, hsa
guguguguuugguguuuuuguuuuuuuguuuuuuuuuuuuuaagguuugcaaauuaaaaagggc

SEQ ID NO: 509357 - RNA, 64 nt, hsa
gacagauuuugaaaaugaguaaaggcaaaaaaaauuuuuuuagccuuuauuuugcuuuugggaa

SEQ ID NO: 509358 - RNA, 64 nt, hsa
uucauccuugaaagauuuuuaugugccugcauuuuuuuuuuaauuaaaaaaugccuuuucauug

SEQ ID NO: 509359 - RNA, 64 nt, hsa
ugccagguaguggaguaaaaaaggagacaguuuauuuuuuuauucuaugugcacacuuacagua

SEQ ID NO: 509360 - RNA, 64 nt, hsa
agguaacagucguagauaccagcuuuuuuuuuuuuuuuuuuaaauuggcuuuggccaguagcua

SEQ ID NO: 509361 - RNA, 64 nt, hsa
cuucugcacacgauugacuuucuugauggguaauuuuuuuuaagauuauaccaacaguggauca

SEQ ID NO: 509362 - RNA, 64 nt, hsa
gaaagaaaauuuuuucuacaauuugcaugagggauuuuuuuaauuguauguacucaugguugua

SEQ ID NO: 509363 - RNA, 64 nt, hsa
acuucugcuaaaaacagguuuuugugacuuuuuuuuuuuuuaaauuuaaaucacuguguuuggu

SEQ ID NO: 509364 - RNA, 64 nt, hsa
cccacauuuuuggauauauguaugguagacaauuuuuuuuuaagacacagagauaaauguuuuc

SEQ ID NO: 509365 - RNA, 64 nt, hsa
guuuugcuuuucucucuuccacaaaauuggaagcuuuuuuuaaaaauguuuuccccacaaguca

SEQ ID NO: 509366 - RNA, 64 nt, hsa
cagaaugauauuaauuuugccuuuuuuuuuuuuuuuuuuuuaagcgcuacuaauguagagaaug

SEQ ID NO: 509367 - RNA, 64 nt, hsa
ggagaaguuuuaaaaaacccagaaaaacgcuuuuuuuuuuuaauaaagaagaaauuuaaaauca

SEQ ID NO: 509368 - RNA, 64 nt, hsa
aauauugcaaauguaaaaugacaauuugggucuauuuuuuuauauggauuguagaucaauccau

SEQ ID NO: 509369 - RNA, 64 nt, hsa
uagaaaagugcuguuugagggauuuuauuaaaucuuuuuuuaauggaaugugguacaaauuguu

SEQ ID NO: 509370 - RNA, 64 nt, hsa
ugggacaggaacuaggauagaugugauuccugcauuuuuuuaccuuaaaucugccuuuguuucu

SEQ ID NO: 509371 - RNA, 64 nt, hsa
auucccuuuuauuuccaaaauaaaaugaaaaaucuuuuuuuaauaauuucaucccuauuuauag

SEQ ID NO: 509372 - RNA, 64 nt, hsa
agucaauaugcuuguauaaaacacuguucacuguuuuuuuuaaaaaaaaaacuugauuuguuau

SEQ ID NO: 509373 - RNA, 64 nt, hsa
guucaaauuuagguuuaaacuuuugaagcaaacuuuuuuuuauccuugugcacugcaggccugg

SEQ ID NO: 509374 - RNA, 64 nt, hsa
acacuacacuaucaaaauaauuuuugccuucgaauuuuuuuaagucaaguugagguuauuuuug

SEQ ID NO: 509375 - RNA, 64 nt, hsa
caaagaagcacaguugaaguccuagaauaauggauuuuuuuaaaaaaaaaaaguuguuaguuug

SEQ ID NO: 509376 - RNA, 64 nt, hsa
ugaaucuugcaacuaaguuuagccucauucagaauuuuuuuauuuugugagcauaauuuauugu

SEQ ID NO: 509377 - RNA, 64 nt, hsa
uugcaauuauuagcugcugauauuauggaaguauuuuuuuuaaucaucaguggaaauuuuuauu

SEQ ID NO: 509378 - RNA, 64 nt, hsa
ucagaaguuaaugggcuuuuauguuuuucuauauuuuuuuuauuucaaugauuuggccugucua

SEQ ID NO: 509379 - RNA, 64 nt, hsa
aaaacaaaucuuggcagcuguccuuugacauuuuuuuuuuuagaggaaauguaacuuggaucua

SEQ ID NO: 509380 - RNA, 64 nt, hsa
cagggugacaaaugccaauagauaugugaguuaauuuuuuuaaauaucuccgugaguuguaaau

SEQ ID NO: 509381 - RNA, 64 nt, hsa
uugguuuggggacugguuguuauaaaaugcaauuuuuuuuuaaaucuaagcauuucauuaugug

SEQ ID NO: 509382 - RNA, 64 nt, hsa
ccaaucucuuccaguugcuuuuucuuuuuucuuuuuuuuuuagacaggucuuacucugucaccc

SEQ ID NO: 509383 - RNA, 64 nt, hsa
uaaauauuuaauuucucauuuugggggguuuuuauuuuuuuauuuuuuagauggugucucacgc

SEQ ID NO: 509384 - RNA, 64 nt, hsa
aacuccauaucagaagaaauaacuuuauaacaauuuuuuuuaauaaugaaaaauauuuucguga

SEQ ID NO: 509385 - RNA, 64 nt, hsa
augcuugccugacuuaguauuucugaauugauguuuuuuuuaaugguauaacuaucuugauuuu

SEQ ID NO: 509386 - RNA, 64 nt, hsa
ccugaggaauguaugugggcaaccaggcccugcauuuuuuuauauucugaauuuugcaugcuug

SEQ ID NO: 509387 - RNA, 64 nt, hsa
acuguacuuugccauuuuucuauaaaucaguauuuuuuuuuaauuuugauauacauugugugaa

SEQ ID NO: 509388 - RNA, 64 nt, hsa
gcacuuugcacuuaauggcuguugagggccacuuuuuuuuuauacugcacaguggcacaaaaaa

SEQ ID NO: 509389 - RNA, 64 nt, hsa
uuaguccccuauuagaauaggguugcuacucaucuuuuuuuaaaaaccgaauuucaucauuuau

SEQ ID NO: 509390 - RNA, 64 nt, hsa
uuaacaaaaaauugcagcuauugucuagcuuucauuuuuuuacugagaacuuuaaauuaguccc

SEQ ID NO: 509391 - RNA, 64 nt, hsa
uuuaaaaucuuuagacaauauuuaaaaucuugauuuuuuuuaaaugucagcagauacaauuugg

SEQ ID NO: 509392 - RNA, 64 nt, hsa
aauuucauauguuuucauguaaugaaaauucuauuuuuuuuagaauugguuuuguuuuuauucu

SEQ ID NO: 509393 - RNA, 64 nt, hsa
cuuucaaaaagaucaauuuggcacuuuuuuucauuuuuuuuaauggaaauaagauuuggucucu

SEQ ID NO: 509394 - RNA, 64 nt, hsa
gauuacacccuuucccuucauagaucuuuuuucuuuuuuuuaagccaugcugugaccuacaagc

SEQ ID NO: 509395 - RNA, 64 nt, hsa
uuuuuucuuaagagaacuuaaagaacuggugauuuuuuuuuaacaaaaaaagggaccauugcaa

SEQ ID NO: 509396 - RNA, 64 nt, hsa
ggcuucagaaugggaagagauagucaagauuuuuuuuuuuuaaagccauguggccuaacuugau

SEQ ID NO: 509397 - RNA, 64 nt, hsa
uuuuguaguuucagaaguuuuuuuguuuugguuuuuuuuuuaaagaaaugguagaaaauuugau

SEQ ID NO: 509398 - RNA, 64 nt, hsa
acagaauguugcacuaauuugguagccugggaauuuuuuuuauugugcaguauguauuuaaauu

SEQ ID NO: 509399 - RNA, 64 nt, hsa
ucaaguuuauugcagccuuucuuuuccuauuucuuuuuuuuaaggguuaguauuaacaaauggc

SEQ ID NO: 509400 - RNA, 64 nt, hsa
acuaaguauguugguuaauaggaauccuuuuuuuuuuuuuuaaagacuaaaugugaaaaaauaa

SEQ ID NO: 509401 - RNA, 64 nt, hsa
auuguaaaaaguaccuaaacauucgugaaaugauuuuuuuuagcugaaaaaugcuggcaagaag

SEQ ID NO: 509402 - RNA, 64 nt, hsa
aaucuaagauggaaccuuucuuucuuucuuucuuuuuuuuuaaauuuuguauuuuccauccaac

SEQ ID NO: 509403 - RNA, 64 nt, hsa
augguuuuuaaacuugggcuucauuuuaaacuuuuuuuuuuaaacccaguuauuucacuugauu

SEQ ID NO: 509404 - RNA, 64 nt, hsa
gcacuuaauuuugugggaaaaauauugcuacaauuuuuuuuaaucucugaauguaauuucgaua

SEQ ID NO: 509405 - RNA, 64 nt, hsa
cuuguuuuuucuuuuucuuuucuuuuuuuuuuuuuuuuuuuaaaaaagcaccuuuuuuuguugu

SEQ ID NO: 509406 - RNA, 64 nt, hsa
acuccaaaaauaauuguccuuuuuucuuucuuucuuuuuuuacaauaaggcucuugaaaauugu

SEQ ID NO: 509407 - RNA, 64 nt, hsa
uuuuagaagagaaucuugguuuugguaauucauuuuuuuuuaagaucauuaugugcaaaacacc

SEQ ID NO: 509408 - RNA, 64 nt, hsa
aagucauuucuugaugugagcacuggagcuuuuuuuuuuuuacaacgugacaggaagaggaggg

SEQ ID NO: 509409 - RNA, 64 nt, hsa
uaguuuuuguugaagcucuagcuuaagaagaaacuuuuuuuaaaaagacuguuuggggauucuu

SEQ ID NO: 509410 - RNA, 64 nt, hsa
gaaaauacuaacaggauauaggacaagguguaaauuuuuuuauuauuauuuuaaagauaugauu

SEQ ID NO: 509411 - RNA, 64 nt, hsa
ugagggauaagauacucaucaaauugcaaauucuuuuuuuuacagaaguguggguaacagucac

SEQ ID NO: 509412 - RNA, 64 nt, hsa
uuuuuacagaaguguggguaacagucacagcaguuuuuuuuaccaacagcauacuuaacagacu

SEQ ID NO: 509413 - RNA, 64 nt, hsa
ugggcaaugcauguauuaugcauuggaaagguauuuuuuuuaaguucuguuggcuagcuauggu

SEQ ID NO: 509414 - RNA, 64 nt, hsa
uccugacacgcaauccgguaacauaagauugaaauuuuuuuacuuugucuuaauuuguuucuaa

SEQ ID NO: 509415 - RNA, 64 nt, hsa
aaacaauaggaugcuaaacuaauucauuguaucuuuuuuuuacaaugguggaagcaacuuucug

SEQ ID NO: 509416 - RNA, 64 nt, hsa
acccuuaagcaugcaggaugagguauuuggguuuuuuuuuuagaucgaucacaucuacagaaaa

SEQ ID NO: 509417 - RNA, 64 nt, hsa
auauaucuuacagguguuuuuuuguauuuuuuuuuuuuuuuaguuugaaauguguaagcuuuga

SEQ ID NO: 509418 - RNA, 64 nt, hsa
guuuaaaauguuggccaaaaaaaucaagauuuaauuuuuuuauuuguacugaaaaacuaaucau

SEQ ID NO: 509419 - RNA, 64 nt, hsa
uucuggaaaaaauauuuuucuucauuuuaaaacuuuuuuuuaacuaauaauagcuuugaaagaa

SEQ ID NO: 509420 - RNA, 64 nt, hsa
uuagaauugccaauacuucuacauuugagaaggguuuuuuuagaaauacauuuaguaaaguccc

SEQ ID NO: 509421 - RNA, 64 nt, hsa
cagcccccguguuauuguccuuuugaacuguuuuuuuuuuuauuaaagccaaauuuguguugua

SEQ ID NO: 509422 - RNA, 64 nt, hsa
gcaaaaccuguacaaugacaacccuggaaguugcuuuuuuuaaaaaaauaauaaauuucuuaaa

SEQ ID NO: 509423 - RNA, 64 nt, hsa
cccagaaggacaggaggauucucaacacuuugaauuuuuuuaacuucauuuuucuacacugcua

SEQ ID NO: 509424 - RNA, 64 nt, hsa
cauagucaaagccuugaaagcaucuacaaaucucuuuuuuuagguuuuguccauagcaucaguu

SEQ ID NO: 509425 - RNA, 64 nt, hsa
uuucugacaagauaaaggaagucaccaaaauuucuuuuuuuaaauuguaucuaauccucaacaa

SEQ ID NO: 509426 - RNA, 64 nt, hsa
gcauuggucugcugaccuguuuuuguguuuuucuuuuuuuuauacacaacauuuauuucaaacu

SEQ ID NO: 509427 - RNA, 64 nt, hsa
uuagguacuaucugugaaguuacacuuuuuuuuuuuuuuuuaaagguagagaugugugugugug

SEQ ID NO: 509428 - RNA, 64 nt, hsa
uaaugccuuccacauuaauuagauuuucuugcaguuuuuuuauggcauuuuuuuaaagaugccc

SEQ ID NO: 509429 - RNA, 64 nt, hsa
auuaauuagauuuucuugcaguuuuuuuauggcauuuuuuuaaagaugcccuaaguguugaaga

SEQ ID NO: 509430 - RNA, 64 nt, hsa
gauaaauuauguuuguacuaguugaugaaggaguuuuuuuuaaccuguuuauauaauuuugcag

SEQ ID NO: 509431 - RNA, 64 nt, hsa
uaaaugcaguuuugccuaguucccuuuuuuuuucuuuuuuuacuuuuuuuuaaacguuuguaaa

SEQ ID NO: 509432 - RNA, 64 nt, hsa
uuugccuaguucccuuuuuuuuucuuuuuuuacuuuuuuuuaaacguuuguaaaaaccucuuug

SEQ ID NO: 509433 - RNA, 64 nt, hsa
cauuuaacauucauacaguuauauauaauauccuuuuuuuuaaagaaugguauuucacaaaaau

SEQ ID NO: 509434 - RNA, 64 nt, hsa
auugcagagauauaaugauuacauuguuauuaaauuuuuuuaacacaaguaagugucaccauuu

SEQ ID NO: 509435 - RNA, 64 nt, hsa
cacuauaaaggcagacuuagggccaacuuuuuuuuuuuuuuacaauuauuacaacacuaaagag

SEQ ID NO: 509436 - RNA, 64 nt, hsa
uuacuugucaggauuucuccucuucagagagauuuuuuuuuauagcacagauuccuuugccccu

SEQ ID NO: 509437 - RNA, 64 nt, hsa
aaacuaguuuacaauuugcaggcugaucuuaagauuuuuuuauaucuaauugcugcugccuuca

SEQ ID NO: 509438 - RNA, 64 nt, hsa
gagagagcaaaugcaguaucuucagaaugauuuauuuuuuuaauuaauuguaaagacuugugcc

SEQ ID NO: 509439 - RNA, 64 nt, hsa
uuuauauuuuuuauggggcauaguuccuuauguguuuuuuuaauguauuuucauacuacauacu

SEQ ID NO: 509440 - RNA, 64 nt, hsa
uaaaauuguuacaucuagacaacuguaaacauuauuuuuuuagcuagugcaaaccuaguaccug

SEQ ID NO: 509441 - RNA, 64 nt, hsa
uacacuuuucauuuugucuucuucuuuuuuuuucuuuuuuuagauggaguuuggcucuugucac

SEQ ID NO: 509442 - RNA, 64 nt, hsa
uuuuucaauucuguuaucggcauuucuuucuuuuuuuuuuuaauguauagguguucugucauac

SEQ ID NO: 509443 - RNA, 64 nt, hsa
aauacuaaagacuuuauaacugcaugaacuuggauuuuuuuaaucacucauaugguagaauuuu

SEQ ID NO: 509444 - RNA, 64 nt, hsa
ugaaagccuacuuucugaagaaaauggugggauuuuuuuuuaucaugauuaaauaucaaaaaau

SEQ ID NO: 509445 - RNA, 64 nt, hsa
aaaagagaaaaguaaaauauuucuuaugccuauuuuuuuuuaaaucaaaagggagagaacaaaa

SEQ ID NO: 509446 - RNA, 64 nt, hsa
gugacagaacaagaccccgucucaaaaaaaauuuuuuuuuuaauaaaacaaaauuuguuugaaa

SEQ ID NO: 509447 - RNA, 64 nt, hsa
uauauguguguguaucaaaaguggucucaaaauauuuuuuuaagaaaaaaagcaaaaacaaugu

SEQ ID NO: 509448 - RNA, 64 nt, hsa
acuuauaaucuccucuaaaacaaccucugcauguuuuuuuuaaauaaagcacuuucugucaaau

SEQ ID NO: 509449 - RNA, 64 nt, hsa
auuuucuauuaauuugcaaacugaugauuucacuuuuuuuuacuuuuuuuucgauuaucagagu

SEQ ID NO: 509450 - RNA, 64 nt, hsa
cccacuuuuauguauagaaagaggucuuuuaauuuuuuuuuaaugugagaaggaagggaggagu

SEQ ID NO: 509451 - RNA, 64 nt, hsa
uuuuugaaauggcaguggcaaauaaauaaauacuuuuuuuuaaauggaaagacuugaucuaugg

SEQ ID NO: 509452 - RNA, 64 nt, hsa
cucagacugcaaaaggccuauuuuaacuauugauuuuuuuuaaaaaaaauugucuuugaaugua

SEQ ID NO: 509453 - RNA, 64 nt, hsa
gaaaaccgaacacaacucagaaacuuggaaucguuuuuuuuaaaaaugccucugagcaacccau

SEQ ID NO: 509454 - RNA, 64 nt, hsa
ccagucacugcagcaacgccuuguguuuguuucauuuuuuuaaaacccacacaaagccgcuguc

SEQ ID NO: 509455 - RNA, 64 nt, hsa
caugcuauucugucagcugaauauggaagagaucuuuuuuuacuagagaucugcagaagaaacg

SEQ ID NO: 509456 - RNA, 64 nt, hsa
uaucaaaacacaacucaacuaugaaucuucaauuuuuuuuuaaagcaaaacuauuuauugacuu

SEQ ID NO: 509457 - RNA, 64 nt, hsa
aauggaacuaaugcuauauuuaaaaacacugauuuuuuuuuaaccugccaaaaauaaaaaaaag

SEQ ID NO: 509458 - RNA, 64 nt, hsa
aaagauuaaaucaaauuaauuuucaaaaaaaauuuuuuuuuagaaauguuauuuucccugugau

SEQ ID NO: 509459 - RNA, 64 nt, hsa
uauauauauauaaauauaaauauauguuuguuuguuuuuuuaaugaaaaacaagucaagcuagc

SEQ ID NO: 509460 - RNA, 64 nt, hsa
gaaaaaugaacaugugaggucagauuuuuuuuuuuuuuuuuaagucagcacugaugccacccuc

SEQ ID NO: 509461 - RNA, 64 nt, hsa
guuggguuuucuaaaauaauauucuuacaaaguauuuuuuuaccuguuaugcccuguuugcaaa

SEQ ID NO: 509462 - RNA, 64 nt, hsa
aaaaauagauuuaguuaacccagggaaacaucaauuuuuuuaguaguuccaauuuuauaucaca

SEQ ID NO: 509463 - RNA, 64 nt, hsa
uuuucuuugguauuggguuauguaugcgugugcauuuuuuuaacuugagagcugacuguugcuu

SEQ ID NO: 509464 - RNA, 64 nt, hsa
guuaacccaugguaaagaguguuuuucugaaacuuuuuuuuaguaagaugguuuuucagcaaau

SEQ ID NO: 509465 - RNA, 64 nt, hsa
uuauuuguacuaaaaugcucauuuacaugugccauuuuuuuaauucgaguaacccauauuuguu

SEQ ID NO: 509466 - RNA, 54 nt, hsa
caucaucuaauucucagugauuuuuuuuuuuaaagagaauucuagaauucuauu

SEQ ID NO: 509467 - RNA, 64 nt, hsa
aauuugaucuuuuauuuuucuuuguuuuuauuuuuuuuuuuauuuagaugaccaaaggucauua

SEQ ID NO: 509468 - RNA, 64 nt, hsa
aguggaaaaaaaaaagacaggcugccacaguauauuuuuuuaauuuggcaggauaauauagugc

SEQ ID NO: 509469 - RNA, 64 nt, hsa
caaaacuuuuuuaaauauaaauguuaagaaaaauuuuuuuuaaaaaacacuucauuauguuuag

SEQ ID NO: 509470 - RNA, 64 nt, hsa
uaacauggaagaggauucauuguuuuuauuuuuauuuuuuuaauuuuuucuuuuuuauuaagcu

SEQ ID NO: 509471 - RNA, 64 nt, hsa
uaaaagaaaugggcuguuuugcccaaaguuuuauuuuuuuuaaacaaugauuaaauugaaugug

SEQ ID NO: 509472 - RNA, 64 nt, hsa
ucucuugugcaauaauuuacauguuguguauguuuuuuuuuaaacuuagacagcauguauggua

SEQ ID NO: 509473 - RNA, 64 nt, hsa
ccagagcucucuaaauaccugaaagacuuaagccuuuuuuuaaguaauuaauacuuaaaaaaaa

SEQ ID NO: 509474 - RNA, 64 nt, hsa
cucuaugaaaguaaagcuguuugaaaaauuauuauuuuuuuacagaucuuucuauaaaaaauaa

SEQ ID NO: 509475 - RNA, 64 nt, hsa
aauuuaagcuaaacacaagccaaaaaugaauagguuuuuuuaauuuuuauuuuucacuaaacag

SEQ ID NO: 509476 - RNA, 64 nt, hsa
aaggucagagauuguaaauggucaauacugacuuuuuuuuuauucccuugacucaagacagcua

SEQ ID NO: 509477 - RNA, 64 nt, hsa
uacaaguguaugauguacauuuuaguucuuaacuuuuuuuuaugguuucuaauauguaugacca

SEQ ID NO: 509478 - RNA, 64 nt, hsa
cuuuaccuguauacuaaaaacccuguuguauugauuuuuuuauaauaagccuuuuuaccucugu

SEQ ID NO: 509479 - RNA, 64 nt, hsa
uuuucauuaucuuuauuauaauaaaccugaugcuuuuuuuuagaacuccuuacucugaugucug

SEQ ID NO: 509480 - RNA, 64 nt, hsa
ccuggauuuuucccacugcucuacaggcugugacuuuuuuuaagcauccugacaggaaauguuu

SEQ ID NO: 509481 - RNA, 64 nt, hsa
uggaagaacaauuucuaugaauuuucucuuuauuuuuuuuuauaauucagacaauucuaugacc

SEQ ID NO: 509482 - RNA, 64 nt, hsa
guuucuauguguacauaguuuuggguuuuuuuuuuuuuuuuacguaaguggcagacacuuuauu

SEQ ID NO: 509483 - RNA, 64 nt, hsa
gaaguuuuccuuauuugccauuuuucuuuuauuuuuuuuuuaauuguauuuuuugagacagggu

SEQ ID NO: 509484 - RNA, 64 nt, hsa
ugacuucuuucaagucuaaaugauuuaauaaaacuuuuuuuaaauuaaguauguugacucuuau

SEQ ID NO: 509485 - RNA, 64 nt, hsa
aguuuguucuucgcucaauuuuuuuguggacuacuuuuuuuauaucaaauuuaagcuggauuug

SEQ ID NO: 509486 - RNA, 64 nt, hsa
gcuuucccuggaggaaagguuuuuuuuguuguuuuuuuuuuaagaacuugaaacuuguaaacug

SEQ ID NO: 509487 - RNA, 64 nt, hsa
acagaaguuuggcuugaacuaaaggacauuuuauuuuuuuuacuuuagcacauaauuuguauau

SEQ ID NO: 509488 - RNA, 64 nt, hsa
ggacauggugucguugggaagcuuaccuuuuuuuuuuuuuuacuuagucuguguuugguuccac

SEQ ID NO: 509489 - RNA, 64 nt, hsa
gguccuuugccuauuuuuaauugaguugucuuuuuuuuuuuaaguuuucuguuuuccuaaccac

SEQ ID NO: 509490 - RNA, 64 nt, hsa
auguaaaagacuuuuuuuuauacgauaaauaacuuuuuuuuaaguuacacauuuuucagauaua

SEQ ID NO: 509491 - RNA, 64 nt, hsa
guuuucacuccagcuaacacagauguaaaagacuuuuuuuuauacgauaaauaacuuuuuuuua

SEQ ID NO: 509492 - RNA, 64 nt, hsa
aaaaaguuacguggaagcaagauuucuauauuuguuuuuuuaaaggaagcagucauucuuucua

SEQ ID NO: 509493 - RNA, 64 nt, hsa
cauggaugauaaguguguuuuuagugguguguuguuuuuuuaaagaggugauucaaguaccguu

SEQ ID NO: 509494 - RNA, 64 nt, hsa
uuuaaaauaaaauguuguggaaaagguagcauucuuuuuuuaggaguguuauuuuucacuaugu

SEQ ID NO: 509495 - RNA, 64 nt, hsa
ucuccuuucccucucaauaaauaucuauuuuucauuuuuuuacuuuguaguuuauuuuuuagug

SEQ ID NO: 509496 - RNA, 64 nt, hsa
cuuuuguaguauuuacguaugcagacuagucuuauuuuuuuaauuccugcugcacuaaagcuau

SEQ ID NO: 509497 - RNA, 64 nt, hsa
guugccucaauauaaccuuuuauucauagauguuuuuuuuuauucaacuuuuguaguauuuacg

SEQ ID NO: 509498 - RNA, 64 nt, hsa
cuuuguaauggauucuuuucaucaaaaagccuuauuuuuuuaucuauguggaaaacacaauaaa

SEQ ID NO: 509499 - RNA, 64 nt, hsa
uuuggggggauaggaagaaagauuuguuacuguauuuuuuuaacuacauaaaaauagaucaaua

SEQ ID NO: 509500 - RNA, 64 nt, hsa
uuuaaaauauggcuuuucuaauuggauauuguauuuuuuuuaagucuucuugaaggcacucuaa

SEQ ID NO: 509501 - RNA, 64 nt, hsa
aguguuuguuuucuuuuucuuuuuuuuuuuuuuuuuuuuuuacacaagacgugguuaagaacug

SEQ ID NO: 509502 - RNA, 64 nt, hsa
ucauccaucaccaguggaguuuuuuuauuuguuauuuuuuuaaaaguuuaggugccuuugcgga

SEQ ID NO: 509503 - RNA, 64 nt, hsa
cccucagcucucuccucauccaucaccaguggaguuuuuuuauuuguuauuuuuuuaaaaguuu

SEQ ID NO: 509504 - RNA, 64 nt, hsa
ggugccuuacuuugugauuuaaaagaaaucaacuuuuuuuuaugucuaaguaguagauuauuug

SEQ ID NO: 509505 - RNA, 64 nt, hsa
uuuuucuucccugaaaucagagcuuacauguguguuuuuuuauaacauuuucagauaaauguau

SEQ ID NO: 509506 - RNA, 64 nt, hsa
aagcuuggcaaaguguuggcuuuuuaaaaaaaaauuuuuuuaaucucuagcaguuugguaauuu

SEQ ID NO: 509507 - RNA, 64 nt, hsa
cgguuuuuagucucuggaaaaagacugauuuugcuuuuuuuauaaauauuauuagauuuauuaa

SEQ ID NO: 509508 - RNA, 64 nt, hsa
uccauuuaugcgaaaucugugguuguaaauuuuuuuuuuuuacuugaaauuaaauuuggcucua

SEQ ID NO: 509509 - RNA, 64 nt, hsa
acuagaucuauguaaguuguagaauagagugaaguuuuuuuauauauuugugguagccuccauc

SEQ ID NO: 509510 - RNA, 64 nt, hsa
ucuguauaagccacauagaaaaaaguugccuuucuuuuuuuaugaccuggauauauaagcaaau

SEQ ID NO: 509511 - RNA, 64 nt, hsa
cuuuuuucaaaauggcuuucuuacguaccacacuuuuuuuuaucuguauuuagccuuggcaucu

SEQ ID NO: 509512 - RNA, 64 nt, hsa
ccaacuuuaaccuuaccagcauguuaauauccaguuuuuuuauaguuuaaaaguuaaagugccu

SEQ ID NO: 509513 - RNA, 64 nt, hsa
cgaugaacuauagcauauuuguauuucuacuuuuuuuuuuuagcuauuuacuguacuuuaugua

SEQ ID NO: 509514 - RNA, 64 nt, hsa
aagcacaucugaucaaaaagaaccaggcuuagauuuuuuuuaaguacauugauguugauguucc

SEQ ID NO: 509515 - RNA, 64 nt, hsa
gagucaaagcuuuuucuuuuucucuaagguucuuuuuuuuuauucaaacuguaugaaauggcaa

SEQ ID NO: 509516 - RNA, 64 nt, hsa
guaucaaaagggaaacuuaaaacauacuguuugauuuuuuuauuuccucuuacaauccauguuu

SEQ ID NO: 509517 - RNA, 64 nt, hsa
ugcaggugugugcugaauugcaagaugguauuuuuuuuuuuaaccaagggaugucucuuguaau

SEQ ID NO: 509518 - RNA, 64 nt, hsa
gaccaggguuuucuuuuuuuuuuuuuuuuuuuuuuuuuuuuagauggaguuucuuuuugcccag

SEQ ID NO: 509519 - RNA, 64 nt, hsa
uuuaucugaauuaucauuuagucaagguagaguguuuuuuuauacauaccaaauggagauagca

SEQ ID NO: 509520 - RNA, 64 nt, hsa
uauaaauauauagauauaaauauauaugaauauauuuuuuuaaguuuccuacaccuggagguug

SEQ ID NO: 509521 - RNA, 64 nt, hsa
uggcuuauggggaggaaugcaucaucucacuuuuuuuuuuuaagcagaugaugggauaacaugg

SEQ ID NO: 509522 - RNA, 64 nt, hsa
aucuuuuuccuuucugaauucuugcuuguacauuuuuuuuuaccuuucaaagguuuuuaauuau

SEQ ID NO: 509523 - RNA, 64 nt, hsa
ucaaaagccaucggaagaugcgaguuugugccuuuuuuuuuauugcucugguggauuuuugugg

SEQ ID NO: 509524 - RNA, 64 nt, hsa
uguguaaaccacucgacucaucuuguagcuuauuuuuuuuuaaagaggacguuuucuacggcug

SEQ ID NO: 509525 - RNA, 64 nt, hsa
aacagaaguauacguuuuucaguuucaacaugaauuuuuuuauuucugucaguuaugacaucca

SEQ ID NO: 509526 - RNA, 64 nt, hsa
ggucaaguucagcgcucgacauuuuauggaaagauuuuuuuaaccuuaccacgaaauacuuaac

SEQ ID NO: 509527 - RNA, 64 nt, hsa
gcuauacuggaguauugcuaugucuuuaaaaaauuuuuuuuauuauauuuuauuuuuuugagac

SEQ ID NO: 509528 - RNA, 64 nt, hsa
gagccaguuucaaagguuacuuguuuuuuuuuuuuuuuuuuaaagucagaauguuaacagcugu

SEQ ID NO: 509529 - RNA, 64 nt, hsa
aaaaaccagcuucuguauucaaaucuuuccuucauuuuuuuaaauuuuuuuuuuggcagcgcuu

SEQ ID NO: 509530 - RNA, 64 nt, hsa
cuucugauguucaguccccugggccgggacagauuuuuuuuaacgucuugaaacuuaaacucug

SEQ ID NO: 509531 - RNA, 64 nt, hsa
gauacuguaaccuuuuugucuuuuuuuuuuuuuuuuuuuuuaaaccuccaccuccaguggcugu

SEQ ID NO: 509532 - RNA, 64 nt, hsa
aauggaaugcauuuuuuuguuguuguuguuguuuuuuuuuuaguguuauaccuuacccaaugaa

SEQ ID NO: 509533 - RNA, 64 nt, hsa
cuucauguggucugacaauuuauuuuugccaucauuuuuuuaauuaaagaaaaaauuuccagaa

SEQ ID NO: 509534 - RNA, 64 nt, hsa
cagaauuuuucugaagguguagauacuuuuuuuuuuuuuuuaacagaaaaccugaugucaagag

SEQ ID NO: 509535 - RNA, 64 nt, hsa
agaaauaaugcguguuuggggggcagaaugcagauuuuuuuaauuuacaaagcgugaucgcuag

SEQ ID NO: 509536 - RNA, 64 nt, hsa
accaaaacuaaguucuuagauuuugggggauuuuuuuuuuuaaacgaugagaagggaauccggu

SEQ ID NO: 509537 - RNA, 64 nt, hsa
uaguguacaagauacugucugcugugguucuguauuuuuuuauuuuuugaccaacuguauggaa

SEQ ID NO: 509538 - RNA, 64 nt, hsa
auguuaagcauguuuauuuauuugccuguuuuuguuuuuuuacuugagcuguggucacagcugc

SEQ ID NO: 509539 - RNA, 64 nt, hsa
auaaacaaagacagacuuguaguuuauuuuguauuuuuuuuaaauaaauacacuuuacauuaaa

SEQ ID NO: 509540 - RNA, 64 nt, hsa
acaauuugguguaucacaacaugcaugucuuauuuuuuuuuaguuuuaaguccuauaggacuau

SEQ ID NO: 509541 - RNA, 64 nt, hsa
gagucucuaaguuauuuguuucagaaaauuauucuuuuuuuaugugauaaaucauaugauuuaa

SEQ ID NO: 509542 - RNA, 64 nt, hsa
uagaccuuucucccuccuuccuuuuacuaccauuuuuuuuuaacacugucaucuguaggucacu

SEQ ID NO: 509543 - RNA, 64 nt, hsa
uuuucaugauacaaaagcaauucugugugauuuuuuuuuuuaagaagaaagaaaaugcaagcua

SEQ ID NO: 509544 - RNA, 64 nt, hsa
acuaucuuuggagccgcuuuuuuuuucuuuuucauuuuuuuaaaagauugagugguacacuaau

SEQ ID NO: 509545 - RNA, 64 nt, hsa
aaaucagaaaugguaccuuuuuaagaauugcauauuuuuuuagacacaacuauuaguacauuaa

SEQ ID NO: 509546 - RNA, 64 nt, hsa
ccguggauacagacgcuuagcucuuaaaagauuuuuuuuuuauguaaacuguugaauauuugaa

SEQ ID NO: 509547 - RNA, 64 nt, hsa
guguuuguuuuguauuuuuguauuguauaugaacuuuuuuuaaaugugacaguuaaacacaucu

SEQ ID NO: 509548 - RNA, 64 nt, hsa
aauuucuaauuuauguguucuguugaaauuuuuguuuuuuuaccuuuauugaaacaacaaaaag

SEQ ID NO: 509549 - RNA, 64 nt, hsa
uuuuuguaauaaauuugacucauuaaaaaccuuuuuuuuuuaaaaaaaaaaaaaaagaaaaucu

SEQ ID NO: 509550 - RNA, 64 nt, hsa
ucacuggcauugacauuauugguaaucaacuggcuuuuuuuaaaaaagguagcauuuuguugac

SEQ ID NO: 509551 - RNA, 64 nt, hsa
uguauuauuuuauuuuauuuuuuacaauuagccuuuuuuuuaguuaauuuuugucaaaugaaac

SEQ ID NO: 509552 - RNA, 64 nt, hsa
ucuguccuugauuuuuuuucauuaaaguauuuccuuuuuuuaauucaagaaaaguuuaccuuuc

SEQ ID NO: 509553 - RNA, 64 nt, hsa
acugcacauuauauucaaacuuaaaauugagcuuuuuuuuuaaaggcccaaaauuguacaguga

SEQ ID NO: 509554 - RNA, 64 nt, hsa
gggguuucgccuuguugcccaggcugaauuuggguuuuuuuaaaaugagacuuucaguccuaau

SEQ ID NO: 509555 - RNA, 64 nt, hsa
uacaggugugagcuaccucaccuggccaaaacaguuuuuuuagaaaugaaguauauuagacaac

SEQ ID NO: 509556 - RNA, 64 nt, hsa
uguauugaaaaacaauuaggaaucauugcagauuuuuuuuuauucugcucccaccucccacccg

SEQ ID NO: 509557 - RNA, 64 nt, hsa
cccgggacuacuugcuggugacuuuuuuuuuuuuuuuuuuuaaauaggggaugauuuuagcuug

SEQ ID NO: 509558 - RNA, 64 nt, hsa
ccaucugucagucaucaacuuuuccccuagauuuuuuuuuuaacuaguucugaaagugucaaga

SEQ ID NO: 509559 - RNA, 64 nt, hsa
aaaaguaaaaauucaauuuuacaauauacauuuuuuuuuuuaacuauuuggcuuuaccuuuuua

SEQ ID NO: 509560 - RNA, 64 nt, hsa
gaggcuauagcucacauuuucaauccucuauuucuuuuuuuaaauauaacuuucuacucugaug

SEQ ID NO: 509561 - RNA, 64 nt, hsa
ucagaaauugucccuagaugaaugagaaaauuauuuuuuuuaauuuaaguccuaaauauaguua

SEQ ID NO: 509562 - RNA, 64 nt, hsa
cacaaaaucacccaguuaauguguguguguguuuuuuuuuuaagguaaacauuacuacuuguaa

SEQ ID NO: 509563 - RNA, 64 nt, hsa
aggauuuuaaacauggugugguauucuaaagccuuuuuuuuaaaaaaagagaucuuuuugagag

SEQ ID NO: 509564 - RNA, 64 nt, hsa
aaaggggagucugggggagaaugguaguauuuuuuuuuuuuaucagcugugaaaaaaauguuac

SEQ ID NO: 509565 - RNA, 64 nt, hsa
aaugcugaagucaugucaaguacugucuggaggguuuuuuuaagaaaaggcauuuggcauuuaa

SEQ ID NO: 509566 - RNA, 64 nt, hsa
uuucagacccauuuuuuaaagugcuagaaaaugcuuuuuuuaaaaaaaaaauacaaguuuuaaa

SEQ ID NO: 509567 - RNA, 64 nt, hsa
cccuaaggaaaaagaaagcuuuaugacauauuuauuuuuuuaauaaaacuaagcaaaaauaaaa

SEQ ID NO: 509568 - RNA, 64 nt, hsa
aaaaucguuuauaauuguuaauagaauggcgauuuuuuuuuaagaacuucagauuugcuaugcu

SEQ ID NO: 509569 - RNA, 64 nt, hsa
aaaagucaucuugugucuuuuguaaauugaauuuuuuuuuuaaaucuauuaggaacuggaaaac

SEQ ID NO: 509570 - RNA, 64 nt, hsa
accauuauucaggguggucuuuuguuuuuaaaucuuuuuuuaacuaauaagauuuacggugugu

SEQ ID NO: 509571 - RNA, 64 nt, hsa
ucauaauguaaucuauuucuguaccuuuuuuuuuuuuuuuuacuuugaagucuuuaaauaaaau

SEQ ID NO: 509572 - RNA, 64 nt, hsa
aaugcaaaacuaggaaaagguuaaacuggauuuuuuuuuuuaaaaaaaagaaaaaaaaagaaga

SEQ ID NO: 509573 - RNA, 64 nt, hsa
cugcuauaaagaaauucucuaauugguugaauuuuuuuuuuaaguaaauaguacuuuaggccaa

SEQ ID NO: 509574 - RNA, 64 nt, hsa
cuagauguaguaauacacugguuaugaaauuguauuuuuuuaaguauuaaugaaaaaagagcca

SEQ ID NO: 509575 - RNA, 64 nt, hsa
uuuagaugaaaaaugaaacuaccuuacaauauuauuuuuuuaaccaauguauuuguuugcaaac

SEQ ID NO: 509576 - RNA, 64 nt, hsa
guugcccuaauacuuuauauguuuuuaauggauuuuuuuuuaaguauuagaaaaugacacauaa

SEQ ID NO: 509577 - RNA, 64 nt, hsa
uagaagaugguuauacacaguguuauuguuaaaauuuuuuuaccuuuugguugguuugcaucuu

SEQ ID NO: 509578 - RNA, 64 nt, hsa
ucuaagaucuaccugaacuuagagacucaagauauuuuuuuaggaaaccuccuacccaugucug

SEQ ID NO: 509579 - RNA, 64 nt, hsa
cccccaaaucuucuccuaaccaccaucuguuuuuuuuuuuuaaagcauuuuuugcuuuaaaagc

SEQ ID NO: 509580 - RNA, 64 nt, hsa
uaaccuugccuuagaaacacauaaauuaugagauuuuuuuuaaaaguuguuaccaaauacacau

SEQ ID NO: 509581 - RNA, 64 nt, hsa
auagacaggacucugaaaacacaacuuccagccauuuuuuuaguuaguaaaaauccuauuaaug

SEQ ID NO: 509582 - RNA, 64 nt, hsa
ggauagugggauuuccagaaccacacuugaaaccuuuuuuuaucguuuuuguauuuucaugaaa

SEQ ID NO: 509583 - RNA, 64 nt, hsa
gcuacaauuuuaagaggggagggaagggaaaguuuuuuuuuauuauuuuuuuaaaauuuuguau

SEQ ID NO: 509584 - RNA, 64 nt, hsa
aagaggggagggaagggaaaguuuuuuuuuauuauuuuuuuaaaauuuuguauguuaaagagaa

SEQ ID NO: 509585 - RNA, 64 nt, hsa
aaaaguagaaaaguaggucauucuuggaucuacuuuuuuuuagccuuauuaauauuuuucccua

SEQ ID NO: 509586 - RNA, 64 nt, hsa
uacguaucauugcaagagaauuuguuucaagauuuuuuuuuaauguuccagaagauggccaaua

SEQ ID NO: 509587 - RNA, 64 nt, hsa
uaauuuagagaacaagaacaaaccaugucucaaauuuuuuuaaaaaaaauuaaugguuuuaaau

SEQ ID NO: 509588 - RNA, 64 nt, hsa
gcacagaugcgcugguagaugcauagucaggaacuuuuuuuauuucuuuuaggucuagggacag

SEQ ID NO: 509589 - RNA, 64 nt, hsa
uuucacuugugcacugugaaugaacuuuguauuauuuuuuuaaaaccuucacauuacguguaga

SEQ ID NO: 509590 - RNA, 64 nt, hsa
cuaaauaacucuuauuuuuauuuuugaagguuuuuuuuuuuaaaaaaaaaaacguauaaaauaa

SEQ ID NO: 509591 - RNA, 64 nt, hsa
gguuguaauccuuguucaguucuuaaguuucgguuuuuuuuaaaaacaggaugcaacuuaaacu

SEQ ID NO: 509592 - RNA, 64 nt, hsa
aaauaauuuaugaccauucaucuguuuuuaugaauuuuuuuaucuagacaauaauguaaauaaa

SEQ ID NO: 509593 - RNA, 64 nt, hsa
guugaaauauuauaaaugguauuguguugauuuuuuuuuuuauuuaguaacuuacagguuuguu

SEQ ID NO: 509594 - RNA, 64 nt, hsa
uuugacuuaauuguuaaaccccaguuuuguuuuguuuuuuuaaucagauuuuugcacacugauu

SEQ ID NO: 509595 - RNA, 64 nt, hsa
uaauaaugauaguuuuuaacuuuuauguuuaaauuuuuuuuaaaucuuaaaaccuucauaucua

SEQ ID NO: 509596 - RNA, 64 nt, hsa
uuuauauuugucaauuuaaaucuuaugggucuuuuuuuuuuaucucucuugaugucagauuuua

SEQ ID NO: 509597 - RNA, 64 nt, hsa
gucuuccuuaguguuuucuuugaagccaaucuguuuuuuuuaggacaccagccuuugguuuuuc

SEQ ID NO: 509598 - RNA, 64 nt, hsa
accacaaaguaggccagauaaguuaaaaaaaauuuuuuuuuaaauaauaauugaaacuuaucuc

SEQ ID NO: 509599 - RNA, 64 nt, hsa
aauaaauuuuggcaccagcaaauuuguuacuuuguuuuuuuaauaguaggauguacacauuuca

SEQ ID NO: 509600 - RNA, 64 nt, hsa
auguuugaggccugugguguaggggacugaauuuuuuuuuuaacuucuauuccauuuuaauugu

SEQ ID NO: 509601 - RNA, 64 nt, hsa
ggaaccaggauacuaaugauuucucaucuuuacuuuuuuuuaauccuaauauaaagugaauuug

SEQ ID NO: 509602 - RNA, 64 nt, hsa
cuuaaagggugauuuucuguuacuuuuuagcaaauuuuuuuaaucaccucuugcuacacccauu

SEQ ID NO: 509603 - RNA, 64 nt, hsa
ccauuaaccuuugccaguguuaugauuguauaaauuuuuuuaaaugcugguuaaacaggaaugc

SEQ ID NO: 509604 - RNA, 64 nt, hsa
auuaaguaauucuguaacugcauggcagucuuuuuuuuuuuaaauaaauauaguuguuacuggu

SEQ ID NO: 509605 - RNA, 64 nt, hsa
uuaaugguugccaguuaguaauucuuuuuuuuuuuuuuuuuacuguagacacaaguuuggcccu

SEQ ID NO: 509606 - RNA, 64 nt, hsa
auaagacuaauuauuggggguuuuccuuggauuuuuuuuuuaauaacugggggcuauuuuauca

SEQ ID NO: 509607 - RNA, 64 nt, hsa
gguguuuugucuaaccaucaaaauguuugagacuuuuuuuuaaacauuucugaguucgaaggua

SEQ ID NO: 509608 - RNA, 64 nt, hsa
agcguccuugggaucccagaucacucuuuuuuuuuuuuuuuaaaaggggcagccccuugauggc

SEQ ID NO: 509609 - RNA, 64 nt, hsa
aaacacugcucuuccucaccugucacauaaagcauuuuuuuaaaaagucagcugcuccaaaauc

SEQ ID NO: 509610 - RNA, 64 nt, hsa
uugucacuguaagcuauacuuuuaaaauauuuauuuuuuuuaaaguauuuucuagucuuuucuc

SEQ ID NO: 509611 - RNA, 64 nt, hsa
uuuugguuuuuauuauacaaaaaccaugaaguacuuuuuuuauuugcuaaaucagauuguuccu

SEQ ID NO: 509612 - RNA, 64 nt, hsa
auucagcccacuacauagauagcuuuuuuuuuuuuuuuuuuaauaaggacaccucuuuccaaac

SEQ ID NO: 509613 - RNA, 64 nt, hsa
ggugacagagcagaagaaccgguuuuuuuuuuuuuuuuuuuacuacuaagcuuuuacaaaagaa

SEQ ID NO: 509614 - RNA, 62 nt, hsa
cauauucacaagagaaauaacuguaguaacuuuuuuuuuaagagauuguuguggacuuuguu

SEQ ID NO: 509615 - RNA, 64 nt, hsa
cagguauuaauaugacauuugucauugucacugauuuuuuuaaaaaagcaaugcacauguuggu

SEQ ID NO: 509616 - RNA, 64 nt, hsa
aguagaauuuauuuucuacaaagugguaguaauuuuuuuuuaaauugcaaauguaauuuuugcc

SEQ ID NO: 509617 - RNA, 64 nt, hsa
uuugucuuuuuugggggagggcagagggcgguucuuuuuuuagauauuguuccuaaaaaggaau

SEQ ID NO: 509618 - RNA, 64 nt, hsa
acuuuccugucauuuauuuauauaggacuguaguuuuuuuuaguucgagagccuuucgaagcuu

SEQ ID NO: 509619 - RNA, 64 nt, hsa
uuaguuuugaauuauauguauagcuugaaaaguuuuuuuuuaaugacugugcuaaagaaaugau

SEQ ID NO: 509620 - RNA, 64 nt, hsa
uuuagcauugaugggcuauuuuugagggauguauuuuuuuuaaaauuguaaaaauuguugaguu

SEQ ID NO: 509621 - RNA, 64 nt, hsa
auauauagcuaaguuuuuguuucauuuugauuuuuuuuuuuagccaaccaccuugucaggaaag

SEQ ID NO: 509622 - RNA, 64 nt, hsa
uuuuauaguagagguuuucuauuuuuuuuuuuuuuuuuuuuacuacauuuauaugucugauaca

SEQ ID NO: 509623 - RNA, 64 nt, hsa
guuuuuguuguuguuguuuaguuuuggguuuuuuuuuuuuuaagaggggcaaguguuuucugaa

SEQ ID NO: 509624 - RNA, 64 nt, hsa
auuuccucuucuauuccuauauucuuuucuggauuuuuuuuaauaauuagugauauaagcauug

SEQ ID NO: 509625 - RNA, 64 nt, hsa
uuuacaaagcaucguuuuaaagcacauggccuuuuuuuuuuaauuauuagugguaguaauauau

SEQ ID NO: 509626 - RNA, 64 nt, hsa
guuguuuuacagcuguguuaccguuaaagguuuuuuuuuuuauauguauuaaaucaauuuauca

SEQ ID NO: 509627 - RNA, 64 nt, hsa
uuuauuuuuuauuguauuuuauuugguugagggauuuuuuuauaaacaguuuuacuugugucau

SEQ ID NO: 509628 - RNA, 64 nt, hsa
aacacaaagcaggagacagccugcguuaauuuuuuuuuuuuaauaauuuucaaaagcaguggua

SEQ ID NO: 509629 - RNA, 64 nt, hsa
uugccucagcuuuaugguuaccuaaaauugccacuuuuuuuagguuaaaaaaaacuucaguauc

SEQ ID NO: 509630 - RNA, 64 nt, hsa
agauuucaaaacauaauuuuauguucaauggguauuuuuuuacauauacauacucacauauuau

SEQ ID NO: 509631 - RNA, 64 nt, hsa
guguguguguguguccguaauuguucaucauuacuuuuuuuaaccuaucuuuuugcuugcuuaa

SEQ ID NO: 509632 - RNA, 64 nt, hsa
cagugagagacauuuacagccuccucucuauuuguuuuuuuaaggaaaagucaacuccugaaau

SEQ ID NO: 509633 - RNA, 64 nt, hsa
aacagauaagcuauaguuggggaaauuuguggguuuuuuuuaaauaagaaauguuuauuuuugu

SEQ ID NO: 509634 - RNA, 64 nt, hsa
acuagaggguuuuuuuuuucuguuuacauauacuuuuuuuuaauagcaauguguuuuuauuaaa

SEQ ID NO: 509635 - RNA, 64 nt, hsa
uuggguauugugugagugcauguguuuuuuuuuuuuuuuuuaaagcgugugugaacaaauggaa

SEQ ID NO: 509636 - RNA, 64 nt, hsa
gaguuugccguuuguccuuaacuuucuuuuuuuuuuuuuuuaaaaaaagaaaacuuuaaaaaaa

SEQ ID NO: 509637 - RNA, 64 nt, hsa
agaaaauuuaaagaaaagcuagaggaaaaaaaaauuuuuuuaaaaauacuuauuagaagcaaac

SEQ ID NO: 509638 - RNA, 64 nt, hsa
ucaucaaggugauguaagugacucaccuuuaaaguuuuuuuaguguuauuuuuuaucacuacuc

SEQ ID NO: 509639 - RNA, 64 nt, hsa
uggaauuagcuaucuuagugccaacugcuuuuuauuuuuuuacuucaucaaggugauguaagug

SEQ ID NO: 509640 - RNA, 64 nt, hsa
ugccacagucuuuauuuugaauaugcuccuaguuuuuuuuuagggugcuguucauuaugaaggc

SEQ ID NO: 509641 - RNA, 64 nt, hsa
uaauuaaauuuagacuauguaguaugugacagaauuuuuuuaaaauuauaaaaagauuuuauuu

SEQ ID NO: 509642 - RNA, 64 nt, hsa
gauugguggaggaaugaagaacuauugaugcaaguuuuuuuauuguuucuuucuaugaucaggu

SEQ ID NO: 509643 - RNA, 64 nt, hsa
caaaaaaaagaaaaaaguuuuauuauccuuacuuuuuuuuuaacauuauuauucuaaaggucaa

SEQ ID NO: 509644 - RNA, 64 nt, hsa
guaaugcucauuuuuacaugcugcuacuagcuuuuuuuuuuaaaaaaaguaaaaguugcugcuu

SEQ ID NO: 509645 - RNA, 64 nt, hsa
uuuaguuuucuaccugcauauggacugcauuuuuuuuuuuuaacacagucaguauguagaaugg

SEQ ID NO: 509646 - RNA, 64 nt, hsa
guuugcuuccaucuuuuuuuaugcagugccuguuuuuuuuuaaccaauuaaaaucccuuuuguu

SEQ ID NO: 509647 - RNA, 64 nt, hsa
cccuucgcacauaggcauuugguuugcuuccaucuuuuuuuaugcagugccuguuuuuuuuuaa

SEQ ID NO: 509648 - RNA, 64 nt, hsa
uuuuuuaguuuuuauuuacuuuaccuaguaugccuuuuuuuaguugcuucucaagucagaaaac

SEQ ID NO: 509649 - RNA, 64 nt, hsa
uccuuuuuuuuuucuuuuuugcuuuucuuuucuuuuuuuuuaguuuuuauuuacuuuaccuagu

SEQ ID NO: 509650 - RNA, 64 nt, hsa
aaauucaaugugucuuuuuauuuucaguaacuauuuuuuuuauaguuguaguuuugauuuaaag

SEQ ID NO: 509651 - RNA, 64 nt, hsa
cuucgcagacuuuugccagcaaauguuaucauuauuuuuuuauacugaaacuugagacuuugac

SEQ ID NO: 509652 - RNA, 64 nt, hsa
uagucuguuggugccucaacuguugguaacuuuuuuuuuuuaaauuuacaacuuuccacaacuu

SEQ ID NO: 509653 - RNA, 64 nt, hsa
ccaaagcuauagccuucauaagcaaccucauuucuuuuuuuaauuguuuucagauugugcuggg

SEQ ID NO: 509654 - RNA, 64 nt, hsa
guucuucuaaaauugaagagauuucaacauaucauuuuuuuaacacauaacuagaaaccugagg

SEQ ID NO: 509655 - RNA, 64 nt, hsa
aucagaaaugucaucaaauauuaccaaaaaaguauuuuuuuaaguuagagaauauauuuuugau

SEQ ID NO: 509656 - RNA, 64 nt, hsa
guaguagcucugaagugucacauuuaauaucaguuuuuuuuaaacaugauucuaguuaaaugua

SEQ ID NO: 509657 - RNA, 64 nt, hsa
ucaaauauagauagauuuaagcugcuaauuuuuuuuuuuuuaguaaucacuacuauaucauguc

SEQ ID NO: 509658 - RNA, 64 nt, hsa
uucaagguguuuuuaaauagcagugauucagaauuuuuuuuaaugaaaguauaauugcacuaac

SEQ ID NO: 509659 - RNA, 64 nt, hsa
uuucugccaauuaaagacuagaagggcacaacuuuuuuuuuaauuaccauagagaagauacauu

SEQ ID NO: 509660 - RNA, 64 nt, hsa
auuuuguaaagcugauaguuggagcauuuuuuuauuuuuuuaauaaaaaugaguuggaaaaaaa

SEQ ID NO: 509661 - RNA, 64 nt, hsa
ccuuagagauuuuguaaagcugauaguuggagcauuuuuuuauuuuuuuaauaaaaaugaguug

SEQ ID NO: 509662 - RNA, 64 nt, hsa
caagguuguuggcccagggcguuaaauucacagauuuuuuuaacgagaaaaacacacagaagaa

SEQ ID NO: 509663 - RNA, 64 nt, hsa
gauuuauuuuaugcagcaaaaagaagcucuuuuuuuuuuuuaaucacaaaaaaaaaccccaguu

SEQ ID NO: 509664 - RNA, 64 nt, hsa
ugacccccuaauguauacagcuaaaaaaucacaauuuuuuuacugcuuuaauucuacuuaauuu

SEQ ID NO: 509665 - RNA, 51 nt, hsa
aagauucacagaaauucugaauuuuuuuaaaaaugggaaaauaugaaaucu

SEQ ID NO: 509666 - RNA, 64 nt, hsa
ugccuuccauaauuaugacaguuauacugucgguuuuuuuuaaauaaaagcagcaucugcuaau

SEQ ID NO: 509667 - RNA, 64 nt, hsa
uauuuaucagugacagaguucacuauaaaugguguuuuuuuaauagaauauaauuaucggaagc

SEQ ID NO: 509668 - RNA, 64 nt, hsa
uaaagaagucuguaucuagugauaaauauaccaguuuuuuuaaaaagaugcuguugugccuaua

SEQ ID NO: 509669 - RNA, 64 nt, hsa
uuuaacacuucucaguguauuuaauuucaaauuguuuuuuuaauugguuuuaugcugcuuuguu

SEQ ID NO: 509670 - RNA, 64 nt, hsa
cuacacugaaagacucagugccaugcagaagccuuuuuuuuaagaugaaggaaauauuuuaugu

SEQ ID NO: 509671 - RNA, 64 nt, hsa
guccuagauauuuccaugggccagugugaugacuuuuuuuuaaaugagguucaguaccauaaug

SEQ ID NO: 509672 - RNA, 64 nt, hsa
ccucuaaagacaaacacaaacucucagacuuuuuuuuuuuuaaugggauuuuuaggucagccca

SEQ ID NO: 509673 - RNA, 64 nt, hsa
guaagcauuggaaggucaaauuauuuugaagugauuuuuuuaaaaaaaagucuucuguuuauua

SEQ ID NO: 509674 - RNA, 64 nt, hsa
gaauacaaaagguaaauuagcagcacauauaauuuuuuuuuaauuuaugauccauuuuguaugg

SEQ ID NO: 509675 - RNA, 64 nt, hsa
acacuuuuggcagcuuaauaugaccuuuuuaaauuuuuuuuauuuuuuuuauuuuuauuucuuu

SEQ ID NO: 509676 - RNA, 64 nt, hsa
gcagcuuaauaugaccuuuuuaaauuuuuuuuauuuuuuuuauuuuuauuucuuuaagauggag

SEQ ID NO: 509677 - RNA, 64 nt, hsa
caaaacuuuuugaccaguuucuuuucuuuuguuuuuuuuuuaaaaaagacauuuaaagacaaag

SEQ ID NO: 509678 - RNA, 64 nt, hsa
uaccauacauaaacugucucauuauacguaugcauuuuuuuaguuuguuuuuguuugguauaaa

SEQ ID NO: 509679 - RNA, 64 nt, hsa
caagugcuggaaugucccuuuuuuccuaugcaacuuuuuuuaacccuuuaaugaacuuaucugu

SEQ ID NO: 509680 - RNA, 64 nt, hsa
accugccacuuauuuuuugucaauuuuuaaaacuuuuuuuuaauuacuguaaagaaaaugaauu

SEQ ID NO: 509681 - RNA, 64 nt, hsa
ucuaugcaaacuggacacaaauuacaacaguaaauuuuuuuauaagugcuucucccuucuccau

SEQ ID NO: 509682 - RNA, 64 nt, hsa
uguguguucuuuaguuuuauuuuauuuuauuuuauuuuuuuacccuuccucaaacaccaguaac

SEQ ID NO: 509683 - RNA, 64 nt, hsa
agcuacuggaccaacauucuuguuuuugcuuuuguuuuuuuaaauaauucuagucuggagcuaa

SEQ ID NO: 509684 - RNA, 64 nt, hsa
guacacuuuuaaauugucucuugcaucacuaaaauuuuuuuaaaaugagcauaacaacgaaagg

SEQ ID NO: 509685 - RNA, 64 nt, hsa
gaauaaaaagucaaaagaaacaaauagaagcuuuuuuuuuuaaaaaauguauugcuucugaacu

SEQ ID NO: 509686 - RNA, 64 nt, hsa
uggguguaugaauggucuagaaacauuucuauuuuuuuuuuaaaccagcaggauacaaguugca

SEQ ID NO: 509687 - RNA, 64 nt, hsa
uagccacgcuaguccauucccagaaggaaauuuuuuuuuuuaacaaugacuuuugguaaagggu

SEQ ID NO: 509688 - RNA, 64 nt, hsa
ggcgugagccaccacaccuggccuuucugcaacauuuuuuuaaaaaaaucuaauaaaucuuaga

SEQ ID NO: 509689 - RNA, 64 nt, hsa
uauuacaacuagagagaaauuccagaaauauuuguuuuuuuaagagaaaguaaauuuucacauu

SEQ ID NO: 509690 - RNA, 64 nt, hsa
ugaaacuuuagagauuaacgacaagauuuucuacuuuuuuuaagugauuuuuuuguccuucagc

SEQ ID NO: 509691 - RNA, 64 nt, hsa
gcaauuagauuaguauuuuccacgucacuguuuauuuuuuuaaaacacaaauucuaaagcuaca

SEQ ID NO: 509692 - RNA, 64 nt, hsa
uacaggcgugcaccaccacgccugguuaauuguuuuuuuuuaauuuaucuuuuguagagauggg

SEQ ID NO: 509693 - RNA, 64 nt, hsa
gacuaauugggaaacggggaaauucuuggaauuuuuuuuuuaagaaacuuuuuuguguuuuuuu

SEQ ID NO: 509694 - RNA, 64 nt, hsa
cuuggaauuuuuuuuuuaagaaacuuuuuuguguuuuuuuuaauuuuaggucacuuauuaguga

SEQ ID NO: 509695 - RNA, 64 nt, hsa
guuuuuccaggaagauuuacauuuagguuuaauauuuuuuuaguuagguagaguuuuaaaaaau

SEQ ID NO: 509696 - RNA, 64 nt, hsa
gauaucucaauaguagacugaauacaaagcuaauuuuuuuuacaugucaauauuggcacaaacu

SEQ ID NO: 509697 - RNA, 64 nt, hsa
acaugacuacaaguccuuuaugacuguuugccauuuuuuuuaaugguacuuaguauuuugauca

SEQ ID NO: 509698 - RNA, 64 nt, hsa
augauuauacugcuuuaccuugugucacuuuuuuuuuuuuuaggaaaaacucauguuccaguau

SEQ ID NO: 509699 - RNA, 64 nt, hsa
cguuaaaagauacacagugagguguuguguuuuguuuuuuuaaugaugaaaaguuacacauuuu

SEQ ID NO: 509700 - RNA, 64 nt, hsa
auuuauuuuuaauauuacuacuauaugaauuaucuuuuuuuaaacuuguagauaaaaguguucc

SEQ ID NO: 509701 - RNA, 64 nt, hsa
aauugacuucauuauuuggaaggaaaauuaguauuuuuuuuaauauuauauggaccaucugauu

SEQ ID NO: 509702 - RNA, 64 nt, hsa
uucugauagaagauuuuuguccaugcuugauuuuuuuuuuuaaagaaaaacuuucauggguuag

SEQ ID NO: 509703 - RNA, 64 nt, hsa
caaaauacuuuuaaaaaaaagaaaauguuaccaguuuuuuuaucugaaguuuaacugucccauu

SEQ ID NO: 509704 - RNA, 64 nt, hsa
caauggauaauauaaaaagaguaccugagauguauuuuuuuaaacucuuagagauaucuguaac

SEQ ID NO: 509705 - RNA, 64 nt, hsa
gugguuuuauucauuguaugaaaauuccugugauuuuuuuuaaaugugcaguacacaucagccu

SEQ ID NO: 509706 - RNA, 64 nt, hsa
ccgcugaugucugggcaucagccuuuguacucuguuuuuuuaagaaagugcagaaucaacuuga

SEQ ID NO: 509707 - RNA, 64 nt, hsa
guuuugauauuaaacauuauguagcuaaguuuuuuuuuuuuagcauuucuuuuuuauuuuucaa

SEQ ID NO: 509708 - RNA, 64 nt, hsa
cuaccuggucacauuuaaucuagguuuuuuuuucuuuuuuuaaguaaagguguggucucuuccc

SEQ ID NO: 509709 - RNA, 64 nt, hsa
ccacaggguccuguuguuuuguuugauuuuuagauuuuuuuaaauuauuauuaagguuguaaug

SEQ ID NO: 509710 - RNA, 64 nt, hsa
aaguaggaaauaaaaugaauugcuccccagauuauuuuuuuaauauuguaugcaaucuuuaugu

SEQ ID NO: 509711 - RNA, 64 nt, hsa
cccauuauuuauugguuuuccucacuaaucuuuuuuuuuuuaguccaaaagccaaaaauauuua

SEQ ID NO: 509712 - RNA, 64 nt, hsa
auuuccagucaccccaaauaugguuaaaagauuuuuuuuuuaaucaugaagagaaaauuaguag

SEQ ID NO: 509713 - RNA, 64 nt, hsa
gauauuagcauaucugguaauuaugaaucuagaauuuuuuuacauauuuuuauaauacuguuag

SEQ ID NO: 509714 - RNA, 64 nt, hsa
ccaugaaccaaguguuuuuaaggaaacaaaacuauuuuuuuaaucaucagauuuauacuagcua

SEQ ID NO: 509715 - RNA, 64 nt, hsa
auucuugugcugcacaugggcugaauuuuuaaauuuuuuuuaaaaacuugaagcagaaccuugu

SEQ ID NO: 509716 - RNA, 64 nt, hsa
accaagcugauggggagggacuuguuuacgggaauuuuuuuaguuuuccuuuucaaaggaaaac

SEQ ID NO: 509717 - RNA, 64 nt, hsa
cacaauuuucugaagucugaauucaauuacaauuuuuuuuuaccaauuuaaucucaaauguugu

SEQ ID NO: 509718 - RNA, 64 nt, hsa
cccuuuauccuuaauuuaauuaauuaucauaugcuuuuuuuaaugaagugcuugaucacuugca

SEQ ID NO: 509719 - RNA, 64 nt, hsa
caauugcauauaauacaacaauaugugguguucuuuuuuuuacacaagcauuggcuagccuuuu

SEQ ID NO: 509720 - RNA, 64 nt, hsa
ugaagcgcucaugauuugauagauuaaccuuucauuuuuuuaggugacucuaguuagaaagucu

SEQ ID NO: 509721 - RNA, 64 nt, hsa
aagccuuaauaaaaacaucaacauugaaaacaguuuuuuuuagguugcccaaaauuauuucuuc

SEQ ID NO: 509722 - RNA, 64 nt, hsa
gauuaguuuacagagaaaaggcuugguggugggauuuuuuuaaauguguguuauguacauauau

SEQ ID NO: 509723 - RNA, 64 nt, hsa
gacaucccucacuuaccaauuaauuauaaauauguuuuuuuaaauccccaaagacauuaucugu

SEQ ID NO: 509724 - RNA, 64 nt, hsa
ggacuauccucuuguuuuuauuaaaaacaaaugauuuuuuuaaaagucacaaaaacaauucacu

SEQ ID NO: 509725 - RNA, 64 nt, hsa
gauuacgggugugagccaccgugcccagccuuuuuuuuuuuaauagaaaaaauaauccgacucc

SEQ ID NO: 509726 - RNA, 64 nt, hsa
uuugucauuccaguuugaguuaaugugcugagcauuuuuuuaaaagaagcuuuguaauaaaaca

SEQ ID NO: 509727 - RNA, 64 nt, hsa
uucaguuuauuuuuucuucuguuuucuucuuuucuuuuuuuaaacaguaaaccuuaacagaugc

SEQ ID NO: 509728 - RNA, 64 nt, hsa
aaggaucguuuuuuuuugcuuuuuuaaacuugaauuuuuuuaauuuacacuuuuuaguuuuaau

SEQ ID NO: 509729 - RNA, 64 nt, hsa
uguauuuaaagaaaaaaaaauagauguagaguguuuuuuuuacacuuuuaacuuagcauguggu

SEQ ID NO: 509730 - RNA, 64 nt, hsa
guuaaucuguuuugguuuguuugguuuuuuuuuuuuuuuuuaagguaaaaaaaaaauacaccuu

SEQ ID NO: 509731 - RNA, 64 nt, hsa
uaaucagcacaagugaauuaaccaugcuucuucauuuuuuuacuuuaguuaaaaaagaggacau

SEQ ID NO: 509732 - RNA, 64 nt, hsa
aucaccuugacuaucagauauguuuuugcacuauuuuuuuuaacugaaaaagaaauaucuaagc

SEQ ID NO: 509733 - RNA, 64 nt, hsa
uaaaaagaaaaaagacuacuacagguuaagauaauuuuuuuaccugucuuuucuccauauuuua

SEQ ID NO: 509734 - RNA, 64 nt, hsa
gugguugaagaugaaaucauuccuaaauuaaccuuuuuuuuaaaaaaaaacaauguauauuaug

SEQ ID NO: 509735 - RNA, 64 nt, hsa
acugucugauuuacuacacagagaaacuuuuuuuuuuuuuuaagauauaugacuaaaauggaca

SEQ ID NO: 509736 - RNA, 64 nt, hsa
guaaauuuuggguuuuuuaggauguugcauuucguuuuuuuaaaaaaaauuuuguaauaaaauu

SEQ ID NO: 509737 - RNA, 64 nt, hsa
cuucugauguugaauguuccuaaauauuuaaugguuuuuuuaauuucuuguguaugguagcaca

SEQ ID NO: 509738 - RNA, 64 nt, hsa
aaggauaauuuuuaucaauagccaacuuuggguauuuuuuuaagugucaaauaucaucaugguu

SEQ ID NO: 509739 - RNA, 64 nt, hsa
cgaagacaggucucagagauaccuuaacuauuccuuuuuuuauaaacauauuaaaggauguggc

SEQ ID NO: 509740 - RNA, 64 nt, hsa
aaugaauuuguacaugcagccaaauuuacaggaauuuuuuuaaaaggcagaaaaacuugaaaua

SEQ ID NO: 509741 - RNA, 64 nt, hsa
ccagguaaucugguggagcgaauacugcaauaaauuuuuuuacuucucuuuguuacuugucugu

SEQ ID NO: 509742 - RNA, 64 nt, hsa
agagucaaccaccacagauaggaauuccuuauucuuuuuuuaauuuuuuuaagacagagucuca

SEQ ID NO: 509743 - RNA, 64 nt, hsa
caccacagauaggaauuccuuauucuuuuuuuaauuuuuuuaagacagagucucacuuuguugc

SEQ ID NO: 509744 - RNA, 64 nt, hsa
auuuagcuuuacaaagauuuuuucuauuacuuuuuuuuuuuauugugguauauguaacacaagu

SEQ ID NO: 509745 - RNA, 64 nt, hsa
ucuucacuauauuuuuuucucucucucucuuuuuuuuuuuuacuuuacauauuuuauacaaugu

SEQ ID NO: 509746 - RNA, 64 nt, hsa
acauaauuaugggaacaaguguacagaagaauuuuuuuuuuaagauaugugagaacuuuucaua

SEQ ID NO: 509747 - RNA, 64 nt, hsa
gaaauugcaaagaaaauucucaagugauagucuuuuuuuuuaaguguuucguaagacaaaaauu

SEQ ID NO: 509748 - RNA, 64 nt, hsa
aauguaaauaauuauuuuuuagaaguuuuuuuuuuuuuuuuaaagacagggucucgcuuuaucg

SEQ ID NO: 509749 - RNA, 64 nt, hsa
ggugugagccacuguguccagccuguaacuauuauuuuuuuauaaagagagauucuuauuuucu

SEQ ID NO: 509750 - RNA, 64 nt, hsa
ucuguaaauucaggguuuuuuuuuguuuuuuuguuuuuuuuaagccgaaaaaaugcuuaauaug

SEQ ID NO: 509751 - RNA, 64 nt, hsa
aacaugauugaaaucacugcuuauaaaugugugauuuuuuuaaaacgaccaaaacuguucugaa

SEQ ID NO: 509752 - RNA, 64 nt, hsa
aaaugucccacuugaauaacguaauucuucauaguuuuuuuaaucuauggauaaauggaaaccu

SEQ ID NO: 509753 - RNA, 64 nt, hsa
gagugaaggcuaaucauagaaaaaaaaccucuaguuuuuuuaaaaauagaauuuggaaacuuau

SEQ ID NO: 509754 - RNA, 64 nt, hsa
agaaauguguaugguuugcagcuuuuaaaaaccauuuuuuuaaaacuaauaaauagugacugaa

SEQ ID NO: 509755 - RNA, 64 nt, hsa
uucugcaaacuuuuccaucuaaaaaaaaaaauguuuuuuuuaagacaggaucucauucuguugc

SEQ ID NO: 509756 - RNA, 64 nt, hsa
uuggggagaauuauagaauguuuguuuuuguauuuuuuuuuaaaguaaauucaacuuacgcuua

SEQ ID NO: 509757 - RNA, 64 nt, hsa
uuuuuugacuuuuuuuguauguguguuuuuucuuuuuuuuuaaguucuuaugaggaggggaggg

SEQ ID NO: 509758 - RNA, 64 nt, hsa
gaauuuuuuuguaauaagcaaucaagguuauaauuuuuuuuaaaauagaaauuuuguaagaagg

SEQ ID NO: 509759 - RNA, 64 nt, hsa
aaaugugcacagguacacuuaccuuuuuuuuuuuuuuuuuuaaguuuuucccauucaggaaaac

SEQ ID NO: 509760 - RNA, 64 nt, hsa
agcuaaaaauagcuuuauuuaugcugaauugugauuuuuuuaugccaaauuuuuuuuaguucua

SEQ ID NO: 509761 - RNA, 64 nt, hsa
auuuaugcugaauugugauuuuuuuaugccaaauuuuuuuuaguucuaaucauugaugauagcu

SEQ ID NO: 509762 - RNA, 64 nt, hsa
uaaaugaagauuuuuuaaauucuaucuugcugauuuuuuuuaaauauaagaaacugguacuugg

SEQ ID NO: 509763 - RNA, 64 nt, hsa
ugacuuuuaaaauuugaaugauauauagacuuuguuuuuuuaaugcaauaugaauauuugcuca

SEQ ID NO: 509764 - RNA, 64 nt, hsa
uuuaugugaacaaauagaguuguucuuuuucucuuuuuuuuaagacagaguguugcucugucgc

SEQ ID NO: 509765 - RNA, 64 nt, hsa
aaagaaaaggaaaaagaaaaauauauauucuauauuuuuuuaacuuaugagaauguguucauuu

SEQ ID NO: 509766 - RNA, 64 nt, hsa
uuccaauuuuccagcauuucuucauuugauucucuuuuuuuagucuuaaaauaaugacuccuau

SEQ ID NO: 509767 - RNA, 64 nt, hsa
uuaauguauauacaccagaaacuauuuuucaaacuuuuuuuacugcaaccaauaguuaagauua

SEQ ID NO: 509768 - RNA, 64 nt, hsa
uguuaauuuugucuuccucacuuuucaccuuaguuuuuuuuaacccuuuaguaaucuugaauuc

SEQ ID NO: 509769 - RNA, 64 nt, hsa
uuuuuuuaacccuuuaguaaucuugaauucuacuuuuuuuuaaauuucuacuguugucuuuagu

SEQ ID NO: 509770 - RNA, 64 nt, hsa
ucucauuucauuuauuaauaguuaaugcugaauuuuuuuuuaaguuuccucuggcucuauuuau

SEQ ID NO: 509771 - RNA, 64 nt, hsa
caccacugcgcccgcaaaguuuuuuuguuguuuuuuuuuuuaaguugguacucacaaaucacua

SEQ ID NO: 509772 - RNA, 64 nt, hsa
agaaaaugagcugauuguaauuacucucuguguguuuuuuuauugcuagcuaucauuaccaguu

SEQ ID NO: 509773 - RNA, 64 nt, hsa
ccuacuacaguaggugcucagauauuuauuuuuauuuuuuuauuaugcacauuguuuuuccugc

SEQ ID NO: 509774 - RNA, 64 nt, hsa
ucugaugguaauaaaacugacaagaugucuaauuuuuuuuuaaguaggaccaaaggaaaacaag

SEQ ID NO: 509775 - RNA, 64 nt, hsa
ccuaaaauaaaaagaaaaaauuaaaaagaaucaguuuuuuuaauuaaaaaaauagaaagcuguu

SEQ ID NO: 509776 - RNA, 64 nt, hsa
ucuuucauuaguuuauuuguguuggguucuuuuuuuuuuuuaaaugaaaaguauaguauguggc

SEQ ID NO: 509777 - RNA, 64 nt, hsa
uuuuuucuaggcaaacauugaaugcaaacguguauuuuuuuaauauaaauauauaacuguccuu

SEQ ID NO: 509778 - RNA, 64 nt, hsa
ggcauguaaugcuuaguuuucuuguauuuacuucuuuuuuuaaauguaaggaccaaacuucuaa

SEQ ID NO: 509779 - RNA, 64 nt, hsa
cccuuuucccaugcauggauggaaauggaagauuuuuuuuuaacuuguucuagaagucuuaaua

SEQ ID NO: 509780 - RNA, 64 nt, hsa
ucacaauucaguuucuaugaguuugaucaccugauuuuuuuaacaaaauauuucuaacgggaau

SEQ ID NO: 509781 - RNA, 64 nt, hsa
aauucauauuauuauuauuauuauaauacaauauuuuuuuuaaaagacugcugcauccuuagga

SEQ ID NO: 509782 - RNA, 64 nt, hsa
cuuucucucuauugcuauguugaaguaauaggguuuuuuuuaaccucuggaugucucgucugug

SEQ ID NO: 509783 - RNA, 64 nt, hsa
ggugcuugaacaaggagcuccgcucuacaacugguuuuuuuaggacuugugaggaacacagcaa

SEQ ID NO: 509784 - RNA, 64 nt, hsa
uugugaaauguaacaugaagcaaacuaacuuuuuuuuuuuuaacaucuuuguuuuuaaaauaga

SEQ ID NO: 509785 - RNA, 64 nt, hsa
guuagggagaugaguugcaguuuuuauaauagauuuuuuuuaaaguuugguauuguaaaacauu

SEQ ID NO: 509786 - RNA, 64 nt, hsa
auaaauuacacaauaaagcaguccuguucaaauuuuuuuuuaacguggcuuguagaauuuuuaa

SEQ ID NO: 509787 - RNA, 64 nt, hsa
uuucugcuuuucuuaauccuuuuccaguccccucuuuuuuuauaaacguuggcaguuugauguu

SEQ ID NO: 509788 - RNA, 64 nt, hsa
uuagagucaaaggauauuuauuuauaggccuuuuuuuuuuuaauauagaaucugaggcuguuug

SEQ ID NO: 509789 - RNA, 64 nt, hsa
cgugguuuauugacaggguuggggguuuuuuuuguuuuuuuaaaaugaagggacaaagucaacu

SEQ ID NO: 509790 - RNA, 64 nt, hsa
acuaaaggcaaugaugugggacuacuuggucgaauuuuuuuagcccucaacuugguaauugggu

SEQ ID NO: 509791 - RNA, 64 nt, hsa
ucagcuacuugcauuugauuauuuccuuuuuuuuuuuuuuuaacucggaaacacaacuggggaa

SEQ ID NO: 509792 - RNA, 64 nt, hsa
acacguaacagugcaaaaacuuucaugccuuuuuuuuuuuuaaguagaaaaauuguuuccaaag

SEQ ID NO: 509793 - RNA, 64 nt, hsa
uaccaucaaucauccaucagauugauuuuuuuuuuuuuuuuaaguaacacuaaagaagcuguaa

SEQ ID NO: 509794 - RNA, 64 nt, hsa
aggcaugugccaccaugcccagcuaauuuuguuuuuuuuuuagucgagacgggguuucaccaug

SEQ ID NO: 509795 - RNA, 64 nt, hsa
uaauacuagauaauaaggaaaugggggugaaauauuuuuuuauuguugaaucauuuugugaaug

SEQ ID NO: 509796 - RNA, 64 nt, hsa
caaagaguugagggcuguugcucuuaaaaauuauuuuuuuuauuauuauuuugaaaguauggaa

SEQ ID NO: 509797 - RNA, 64 nt, hsa
aaaaaacuuuaacaugaaaaaacgcacugacauuuuuuuuuauuuaauauagccuggacuuuac

SEQ ID NO: 509798 - RNA, 64 nt, hsa
cugggauuauucuuugaaaacagaugaccauaauuuuuuuuaaagaagagugacuuauuuuguc

SEQ ID NO: 509799 - RNA, 64 nt, hsa
caaguuuaaaagccauguauaaccaagugugcucuuuuuuuaaaagguagagucuuacaaucaa

SEQ ID NO: 509800 - RNA, 64 nt, hsa
auauagauauuuaaagcuuuucugcuguuuuuuuuuuuuuuaauugcaacugcuuuucugccgu

SEQ ID NO: 509801 - RNA, 64 nt, hsa
acaaugcauauucccaaacuguggaaaggacaccuuuuuuuauuuguaaagguggaaaaacuuu

SEQ ID NO: 509802 - RNA, 64 nt, hsa
auacauaggacuuugcacuuuuuuuuuuuuuuuuuuuuuuuaaagagacagcguuucggucuug

SEQ ID NO: 509803 - RNA, 64 nt, hsa
ucaugguaaaaguuaauauacuaaaggguuccuuuuuuuuuaauguuuacauuuaucucuaugu

SEQ ID NO: 509804 - RNA, 64 nt, hsa
uauuuuaaaacuaaaaaaaacuuugaauuggcuauuuuuuuaaugcaauauuuuuuuucugaau

SEQ ID NO: 509805 - RNA, 64 nt, hsa
guguguuguguugucuuucaauuauuugcuuuuuuuuuuuuacuuucuuuuuguauucuauccc

SEQ ID NO: 509806 - RNA, 64 nt, hsa
aaauaauuuggcaaucagaauuaaaaaguuuuuuuuuuuuuaaauaauggcuucuugucugucu

SEQ ID NO: 509807 - RNA, 64 nt, hsa
guucuauuacuugaauaguucuacagucuuuuuuuuuuuuuaauguuuacaauuauccaguuuu

SEQ ID NO: 509808 - RNA, 64 nt, hsa
aaccaguuauacccaguauuuugagguuuuauuguuuuuuuaauaacuaaaaagaaaaaaggaa

SEQ ID NO: 509809 - RNA, 64 nt, hsa
aauauauguuguuguuguuguuuuaaacccauuuuuuuuuuagaauuuucauuaauacuguagu

SEQ ID NO: 509810 - RNA, 64 nt, hsa
cuuguuuuucuuuagauuuauaaauuugagcuauuuuuuuuagaggugcuuuuuaaaaauccaa

SEQ ID NO: 509811 - RNA, 64 nt, hsa
uauauuuuauauauauuaaguuuaauuuuuucaguuuuuuuaauguaaaagcaagugaaauuuu

SEQ ID NO: 509812 - RNA, 64 nt, hsa
aacuaaaaucucucauaacucaaguauggaauacuuuuuuuaaagaaauucuuaucaugggugu

SEQ ID NO: 509813 - RNA, 64 nt, hsa
cgugagccacugugcccagccuuguacuuuuuuuuuuuuuuauuguagcucuguauagcacuug

SEQ ID NO: 509814 - RNA, 64 nt, hsa
uucacacacucuaaaauauaaguaaagccaaccuuuuuuuuaaggcugagauucccaaaaugag

SEQ ID NO: 509815 - RNA, 64 nt, hsa
auguuauccacccaaguguacauauguaccuauuuuuuuuuaaaaagcagaaauagaaauacaa

SEQ ID NO: 509816 - RNA, 64 nt, hsa
auuagggcaauguuggucgccuuuuauuaaaagcuuuuuuuaagcuuucauaaagauugcuuuu

SEQ ID NO: 509817 - RNA, 64 nt, hsa
agagagagacuuuuauuugaagggugaaucuuguuuuuuuuaucuuuaaaauauaucucuagaa

SEQ ID NO: 509818 - RNA, 64 nt, hsa
uuuucaugccucacuuugacaugacagcauucgauuuuuuuaaagaucuuuaauacuuuccaug

SEQ ID NO: 509819 - RNA, 64 nt, hsa
aucaugauaagggcacaaaagcuguacagauuuuuuuuuuuaaccacucaaucccaaauggagg

SEQ ID NO: 509820 - RNA, 64 nt, hsa
guuugccuggagaagcaaggagguuagaauguaauuuuuuuaagcguuugcacuauuuagaguc

SEQ ID NO: 509821 - RNA, 64 nt, hsa
uuuucaguagcuccagguagaugagccuuuuuuuuuuuuuuaaaaauaccauauucaagggagu

SEQ ID NO: 509822 - RNA, 64 nt, hsa
uuuuaaaaaagaaaaguaguaaauuagcagcuuuuuuuuuuaaaugaagagaacuucaugauga

SEQ ID NO: 509823 - RNA, 64 nt, hsa
uuauaguauauucauuuauggaguuagcuguauuuuuuuuuaaaaaagaaaaguaguaaauuag

SEQ ID NO: 509824 - RNA, 64 nt, hsa
ucauuggucauuuuuuuuuuaacaauaaaguaucuuuuuuuacuguuauuuucuguguccuuua

SEQ ID NO: 509825 - RNA, 64 nt, hsa
gugagugacagauacauaguuucauuggucauuuuuuuuuuaacaauaaaguaucuuuuuuuac

SEQ ID NO: 509826 - RNA, 64 nt, hsa
gaaauguuaaggcaauacuacuaauuauuguagguuuuuuuaacguaucacccaaagcauguau

SEQ ID NO: 509827 - RNA, 64 nt, hsa
cagccucugauuauugagcuuccucuuaaaaagauuuuuuuauuuuauguagccaacauugcag

SEQ ID NO: 509828 - RNA, 64 nt, hsa
aaaaaccagcccauccuuugaggcugauuuuucuuuuuuuuaaguucuauuuuaaaagcuauca

SEQ ID NO: 509829 - RNA, 64 nt, hsa
auauuuuaaccacugcuucaaaucucgauuucacuuuuuuuauuuauccaguuauaucuacaua

SEQ ID NO: 509830 - RNA, 64 nt, hsa
cuaguucugcuugaccaaguagugcaaucauuauuuuuuuuaauauuguugcugauuucagagg

SEQ ID NO: 509831 - RNA, 64 nt, hsa
uguauacugauugaaauuuuuaacagauuuguacuuuuuuuaaaaugaaaguugcuaguucugc

SEQ ID NO: 509832 - RNA, 64 nt, hsa
gcgccuucaguguacuguuucuuauuaacuuuacuuuuuuuaaaucaacuugcuauagacuuua

SEQ ID NO: 509833 - RNA, 64 nt, hsa
ccagucuuaaaguagacaaaauauucagagccauuuuuuuuaagggaaaugaaaaagauacucu

SEQ ID NO: 509834 - RNA, 64 nt, hsa
agaauguuuuuaugaucuguuuagugcuuauuauuuuuuuuaugaucuguuuagugcuuauuau

SEQ ID NO: 509835 - RNA, 64 nt, hsa
ucagagggaacuuuagcuuuauccauaacauuaauuuuuuuaaaaaauaaggucuuaauguuuc

SEQ ID NO: 509836 - RNA, 64 nt, hsa
cucugggacgcagacacauuccuuggauguugauuuuuuuuaugaucuaguaaaggaauaggua

SEQ ID NO: 509837 - RNA, 64 nt, hsa
ccuuuucuguuuuuggggggggaguuuuguuguguuuuuuuaaaguaagugcuuaaguauuaac

SEQ ID NO: 509838 - RNA, 64 nt, hsa
gcuuuacuaaucuaccagagcauuguagauauuuuuuuuuuacaucuauuguuuaaaauagaug

SEQ ID NO: 509839 - RNA, 64 nt, hsa
uuaaauauuuuuuuguaaauauuauguguguguuuuuuuuuaaucuaugggaauauuucuuuug

SEQ ID NO: 509840 - RNA, 64 nt, hsa
caaauuaaacuuguucugaguccauucaaauguguuuuuuuaaauguagauugaaaucuuugua

SEQ ID NO: 509841 - RNA, 64 nt, hsa
cagaccaaaaauucugaugaccgcaucuagauuauuuuuuuauaaaaaugauuuucacuauagc

SEQ ID NO: 509842 - RNA, 64 nt, hsa
uaugcuucgugugaacucuccuuaaaaaccgauauuuuuuuaucauggaaccagaacaucuguc

SEQ ID NO: 509843 - RNA, 64 nt, hsa
acuuaguucuuuguggauuguucuagacuuuuaauuuuuuuagcugccauuuaagcauuccugu

SEQ ID NO: 509844 - RNA, 64 nt, hsa
uaaauuuuguaugguaaaggaucaauaaaaugauuuuuuuuaagaguucaggcuuguggauggg

SEQ ID NO: 509845 - RNA, 64 nt, hsa
aaggaggggagaacccagcgcaccccucccccccuuuuuuuaaacgcgugaugaagacagaagg

SEQ ID NO: 509846 - RNA, 64 nt, hsa
uagcuuuaacuuguaaaccacaucuuuuuugcacuuuuuuuauaagcaaaaacgugccguuuaa

SEQ ID NO: 509847 - RNA, 64 nt, hsa
acuacaggcaccugccaccacccccaguuaauauuuuuuuuaauuuuuuuuagaggcaggaucu

SEQ ID NO: 509848 - RNA, 64 nt, hsa
ccugccaccacccccaguuaauauuuuuuuuaauuuuuuuuagaggcaggaucuugcuguccaa

SEQ ID NO: 509849 - RNA, 64 nt, hsa
aauuuuuuuuagaggcaggaucuugcuguccaauuuuuuuuaaaaagcuaaaauugccaacuuu

SEQ ID NO: 509850 - RNA, 64 nt, hsa
aaaccguuaggaacagccccguggauacugaaguuuuuuuuaugguaguuacaggaaacuucug

SEQ ID NO: 509851 - RNA, 64 nt, hsa
uuugacauaaccuuauuucuuguauuugcccccuuuuuuuuauaaaaggugaauaaaaagaaau

SEQ ID NO: 509852 - RNA, 64 nt, hsa
auaaaccucuaaaccugcccagcggaaguguguuuuuuuuuaaauuuaaauacagaaacaacug

SEQ ID NO: 509853 - RNA, 64 nt, hsa
gaugucaccuaagugauaguuaacccauuuuuuuuuuuuuuaggcauagaagccaguucagggu

SEQ ID NO: 509854 - RNA, 64 nt, hsa
uacuacugaauauaaauaagaaugugcacaguaguuuuuuuauugaaacuuguauuauuuuuaa

SEQ ID NO: 509855 - RNA, 64 nt, hsa
ucagauuuuugaguaccaaugaucaugcuuccauuuuuuuuaguuuuaaaccaccaaaccaaua

SEQ ID NO: 509856 - RNA, 59 nt, hsa
agaaacuggaugcaucuuaaagaguguuuuuuuuuuagauuguuccauauuaauuuaau

SEQ ID NO: 509857 - RNA, 64 nt, hsa
caaacuacaguauacugucuuggguuuuuuuuuuuuuuuuuagucuguaaaauaaaaugacugc

SEQ ID NO: 509858 - RNA, 64 nt, hsa
auuuuauuuguacuguacaaaugaugcuaguuuauuuuuuuagcagugaaaaugaauauaaaaa

SEQ ID NO: 509859 - RNA, 64 nt, hsa
ucuguaacacuaaauauuuuagugugaaauugaauuuuuuuauuacuauagucuuuucaaucua

SEQ ID NO: 509860 - RNA, 64 nt, hsa
auacgucagguuugcuuaaccauugauuuuuuuuuuuuuuuaccaagucuuacagugauuauuu

SEQ ID NO: 509861 - RNA, 64 nt, hsa
acauguagaauaugcucuuuaauuuaguaaaauauuuuuuuaaaagguagagaugcuuuguuau

SEQ ID NO: 509862 - RNA, 64 nt, hsa
auuuuuggcuaauuuuuaaccugagguuuuguuuuuuuuuuaaaggaaaugcagccuagucuug

SEQ ID NO: 509863 - RNA, 64 nt, hsa
acuuggcuaaagaaucucaaucucuugaaauuuauuuuuuuaaugucauauucaucugguaaau

SEQ ID NO: 509864 - RNA, 64 nt, hsa
guggacaacuaaaucagacucuugccuuugcacuuuuuuuuaacuuuuguagauaauuuuuguu

SEQ ID NO: 509865 - RNA, 64 nt, hsa
ucacuauuuacaaaaguacaauuagaaacacuguuuuuuuuaaguaccguuuuuauuuucauaa

SEQ ID NO: 509866 - RNA, 64 nt, hsa
gcauucuugucccuauaacagggaugcuuaauuuuuuuuuuaacuuagaguuuuaaauugccaa

SEQ ID NO: 509867 - RNA, 64 nt, hsa
ccauuugacaaaucccagggacuauccaggaauuuuuuuuuaacuggauauuguguuugaguau

SEQ ID NO: 509868 - RNA, 64 nt, hsa
cagcagcaguuaaacuuuguuucucuaauagcuuuuuuuuuacauaaaaaaagacccaggaacu

SEQ ID NO: 509869 - RNA, 64 nt, hsa
aaauaguuuaaauguuucuuugucuauuuuucuuuuuuuuuaaugcuacccagggaaauauuuu

SEQ ID NO: 509870 - RNA, 64 nt, hsa
uugucuacaaccagggauugauuuuaaagaugucuuuuuuuauuuuacuuuuuuuuaagcacca

SEQ ID NO: 509871 - RNA, 64 nt, hsa
gauugauuuuaaagaugucuuuuuuuauuuuacuuuuuuuuaagcaccaaauuuuguuguuuuu

SEQ ID NO: 509872 - RNA, 64 nt, hsa
cacuagaaaugguguaaaggcugucuuuuuuuuuuuuuuuuaaagaaaaguuauuaccauguau

SEQ ID NO: 509873 - RNA, 64 nt, hsa
acccuccaggugucaauggacuugugcuacuauauuuuuuuauucuugguaucaguuuaaaauu

SEQ ID NO: 509874 - RNA, 64 nt, hsa
gguuuuguuaauuaugauucuuuauuuucucuccuuuuuuuaggauauagcaguaaugcuauua

SEQ ID NO: 509875 - RNA, 64 nt, hsa
gcaguuaguccugcaugggaauaaggacuaguuauuuuuuuagugcugcauuuuuuuaaaguug

SEQ ID NO: 509876 - RNA, 64 nt, hsa
gggaauaaggacuaguuauuuuuuuagugcugcauuuuuuuaaaguuggauugcugcuauuuaa

SEQ ID NO: 509877 - RNA, 64 nt, hsa
gugacagagugagacucugucucaauuaauuuuuuuuuuuuaaaggaggaggaucuccaugggu

SEQ ID NO: 509878 - RNA, 64 nt, hsa
uugagugccguaaaagugcuuguaaaucuuuuuuuuuuuuuaagaagaaagaaaaaaauggugu

SEQ ID NO: 509879 - RNA, 64 nt, hsa
uauaaguacauccuuugggguuuuuuuuuucucuuuuuuuuaaccaaaguugcugucuagugca

SEQ ID NO: 509880 - RNA, 64 nt, hsa
uucuucacaauuccuuucaucauuuuuuaaauauuuuuuuuacugccuaugggcugugauguau

SEQ ID NO: 509881 - RNA, 64 nt, hsa
cauacccucauuuuuuucuuuucuuuuuuuuuuuuuuuuuuaguacaaaguuuuaguuucuuuu

SEQ ID NO: 509882 - RNA, 64 nt, hsa
aguggugugcucgaaaaagacauuacugaugccuuuuuuuuauagaguggauugaaaugccagu

SEQ ID NO: 509883 - RNA, 64 nt, hsa
ugaggacugugaagauaacuuucauguaguuggauuuuuuuauauaaauuagagcgucaauucc

SEQ ID NO: 509884 - RNA, 64 nt, hsa
aagcuucgccuuugcuuuugcacucucuuuuacauuuuuuuacuucuuuccuuuuucuuaaguu

SEQ ID NO: 509885 - RNA, 64 nt, hsa
aucagcuguguuaaugccuuuauucuuuguuuuuuuuuuuuagacggagucucgcucugucacg

SEQ ID NO: 509886 - RNA, 64 nt, hsa
acuuccucaccaacacuuauuauuuuccuuuuccuuuuuuuaaaaaaaauaaguuauggccauc

SEQ ID NO: 509887 - RNA, 64 nt, hsa
ugguuggauaucacugaguuuuuuuuuuuaagaauuuuuuuauugagguaaacuucacauaaca

SEQ ID NO: 509888 - RNA, 64 nt, hsa
uauauuuuuuaaugguuggauaucacugaguuuuuuuuuuuaagaauuuuuuuauugagguaaa

SEQ ID NO: 509889 - RNA, 64 nt, hsa
ucggaaauguagaauuuauuauuugucauuuuuuuuuuuuuagcauagauugagaacaguugaa

SEQ ID NO: 509890 - RNA, 64 nt, hsa
cugcauucauuuuucuaaaguaacaaauuugguuuuuuuuuaaaccauuaaaaucuaugugugu

SEQ ID NO: 509891 - RNA, 64 nt, hsa
uuuccauaaagacauuuauauaugugagcaagauuuuuuuuaaacaauuacuuuauuauuguug

SEQ ID NO: 509892 - RNA, 64 nt, hsa
ucccccuauggggccugacugcacugauauauauuuuuuuuaaagagcaacugccacaugcggg

SEQ ID NO: 509893 - RNA, 64 nt, hsa
guuuuguuuuuuuacuaaugaugguuuuguggguuuuuuuuaagggaugaguggaugagaggag

SEQ ID NO: 509894 - RNA, 64 nt, hsa
gaaccccuaacccccaauacuugaagggguuuuguuuuuuuacuaaugaugguuuuguggguuu

SEQ ID NO: 509895 - RNA, 64 nt, hsa
uuuuuuauaaauauguugauuucuugucuuuuuuuuuuuuuauuucuuacuuucccauauuagg

SEQ ID NO: 509896 - RNA, 64 nt, hsa
auuuuuaauuuaguuuggggaaguagcuuguuuuuuuuuuuauaaauauguugauuucuugucu

SEQ ID NO: 509897 - RNA, 64 nt, hsa
gaauuauugacugggcuuugggguugaacuuuuuuuuuuuuaaagaaagaaaaagaaacccugg

SEQ ID NO: 509898 - RNA, 64 nt, hsa
guuuguuccuccucauccucuucugagacuguuguuuuuuuagagcuugauugugggagaaaag

SEQ ID NO: 509899 - RNA, 64 nt, hsa
cauguuaauuuuuuucccucuuuccccacuuuuauuuuuuuaaauaagggauaacauauucuuu

SEQ ID NO: 509900 - RNA, 64 nt, hsa
uuuuuguuuuaauugagaaaagacuuugcaauuuuuuuuuuaggaugagccucuccuagacuug

SEQ ID NO: 509901 - RNA, 64 nt, hsa
aagcucuuccuucaagaguuucuagaucuuguuuuuuuuuuaauccaacauguucauuuggguu

SEQ ID NO: 509902 - RNA, 64 nt, hsa
uggaacagucaguuuaacuuuuuaacagaucuuauuuuuuuauuuugagugccacuauuaaugu

SEQ ID NO: 509903 - RNA, 64 nt, hsa
auucacaauuuaaaaacacuguaauccaaacuuuuuuuuuuaacuguagaucaugcaugugauu

SEQ ID NO: 509904 - RNA, 64 nt, hsa
gccuguucuauguuuuuaagcuacacgagaauuuuuuuuuuaauuaauucucacuguuuguuca

SEQ ID NO: 509905 - RNA, 64 nt, hsa
aagugccuucuguauuguguaagcauucuaugucuuuuuuuaauuguacuuguauuagauuuuu

SEQ ID NO: 509906 - RNA, 64 nt, hsa
uucagaaagggccaaauucccaaccugcucauuuuuuuuuuaucagagucaugaugaaucaguc

SEQ ID NO: 509907 - RNA, 64 nt, hsa
uuucaugccuggguggccaaacaacagucuucauuuuuuuuaauugaaaagaaguagugucugg

SEQ ID NO: 509908 - RNA, 64 nt, hsa
aaaucuagaagagucuauugucuccuugguuauauuuuuuuaacuuuaccaugcucaaugaaaa

SEQ ID NO: 509909 - RNA, 64 nt, hsa
ugaugccucccuggcagcacaggaaaagaauuuuuuuuuuuaagcucaaaaucuagaagagucu

SEQ ID NO: 509910 - RNA, 64 nt, hsa
agguccuuuauguguuguucuccugggagacuucuuuuuuuaaaugccagggcuacuucugcuu

SEQ ID NO: 509911 - RNA, 64 nt, hsa
acgacuguggcuugauguugauacacauuugaauuuuuuuuaaaaaaagaaaguuaucguagcc

SEQ ID NO: 509912 - RNA, 64 nt, hsa
aaaaucuaggccaaaauacugaaaagccuauguguuuuuuuaauuggaaguauauguaagguua

SEQ ID NO: 509913 - RNA, 64 nt, hsa
agguuaugcuccaaaaguguuauuuguaaguuaauuuuuuuacaagucaaacaauguuggaagu

SEQ ID NO: 509914 - RNA, 64 nt, hsa
ugauugugauacauugaacaaaauggaacucauuuuuuuuuaaggaguaaagauuuuuaauucu

SEQ ID NO: 509915 - RNA, 64 nt, hsa
accguuacauuuugaaauaugcaaagaaagacuuuuuuuuuaaggaaaggaaaaccuuauaaug

SEQ ID NO: 509916 - RNA, 64 nt, hsa
uaggaauagucuguuuuucuuuccugaagaucaguuuuuuuauucaaacacauuucaaagaacc

SEQ ID NO: 509917 - RNA, 64 nt, hsa
ggcuuguaauuaugucucuggauuauuauuauuuuuuuuuuagauguaguuuugcucuuguugc

SEQ ID NO: 509918 - RNA, 64 nt, hsa
guugaagaauguauuuuacuuaaagagggauuuuuuuuuuuaaguccugaauaagucuacugga

SEQ ID NO: 509919 - RNA, 64 nt, hsa
cucugugaaauguguccagaugugacauaguuuuuuuuuuuaauauguggaaaugucuucucuu

SEQ ID NO: 509920 - RNA, 64 nt, hsa
guaaucaauauuuuucaauagaaguauuagagguuuuuuuuauugauauaaaaauaacaauuac

SEQ ID NO: 509921 - RNA, 64 nt, hsa
uuuucauguauuucuuuucugucucuccaaugcauuuuuuuacauaguugugagcguuagccaa

SEQ ID NO: 509922 - RNA, 64 nt, hsa
acucugaucugauagacuguuuaugauaagcuuuuuuuuuuauuagcagcgugauuuguauauc

SEQ ID NO: 509923 - RNA, 64 nt, hsa
uauccuaauggcagauccaauuucaucucauucauuuuuuuaaccauaacuugcuuuucccauu

SEQ ID NO: 509924 - RNA, 64 nt, hsa
uagguugaaugagagacuucaucuauuggacuauuuuuuuuaauccaggcauauggucuuuagu

SEQ ID NO: 509925 - RNA, 64 nt, hsa
caaguagaaugaauaggagaagaguuuaagccuguuuuuuuaaaauauuauugcaaagagcucu

SEQ ID NO: 509926 - RNA, 64 nt, hsa
aagaacuuaucuuuauucucaaaauuaaauguaauuuuuuuagugacaaagaagaaaggaaacc

SEQ ID NO: 509927 - RNA, 64 nt, hsa
ccaaggaauaguauuuaagaaaauguugaaauaauuuuuuuaaaauagcauuacagacugaggc

SEQ ID NO: 509928 - RNA, 64 nt, hsa
caaccacauaguucguuuaccuucaaacuuuagguuuuuuuaaugauauacugaucuucauuac

SEQ ID NO: 509929 - RNA, 64 nt, hsa
aaaaaaaaaaaaauacaauuuuuauuucuuuuacuuuuuuuaguaaguuaauguauauaaaaau

SEQ ID NO: 509930 - RNA, 64 nt, hsa
uguuaaagguagucugccccuuccuuccucucucuuuuuuuaguuaaguagaaauguucugguc

SEQ ID NO: 509931 - RNA, 64 nt, hsa
ucuguuauaagucucuuccuuucucaaauaaaguuuuuuuuaaaagauccccuuucauacacuu

SEQ ID NO: 509932 - RNA, 64 nt, hsa
uagaaaucuaauuauucaguuauucaugacaauauuuuuuuaaaaguaagaaauucugaguugu

SEQ ID NO: 509933 - RNA, 64 nt, hsa
aaaauuauuaagucaccuaucaccuuuaaacgccuuuuuuuaaaauuauaaaauauuguaaagc

SEQ ID NO: 509934 - RNA, 64 nt, hsa
aaagcgcagcuacugacaaguagaacacugcuacuuuuuuuaaggcaguuucuuguuuuuuuag

SEQ ID NO: 509935 - RNA, 64 nt, hsa
agaacacugcuacuuuuuuuaaggcaguuucuuguuuuuuuagacggaauuaguccuuggcuuc

SEQ ID NO: 509936 - RNA, 64 nt, hsa
ugugcaauucuuauauuuauuuuacugguucacuuuuuuuuacauuuauuuuagucuuuauauu

SEQ ID NO: 509937 - RNA, 64 nt, hsa
gaaauuacaugaaacaugaaacaguuuuugcaauuuuuuuuaaacugggcaucugguuucuaaa

SEQ ID NO: 509938 - RNA, 64 nt, hsa
gcaucugggacuugaccaaaguuguucuguuuuguuuuuuuaacugaaaguaacagaaggaccu

SEQ ID NO: 509939 - RNA, 64 nt, hsa
agcaaaguaaacagcacuccccaccccacccuccuuuuuuuacucaucuuggaaaagguuaguc

SEQ ID NO: 509940 - RNA, 64 nt, hsa
uucaacuuaaaaaguagaaaugcauuauuauacauuuuuuuaagaaaggacacguuauguuagc

SEQ ID NO: 509941 - RNA, 64 nt, hsa
uuuuauuaucuuguacccucuuuuuuuuuuuuuuuuuuuuuaaagacagagucuugcucuguca

SEQ ID NO: 509942 - RNA, 64 nt, hsa
guuuuucuacgucauuuuuuaaaauuauauuuaauuuuuuuauuuugaaaguuuuuucacagau

SEQ ID NO: 509943 - RNA, 64 nt, hsa
aauuuuuuuauuuugaaaguuuuuucacagaucuuuuuuuuaguauuauuaccuucugauauau

SEQ ID NO: 509944 - RNA, 64 nt, hsa
aaaugccgucaguagaaagcacacaagguuaugauuuuuuuaauuacuggcuucugauuucuuu

SEQ ID NO: 509945 - RNA, 64 nt, hsa
uaaagguagacucagucuuuaagauauuagacaguuuuuuuaguccaugggauuguaaauauaa

SEQ ID NO: 509946 - RNA, 64 nt, hsa
ggucaggguggcauuaaaauggacuccaaaaacauuuuuuuaaauguucuguaagauaaacugu

SEQ ID NO: 509947 - RNA, 64 nt, hsa
cugaugcugauuugaugcuguaugaucuuuuuuuuuuuuuuaguuaaauucauuuagugaaugu

SEQ ID NO: 509948 - RNA, 64 nt, hsa
ugccaagcauuuucugugauuucagguuuuuuccuuuuuuuacauuuacaacguaucaauaaac

SEQ ID NO: 509949 - RNA, 64 nt, hsa
ggcaauuaaacaugcuacacagcauggcaucacuuuuuuuuauaacucauuaaacacaguaaaa

SEQ ID NO: 509950 - RNA, 64 nt, hsa
aaugcauuuuucccucaucaagcauauaucugcuuuuuuuuauuuugcaauucucuguauucua

SEQ ID NO: 509951 - RNA, 64 nt, hsa
auuugaucuugacauuuaaugucacaaaguuuuguuuuuuuaaaaagugauuuaaacuuaagau

SEQ ID NO: 509952 - RNA, 64 nt, hsa
cucauugaucagcagccaauauggguuuguuugguuuuuuuaauucuuaaaaacauccucuaga

SEQ ID NO: 509953 - RNA, 64 nt, hsa
aaguucagaaaaaugcacuaugaccgguucguaauuuuuuuaaugccacacauagguuguauug

SEQ ID NO: 509954 - RNA, 64 nt, hsa
auaaggaagagucggaaaaaacaaugaccuuaguuuuuuuuaagccugaugauacuaugguuua

SEQ ID NO: 509955 - RNA, 64 nt, hsa
gcagagguggcauuuucuuuauugcauuucucuauuuuuuuaauguacccuaccuucaguauuc

SEQ ID NO: 509956 - RNA, 64 nt, hsa
aacaguauccacacuuuuuaguucuuuauuuuuuuuuuuuuauuuugagcaauucuccugccuc

SEQ ID NO: 509957 - RNA, 64 nt, hsa
aagguuauuuagcuagcuuaguguugaacuaaauuuuuuuuaaacaaggcaaggucuaaugcug

SEQ ID NO: 509958 - RNA, 64 nt, hsa
acguacucccacagacgucugggccuggaaauuuuuuuuuuauuuuauuuuauuguuuuuuuuu

SEQ ID NO: 509959 - RNA, 64 nt, hsa
uggaaauuuuuuuuuuauuuuauuuuauuguuuuuuuuuuuagaaaaacaccacuuuuauuaug

SEQ ID NO: 509960 - RNA, 64 nt, hsa
ugaugcagaaagacguucuuuugcauaaaagacuuuuuuuuaacacuuuggacuucucugaaau

SEQ ID NO: 509961 - RNA, 64 nt, hsa
ugaaagaccuaugagcaaauggugcugaauacuuuuuuuuuaaagccacauuucauugucuuag

SEQ ID NO: 509962 - RNA, 64 nt, hsa
aaagcaggauuauuaagugauuauuuaaaauucguuuuuuuaaauuagcaacuucaaguauaac

SEQ ID NO: 509963 - RNA, 64 nt, hsa
ggcuacaauaccggaaaaugcuaguuuuuauuuauuuuuuuaaguagugcuuccuaaaugguuu

SEQ ID NO: 509964 - RNA, 64 nt, hsa
acuucuugucaacaaaaaauauaaauggaaauuuuuuuuuuagcucuugcuuuaaguguuuguu

SEQ ID NO: 509965 - RNA, 64 nt, hsa
augaaaacgguauuaauucuuggaugauuaaaaguuuuuuuauuagaauguucuuuauccuaau

SEQ ID NO: 509966 - RNA, 64 nt, hsa
agcauugcuuucguguaaauuauguaaugcaaaauuuuuuuaaucuucgccuuaauacuuuuuu

SEQ ID NO: 509967 - RNA, 64 nt, hsa
caauguggccgaggacuuugauugcacauuguuguuuuuuuaauagucauuccaaauaugagau

SEQ ID NO: 509968 - RNA, 64 nt, hsa
aagugaagauuuugugaggaauaagugcaaauuuuuuuuuuauuuuaaaaaauucuuugaaacu

SEQ ID NO: 509969 - RNA, 64 nt, hsa
uugccuuaucuuuuuuuauuacuguguacaaagauuuuuuuacacaaagaaacuuaaugcugua

SEQ ID NO: 509970 - RNA, 64 nt, hsa
cagaagguuucuguuuaaugcaucuugccuuaucuuuuuuuauuacuguguacaaagauuuuuu

SEQ ID NO: 509971 - RNA, 64 nt, hsa
gggguggaauggaacagucagguaguugaaaguuuuuuuuuagagaugaaaagcuugugaacuc

SEQ ID NO: 509972 - RNA, 64 nt, hsa
uauuagagaucugcauuuaucaugaguuccuuuuuuuuuuuaacuuuauuuuugggaaaguaac

SEQ ID NO: 509973 - RNA, 64 nt, hsa
uuaaggacauuuuuuuuccucuuuuuuuuuuuuuuuuuuuuaauucugagauuuccccaagcug

SEQ ID NO: 509974 - RNA, 64 nt, hsa
cuuuuguucaauuguguauuggcguacuuagaauuuuuuuuauuugaaagagaaauauaauucc

SEQ ID NO: 509975 - RNA, 64 nt, hsa
aggggaagcgauuacuuuuuuuaauuuuaaauuuuuuuuuuaauugcacuucuuguaaagagug

SEQ ID NO: 509976 - RNA, 64 nt, hsa
ucuuacauuauggcucccgaggggaagcgauuacuuuuuuuaauuuuaaauuuuuuuuuuaauu

SEQ ID NO: 509977 - RNA, 64 nt, hsa
ccaccuuuuuucuuugguugcuuuuuuuuuuuuuuuuuuuuagguucuuccugcccuuuccuuc

SEQ ID NO: 509978 - RNA, 64 nt, hsa
uuuucaguuguugcuaugaaugauuuugagccuuuuuuuuuaagcuuggcaaacaucccagcua

SEQ ID NO: 509979 - RNA, 64 nt, hsa
acucucaucauccacaguagaauuuuuaaacagauuuuuuuaaagcuuuucuuuuaaauuuuuc

SEQ ID NO: 509980 - RNA, 64 nt, hsa
gaggcaaguaaccccgccuccacaaucuuaguauuuuuuuuaaacugcaugccugccccuuauu

SEQ ID NO: 509981 - RNA, 64 nt, hsa
agccaucuaagaauacagaaccaaauuggauccauuuuuuuaaaaaaaugguuuugcauggaac

SEQ ID NO: 509982 - RNA, 64 nt, hsa
caagacauucugccuaccuauuagcuuuucuuuauuuuuuuaacuuuuuggggggaaaaguauu

SEQ ID NO: 509983 - RNA, 64 nt, hsa
ccucgauuuauauuucuguuuguggugaacugauuuuuuuuaaaccaaaguuuagaaagagguu

SEQ ID NO: 509984 - RNA, 64 nt, hsa
uucagugacaccugaauuguuuguuguuguuuuuuuuuuuuauugucuucaaagaggaagggcc

SEQ ID NO: 509985 - RNA, 64 nt, hsa
gaagaaaagcaggaagaauuuaaauguuuaauuuuuuuuuuaaauugacuuuucuaguuauuaa

SEQ ID NO: 509986 - RNA, 64 nt, hsa
aaaaauuaagucuucaaauuuuuuaaagguuuuuuuuuuuuaauuuaauuuuuccuuuuggggg

SEQ ID NO: 509987 - RNA, 64 nt, hsa
gucuaucugugaacguggcccgcaugugcauucuuuuuuuuauauauauaaagucagugacgag

SEQ ID NO: 509988 - RNA, 64 nt, hsa
guccacagagguuuuuguuuuuugguuuuuuuuuuuuuuuuaagaaaaaaagaugaaaaaugaa

SEQ ID NO: 509989 - RNA, 64 nt, hsa
acagacugggggaggggguuuuucuuuuuauuuuuuuuuuuaauuuuaaacgacugaagaaaac

SEQ ID NO: 509990 - RNA, 64 nt, hsa
ccuuggcucugcuugugaucagaacaugaacuuuuuuuuuuaaagaagauuugagcauuuuucu

SEQ ID NO: 509991 - RNA, 64 nt, hsa
aaggaaggaagaccuugaucgacauuguuuuuuauuuuuuuaaccuuguccuuguaauuacauu

SEQ ID NO: 509992 - RNA, 64 nt, hsa
guucuuggaacagauaacugaaugauagauuuuuuuuuuuuaaagauaaaacuuuacaaccugc

SEQ ID NO: 509993 - RNA, 64 nt, hsa
caauuugcuguauauuuuuguugccuuuuuugcuuuuuuuuaaucugugcaauaccucauuuaa

SEQ ID NO: 509994 - RNA, 64 nt, hsa
aguauuugucuuguagaucagguguuuuguuuuguuuuuuuaauuuuaaaaugcaacccugccc

SEQ ID NO: 509995 - RNA, 64 nt, hsa
ucuuacuggaaaugacaaguuuuugcuugauuuuuuuuuuuaaacaaaaaaugaaauauaacaa

SEQ ID NO: 509996 - RNA, 64 nt, hsa
auagaauagacugaccaagaugguucacaguuucuuuuuuuaacuagguuauuuauaauguauu

SEQ ID NO: 509997 - RNA, 64 nt, hsa
guggguguguguguguauuuuuccccaugaguccuuuuuuuaauccuguggcuuuuucacuuac

SEQ ID NO: 509998 - RNA, 64 nt, hsa
gcagagcauguccuaguucaauguugacuuuuuuuuuuuuuaaagaaaagcauuaagacauaaa

SEQ ID NO: 509999 - RNA, 64 nt, hsa
guuuuuugaaauuaugugacauuuuacauuaaauuuuuuuuacauuuuuugggcagcaauuuaa

SEQ ID NO: 510000 - RNA, 64 nt, hsa
aaagcagauaauucuucugugugaaaauguuuucuuuuuuuaauuuaagguuuaaaauuccuuu

SEQ ID NO: 510001 - RNA, 64 nt, hsa
ucuauuuuuaucauuauuugggguuugaaaaauuuuuuuuuacaccuucuaauuucuuuauuuc

SEQ ID NO: 510002 - RNA, 64 nt, hsa
caacaaacgacaguaucucggauuccuuuuuuuuuuuuuuuaauuuuuuauacuuugguguuuc

SEQ ID NO: 510003 - RNA, 64 nt, hsa
cguuuucuuuccuagcauaucaguuauacuuuuuuuuuuuuaaaccuuucuuagugguuucuuu

SEQ ID NO: 510004 - RNA, 64 nt, hsa
uuucuaucuauaugugucuuuauauuuaaagugguuuuuuuauagacaguauauaaauggguca

SEQ ID NO: 510005 - RNA, 64 nt, hsa
cugguuuauauguguauguguguuuuauuguguguuuuuuuaauuuguaaguauucuaagaguu

SEQ ID NO: 510006 - RNA, 64 nt, hsa
auaaggauccucagauuuaaauaaguacuuuuuuuuuuuuuaaucagaagaacauuguuguuug

SEQ ID NO: 510007 - RNA, 64 nt, hsa
uuauguugaaggcagaguuuucauaggguuagauuuuuuuuauccuuuucuaguucaguuaauu

SEQ ID NO: 510008 - RNA, 64 nt, hsa
cuccauuuuggaaagcaggaaaacaggauuuuuuuuuuuuuaucuuguucccuggaggauccag

SEQ ID NO: 510009 - RNA, 64 nt, hsa
aaagaacgugagcaggaaaaacugcuggugauacuuuuuuuaaguuuuguuuuuaucuugccug

SEQ ID NO: 510010 - RNA, 64 nt, hsa
uuucccuuuacaguucugcaguuccaucacaguauuuuuuuaaauaacucagguguaugagaag

SEQ ID NO: 510011 - RNA, 64 nt, hsa
cuucuuucuuccuuccuuuuuuuuuuuuuguuuuuuuuuuuaagagccugugauaguuacugug

SEQ ID NO: 510012 - RNA, 64 nt, hsa
aggggccggggucagggagagucuuuuuuuuuuuuuuuuuuaaauacuaaauuggaacauuuaa

SEQ ID NO: 510013 - RNA, 64 nt, hsa
acccaggacugaacaugcagaacuguuuuuuuuuuuuuuuuaucuuaaacacauacacaccucc

SEQ ID NO: 510014 - RNA, 64 nt, hsa
gaaacaugaaaccaaacaggcuuugauauuuuuuuuuuuuuaauuacuuuccccuuuugcuuga

SEQ ID NO: 510015 - RNA, 64 nt, hsa
uccugggagcuuauagcccauuauuuuuacuuuuuuuuuuuaauucagaagacuagaacagaac

SEQ ID NO: 510016 - RNA, 64 nt, hsa
aaccacuaacauauggcuauugcucuaugauuuuuuuuuuuacauuaggaggcagugauauugu

SEQ ID NO: 510017 - RNA, 64 nt, hsa
guuggggaguacuuggcaguugggauaugauccauuuuuuuaaacaaguuuuuuguagaucccu

SEQ ID NO: 510018 - RNA, 64 nt, hsa
uguuucaucuacucugugaaucuacauaggucuuuuuuuuuagauguuugauacauuuuaagua

SEQ ID NO: 510019 - RNA, 64 nt, hsa
acccuguaacguaacccauuaaaaugaauuucuuuuuuuuuaagacagaguuucucucuguugc

SEQ ID NO: 510020 - RNA, 64 nt, hsa
guguuuccugaaucuaaaauaaaaaucgaaauaauuuuuuuaaaaaagaaaaagacaauaguau

SEQ ID NO: 510021 - RNA, 64 nt, hsa
uauuccacaucaucgauccucucugugguguuaauuuuuuuauaugaccaguagaaaaauuuua

SEQ ID NO: 510022 - RNA, 64 nt, hsa
ugcuauaaguuuugaaguuucuuagcaauuaaaguuuuuuuauucagugugaacugucaguauc

SEQ ID NO: 510023 - RNA, 64 nt, hsa
acuguagggucaaagccuuauagcaaaaaaaauuuuuuuuuauauuugcacaggacuauacagc

SEQ ID NO: 510024 - RNA, 64 nt, hsa
guuuuguuucuauuuuuauuuuuauuaauuuuauuuuuuuuaauacagauuuucagugaggggc

SEQ ID NO: 510025 - RNA, 64 nt, hsa
agugucacaaagaaaaccagaucucucucucuuuuuuuuuuauuuuuuuuagugauagagucuc

SEQ ID NO: 510026 - RNA, 64 nt, hsa
aagaaaaccagaucucucucucuuuuuuuuuuauuuuuuuuagugauagagucucacucuguca

SEQ ID NO: 510027 - RNA, 64 nt, hsa
ugcacaagcaugccuggcuaauuuuuaaauuuuuuuuuuuuaagaaauagggucuugcuauguu

SEQ ID NO: 510028 - RNA, 64 nt, hsa
uugauuuguacagauccacuuagucauuuucuccuuuuuuuaagaaccauuuucaucugauuuu

SEQ ID NO: 510029 - RNA, 64 nt, hsa
cugcauuaagauaggguggauuuuaugugcuuuuuuuuuuuaagaguugaauuucuuuuccuga

SEQ ID NO: 510030 - RNA, 64 nt, hsa
cauaaaaggauauuuauaucucuguugcuuugacuuuuuuuauauaaaauccgugaguauuaaa

SEQ ID NO: 510031 - RNA, 64 nt, hsa
uaaauauuagucucccuccaugacacugcaguauuuuuuuuaauuaauacaaguaaaaaguuug

SEQ ID NO: 510032 - RNA, 64 nt, hsa
acucuucuauugaaguuaaagaaagaaaaaaagauuuuuuuauuuguauuaaugaaaagcuuua

SEQ ID NO: 510033 - RNA, 64 nt, hsa
uugagguguuuuuguuuuuauuuguguguuuuuuuuuuuuuaagucagcuuggaacuuuuuucc

SEQ ID NO: 510034 - RNA, 64 nt, hsa
auguaaacuuucaugguauuuagccuuucuuaaauuuuuuuaaaauuuaaacuuucuaaccuau

SEQ ID NO: 510035 - RNA, 64 nt, hsa
caaaauaaaugcuuuaauuuucauuugcuaccucuuuuuuuauuaugccuuggaaugguucacu

SEQ ID NO: 510036 - RNA, 64 nt, hsa
uucauuuugcuucaaucaaaagugguuucaauauuuuuuuuaguugguuagaauacuuucuuca

SEQ ID NO: 510037 - RNA, 64 nt, hsa
accaaucuuuguacaauuuguaaauguuaagaauuuuuuuuauaucuguuaaauaaaaauuauu

SEQ ID NO: 510038 - RNA, 64 nt, hsa
uuuuacauugugauuuuuacauuaaaauauuaacuuuuuuuaaugcuauuuuaugaaagauuau

SEQ ID NO: 510039 - RNA, 64 nt, hsa
guauuuugguuaaucuucaugaauugaauaauuguuuuuuuaaagcaaaauaaaguuuuuuaaa

SEQ ID NO: 510040 - RNA, 64 nt, hsa
gugacagaauaucaaaauaauuuguggcuguggauuuuuuuaacugcuaguaguggaauacugg

SEQ ID NO: 510041 - RNA, 64 nt, hsa
uuaaaaauuaaaaauguauguauagguuuugaaauuuuuuuaaaaggggagaaagacuguuaag

SEQ ID NO: 510042 - RNA, 64 nt, hsa
cagaugagcgaaaauguauuauuguaaaguuuauuuuuuuuaauacuguugucuauaaugggga

SEQ ID NO: 510043 - RNA, 64 nt, hsa
uauacauauauugugugguuuccccuuucuuuccuuuuuuuaagcaacaaaacuauggaaauaa

SEQ ID NO: 510044 - RNA, 64 nt, hsa
uuguauuuuuaaaacuagauuuauagacuuuuuuuuuuuuuaacuagggcacuugcuuccuucu

SEQ ID NO: 510045 - RNA, 64 nt, hsa
uuuuuuaagacucuuaaaaaaagagccugggcaauuuuuuuaagacucugucuuaaaaaaaacu

SEQ ID NO: 510046 - RNA, 64 nt, hsa
agaucgugccacugcacuccagccugggcaagaguuuuuuuaagacucuuaaaaaaagagccug

SEQ ID NO: 510047 - RNA, 64 nt, hsa
uagacgcuuuuuagaaguuuugaaauuaccuugauuuuuuuaauuguuaugaaaauggaucuuu

SEQ ID NO: 510048 - RNA, 64 nt, hsa
uuguggcuggggauggguuuugguuuugggguuuuuuuuuuaaauuguuuugacuucguacagg

SEQ ID NO: 510049 - RNA, 64 nt, hsa
gaucaauaacuucagauucuaagaguggauuuuuuuuuuuuacaugggcuccuauuuuuucccc

SEQ ID NO: 510050 - RNA, 64 nt, hsa
guaaguugguuucaagauuggggauuuugggguuuuuuuuuaguauuuauagaaauaauguaaa

SEQ ID NO: 510051 - RNA, 64 nt, hsa
cauuugauuacuuauauaaaaacaguucagaauauuuuuuuaaaaaaaauucuauauauacugu

SEQ ID NO: 510052 - RNA, 64 nt, hsa
ucuuuuguaaacaaaaaggcaaugauguaugcauuuuuuuuaauuugagguaguuuguuuguau

SEQ ID NO: 510053 - RNA, 64 nt, hsa
uuaagcauuguuucaaaaguuuuuuuauauuuauuuuuuuuaaggaaaagguauagacaaccag

SEQ ID NO: 510054 - RNA, 64 nt, hsa
gggauuguaaaguaguuaagcauuguuucaaaaguuuuuuuauauuuauuuuuuuuaaggaaaa

SEQ ID NO: 510055 - RNA, 64 nt, hsa
aauauuuaauuucuucauaaaaauaaguuaaauauuuuuuuaaauauguauaucuaauaguaca

SEQ ID NO: 510056 - RNA, 64 nt, hsa
uugccucaguagauacuaaagcaaauuguuucaguuuuuuuaaaugcccuuugauguuucaaaa

SEQ ID NO: 510057 - RNA, 64 nt, hsa
ggcugaauuaaaaugguuuuuguuuuuugguuuuuuuuuuuacccagacaacucuagaaaugcg

SEQ ID NO: 510058 - RNA, 64 nt, hsa
ugugugucuuuucauaagguuuuacaaugguuuauuuuuuuacaagguuuacgugucucaaagc

SEQ ID NO: 510059 - RNA, 64 nt, hsa
aucuagugagcaauacacauauuauaggccaauauuuuuuuaaaaaauagagcuuggucaaccu

SEQ ID NO: 510060 - RNA, 64 nt, hsa
gcuuuggcuccugauauuuuaucaugcuccuauauuuuuuuaauccuuggagcaguaguuuuua

SEQ ID NO: 510061 - RNA, 64 nt, hsa
uuauuguuucuucauacugugucuguauuuaaucuuuuuuuauggaaccuguugcgccuauuua

SEQ ID NO: 510062 - RNA, 64 nt, hsa
ccacucuggaagaaauagucaugcuucuuuauuauuuuuuuaauccuuuauggacauuguuuuu

SEQ ID NO: 510063 - RNA, 64 nt, hsa
gugaauuauagaagcuacuuuuuauaaagccauauuuuuuuagggaaacuaaggagugacauag

SEQ ID NO: 510064 - RNA, 64 nt, hsa
auuucagugaaaguuuuaaauuaucauuuauuuauuuuuuuaaaugagaggggaaagcugaaau

SEQ ID NO: 510065 - RNA, 64 nt, hsa
agcuagacaucucagguaaauuuguuuuuuuuuuuuuuuuuagcccuagagguaacauuauaac

SEQ ID NO: 510066 - RNA, 64 nt, hsa
auuccuggcuuggucaagaacaaccugauuuuuuuuuuuuuaaucuugcagaaaaguugauugc

SEQ ID NO: 510067 - RNA, 64 nt, hsa
guuuucgguauaaauauguagauaauggauuuuuuuuuuuuagauaauguugucaagaccaaaa

SEQ ID NO: 510068 - RNA, 64 nt, hsa
uaaucuguacaucucuacuuauuuaugaacagacuuuuuuuaaaaagauaaaaaaacagcuuua

SEQ ID NO: 510069 - RNA, 64 nt, hsa
agaagagaagaggagguacuguguguuacaaaaauuuuuuuaaauaaagaauucagugucacua

SEQ ID NO: 510070 - RNA, 64 nt, hsa
gaaaugucaaauauaauuccauuuuuuauuuuuauuuuuuuaagcuuuuggaaaagcuccaggu

SEQ ID NO: 510071 - RNA, 64 nt, hsa
gguaaaccacuauuauuuauauuuauaauuuacuuuuuuuuacuuuuauaaugcauuuuacucc

SEQ ID NO: 510072 - RNA, 64 nt, hsa
auuaaacucuuuugugccaaguuuaauugguggauuuuuuuaguaaguagaguuaggagaaaga

SEQ ID NO: 510073 - RNA, 64 nt, hsa
aagaaugcacauguauaaaguuuacauaaagaaguuuuuuuaaguuauugagauaggaaauaua

SEQ ID NO: 510074 - RNA, 64 nt, hsa
uaagcauucaauaagaacuagcugcggauguaauuuuuuuuaaaaaaguccaaaagcagcuaug

SEQ ID NO: 510075 - RNA, 64 nt, hsa
aauaccuuagaauaguuaucccccccuuuuuuuuuuuuuuuaacaaaaaaacacuuuucuaagg

SEQ ID NO: 510076 - RNA, 64 nt, hsa
agccaucuuuaaauaguucuuuaaaaauaggucuuuuuuuuauauuuuggaaaaggcauuguuu

SEQ ID NO: 510077 - RNA, 64 nt, hsa
gacuacaggcaccugccaccacgccuggcuaacuuuuuuuuauauuuugaguagaaaugggguu

SEQ ID NO: 510078 - RNA, 64 nt, hsa
aagguguugaccaaauccagaccauuuuauuuuauuuuuuuauuuauuuauuuuuugagaugga

SEQ ID NO: 510079 - RNA, 64 nt, hsa
agauguuuuaauauguaucaaaaauuaaaaugauuuuuuuuauugccuugagguacuuuuuaaa

SEQ ID NO: 510080 - RNA, 64 nt, hsa
uuuuaaguagugugaauugcaaaacccaacauauuuuuuuuacugucaguugcgguuuauuuau

SEQ ID NO: 510081 - RNA, 64 nt, hsa
uaugcccaauucucucuacaugacauauugagauuuuuuuuaaucaacuuuuaagauagugaug

SEQ ID NO: 510082 - RNA, 64 nt, hsa
uugugauuuuaaacgagcuauuaugguacggaacuuuuuuuaaugaggaauuucaugaugauuu

SEQ ID NO: 510083 - RNA, 64 nt, hsa
uuauuccaucucucaagauauauuauaaaauuuauuuuuuuaauuuaagauuucugaauuauuu

SEQ ID NO: 510084 - RNA, 64 nt, hsa
aaaggguagcacuuauucauuccaaguacuuuuuuuuuuuuaauuuuuaagcucuuaacucaca

SEQ ID NO: 510085 - RNA, 64 nt, hsa
uuaacaugaugcuuggaaauuaagagacuaaagcuuuuuuuaaaaaaagguggaaaauaggaac

SEQ ID NO: 510086 - RNA, 64 nt, hsa
guguauacuaacaagcguacaauuuuuaguugauuuuuuuuaaccuuuuaguuucccaguuuug

SEQ ID NO: 510087 - RNA, 64 nt, hsa
caaauuacuuaagauguuuaaugucaguuaaagauuuuuuuacccucuuuuugggaacaucaau

SEQ ID NO: 510088 - RNA, 64 nt, hsa
acaguuuuucaguacuguauguguuaauuucuacuuuuuuuaauauuuaaaauugcuuuuaaau

SEQ ID NO: 510089 - RNA, 64 nt, hsa
ucuuauuuuacuguugaacagcaauugcuauuuauuuuuuuauugccuagaacuucaacauguu

SEQ ID NO: 510090 - RNA, 64 nt, hsa
ugcuuuacucacggaguuuaaauaauaguguucauuuuuuuaaugacacugguuucauguaguu

SEQ ID NO: 510091 - RNA, 64 nt, hsa
aaaaugaaaucuuaggugccuuagggguuuuuuuuuuuuuuaaguauuuuuuaaaaaccugcaa

SEQ ID NO: 510092 - RNA, 64 nt, hsa
cgggugagaagaaaagagcaggcaaaauuagugauuuuuuuagaagucugcuaaauggauauau

SEQ ID NO: 510093 - RNA, 64 nt, hsa
gccccaaauccagcaugaccaaaaguaaaugauguuuuuuuaaagugucuuucuucaaguuucu

SEQ ID NO: 510094 - RNA, 64 nt, hsa
gcaaucuacauugggcaucuggucauucaaucuguuuuuuuaaauguuauuuuugccuuucaau

SEQ ID NO: 510095 - RNA, 64 nt, hsa
uuuuuaauaaaguggaagcuugcuuuuuuaacucuuuuuuuauuguuauuuuauagaaaugcuu

SEQ ID NO: 510096 - RNA, 64 nt, hsa
aacacuucucacuugugaugcuguacuaauuuuuuuuuuuuaauuuaagcuaguauacuaagug

SEQ ID NO: 510097 - RNA, 64 nt, hsa
aucuaugauuaaauaaagugaguuuuugguuuuguuuuuuuaauuucagccauuccuagaguua

SEQ ID NO: 510098 - RNA, 64 nt, hsa
aaagucaucaauauuuuucaacuuuuuuuuuuuuuuuuuuuacuuuggaaaggacaauaacuau

SEQ ID NO: 510099 - RNA, 64 nt, hsa
cauuuaacauucauacaauuauauauaauauccuuuuuuuuaaagaaugguauuucacaaaaau

SEQ ID NO: 510100 - RNA, 64 nt, hsa; identical to SEQ ID NO: 509434

SEQ ID NO: 510101 - RNA, 64 nt, hsa
gcuaauaugucuaaauacauauguuaucccuugauuuuuuuaaauaacugagagcucuauuuau

SEQ ID NO: 510102 - RNA, 64 nt, hsa
aacuacuauagagaaaauaaaauuuuuuccuuuuuuuuuuuaaccggaaagugcauuugcuugg

SEQ ID NO: 510103 - RNA, 64 nt, hsa
auuaagacaaaauguuuaauaagaauagcaaaaauuuuuuuauauuaugcauccuuauaccuca

SEQ ID NO: 510104 - RNA, 64 nt, hsa
aauuuugcuggaauuccuaacuuuucaaugacauuuuuuuuaacuacuauauugauuguccuuu

SEQ ID NO: 510105 - RNA, 64 nt, hsa
auaaaaugucguuaaaaaguuguuuguuuuuuucuuuuuuuauaaauaaacuguugcucguugc

SEQ ID NO: 510106 - RNA, 64 nt, hsa
gaucuguuuaugcgauaacuccuuuuuguuacaauuuuuuuaaaaaaagcuauuuuuguuaaug

SEQ ID NO: 510107 - RNA, 64 nt, hsa
gaccuuuaaauugcugcaaaagguaaauuguauuuuuuuuuaaguauugguguucuuuacucua

SEQ ID NO: 510108 - RNA, 64 nt, hsa
accucacugacuucauaauuggaaugucacaugguuuuuuuaaucaagaugcagugaacugaga

SEQ ID NO: 510109 - RNA, 64 nt, hsa
ugggaauuuaaaccaacauguggcugagccuuuuuuuuuuuaaucuucguaacauguuuaaaaa

SEQ ID NO: 510110 - RNA, 64 nt, hsa
caguauuuguggcaguuuuaguuuuuuguuuuuuuuuuuuuaaucaaaaaacaauuuuuuuaaa

SEQ ID NO: 510111 - RNA, 64 nt, hsa
guuuuuuguuuuuuuuuuuuuaaucaaaaaacaauuuuuuuaaaaaaaaagcuuugaaaaugga

SEQ ID NO: 510112 - RNA, 64 nt, hsa
acaguauugugcuuuuuguggggaaagugagguuuuuuuuuauauacauauauaauugauaucu

SEQ ID NO: 510113 - RNA, 64 nt, hsa
ugugaugggaagccuugccccccucuuuuuuuuuuuuuuuuaauaucugcggaauaaacccaau

SEQ ID NO: 510114 - RNA, 64 nt, hsa; identical to SEQ ID NO: 509434

SEQ ID NO: 510115 - RNA, 64 nt, hsa; identical to SEQ ID NO: 509433

SEQ ID NO: 510116 - RNA, 64 nt, hsa
auauuacacuguuuuuuuuguuuguuuuguuaguuuuuuuuauuuaaagcaaaccucaaacauu

SEQ ID NO: 510117 - RNA, 64 nt, hsa
cuccaaaaucaugaaugauacacaugaagauaacuuuuuuuaaaaaaaagcagaaauacacaau

SEQ ID NO: 510118 - RNA, 64 nt, hsa
uaauguuuugccuuguuuucuuuucuuccuuuuuuuuuuuuaagagaaggggucucucccuauu

SEQ ID NO: 510119 - RNA, 64 nt, hsa
uucuaggguaaauucuggcaaacuacccuuuuuuuuuuuuuaaucacagaauauuccuguuccc

SEQ ID NO: 510120 - RNA, 64 nt, hsa
guuuguuuuuuggcaugaauugucaucuuugguguuuuuuuaacccccagccccucaaaaaaau

SEQ ID NO: 510121 - RNA, 64 nt, hsa
cauuuaguugauguaauacauagcuguaugggguuuuuuuuaguaaguucuuugagcauaauuc

SEQ ID NO: 510122 - RNA, 64 nt, hsa
uuccaguaaguuucuuacagaaaguaccugugauuuuuuuuaauguuuagauuuguagucuagu

SEQ ID NO: 510123 - RNA, 64 nt, hsa
aaguguaacaaauucucgcuccaugaaccugguuuuuuuuuauucuguuguggaaauuuuuaaa

SEQ ID NO: 510124 - RNA, 64 nt, hsa
auaaauuuagugaaccuauuuuugguggucauuuuuuuuuuaagacagucauuuuaaaauggug

SEQ ID NO: 510125 - RNA, 64 nt, hsa
acuagugaagaacugaaggaguccugcaucuuuuuuuuuuuaucugcuucuguuuaaaaagcca

SEQ ID NO: 510126 - RNA, 64 nt, hsa
agauuuucuuucuguacuucguuuuacuuuucuuuuuuuuuaacuuuuacucucucgaagaaga

SEQ ID NO: 510127 - RNA, 64 nt, hsa
cggagcccacucaccuuuuuucuuuuucuuuuuuuuuuuuuaacuuuauuccuugagggaagca

SEQ ID NO: 510128 - RNA, 64 nt, hsa
uuuugcuuugauuguguuuaugucaugggucauuuuuuuuuaguuacagaagcaguuguguuaa

SEQ ID NO: 510129 - RNA, 64 nt, hsa
cagauuggcacgaaccuuuucuuccacuuaauuauuuuuuuaggauuuugcuuugauuguguuu

SEQ ID NO: 510130 - RNA, 64 nt, hsa
aaaaagaaaacacaucuaaaagcccaggaacugauuuuuuuaagaggaaaacuaaugacagugu

SEQ ID NO: 510131 - RNA, 64 nt, hsa
ggaccaauugugugaccaugagaaggaugcuuauuuuuuuuaaaaagaaaacacaucuaaaagc

SEQ ID NO: 510132 - RNA, 64 nt, hsa
auugauuauuaggauauauucccaugaaggauucuuuuuuuaaaaaaaugugaaaugucaucuu

SEQ ID NO: 510133 - RNA, 64 nt, hsa
aacccccauguaugccuauauguguauuguauacuuuuuuuacauaauuggagucauacuguaa

SEQ ID NO: 510134 - RNA, 64 nt, hsa
ccaaaacauuucuggacaguaccugauuguauuuuuuuuuuaaauaaaagcacaaguacuuuug

SEQ ID NO: 510135 - RNA, 64 nt, hsa
agcaaagauuaaaugugucauuggaagccaucccuuuuuuuacauuucauacaacagaaaccag

SEQ ID NO: 510136 - RNA, 64 nt, hsa
aacauguuuuauuaaguucuucauuucuguugauuuuuuuuauugcauuuaugauucaguggcu

SEQ ID NO: 510137 - RNA, 64 nt, hsa
aucuucucucucgugcuuaauuaauagcuuuaucuuuuuuuauaccauuuuauccuuuucucuu

SEQ ID NO: 510138 - RNA, 64 nt, hsa
guauuuauaauaauuaucauuugcguuuuuuuccuuuuuuuaacuuuaaaaauguauauucuag

SEQ ID NO: 510139 - RNA, 64 nt, hsa
augguugucucuuaaaaagaaagauagcaaauacuuuuuuuaaauuacaaaagugauagauguu

SEQ ID NO: 510140 - RNA, 64 nt, hsa
ucuauaguauggucagcuaauaauauaucagaccuuuuuuuauauuauuaaauauucuacaacu

SEQ ID NO: 510141 - RNA, 64 nt, hsa
uguuuaacaagguaacuuuuuguuuaaccuagauuuuuuuuaaaacuuuuuuuuuuuuucauau

SEQ ID NO: 510142 - RNA, 64 nt, hsa
ugauaugucuaaaaauuuucaggaaaauggaaucuuuuuuuaaaguucagguaugacaaaguau

SEQ ID NO: 510143 - RNA, 64 nt, hsa
aguaacaauucagauucacuugggaauagcagaauuuuuuuauacaggguuaauaauccuuaaa

SEQ ID NO: 510144 - RNA, 64 nt, hsa
uagucacuuuagaacagauggcacuaaaaaaauuuuuuuuuaacuuuuuaccagcuguucuugg

SEQ ID NO: 510145 - RNA, 64 nt, hsa
uuauuuacuggucugggaaacaggauguguuuccuuuuuuuaaaagccaauugacagauuacac

SEQ ID NO: 510146 - RNA, 64 nt, hsa
cacuuugcugcugaaaugcugccucuugccuuuuuuuuuuuaaauuuuaaauuaucuaaauuua

SEQ ID NO: 510147 - RNA, 64 nt, hsa
ccccuuaucuuucuaaaacugccuuucugguggcuuuuuuuaaaauuauuacuaaugaugcuuu

SEQ ID NO: 510148 - RNA, 64 nt, hsa
acuucuauuuaaugcuuccagggauuuuuuuuuuuuuuuuuaacccuccugggcccaagugauc

SEQ ID NO: 510149 - RNA, 64 nt, hsa
uaacauuuucauuguuuuugguuguucuuuuuucuuuuuuuaauggcagcuaaagauauacaga

SEQ ID NO: 510150 - RNA, 64 nt, hsa
agauauacagauuacuguuaaauugcaguccuuuuuuuuuuaaagauauuuucuugaauuauuu

SEQ ID NO: 510151 - RNA, 64 nt, hsa
cauuuuacauucauuuaaccugccgauuauuuaauuuuuuuauuguaaaguaguuuuuagcauu

SEQ ID NO: 510152 - RNA, 64 nt, hsa
uuuauuguaaaguaguuuuuagcauuugcuuuuauuuuuuuacuuugaugccuuuucaaauugg

SEQ ID NO: 510153 - RNA, 64 nt, hsa
aguuuuguguuggcuugugaagcauugaugucauuuuuuuuaauuguggacuauuuagaugugu

SEQ ID NO: 510154 - RNA, 64 nt, hsa
uuagaagcccauagcccuuucccagccuuuuugguuuuuuuaauugaacacauuucaucuaagu

SEQ ID NO: 510155 - RNA, 64 nt, hsa
cugugccagaagaaaacacacacagggaaaccgcuuuuuuuaaucaauuguagagaauagucau

SEQ ID NO: 510156 - RNA, 64 nt, hsa
cugugauagaaauauguaaaaucucauauuauuuuuuuuuuaauuuuuuuauuuuuuaugacag

SEQ ID NO: 510157 - RNA, 64 nt, hsa
aaauauguaaaaucucauauuauuuuuuuuuuaauuuuuuuauuuuuuaugacagggucucacu

SEQ ID NO: 510158 - RNA, 64 nt, hsa
uuucauucuuuguuagcucacuuuauaauuuguauuuuuuuacuguauagacuaaauauauucu

SEQ ID NO: 510159 - RNA, 64 nt, hsa
uuuaaugccaucacaauuugaaaaacuuuuuuuuuuuuuuuacuauagaaguuacaaaggaagu

SEQ ID NO: 510160 - RNA, 64 nt, hsa
uuaccuuugacaaagguaaaucagacuaugaaguuuuuuuuauacaggaugaugacuauggaaa

SEQ ID NO: 510161 - RNA, 64 nt, hsa
uuuaagacgaaacauuuguucuauagcuuuucccuuuuuuuaaguaaggaauuuuauuuuuuuc

SEQ ID NO: 510162 - RNA, 64 nt, hsa
ugagcuaggaauuguguuuauaauuuuaaauguuuuuuuuuaaagacuuuuaugauacuugaaa

SEQ ID NO: 510163 - RNA, 64 nt, hsa
ggaccagagagaaggagucaccugcagucuuuuguuuuuuuaaauacuuagaacuuagcacuug

SEQ ID NO: 510164 - RNA, 64 nt, hsa
agaauacaaacaguauacucaugauugcuaaguguuuuuuuauuuuugcauauuuauugaacug

SEQ ID NO: 510165 - RNA, 53 nt, hsa
cacaaauuacaaaagucugaauuuuuuuuuaucaagagggauaaaacaccaug

SEQ ID NO: 510166 - RNA, 64 nt, hsa
aaauaaacuugaauaaacugaaaauggaccuuuuuuuuuuuaauggcaauaggacauuguguca

SEQ ID NO: 510167 - RNA, 64 nt, hsa
auuggccgcugucacugcuuguuguuugcgcauuuuuuuuuaaagcauauuggugcuagaaaag

SEQ ID NO: 510168 - RNA, 64 nt, hsa
uuuuucccuucauuuuggguucuccuguuuguuuuuuuuuuauuauuuuaaucccuuguuuauu

SEQ ID NO: 510169 - RNA, 64 nt, hsa
auuuuagcauuucaaagugacuucuaugaagcuuuuuuuuuaaugugaaauuuucagaauguug

SEQ ID NO: 510170 - RNA, 64 nt, hsa
acuggauucugaauauaauaaauucaaaguacccuuuuuuuagaguuucuaauaaaguaguaug

SEQ ID NO: 510171 - RNA, 64 nt, hsa
aaagaaacugcauuuuaagucagacaguaaauguuuuuuuuaauuuacagcaaaugaagcaguu

SEQ ID NO: 510172 - RNA, 64 nt, hsa
uuaauuuaaaaagcuagaaaauucauguaguuacuuuuuuuacauauauaaucuguuaaugaau

SEQ ID NO: 510173 - RNA, 64 nt, hsa
aacaacucuaauccuuuuggggcaggagggaggguuuuuuuaggguugcggggagggaacugca

SEQ ID NO: 510174 - RNA, 64 nt, hsa
uuaauuagucacugccuugcuaacuuugcuguaauuuuuuuaaacgucuuguuuuuaauauagc

SEQ ID NO: 510175 - RNA, 64 nt, hsa
gaaggaaaguuacaguauuaauuuuugaaaagguuuuuuuuauucugcaauuuuuuauuuuugu

SEQ ID NO: 510176 - RNA, 64 nt, hsa
auuguuaugcuauaccaaucugcaguaaaaaaaauuuuuuuagaugauucuauauaacuucguc

SEQ ID NO: 510177 - RNA, 64 nt, hsa
cugguuuaaaaauuaguaaggugugucuuuuuguuuuuuuuaagauagcacuugaauagaaggg

SEQ ID NO: 510178 - RNA, 64 nt, hsa
ggauuuuguuuugguuuuggcuuuguuuuugauuuuuuuuuauuaugaaucuccuggacgcaga

SEQ ID NO: 510179 - RNA, 64 nt, hsa
gaaugaccuuuagauugugcgacuuuuguuuuuguuuuuuuaaauuuuuuuaaaccaagaauga

SEQ ID NO: 510180 - RNA, 64 nt, hsa
uagauugugcgacuuuuguuuuuguuuuuuuaaauuuuuuuaaaccaagaaugauuucuccugc

SEQ ID NO: 510181 - RNA, 64 nt, hsa
uguaagaguuguuagcacaaguuuuuuuuuuuuuuuuuuuuaagcacuuguuuuggguacaagg

SEQ ID NO: 510182 - RNA, 64 nt, hsa
ugugaagcaguauugauucuuuauugggaguacauuuuuuuaggucucuuaaacuuuaauuuca

SEQ ID NO: 510183 - RNA, 64 nt, hsa
ugagaagcaaugggucacucauuaaugaaucacauuuuuuuaugcucuugaaauauucagaaau

SEQ ID NO: 510184 - RNA, 64 nt, hsa
ggugcugucuuuuguucucugaauuuucagagacuuuuuuuauaauguuauucauuuggugacu

SEQ ID NO: 510185 - RNA, 64 nt, hsa
ccugaaaauaauggaaaagagguuuuugaauuuuuuuuuuuaaauaaacaccuucuuaagugca

SEQ ID NO: 510186 - RNA, 64 nt, hsa
accuuuccugagauuuauuuuauccgugauguauuuuuuuuaauucuuuugauacagagaaggg

SEQ ID NO: 510187 - RNA, 64 nt, hsa
uuuuuaauucuuuugauacagagaagggucuuuuuuuuuuuaaguauuucagugaaaacuuggu

SEQ ID NO: 510188 - RNA, 64 nt, hsa
uauucuucuuuugcugcuuucugauagugaucaauuuuuuuauuuauaucucuuguauuagagu

SEQ ID NO: 510189 - RNA, 64 nt, hsa
caaugagggcugauuuucauuuagcuaaauaacuuuuuuuuaaguauuucuuuguaucaugguu

SEQ ID NO: 510190 - RNA, 64 nt, hsa
ucaucaguuuuggaaaauucuuagccauuuuuuuuuuuuuuacuauuuuuuccccuguucuccc

SEQ ID NO: 510191 - RNA, 64 nt, hsa
uccauguaacagaacaaaagauccauuuggaaauuuuuuuuacugguaucaccuuacaugguau

SEQ ID NO: 510192 - RNA, 64 nt, hsa
uguacguuucuagcuagaauguuaaacuucauccuuuuuuuacuguugaccuauuugugggagg

SEQ ID NO: 510193 - RNA, 64 nt, hsa
augagauuauauuuucuguuuuuaaaagauuuuuuuuuuuuauguauuuaguagaguauaaaga

SEQ ID NO: 510194 - RNA, 64 nt, hsa
gaaaauuccaaacauuugcugucugugguuuuuuuuuuuuuaaccaaaguguugucaggccaac

SEQ ID NO: 510195 - RNA, 64 nt, hsa
cucauuaacauauauucucaagcuguuaaaaagauuuuuuuaauuacaaauaagguuaaauuuc

SEQ ID NO: 510196 - RNA, 64 nt, hsa
ggauuacuggcgcccgccaccaugccuggcuaauuuuuuuuauuuuuaguagagacggaauuuu

SEQ ID NO: 510197 - RNA, 64 nt, hsa
ucucuuucucuuuuuuccuucuuuuucuuuuuuuuuuuuuuauuuuaauuuuuugagacggagu

SEQ ID NO: 510198 - RNA, 64 nt, hsa
gcaauggaaaaacauuuauucuuuuaaauaauaauuuuuuuaaaacccaagaggucaggggauu

SEQ ID NO: 510199 - RNA, 64 nt, hsa
aaauuucacaaugacugacucugaaugaauuauuuuuuuuuauauauccuauuuuuuauguagu

SEQ ID NO: 510200 - RNA, 64 nt, hsa
cagaauuuggucucucaggcuguuugggagcucuuuuuuuuacauuuuuucuccuuugacaccu

SEQ ID NO: 510201 - RNA, 64 nt, hsa
caauuuacuugguccagaguuuucuauucuuuuuuuuuuuuaaacuaaugaaugacauuuagau

SEQ ID NO: 510202 - RNA, 64 nt, hsa
uaaaagucuuuuucuuagaaagccaaaauguuuguuuuuuuaagauucugaaauguguugugac

SEQ ID NO: 510203 - RNA, 64 nt, hsa
auguacaaguccuuucagugaugagggaauugauuuuuuuuaaaagucuuuuucuuagaaagcc

SEQ ID NO: 510204 - RNA, 64 nt, hsa
gccuucuuaacuaaaaugcucaccacuuagccuguuuuuuuaucccuuuuuuaaaaugacagau

SEQ ID NO: 510205 - RNA, 64 nt, hsa
acguacuugaguuaaaauauuucgauuuuuuuuuuuuuuuuaauggaaaguccugcauaacaac

SEQ ID NO: 510206 - RNA, 64 nt, hsa
auacauagccuacuuuuuuuucgcaguuguuuucuuuuuuuaaauugaguuaugacaaauaaaa

SEQ ID NO: 510207 - RNA, 62 nt, hsa
uggcuauugugggccaguaggagggauuuuuuuuuuuuuaaugaaaaaaaauuucuauucau

SEQ ID NO: 510208 - RNA, 64 nt, hsa
cgaugcauuuguggcuagaaauuuuaaucuaaacuuuuuuuaaaaaaaaucauaauaguuagga

SEQ ID NO: 510209 - RNA, 64 nt, hsa
aagaugaauguugacucccaggagaccagaacuauuuuuuuaaagccugacaaacuucauaaau

SEQ ID NO: 510210 - RNA, 64 nt, hsa
accauguuuauauauauauauauauauuuuuuuuuuuuuuuagaauuuucuacccuuggcauga

SEQ ID NO: 510211 - RNA, 64 nt, hsa
ugaauggucaauuuuucacauauauaucucucuauuuuuuuaaucaaacucuggucucacugcc

SEQ ID NO: 510212 - RNA, 64 nt, hsa
ggacagugaccaagaauuauaguaccuucuuauauuuuuuuauagaacuguauauuuauuuuga

SEQ ID NO: 510213 - RNA, 64 nt, hsa
acacuugaaugaagagaaacaccugagcuauauauuuuuuuaaagcaacuaacuuauugcuuua

SEQ ID NO: 510214 - RNA, 64 nt, hsa
ugaccaggauugugaaagaguucuucuguuuguauuuuuuuaaagagaacuuuuuuaguuuauu

SEQ ID NO: 510215 - RNA, 64 nt, hsa
caccccucuuucauguauuaaaauaacacugagauuuuuuuaaaagcuggaagauuguacagca

SEQ ID NO: 510216 - RNA, 64 nt, hsa
aaacacacacaaugauugcaagacuauguaaaucuuuuuuuaaucuucuuccuauguuuuggaa

SEQ ID NO: 510217 - RNA, 64 nt, hsa
guuucaggguucagucugauccaucaaaagguucuuuuuuuauaaucccuuuugaaaaugauaa

SEQ ID NO: 510218 - RNA, 64 nt, hsa
uguaaggacuugcaaaacaaaagaaagugagggguuuuuuuaaccucagagcuagcugcucucu

SEQ ID NO: 510219 - RNA, 64 nt, hsa
cucuuuaaagagaaaagaagagaaagauuuuuuuuuuuuuuaauggcagaccgaaguggagauc

SEQ ID NO: 510220 - RNA, 64 nt, hsa
aagaugcuuuuugggaaacguuguuuaaaucuuauuuuuuuacuacaucaaaaggauggugguu

SEQ ID NO: 510221 - RNA, 64 nt, hsa
ucagggggacccaaaucacugcugguuuucaauuuuuuuuuaacaauacauuuuuguggucagu

SEQ ID NO: 510222 - RNA, 64 nt, hsa
aaaauaugcuauuguuuagacuuuccauccuuuuuuuuuuuauuuugaggaaaagucaaauuca

SEQ ID NO: 510223 - RNA, 64 nt, hsa
uucuucuauuucugaagguuugucucuuggcaucuuuuuuuaguuucuuaccauaagaguuuga

SEQ ID NO: 510224 - RNA, 64 nt, hsa
ugugaguagacaccugccaauauuguuugaaaccuuuuuuuaauaugacauccucucuugucau

SEQ ID NO: 510225 - RNA, 64 nt, hsa
agaagauggggcuacauuucccccauaccuacuauuuuuuuauaucccgauuugcacuuugaga

SEQ ID NO: 510226 - RNA, 64 nt, hsa
uucuuaaauuuaaacacgggacuucccgaacuaauuuuuuuaaggauacugaaaaaugagagag

SEQ ID NO: 510227 - RNA, 64 nt, hsa
uagccaugugaccuggaacuuuuaaaaaaaaauuuuuuuuuaagagccagagucucacuuuguc

SEQ ID NO: 510228 - RNA, 64 nt, hsa
gggaucacaggugcacaccaccacgccuggcuaauuuuuuuauuuuuauuuuuaguaaaggcgg

SEQ ID NO: 510229 - RNA, 64 nt, hsa
acucagugucagcuugagccugcauuccaagcuuuuuuuuuaauuugguguuuucucccauccu

SEQ ID NO: 510230 - RNA, 64 nt, hsa
ugaagagaucuuugugccacacaggauuuuuuuuuuuuuuuaagaaaaaccuauagaugaaaaa

SEQ ID NO: 510231 - RNA, 64 nt, hsa
cugucccugcugcuuugauuccaggugauuuuauuuuuuuuauuuuuuuauuuuuuuugagacg

SEQ ID NO: 510232 - RNA, 64 nt, hsa
gcugcuuugauuccaggugauuuuauuuuuuuuauuuuuuuauuuuuuuugagacggagucuug

SEQ ID NO: 510233 - RNA, 64 nt, hsa
gugagguuuucacucauaaauuuaaaccaguguauuuuuuuagaacugguuuguguauauauau

SEQ ID NO: 510234 - RNA, 64 nt, hsa
aaaccaaaaggauauucugaaaaauggccaacaauuuuuuuagaaguagcaucccaagcagcgu

SEQ ID NO: 510235 - RNA, 64 nt, hsa
aaaaaagcugcuguuggaucuagaaggugaagaauuuuuuuauguauauauagacauaucuaua

SEQ ID NO: 510236 - RNA, 64 nt, hsa
auuaacaaauauauuuaaguacuaaaggugauuuuuuuuuuaaagacuuuuucaaauugucaaa

SEQ ID NO: 510237 - RNA, 64 nt, hsa
cuucugagauucaucuuggugguggguuuuuuuguuuuuuuaauucagugccugaucuuuaaug

SEQ ID NO: 510238 - RNA, 64 nt, hsa
aaaaaaguucacugaacaccaagaccagaauggauuuuuuuaaaaaaauagauguuccuuuugu

SEQ ID NO: 510239 - RNA, 64 nt, hsa
uguaguuguuuugguaaaaucuucauuuccugguuuuuuuuaccaccuuauuuaaaucucgauu

SEQ ID NO: 510240 - RNA, 64 nt, hsa
uggguauaugaauuacauagcauguuguugggauuuuuuuuaaugugcagaagaucaaagcuac

SEQ ID NO: 510241 - RNA, 64 nt, hsa
ugcuuguuuaguaucaaauuuuauuucacgaaaguuuuuuuaaagaacagaaacuuuuccaauu

SEQ ID NO: 510242 - RNA, 64 nt, hsa
uucuuggcaaaugaauccauauugacauauuugauuuuuuuaaaaacauggaaacguacuguuu

SEQ ID NO: 510243 - RNA, 64 nt, hsa
ucgauuaguaaaagaaaaaaauuugaauguuuuuuuuuuuuauuuuauuaagcaugcccaguua

SEQ ID NO: 510244 - RNA, 64 nt, hsa
uuuucuuucuucuuuucuuuuucuuuuuuuuuuuuuuuuuuacuaaauuagagaacugcucuug

SEQ ID NO: 510245 - RNA, 64 nt, hsa
guguagacuucugaauaagaugauagacgagaauuuuuuuuaaaaaaggaauuuaaaggaaucu

SEQ ID NO: 510246 - RNA, 64 nt, hsa
cagauuguaagccuuuucuggcaagcuuuucuucuuuuuuuaaacucuuuuccugaaacuuuuu

SEQ ID NO: 510247 - RNA, 64 nt, hsa
gcauugaaaggacagcuuggggauggaauuuuuuuuuuuuuaucuccauuuuccaguuagguag

SEQ ID NO: 510248 - RNA, 64 nt, hsa
ggugugagccaccacaccuggcccauaguuguauuuuuuuuaggucacuuagaaaaauauguca

SEQ ID NO: 510249 - RNA, 64 nt, hsa
ggauagaaccuuuguauuuguucuuuaaaaacauuuuuuuuaauguugguaacuuuugcuuccu

SEQ ID NO: 510250 - RNA, 64 nt, hsa
ugaaagacggggaauuaaauuacuaauuuuuuuuuuuuuuuaaaugaugacaguggucccagaa

SEQ ID NO: 510251 - RNA, 64 nt, hsa
aaagcaguuuuacuaucgaaucaaucgcuguuauuuuuuuuaauguaauuuguacaucuuuuuu

SEQ ID NO: 510252 - RNA, 64 nt, hsa
guuuauaagugacaaaauuaggccaaaggugauuuuuuuuuaaaucaggaagcugguuacuggc

SEQ ID NO: 510253 - RNA, 64 nt, hsa
ucuugauacccuaaucuugcuucuggaucuguucuuuuuuuaaaaaaacuuccuucaccgcgcc

SEQ ID NO: 510254 - RNA, 64 nt, hsa
guaaauauauugucauacaauguuaaauaaccuauuuuuuuaaaaaaguucaacuuaagguaga

SEQ ID NO: 510255 - RNA, 64 nt, hsa
uggcucacaaaauagggcccccaaugcuauuuuuuuuuuuuaaguuuguuuaauuauuuguuaa

SEQ ID NO: 510256 - RNA, 64 nt, hsa
uccagugucuuggguuuuuuauacuuugacagcuuuuuuuuaauugcauacaugagacuguguu

SEQ ID NO: 510257 - RNA, 64 nt, hsa
uuuuuuuuaauugcauacaugagacuguguugacuuuuuuuaguuaugugaaacacuuugccgc

SEQ ID NO: 510258 - RNA, 64 nt, hsa
ccaucucuuaguuuucuuuuucacaagcgcuuuauuuuuuuaauagacaaaucacauuuugcaa

SEQ ID NO: 510259 - RNA, 64 nt, hsa
auuuaaggcacacacaaucccucacacuguggguuuuuuuuagaacuucccagacgaaaacuca

SEQ ID NO: 510260 - RNA, 64 nt, hsa
cugccuacuguuacucuaaauagaaauauaggguuuuuuuuaaugugaauuuuugccuaucuuu

SEQ ID NO: 510261 - RNA, 64 nt, hsa
uuuaaaauauaugucuauauacacagacaugcucuuuuuuuaagugcuuacauuuuaauagaga

SEQ ID NO: 510262 - RNA, 64 nt, hsa
uuuaaaaaauaucauuguccuccuccucuuaagauuuuuuuaaguuauuuugcucaaguacuua

SEQ ID NO: 510263 - RNA, 64 nt, hsa
uaauuacagucuuaucuuuuuuuuucuuuuuucuuuuuuuuaauaaaaucuaccaguaauuuaa

SEQ ID NO: 510264 - RNA, 64 nt, hsa
aaguucuccaauucuuuuuuuuugcuuacucuauuuuuuuuaaccugugaaauuucuuuacagu

SEQ ID NO: 510265 - RNA, 64 nt, hsa
uuuaauauuaaaauguacuuuuacauucuuaaucuuuuuuuagaaaggaaaaguuuucuucauu

SEQ ID NO: 510266 - RNA, 64 nt, hsa
uggcuaugucucuggacaaguuuuuuuuuuuuuuuuuuuuuaaacccuuucugaacuuucacuu

SEQ ID NO: 510267 - RNA, 64 nt, hsa
acaucaaugguguguuaaagcuauuuccuugccuuuuuuuuauuggaaugguaggauaucuugg

SEQ ID NO: 510268 - RNA, 64 nt, hsa
ccuuugcucucaauagcaaaagugauguuauaguuuuuuuuacuuuugucagaaucaaggcuuc

SEQ ID NO: 510269 - RNA, 64 nt, hsa
uguaguaguagaaaaugcauucuuuuuuuuuuuuuuuuuuuagacagagucuugcucuguugcu

SEQ ID NO: 510270 - RNA, 64 nt, hsa
gggcaaaaaucuuuguaucuggggaaaaaaaacuuuuuuuuaaauuaaaaaggaaaauaaaaga

SEQ ID NO: 510271 - RNA, 64 nt, hsa
cuuugugaguccuugugucaucguucgggcacuguuuuuuuaugcaagggcaaaaaucuuugua

SEQ ID NO: 510272 - RNA, 64 nt, hsa
aggcgcccaccaccaugcccggcuaauuuuuguguuuuuuuaguagagacgggguuucaccaug

SEQ ID NO: 510273 - RNA, 64 nt, hsa
aggucugggaaggaauagaaaggggcccccaauuuuuuuuuaagcggccagauaauaaauaaug

SEQ ID NO: 510274 - RNA, 64 nt, hsa
ucaaagcauugaaguguguucauaguccagguuuuuuuuuuaauaaacacaauuuugcugccaa

SEQ ID NO: 510275 - RNA, 64 nt, hsa
uuuucuuuggugauauuuauuucuuugccuuuuuuuuuuuuaacaacuuucaaucuucagaugu

SEQ ID NO: 510276 - RNA, 64 nt, hsa
gaugacuuuuuaaggguccuucuuuccagcacauuuuuuuuaaaaacucagguuagaacaaaaa

SEQ ID NO: 510277 - RNA, 64 nt, hsa
gagaaaucuucauaauaucuucuauucaaaaucuuuuuuuuauuuuuaagggaauaaaaauuuu

SEQ ID NO: 510278 - RNA, 64 nt, hsa
cuagugaagacagaaccagagggaauaaggaucuuuuuuuuaaagacagcauggaaaguuuaag

SEQ ID NO: 510279 - RNA, 64 nt, hsa
cuuacuugggccugaaacuggagaaggggugacauuuuuuuaauuucagagaugcuuucugauu

SEQ ID NO: 510280 - RNA, 64 nt, hsa
acuugcauucucagaaugauagugccuuuaaaaauuuuuuuauuuuuuaaagcauaagaauguu

SEQ ID NO: 510281 - RNA, 64 nt, hsa
ugguaauauaauaauguccuuucccuggagucaguuuuuuuaaaaaguuaacucuuaguuuuua

SEQ ID NO: 510282 - RNA, 64 nt, hsa
aaccccuucgauagcaagucccaucagccuauuauuuuuuuaaagaaaacuugcacuuguuuuu

SEQ ID NO: 510283 - RNA, 64 nt, hsa
aaaggagugagaugaaucaaaaccagugaacuuuuuuuuuuaauguuuuuaauucccuuuuaac

SEQ ID NO: 510284 - RNA, 64 nt, hsa
aacuaugaagacuuaaaagagcucagacauuuucuuuuuuuaacuggugaagagaaaaaggcug

SEQ ID NO: 510285 - RNA, 64 nt, hsa
guagcuuagagauguagcgauguaagugucgauguuuuuuuaaaaaaaaaugcaaaaaaauucu

SEQ ID NO: 510286 - RNA, 64 nt, hsa
cucaguuauugaacuuuuuuuuuuaagaauacuuuuuuuuuaagcugagaaguauagggaugaa

SEQ ID NO: 510287 - RNA, 64 nt, hsa
auuaucaggaauacugccucaguuauugaacuuuuuuuuuuaagaauacuuuuuuuuuaagcug

SEQ ID NO: 510288 - RNA, 64 nt, hsa
agcagccuguagugggcgcugccagaugcgggcuuuuuuuuauuuguuucaauguuccuaaugg

SEQ ID NO: 510289 - RNA, 64 nt, hsa
ugacagcauguugcaguuucuuuucgguuuugguuuuuuuuaaauguuuuauuuugcuuuccca

SEQ ID NO: 510290 - RNA, 64 nt, hsa
uugaauucaggucaguuucaguauuuuucaaauauuuuuuuaaaacugaauugcaauugugcca

SEQ ID NO: 510291 - RNA, 64 nt, hsa
aggguguggcauuuuguucccuuuuccguuuuuuuuuuuuuauuguuguuguuaauuuuauugc

SEQ ID NO: 510292 - RNA, 64 nt, hsa
gguugaagacggaaaacaaucuaagggucucucauuuuuuuaauuuuguuuuguucaguuuggu

SEQ ID NO: 510293 - RNA, 64 nt, hsa
cacauuagagucaaccccuucuuuuuuuuuuuuuuuuuuuuaaauccaguauuuaggauaauau

SEQ ID NO: 510294 - RNA, 64 nt, hsa
gaguuguuuuuucuuaauguaagaaaaauuguauuuuuuuuacaaguaucuucaaacugaaucu

SEQ ID NO: 510295 - RNA, 64 nt, hsa
cuuucuugcuugguaagcaagaagccauaucgauuuuuuuuaacuuacagaaauggaaauaugu

SEQ ID NO: 510296 - RNA, 64 nt, hsa
ccaugucaugauguaauuuuucuuucuucuuucuuuuuuuuaaauuuuagcaguggcuuauuau

SEQ ID NO: 510297 - RNA, 64 nt, hsa
uacuauuuguuuuaccacugauugcacuguuuuguuuuuuuaacaguugcaaagcuuuuuaaug

SEQ ID NO: 510298 - RNA, 64 nt, hsa
cuauaggaauugguuggcagugccagcuggcucuuuuuuuuaauauuuuauuauuuuuguuaac

SEQ ID NO: 510299 - RNA, 64 nt, hsa
uguaaaguugauuuucuugugacaagagaacuucuuuuuuuaacaagaggacauggcauuauuu

SEQ ID NO: 510300 - RNA, 64 nt, hsa
cugcuuguagaauuaguguauuuuuauuaaacuauuuuuuuaaaugucaaacuucuaucaugua

SEQ ID NO: 510301 - RNA, 64 nt, hsa
guuuaugagauuuucucaccccacaucgcuccccuuuuuuuaaaaaggacuguuuugcuagugu

SEQ ID NO: 510302 - RNA, 64 nt, hsa
ucauauggaagaacuugagggacauuaguauacuuuuuuuuaagauggagucuugcucugucac

SEQ ID NO: 510303 - RNA, 64 nt, hsa
auuauaggcaugagccaccacgcccagccuguuauuuuuuuauuauuauuguuuuuuuuuagug

SEQ ID NO: 510304 - RNA, 64 nt, hsa
acgcccagccuguuauuuuuuuauuauuauuguuuuuuuuuagugacagagucucauucuguug

SEQ ID NO: 510305 - RNA, 64 nt, hsa
uauaaccuaacugauaauagguaauaagguuaaauuuuuuuaugacguauuuuauuuacaaaua

SEQ ID NO: 510306 - RNA, 64 nt, hsa
uugaauugguagaugaaaaaaaccugguucaaguuuuuuuuaaaauguggugucccauuccaag

SEQ ID NO: 510307 - RNA, 64 nt, hsa
gagaaccaaagagaauuuaacccugccauuuuuuuuuuuuuaacaccaagauccuaaguaauuc

SEQ ID NO: 510308 - RNA, 64 nt, hsa
uuaggugcagugguggucuucaaauuacauuaguuuuuuuuauauauauuuuaaacauauguaa

SEQ ID NO: 510309 - RNA, 64 nt, hsa
uucauaugauuguuaggagacuaccuuuuuagauuuuuuuuauuauauaucaaauuauaguugu

SEQ ID NO: 510310 - RNA, 64 nt, hsa
auaugccaggaauaguggaauuuuauuuuuuaaauuuuuuuauaggcccauaugcucuaucuca

SEQ ID NO: 510311 - RNA, 64 nt, hsa
auuccgcaaauuuaaaagcuaauugaggacaauuuuuuuuuaauuuccuaaaugagaccaccuu

SEQ ID NO: 510312 - RNA, 64 nt, hsa
gcaaaugauugaugcaguuaaagcucaauaugccuuuuuuuacuggauacuguacauuuggcua

SEQ ID NO: 510313 - RNA, 64 nt, hsa
cucgucucauuacuuuauagucaugucauguauguuuuuuuaaccaugaaaugacaauaaaaug

SEQ ID NO: 510314 - RNA, 64 nt, hsa
uuugaagaagcauuucuguaaaauuagaaauuacuuuuuuuaaucuauuuaaaguuuggcuuga

SEQ ID NO: 510315 - RNA, 64 nt, hsa
ucuuaaguguuaaauaauguagaaguaaaaaaauuuuuuuuaaaggcuuaauuugggagggggg

SEQ ID NO: 510316 - RNA, 64 nt, hsa
aaacuuaauuacugcacuuaaaaugaaacauuacuuuuuuuaaacaaugugucacaaauguagg

SEQ ID NO: 510317 - RNA, 64 nt, hsa
acagaacacuguugaaauauccauaucaacuugauuuuuuuaaccuaauucagguguccuuugc

SEQ ID NO: 510318 - RNA, 64 nt, hsa
cacaucuguaauuuaaauguuucuaguaaccacauuuuuuuaaaaguaaaaagaaacccauggu

SEQ ID NO: 510319 - RNA, 64 nt, hsa
uucaaacuacaguacuguguaauuauguauaaaguuuuuuuauuuauuugaaguuagacuagau

SEQ ID NO: 510320 - RNA, 64 nt, hsa
aauggcagagaagaugaaauuugauaaacugaauuuuuuuuaaaaauccauuuacccuacaggu

SEQ ID NO: 510321 - RNA, 64 nt, hsa
ccuacagguuugcauuuguuugcugaaauuuaccuuuuuuuaguuauauauaugugugugugug

SEQ ID NO: 510322 - RNA, 64 nt, hsa
aagccauaacuuuuaacuggagugguuugauuucuuuuuuuaauuuuauugggaggguuuggau

SEQ ID NO: 510323 - RNA, 64 nt, hsa
uuuuuaauuuuauugggaggguuuggauuuuaacuuuuuuuaauguuguuaaauauuaaguuuu

SEQ ID NO: 510324 - RNA, 64 nt, hsa
uaaaacucaccaucuccugaagaccuuucuuaccuuuuuuuaaaaacaaaaaaugaaauuauuu

SEQ ID NO: 510325 - RNA, 64 nt, hsa
guuuugggggccagccuagagggaauuccuuuuuuuuuuuuaaccccccagggggguaguuggg

SEQ ID NO: 510326 - RNA, 64 nt, hsa
gagguggccagaccaauguguuguuuuguuguuguuuuuuuaagcuucccuugagagaauaaau

SEQ ID NO: 510327 - RNA, 64 nt, hsa
gaagaccauucugugaccaaaauaccuuggucauuuuuuuuauauugccuuauuucccuauggc

SEQ ID NO: 510328 - RNA, 64 nt, hsa
uuguauauccuauauaggaaacuaagcauuguauuuuuuuuaacaaaucuaaaaaagcacuaug

SEQ ID NO: 510329 - RNA, 64 nt, hsa
uaugacuuuaucuaggaguuuguuuuucauuuuguuuuuuuaaaguauuagaaaagguuuuagc

SEQ ID NO: 510330 - RNA, 64 nt, hsa
ugucacucuuaagaugucaaagggaauuagccauuuuuuuuauuguaauaaaggcaggugcuau

SEQ ID NO: 510331 - RNA, 64 nt, hsa
cuucgcuucuuugauacuuguagcuuauuguaauuuuuuuuaagaaauucaaggucauuauuau

SEQ ID NO: 510332 - RNA, 64 nt, hsa
caaaauaagcgcuuugauuaacacagcuauauaguuuuuuuaauuuuuaaaaaaccuguggaga

SEQ ID NO: 510333 - RNA, 64 nt, hsa
ccagauuuucaguguuaacgugugggaggaauuuuuuuuuuaguuuuuauuuuuugguuuuggg

SEQ ID NO: 510334 - RNA, 64 nt, hsa
uuucuaauguugaaauuauaucaggcuuuaccgguuuuuuuaguuguuuaaauaaguaauauuu

SEQ ID NO: 510335 - RNA, 64 nt, hsa
ggcuaguuaauucaacucccaauuguucugaaaguuuuuuuaccuucucuucuaagagaauauu

SEQ ID NO: 510336 - RNA, 64 nt, hsa
guuuacagucuuaaaagagguaaaacagcaaauauuuuuuuaagggaacuauaaccuuaggauu

SEQ ID NO: 510337 - RNA, 64 nt, hsa
aacaauuugcauguuuuucagaugcuuucaaaucuuuuuuuaaaaaaauaguguaaaauauuuu

SEQ ID NO: 510338 - RNA, 64 nt, hsa
acaggcaugagccaccaugcccagccaaagaucauuuuuuuauauagacuucagcccuuuguaa

SEQ ID NO: 510339 - RNA, 64 nt, hsa
gguuuuuaaggcagcacagacugccaaguacuguuuuuuuuaaccgacugaaaucacuuuggga

SEQ ID NO: 510340 - RNA, 64 nt, hsa
augcagauauauauauauauauuuuucccaguccuuuuuuuaagagacggucuuuauugggucu

SEQ ID NO: 510341 - RNA, 64 nt, hsa
aggauccuuggauaccacaucgugaaaucuuuuauuuuuuuacucugagaccagcaccagaugu

SEQ ID NO: 510342 - RNA, 64 nt, hsa
uuacaggcaugagccaccaucuucagccagaugauuuuuuuauugagagagugaaaugcuauuu

SEQ ID NO: 510343 - RNA, 64 nt, hsa
guaaauuugcagccauuucaagcaggugauggucuuuuuuuauaacaucguuaacggguaccau

SEQ ID NO: 510344 - RNA, 64 nt, hsa
ugaauguaaaauauaaaagguauagguuuuuuuuuuuuuuuaaagaaaacaauaaacuuucaaa

SEQ ID NO: 510345 - RNA, 64 nt, hsa
gaaaggacucugaacucagaggagucacuguuccuuuuuuuagguuagaaauuaacagcaggga

SEQ ID NO: 510346 - RNA, 64 nt, hsa
uuuccaaagugagagacgaaucuuucuuucuuuuuuuuuuuaaagggcaggauggguaugcuuu

SEQ ID NO: 510347 - RNA, 64 nt, hsa
uuggcauuuucacuguucuguacaaggcugcuuguuuuuuuauugccaaagucaaauaaacggg

SEQ ID NO: 510348 - RNA, 64 nt, hsa
auuaaaauuguccuuguguauaacgugugaaucauuuuuuuaaacugaaauuuaaaaugcaaca

SEQ ID NO: 510349 - RNA, 64 nt, hsa
augacauacaacaaaugguuaucccacuuguauauuuuuuuaaagacucuuauccuguuacccu

SEQ ID NO: 510350 - RNA, 64 nt, hsa
auugcacuuauccuugagaacagucuaaugauacuuuuuuuacuuucagacuguuucuagcuaa

SEQ ID NO: 510351 - RNA, 64 nt, hsa
ugcagccgcuuuucuuuuugaaaugacuuugggauuuuuuuaagcuuuuauuuacuuuuuuuuu

SEQ ID NO: 510352 - RNA, 64 nt, hsa
ugacuuugggauuuuuuuaagcuuuuauuuacuuuuuuuuuaacuguuaucuuucuggaugaaa

SEQ ID NO: 510353 - RNA, 64 nt, hsa
cauagguauauauaugccaugauggaaauauuuauuuuuuuaagcguaauuuugccaaauaaua

SEQ ID NO: 510354 - RNA, 64 nt, hsa
uuauuuuauccucugguuuaauuacauaauuuuuuuuuuuuaacuuuaaguuucaggauacaug

SEQ ID NO: 510355 - RNA, 64 nt, hsa
ccugaaauaccagcagcuggugagauuugacuuuuuuuuuuaauggaaacuguaggugcuguuc

SEQ ID NO: 510356 - RNA, 64 nt, hsa
ccaagcacugaagucuuacccgucaacuuuuuuuuuuuuuuaaauaaacuuuauggcuguuugu

SEQ ID NO: 510357 - RNA, 64 nt, hsa
ucuucaaacaguauauaacuuuuuuuaggggauuuuuuuuuagacagcaaaaacuaucugaaga

SEQ ID NO: 510358 - RNA, 64 nt, hsa
cuucuaaacauuuuuucuucaaacaguauauaacuuuuuuuaggggauuuuuuuuuagacagca

SEQ ID NO: 510359 - RNA, 64 nt, hsa
auuacagccuuaaagacaaaaauccuuguugaaguuuuuuuaaaaaaagcuaaauuacauagac

SEQ ID NO: 510360 - RNA, 64 nt, hsa
uuuaggccucuugaauuuuugauguagaugggcauuuuuuuaagguagugguuaauuaccuuua

SEQ ID NO: 510361 - RNA, 64 nt, hsa
ucauuguuuuaaaggaauaaacuugauuauauuguuuuuuuauuuggcauaacugugauucuuu

SEQ ID NO: 510362 - RNA, 64 nt, hsa
uguuaaaagaagucaucucaaacucuuaguuuuuuuuuuuuacaacuauguaauuuauauucca

SEQ ID NO: 510363 - RNA, 64 nt, hsa
auuuuggggugguggugugccaagacauuaauuuuuuuuuuaaacaaugaagugaaaaaguuuu

SEQ ID NO: 510364 - RNA, 64 nt, hsa
uguuggacuaggguccaaagcauuuuauaauauuuuuuuuuaaucuaggaaaaagacccaaaca

SEQ ID NO: 510365 - RNA, 64 nt, hsa
uuaucagaaaaaaauuuuuggagugcauugcaauuuuuuuuaaagcauaaaacauauuucuaga

SEQ ID NO: 510366 - RNA, 64 nt, hsa
aguauauauuucaagcuuauuucaaaauuggugguuuuuuuaaaaaaagaggcaagaaaauaaa

SEQ ID NO: 510367 - RNA, 64 nt, hsa
uuuuacuauguuguaauucuuugcauaugaaauguuuuuuuaaacaguucauacuuaccuaaaa

SEQ ID NO: 510368 - RNA, 64 nt, hsa
uuuaccacaaguuacaauuugaaaagaaaacuauuuuuuuuaaauauuccauuguuaacugaau

SEQ ID NO: 510369 - RNA, 64 nt, hsa
uauguauguauaaaauuucacagggauaugcuuuuuuuuuuaaagacugaauguguucaccauu

SEQ ID NO: 510370 - RNA, 64 nt, hsa
uuguuggcaauuuaauuuauuuacuuccuuuuuuuuuuuuuaagaaaggaaaaaagaaaaaaaa

SEQ ID NO: 510371 - RNA, 64 nt, hsa
uuucacaaacuccaccuacugccccccccccucuuuuuuuuaagaauggccugaucauggcuau

SEQ ID NO: 510372 - RNA, 64 nt, hsa
gcauuuguugugacuggcacccaauguuugauuuuuuuuuuaaaacuauccaauuaaaauuaag

SEQ ID NO: 510373 - RNA, 64 nt, hsa
aagaccuguugguuagcuggacaugcuuuggcaauuuuuuuauacuaccaagugaccauaaagg

SEQ ID NO: 510374 - RNA, 64 nt, hsa
agcaccauggcaugcgccaccaugcccuauuuuuuuuuuuuaaagacagggucuugcuauauug

SEQ ID NO: 510375 - RNA, 64 nt, hsa
aggcuggggaugguaggauugcuggggauuuuuuuuuuuuuaaacagggucucacucuguugcc

SEQ ID NO: 510376 - RNA, 64 nt, hsa
uccccuucccuccccuucccauccuucuuucucuuuuuuuuacuuaauccccagugugacagua

SEQ ID NO: 510377 - RNA, 64 nt, hsa
auuauguuaccuccuaacagcacuacaaaguaccuuuuuuuaucagaaaaaaauuuuaccauua

SEQ ID NO: 510378 - RNA, 64 nt, hsa
uuuccuuugcuuugauuagacacuaugugcuuuuuuuuuuuaaccauaguucaucgaaaugcag

SEQ ID NO: 510379 - RNA, 64 nt, hsa
auguuuuuguauuuucuugguagacuagguaauuuuuuuuuaaaggacaggaaacugauauuuu

SEQ ID NO: 510380 - RNA, 64 nt, hsa
gucuuagaauccugaaagcauagauuuugaaauguuuuuuuaaugaaaaugaaggucagagaga

SEQ ID NO: 510381 - RNA, 64 nt, hsa
guaucuacgaagaguaucaaguucugaaguuuaauuuuuuuauuauccuccucucuucuuagua

SEQ ID NO: 510382 - RNA, 64 nt, hsa
auggcaaauugcuuuuuuaaaaguuuacauaaguuuuuuuuaaccccuagaauuuaauauuugu

SEQ ID NO: 510383 - RNA, 64 nt, hsa
ucagaccauuuuauacauuucaguggccuuuuuuuuuuuuuaaggaaaaaaaagcgcaaaacca

SEQ ID NO: 510384 - RNA, 64 nt, hsa
uuuuaauuccuauuuucugcuucauuggucacuuuuuuuuuauuguaguauaagauguuagauu

SEQ ID NO: 510385 - RNA, 64 nt, hsa
auuguuucauguuaaugcagcugcugagaagauuuuuuuuuaaugacugagaaaacuuguuuac

SEQ ID NO: 510386 - RNA, 64 nt, hsa
uguuuuuguuguuguugguuuguuuuuuguuuuuuuuuuuuaaucaagaccauuguuucauguu

SEQ ID NO: 510387 - RNA, 64 nt, hsa
ccacuucucuugcccaggcugcuuuuuaaaaauauuuuuuuauuuuuuacuuauuuuuaaauuu

SEQ ID NO: 510388 - RNA, 64 nt, hsa
uauuuccaaacuaaauuacucgggaaguaaacgcuuuuuuuaaaaguauuuuuacugguuuuau

SEQ ID NO: 510389 - RNA, 64 nt, hsa
auaugcccuuuuauuaaauaaauucauggcaauguuuuuuuaaaagacauuucagcuucuuuac

SEQ ID NO: 510390 - RNA, 64 nt, hsa
caacagaagacacacuuguacgaauguagauuuauuuuuuuaaaaaaaaaaaagcaaagcuuuc

SEQ ID NO: 510391 - RNA, 64 nt, hsa
ggagccauaaaaauaguuuuccagaauggauuuuuuuuuuuagauaaaaagauuaucuaccuuu

SEQ ID NO: 510392 - RNA, 64 nt, hsa
guguuuuccccucuagaaaacagaguugcuguuguuuuuuuaaaucuggcaaugcugaaaaagc

SEQ ID NO: 510393 - RNA, 64 nt, hsa
caucaaacucaaugcuuuauuuguaaauuuaguguuuuuuuauuucuacugucaaaugaugugc

SEQ ID NO: 510394 - RNA, 64 nt, hsa
uaaaaucugagggaaauguuuuguaaacauuuauuuuuuuuaaagaaaagaugaaaggcaggcc

SEQ ID NO: 510395 - RNA, 64 nt, hsa
agauacuguuuaaaaguucuuuuuuaaacucaauuuuuuuuagaaacauaagagaaauauuuag

SEQ ID NO: 510396 - RNA, 64 nt, hsa
aguuaaagggcuaaauuauauaagcaaacacuacuuuuuuuaaaacgucuggacucaaaaaaug

SEQ ID NO: 510397 - RNA, 64 nt, hsa
aagaaaaaaagaaaaaaaagaaagcauagacauauuuuuuuaaaguauaaaaacaacaauucua

SEQ ID NO: 510398 - RNA, 64 nt, hsa
acaaacuuuacucuuauucuuagcuguauauacauuuuuuuaaaaguuuguuaaaauaugcuug

SEQ ID NO: 510399 - RNA, 64 nt, hsa
gugguauaagguuuaaaaagauaaagauucagauuuuuuuuacccuggguugcuguaagggugc

SEQ ID NO: 510400 - RNA, 64 nt, hsa
uggauuauuuuccuguuuugucuuuuuuuuuuuuuuuuuuuaagccaugacaucccagaagagg

SEQ ID NO: 510401 - RNA, 64 nt, hsa
cuaauucugauugugucgugcccaaguacccuuuuuuuuuuaaugaauagggaccaaugccaca

SEQ ID NO: 510402 - RNA, 64 nt, hsa
cuggauuugcuacagagugagaaguuauuuuauuuuuuuuuauuuuuaauuuuggaaauucugc

SEQ ID NO: 510403 - RNA, 64 nt, hsa
cuuuuuucccggaauucaucagaacuuugaauuuuuuuuuuaaaugggcuguuuuuaaugcagg

SEQ ID NO: 510404 - RNA, 64 nt, hsa
uaauuuguuuugucauaugguuuuugugacuuuauuuuuuuaauucacaaggaccagguacagu

SEQ ID NO: 510405 - RNA, 64 nt, hsa
aauuccguuuucugauuugcuuugggauuuuuuuuuuuuuuaagauguuacaugguguuucgaa

SEQ ID NO: 510406 - RNA, 64 nt, hsa
gagaugcgcggcuguucguguuuuggguuuuuuuuuuuuuuaauguuuccuaauaaaagagaag

SEQ ID NO: 510407 - RNA, 64 nt, hsa
ccuccuuuacccuuucccuuuuuuuuuuuuuuuuuuuuuuuaaagaaaccuuuuuuaaacuauu

SEQ ID NO: 510408 - RNA, 64 nt, hsa
ggauuuagugucuuaggaaauuuuuuuaauuuuuuuuuuuuaaagaagaaaaaaaacuacauaa

SEQ ID NO: 510409 - RNA, 64 nt, hsa
acauuccagauugaggauuuagugucuuaggaaauuuuuuuaauuuuuuuuuuuuaaagaagaa

SEQ ID NO: 510410 - RNA, 64 nt, hsa
uggauuuuuaaauugcuuuuuuuuauuguugagguuuuuuuaucuccaagggacucucccggca

SEQ ID NO: 510411 - RNA, 64 nt, hsa
ccgcccccggcugcaguuggauuuuuaaauugcuuuuuuuuauuguugagguuuuuuuaucucc

SEQ ID NO: 510412 - RNA, 64 nt, hsa
ugauauuguuucaccgcuuugguuuuuccuuuuguuuuuuuaaaggauguguuucugaauaagu

SEQ ID NO: 510413 - RNA, 64 nt, hsa
gggucuagaacuccccuuugguaaugcuucuuuguuuuuuuauggcccuucuguucucaggaug

SEQ ID NO: 510414 - RNA, 64 nt, hsa
gacuguguauucuccaagcugugauacagcaguuuuuuuuuauugucacagggaaauaaauggu

SEQ ID NO: 510415 - RNA, 64 nt, hsa
auuuggaccuuauguuuuacucuuguuuuuuuuuuuuuuuuaaauguuacuuaaugacucucuc

SEQ ID NO: 510416 - RNA, 64 nt, hsa
augguuuuuuaucuuauuguaauagaugagcauauuuuuuuaccagacauaaaugggguaauaa

SEQ ID NO: 510417 - RNA, 64 nt, hsa
aacacaauuuaauuuuugucugccacauuagacauuuuuuuaccuuauaaaaugaucaauaaag

SEQ ID NO: 510418 - RNA, 64 nt, hsa
agccaacuguuaacuggaagcuuuugauaauuuuuuuuuuuagaacaauuuggaacauuaaaau

SEQ ID NO: 510419 - RNA, 64 nt, hsa
gaacaguuaacuauauuaaauuuuuaucauuuacuuuuuuuaagauucagaccucaguuauaua

SEQ ID NO: 510420 - RNA, 64 nt, hsa
uucagaacuugagauguggcagcacuggacuggguuuuuuuaaauguuaggacuaggaauguuu

SEQ ID NO: 510421 - RNA, 64 nt, hsa
uagucacucuugucacuuuauuuauuuauugguuuuuuuuuaaccaucuguguacauuccuuuc

SEQ ID NO: 510422 - RNA, 64 nt, hsa
uguuugcucuuguuuuuauuaauuuauauguauauuuuuuuaauuuaacaugaacacccuuaga

SEQ ID NO: 510423 - RNA, 64 nt, hsa
ucuuuugaacuggcaauugucuauuuaucuuuuauuuuuuuaagucaguauggucuaacacugg

SEQ ID NO: 510424 - RNA, 64 nt, hsa
ugccgcucuguuuaaagcaauguguaaagaugaguuuuuuuaagcauggaauuuaggguugggg

SEQ ID NO: 510425 - RNA, 64 nt, hsa
aaaauggugugcuuuuggggagauacacuagcaauuuuuuuaaaaacuggaacagugugauagg

SEQ ID NO: 510426 - RNA, 64 nt, hsa
cacuuuuucuuuagcucuugugauaagauuuucuuuuuuuuacuuuuauacaaaggcagcaucu

SEQ ID NO: 510427 - RNA, 64 nt, hsa
gccaaucaaacauuaaggacuauggaggucuuuuuuuuuuuauuuaacaugucauuguucaucu

SEQ ID NO: 510428 - RNA, 64 nt, hsa
cauuucauguuuuuaauauaagaaugaucuaauauuuuuuuaaaguaauagcuaucaguaauag

SEQ ID NO: 510429 - RNA, 64 nt, hsa
uguacugaugccaaucagcuagagcaauguaggcuuuuuuuaauuuaaauuauuacuacacuuu

SEQ ID NO: 510430 - RNA, 64 nt, hsa
uaugcaauuaagggcuuacagaacauguugaaacuuuuuuuacuuuuauugggaauaaggaaug

SEQ ID NO: 510431 - RNA, 64 nt, hsa
acaaccuuuucuuucaauauggcauguaguggaguuuuuuuaacuuuaaaaacaucaaaaauug

SEQ ID NO: 510432 - RNA, 64 nt, hsa
ugcacugagugcacuuuacaucuuuauuuaaauuuuuuuuuaacaucuuauguuuacaggcuuc

SEQ ID NO: 510433 - RNA, 64 nt, hsa
aacauaaggggaauuaagucuuuguagucugucauuuuuuuaaguggauccucuuggaugcguu

SEQ ID NO: 510434 - RNA, 64 nt, hsa
auguuuacuauaaaccuuuugcccccauaauuucuuuuuuuaaaggaaauuaauauuaguaaaa

SEQ ID NO: 510435 - RNA, 64 nt, hsa
cuuuuuggacauuuaaccaagauacuaagaagguuuuuuuuaaaaaaagagauuugauuauuuu

SEQ ID NO: 510436 - RNA, 64 nt, hsa
cccugaggauaaaaccuccauccccuaaaaugauuuuuuuuaaauaccacugucuuuagcuguc

SEQ ID NO: 510437 - RNA, 64 nt, hsa
agaguccucaaaggguuaaggccaauuugcaauuuuuuuuuaaacuuagaagcaaugaauguuu

SEQ ID NO: 510438 - RNA, 64 nt, hsa
cugacucauuaggagauaggcaucuucuaaagauuuuuuuuauauuguguaaugauugauauau

SEQ ID NO: 510439 - RNA, 64 nt, hsa
aaguauuguccccucuuuuugcacuaauuguggauuuuuuuagaugcuucucaaaauuuucagu

SEQ ID NO: 510440 - RNA, 64 nt, hsa
ccagagauaauaucaauucauauuguaguguagauuuuuuuaaaguucacauacacuuuuuugu

SEQ ID NO: 510441 - RNA, 64 nt, hsa
uucucaaaggccuauuccuauuagaagaaauaauuuuuuuuaauaauugaaaaaauuuaccaca

SEQ ID NO: 510442 - RNA, 64 nt, hsa
uuuguaaauaaauuuguuuguacauuguaugcuuuuuuuuuaguuuaaauauacugucagugua

SEQ ID NO: 510443 - RNA, 64 nt, hsa
uuuaggaccuaaaaugucuagauuagcuuucugcuuuuuuuauuugaauaacucauucaguugu

SEQ ID NO: 510444 - RNA, 64 nt, hsa
ucagauaaaaugaguagauguauauuuagauuaauuuuuuuagucagaacuucaugaaauccac

SEQ ID NO: 510445 - RNA, 64 nt, hsa
gagaaguaugucaaaagacugcagacuauagauuuuuuuuuaauauaggauuauaaaucagcua

SEQ ID NO: 510446 - RNA, 64 nt, hsa
uguuuuauuuuauuuuauuuuuuucagggggucuuuuuuuuaauacauauccaauaaugccuuc

SEQ ID NO: 510447 - RNA, 64 nt, hsa
cuuuccauugagcaccucugaacaaugugauucuuuuuuuuaagucuuucacacuucaggaaaa

SEQ ID NO: 510448 - RNA, 64 nt, hsa
aaaagauauuucaaggauuaucaagguauggaauuuuuuuuauuuuuuaucuuuuaacaaacuu

SEQ ID NO: 510449 - RNA, 64 nt, hsa
auuugagccauuacugaauucacauauguauguuuuuuuuuacuauuuaaaauacccaacaugu

SEQ ID NO: 510450 - RNA, 64 nt, hsa
aaguguauuuuuuucaacuaauuuuuuagugaauuuuuuuuaaacuuacagcauguuuugguuu

SEQ ID NO: 510451 - RNA, 64 nt, hsa
gucccaacuaagaaaauauauagagcauuuuauuuuuuuuuaguguuguaaaauauuaaccucu

SEQ ID NO: 510452 - RNA, 64 nt, hsa
auauucauuaguuaagaugguaacgucauugcuauuuuuuuaacauccucuuuagagguaauuu

SEQ ID NO: 510453 - RNA, 64 nt, hsa
caaggguaggugggcgugggugguaggagguuuuuuuuuuuacccagggcucuggaaggacacc

SEQ ID NO: 510454 - RNA, 64 nt, hsa
ugggaacagggaggugggagguggauuuuguuuauuuuuuuagcucauuuccaggggugggaau

SEQ ID NO: 510455 - RNA, 64 nt, hsa
uuauuuuuuuagcucauuuccaggggugggaauuuuuuuuuaauaugugucaugaauaaaguug

SEQ ID NO: 510456 - RNA, 64 nt, hsa
ccaucaaaccuauuaaguauucuuauuguuuaucuuuuuuuaauugccauuugauuuuuauugu

SEQ ID NO: 510457 - RNA, 64 nt, hsa
uuucauauaccauagcagauuauccauuucaauuuuuuuuuacuccacaggaaaauguaagcua

SEQ ID NO: 510458 - RNA, 64 nt, hsa
caaaugcagugugugaaaaguaugaaauuauuauuuuuuuuaaugagggauguaaacaguauaa

SEQ ID NO: 510459 - RNA, 64 nt, hsa
auaagggcugguuauuuaccuccuuuuuuuuuuuuuuuuuuaaagaaaaaaggacuuuuaaccu

SEQ ID NO: 510460 - RNA, 64 nt, hsa
uucuauagucaugaaccccuucagugcauuuucauuuuuuuauuaacagcaacuaaaauuuuau

SEQ ID NO: 510461 - RNA, 64 nt, hsa
ugucccuacauuugugcuugguggcccuauuuuuuuuuuuuagagaggccuugagacauacagg

SEQ ID NO: 510462 - RNA, 64 nt, hsa
cuaguaaaaauaaauggagugguauccuaucuucuuuuuuuaaggaaucaaugaauaauaaaug

SEQ ID NO: 510463 - RNA, 64 nt, hsa
ggaauuguuuaagggaaaagaaaagaguaauaauuuuuuuuaaaacauuaaggaauuggaauuc

SEQ ID NO: 510464 - RNA, 64 nt, hsa
ggggagagaauauucauaacuugugggcuuuuuuuuuuuuuaacuucaguggaauuuacuuuag

SEQ ID NO: 510465 - RNA, 64 nt, hsa
ucucuuaauuugaccauugcagauuugggugacuuuuuuuuaaccuuuguacauauacguaauu

SEQ ID NO: 510466 - RNA, 64 nt, hsa
caauucagaaaaguaauuucuccaaggucacuucuuuuuuuaugucuugccaucacuuuaaagg

SEQ ID NO: 510467 - RNA, 64 nt, hsa
cacaaaacuuaauuucuaauuuuccaugaauacuuuuuuuuagaaagcucauuagcagcccucu

SEQ ID NO: 510468 - RNA, 64 nt, hsa
uuggaaaaaaacacuauauaaaugcaauccaugcuuuuuuuaaagaacaacauugccagaguau

SEQ ID NO: 510469 - RNA, 64 nt, hsa
auuuuuggaugguuauugauaucuuuguaguagcuuuuuuuaaaagacuaccaaaauguauggu

SEQ ID NO: 510470 - RNA, 64 nt, hsa
aaaauguaugguuguccuuuuuuuuuguuuuuuuuuuuuuuaauuauuucucuuagcagaucag

SEQ ID NO: 510471 - RNA, 64 nt, hsa
ggcacaaaauaacuggugucuuguaaauguucuguuuuuuuaaauaaaacuucucuacuuuagu

SEQ ID NO: 510472 - RNA, 64 nt, hsa
cuuuaucuaacaucuucucuuucaguagucuuguuuuuuuuauaucaugugauuguuugugugu

SEQ ID NO: 510473 - RNA, 64 nt, hsa
gcaauuaaacuguaaauaacuugcccugggggccuuuuuuuaaaaaacaaaaaccacaaaaauu

SEQ ID NO: 510474 - RNA, 64 nt, hsa
uaaggacacaucaaagcuggccaaaauaaugaauuuuuuuuaaaaagcaauaccugguuuccac

SEQ ID NO: 510475 - RNA, 64 nt, hsa
uuuagucuauuagcuagaggguuuuggcuguugcuuuuuuuaaaguuagguccacacagugaag

SEQ ID NO: 510476 - RNA, 64 nt, hsa
uauaugucugauaccguuguuauaacaaaacaaauuuuuuuacuauaguuuuuuguuuucuacc

SEQ ID NO: 510477 - RNA, 64 nt, hsa
gaaagcacaauuaauuuuauagagagguuuuuuauuuuuuuaauauuucuauugcaaaagucua

SEQ ID NO: 510478 - RNA, 64 nt, hsa
ucguagcuacaccaaguucaggcuucucuuuuuguuuuuuuaccuagaaauugggcucaguggu

SEQ ID NO: 510479 - RNA, 64 nt, hsa
acuuagugcagaaggugguaaaacacaaaagugauuuuuuuacucuaaccuccauuugaaauga

SEQ ID NO: 510480 - RNA, 64 nt, hsa
acuacugacucaaaaauaaaauaauaaaaacaaauuuuuuuaagcacuggggauaaaaagacau

SEQ ID NO: 510481 - RNA, 64 nt, hsa
uuuuagcaaaggaggguugcagagcagcuuaaauuuuuuuuauaauguauaagaauuuuguuua

SEQ ID NO: 510482 - RNA, 64 nt, hsa
gacaaauaguccucuaguuccaggaaacacagucuuuuuuuaaaaaaaacaauguuuguaacaa

SEQ ID NO: 510483 - RNA, 64 nt, hsa
ggugacuaacaaagcucacaucugggagauuaacuuuuuuuaacgcaaaaauauucugcacauu

SEQ ID NO: 510484 - RNA, 64 nt, hsa
auuaaugcucaauaaacaaauucccugcaguuguuuuuuuuauuucacucuuuuuauauuuuag

SEQ ID NO: 510485 - RNA, 64 nt, hsa
ggaccaaauuuuuagaaaaauuaguuuuuggauuuuuuuuuaaguucuguauacuguuuugaau

SEQ ID NO: 510486 - RNA, 64 nt, hsa
auauauauuauauauaaaauaauauaccuaaguguuuuuuuaaacuaugggaguguauuauaaa

SEQ ID NO: 510487 - RNA, 64 nt, hsa
caacuuuuaaaaauuguuuuuaaaaauagacuuuuuuuuuuagagcaguuguagguuaacagaa

SEQ ID NO: 510488 - RNA, 64 nt, hsa
uauuuggagaaaguuugugcccuguguuuuauaauuuuuuuacccauaagacaucacauuaucc

SEQ ID NO: 510489 - RNA, 64 nt, hsa
uucccgcucagccuccauaaaucuaaugucauuuuuuuuuuaauaaguccuaggagcugggcuu

SEQ ID NO: 510490 - RNA, 64 nt, hsa
auuagacauggcaugcuaagaagguuuuguuuuuuuuuuuuaauguugcaucugucuaauuugu

SEQ ID NO: 510491 - RNA, 64 nt, hsa
aaaaaaacaaaaacaaacaggcugccauaauauauuuuuuuaauuuggcaggauaaaauauugc

SEQ ID NO: 510492 - RNA, 64 nt, hsa
cuuuuaggcguuuucuggcuugacggcuucucucuuuuuuuaaaucacccccaccacauaaauc

SEQ ID NO: 510493 - RNA, 64 nt, hsa
uuuuuguccugaaauaaaaaguggcaugcaguuuuuuuuuuaauuauuuuuuaauuuuuuuuuu

SEQ ID NO: 510494 - RNA, 64 nt, hsa
gagauuuuguuggguauccaucccuucuuuguuuuuuuuuuaacccgguaguagccugagcaau

SEQ ID NO: 510495 - RNA, 64 nt, hsa
uaaaaauacucuaauagccuugagugaccaacuuuuuuuuuaaagcacagauguaauugucuaa

SEQ ID NO: 510496 - RNA, 64 nt, hsa
uucccuuagagggauaaaguugagaagugugccuuuuuuuuaauggcuugaaguuucagaggug

SEQ ID NO: 510497 - RNA, 64 nt, hsa
acaauguauauaacacuaucugucuguaaaauacuuuuuuuaagaaagcauuuauauuuauaug

SEQ ID NO: 510498 - RNA, 64 nt, hsa
uucugggaccaguucucccccaacaggaaacuuguuuuuuuaacgucagccagauauuuagaaa

SEQ ID NO: 510499 - RNA, 64 nt, hsa
auguagaacugggccagagccaguccauugccuguuuuuuuaaauaagguuuuacugagcacag

SEQ ID NO: 510500 - RNA, 64 nt, hsa
uuauuggguugucuugcuuucuuacaugaacuuguuuuuuuaaucacugaaaggaauuuagugu

SEQ ID NO: 510501 - RNA, 64 nt, hsa
cugaaguccuuugaaacaucucauuaucuugaaauuuuuuuaauguuugagaacaccauaagca

SEQ ID NO: 510502 - RNA, 64 nt, hsa
auuuuccuggguagaagggaaaagacuggaaaaauuuuuuuagugacaugcauuuuuuuuuuag

SEQ ID NO: 510503 - RNA, 64 nt, hsa
aagacuggaaaaauuuuuuuagugacaugcauuuuuuuuuuaguuguuaucaaauuguaaaauc

SEQ ID NO: 510504 - RNA, 64 nt, hsa
ccauuguccuuauguugucuguguuguauuuuuuuuuuuuuauugaccauggugauuauuuuuu

SEQ ID NO: 510505 - RNA, 64 nt, hsa
uguauuuuuuuuuuuuuauugaccauggugauuauuuuuuuaaaccaucguuaauauacugaag

SEQ ID NO: 510506 - RNA, 64 nt, hsa
gauugagaaauucucagugauucugcaauggauuuuuuuuuaaugcagaaguaauguauacucu

SEQ ID NO: 510507 - RNA, 64 nt, hsa
agggggaggaaauguugcauugcuguuuguaagcuuuuuuuauuauuuuuuuauuauaauuauu

SEQ ID NO: 510508 - RNA, 64 nt, hsa
auguugcauugcuguuuguaagcuuuuuuuauuauuuuuuuauuauaauuauuaaaggccugac

SEQ ID NO: 510509 - RNA, 64 nt, hsa
auggauguagcuaccuuuuuuuguaugucuuuuuuuuuuuuaagcaaucguguugaauuaggag

SEQ ID NO: 510510 - RNA, 64 nt, hsa
uuugcaaauggggggaagcuacugugagcguguguuuuuuuaauuuacacuauagagugauuuu

SEQ ID NO: 510511 - RNA, 64 nt, hsa
uaauuugugauacaaugcugugcccuaaaguguauuuuuuuacuaauagacaauuuauuauggc

SEQ ID NO: 510512 - RNA, 64 nt, hsa
uaaagcagcguuucuaugacacaugcaaggucauuuuuuuuaagaaaaaggaugcacagaguug

SEQ ID NO: 510513 - RNA, 64 nt, hsa
gguucaaagauauuuugcuuugugauuuuuguaauuuuuuuaucgucacugcuuaacuucacau

SEQ ID NO: 510514 - RNA, 64 nt, hsa
agaaaggaaaaaaauauucaucauacucuaaucauuuuuuuauaucuauugagcuuguuucuug

SEQ ID NO: 510515 - RNA, 64 nt, hsa
cauuuuauauuaagccagugcuggaaaacugaauuuuuuuuauuauguauaauaaucucgacac

SEQ ID NO: 510516 - RNA, 64 nt, hsa
aaaagccucauuuuauuuugcugguuugauuuuuuuuuuuuaaagaagaaaaaaaaacugcccu

SEQ ID NO: 510517 - RNA, 64 nt, hsa
aaauaaccaguccauuuuuccuuuuuuuuuuuuuuuuuuuuaaaugguggaaugucucucagca

SEQ ID NO: 510518 - RNA, 64 nt, hsa
uacuagauuuuucaaagugugaaaaccuuuagacuuuuuuuagcaauuaguuugacauucgcua

SEQ ID NO: 510519 - RNA, 64 nt, hsa
uaaaauaaaauauauuuuguucuauugguagguuuuuuuuuaaaauuagaugaauauguuaguc

SEQ ID NO: 510520 - RNA, 64 nt, hsa
gaauuuuguuaauaaauuauaagguuuguuuuuuuuuuuuuaaacucugcaguguugauuuuuc

SEQ ID NO: 510521 - RNA, 64 nt, hsa
uacaggugugcaccaccacagcuggcuaauucuauuuuuuuauagaggcgaagucucacuaugu

SEQ ID NO: 510522 - RNA, 64 nt, hsa
uuuguuuuaaccaauaacuagcuucuuauaaugauuuuuuuacuaaugauacuuacaaguuucu

SEQ ID NO: 510523 - RNA, 64 nt, hsa
auauuggccaaacuggugcaugacaaguacuguauuuuuuuauaccuaaauaaagaaaaaucuu

SEQ ID NO: 510524 - RNA, 64 nt, hsa
uuaaaugcuaguaaucagcacucuuucuuuuuuuuuuuuuuaauagagacagggucucgcagug

SEQ ID NO: 510525 - RNA, 64 nt, hsa
gaagucacaggcuggcuucuguuuuauucagggauuuuuuuaaaaagucaaucagaaaagggau

SEQ ID NO: 510526 - RNA, 64 nt, hsa
uuuuuuaaauaggcuuacugucaaauugcaacuuuuuuuuuagauacagaguggaaaacagugc

SEQ ID NO: 510527 - RNA, 64 nt, hsa
cagagcuccuugguuuuuuacuucugcacuuaaauuuuuuuaaauaacaugaugaugguacauu

SEQ ID NO: 510528 - RNA, 64 nt, hsa
gucagcugucggguuagugguaguauuauuguuauuuuuuuaaaggaaacaaacagacaacaaa

SEQ ID NO: 510529 - RNA, 64 nt, hsa
agguagacuuuauuacccccccacuaugcccucauuuuuuuaaaaaaggaaaaaaaaaagaaac

SEQ ID NO: 510530 - RNA, 64 nt, hsa
cuuuuggucugaaauacuuuugaacagaauuucuuuuuuuuaaaaaaaaacagagauggggucu

SEQ ID NO: 510531 - RNA, 64 nt, hsa
auuagcacacagauucacuuuaauuucuuaauuuuuuuuuuaaauacaaggagggggcuauuaa

SEQ ID NO: 510532 - RNA, 64 nt, hsa
uguacuccacaauggccaguccaauugcuaucuauuuuuuuauccagaggcuuaauuaaaugau

SEQ ID NO: 510533 - RNA, 64 nt, hsa
uaguguuacaggaagugaaaugcaaaugugcaauuuuuuuuaaaggagcuuuuaaacaaaguaa

SEQ ID NO: 510534 - RNA, 64 nt, hsa
ugucuguaguugacaaaaguggcuucaucacaaauuuuuuuaaacguuucuacuuugggguucc

SEQ ID NO: 510535 - RNA, 64 nt, hsa
guccaauguuugguguuaucugcauuguuuuuuguuuuuuuaauugugguuguucugacgugug

SEQ ID NO: 510536 - RNA, 64 nt, hsa
aauaaagugauguucugguggagguagacugaaauuuuuuuaauucauguuuuucauuugauac

SEQ ID NO: 510537 - RNA, 64 nt, hsa
ugugauuuucuuguuuaugucuguuuuuuuuuuuuuuuuuuaacauuuguguguaauauagcug

SEQ ID NO: 510538 - RNA, 64 nt, hsa
guagugagcaaugauugcgcagcccuguuaacaguuuuuuuagggaucuuucagccuuuauggu

SEQ ID NO: 510539 - RNA, 64 nt, hsa
caacuuccacuuuuuuuuaaacugcacuuuugacuuuuuuuaugguauaaaaacaauaauuuau

SEQ ID NO: 510540 - RNA, 64 nt, hsa
uuucuagcucuuaucaagaauaacaacuuccacuuuuuuuuaaacugcacuuuugacuuuuuuu

SEQ ID NO: 510541 - RNA, 64 nt, hsa
augguacuaauaaaaaccuaaauucuccaaccaauuuuuuuaaacugccaggaacacccaaaaa

SEQ ID NO: 510542 - RNA, 64 nt, hsa
gaaaccagaacacuuguuccuaguguuguguuguuuuuuuuaagcaaauuacuuacuguauuuu

SEQ ID NO: 510543 - RNA, 64 nt, hsa
ccuugaaaugcuguuaguaaauuucugugauuuuuuuuuuuaauuuguuuugcugagagcauag

SEQ ID NO: 510544 - RNA, 64 nt, hsa
auuggauuacuuuuuuuuuuuuuuuuuuuuuuuuuuuuuuuacucuuugaaagcuuuguuuugu

SEQ ID NO: 510545 - RNA, 64 nt, hsa
uguaaaguaaguuugguuaaagugaucacuguucuuuuuuuauuuuauugucauuucaauaaaa

SEQ ID NO: 510546 - RNA, 64 nt, hsa
ccaaguguagcugagcaauuaauaaacacucaaguuuuuuuaguuggggucaugucaaacccuc

SEQ ID NO: 510547 - RNA, 64 nt, hsa
cauacuuuuuuguacaacauuaaagaaaauggacuuuuuuuauuuuaauuucucauuaaacuuc

SEQ ID NO: 510548 - RNA, 64 nt, hsa
uugccaagggcauaaauuauuguuuuucuuuuuuuuuuuuuaauaaauuucaccaaguauggcu

SEQ ID NO: 510549 - RNA, 64 nt, hsa
uuagauuugugugcaucaggcuuucuuuuuuuucuuuuuuuagagaaguucaauauaagcuuuu

SEQ ID NO: 510550 - RNA, 64 nt, hsa
ccaacacuaaugguuuauauaacaugcuucccauuuuuuuuaugucguagaaauuggaaguuag

SEQ ID NO: 510551 - RNA, 64 nt, hsa
uuucucucuuauauuuguagcuaaccagcucagguuuuuuuauuugaacuggguugaaucucug

SEQ ID NO: 510552 - RNA, 64 nt, hsa
uaugugcugaaagccaaacuuuuaaauuuuuugguuuuuuuaagcaaagaaauauuuuaaauaa

SEQ ID NO: 510553 - RNA, 64 nt, hsa
acuucauagaaacuaaagcagaaaguuguuacauuuuuuuuaugacaggcuuuuaguagaauuu

SEQ ID NO: 510554 - RNA, 64 nt, hsa
aacuuuaguuuugcuuuguuugcauguccacugguuuuuuuauuuugauauuugucuuuuuuua

SEQ ID NO: 510555 - RNA, 64 nt, hsa
cauguccacugguuuuuuuauuuugauauuugucuuuuuuuaaauuuuacaguagucauugaaa

SEQ ID NO: 510556 - RNA, 64 nt, hsa
guugugugauuuguguuauacugguuguaauuaauuuuuuuaauucaugaacuagcggaaaauu

SEQ ID NO: 510557 - RNA, 64 nt, hsa
aacuugagggcaauacuaaacuuaaaaauaagaguuuuuuuauuacaaaauuauuuuuaugguc

SEQ ID NO: 510558 - RNA, 64 nt, hsa
uguguguguguguguguguguguaugauguuuuguuuuuuuaaauguuuuaaaagcuuaauagg

SEQ ID NO: 510559 - RNA, 64 nt, hsa
acugcauuggccaauggcuuugauacuucugcuauuuuuuuagacacaaacccauaaacuaacu

SEQ ID NO: 510560 - RNA, 64 nt, hsa
acugggcaaaugguauuuguuuuuguuuuaauuuuuuuuuuaauagacggaagucuugcucugu

SEQ ID NO: 510561 - RNA, 64 nt, hsa
ccuugcccagccuggaugccauccaaguuguauauuuuuuuaaucucucgacugaauggacuuu

SEQ ID NO: 510562 - RNA, 64 nt, hsa
cgccaccguuaucggugucauucaccuuucguguuuuuuuuaauuuauccucuguugauuuuuu

SEQ ID NO: 510563 - RNA, 64 nt, hsa
acaauuuguuaaccuuacguuuucugucuguauauuuuuuuaaaaaucugguaguuucuggaaa

SEQ ID NO: 510564 - RNA, 64 nt, hsa
caauagaaguauuucugaacauaucaaauauaaauuuuuuuaaagaucuaacugugaaaacaua

SEQ ID NO: 510565 - RNA, 64 nt, hsa
caggauauaacuagaaaaaggaugucuuuuuuuuuuuuuuuacucccccucuaaacacugcugc

SEQ ID NO: 510566 - RNA, 64 nt, hsa
guuugaccacacaccgcccugauuugcuguuuucuuuuuuuagggagaagggcuuuucuuuagu

SEQ ID NO: 510567 - RNA, 64 nt, hsa
ugcgugucuguuuccuucucuuucuccguauuuauuuuuuuauucuucggaggagguggacauu

SEQ ID NO: 510568 - RNA, 64 nt, hsa
acuaucucuguaaagucucucucucucuuuuuuuuuuuuuuacuuaaucuagcuagaaucuauu

SEQ ID NO: 510569 - RNA, 64 nt, hsa
gacaggaagauuuuaaucagcuuuacuaucuauguuuuuuuauggaaacuguguguauguauac

SEQ ID NO: 510570 - RNA, 64 nt, hsa
cuccauuuacggccucuuucuauauuuacacuaauuuuuuuaucuuuauugcuaccagaaaaaa

SEQ ID NO: 510571 - RNA, 64 nt, hsa
cccugauucccaucguucucaggcggauuuuauauuuuuuuaaagucuauuuuaaugauuggau

SEQ ID NO: 510572 - RNA, 64 nt, hsa
agcaaaagagaagcugauagucuugaauauuuuauuuuuuuaaugaaaagaaaaaacaagaaag

SEQ ID NO: 510573 - RNA, 64 nt, hsa
uguaauauagucgccauugaaaaguuaauuauccuuuuuuuagggauuuugaugucauuucuuu

SEQ ID NO: 510574 - RNA, 64 nt, hsa
ccuuuuuuuagggauuuugaugucauuucuuuuuuuuuuuuaauaaaaagguugaacuguuuuu

SEQ ID NO: 510575 - RNA, 64 nt, hsa
auaguggcauagaaaaaguauaaagcucaguuaguuuuuuuauuauuauuauuauuaaaaguua

SEQ ID NO: 510576 - RNA, 64 nt, hsa
ggauuuuuuuccuguaacauaaaagauugugaacuuuuuuuaauuaaaaaauauuuccuagggc

SEQ ID NO: 510577 - RNA, 64 nt, hsa
acaaagaaaaucaaaagcauuucuauauuuugucuuuuuuuaguucagacagcaaaggcaugua

SEQ ID NO: 510578 - RNA, 64 nt, hsa
acagugaucaccaauacauguuuucaguuuuuuuuuuuuuuaaggucucuaucacuuuaaucug

SEQ ID NO: 510579 - RNA, 64 nt, hsa
uauaauacacauaucuuagugguaaacagcuuuuuuuuuuuaaggucagauugccucagguuua

SEQ ID NO: 510580 - RNA, 64 nt, hsa
caauugauguuuuacgugcaaacaaccugaaucuuuuuuuuauauaaauauauauuuuucaaau

SEQ ID NO: 510581 - RNA, 64 nt, hsa
caaagucaauuuguaauauuuugcaacccuaggauuuuuuuaaauagaugcugcuugcuauguu

SEQ ID NO: 510582 - RNA, 64 nt, hsa
gauuauuuucuuuaaaaucagcuauuacaggauauuuuuuuauuuuauacaugcuguuuuuuaa

SEQ ID NO: 510583 - RNA, 64 nt, hsa
uuuaacuuuguauauuuguuaucuaucaggcuaauuuuuuuaugaaaagaauuuuacucuccug

SEQ ID NO: 510584 - RNA, 64 nt, hsa
accauacagggaccugucccaaagaaaaaggcucuuuuuuuagccagcauauuuccccuucuac

SEQ ID NO: 510585 - RNA, 64 nt, hsa
uaccauagaguaaugauguaacagugcaagauuuuuuuuuuaagugacauaauuguccaguuau

SEQ ID NO: 510586 - RNA, 64 nt, hsa
uauuccaaugauacccaacaguuuauuuuuauuauuuuuuuaaacaaaauuucacaguucugua

SEQ ID NO: 510587 - RNA, 64 nt, hsa
accagaauucccuuuggacauuuguguuuuuuuguuuuuuuauuuuguuuuguuuuuucuucuu

SEQ ID NO: 510588 - RNA, 64 nt, hsa
cuaaaucucucugccuguuuggacuuuguaauuauuuuuuuagcaguaauuaaagaaaaaaguc

SEQ ID NO: 510589 - RNA, 64 nt, hsa
uguuguuaaauuauguucuuaacuguaaccaguuuuuuuuuauuuaucucuuuaaucuuuuuuu

SEQ ID NO: 510590 - RNA, 64 nt, hsa
uguaaccaguuuuuuuuuauuuaucucuuuaaucuuuuuuuauuauuaaaagcaaguuucuuug

SEQ ID NO: 510591 - RNA, 64 nt, hsa
ugaggauugcuuuuuaaaaaagacagcaaacuuuuuuuuuuauuuaaaaaaagauauauuaaca

SEQ ID NO: 510592 - RNA, 64 nt, hsa
uucagaaaaucuugagguuaaacaucucucucucuuuuuuuaaaauacaaggcccugauaaaau

SEQ ID NO: 510593 - RNA, 64 nt, hsa
uuuaaaaagaaaaaaaaaaucaaaauauaauauauuuuuuuaccaaucgguagagaagagacag

SEQ ID NO: 510594 - RNA, 64 nt, hsa
uuugaucuguguuuguuauacugguuguaauuaauuuuuuuaauucaugaacuagcggaaaauu

SEQ ID NO: 510595 - RNA, 64 nt, hsa
aacuuuaguuuugcuuuguuugcauguccacuaauuuuuuuauuuugauauuagucuuuuuuaa

SEQ ID NO: 510596 - RNA, 64 nt, hsa
cauaacugaagugaaaaaagucuguguuuuuguguuuuuuuaaauaaaaauuuucaaaaaguua

SEQ ID NO: 510597 - RNA, 64 nt, hsa
uggauugccaauuccacuugauguaaacaaaacuuuuuuuuauacauaauauauauauauauau

SEQ ID NO: 510598 - RNA, 64 nt, hsa
ugcuggauaaaugccuugaaguuagcaggguguauuuuuuuagcgaauaugauuugcaugucuu

SEQ ID NO: 510599 - RNA, 64 nt, hsa
ggcauguuugguaaaaauguuuuugugagaguucuuuuuuuaagaaagcauuaugcaaaaaguc

SEQ ID NO: 510600 - RNA, 64 nt, hsa
gcagaggaaagucuuucugccuuuuuauaauuacuuuuuuuaucauuuaauuuaccugccuaaa

SEQ ID NO: 510601 - RNA, 64 nt, hsa
uuccuuccccaugcuguuguccccaugcugccuauuuuuuuaaauuucauagauuauauuugaa

SEQ ID NO: 510602 - RNA, 64 nt, hsa
uagcagagcaaaaaaauauagcguaaauacuuauuuuuuuuaaaaacuuacuuaaauuugugug

SEQ ID NO: 510603 - RNA, 64 nt, hsa
aggugugagccacugcaguggaccaauuuuuguauuuuuuuaaaugcuugaccaagugucuaaa

SEQ ID NO: 510604 - RNA, 64 nt, hsa
auacauuuaaagcaccccaaugucucucuuuuuuuuuuuuuacuucccuuucuucuuccuuaua

SEQ ID NO: 510605 - RNA, 64 nt, hsa
acaccccuucaguccacacaaagaagcuucauauuuuuuuuauaagcauagaaauaaaaaccaa

SEQ ID NO: 510606 - RNA, 64 nt, hsa
ggaagguuuaaggagaaucuaagcauuuuagacuuuuuuuuauaaauagacuuauuuuccuuug

SEQ ID NO: 510607 - RNA, 64 nt, hsa
aucaucugaaacuacuaacuuugugguuccagauuuuuuuuaaucuccuacuucugcuaucuuu

SEQ ID NO: 510608 - RNA, 64 nt, hsa
ugccuuccuaguacuuagcccccucugacaauuuuuuuuuuaaugugccuuuuggguugguaga

SEQ ID NO: 510609 - RNA, 64 nt, hsa
uguuguguugauguuuccuucuuaauuuauaggauuuuuuuaauguaaaaaauugcacugaacu

SEQ ID NO: 510610 - RNA, 64 nt, hsa
uuauuucauggucaagccuguaguauuaaaaugauuuuuuuaaaagauguaaacugugcuuagu

SEQ ID NO: 510611 - RNA, 64 nt, hsa
ucuuugccugaaucagaacgcuggcuuuuauuuauuuuuuuauuuuuaauauuaaaugugcaga

SEQ ID NO: 510612 - RNA, 64 nt, hsa
cuaaaucacuuaccucccacccccucuccaauuuuuuuuuuaagagacaaggucuugcuauguu

SEQ ID NO: 510613 - RNA, 64 nt, hsa
agugaucugugacagcagcagcuucauguuguauuuuuuuuacugaaauuguaaaauauccauc

SEQ ID NO: 510614 - RNA, 64 nt, hsa
caguauuuaagauauagcaaggacauggcugauuuuuuuuuauaaaaauuggcacuaauaagug

SEQ ID NO: 510615 - RNA, 64 nt, hsa
gggggauuuuuuuuuucaccuccuugagaauuuuuuuuuuuaagcuuauaguaaggauacauuc

SEQ ID NO: 510616 - RNA, 64 nt, hsa
gauuccugccccaaccaaaccgcauucguguggauuuuuuuauucaacuuaauuggcuauucca

SEQ ID NO: 510617 - RNA, 64 nt, hsa
uccucugugugacugauagagcguugcuauuucauuuuuuuaagacaaaaugaaagcaaaauau

SEQ ID NO: 510618 - RNA, 64 nt, hsa
uuugaucuguguuuguuauacugguuguaauuaauuuuuuuaauucaugaacuagcagaaaauu

SEQ ID NO: 510619 - RNA, 64 nt, hsa
auguccacuaauuuuuuuauuuugauauuugucuuuuuuuuaaauuuuacaguagucaucgaaa

SEQ ID NO: 510620 - RNA, 64 nt, hsa
aacuuuaguuuugcuuuguuugcauguccacuaauuuuuuuauuuugauauuugucuuuuuuuu

SEQ ID NO: 510621 - RNA, 64 nt, hsa
aacuuuaaguucaaucuaaaggcuucaguccacauuuuuuuauacguuguauuuuaaaaacguu

SEQ ID NO: 510622 - RNA, 64 nt, hsa
auguuuuaaggaugcuucuaaggaucaguaguaauuuuuuuaguucgcaccuaaagaugauuac

SEQ ID NO: 510623 - RNA, 64 nt, hsa
uuuuucaaaugaaauaccuuuuauuuccauauaauuuuuuuauuuuagaguucaauagcuguuu

SEQ ID NO: 510624 - RNA, 64 nt, hsa
uuaguuccauuauaugaacacuggauaaccuaauuuuuuuuaaugcuuuaaaaaaauggcaaaa

SEQ ID NO: 510625 - RNA, 64 nt, hsa
aguuucuagauaagauaaacaaauuuuguuuaaauuuuuuuaauaaaaaucuuaaaacacuuuu

SEQ ID NO: 510626 - RNA, 64 nt, hsa
ccccaaauucuguguuccuguuuaaacccgugguuuuuuuuaaauacauuuauuuuuauagcag

SEQ ID NO: 510627 - RNA, 64 nt, hsa
aagugggguugcugggucauagggcagguguaauuuuuuuuacuugaaauguuccacuucuugu

SEQ ID NO: 510628 - RNA, 64 nt, hsa
gugagucacucagggaacaaugagcacuugaagauuuuuuuauacaaaaggccacagugaggcc

SEQ ID NO: 510629 - RNA, 64 nt, hsa
aagagaagccacauacuauaaagaucuauuuuuuuuuuuuuaagagagaacguagggcuguuca

SEQ ID NO: 510630 - RNA, 64 nt, hsa
uggauuccuagagacuagcuucagcuuuugcuauuuuuuuuaagugggagaagggugggcaguu

SEQ ID NO: 510631 - RNA, 64 nt, hsa
gaauuuuuauucuuaaacauagguguguuggcucuuuuuuuaaaagaugcgcucuaccugaaaa

SEQ ID NO: 510632 - RNA, 64 nt, hsa
ugguaaauaccaaguuugguaucucauagcuaucuuuuuuuaaagaaauuaaguucuugaaaau

SEQ ID NO: 510633 - RNA, 64 nt, hsa
aauucaaccacagauuuauacaaggguuaaccauuuuuuuuaaguuugacuacauagucaaguc

SEQ ID NO: 510634 - RNA, 64 nt, hsa
agcagcuuguaguaugcuuaagcuuuggggaauuuuuuuuuaaggggaucuaaaaaaauguuuu

SEQ ID NO: 510635 - RNA, 64 nt, hsa
auuagauuauugaauuguaauguuuaucugcugcuuuuuuuaaauaaaauuugacugaaaaugu

SEQ ID NO: 510636 - RNA, 64 nt, hsa
uauuuaggcuaaaucaguuuuauuuuucucugauuuuuuuuaauaccacagaaucaccugagug

SEQ ID NO: 510637 - RNA, 64 nt, hsa
ucaaacucauggaaaauucccuccucuuccccccuuuuuuuaauuaaaagaagucacuuaggaa

SEQ ID NO: 510638 - RNA, 64 nt, hsa
uuugaucuggccucuguccuucaucagcuuuuauuuuuuuuauuuuuauuuucugcuuuuguua

SEQ ID NO: 510639 - RNA, 64 nt, hsa
gacaaacuuaaauguuggugcgugcuuuuuuuuuuuuuuuuacacugaauacuugcugugugca

SEQ ID NO: 510640 - RNA, 64 nt, hsa
guuuacugaaucuuuaaaacuguguauuugaccuuuuuuuuacaacacuggugacagucauaug

SEQ ID NO: 510641 - RNA, 64 nt, hsa
guuuaaugcugcuguuuuuaaaaaaaaaaaaaaguuuuuuuaaaaagccaaucuauguacuaaa

SEQ ID NO: 510642 - RNA, 64 nt, hsa
agguucaucuguuguaguauguauugauacuuaauuuuuuuauugccgaauacuauuccauugc

SEQ ID NO: 510643 - RNA, 64 nt, hsa
auuugcauuuccauaauaucuaauuagguugagcuuuuuuuaugugcuuauuggccauuuguuu

SEQ ID NO: 510644 - RNA, 64 nt, hsa
uuguacugcagaauacaucuggcugugugauuuuuuuuuuuaagcaagauuuguuuuacuauaa

SEQ ID NO: 510645 - RNA, 64 nt, hsa
caaguaccugucaguaauaagccuuuuuuuuuuuuuuuuuuaauuuaaauguuuguagcugcua

SEQ ID NO: 510646 - RNA, 64 nt, hsa
cuuaaagauuguauuuucacagaguggaaaccaauuuuuuuaguuauuguucaaggagggugca

SEQ ID NO: 510647 - RNA, 64 nt, hsa
auauggaaauauaccaguguagcuugguacuguauuuuuuuauauugaucugcugauaccagug

SEQ ID NO: 510648 - RNA, 64 nt, hsa
guggccugacacugguggcacuacuaaguguguguuuuuuuaaaaaaaaaauggaaaaaaaaaa

SEQ ID NO: 510649 - RNA, 64 nt, hsa
uguaguuagaauacucaauuuuuaauuuuuuuaauuuuuuuauuuuuuauuuucuuuuugguuu

SEQ ID NO: 510650 - RNA, 64 nt, hsa
uuguugagcuguaguuagaauacucaauuuuuaauuuuuuuaauuuuuuuauuuuuuauuuucu

SEQ ID NO: 510651 - RNA, 64 nt, hsa
aauggcuagucauaucuguguguuuguaaaguuauuuuuuuaauauuuuaagauuacaauuuua

SEQ ID NO: 510652 - RNA, 64 nt, hsa
ugucucuuucuguuucucucuccaguuuuuuuuuuuuuuuuaauuuccauaugggcuaaagaau

SEQ ID NO: 510653 - RNA, 64 nt, hsa
ucuuagaacuauuuccaaaauauuuauauuucaguuuuuuuaugguacucgaaaaaucaaaccu

SEQ ID NO: 510654 - RNA, 64 nt, hsa
aaaaguaucuucauuuaaaaagaaaucaagucaguuuuuuuaaaagaaugaucuauggaagaaa

SEQ ID NO: 510655 - RNA, 64 nt, hsa
aauguuuccaagguuguguguuuauacuguguauuuuuuuuaaauucacggugaacagcacuuu

SEQ ID NO: 510656 - RNA, 64 nt, hsa
agauuguuaaaagggugcaagacuguugcuucucuuuuuuuagauauuuuucuaucucucacuu

SEQ ID NO: 510657 - RNA, 64 nt, hsa
gaaaauaaaaccaggguuucuauuuaucuguuuuuuuuuuuaauguugcacuuguaguuucauu

SEQ ID NO: 510658 - RNA, 64 nt, hsa
uuauuguuauucaauuuggaucuuucagggauuuuuuuuuuaaauuauuaugggacaaaggaca

SEQ ID NO: 510659 - RNA, 64 nt, hsa
gaugggaaaaaugcccuuaaaucauaggaaaguauuuuuuuaagcuaccaauugugccgagaaa

SEQ ID NO: 510660 - RNA, 64 nt, hsa
uccuccguucccuaaaaagguuugucuuccuuuuuuuuuuuauuuuuauuuuucaaaucuauac

SEQ ID NO: 510661 - RNA, 64 nt, hsa
aaccguuugagccuuauagaucauuuacauucaauuuuuuuaacucagcaagugagaacuuaca

SEQ ID NO: 510662 - RNA, 64 nt, hsa
uuuuuaacucagcaagugagaacuuacaagaggguuuuuuuaaaauuuuuuuuucucuuaauga

SEQ ID NO: 510663 - RNA, 64 nt, hsa
ccaggccucggucacaacggacgugacaugcugcuuuuuuuaauuuuauuuuuuuaugaaaaga

SEQ ID NO: 510664 - RNA, 64 nt, hsa
caacggacgugacaugcugcuuuuuuuaauuuuauuuuuuuaugaaaagaaccagugucaaucc

SEQ ID NO: 510665 - RNA, 64 nt, hsa
ggacuggggaagggaggggagacuaugugugagcuuuuuuuaaauagagggauugacucggauu

SEQ ID NO: 510666 - RNA, 64 nt, hsa
uuggaaucguuucuuuuguuugucugauuuaugguuuuuuuaaguauaaacaaaaguuuuuuau

SEQ ID NO: 510667 - RNA, 64 nt, hsa
uucacuuuaacgcuuaaugccuucaaaguuuugguuuuuuuaagaaaaaaaaauauauauauau

SEQ ID NO: 510668 - RNA, 64 nt, hsa
uuuuuauuuggguagguuuugggguccaggccauuuuuuuuaccccuuggaggaaauaagauga

SEQ ID NO: 510669 - RNA, 64 nt, hsa
caguuucuuugaacagcauauacucaggccaugcuuuuuuuauucauucugcauaugucucucu

SEQ ID NO: 510670 - RNA, 64 nt, hsa
uuacuagucuuccuauagguuacuucaccuuuuuuuuuuuuaauaauuugauuugauacauaug

SEQ ID NO: 510671 - RNA, 64 nt, hsa
gaaacauugucucuugaccuuuuuuuuuuuuuuuuuuuuuuaaagagacagagucucacucugu

SEQ ID NO: 510672 - RNA, 64 nt, hsa
uguugucauuuuuaaaauuuuuuuaauuuuuuuuuuuuuuuacuuuuacuuuuuaccucuugug

SEQ ID NO: 510673 - RNA, 64 nt, hsa
cuuuuuacugcgguuucuguugucauuuuuaaaauuuuuuuaauuuuuuuuuuuuuuuacuuuu

SEQ ID NO: 510674 - RNA, 64 nt, hsa
uacaauaaaccggagagaaaagguccgcuugcacuuuuuuuaguuuucuuauuuuuagacaccc

SEQ ID NO: 510675 - RNA, 64 nt, hsa
ugaucugagugccucaagaugguuuucaaaaaaauuuuuuuaaagaaaauaauuguauacgugu

SEQ ID NO: 510676 - RNA, 64 nt, hsa
gaaaauuagcaaggaugcugccuuuggucucugguuuuuuuaagcuuuuuuugcauauguuuug

SEQ ID NO: 510677 - RNA, 64 nt, hsa
aaagccaccagcaaauugugccuaagcgaaauauuuuuuuuaaggaaaauaaaaacauuaguua

SEQ ID NO: 510678 - RNA, 64 nt, hsa
gauacacagaaguuauuuuuuuaauggauauuuauuuuuuuacauuggucaguacacaggucag

SEQ ID NO: 510679 - RNA, 64 nt, hsa
guuuacacccucccucauagauacacagaaguuauuuuuuuaauggauauuuauuuuuuuacau

SEQ ID NO: 510680 - RNA, 64 nt, hsa
cgcggaaacugcguaggaauucaguggugguggguuuuuuuaaggcuuucuacaaaaccaaauu

SEQ ID NO: 510681 - RNA, 64 nt, hsa
ugaccucccgugaagauacagagacugucuccuuuuuuuuuaacuuugacaacugacuucuguu

SEQ ID NO: 510682 - RNA, 64 nt, hsa
ucgcuuuuggguuuucugauguuuuguuuuguguuuuuuuuaaaccauuuucucucuuucggua

SEQ ID NO: 510683 - RNA, 64 nt, hsa
ggauuacaggugugcaccaccacacccggcuaauuuuuuuuauuuuuaauagagaugagguuuc

SEQ ID NO: 510684 - RNA, 64 nt, hsa
cccugaguuuccuuuucugucucucucuuuuuauuuuuuuuauuuuuauuuuuauuuuugagac

SEQ ID NO: 510685 - RNA, 64 nt, hsa
aucacgagccacugguuauuggauuuuuuuucuuuuuuuuuagacagaguuuugcucuuguugc

SEQ ID NO: 510686 - RNA, 64 nt, hsa
aauuuacaacuauauauuaacauggcuucaauuguuuuuuuaaucuauuaucauuauuuuucuu

SEQ ID NO: 510687 - RNA, 64 nt, hsa
gacuacaggugcaugccaacacgcccggcuaauuuuuuuuuaaaaauauuuuuaguagagacag

SEQ ID NO: 510688 - RNA, 64 nt, hsa
aaguuccuaguagacaccaucugguugagucaguuuuuuuuaugguguauuuugaacccauucu

SEQ ID NO: 510689 - RNA, 64 nt, hsa
cuggagcagaacuuuccagggauccagggacacuuuuuuuuaaagcucauaaacugccaagagc

SEQ ID NO: 510690 - RNA, 64 nt, hsa
accggcgugagccaccaugccuggcccggauaauuuuuuuuaauuuuuguagagacgaggucuu

SEQ ID NO: 510691 - RNA, 64 nt, hsa
cuggcaugagccacugugcccagcccggauauuuuuuuuuuaauuauuuauuuauuuauuuauu

SEQ ID NO: 510692 - RNA, 64 nt, hsa
uaauggacguagacuugcugcuaugaaaacauauuuuuuuuauuuaugaagacuaaauuuauau

SEQ ID NO: 510693 - RNA, 64 nt, hsa
uuaaaguuauuuauuaaguucuucauuggaaguuuuuuuuuauaucugguucacuaccaccauu

SEQ ID NO: 510694 - RNA, 64 nt, hsa
cuuccuuuuacauccuggaacaacaauaaaaacauuuuuuuaaacuugucuacuguaagauacu

SEQ ID NO: 510695 - RNA, 64 nt, hsa
aaauggggaggcuaggcucuccccagcccuaugguuuuuuuauuucauguaccccaggaaauac

SEQ ID NO: 510696 - RNA, 64 nt, hsa
auaaauccuguuaauuuuuuuuuuuuuuuuuuuuuuuuuuuacugcauguuacauugaaauaaa

SEQ ID NO: 510697 - RNA, 64 nt, hsa
ggaagugaagaaggugguauaaaugcugucaauuuuuuuuuaacccaaguauuuugguggggaa

SEQ ID NO: 510698 - RNA, 64 nt, hsa
cuuuucccuguuguauaucuuaagcauuuggaauuuuuuuuaucuucugaaaucauauaaaaag

SEQ ID NO: 510699 - RNA, 64 nt, hsa
uaaacauguuugguuuucuuacgauacagggccauuuuuuuaaaacucucaggacugaacagaa

SEQ ID NO: 510700 - RNA, 64 nt, hsa
gagauugaguucugggaucaguuauaauauauauuuuuuuuagaaagagaaaaugagcugagag

SEQ ID NO: 510701 - RNA, 64 nt, hsa
cagaagcuguucaguauuauauguguauaugcuauuuuuuuagcagccaugucugagcagaaug

SEQ ID NO: 510702 - RNA, 64 nt, hsa
cugaaggaaagugacccuuuaagagaggaucaucuuuuuuuauauuuauuuucaccaaauaggg

SEQ ID NO: 510703 - RNA, 64 nt, hsa
ggaacuauaggcaugugccaccaugcccagcuaauuuuuuuauuuuuuguagagacaaggucuu

SEQ ID NO: 510704 - RNA, 64 nt, hsa
gaucuggguuugggguuaguugcuuuuuuuuuuuuuuuuuuaauugagacaggguuggucucug

SEQ ID NO: 510705 - RNA, 64 nt, hsa
uuuuacuugcuuucuuacugacagcaaccaggaauuuuuuuauccugcagagcaaguuuucaaa

SEQ ID NO: 510706 - RNA, 64 nt, hsa
uaaaaucaaagaucagugaguucaucuguaauauuuuuuuuacuugcuuucuuacugacagcaa

SEQ ID NO: 510707 - RNA, 64 nt, hsa
uacauaauacugaaccacuuguagauuugauuuuuuuuuuuaaucuacugcauuuagggaguau

SEQ ID NO: 510708 - RNA, 64 nt, hsa
cacagcaacgaucacaaaugacuuuauuauuuauuuuuuuuaauuguauuuuuguuguuggggg

SEQ ID NO: 510709 - RNA, 64 nt, hsa
ugagggcgguguguuguaugucuuuggguguuuguuuuuuuauaaagcauauaauaaaauaauc

SEQ ID NO: 510710 - RNA, 64 nt, hsa
aucucauuuaucuuuauauacucuuugcaccuccuuuuuuuagucgagauauaaauauuugagg

SEQ ID NO: 510711 - RNA, 64 nt, hsa
ccuaauuacuauguaaagauugaccuuauuuaaauuuuuuuauguugaaaucaucaauauuccc

SEQ ID NO: 510712 - RNA, 64 nt, hsa
uagaaauugagguugagaggaacucaggagauuuuuuuuuuaaaucauaugacaguauaagcca

SEQ ID NO: 510713 - RNA, 64 nt, hsa
ccucuuauaaaauagcuuuugccgaaacauaguuuuuuuuuagcagaucccaaaauauaaugaa

SEQ ID NO: 510714 - RNA, 64 nt, hsa
uuuguucucuuucauuaaaccccuuccccaguuuuuuuuuuauacuuuaaaccccgcuccucau

SEQ ID NO: 510715 - RNA, 64 nt, hsa
gagaugauuuuuauuaauuuuuuuuuuuuuuuuuuuuuuuuacuauuuauagcuuuagauaggg

SEQ ID NO: 510716 - RNA, 64 nt, hsa
gaauauuuguaaaucuauuuuuaguguuuguucguuuuuuuaacuguucauuccuuugugcaga

SEQ ID NO: 510717 - RNA, 64 nt, hsa
gaugaggaguacuuucugaagaguacuucguauuuuuuuuuaauugccuuguuugccuucaacu

SEQ ID NO: 510718 - RNA, 64 nt, hsa
uucuucuagaucucugguguucucuuugguuucauuuuuuuaaaaaauuaccuucuuugggugg

SEQ ID NO: 510719 - RNA, 64 nt, hsa
ccauagagcaaggguaauccuagaaaaaauuuuuuuuuuuuaaauuaugcaacguaagaugucc

SEQ ID NO: 510720 - RNA, 64 nt, hsa
uauugugcucuuucauuuaaaauguauguuuuuuuuuuuuuaaacugucaaugauuuuguauua

SEQ ID NO: 510721 - RNA, 64 nt, hsa
uuuuuuuuuaaaucgauguucaaacuaauaaauauuuuuuuaugaagaggaaaaauguguagau

SEQ ID NO: 510722 - RNA, 64 nt, hsa
caugucaugaaggguuuuuuuuaugugacugauuuuuuuuuaaaucgauguucaaacuaauaaa

SEQ ID NO: 510723 - RNA, 64 nt, hsa
gaggcguggagggaaaagacaugucaugaaggguuuuuuuuaugugacugauuuuuuuuuaaau

SEQ ID NO: 510724 - RNA, 64 nt, hsa
caggguuugcuuguugcugcuauaguuuuuaacuuuuuuuuauuuuaauaacugcaaaagacaa

SEQ ID NO: 510725 - RNA, 64 nt, hsa
uucagucagguuuuuacucaaguaagugguugauuuuuuuuaagucaaacuacacugaaacuuu

SEQ ID NO: 510726 - RNA, 64 nt, hsa
cuuuuauuucuaggcuguacagucugaugcaugauuuuuuuauaaauauuucauacucuuguga

SEQ ID NO: 510727 - RNA, 64 nt, hsa
auuuuuuucucaucuaugcaauucccauaugguuuuuuuuuaaaucauauuuuauucauuuucu

SEQ ID NO: 510728 - RNA, 64 nt, hsa
aauguggauacagucuugguucuccaucuguaauuuuuuuuaacaguuugcuauagcuuacugc

SEQ ID NO: 510729 - RNA, 64 nt, hsa
cauacugauuauaaaagaagcagaaaaacauugauuuuuuuauaucuuucauaauauaauuuuc

SEQ ID NO: 510730 - RNA, 64 nt, hsa
ccggccaaaaaaaaauguauuuauuaaaaaaaaauuuuuuuaacccgccgaauaauucccauaa

SEQ ID NO: 510731 - RNA, 64 nt, hsa
uuuaauagaugaacacuacuuuuuuaauuuuuuauuuuuuuaacccuacccuuaacccaugaac

SEQ ID NO: 510732 - RNA, 64 nt, hsa
uuuguuuucuauuuuuuuuauuuuauauuuuuaauuuuuuuaacagggucuuccucucucgccc

SEQ ID NO: 510733 - RNA, 64 nt, hsa
aucacagugguacugauuuuuauuuguuuucuauuuuuuuuauuuuauauuuuuaauuuuuuua

SEQ ID NO: 510734 - RNA, 64 nt, hsa
cauuccauaccagugguaggaaagauauucucauuuuuuuuauugaaccagacauuuuuauaaa

SEQ ID NO: 510735 - RNA, 64 nt, hsa
acucuaguuuguguuacgagguauucuuucaaauuuuuuuuaaaagccaacuacugucauuaag

SEQ ID NO: 510736 - RNA, 64 nt, hsa
cacuacgugaucugauugagauguacauaguuuuuuuuuuuaccauaacugaauuauuuuaucu

SEQ ID NO: 510737 - RNA, 64 nt, hsa
ucuuuuggaggacguuaaaggcguguuuuacuuguuuuuuuaagagugugugauguguguuuug

SEQ ID NO: 510738 - RNA, 64 nt, hsa
agagguuuaggucaguguuuuuaaguuuuuguuuuuuuuuuaaagcaaauccuguauauguauc

SEQ ID NO: 510739 - RNA, 64 nt, hsa
uguauuccucuucuucgugauaauauaaucucuauuuuuuuaggaaaacaaaaaugaaaaacua

SEQ ID NO: 510740 - RNA, 64 nt, hsa
cauuugcauauacccacauggggacauaagcuaauuuuuuuacaggacacagaauucuguucaa

SEQ ID NO: 510741 - RNA, 64 nt, hsa
aguguuugaacugcugauaauuuggauuuuuuuuuuuuuuuaacuuuggcacauugaucuaucu

SEQ ID NO: 510742 - RNA, 64 nt, hsa
gugccccugaccauuaacgacuguuuuuuuuuuuuuuuuuuaaagaauggaguuguuggggcag

SEQ ID NO: 510743 - RNA, 64 nt, hsa
acugacccccuuguuugaucaaauuuguguaaaauuuuuuuagaagagauggcuuauuaacagg

SEQ ID NO: 510744 - RNA, 64 nt, hsa
uauuccaguuguaagaauagccuuaguguuuagauuuuuuuaugauagggaagaugcggccauc

SEQ ID NO: 510745 - RNA, 64 nt, hsa
gguauuaauuuauuuuuuuaauuuuaauuuuuuuuuuuuuuacuuuagagacagggucucacug

SEQ ID NO: 510746 - RNA, 64 nt, hsa
gugugugugugugagagagaaagguauuaauuuauuuuuuuaauuuuaauuuuuuuuuuuuuua

SEQ ID NO: 510747 - RNA, 64 nt, hsa
caucaugagagugcuggucagaaacggcugccacuuuuuuuaauuuaauuuuauuuuuuauuua

SEQ ID NO: 510748 - RNA, 64 nt, hsa
uuuucucuucuuuuaagucagucuguuauaaauuuuuuuuuagucccauaagcaguagacuccc

SEQ ID NO: 510749 - RNA, 64 nt, hsa
aaaauauuuauuuuuuauaccaaaugaauacuuuuuuuuuuaagaaaaaaaagagaaaugaaua

SEQ ID NO: 510750 - RNA, 64 nt, hsa
agaugucuccgggcccuuauuuauuauuuaaacauuuuuuuaaaaagcacugcuaguuuacuug

SEQ ID NO: 510751 - RNA, 64 nt, hsa
gauguuugccaccaugcccgccucauuuuuuuucuuuuuuuauagagaugagauuuuacuaugu

SEQ ID NO: 510752 - RNA, 64 nt, hsa
aagaguugcuguagcuuuuaacuuuauaauccauuuuuuuuaagauuaaacuaauugugagaug

SEQ ID NO: 510753 - RNA, 64 nt, hsa
cugaaauauaugcauguaaaaacuuugacaucuuuuuuuuuaauuuuccacuuucuucuuaacu

SEQ ID NO: 510754 - RNA, 64 nt, hsa
ucgccuuuucuuuuuuuuuccuuuuuucuuuuuuuuuuuuuaauuuuuccccccaaccaucgug

SEQ ID NO: 510755 - RNA, 64 nt, hsa
uugaucaaaucuguacaguuucuauuguuccagauuuuuuuaaguuuguauuaaaagcaugaua

SEQ ID NO: 510756 - RNA, 64 nt, hsa
ucugcacuaauuuaccugguuucguaggaaaacuuuuuuuuauuuuuuacauuuuuuggugucc

SEQ ID NO: 510757 - RNA, 64 nt, hsa
gucucaaaucuaggcauuuuugcuucaauuuuauuuuuuuuaagaauacaaaaacagaaaucug

SEQ ID NO: 510758 - RNA, 64 nt, hsa
uuuaagaagaugaaauuacucuggauguuugguauuuuuuuacauuaaaacaaacuaaagcaaa

SEQ ID NO: 510759 - RNA, 64 nt, hsa
aauuuggacagaaugaaaagcaugcuuuugauuuuuuuuuuaaucagugagagaagucaucauu

SEQ ID NO: 510760 - RNA, 64 nt, hsa
uuguugcuacuuccuuuuguauuuucaucagguauuuuuuuaacuguaggguuuuuacuuuuuu

SEQ ID NO: 510761 - RNA, 64 nt, hsa
guuuaaauaaguuaauacuuuaaaaauuuucagguuuuuuuaguauggugaauauugauagaua

SEQ ID NO: 510762 - RNA, 64 nt, hsa
ggccuuuuuuuguuuguuucauucauuguuuuuuuuuuuuuaauuauuuuaaaugagauuuuug

SEQ ID NO: 510763 - RNA, 64 nt, hsa
uuuuuuuuuuaauuauuuuaaaugagauuuuuguuuuuuuuaaaugcaauaucucuguauacag

SEQ ID NO: 510764 - RNA, 64 nt, hsa
agguagcugaagaccuuuuagacaguuccaucuuuuuuuuuaaauuuuuucugccuauuuaaag

SEQ ID NO: 510765 - RNA, 64 nt, hsa
agaguuggcuuuaaaauguuugcaaaugucuuuuuuuuuuuaauacuggaagaaaaaauauucu

SEQ ID NO: 510766 - RNA, 64 nt, hsa
auuagagauugcugaacugcugcuaaagugauuuuuuuuuuauuugaccaaaaaaaaaaaggcc

SEQ ID NO: 510767 - RNA, 64 nt, hsa
acugaaauaucaauggguuugcauaucuaggcccuuuuuuuagaccaaugccuaugccauccuc

SEQ ID NO: 510768 - RNA, 64 nt, hsa
uaacagugaaucuccuaauuuuagcaucuuuuuuuuuuuuuacaaucauucagauugugaauuc

SEQ ID NO: 510769 - RNA, 64 nt, hsa
cacuuauauaguuauuuucucuuuaaaaaaaaauuuuuuuuaauguauuagagaugaggucuca

SEQ ID NO: 510770 - RNA, 64 nt, hsa
cuugauuuuucaggguauuagcuguauuauccauuuuuuuuacuguuauuuaauugaaaccaua

SEQ ID NO: 510771 - RNA, 64 nt, hsa
uuuuaaaguuauaaacacguacuugugcgaauuauuuuuuuaaagugauuugccauuuuugaaa

SEQ ID NO: 510772 - RNA, 64 nt, hsa
aauuacaggcaggugccaccaugcccgacuaauuuuuuuuuauuuuuaguagagacgggguuuc

SEQ ID NO: 510773 - RNA, 64 nt, hsa
auauacauguugaaguaaugguaugcaguaagauuuuuuuuaauccuauuauguuuaguuaaga

SEQ ID NO: 510774 - RNA, 64 nt, hsa
uugauuguguuccccucaagcaucauauuuuacauuuuuuuaucaucuuuuaaacagguucaug

SEQ ID NO: 510775 - RNA, 64 nt, hsa
agguggaaaauuacacugugcuuaaugacugauuuuuuuuuaaacugcgagucccuuaagauca

SEQ ID NO: 510776 - RNA, 64 nt, hsa
cuccuucauuuuuggacaacuacuguaaucauuuuuuuuuuaggaaaaauggaaggugccgggg

SEQ ID NO: 510777 - RNA, 64 nt, hsa
uuuuguuugagcuuauaagaacauagacagcuuuuuuuuuuacuaguuuuaaaacccaucuucc

SEQ ID NO: 510778 - RNA, 64 nt, hsa
uuagauuugauuucuucugucugcacaacucuucuuuuuuuaauuacaaugaaaaauuuugugu

SEQ ID NO: 510779 - RNA, 64 nt, hsa
uuacuugcucuucuuaucccacucucuucugauuuuuuuuuacuuucugcuccuuacuucucug

SEQ ID NO: 510780 - RNA, 64 nt, hsa
auuuauuuauuuaucuaucuauugaucuaucgauuuuuuuuaauuugauguuuaccuaagccuu

SEQ ID NO: 510781 - RNA, 64 nt, hsa
uuggccugaugaccaauuuuaacuuagagcuuuuuuuuuuuaauuuugucugccccaaguuuug

SEQ ID NO: 510782 - RNA, 64 nt, hsa
aguguugggguuugguuuuguuuuuugagucuuuuuuuuuuaagugaaauuuauugaggaaaaa

SEQ ID NO: 510783 - RNA, 64 nt, hsa
cucuuccacagcaguuacauaaguuuuguauuauuuuuuuuauucgugcauauuugcucauguc

SEQ ID NO: 510784 - RNA, 64 nt, hsa
gcaaguuuuacucugcaaugguccuuaaauuucuuuuuuuuaaauugccacugaggcaacccua

SEQ ID NO: 510785 - RNA, 64 nt, hsa
guaaaacaugugauuugcaaauuauuauuuuucuuuuuuuuaacaaauggaaguaaauuuguuu

SEQ ID NO: 510786 - RNA, 64 nt, hsa
caugccaccauuuuuuccuuauauuuuugcuuaauuuuuuuaaauugucauuuaauucuuaaac

SEQ ID NO: 510787 - RNA, 64 nt, hsa
uauggaaaauaaccuugcuuuugggggguuuuuguuuuuuuagaguuaauuuaguaaguuaugc

SEQ ID NO: 510788 - RNA, 64 nt, hsa
agacuuguauuggaaauuacauaccuuuuuuuuuuuuuuuuaaaggacuacagauuauuuuuaa

SEQ ID NO: 510789 - RNA, 64 nt, hsa
uuugcuaagccgcuucauucaugccuacacaauuuuuuuuuaaaagggaacuuuaguuaauuaa

SEQ ID NO: 510790 - RNA, 64 nt, hsa
guuuuaacaccaacacuguaacauuuacgaauuauuuuuuuaaacuucaguuuuacugcauuuu

SEQ ID NO: 510791 - RNA, 64 nt, hsa
uccacugacaacgaaaguaaaguaaaguauuggauuuuuuuaaagggaacaugugaaugaauac

SEQ ID NO: 510792 - RNA, 64 nt, hsa
cuacuuaaacaugaauucaugguauccugguuauuuuuuuuaagucaucugggggaaaaccugu

SEQ ID NO: 510793 - RNA, 64 nt, hsa
cugcuauuuuuugcaaguauuuuaaaugucuucauuuuuuuaagaaaggaauagcgauagauuu

SEQ ID NO: 510794 - RNA, 64 nt, hsa
cuuguuuacuuuuucugaggauuaguaaaucaauuuuuuuuaauuucaaauuuuuggauuuaca

SEQ ID NO: 510795 - RNA, 64 nt, hsa
ucaguuguacuuaauauuuaguggaaaguaauaauuuuuuuaauuuucuaucaacuaauaguau

SEQ ID NO: 510796 - RNA, 64 nt, hsa
gagaaaaugaugagaauuagcuaacauuuuuaaguuuuuuuaaacuuucuuccccucaguugua

SEQ ID NO: 510797 - RNA, 64 nt, hsa
uuuucuuauguuguguuacuaauguaauuuauauuuuuuuuagauccucccuuuccuauagaga

SEQ ID NO: 510798 - RNA, 64 nt, hsa
gcuuuuccaaagaggcugaugucuuuguuuuuguuuuuuuuaauguuucagguucuaagugaag

SEQ ID NO: 510799 - RNA, 64 nt, hsa
cuuacauuuuuuuaaauuguuucagaguuuguuuuuuuuuuaguuuagauugugaggcaauuau

SEQ ID NO: 510800 - RNA, 64 nt, hsa
caucaucauguucuuuuaccccaguuuccuuacauuuuuuuaaauuguuucagaguuuguuuuu

SEQ ID NO: 510801 - RNA, 64 nt, hsa
aaaugccaaucuuccauauuaguuuuacuuuuuuuuuuuuuaaauagggcauaccauuucuucc

SEQ ID NO: 510802 - RNA, 64 nt, hsa
uaauggauuguuaaaaucauagaaagaucuuuuauuuuuuuaggaaucaaugacuuaacagaac

SEQ ID NO: 510803 - RNA, 64 nt, hsa
auagcauauuaguaaacaucuggauaaagguaauuuuuuuuagcaauuuagagcaauucuauau

SEQ ID NO: 510804 - RNA, 64 nt, hsa
uguaguuucaauuuaauaaucacauuagguuuaauuuuuuuacaucauagcauauuaguaaaca

SEQ ID NO: 510805 - RNA, 64 nt, hsa
uugaauacagauuugcugaacaguuuugauguuauuuuuuuaauaaaauuuguauuguuaaagu

SEQ ID NO: 510806 - RNA, 64 nt, hsa
cuuguuucuugcucauauauauauagauguauauuuuuuuuaauuucuuguuuguuuauuuugg

SEQ ID NO: 510807 - RNA, 64 nt, hsa
acugcacccgaccgauacucacauuuuuaaacuuuuuuuuuaauuuuauuuugguagcuagguu

SEQ ID NO: 510808 - RNA, 64 nt, hsa
uucagcaauacugauauucacuuuauuuuuuuucuuuuuuuaagacagagucuugcucugucac

SEQ ID NO: 510809 - RNA, 64 nt, hsa
auucaucaugauuuaaauuuucuagagauuuugauuuuuuuauaauguuucuuuccuguagauu

SEQ ID NO: 510810 - RNA, 64 nt, hsa
uuacugaguagaaauugacuaaacuuugauuuccuuuuuuuaaaucguguugcauuugauuccu

SEQ ID NO: 510811 - RNA, 64 nt, hsa
uuaucacauguucacacuuggguuuagggguguuuuuuuuuaaaaccaggcagguuagcuagcc

SEQ ID NO: 510812 - RNA, 64 nt, hsa
ugccuuaucuggagagacguggaggugauuuucuuuuuuuuaaauuauuauuaagacagaaugu

SEQ ID NO: 510813 - RNA, 64 nt, hsa
uagcuaugucuauuuuauaucagucacugagacuuuuuuuuaaguuuuuauuuauuauuaagac

SEQ ID NO: 510814 - RNA, 64 nt, hsa
gguugugguccagacaccaagaaucauagggguuuuuuuuuaaaaaaccuaauagaaguagggu

SEQ ID NO: 510815 - RNA, 64 nt, hsa
gauaaccucuuuuagagaacaaauaagugacuuauuuuuuuaaagcuagaugacuuugaaaugc

SEQ ID NO: 510816 - RNA, 64 nt, hsa
ggccaugaugauuacauuugugguuccaaaauaauuuuuuuaaauauuaauagcccauauacaa

SEQ ID NO: 510817 - RNA, 64 nt, hsa; identical to SEQ ID NO: 243333

SEQ ID NO: 510818 - RNA, 64 nt, hsa; identical to SEQ ID NO: 243334

SEQ ID NO: 510819 - RNA, 64 nt, hsa; identical to SEQ ID NO: 243335

SEQ ID NO: 510820 - RNA, 64 nt, hsa; identical to SEQ ID NO: 243336

SEQ ID NO: 510821 - RNA, 64 nt, hsa; identical to SEQ ID NO: 243337

SEQ ID NO: 510822 - RNA, 64 nt, hsa; identical to SEQ ID NO: 243338

SEQ ID NO: 510823 - RNA, 64 nt, hsa; identical to SEQ ID NO: 243339

SEQ ID NO: 510824 - RNA, 64 nt, hsa; identical to SEQ ID NO: 243340

SEQ ID NO: 510825 - RNA, 64 nt, hsa; identical to SEQ ID NO: 243341

SEQ ID NO: 510826 - RNA, 64 nt, hsa; identical to SEQ ID NO: 243342

SEQ ID NO: 510827 - RNA, 64 nt, hsa; identical to SEQ ID NO: 243343

SEQ ID NO: 510828 - RNA, 64 nt, hsa; identical to SEQ ID NO: 243344

SEQ ID NO: 510829 - RNA, 64 nt, hsa; identical to SEQ ID NO: 175633

SEQ ID NO: 510830 - RNA, 64 nt, hsa; identical to SEQ ID NO: 175634

SEQ ID NO: 510831 - RNA, 64 nt, hsa; identical to SEQ ID NO: 175635

SEQ ID NO: 510832 - RNA, 64 nt, hsa; identical to SEQ ID NO: 175636

SEQ ID NO: 510833 - RNA, 64 nt, hsa; identical to SEQ ID NO: 175637

SEQ ID NO: 510834 - RNA, 64 nt, hsa; identical to SEQ ID NO: 175638

SEQ ID NO: 510835 - RNA, 64 nt, hsa; identical to SEQ ID NO: 175639

SEQ ID NO: 510836 - RNA, 64 nt, hsa; identical to SEQ ID NO: 175640

SEQ ID NO: 510837 - RNA, 64 nt, hsa; identical to SEQ ID NO: 175641

SEQ ID NO: 510838 - RNA, 64 nt, hsa; identical to SEQ ID NO: 175642

SEQ ID NO: 510839 - RNA, 64 nt, hsa; identical to SEQ ID NO: 175643

SEQ ID NO: 510840 - RNA, 64 nt, hsa; identical to SEQ ID NO: 175644

SEQ ID NO: 510841 - RNA, 64 nt, hsa; identical to SEQ ID NO: 175645

SEQ ID NO: 510842 - RNA, 64 nt, hsa; identical to SEQ ID NO: 175646

SEQ ID NO: 510843 - RNA, 64 nt, hsa; identical to SEQ ID NO: 175647

SEQ ID NO: 510844 - RNA, 64 nt, hsa; identical to SEQ ID NO: 175648

SEQ ID NO: 510845 - RNA, 64 nt, hsa; identical to SEQ ID NO: 175649

SEQ ID NO: 510846 - RNA, 64 nt, hsa; identical to SEQ ID NO: 175650

SEQ ID NO: 510847 - RNA, 64 nt, hsa; identical to SEQ ID NO: 175651

SEQ ID NO: 510848 - RNA, 64 nt, hsa; identical to SEQ ID NO: 175652

SEQ ID NO: 510849 - RNA, 64 nt, hsa; identical to SEQ ID NO: 175653

SEQ ID NO: 510850 - RNA, 64 nt, hsa; identical to SEQ ID NO: 175654

SEQ ID NO: 510851 - RNA, 64 nt, hsa; identical to SEQ ID NO: 175655

SEQ ID NO: 510852 - RNA, 64 nt, hsa; identical to SEQ ID NO: 175656

SEQ ID NO: 510853 - RNA, 64 nt, hsa; identical to SEQ ID NO: 175657

SEQ ID NO: 510854 - RNA, 64 nt, hsa; identical to SEQ ID NO: 175658

SEQ ID NO: 510855 - RNA, 64 nt, hsa; identical to SEQ ID NO: 175659

SEQ ID NO: 510856 - RNA, 64 nt, hsa; identical to SEQ ID NO: 175660

SEQ ID NO: 510857 - RNA, 64 nt, hsa; identical to SEQ ID NO: 175661

SEQ ID NO: 510858 - RNA, 64 nt, hsa; identical to SEQ ID NO: 175662

SEQ ID NO: 510859 - RNA, 64 nt, hsa; identical to SEQ ID NO: 175663

SEQ ID NO: 510860 - RNA, 64 nt, hsa; identical to SEQ ID NO: 175664

SEQ ID NO: 510861 - RNA, 64 nt, hsa; identical to SEQ ID NO: 175665

SEQ ID NO: 510862 - RNA, 64 nt, hsa; identical to SEQ ID NO: 175666

SEQ ID NO: 510863 - RNA, 64 nt, hsa; identical to SEQ ID NO: 175667

SEQ ID NO: 510864 - RNA, 64 nt, hsa; identical to SEQ ID NO: 175668

SEQ ID NO: 510865 - RNA, 64 nt, hsa; identical to SEQ ID NO: 175669

SEQ ID NO: 510866 - RNA, 64 nt, hsa; identical to SEQ ID NO: 175670

SEQ ID NO: 510867 - RNA, 64 nt, hsa; identical to SEQ ID NO: 175671

SEQ ID NO: 510868 - RNA, 64 nt, hsa; identical to SEQ ID NO: 175672

SEQ ID NO: 510869 - RNA, 64 nt, hsa; identical to SEQ ID NO: 175673

SEQ ID NO: 510870 - RNA, 64 nt, hsa; identical to SEQ ID NO: 175674

SEQ ID NO: 510871 - RNA, 64 nt, hsa; identical to SEQ ID NO: 175675

SEQ ID NO: 510872 - RNA, 64 nt, hsa; identical to SEQ ID NO: 175676

SEQ ID NO: 510873 - RNA, 64 nt, hsa; identical to SEQ ID NO: 175677

SEQ ID NO: 510874 - RNA, 64 nt, hsa; identical to SEQ ID NO: 175678

SEQ ID NO: 510875 - RNA, 64 nt, hsa; identical to SEQ ID NO: 175679

SEQ ID NO: 510876 - RNA, 64 nt, hsa; identical to SEQ ID NO: 175680

SEQ ID NO: 510877 - RNA, 64 nt, hsa; identical to SEQ ID NO: 175681

SEQ ID NO: 510878 - RNA, 64 nt, hsa; identical to SEQ ID NO: 175682

SEQ ID NO: 510879 - RNA, 64 nt, hsa; identical to SEQ ID NO: 175683

SEQ ID NO: 510880 - RNA, 64 nt, hsa; identical to SEQ ID NO: 175684

SEQ ID NO: 510881 - RNA, 64 nt, hsa; identical to SEQ ID NO: 175685

SEQ ID NO: 510882 - RNA, 64 nt, hsa; identical to SEQ ID NO: 175686

SEQ ID NO: 510883 - RNA, 64 nt, hsa; identical to SEQ ID NO: 175687

SEQ ID NO: 510884 - RNA, 64 nt, hsa; identical to SEQ ID NO: 175688

SEQ ID NO: 510885 - RNA, 64 nt, hsa; identical to SEQ ID NO: 175689

SEQ ID NO: 510886 - RNA, 64 nt, hsa; identical to SEQ ID NO: 175690

SEQ ID NO: 510887 - RNA, 64 nt, hsa; identical to SEQ ID NO: 175691

SEQ ID NO: 510888 - RNA, 64 nt, hsa; identical to SEQ ID NO: 175692

SEQ ID NO: 510889 - RNA, 64 nt, hsa; identical to SEQ ID NO: 175693

SEQ ID NO: 510890 - RNA, 64 nt, hsa; identical to SEQ ID NO: 175694

SEQ ID NO: 510891 - RNA, 64 nt, hsa; identical to SEQ ID NO: 175695

SEQ ID NO: 510892 - RNA, 64 nt, hsa; identical to SEQ ID NO: 175696

SEQ ID NO: 510893 - RNA, 64 nt, hsa; identical to SEQ ID NO: 175697

SEQ ID NO: 510894 - RNA, 64 nt, hsa; identical to SEQ ID NO: 175698

SEQ ID NO: 510895 - RNA, 64 nt, hsa; identical to SEQ ID NO: 175699

SEQ ID NO: 510896 - RNA, 64 nt, hsa; identical to SEQ ID NO: 175700

SEQ ID NO: 510897 - RNA, 64 nt, hsa; identical to SEQ ID NO: 175701

SEQ ID NO: 510898 - RNA, 64 nt, hsa; identical to SEQ ID NO: 175702

SEQ ID NO: 510899 - RNA, 64 nt, hsa; identical to SEQ ID NO: 175703

SEQ ID NO: 510900 - RNA, 64 nt, hsa; identical to SEQ ID NO: 175704

SEQ ID NO: 510901 - RNA, 64 nt, hsa; identical to SEQ ID NO: 175705

SEQ ID NO: 510902 - RNA, 64 nt, hsa; identical to SEQ ID NO: 175706

SEQ ID NO: 510903 - RNA, 64 nt, hsa; identical to SEQ ID NO: 175707

SEQ ID NO: 510904 - RNA, 64 nt, hsa; identical to SEQ ID NO: 175708

SEQ ID NO: 510905 - RNA, 64 nt, hsa; identical to SEQ ID NO: 175709

SEQ ID NO: 510906 - RNA, 64 nt, hsa; identical to SEQ ID NO: 175710

SEQ ID NO: 510907 - RNA, 64 nt, hsa; identical to SEQ ID NO: 175711

SEQ ID NO: 510908 - RNA, 64 nt, hsa; identical to SEQ ID NO: 175712

SEQ ID NO: 510909 - RNA, 64 nt, hsa; identical to SEQ ID NO: 175713

SEQ ID NO: 510910 - RNA, 64 nt, hsa; identical to SEQ ID NO: 175714

SEQ ID NO: 510911 - RNA, 64 nt, hsa; identical to SEQ ID NO: 175715

SEQ ID NO: 510912 - RNA, 64 nt, hsa; identical to SEQ ID NO: 175716

SEQ ID NO: 510913 - RNA, 64 nt, hsa; identical to SEQ ID NO: 175717

SEQ ID NO: 510914 - RNA, 64 nt, hsa; identical to SEQ ID NO: 175718

SEQ ID NO: 510915 - RNA, 64 nt, hsa; identical to SEQ ID NO: 175719

SEQ ID NO: 510916 - RNA, 64 nt, hsa; identical to SEQ ID NO: 175720

SEQ ID NO: 510917 - RNA, 64 nt, hsa; identical to SEQ ID NO: 175721

SEQ ID NO: 510918 - RNA, 64 nt, hsa; identical to SEQ ID NO: 175722

SEQ ID NO: 510919 - RNA, 64 nt, hsa; identical to SEQ ID NO: 175723

SEQ ID NO: 510920 - RNA, 64 nt, hsa; identical to SEQ ID NO: 175724

SEQ ID NO: 510921 - RNA, 64 nt, hsa; identical to SEQ ID NO: 175725

SEQ ID NO: 510922 - RNA, 64 nt, hsa; identical to SEQ ID NO: 175726

SEQ ID NO: 510923 - RNA, 64 nt, hsa; identical to SEQ ID NO: 175727

SEQ ID NO: 510924 - RNA, 64 nt, hsa
gauggggagggagugggccuggaucugggaccucccuccagaauuuccuccagaugggggcagu

SEQ ID NO: 510925 - RNA, 64 nt, hsa
gugggccuggaucugggaccucccuccagaauuuccuccagaugggggcagugcccagggaggg

SEQ ID NO: 510926 - RNA, 57 nt, hsa
agagugaguccaaggugugaccagcuuccuccagaccccuguggcagaccgggggcc

SEQ ID NO: 510927 - RNA, 64 nt, hsa
caccccugugcaaauuuuaaaaaggaacccuuuuccuccagacagauacagccccaaaccaggg

SEQ ID NO: 510928 - RNA, 64 nt, hsa
agugcauguggaaaguaucagaguaaggcucuccccuccagagcccugaguuucuuggcugcau

SEQ ID NO: 510929 - RNA, 64 nt, hsa
ugcuuuccuagauccacacuuucaaagagaaaccccuccagaacucccacccugacagcccaac

SEQ ID NO: 510930 - RNA, 64 nt, hsa
aagcagauuaaccccaggcagaccgauaaaaagaccuccagauaggcagacagacagauggacc

SEQ ID NO: 510931 - RNA, 64 nt, hsa
cuugauggauggaccccagcuagucagacaugauccuccagauugacagacaagucccccaaau

SEQ ID NO: 510932 - RNA, 64 nt, hsa
cugccuguauuggucccuucugaccacucuccugccuccagagaaagcucugcuucacccugga

SEQ ID NO: 510933 - RNA, 64 nt, hsa
gaaagccaguggcuccuuucucccuuccucuuggccuccagauuuugaaugguuccuuguucuu

SEQ ID NO: 510934 - RNA, 64 nt, hsa
augacccuuaagugccacccuucuuggaagacccccuccagaagcauacuggaagccaccucug

SEQ ID NO: 510935 - RNA, 64 nt, hsa
auaccauucccauuuucucagccucuucucacugccuccagagaggugggugccuggguugaga

SEQ ID NO: 510936 - RNA, 64 nt, hsa
ugcccacagaccugucgggugcuccugugaguggccuccagaugucuuugugcauaggcacaag

SEQ ID NO: 510937 - RNA, 64 nt, hsa
gccuggugccaacaggggcaucccggcccauaccccuccagacaggaagcauggguuugcccac

SEQ ID NO: 510938 - RNA, 64 nt, hsa
uguccuuucaaggggaaaaugugaagcugaacccccuccagacacccagaauguagcaucugag

SEQ ID NO: 510939 - RNA, 64 nt, hsa
ccacagcugcuggccaggguagacuuggagcuguccuccagaggggucacguguaggagugaga

SEQ ID NO: 510940 - RNA, 64 nt, hsa
gaggcguccugucuucacgggggggucccgguggccuccagacguagccauuuccugacaucaa

SEQ ID NO: 510941 - RNA, 64 nt, hsa
aaguaaacuggaaaugagacauugacgugcugcuccuccagaggucugcacacuccacuucaca

SEQ ID NO: 510942 - RNA, 64 nt, hsa
guucauauaccugccugagauaggcugguccucaccuccagagccagccagccccgucaggggc

SEQ ID NO: 510943 - RNA, 64 nt, hsa
uagagcgagagcagagcaaacugcgcagcaggcaccuccagaaagguaaugguggcagaaccca

SEQ ID NO: 510944 - RNA, 64 nt, hsa
agagugaccguggcacuuggguguacagguaauuccuccagagcuguuugcuggcuucaggagu

SEQ ID NO: 510945 - RNA, 64 nt, hsa
auugcauucugccguguuuauagguguucacuuuccuccagagcugauuaacuacugacaugac

SEQ ID NO: 510946 - RNA, 64 nt, hsa
acuacugcuucugucccugcuggcagccucugucccuccagaacggcuaaccagagcacacugu

SEQ ID NO: 510947 - RNA, 64 nt, hsa
uggccugcccguacuccuccacccagaugagggcccuccagagccugcaggcaucuguggggaa

SEQ ID NO: 510948 - RNA, 64 nt, hsa
aacugcagugaccaguggguguggcuggguccagccuccagaucuggcccgcacgaugccuugc

SEQ ID NO: 510949 - RNA, 64 nt, hsa
agucacucugaaagggaguuguggagaggagacgccuccagacucucagaaguuuugaggacug

SEQ ID NO: 510950 - RNA, 64 nt, hsa
augucugcuggcaccuugaucuuggaccucccagccuccagaacugugagaaauaaauguguuu

SEQ ID NO: 510951 - RNA, 64 nt, hsa
ucauacaacauacuuaaugcagggcuacacugaaccuccagaaucauuuuguuugcuuugaccc

SEQ ID NO: 510952 - RNA, 64 nt, hsa
agucaccaggagaugaggguuaggugugcccagcccuccagacccggccuuucugguuaacccc

SEQ ID NO: 510953 - RNA, 64 nt, hsa
uggagguuuuuaagcaguacgugccuccaaguuaccuccagaucagcaggcacaggugggcauu

SEQ ID NO: 510954 - RNA, 64 nt, hsa
gacugcaaggcccaccugccccucccccacagagccuccagagcuagcugaggccaacgcaggc

SEQ ID NO: 510955 - RNA, 64 nt, hsa
gagcucgagagccagacggccagacaggcagaccccuccagaggcccgccaggugggcaugguc

SEQ ID NO: 510956 - RNA, 64 nt, hsa
uugaguacuuauggcccugaaagcggccacggugccuccagauggcagguuugcaauccaagca

SEQ ID NO: 510957 - RNA, 64 nt, hsa
agauauaccugauauauuccaccaggauauccucccuccagauauacuugguucucuccaccag

SEQ ID NO: 510958 - RNA, 64 nt, hsa
acaaggcgucgaggaauuggaaagauuugcacacccuccagaaaggagagacgcaaucuccccu

SEQ ID NO: 510959 - RNA, 64 nt, hsa
gcgguuccucuccacgcaucucgaggcggcguuaccuccagauuccguagaguuagagucacau

SEQ ID NO: 510960 - RNA, 64 nt, hsa
ugugugcuggucuaaauuaauccaucgcagugauccuccagagacagcgcucugcucauguccg

SEQ ID NO: 510961 - RNA, 64 nt, hsa
aaccgagaaugaggagcccucccugccccaccguccuccagagaaugcgccccuccugguuccc

SEQ ID NO: 510962 - RNA, 64 nt, hsa
ggggagcauccuaaaaaugggguccaggcagaccccuccagaccucacacugccgaggaggccu

SEQ ID NO: 510963 - RNA, 64 nt, hsa
aauggagccugucucaggaaggccagcugcagguccuccagaaaaucaaagaagggaagaaacu

SEQ ID NO: 510964 - RNA, 64 nt, hsa
agaggaacgguguuauggacugaauguucauguuccuccagaauucauaugcugaagccucugu

SEQ ID NO: 510965 - RNA, 64 nt, hsa
gcgucugcuggcaccuugaucuugaacuucccagccuccagaacugugagaaagaaaucucuau

SEQ ID NO: 510966 - RNA, 64 nt, hsa
uacuaaggugcuaggaauucguaaucauccccauccuccagagaaacccagggaggaagacugu

SEQ ID NO: 510967 - RNA, 64 nt, hsa
cuugaccucaucucccgagcaauggcgccugcucccuccagaauggaacucaagcugguuuuaa

SEQ ID NO: 510968 - RNA, 64 nt, hsa
cuuuggccaccaguucuucggccagcaccucugcccuccagaaccugcagccuggaggggugag

SEQ ID NO: 510969 - RNA, 64 nt, hsa
cucuucucccgucugcccugcggguugcccgccuccuccagagacuugcccaagggcccaucac

SEQ ID NO: 510970 - RNA, 64 nt, hsa
uuacauugcaaagccuuacucuaaaagcucccagccuccagaggcucucaaugaagagucaccu

SEQ ID NO: 510971 - RNA, 64 nt, hsa
aaagccccagguugagagaacagaggccuagggaccuccagaccauuggaaucacuguuugcca

SEQ ID NO: 510972 - RNA, 64 nt, hsa
gggccggggcaagcacuucaucggagacuuccugccuccagacgagcuggaaaaguuuauggag

SEQ ID NO: 510973 - RNA, 64 nt, hsa
uagcggacgggggucccgagguggaaaccauugcccuccagaacaaccgugagaaccaggcauu

SEQ ID NO: 510974 - RNA, 64 nt, hsa
caucuccuggauucaaacaauucuccugccucagccuccagaauagcugggauuacaggcguac

SEQ ID NO: 510975 - RNA, 64 nt, hsa
gcagcagaucuuggaugguccaggcucuaugugaccuccagagcaaagagaaagacuucggaca

SEQ ID NO: 510976 - RNA, 64 nt, hsa
cccagugccucaccuccagauccugcuggcaucaccuccagagcccugcaugcacuggcugaag

SEQ ID NO: 510977 - RNA, 64 nt, hsa
ucuccgggugucugagaaaccacccagugccucaccuccagauccugcuggcaucaccuccaga

SEQ ID NO: 510978 - RNA, 64 nt, hsa
ugcuauccugggagaucuaccugaaggagaacuaccuccagaaccgacaguuccagcaaaagca

SEQ ID NO: 510979 - RNA, 64 nt, hsa
ggcgcaucccacucuaugcgaaccacaagacccuccuccagaaggcagccgcugaguucggggc

SEQ ID NO: 510980 - RNA, 64 nt, hsa
auguggaaacaaagcaggaccagcaggcacagcaccuccagaacagugccccggaugaccagag

SEQ ID NO: 510981 - RNA, 64 nt, hsa
uugcccagaggcaacccuugccagucuguuuaucccuccagauacagucucugauaguaaacuu

SEQ ID NO: 510982 - RNA, 64 nt, hsa
auucugucuggggacgaaggguuggacgggaugaccuccagaagucccuucaauuucuaguacc

SEQ ID NO: 510983 - RNA, 64 nt, hsa
agaugaccugccccaaguggugagcaagcaccaaccuccagacucagcagagugaggggguaaa

SEQ ID NO: 510984 - RNA, 64 nt, hsa
ccgucacuagcccaaguguuuuguauuacucagacaccaucaugaaauaauucugugaggucau

SEQ ID NO: 510985 - RNA, 64 nt, hsa
aggcucagacaggcaucaacaaaccuauucaccccaccaucauccugaucuaaccauuccccag

SEQ ID NO: 510986 - RNA, 64 nt, hsa
ccccacuaaagggcuccccaggccugggaucugacaccaucaccaguaggagaccucaguguuu

SEQ ID NO: 510987 - RNA, 53 nt, hsa
ccuugguccacucugagugaggccaccaucacccaccacacccugcccacucc

SEQ ID NO: 510988 - RNA, 64 nt, hsa
ugagaauuucuggacuguguccugauggacgcagcaccaucaaagcccagaauuucugaaaacg

SEQ ID NO: 510989 - RNA, 64 nt, hsa
uguacauccacacagcacccuaaggagccauagucaccaucaaagacucaacccuaaggcccuu

SEQ ID NO: 510990 - RNA, 64 nt, hsa
ccccuguuccccugaucuagugcucaggacccuucaccaucaggaauuccuuccugucaucuaa

SEQ ID NO: 510991 - RNA, 64 nt, hsa
cuuagugugccccagcagucuggcugcguccagccaccaucacccggaaggaugcccacaaggc

SEQ ID NO: 510992 - RNA, 64 nt, hsa
gugcaaguguuuuauaaaaaauaaaacaaaaacccaccaucacaaaaaaaaaaauuuugcagcg

SEQ ID NO: 510993 - RNA, 64 nt, hsa
uacuucaccuaccucauaggggagguugugaggccaccaucaccugaccugggggucaaggcag

SEQ ID NO: 510994 - RNA, 64 nt, hsa
uggugaucaucgacgaggcgcacaaccugaucgacaccaucacgggcaugcacagcguggaggu

SEQ ID NO: 510995 - RNA, 64 nt, hsa
gagaaaggggcuguggucagcugggaucuucugccaccaucagggacaaacgggggcaggagga

SEQ ID NO: 510996 - RNA, 64 nt, hsa
augcaauauuaucacauguguagauucaugugaccaccaucacaagagacagaacaguucuguc

SEQ ID NO: 510997 - RNA, 64 nt, hsa
gggacgugccuggccuaaggcauccuaccaacagcaccaucaaggcacguuggagcuuucuugc

SEQ ID NO: 510998 - RNA, 64 nt, hsa
aaugucgcugcauucagcugucuggacaaacagacaccaucagugagcgagaggucagggcacg

SEQ ID NO: 510999 - RNA, 64 nt, hsa
aggcgcucaggcauaccgugcggaacgaccguaccaccaucaggcgcgcgcucucccagaaaca

SEQ ID NO: 511000 - RNA, 64 nt, hsa
ccaucuuugagguggacccccgagggugccccuucaccaucaagcucagcgcccggaaguaagu

SEQ ID NO: 511001 - RNA, 64 nt, hsa
ccaggugcaaacucuacagcggcucugcagacugcaccaucauugugaguggggccuacaggcg

SEQ ID NO: 511002 - RNA, 64 nt, hsa
agccccuccaucugcccugggguggaggcaccaucaccaucaccaggcaugucugcagagccug

SEQ ID NO: 511003 - RNA, 64 nt, hsa
aguagaagccccuccaucugcccugggguggaggcaccaucaccaucaccaggcaugucugcag

SEQ ID NO: 511004 - RNA, 64 nt, hsa
aaaguggagcaguggcauuuccaugccucaugcucaccaucaugagguuaacuucccgccgucg

SEQ ID NO: 511005 - RNA, 64 nt, hsa
cucagccucccgaguagcugggauugcaggcaugcaccaucacaccuggcuaauuuuguauuuu

SEQ ID NO: 511006 - RNA, 64 nt, hsa
ugcauugcaucaucaccaugguaacaguucccaucaccaucaccaccaccaccaccaucaccac

SEQ ID NO: 511007 - RNA, 64 nt, hsa
ugguaacaguucccaucaccaucaccaccaccaccaccaucaccaccaccauggacaacaagcc

SEQ ID NO: 511008 - RNA, 64 nt, hsa; identical to SEQ ID NO: 277176

SEQ ID NO: 511009 - RNA, 64 nt, hsa; identical to SEQ ID NO: 277177

SEQ ID NO: 511010 - RNA, 64 nt, hsa; identical to SEQ ID NO: 277178

SEQ ID NO: 511011 - RNA, 64 nt, hsa; identical to SEQ ID NO: 277179

SEQ ID NO: 511012 - RNA, 64 nt, hsa; identical to SEQ ID NO: 277180

SEQ ID NO: 511013 - RNA, 64 nt, hsa; identical to SEQ ID NO: 277181

SEQ ID NO: 511014 - RNA, 64 nt, hsa; identical to SEQ ID NO: 277182

SEQ ID NO: 511015 - RNA, 64 nt, hsa; identical to SEQ ID NO: 277183

SEQ ID NO: 511016 - RNA, 64 nt, hsa; identical to SEQ ID NO: 277184

SEQ ID NO: 511017 - RNA, 64 nt, hsa; identical to SEQ ID NO: 277185

SEQ ID NO: 511018 - RNA, 52 nt, hsa; identical to SEQ ID NO: 277186

SEQ ID NO: 511019 - RNA, 64 nt, hsa; identical to SEQ ID NO: 277187

SEQ ID NO: 511020 - RNA, 64 nt, hsa; identical to SEQ ID NO: 277188

SEQ ID NO: 511021 - RNA, 64 nt, hsa; identical to SEQ ID NO: 277189

SEQ ID NO: 511022 - RNA, 64 nt, hsa; identical to SEQ ID NO: 277190

SEQ ID NO: 511023 - RNA, 64 nt, hsa; identical to SEQ ID NO: 277191

SEQ ID NO: 511024 - RNA, 64 nt, hsa; identical to SEQ ID NO: 277192

SEQ ID NO: 511025 - RNA, 64 nt, hsa; identical to SEQ ID NO: 277193

SEQ ID NO: 511026 - RNA, 64 nt, hsa; identical to SEQ ID NO: 277194

SEQ ID NO: 511027 - RNA, 64 nt, hsa; identical to SEQ ID NO: 277195

SEQ ID NO: 511028 - RNA, 64 nt, hsa; identical to SEQ ID NO: 277196

SEQ ID NO: 511029 - RNA, 64 nt, hsa; identical to SEQ ID NO: 277197

SEQ ID NO: 511030 - RNA, 64 nt, hsa; identical to SEQ ID NO: 277198

SEQ ID NO: 511031 - RNA, 64 nt, hsa; identical to SEQ ID NO: 277199

SEQ ID NO: 511032 - RNA, 64 nt, hsa; identical to SEQ ID NO: 53544

SEQ ID NO: 511033 - RNA, 64 nt, hsa; identical to SEQ ID NO: 53545

SEQ ID NO: 511034 - RNA, 64 nt, hsa; identical to SEQ ID NO: 53546

SEQ ID NO: 511035 - RNA, 64 nt, hsa; identical to SEQ ID NO: 53547

SEQ ID NO: 511036 - RNA, 64 nt, hsa; identical to SEQ ID NO: 53548

SEQ ID NO: 511037 - RNA, 64 nt, hsa; identical to SEQ ID NO: 53549

SEQ ID NO: 511038 - RNA, 64 nt, hsa; identical to SEQ ID NO: 53550

SEQ ID NO: 511039 - RNA, 64 nt, hsa; identical to SEQ ID NO: 53551

SEQ ID NO: 511040 - RNA, 64 nt, hsa; identical to SEQ ID NO: 53552

SEQ ID NO: 511041 - RNA, 64 nt, hsa; identical to SEQ ID NO: 53553

SEQ ID NO: 511042 - RNA, 64 nt, hsa; identical to SEQ ID NO: 53554

SEQ ID NO: 511043 - RNA, 64 nt, hsa; identical to SEQ ID NO: 53555

SEQ ID NO: 511044 - RNA, 64 nt, hsa; identical to SEQ ID NO: 53556

SEQ ID NO: 511045 - RNA, 64 nt, hsa; identical to SEQ ID NO: 53557

SEQ ID NO: 511046 - RNA, 64 nt, hsa; identical to SEQ ID NO: 53558

SEQ ID NO: 511047 - RNA, 64 nt, hsa; identical to SEQ ID NO: 53559

SEQ ID NO: 511048 - RNA, 64 nt, hsa; identical to SEQ ID NO: 53560

SEQ ID NO: 511049 - RNA, 64 nt, hsa; identical to SEQ ID NO: 53561

SEQ ID NO: 511050 - RNA, 64 nt, hsa; identical to SEQ ID NO: 53562

SEQ ID NO: 511051 - RNA, 64 nt, hsa; identical to SEQ ID NO: 53563

SEQ ID NO: 511052 - RNA, 64 nt, hsa; identical to SEQ ID NO: 53564

SEQ ID NO: 511053 - RNA, 64 nt, hsa; identical to SEQ ID NO: 53565

SEQ ID NO: 511054 - RNA, 64 nt, hsa; identical to SEQ ID NO: 53566

SEQ ID NO: 511055 - RNA, 64 nt, hsa; identical to SEQ ID NO: 53567

SEQ ID NO: 511056 - RNA, 64 nt, hsa; identical to SEQ ID NO: 53568

SEQ ID NO: 511057 - RNA, 64 nt, hsa; identical to SEQ ID NO: 53569

SEQ ID NO: 511058 - RNA, 64 nt, hsa; identical to SEQ ID NO: 53570

SEQ ID NO: 511059 - RNA, 64 nt, hsa; identical to SEQ ID NO: 53571

SEQ ID NO: 511060 - RNA, 64 nt, hsa; identical to SEQ ID NO: 53572

SEQ ID NO: 511061 - RNA, 64 nt, hsa; identical to SEQ ID NO: 53573

SEQ ID NO: 511062 - RNA, 64 nt, hsa; identical to SEQ ID NO: 53574

SEQ ID NO: 511063 - RNA, 64 nt, hsa; identical to SEQ ID NO: 53575

SEQ ID NO: 511064 - RNA, 64 nt, hsa; identical to SEQ ID NO: 53576

SEQ ID NO: 511065 - RNA, 64 nt, hsa; identical to SEQ ID NO: 53577

SEQ ID NO: 511066 - RNA, 64 nt, hsa; identical to SEQ ID NO: 53578

SEQ ID NO: 511067 - RNA, 64 nt, hsa; identical to SEQ ID NO: 53579

SEQ ID NO: 511068 - RNA, 64 nt, hsa; identical to SEQ ID NO: 53580

SEQ ID NO: 511069 - RNA, 64 nt, hsa; identical to SEQ ID NO: 53580

SEQ ID NO: 511070 - RNA, 64 nt, hsa; identical to SEQ ID NO: 53582

SEQ ID NO: 511071 - RNA, 64 nt, hsa; identical to SEQ ID NO: 53583

SEQ ID NO: 511072 - RNA, 64 nt, hsa; identical to SEQ ID NO: 53584

SEQ ID NO: 511073 - RNA, 64 nt, hsa; identical to SEQ ID NO: 53585

SEQ ID NO: 511074 - RNA, 64 nt, hsa; identical to SEQ ID NO: 53586

SEQ ID NO: 511075 - RNA, 64 nt, hsa
aacauaauuguuguagcauaauauuaauagugcaaaaguacauauaagucauuuugaugaaaaa

SEQ ID NO: 511076 - RNA, 64 nt, hsa
uuuguaucucauuaauuuuaucaaaaugaaacuaaaaguacauauguauuauacacuugaacau

SEQ ID NO: 511077 - RNA, 64 nt, hsa
gguauuugaauuuuaaauuaaagcaaaguaaauaaaaguacaaagcauauuuuaguuaguacua

SEQ ID NO: 511078 - RNA, 64 nt, hsa
aauuuuuuaaaugaaagaaguuguaaggauauaaaaaguacaguguuagaugugcacaaggaaa

SEQ ID NO: 511079 - RNA, 64 nt, hsa
uaugcccuauguaacagcagaguaacauaaaauaaaaguacauuuuauaaaccauuuacuaugg

SEQ ID NO: 511080 - RNA, 64 nt, hsa
cauuucuuaauacacuagaaaggggaaauaaauuaaaguacacaaguccaagucuaaaacuuua

SEQ ID NO: 511081 - RNA, 64 nt, hsa
auauugauuucaagucuccuaauuuggaauggguaaaguacaaauguuaaugcaacauaguaca

SEQ ID NO: 511082 - RNA, 64 nt, hsa
ucuucagagacaaauguuacuuaaucaggaauacaaaguacagauuuuuuacauuuuagaggaa

SEQ ID NO: 511083 - RNA, 64 nt, hsa
gugugcauaauagcuacagugcauaguuguagacaaaguacauucuggggaaacaacauuuaua

SEQ ID NO: 511084 - RNA, 64 nt, hsa
aauaauauaugccuuguauaauauugaaaauugaaaaguacaacuaacgcaaccaagugugcua

SEQ ID NO: 511085 - RNA, 64 nt, hsa
acuccaaggugauguuguaccucuuuugcuugccaaaguacagaauuugaauuaucagcaaaga

SEQ ID NO: 511086 - RNA, 64 nt, hsa
aaauaacuagcaauuaaucacagcauaucaggaaaaaguacacagugaguucuguuuauuuuuu

SEQ ID NO: 511087 - RNA, 64 nt, hsa
uuaaauaauauaauaaaaguaaauauauuuccugaaaguacauucauuuaagcccuaaguuaua

SEQ ID NO: 511088 - RNA, 64 nt, hsa
uauauacuucacaaagagaugaccuauauaaaucaaaguacacauuauuuaaaauauuuaaaaa

SEQ ID NO: 511089 - RNA, 64 nt, hsa
auauuucaaauggauuguaugcacuugcaaagcaaaaguacauugguaauuugggcacauucag

SEQ ID NO: 511090 - RNA, 64 nt, hsa
uuaauuuuauauuuaugagggggcccuucacuaaaaaguacauguaaaaguacauuugaugaca

SEQ ID NO: 511091 - RNA, 64 nt, hsa
uuaugagggggcccuucacuaaaaaguacauguaaaaguacauuugaugacaauagcugcuuag

SEQ ID NO: 511092 - RNA, 64 nt, hsa
uuucuuuuaagcagacccauaccuuuccagggucaaaguacagaauagaauacauugauacaaa

SEQ ID NO: 511093 - RNA, 64 nt, hsa
cagggucaaaguacagaauagaauacauugauacaaaguacagaaaaauacuuugauuuuuauc

SEQ ID NO: 511094 - RNA, 64 nt, hsa
gauacugauagaaaaagugauuucuucuuauuauaaaguacauuuaaaguucaaggacuaaccu

SEQ ID NO: 511095 - RNA, 64 nt, hsa
aacggaaaggaaagaacacuaguguucuuucaguaaaguacaaaguguuuauuuuacaaaagag

SEQ ID NO: 511096 - RNA, 64 nt, hsa
gggcaacagaacaagacuccaucucaaaaaaaaaaaaguacaucauaaaaguacaucauaugug

SEQ ID NO: 511097 - RNA, 64 nt, hsa
agacuccaucucaaaaaaaaaaaaguacaucauaaaaguacaucauaugugaacaugcaaaagc

SEQ ID NO: 511098 - RNA, 64 nt, hsa
uuggcccagucaggugcugccagguuuagauaggaaaguacaugucccauuuucaugggugccc

SEQ ID NO: 511099 - RNA, 64 nt, hsa
cgucaucacaugagacacugacucugugacgacaaaaguacaaacagucugaggcuaagaaagg

SEQ ID NO: 511100 - RNA, 64 nt, hsa
uguuuuagaaacaugaguccggacuguguaaguaaaaguacaaacauuauuuccaccauaaagu

SEQ ID NO: 511101 - RNA, 64 nt, hsa
uacuuuuaaccucuauugguacaacauauaaaugaaaguacaccuacacuaauagucugucuca

SEQ ID NO: 511102 - RNA, 64 nt, hsa
aacauaacaaaacaguuauauagacugcuuuagcaaaguacacaauaauggcuuauaaauggug

SEQ ID NO: 511103 - RNA, 64 nt, hsa
caucugucaguuauagacaaagauaauaauucacaaaguacaugcuaucagaaugaacuuuggu

SEQ ID NO: 511104 - RNA, 64 nt, hsa
gugagagcauugggaguaggaaacgauggacuccaaaguacaagggagaauacccauuuucauu

SEQ ID NO: 511105 - RNA, 64 nt, hsa
gauuuuagauaacagauuuuuaaaguuuuagagaaaaguacaguaauacaguaaacugaaagag

SEQ ID NO: 511106 - RNA, 64 nt, hsa
uccauuuucucucuuguaaguguuaaaugugauaaaaguacauauuuuaaauuguuuucagcuc

SEQ ID NO: 511107 - RNA, 64 nt, hsa
auuuucuuaguauuacaaaauaauucauuagcauaaaguacaauagugaaauauuugaguuguu

SEQ ID NO: 511108 - RNA, 64 nt, hsa
agacuccgucucaaaaaauauauuuaaaaaaaaaaaaguacagaugugaugugcagaacauauu

SEQ ID NO: 511109 - RNA, 64 nt, hsa
ucaaauuccuauguacuguaaagcuguacccuuaaaaguacagauguggccgggcacaguggcu

SEQ ID NO: 511110 - RNA, 64 nt, hsa
cgacagagccagacccugucucaaaaaaaaaaaaaaaguacaugaaaggauucacucuggagag

SEQ ID NO: 511111 - RNA, 64 nt, hsa
auguagggaagccuucagucauuuugguaacuuaaaaguacaugaggcugggcacaguggcuca

SEQ ID NO: 511112 - RNA, 64 nt, hsa
cuccauuggaucuuuuacuuuaaaguagugaugaaaaguacauguugauacugucuuagaagaa

SEQ ID NO: 511113 - RNA, 64 nt, hsa
caagaagggcacuaaacucagauugacuaaauaaaaaguacaaagggcacauauacgugacaga

SEQ ID NO: 511114 - RNA, 64 nt, hsa
aguaauaugugaauaucauauuuuugaaagguaaaaaguacauuuguauauuacauauauggac

SEQ ID NO: 511115 - RNA, 64 nt, hsa
uacauauauggacauaacuugugaaggaugaaagaaaguacagccucucgguggugggauuaug

SEQ ID NO: 511116 - RNA, 59 nt, hsa; identical to SEQ ID NO: 109599

SEQ ID NO: 511117 - RNA, 59 nt, hsa; identical to SEQ ID NO: 109600

SEQ ID NO: 511118 - RNA, 59 nt, hsa; identical to SEQ ID NO: 109601

SEQ ID NO: 511119 - RNA, 59 nt, hsa; identical to SEQ ID NO: 109602

SEQ ID NO: 511120 - RNA, 59 nt, hsa; identical to SEQ ID NO: 109603

SEQ ID NO: 511121 - RNA, 59 nt, hsa; identical to SEQ ID NO: 109604

SEQ ID NO: 511122 - RNA, 59 nt, hsa; identical to SEQ ID NO: 109605

SEQ ID NO: 511123 - RNA, 59 nt, hsa; identical to SEQ ID NO: 109606

SEQ ID NO: 511124 - RNA, 59 nt, hsa; identical to SEQ ID NO: 109607

SEQ ID NO: 511125 - RNA, 59 nt, hsa; identical to SEQ ID NO: 109608

SEQ ID NO: 511126 - RNA, 59 nt, hsa; identical to SEQ ID NO: 109609

SEQ ID NO: 511127 - RNA, 59 nt, hsa; identical to SEQ ID NO: 109610

SEQ ID NO: 511128 - RNA, 59 nt, hsa; identical to SEQ ID NO: 109611

SEQ ID NO: 511129 - RNA, 59 nt, hsa; identical to SEQ ID NO: 109612

SEQ ID NO: 511130 - RNA, 59 nt, hsa; identical to SEQ ID NO: 109613

SEQ ID NO: 511131 - RNA, 59 nt, hsa; identical to SEQ ID NO: 109614

SEQ ID NO: 511132 - RNA, 59 nt, hsa; identical to SEQ ID NO: 109615

SEQ ID NO: 511133 - RNA, 59 nt, hsa; identical to SEQ ID NO: 109616

SEQ ID NO: 511134 - RNA, 59 nt, hsa; identical to SEQ ID NO: 109617

SEQ ID NO: 511135 - RNA, 59 nt, hsa; identical to SEQ ID NO: 109618

SEQ ID NO: 511136 - RNA, 59 nt, hsa; identical to SEQ ID NO: 109619

SEQ ID NO: 511137 - RNA, 59 nt, hsa; identical to SEQ ID NO: 109620

SEQ ID NO: 511138 - RNA, 59 nt, hsa; identical to SEQ ID NO: 109621

SEQ ID NO: 511139 - RNA, 59 nt, hsa; identical to SEQ ID NO: 109622

SEQ ID NO: 511140 - RNA, 59 nt, hsa; identical to SEQ ID NO: 109623

SEQ ID NO: 511141 - RNA, 64 nt, hsa; identical to SEQ ID NO: 418667

SEQ ID NO: 511142 - RNA, 64 nt, hsa; identical to SEQ ID NO: 418668

SEQ ID NO: 511143 - RNA, 64 nt, hsa; identical to SEQ ID NO: 418669

SEQ ID NO: 511144 - RNA, 64 nt, hsa; identical to SEQ ID NO: 418670

SEQ ID NO: 511145 - RNA, 64 nt, hsa; identical to SEQ ID NO: 418671

SEQ ID NO: 511146 - RNA, 64 nt, hsa; identical to SEQ ID NO: 418672

SEQ ID NO: 511147 - RNA, 64 nt, hsa; identical to SEQ ID NO: 418673

SEQ ID NO: 511148 - RNA, 64 nt, hsa; identical to SEQ ID NO: 418674

SEQ ID NO: 511149 - RNA, 64 nt, hsa; identical to SEQ ID NO: 418675

SEQ ID NO: 511150 - RNA, 64 nt, hsa; identical to SEQ ID NO: 418676

SEQ ID NO: 511151 - RNA, 64 nt, hsa; identical to SEQ ID NO: 418677

SEQ ID NO: 511152 - RNA, 64 nt, hsa; identical to SEQ ID NO: 418678

SEQ ID NO: 511153 - RNA, 64 nt, hsa; identical to SEQ ID NO: 418679

SEQ ID NO: 511154 - RNA, 64 nt, hsa; identical to SEQ ID NO: 418680

SEQ ID NO: 511155 - RNA, 64 nt, hsa; identical to SEQ ID NO: 418681

SEQ ID NO: 511156 - RNA, 64 nt, hsa; identical to SEQ ID NO: 418682

SEQ ID NO: 511157 - RNA, 64 nt, hsa; identical to SEQ ID NO: 418683

SEQ ID NO: 511158 - RNA, 64 nt, hsa; identical to SEQ ID NO: 418684

SEQ ID NO: 511159 - RNA, 64 nt, hsa; identical to SEQ ID NO: 418685

SEQ ID NO: 511160 - RNA, 64 nt, hsa; identical to SEQ ID NO: 418686

SEQ ID NO: 511161 - RNA, 64 nt, hsa; identical to SEQ ID NO: 418687

SEQ ID NO: 511162 - RNA, 64 nt, hsa; identical to SEQ ID NO: 418688

SEQ ID NO: 511163 - RNA, 64 nt, hsa; identical to SEQ ID NO: 418689

SEQ ID NO: 511164 - RNA, 64 nt, hsa; identical to SEQ ID NO: 418690

SEQ ID NO: 511165 - RNA, 64 nt, hsa; identical to SEQ ID NO: 115828

SEQ ID NO: 511166 - RNA, 64 nt, hsa; identical to SEQ ID NO: 115829

SEQ ID NO: 511167 - RNA, 64 nt, hsa; identical to SEQ ID NO: 115830

SEQ ID NO: 511168 - RNA, 64 nt, hsa; identical to SEQ ID NO: 115831

SEQ ID NO: 511169 - RNA, 64 nt, hsa; identical to SEQ ID NO: 115832

SEQ ID NO: 511170 - RNA, 64 nt, hsa; identical to SEQ ID NO: 115833

SEQ ID NO: 511171 - RNA, 64 nt, hsa; identical to SEQ ID NO: 115834

SEQ ID NO: 511172 - RNA, 64 nt, hsa; identical to SEQ ID NO: 115835

SEQ ID NO: 511173 - RNA, 64 nt, hsa; identical to SEQ ID NO: 115836

SEQ ID NO: 511174 - RNA, 64 nt, hsa; identical to SEQ ID NO: 115837

SEQ ID NO: 511175 - RNA, 64 nt, hsa; identical to SEQ ID NO: 115838

SEQ ID NO: 511176 - RNA, 64 nt, hsa; identical to SEQ ID NO: 115839

SEQ ID NO: 511177 - RNA, 64 nt, hsa; identical to SEQ ID NO: 115840

SEQ ID NO: 511178 - RNA, 64 nt, hsa; identical to SEQ ID NO: 115841

SEQ ID NO: 511179 - RNA, 64 nt, hsa; identical to SEQ ID NO: 115842

SEQ ID NO: 511180 - RNA, 64 nt, hsa; identical to SEQ ID NO: 115843

SEQ ID NO: 511181 - RNA, 64 nt, hsa; identical to SEQ ID NO: 115844

SEQ ID NO: 511182 - RNA, 64 nt, hsa; identical to SEQ ID NO: 115845

SEQ ID NO: 511183 - RNA, 64 nt, hsa; identical to SEQ ID NO: 115846

SEQ ID NO: 511184 - RNA, 64 nt, hsa; identical to SEQ ID NO: 115847

SEQ ID NO: 511185 - RNA, 64 nt, hsa; identical to SEQ ID NO: 115848

SEQ ID NO: 511186 - RNA, 64 nt, hsa; identical to SEQ ID NO: 115849

SEQ ID NO: 511187 - RNA, 64 nt, hsa; identical to SEQ ID NO: 115850

SEQ ID NO: 511188 - RNA, 64 nt, hsa; identical to SEQ ID NO: 115851

SEQ ID NO: 511189 - RNA, 64 nt, hsa; identical to SEQ ID NO: 115852

SEQ ID NO: 511190 - RNA, 64 nt, hsa
agucacuaccccagggggagcuauagcuucaugaccguaacaugugaccugugugcuggcagga

SEQ ID NO: 511191 - RNA, 64 nt, hsa
uuuuguuaugggauauugauuucuuguuuuuuuuccguaacauugucugcugcaauuuaaauaa

SEQ ID NO: 511192 - RNA, 64 nt, hsa
caaaagccugauguucacauugugcuuuuaaacuccguaacagcugaauacaacauaacauagu

SEQ ID NO: 511193 - RNA, 64 nt, hsa
ucuuuaaagggcagaaaauuugagacggugaucgccguaacaguaaauuuggcuuacaauuggg

SEQ ID NO: 511194 - RNA, 64 nt, hsa
cgcgcuauaucggccauuaaauacucggggcuguccguaacacccugugcuucccaauuguagc

SEQ ID NO: 511195 - RNA, 64 nt, hsa
cauucagaggaggaggggauuucucucuucaaggccguaacaguggaagaacagucauaugcca

SEQ ID NO: 511196 - RNA, 64 nt, hsa
guacucuggugagucaccacuucagggcuuuacuccguaacagauuuuguuggcauagcucugg

SEQ ID NO: 511197 - RNA, 64 nt, hsa
caaucaauauaagcauuauugagaaaaaugugacccguaacacuguguucuggauaaaaaugug

SEQ ID NO: 511198 - RNA, 64 nt, hsa
cuuuccaacugaaggcaguaaccauuacuucuaaccguaacacaaacacagcaaguuuuaaccu

SEQ ID NO: 511199 - RNA, 64 nt, hsa
caacccaccaaguacccauguuggcccugccuacccguaacaaauuguucacacaaccuauuuu

SEQ ID NO: 511200 - RNA, 64 nt, hsa
cuuaaguauaauuccauaaugacaugggcauauaccguaacauucuggcaaauaacaauuagaa

SEQ ID NO: 511201 - RNA, 64 nt, hsa
auggagauguauacccucuauuacacacauaaaaccguaacaaaauucauugugguguauuaua

SEQ ID NO: 511202 - RNA, 64 nt, hsa
aucuggagcaggggggugagcuccucagcagccuccguaacagcugcccugccuacaccugcag

SEQ ID NO: 511203 - RNA, 64 nt, hsa
uccaccuuucagugacauuuaagacaucauauucccguaacauuaugucucagucugaucgucu

SEQ ID NO: 511204 - RNA, 64 nt, hsa
gccucuguccccgcauccuuguucuccccuggguccguaacauuuuuuccgaggaugaacaggg

SEQ ID NO: 511205 - RNA, 64 nt, hsa
ccuagaggccccaccuuuggugcuuuccagaaucccguaacaccugauuaacugaggcauccac

SEQ ID NO: 511206 - RNA, 64 nt, hsa
ggggggccacauagaagcccucacacacacaugcccguaacaggauuuaucacaagacacgccu

SEQ ID NO: 511207 - RNA, 64 nt, hsa
cuccgugugaccaccaagaugccagcaggauauaccguaacacgaaauugcugucaaaagcuua

SEQ ID NO: 511208 - RNA, 64 nt, hsa
ccugauauauacacauuagaaauauuccaguucuccguaacaguguaaaguuaaucagaaagaa

SEQ ID NO: 511209 - RNA, 64 nt, hsa
uccacacgauuuccuaucucccuugaaaaguacaccguaacacuccguaaacagcccagcugua

SEQ ID NO: 511210 - RNA, 64 nt, hsa
auccuugauacuguugccugccuuuuuagucaccccguaacaagggcacacauccaggacugug

SEQ ID NO: 511211 - RNA, 64 nt, hsa
augagaaugcggauuaaaaugccuggcgugcucaccguaacaccacggggaaggcugugugccu

SEQ ID NO: 511212 - RNA, 64 nt, hsa
augugcgcaaauucugguucuucccaagcucuaaccguaacacgucccacccccuuuuuaaagc

SEQ ID NO: 511213 - RNA, 64 nt, hsa
auuaaguuggggagggcaauaauaaaaugagggcccguaacagaaccaguguguguauaacgaa

SEQ ID NO: 511214 - RNA, 64 nt, hsa
gauaaaaucuguuaugggcugaauguuuguguucccguaacaauuccuauguugaaacacgaau

SEQ ID NO: 511215 - RNA, 64 nt, hsa
auccucccugcuguguggccuccccuggucucauccguaacacagcccagcuuagugggccucu

SEQ ID NO: 511216 - RNA, 64 nt, hsa
uguauaaaauauuggcauguaaacagcacagacaccguaacacacucugugcccuguuugguug

SEQ ID NO: 511217 - RNA, 64 nt, hsa
ugguaaauagguauuauauuuuggccuuacaauaccguaacaauguuugucauuuugaaauacu

SEQ ID NO: 511218 - RNA, 64 nt, hsa
agaggagacagaggcgaugggcgugcuucguccuccguaacacuggcuuuauuuaccguggugg

SEQ ID NO: 511219 - RNA, 64 nt, hsa
ugccugcugugaacugcuuucccucggaauguuuccguaacaggacauuaaaccuuugauuuua

SEQ ID NO: 511220 - RNA, 64 nt, hsa
aguggcaucugagugggcccagcacauggccauagaggcccaggcaccaccaggagcagcagcc

SEQ ID NO: 511221 - RNA, 64 nt, hsa
agaugucaaguuggguucacuugccaugcaggaagaggcccacuagagggcccaucaggcagug

SEQ ID NO: 511222 - RNA, 64 nt, hsa
uggguucugccuuuagccuggaccaaagggaagugaggcccaaggagcuuacccaagcuguggc

SEQ ID NO: 511223 - RNA, 64 nt, hsa
cugcagcccucacuccugucaucccaggacacuugaggcccaaggagguggaguggagaguggg

SEQ ID NO: 511224 - RNA, 64 nt, hsa
aagggaaaccuaguaaugccaucacauggaggacgaggcccagcucagcugggccagagcccag

SEQ ID NO: 511225 - RNA, 64 nt, hsa
gccauccaugccaucccugccugugccuagaucagaggcccagagggcccccucaguugccuga

SEQ ID NO: 511226 - RNA, 64 nt, hsa
ggcuguuugacuuucugugagcccccagcgaggggaggcccagccuccgaggagaccaggaacc

SEQ ID NO: 511227 - RNA, 64 nt, hsa
gaacugggguuuguuagguucuuucucuaauguagaggcccagaucccaucacaaaguuuuuca

SEQ ID NO: 511228 - RNA, 64 nt, hsa
uuuugccauguccuauugaucagugacacugccagaggcccauaccggcaagaggaagaggacg

SEQ ID NO: 511229 - RNA, 64 nt, hsa
ccgcggagggcacgcggcgcgguaggcgagcgccgaggcccagcggccgggggaggacgaccuc

SEQ ID NO: 511230 - RNA, 64 nt, hsa
ggcgcgggugguguguguguucccacgggccccggaggcccacuccgcggagggcacgcggcgc

SEQ ID NO: 511231 - RNA, 64 nt, hsa
gagccaggccccucaggcccggcaugggcagugcgaggcccauaguggugggaagccaguuggc

SEQ ID NO: 511232 - RNA, 64 nt, hsa
gacagcauaguccuggaugcaaccuggaggaagggaggcccaugguggagcacucacuccgugc

SEQ ID NO: 511233 - RNA, 62 nt, hsa
caugcugugccaucaugugaugcagccugccagaggcccaaugcuggaauggcaccaucauu

SEQ ID NO: 511234 - RNA, 64 nt, hsa
gguuuggucuaagcugugcccugccaccuggcaggaggcccacucacugcccaagucauggcaa

SEQ ID NO: 511235 - RNA, 64 nt, hsa
uacugccauagauacccuaagcccagggccccuugaggcccagacucagccugcccacuggugc

SEQ ID NO: 511236 - RNA, 64 nt, hsa
gcuggagauaggaggcccagguggcagguagcaggaggcccagaucacccauccuccccugggg

SEQ ID NO: 511237 - RNA, 64 nt, hsa
cguggguaggucccuggcucccagcuggagauaggaggcccagguggcagguagcaggaggccc

SEQ ID NO: 511238 - RNA, 64 nt, hsa
gcauggauugaagcugcccucaaguccaggccuugaggcccaccugaggggagauacugcccuu

SEQ ID NO: 511239 - RNA, 64 nt, hsa
gcucaggacacuuggcuuuggggggaaggaaacugaggcccagagaggggcaaccacuggccaa

SEQ ID NO: 511240 - RNA, 64 nt, hsa
acagugcagacggugggcggggagagcucgaggggaggcccagcccugcaggugggacuggcuc

SEQ ID NO: 511241 - RNA, 64 nt, hsa
gcgcagcccccaggccucaggaccccaccccucugaggcccaggggagcccuguucacgcuggu

SEQ ID NO: 511242 - RNA, 64 nt, hsa
aaaagaccuagcccaacuucccuugugggaaacugaggcccagcuuggggaaggccaggaccau

SEQ ID NO: 511243 - RNA, 64 nt, hsa
ccacuuccaagcaagcagaugggggugggcaccugaggcccaauaauauuuggaccaaguggga

SEQ ID NO: 511244 - RNA, 64 nt, hsa
ccccgggccgcugaccgacugaccucuccucacggaggcccagccccaaagccccagggcuggc

SEQ ID NO: 511245 - RNA, 64 nt, hsa
ccuuuagagaaaaaauauuagugaagaagcccuggaggcccagguugggagucagucgaggauu

SEQ ID NO: 511246 - RNA, 64 nt, hsa
ugguuuccuggccaaccccagggucacuugucuggaggcccagcugggcacuaaugucugccac

SEQ ID NO: 511247 - RNA, 64 nt, hsa
acauugagaacaaaggagggaccugagguggagagaggcccagcaccccaaaucucugccauca

SEQ ID NO: 511248 - RNA, 64 nt, hsa
ccaggcaggguuggaggccgggggugugagaggagaggcccauagggcugaguggggucgggug

SEQ ID NO: 511249 - RNA, 64 nt, hsa
gaggcugaggcguuuggccccggccuggccaggagaggcccauccccagggcaguuucaggugc

SEQ ID NO: 511250 - RNA, 62 nt, hsa
ggcaccagcugaaggccugaguggggccaagggaggcccagggggccgagggcccagguccc

SEQ ID NO: 511251 - RNA, 64 nt, hsa
ggguuggggcagcuuacuccagcccuggcccaaggaggcccagaaguuggaaagagauggaaug

SEQ ID NO: 511252 - RNA, 64 nt, hsa
cuuggggguccagauuccuuaggagcuuugggaugaggcccaggaggcugcauuuuuccagguc

SEQ ID NO: 511253 - RNA, 64 nt, hsa
agaacacacaaccaugaaaggcuuuuugaggugagaggcccaggugguccuggcaacccugagu

SEQ ID NO: 511254 - RNA, 64 nt, hsa
agugcugccaggggccgcccuccaagguuaaugagaggcccacauccaggcaagaacuaauuca

SEQ ID NO: 511255 - RNA, 64 nt, hsa
cacucaacugcccacuucauucugugaccugucugaggcccacccugcagcugcccugaggagg

SEQ ID NO: 511256 - RNA, 64 nt, hsa
accugucugaggcccacccugcagcugcccugaggaggcccacagguccccuucuagaauucug

SEQ ID NO: 511257 - RNA, 64 nt, hsa
aaauguugaagcucaaguuuaaagaagcguugcagaggcccacggucuccugggucccggccac

SEQ ID NO: 511258 - RNA, 64 nt, hsa
guuagcucuauauaaguaggggcagcuuagcccugaggcccagagaccugcuguccuuuuucuc

SEQ ID NO: 511259 - RNA, 64 nt, hsa
cacacgccacacacugggcguucccggcacgggagaggcccagaguuuccuucacccugggaac

SEQ ID NO: 511260 - RNA, 64 nt, hsa
auccgaauauguccauuucgcagaggaggaaagugaggcccagggagugcagauagcuacagag

SEQ ID NO: 511261 - RNA, 64 nt, hsa; identical to SEQ ID NO: 114926

SEQ ID NO: 511262 - RNA, 64 nt, hsa; identical to SEQ ID NO: 114927

SEQ ID NO: 511263 - RNA, 64 nt, hsa
gcaucuggcacuugcaauuuuggauuuugugggucaguuuuacguacauagggcauuuugcaag

SEQ ID NO: 511264 - RNA, 64 nt, hsa
uuccucaccugggugggucccacacuugugaccucaguuuuaggaccaagaucuguguugguuu

SEQ ID NO: 511265 - RNA, 64 nt, hsa
cugagauucagagagguccagcuagaaaaaguggcaguuuuaaccaccaacguagaagcuuuuu

SEQ ID NO: 511266 - RNA, 64 nt, hsa
agugacucaguggaauuuuuuguuugcuuuuguacaguuuuaaaauaaaaguuugguauuugug

SEQ ID NO: 511267 - RNA, 64 nt, hsa
acuauguuuauggagauuuccauacuuuuaaagacaguuuuaauguugaauuugguauuuugaa

SEQ ID NO: 511268 - RNA, 64 nt, hsa
uuguuguugccuguaaucacacaugguuugacaucaguuuuaaaucaauggagagaaaaaacug

SEQ ID NO: 511269 - RNA, 64 nt, hsa
cauuugagaaguaggggaaagggaaucauguugacaguuuuaguucugugaacacuaauuugug

SEQ ID NO: 511270 - RNA, 64 nt, hsa
uagucgcauguguggacaucaguaggcaaguaaccaguuuuacuaaugcauucaucgcucaucu

SEQ ID NO: 511271 - RNA, 64 nt, hsa
uuuggcauagcuaacuacacuuugauacuaacuccaguuuuacuauuauuauuuugguuggaaa

SEQ ID NO: 511272 - RNA, 64 nt, hsa
accacucugcaaaguauuucuaaccuuuaauucccaguuuuaaaacagauauaauaauagcauu

SEQ ID NO: 511273 - RNA, 64 nt, hsa
gaguauuuucugacauaagaauauauuaucaauacaguuuuaugcaguaagcucuccuuaccau

SEQ ID NO: 511274 - RNA, 64 nt, hsa
guuucccuauggugguaaagaaugaugccauagucaguuuuauugacauuguuagaugaaagaa

SEQ ID NO: 511275 - RNA, 64 nt, hsa
auuugaagcacucugacauguacauuuaaagugacaguuuuaaaaguaaaaugguguuaaaucu

SEQ ID NO: 511276 - RNA, 64 nt, hsa
ucaguaaguuagucuauaacaaauuuuacccuaacaguuuuaccaccuaguaacagucauuucu

SEQ ID NO: 511277 - RNA, 64 nt, hsa
ccauuuugaaauguaaaauuuuuaugaucugauucaguuuuaagaaaacaugaaugaacuagaa

SEQ ID NO: 511278 - RNA, 64 nt, hsa
ucucauaauugguauuuagcacaauuguaagauacaguuuuacuguuuguacaucguuuuuuuc

SEQ ID NO: 511279 - RNA, 64 nt, hsa
gggucauuguguugcuacccaagagaaaaugcuacaguuuuauagauugcacaucauucuuuaa

SEQ ID NO: 511280 - RNA, 64 nt, hsa
gaaaagguuggguaagaauaguguugaaaauucacaguuuuaaguuugauggucuccauucagg

SEQ ID NO: 511281 - RNA, 64 nt, hsa
gcagacacagguggagugguuccuacaagacauccaguuuuaacaacaaaagaguuauugaaau

SEQ ID NO: 511282 - RNA, 64 nt, hsa
auuuguaagcgugucauuuaaguaauuugaugcucaguuuuagggucuaaguugaccucgagug

SEQ ID NO: 511283 - RNA, 64 nt, hsa
ccacagauaggcauguaccuuaaauucaaaucuacaguuuuacaaaauguuuuccuuugugugc

SEQ ID NO: 511284 - RNA, 64 nt, hsa
uucuaaauauuauuuaauuccuuaauuuggaaagcaguuuuaauguuuacaguuuaagauacuc

SEQ ID NO: 511285 - RNA, 64 nt, hsa
ccggauauguuggguagcagaaaaggccuagaaccaguuuuaagauuaugccuacaucucuaga

SEQ ID NO: 511286 - RNA, 64 nt, hsa
ggagaauaucuggucauagaucuuuuuuuaaaugcaguuuuauaaaacccuaacagcggugaua

SEQ ID NO: 511287 - RNA, 64 nt, hsa
ccuaacagcggugauaucauuagacuguaugaaucaguuuuauuaccuaguguacaagugucag

SEQ ID NO: 511288 - RNA, 64 nt, hsa
cagaauuaacuccauuccagucucugcauguaaucaguuuuauccacagaaacauuuucauuuu

SEQ ID NO: 511289 - RNA, 64 nt, hsa
aauauauaaauuuaaaaaacuaucuuuuugcuuacaguuuuaaauucugaacaauucucucuua

SEQ ID NO: 511290 - RNA, 64 nt, hsa
ucaguuuuucugucucacuguguaacaagucacucaguuuuauuuuaacuuuagacggucuugu

SEQ ID NO: 511291 - RNA, 64 nt, hsa
ucaaacacauccuuuggaacuuacuauuguuucccaguuuuaguuuuuuguuucguuucguuuu

SEQ ID NO: 511292 - RNA, 64 nt, hsa
uguauuuuauuugguugagggauuuuuuuauaaacaguuuuacuugugucauauuuuaaaauua

SEQ ID NO: 511293 - RNA, 64 nt, hsa
ccugaucccaguuucugcuguugacucuuccauucaguuuuauuuauuguguguucucacagug

SEQ ID NO: 511294 - RNA, 64 nt, hsa
uuaguuuuuagaauaaauauuaauuuuuccacuucaguuuuauucuagaaaauacccuuuuuag

SEQ ID NO: 511295 - RNA, 64 nt, hsa
aguuuuauucuagaaaauacccuuuuuagaaauccaguuuuaguuuugucauuuucgauaaauc

SEQ ID NO: 511296 - RNA, 64 nt, hsa
agcacuuuguuuucaaagcaagugguauuuugaucaguuuuauuuaaaugugugaucagaaaga

SEQ ID NO: 511297 - RNA, 64 nt, hsa
uagcauuguuuuuagacuaguaauaugcagaaaacaguuuuaggccugcguuacauauugccuc

SEQ ID NO: 511298 - RNA, 64 nt, hsa
cuuuaggaaaaugugaacuggaaaacgcuucggucaguuuuagugacauagccugugaugaugg

SEQ ID NO: 511299 - RNA, 64 nt, hsa
gggucuggugacuauuauugcggaccgugguacccaguuuuaggaauguggagaaaggaauucu

SEQ ID NO: 511300 - RNA, 64 nt, hsa
acacaaauagugauuuacuuuuggagauccuugucaguuuuauuuucuauuugaugaaguaaga

SEQ ID NO: 511301 - RNA, 64 nt, hsa
uuuaacucaguucaauuuuuguagugagacugagcaguuuuaaauccuuugcgugcaugcauac

SEQ ID NO: 511302 - RNA, 64 nt, hsa
ccuugauuauuaugaaauagagcaucuugaaauucaguuuuacucuaaauguacuuuuaauacu

SEQ ID NO: 511303 - RNA, 64 nt, hsa
aacuuuuucucucuugguuucuuuucuuccuucacaguuuuaucucacaaaaccauuuuucuaa

SEQ ID NO: 511304 - RNA, 64 nt, hsa
aaauucuaguuaacaauuuuauuuuguauucuugcaguuuuaaguggaugcuaauuuuaggggc

SEQ ID NO: 511305 - RNA, 64 nt, hsa
aacuuuuauguaacaaacagccccuccccaccuccaguuuuacaacaaucagaaagggcacuga

SEQ ID NO: 511306 - RNA, 63 nt, hsa
cagaaaauaaaacacaaccuuucucuugaugcaacaguuuuauaaaaaaaaaaauggucaacg

SEQ ID NO: 511307 - RNA, 64 nt, hsa
ugcacauucaguguauugguaauuuaaauuauuucaguuuuaacuugugaaagcuuauauuaug

SEQ ID NO: 511308 - RNA, 64 nt, hsa
cauauuuugagaagaaauucaagaauggaaucagcaguuuuaaggauuugggcaacauucugca

SEQ ID NO: 511309 - RNA, 64 nt, hsa
ucauuuggagcuagaaaucaauagucuauaaaaacaguuuuacuugcaauccauuaaaacaaca

SEQ ID NO: 511310 - RNA, 64 nt, hsa
aggcguuagccacugcgcccggcccgagaaaauacaguuuuaaaaagagaaagcuuuauaaccu

SEQ ID NO: 511311 - RNA, 64 nt, hsa
uccacagcaggcacauaucucuccaagggaugaccaguuuuaugcuuacugugugcuucucauc

SEQ ID NO: 511312 - RNA, 64 nt, hsa
ugcaaacuuaaaaaccugcaucuucuugaagcaucaguuuuacuuaccaaaugguuuagaguca

SEQ ID NO: 511313 - RNA, 64 nt, hsa
uugucuaguuuauagcaccuuaacuuuaacuguucaguuuuaucuggcagaggaaaacauucuu

SEQ ID NO: 511314 - RNA, 64 nt, hsa
ucugaaaucuuauaagcuacuuaagcuacguugucaguuuuaucgcaaagauguuuuguauuuu

SEQ ID NO: 511315 - RNA, 64 nt, hsa
aaacuuagaauuauuuuacacacuaaaaugguugcaguuuuauggcauaugucuccgauuuaga

SEQ ID NO: 511316 - RNA, 64 nt, hsa
uauugacagacaugguguacugaucagaaauguucaguuuuaacuaaaacuaaauuuauguuau

SEQ ID NO: 511317 - RNA, 64 nt, hsa
uuucaguuuauccaauauugaguaaguucugaaacaguuuuagaaaaaauuuucuuuuuguuaa

SEQ ID NO: 511318 - RNA, 64 nt, hsa
caugugguaggcggugauggaacaacugucaaaucaguuuuagcaugaccuuuccuuguggauu

SEQ ID NO: 511319 - RNA, 64 nt, hsa
aaaggagagagcaauugaggcaguugaccauauucaguuuuauuuauuuauuuuuaauuuguuu

SEQ ID NO: 511320 - RNA, 64 nt, hsa
gugauuuuuuucauuguccauuacuugccaggggcaguuuuagcagcacuuuugauagauuacg

SEQ ID NO: 511321 - RNA, 64 nt, hsa
ccuggcaguggcucucagagcagcagaacggguucaguuuuagacucugaaguugguugugauu

SEQ ID NO: 511322 - RNA, 64 nt, hsa
uacacuuacaaauaaaacauaacugaaagaagagcaguuuuaugauuugggugcguuuuugugu

SEQ ID NO: 511323 - RNA, 64 nt, hsa
cuuuucccacucauagaacuuuaacuugcccuuucaguuuuaucuuuuuuuuagagagagguuu

SEQ ID NO: 511324 - RNA, 64 nt, hsa
auucaccaaaaggacuuaauucuuguuuuuuucccaguuuuauauagaggaaacacuaugauag

SEQ ID NO: 511325 - RNA, 64 nt, hsa
uauucaccaaaaggacuuacuucuuguuuuuucccaguuuuauauagaggaaacacugucuaug

SEQ ID NO: 511326 - RNA, 64 nt, hsa
ugaacaauuuaccugucaauaaagcagaagacggcaguuuuaaaguucccagugguccguuugg

SEQ ID NO: 511327 - RNA, 64 nt, hsa
gaugaagaagacaaaucuuuauuauaauauugaucaguuuuaugccgcauuguucguggcagua

SEQ ID NO: 511328 - RNA, 64 nt, hsa
gcaacuaaaucauuuauuaguuguuuuuugaaagcaguuuuauguauaaauaacaaauguuuau

SEQ ID NO: 511329 - RNA, 64 nt, hsa
augaacuaaauccaaaacaugacacuguaggcagcaguuuuaagucuuauuuuuacuguuuaua

SEQ ID NO: 511330 - RNA, 64 nt, hsa
ugacuuccucuucucucaaguugcagguuuucaacaguuuuauaagguauuugcauuuuagaag

SEQ ID NO: 511331 - RNA, 64 nt, hsa
uuuaagauuugaggaaaaggguaaggguuaguuucaguuuuaggauuagagcuagaauuggguu

SEQ ID NO: 511332 - RNA, 64 nt, hsa
auuuauaacacuagauggcaccuguuauauaauucaguuuuaaauuguaguucaaacuaccuaa

SEQ ID NO: 511333 - RNA, 64 nt, hsa
cuuuuaauaacuacacauuaguuauaauucugugcaguuuuaauuuauaacacuagauggcacc

SEQ ID NO: 511334 - RNA, 64 nt, hsa
uaaaauacacugacuccugaguaaauugauuuuccaguuuuauggaauugggagucugacaagu

SEQ ID NO: 511335 - RNA, 64 nt, hsa
uuauaaugcuuaauauaaucuuaauuaaauuuagcaguuuuaguauaagaugugccauuuuguc

SEQ ID NO: 511336 - RNA, 64 nt, hsa
gucuaaucucuuuacagcaaauugguaagauuuucaguuuuacuucuuucuacuguuucugcug

SEQ ID NO: 511337 - RNA, 64 nt, hsa
cugcugucuaccuuccuuauauuuuuuuccucaacaguuuuaaaaagaaaaaaaggucuauuuu

SEQ ID NO: 511338 - RNA, 64 nt, hsa
uuucuuacaugagcuuuugaaauaccuggaaaugcaguuuuaauaugaacuuuuaagacagaug

SEQ ID NO: 511339 - RNA, 64 nt, hsa
gggauauauggucagcagcuguuuugaaaugucccaguuuuacgacuguuacuugugaaucagu

SEQ ID NO: 511340 - RNA, 64 nt, hsa
uuuauguuuucgaaauauauuucaucacugguuacaguuuuaaauagaaguugauugccuuuuc

SEQ ID NO: 511341 - RNA, 64 nt, hsa
aaucacaauucuaugugacuuauggucaaaagagcaguuuuaauaacuuuaaaaguacuucaga

SEQ ID NO: 511342 - RNA, 64 nt, hsa
uaauaacaagauuguaugaaccgcauggugcuugcaguuuuaaauauuguggauauuuguccug

SEQ ID NO: 511343 - RNA, 64 nt, hsa
gccucaguuaggacgcucggcgcccaaaucucaucaguuuuauugccugcucgauuauauagaa

SEQ ID NO: 511344 - RNA, 64 nt, hsa
gacuuuuuggaguuugcacagcaaacauuuuacacaguuuuauuucuaauauguuuuauaugua

SEQ ID NO: 511345 - RNA, 64 nt, hsa
cuaagauuucguuuuaaaugaucagauucgguuccaguuuuauucuuguugaguuuuucccuau

SEQ ID NO: 511346 - RNA, 64 nt, hsa
uaacugcacaaggugucaauucugcucuacagugcaguuuuagucaguuuuaguugcauagguu

SEQ ID NO: 511347 - RNA, 64 nt, hsa
aggugucaauucugcucuacagugcaguuuuagucaguuuuaguugcauagguuuccauuguau

SEQ ID NO: 511348 - RNA, 64 nt, hsa
gcccuuucagaacguucucuucaguuuuaucuuucaguuuuaccauuguuagcaaaaaaguuau

SEQ ID NO: 511349 - RNA, 64 nt, hsa
gggcgugcauguugcccuuucagaacguucucuucaguuuuaucuuucaguuuuaccauuguua

SEQ ID NO: 511350 - RNA, 64 nt, hsa
guaacagagaagaaaugucucaaaugucucguaucaguuuuaguguuuuucaguauuagggaaa

SEQ ID NO: 511351 - RNA, 64 nt, hsa
ugcuuuugacagguaguuuugggucaguuauauucaguuuuaguauuguauuccaaguugauaa

SEQ ID NO: 511352 - RNA, 64 nt, hsa; identical to SEQ ID NO: 167846

SEQ ID NO: 511353 - RNA, 64 nt, hsa; identical to SEQ ID NO: 167847

SEQ ID NO: 511354 - RNA, 64 nt, hsa; identical to SEQ ID NO: 167848

SEQ ID NO: 511355 - RNA, 64 nt, hsa; identical to SEQ ID NO: 167849

SEQ ID NO: 511356 - RNA, 64 nt, hsa; identical to SEQ ID NO: 167850

SEQ ID NO: 511357 - RNA, 64 nt, hsa; identical to SEQ ID NO: 167851

SEQ ID NO: 511358 - RNA, 64 nt, hsa; identical to SEQ ID NO: 511263

SEQ ID NO: 511359 - RNA, 64 nt, hsa; identical to SEQ ID NO: 511264

SEQ ID NO: 511360 - RNA, 64 nt, hsa; identical to SEQ ID NO: 511265

SEQ ID NO: 511361 - RNA, 64 nt, hsa; identical to SEQ ID NO: 511266

SEQ ID NO: 511362 - RNA, 64 nt, hsa; identical to SEQ ID NO: 511267

SEQ ID NO: 511363 - RNA, 64 nt, hsa; identical to SEQ ID NO: 511268

SEQ ID NO: 511364 - RNA, 64 nt, hsa; identical to SEQ ID NO: 511269

SEQ ID NO: 511365 - RNA, 64 nt, hsa; identical to SEQ ID NO: 511270

SEQ ID NO: 511366 - RNA, 64 nt, hsa; identical to SEQ ID NO: 511271

SEQ ID NO: 511367 - RNA, 64 nt, hsa; identical to SEQ ID NO: 511272

SEQ ID NO: 511368 - RNA, 64 nt, hsa; identical to SEQ ID NO: 511273

SEQ ID NO: 511369 - RNA, 64 nt, hsa; identical to SEQ ID NO: 511274

SEQ ID NO: 511370 - RNA, 64 nt, hsa; identical to SEQ ID NO: 511275

SEQ ID NO: 511371 - RNA, 64 nt, hsa; identical to SEQ ID NO: 511276

SEQ ID NO: 511372 - RNA, 64 nt, hsa; identical to SEQ ID NO: 511277

SEQ ID NO: 511373 - RNA, 64 nt, hsa; identical to SEQ ID NO: 511278

SEQ ID NO: 511374 - RNA, 64 nt, hsa; identical to SEQ ID NO: 511279

SEQ ID NO: 511375 - RNA, 64 nt, hsa; identical to SEQ ID NO: 511280

SEQ ID NO: 511376 - RNA, 64 nt, hsa; identical to SEQ ID NO: 511281

SEQ ID NO: 511377 - RNA, 64 nt, hsa; identical to SEQ ID NO: 511282

SEQ ID NO: 511378 - RNA, 64 nt, hsa; identical to SEQ ID NO: 511283

SEQ ID NO: 511379 - RNA, 64 nt, hsa; identical to SEQ ID NO: 511284

SEQ ID NO: 511380 - RNA, 64 nt, hsa; identical to SEQ ID NO: 511285

SEQ ID NO: 511381 - RNA, 64 nt, hsa; identical to SEQ ID NO: 511286

SEQ ID NO: 511382 - RNA, 64 nt, hsa; identical to SEQ ID NO: 511287

SEQ ID NO: 511383 - RNA, 64 nt, hsa; identical to SEQ ID NO: 511288

SEQ ID NO: 511384 - RNA, 64 nt, hsa; identical to SEQ ID NO: 511289

SEQ ID NO: 511385 - RNA, 64 nt, hsa; identical to SEQ ID NO: 511290

SEQ ID NO: 511386 - RNA, 64 nt, hsa; identical to SEQ ID NO: 511291

SEQ ID NO: 511387 - RNA, 64 nt, hsa; identical to SEQ ID NO: 511292

SEQ ID NO: 511388 - RNA, 64 nt, hsa; identical to SEQ ID NO: 511293

SEQ ID NO: 511389 - RNA, 64 nt, hsa; identical to SEQ ID NO: 511294

SEQ ID NO: 511390 - RNA, 64 nt, hsa; identical to SEQ ID NO: 511295

SEQ ID NO: 511391 - RNA, 64 nt, hsa; identical to SEQ ID NO: 511296

SEQ ID NO: 511392 - RNA, 64 nt, hsa; identical to SEQ ID NO: 511297

SEQ ID NO: 511393 - RNA, 64 nt, hsa; identical to SEQ ID NO: 511298

SEQ ID NO: 511394 - RNA, 64 nt, hsa; identical to SEQ ID NO: 511299

SEQ ID NO: 511395 - RNA, 64 nt, hsa; identical to SEQ ID NO: 511300

SEQ ID NO: 511396 - RNA, 64 nt, hsa; identical to SEQ ID NO: 511301

SEQ ID NO: 511397 - RNA, 64 nt, hsa; identical to SEQ ID NO: 511302

SEQ ID NO: 511398 - RNA, 64 nt, hsa; identical to SEQ ID NO: 511303

SEQ ID NO: 511399 - RNA, 64 nt, hsa; identical to SEQ ID NO: 511304

SEQ ID NO: 511400 - RNA, 64 nt, hsa; identical to SEQ ID NO: 511305

SEQ ID NO: 511401 - RNA, 63 nt, hsa; identical to SEQ ID NO: 511306

SEQ ID NO: 511402 - RNA, 64 nt, hsa; identical to SEQ ID NO: 511307

SEQ ID NO: 511403 - RNA, 64 nt, hsa; identical to SEQ ID NO: 511308

SEQ ID NO: 511404 - RNA, 64 nt, hsa; identical to SEQ ID NO: 511309

SEQ ID NO: 511405 - RNA, 64 nt, hsa; identical to SEQ ID NO: 511310

SEQ ID NO: 511406 - RNA, 64 nt, hsa; identical to SEQ ID NO: 511311

SEQ ID NO: 511407 - RNA, 64 nt, hsa; identical to SEQ ID NO: 511312

SEQ ID NO: 511408 - RNA, 64 nt, hsa; identical to SEQ ID NO: 511313

SEQ ID NO: 511409 - RNA, 64 nt, hsa; identical to SEQ ID NO: 511314

SEQ ID NO: 511410 - RNA, 64 nt, hsa; identical to SEQ ID NO: 511315

SEQ ID NO: 511411 - RNA, 64 nt, hsa; identical to SEQ ID NO: 511316

SEQ ID NO: 511412 - RNA, 64 nt, hsa; identical to SEQ ID NO: 511317

SEQ ID NO: 511413 - RNA, 64 nt, hsa; identical to SEQ ID NO: 511318

SEQ ID NO: 511414 - RNA, 64 nt, hsa; identical to SEQ ID NO: 511319

SEQ ID NO: 511415 - RNA, 64 nt, hsa; identical to SEQ ID NO: 511320

SEQ ID NO: 511416 - RNA, 64 nt, hsa; identical to SEQ ID NO: 511321

SEQ ID NO: 511417 - RNA, 64 nt, hsa; identical to SEQ ID NO: 511322

SEQ ID NO: 511418 - RNA, 64 nt, hsa; identical to SEQ ID NO: 511323

SEQ ID NO: 511419 - RNA, 64 nt, hsa; identical to SEQ ID NO: 511324

SEQ ID NO: 511420 - RNA, 64 nt, hsa; identical to SEQ ID NO: 511325

SEQ ID NO: 511421 - RNA, 64 nt, hsa; identical to SEQ ID NO: 511326

SEQ ID NO: 511422 - RNA, 64 nt, hsa; identical to SEQ ID NO: 511327

SEQ ID NO: 511423 - RNA, 64 nt, hsa; identical to SEQ ID NO: 511328

SEQ ID NO: 511424 - RNA, 64 nt, hsa; identical to SEQ ID NO: 511329

SEQ ID NO: 511425 - RNA, 64 nt, hsa; identical to SEQ ID NO: 511330

SEQ ID NO: 511426 - RNA, 64 nt, hsa; identical to SEQ ID NO: 511331

SEQ ID NO: 511427 - RNA, 64 nt, hsa; identical to SEQ ID NO: 511332

SEQ ID NO: 511428 - RNA, 64 nt, hsa; identical to SEQ ID NO: 511333

SEQ ID NO: 511429 - RNA, 64 nt, hsa; identical to SEQ ID NO: 511334

SEQ ID NO: 511430 - RNA, 64 nt, hsa; identical to SEQ ID NO: 511335

SEQ ID NO: 511431 - RNA, 64 nt, hsa; identical to SEQ ID NO: 511336

SEQ ID NO: 511432 - RNA, 64 nt, hsa; identical to SEQ ID NO: 511337

SEQ ID NO: 511433 - RNA, 64 nt, hsa; identical to SEQ ID NO: 511338

SEQ ID NO: 511434 - RNA, 64 nt, hsa; identical to SEQ ID NO: 511339

SEQ ID NO: 511435 - RNA, 64 nt, hsa; identical to SEQ ID NO: 511340

SEQ ID NO: 511436 - RNA, 64 nt, hsa; identical to SEQ ID NO: 511341

SEQ ID NO: 511437 - RNA, 64 nt, hsa; identical to SEQ ID NO: 511342

SEQ ID NO: 511438 - RNA, 64 nt, hsa; identical to SEQ ID NO: 511343

SEQ ID NO: 511439 - RNA, 64 nt, hsa; identical to SEQ ID NO: 511344

SEQ ID NO: 511440 - RNA, 64 nt, hsa; identical to SEQ ID NO: 511345

SEQ ID NO: 511441 - RNA, 64 nt, hsa; identical to SEQ ID NO: 511346

SEQ ID NO: 511442 - RNA, 64 nt, hsa; identical to SEQ ID NO: 511347

SEQ ID NO: 511443 - RNA, 64 nt, hsa; identical to SEQ ID NO: 511348

SEQ ID NO: 511444 - RNA, 64 nt, hsa; identical to SEQ ID NO: 511349

SEQ ID NO: 511445 - RNA, 64 nt, hsa; identical to SEQ ID NO: 511350

SEQ ID NO: 511446 - RNA, 64 nt, hsa; identical to SEQ ID NO: 511351

SEQ ID NO: 511447 - RNA, 64 nt, hsa; identical to SEQ ID NO: 167846

SEQ ID NO: 511448 - RNA, 64 nt, hsa; identical to SEQ ID NO: 167847

SEQ ID NO: 511449 - RNA, 64 nt, hsa; identical to SEQ ID NO: 167848

SEQ ID NO: 511450 - RNA, 64 nt, hsa; identical to SEQ ID NO: 167849

SEQ ID NO: 511451 - RNA, 64 nt, hsa; identical to SEQ ID NO: 167850

SEQ ID NO: 511452 - RNA, 64 nt, hsa; identical to SEQ ID NO: 167851

SEQ ID NO: 511453 - RNA, 64 nt, hsa
uauuauuugcaaauaccauggaugauaugcugcuucuguuuaacagugaugcaacauuaugugg

SEQ ID NO: 511454 - RNA, 64 nt, hsa
cgcauuuugcauuccauaugaaaaaaaugccacgucuguuuaaauuauuugauguagguuuggg

SEQ ID NO: 511455 - RNA, 64 nt, hsa
uauauuucaucuguucuauagggaagccauuuugucuguuuaaaauuucaguuuaauuuugcuu

SEQ ID NO: 511456 - RNA, 64 nt, hsa
auuugaacaguucuugucaauccgaauuguugauucuguuuaaaugaccaauacuuuuugaaau

SEQ ID NO: 511457 - RNA, 64 nt, hsa
uagaccuaagccauacauauuucuuuucccacauucuguuuaggaugacaguaauucuguuguc

SEQ ID NO: 511458 - RNA, 64 nt, hsa
uagccguguuuuauaacauagacgagcaguagggucuguuuauuagcaaauuuccuauuuguuc

SEQ ID NO: 511459 - RNA, 64 nt, hsa
uaucagugaacuacucugagauuuacugucuucaucuguuuaaugaguagaauguccgugaugc

SEQ ID NO: 511460 - RNA, 64 nt, hsa
acacagccaucuaacucauuaccuuaaaagacauucuguuuauuagucugauuaggaaugaugg

SEQ ID NO: 511461 - RNA, 64 nt, hsa
auuauguuuuuugcaguguuaccagaaucaaggcucuguuuauuccccacaagacuugcauaga

SEQ ID NO: 511462 - RNA, 64 nt, hsa
uugaaauucuuuuuuuuuaagccacauuaaauuaucuguuuauaaauacuaaagcaggaaaaug

SEQ ID NO: 511463 - RNA, 64 nt, hsa
uuuaguaugaaaaucugguagauccuauuacacuucuguuuauauuaaauccacaauauuuuau

SEQ ID NO: 511464 - RNA, 64 nt, hsa
ucuagcaauagcaugauguuacaggaauauuaccucuguuuaagcaagguaauguguaaaauca

SEQ ID NO: 511465 - RNA, 64 nt, hsa
uggcacucaugguuuuuaaauaagauuaguauuaucuguuuauaaugccuguuaauaaaagaau

SEQ ID NO: 511466 - RNA, 64 nt, hsa
acuuuccccaauugagauaaaaguguuuuaaaauucuguuuauaguuuuugauaugcauauaua

SEQ ID NO: 511467 - RNA, 64 nt, hsa
ggaagauuaauacuguguuauaauauuuucucuuucuguuuacugggaagauucagcuguacag

SEQ ID NO: 511468 - RNA, 64 nt, hsa
ccuuuacuuuuuuuguucugacuuuccuguacccucuguuuaaacuuuccguucucucaaccug

SEQ ID NO: 511469 - RNA, 64 nt, hsa
uuuguuuugucauauuugcuuucacugucuauuaucuguuuaagucucauaacucuauuuuuag

SEQ ID NO: 511470 - RNA, 64 nt, hsa
aauauuagccaaauuucucucuguuuuauauaugucuguuuauuucaguuugugguuucugcaa

SEQ ID NO: 511471 - RNA, 64 nt, hsa
gauuuaaugagagaguacuauuuuuaaggagcuaucuguuuauguagaaugauuuuguuaagag

SEQ ID NO: 511472 - RNA, 64 nt, hsa
uuuuuaguaaucacuacuauaucaugucuuuuacucuguuuauaauaucaaguauuuucuuaaa

SEQ ID NO: 511473 - RNA, 64 nt, hsa
auagauauaauuuuucuugaaggcaauuuaguagucuguuuauccuauaauucuacuuguaaga

SEQ ID NO: 511474 - RNA, 64 nt, hsa
uauucuacaugacaacucucaagguacucacagaucuguuuaacccacuugaaaaaaaaacacu

SEQ ID NO: 511475 - RNA, 64 nt, hsa
aacaaaaauuguuuauaucuuggaaaaaaaacuuucuguuuaaaaaaaauaaacaagugaaugu

SEQ ID NO: 511476 - RNA, 64 nt, hsa
ugucuguuuccauuugaauuucuuauuguaaaaaucuguuuaaauccauuuauauuauuuuaca

SEQ ID NO: 511477 - RNA, 64 nt, hsa
cuuucuccauauuagauuuacccacagcuauauuucuguuuaaguacuagggugaggguuuucu

SEQ ID NO: 511478 - RNA, 64 nt, hsa
uuuaaagcuacaaucuguucaauguuuuuaaaaaucuguuuauaugacauuguuaaaauaaagu

SEQ ID NO: 511479 - RNA, 64 nt, hsa
cuguguccugcccauguccuccuugguggacguuucuguuuacucagagcugcuagagaccauc

SEQ ID NO: 511480 - RNA, 64 nt, hsa
ucuucucagauuucucccuuccuagaacauucucucuguuuagcacuaauguucaccucguauu

SEQ ID NO: 511481 - RNA, 64 nt, hsa
guauuuuuuggaagugcaaaaaucucaauuugugucuguuuacagcucucucuccucacugcuc

SEQ ID NO: 511482 - RNA, 64 nt, hsa
gccugaugggcaaugaacaaacgggugauaugucucuguuuaagggaaaaauggcuuaaaagcu

SEQ ID NO: 511483 - RNA, 64 nt, hsa
augguccuccagagaauaguuuugacuuaacaugucuguuuagcccacaucacgucaguuauca

SEQ ID NO: 511484 - RNA, 64 nt, hsa
uggaauuccuuugcauaggagaauguuuuuaugaucuguuuagugcuuauuauuuuuuuuauga

SEQ ID NO: 511485 - RNA, 64 nt, hsa
augaucuguuuagugcuuauuauuuuuuuuaugaucuguuuagugcuuauuauuuuccaguaaa

SEQ ID NO: 511486 - RNA, 64 nt, hsa
uauuaucugaaaaauggauuucuugagcaaaagaucuguuuauuguauguaaggaaaaauuuua

SEQ ID NO: 511487 - RNA, 64 nt, hsa
uuugaaaaauauuccacaugguaaucuuauaaauucuguuuaauuacaucuguaaauauuaugu

SEQ ID NO: 511488 - RNA, 64 nt, hsa
uuguggguuuucuguuugaaaaggagucauggcaucuguuuacauuuaccuuaucaaaccuaga

SEQ ID NO: 511489 - RNA, 64 nt, hsa
gguauguuucaaguuuguauuaauuuguaauagcucuguuuagaaaaaaucaaagaccaugauu

SEQ ID NO: 511490 - RNA, 64 nt, hsa
ccuugggauuauggguguaacaaaaaucccuacaucuguuuaugaaggccauauucaguacauu

SEQ ID NO: 511491 - RNA, 64 nt, hsa
aggccauauucaguacauuuuaaaugguaaauaaucuguuuaugugaagaaaaagaauuaaguc

SEQ ID NO: 511492 - RNA, 64 nt, hsa
aguuauuuaauauaaauagucucugauuuuaaguucuguuuaauguucauucuccuuccaagaa

SEQ ID NO: 511493 - RNA, 64 nt, hsa
cuuuguuaaagcaaaaacuaugcgaaagggugagucuguuuagaagaaaaagcaaagacugagg

SEQ ID NO: 511494 - RNA, 64 nt, hsa
cagcucuaauacauuccaacucguauagcaugcaucuguuuauucuauaguuauuaaguucuuu

SEQ ID NO: 511495 - RNA, 64 nt, hsa
gaugugaaccauuaaccagaucuagucaaucaagucuguuuacugcaagguucaacuuauuaac

SEQ ID NO: 511496 - RNA, 64 nt, hsa
uauuuuuuuguagaugaaaaagcauguacaguguucuguuuaauacucauccuuguauaaaaaa

SEQ ID NO: 511497 - RNA, 64 nt, hsa
gcuuggcuucuucuuuaggauugugaugguucguucuguuuacaucaguuuuaacgagagguau

SEQ ID NO: 511498 - RNA, 64 nt, hsa
uucaaaaacuugaaaugcaggacgccauuaagugucuguuuauauuuuuggaauauuuguauua

SEQ ID NO: 511499 - RNA, 64 nt, hsa
uugagugaauuugccuucaguuaacaugggaccuucuguuuagcuuccucuugcuucccaaaga

SEQ ID NO: 511500 - RNA, 64 nt, hsa
cuuacaggauugcuugaaauuauuguggguauuaucuguuuaccagagauacuaaauauuaguu

SEQ ID NO: 511501 - RNA, 64 nt, hsa
uuauugcggaaucauugcugcuaaauaacuacugucuguuuauuuaacacaacaauugaaugcc

SEQ ID NO: 511502 - RNA, 64 nt, hsa
gugaggagagagacucaguucagcaacuguuuauucuguuuauugagcacuuacuuggaccaag

SEQ ID NO: 511503 - RNA, 64 nt, hsa
uuauaaaguaacauaucuggaauuugaaaucagaucuguuuagggcuaaugcugcauuuuucua

SEQ ID NO: 511504 - RNA, 64 nt, hsa
guguuuguaacugugauuaugauagaggccuaucucuguuuacaugcauagcuuugaguuaggc

SEQ ID NO: 511505 - RNA, 64 nt, hsa
auauuauucuauuuagcuuguaaaacacauggaaucuguuuaagauagcccuuguaaaauugaa

SEQ ID NO: 511506 - RNA, 64 nt, hsa
cugugccucagcccacaggccacugugauaauggucuguuuagcacuucuguauuuauuguaag

SEQ ID NO: 511507 - RNA, 64 nt, hsa
gagucucacuuuggaaucagaauuggaaucacauucuguuuaucaagccauaauguaaggacag

SEQ ID NO: 511508 - RNA, 64 nt, hsa
uaguugccaucuauauagcaucuuugaugaaaugucuguuuauauauuuugcacacuuuaaaau

SEQ ID NO: 511509 - RNA, 64 nt, hsa
uuccucccaggaauuaauaaaugugaagagaggcucuguuuaaaaugucuuuggacucccaggg

SEQ ID NO: 511510 - RNA, 64 nt, hsa
ccggucaaguugguuucaaaguccgacaggcuugucuguuuacuagcugcguggccuuggacgg

SEQ ID NO: 511511 - RNA, 64 nt, hsa
uuuucucaagagggauguauuuaucacuuggacaucuguuuauaauauaaacagacaugugacu

SEQ ID NO: 511512 - RNA, 64 nt, hsa
uuaguuuuacuaaaaucuguaaauacuguauuuuucuguuuauuccaaauuugaugaaacugac

SEQ ID NO: 511513 - RNA, 64 nt, hsa
uucugugaaaaauaaauuuccuucuuguaccauuucuguuuaguuuuacuaaaaucuguaaaua

SEQ ID NO: 511514 - RNA, 64 nt, hsa
uugugucuuacauugguagccagccagccaaggcucuguuuaugcuuuuggggggcauauauug

SEQ ID NO: 511515 - RNA, 64 nt, hsa
uaacauuuuugguagucuucaaccagggauuguuucuguuuaacuucuuauaggaaagcuugag

SEQ ID NO: 511516 - RNA, 64 nt, hsa
cuguuacuauuuaaaaaaaaaauacccuaaguacucuguuuacuucuggugaaacaaaaccagu

SEQ ID NO: 511517 - RNA, 64 nt, hsa
ccugacucccaaucaguuucacaaagggauucaaucuguuuauauacguuacauuccuggauac

SEQ ID NO: 511518 - RNA, 64 nt, hsa
cuaugaccaaagcuucuauuuugccaaaaaguuaaauaccgauaaaauggccuuaaguguauuc

SEQ ID NO: 511519 - RNA, 64 nt, hsa
aaaacaacgcugcauauacagguaccauuuaggaaauaccgaugccuuugugggggcagaauca

SEQ ID NO: 511520 - RNA, 64 nt, hsa
acugaaugccauaaucucgaucaaaccgauccagaauaccgaagguauggacaggacagaaaag

SEQ ID NO: 511521 - RNA, 64 nt, hsa
augcaagcaguuuauaugggagaugauuccaggaaauaccgauaugagaauggggaaaugaaac

SEQ ID NO: 511522 - RNA, 64 nt, hsa
ugccuuuucuacgagcauuuggaaggagugaucaaauaccgaaauugaacuuucuaaaaccuac

SEQ ID NO: 511523 - RNA, 64 nt, hsa
uaauagugucuucuauggcauguaauggauaccuaauaccgaugaguuaaaucuugcaaguuaa

SEQ ID NO: 511524 - RNA, 64 nt, hsa
uagggauuucaccccuggcuuuuaaaaaaaacgaaauaccgacaagccacaaggaccaauguag

SEQ ID NO: 511525 - RNA, 64 nt, hsa
uauugaugcagaucagagaguucuuagaauacagaauaccgaugacaaugauaaguaugacaug

SEQ ID NO: 511526 - RNA, 64 nt, hsa
ugaaugugauuuucauuccuugauucacccaacaaauaccgacuggcugagcaccugcugugug

SEQ ID NO: 511527 - RNA, 64 nt, hsa
aaaaucaaaucauuugcauucccacagcauccugaauaccgacuaccucuucacuugcuaaagc

SEQ ID NO: 511528 - RNA, 64 nt, hsa
acugccuaccgagcucccucaugccugcaauuuaaauaccgagguguguucugagagccccagg

SEQ ID NO: 511529 - RNA, 64 nt, hsa
aaacugcugccaaaaagauaccaauaacacuaacaauaccgaucuugaaaaaucaucagcagug

SEQ ID NO: 511530 - RNA, 64 nt, hsa
uagaugauggugugggggguuggaguuuucuucuaauaccgaggguuccuggcugugaggaaac

SEQ ID NO: 511531 - RNA, 64 nt, hsa
uugguuuuaaaccuuuaaugagaaaaaaauauauaauaccgagcucaaaaacacuguguuuggu

SEQ ID NO: 511532 - RNA, 64 nt, hsa
ucuccgcugggcucccagagcugcuggcguuucgaauaccgaaaagucaacccuguggaccacg

SEQ ID NO: 511533 - RNA, 64 nt, hsa
ccaggucuagcccaacagucuaaacuauccagucaauaccgagugaaguggcagccagcacugu

SEQ ID NO: 511534 - RNA, 64 nt, hsa
gugcguuccuuaaagacagacauugaggagagcaaauaccgacagcgccaccugaagguggagu

SEQ ID NO: 511535 - RNA, 64 nt, hsa
auucugucauaggcauagagaguugcacauaaaaaauaccgaagaaaacccaaaauucaaucaa

SEQ ID NO: 511536 - RNA, 64 nt, hsa
cugucaggugugacugucaguuugcuggucuuccaauaccgaagaaagggugguugugacaaua

SEQ ID NO: 511537 - RNA, 64 nt, hsa
agcagggagggauugggggugggggaggccucaaaauaccgacugcguccauucucugccucca

SEQ ID NO: 511538 - RNA, 64 nt, hsa
uaagaggaagaagaagaaaggggcacacacacacaauaccgacgucuauccuuuccugcuaggc

SEQ ID NO: 511539 - RNA, 64 nt, hsa
gggcucucuccugggaugggggcagguguuccugaauaccgacaggccugcuggguaaaugacu

SEQ ID NO: 511540 - RNA, 64 nt, hsa
cugggcuggagagcagguucgggcagccgucgggaauaccgaccauccucuucucccuucuaac

SEQ ID NO: 511541 - RNA, 64 nt, hsa
uucccugucgcuugcccucauucucaccaugugaaauaccgacacccgcuuugccuuccaccau

SEQ ID NO: 511542 - RNA, 64 nt, hsa
caaauucgcacagagguuuugcuuuaugcuguagaauaccgacuuucaugaugacaacuugguu

SEQ ID NO: 511543 - RNA, 64 nt, hsa
acacucuggggaguaucuauucucaggugagcaaaauaccgaauacugaauggaaaucaacugu

SEQ ID NO: 511544 - RNA, 64 nt, hsa
cuacaugaggauaagcauuucuggcaaagaggaaaauaccgacuggucuuaugagaagcagugg

SEQ ID NO: 511545 - RNA, 64 nt, hsa
aaucuguaccaaccaacggcuggaaaugcaaaugaauaccgaauuggaaaaacagauuucuaau

SEQ ID NO: 511546 - RNA, 64 nt, hsa
ggguugggggcgggguaauuauuuuauuuaaaaaaauaccgagcagcaaaaggggagaagaucc

SEQ ID NO: 511547 - RNA, 64 nt, hsa
uuucccaggacauuuuuuuuucuguaucaugucuccccaucauugaagcgcaaauuuucuugaa

SEQ ID NO: 511548 - RNA, 64 nt, hsa
gguguugagccgcucauagcaugugaccuaccuaccccaucagaaauaacuuuuuaucuugcuc

SEQ ID NO: 511549 - RNA, 64 nt, hsa
gaacucuaagaaugccaaagggaccgacgagacuccccaucacagcgagcucuguccuuacaug

SEQ ID NO: 511550 - RNA, 64 nt, hsa
ucaccuuuucugcuugcuacacaggcaacgauucccccaucagcugcccggacccuuuggccug

SEQ ID NO: 511551 - RNA, 64 nt, hsa
ggggaugcuucccucugcccucuuuccugccccuccccaucauaccugcacccaccccagccag

SEQ ID NO: 511552 - RNA, 64 nt, hsa
ugcauuguggggggacaggcucaagcaauucuguccccaucaaggggucagcuggagagaccca

SEQ ID NO: 511553 - RNA, 64 nt, hsa
acaugcuccgcaaaguucuccgcacacacuucuuccccaucaagcccauuuccuuccccaacca

SEQ ID NO: 511554 - RNA, 64 nt, hsa
aaaucucacugucucguuuucacaccgcaucaguccccaucaucacuacuccuccccagagaca

SEQ ID NO: 511555 - RNA, 64 nt, hsa
uacugcccaagguaauuuauagauucaaugccauccccaucaagcuaccaaugacuuucuucac

SEQ ID NO: 511556 - RNA, 64 nt, hsa
caaugaacucaaacaaauuuacaggaacaaacaaccccaucaaaaagucggcaaaggacaugaa

SEQ ID NO: 511557 - RNA, 64 nt, hsa
gguucagcccagaagcccuuccaggcaugaucuuccccaucaggcugggcucuggcagggaccu

SEQ ID NO: 511558 - RNA, 64 nt, hsa
ccugcagcuggacccugcaggguggcucccuccuccccaucaagcacaagagagggcccaggaa

SEQ ID NO: 511559 - RNA, 64 nt, hsa
uugcuucauacauacuugaccucucuuuucuauuccccaucacuuuugugcugaagcuaaucau

SEQ ID NO: 511560 - RNA, 64 nt, hsa
ggcuaauggaaaauacccaagggagggcaaagccccccaucagaugcaugaauguuugcgaaug

SEQ ID NO: 511561 - RNA, 64 nt, hsa
ggucucgguugucguuuuuucuugcugcuccuccccccaucaccugagcuguuuucuguuggcc

SEQ ID NO: 511562 - RNA, 64 nt, hsa
uguuccagaggugcagacaagagguggcgagagcccccaucaugccccucaaccuaucccguuc

SEQ ID NO: 511563 - RNA, 64 nt, hsa
ugggggcugggacuaaagaaaugggugucccccaccccaucagcugggaaagcccaggccgcag

SEQ ID NO: 511564 - RNA, 64 nt, hsa
gccccuuucccugacugucaaggacaacugacucccccaucagcucaaacauuaaggguacccg

SEQ ID NO: 511565 - RNA, 64 nt, hsa
ccccccaccucgggucccugaccccagcucgaugccccaucaccgccucucccuggcucccaag

SEQ ID NO: 511566 - RNA, 64 nt, hsa
gcucccaagggugcaggugggcgcaaggcccggcccccaucacauguucccuuggccucagagc

SEQ ID NO: 511567 - RNA, 64 nt, hsa; identical to SEQ ID NO: 257286

SEQ ID NO: 511568 - RNA, 64 nt, hsa; identical to SEQ ID NO: 257287

SEQ ID NO: 511569 - RNA, 64 nt, hsa; identical to SEQ ID NO: 257288

SEQ ID NO: 511570 - RNA, 64 nt, hsa; identical to SEQ ID NO: 257289

SEQ ID NO: 511571 - RNA, 64 nt, hsa; identical to SEQ ID NO: 257290

SEQ ID NO: 511572 - RNA, 64 nt, hsa; identical to SEQ ID NO: 257291

SEQ ID NO: 511573 - RNA, 64 nt, hsa; identical to SEQ ID NO: 257292

SEQ ID NO: 511574 - RNA, 64 nt, hsa; identical to SEQ ID NO: 257293

SEQ ID NO: 511575 - RNA, 64 nt, hsa; identical to SEQ ID NO: 257294

SEQ ID NO: 511576 - RNA, 64 nt, hsa; identical to SEQ ID NO: 257295

SEQ ID NO: 511577 - RNA, 64 nt, hsa; identical to SEQ ID NO: 257296

SEQ ID NO: 511578 - RNA, 64 nt, hsa; identical to SEQ ID NO: 257297

SEQ ID NO: 511579 - RNA, 64 nt, hsa; identical to SEQ ID NO: 257298

SEQ ID NO: 511580 - RNA, 64 nt, hsa; identical to SEQ ID NO: 257299

SEQ ID NO: 511581 - RNA, 64 nt, hsa; identical to SEQ ID NO: 257300

SEQ ID NO: 511582 - RNA, 64 nt, hsa; identical to SEQ ID NO: 257301

SEQ ID NO: 511583 - RNA, 64 nt, hsa; identical to SEQ ID NO: 257302

SEQ ID NO: 511584 - RNA, 64 nt, hsa; identical to SEQ ID NO: 257303

SEQ ID NO: 511585 - RNA, 64 nt, hsa; identical to SEQ ID NO: 257304

SEQ ID NO: 511586 - RNA, 64 nt, hsa; identical to SEQ ID NO: 257305

SEQ ID NO: 511587 - RNA, 64 nt, hsa; identical to SEQ ID NO: 257306

SEQ ID NO: 511588 - RNA, 64 nt, hsa; identical to SEQ ID NO: 257307

SEQ ID NO: 511589 - RNA, 64 nt, hsa; identical to SEQ ID NO: 257308

SEQ ID NO: 511590 - RNA, 64 nt, hsa; identical to SEQ ID NO: 257309

SEQ ID NO: 511591 - RNA, 54 nt, hsa; identical to SEQ ID NO: 257310

SEQ ID NO: 511592 - RNA, 64 nt, hsa; identical to SEQ ID NO: 257311

SEQ ID NO: 511593 - RNA, 64 nt, hsa; identical to SEQ ID NO: 257312

SEQ ID NO: 511594 - RNA, 64 nt, hsa; identical to SEQ ID NO: 257313

SEQ ID NO: 511595 - RNA, 64 nt, hsa; identical to SEQ ID NO: 257314

SEQ ID NO: 511596 - RNA, 64 nt, hsa; identical to SEQ ID NO: 257315

SEQ ID NO: 511597 - RNA, 64 nt, hsa; identical to SEQ ID NO: 257316

SEQ ID NO: 511598 - RNA, 64 nt, hsa; identical to SEQ ID NO: 257317

SEQ ID NO: 511599 - RNA, 64 nt, hsa; identical to SEQ ID NO: 257318

SEQ ID NO: 511600 - RNA, 64 nt, hsa; identical to SEQ ID NO: 257319

SEQ ID NO: 511601 - RNA, 64 nt, hsa
agcauauaguguuguauauuguaaauuguaauuucaaccagaaguaaauuuuuuucuuuugaag

SEQ ID NO: 511602 - RNA, 64 nt, hsa
cugaccucacuggcccacuggcaaauccaaccagcaaccagaaauguucuaguguagagucuga

SEQ ID NO: 511603 - RNA, 64 nt, hsa
gcugacagaccuucuggccagacagacuccuaaccaaccagauggacugccagacaggcagaca

SEQ ID NO: 511604 - RNA, 64 nt, hsa
cagaccccagccagacccccgccagacagacucccaaccagacugaccccuuacuauucacaca

SEQ ID NO: 511605 - RNA, 64 nt, hsa
aauuuuuuaauugauguuguuaugggcaggauggcaaccagaccauugucucagagcaggugcu

SEQ ID NO: 511606 - RNA, 64 nt, hsa
guuaacuaauucuuggguguuuauccuaucucuccaaccagauugucagcuccuugagggcaag

SEQ ID NO: 511607 - RNA, 64 nt, hsa
guaucgauuaucauaaauucacaaaauauuuuugcaaccagaacacaaaagcaggcuagucagc

SEQ ID NO: 511608 - RNA, 64 nt, hsa
uggaucuuguccaaauuuagugaaauguggaagucaaccagaccaaugauggaauuaaauguaa

SEQ ID NO: 511609 - RNA, 64 nt, hsa
cgccuugagccgagggcauaugcgggggggcagccaaccagagcuggucacuccucaggaccau

SEQ ID NO: 511610 - RNA, 64 nt, hsa
gaaagggaggcucucuuaagagcuaugugccuuccaaccagagggagacccaguagaaagaaaa

SEQ ID NO: 511611 - RNA, 64 nt, hsa
gaugauccuaaaaauaaccgaagaaagagaggaccaaccagaauucccuuuggacauuuguguu

SEQ ID NO: 511612 - RNA, 64 nt, hsa
cucuuaguugaacagugugcccuagcuuuucuugcaaccagaguauuuuuguacagauuugcuu

SEQ ID NO: 511613 - RNA, 64 nt, hsa
ccccuaagucccuuugucuugacccccaagucuucaaccagauauccucggcaacccaccuccc

SEQ ID NO: 511614 - RNA, 64 nt, hsa
caggccugguucccaagacccgauccuuccccugcaaccagacagucuacaacugcccccucca

SEQ ID NO: 511615 - RNA, 64 nt, hsa
ccaccagguggcccauuacucgagaugaucaucacaaccagaugaugcuaaccuauauccucua

SEQ ID NO: 511616 - RNA, 64 nt, hsa
gccucacagggaaucugauaauacauacuucugucaaccagaaccagagggguaguuuucuuuu

SEQ ID NO: 511617 - RNA, 64 nt, hsa; identical to SEQ ID NO: 380623

SEQ ID NO: 511618 - RNA, 64 nt, hsa; identical to SEQ ID NO: 380624

SEQ ID NO: 511619 - RNA, 64 nt, hsa; identical to SEQ ID NO: 380625

SEQ ID NO: 511620 - RNA, 64 nt, hsa; identical to SEQ ID NO: 380626

SEQ ID NO: 511621 - RNA, 64 nt, hsa; identical to SEQ ID NO: 380627

SEQ ID NO: 511622 - RNA, 64 nt, hsa; identical to SEQ ID NO: 380628

SEQ ID NO: 511623 - RNA, 64 nt, hsa; identical to SEQ ID NO: 380629

SEQ ID NO: 511624 - RNA, 64 nt, hsa; identical to SEQ ID NO: 380630

SEQ ID NO: 511625 - RNA, 64 nt, hsa; identical to SEQ ID NO: 380631

SEQ ID NO: 511626 - RNA, 64 nt, hsa; identical to SEQ ID NO: 380632

SEQ ID NO: 511627 - RNA, 64 nt, hsa; identical to SEQ ID NO: 380633

SEQ ID NO: 511628 - RNA, 64 nt, hsa; identical to SEQ ID NO: 380634

SEQ ID NO: 511629 - RNA, 64 nt, hsa; identical to SEQ ID NO: 380635

SEQ ID NO: 511630 - RNA, 64 nt, hsa; identical to SEQ ID NO: 380636

SEQ ID NO: 511631 - RNA, 64 nt, hsa; identical to SEQ ID NO: 380637

SEQ ID NO: 511632 - RNA, 64 nt, hsa; identical to SEQ ID NO: 380638

SEQ ID NO: 511633 - RNA, 64 nt, hsa; identical to SEQ ID NO: 380639

SEQ ID NO: 511634 - RNA, 64 nt, hsa; identical to SEQ ID NO: 380640

SEQ ID NO: 511635 - RNA, 64 nt, hsa; identical to SEQ ID NO: 380641

SEQ ID NO: 511636 - RNA, 64 nt, hsa; identical to SEQ ID NO: 380642

SEQ ID NO: 511637 - RNA, 64 nt, hsa; identical to SEQ ID NO: 380643

SEQ ID NO: 511638 - RNA, 64 nt, hsa; identical to SEQ ID NO: 380644

SEQ ID NO: 511639 - RNA, 64 nt, hsa; identical to SEQ ID NO: 380645

SEQ ID NO: 511640 - RNA, 64 nt, hsa; identical to SEQ ID NO: 380646

SEQ ID NO: 511641 - RNA, 64 nt, hsa; identical to SEQ ID NO: 380647

SEQ ID NO: 511642 - RNA, 64 nt, hsa; identical to SEQ ID NO: 380648

SEQ ID NO: 511643 - RNA, 64 nt, hsa; identical to SEQ ID NO: 380649

SEQ ID NO: 511644 - RNA, 64 nt, hsa; identical to SEQ ID NO: 380650

SEQ ID NO: 511645 - RNA, 64 nt, hsa; identical to SEQ ID NO: 380651

SEQ ID NO: 511646 - RNA, 64 nt, hsa; identical to SEQ ID NO: 380652

SEQ ID NO: 511647 - RNA, 64 nt, hsa; identical to SEQ ID NO: 368368

SEQ ID NO: 511648 - RNA, 64 nt, hsa; identical to SEQ ID NO: 368369

SEQ ID NO: 511649 - RNA, 64 nt, hsa; identical to SEQ ID NO: 368370

SEQ ID NO: 511650 - RNA, 64 nt, hsa; identical to SEQ ID NO: 368371

SEQ ID NO: 511651 - RNA, 64 nt, hsa; identical to SEQ ID NO: 368372

SEQ ID NO: 511652 - RNA, 64 nt, hsa; identical to SEQ ID NO: 368373

SEQ ID NO: 511653 - RNA, 64 nt, hsa; identical to SEQ ID NO: 368374

SEQ ID NO: 511654 - RNA, 64 nt, hsa; identical to SEQ ID NO: 368375

SEQ ID NO: 511655 - RNA, 64 nt, hsa; identical to SEQ ID NO: 368376

SEQ ID NO: 511656 - RNA, 64 nt, hsa; identical to SEQ ID NO: 368377

SEQ ID NO: 511657 - RNA, 64 nt, hsa; identical to SEQ ID NO: 368378

SEQ ID NO: 511658 - RNA, 64 nt, hsa; identical to SEQ ID NO: 368379

SEQ ID NO: 511659 - RNA, 64 nt, hsa; identical to SEQ ID NO: 368380

SEQ ID NO: 511660 - RNA, 64 nt, hsa; identical to SEQ ID NO: 368381

SEQ ID NO: 511661 - RNA, 64 nt, hsa; identical to SEQ ID NO: 368382

SEQ ID NO: 511662 - RNA, 64 nt, hsa; identical to SEQ ID NO: 368383

SEQ ID NO: 511663 - RNA, 64 nt, hsa
uucagcuggaccacucaggccuggacagccucaucuccaugaggcuggugcuucggguaaaucu

SEQ ID NO: 511664 - RNA, 64 nt, hsa
aauuauauacauacaauucuuguguggaauuuaacuccaugacugaauagcauaaggaagaggu

SEQ ID NO: 511665 - RNA, 64 nt, hsa
gacaccccccaccauggugggcuugugguggcugcuccaugagggugggggugauacuacuaga

SEQ ID NO: 511666 - RNA, 64 nt, hsa
gccugcgcaggcgggacuaucaggaguccacugccuccaugaugcaagccagcuuccugugcag

SEQ ID NO: 511667 - RNA, 64 nt, hsa
cuuugaagauggcgcucugggcaugagcauggggcuccaugacuucccuucuauccccaugagc

SEQ ID NO: 511668 - RNA, 64 nt, hsa
uagagcgugggaggugccuuugagaacugcuugacuccaugaucuccuagaacaaaaccgcccu

SEQ ID NO: 511669 - RNA, 64 nt, hsa
ggcaagcacaaugguuucaaagaaagacuguaagcuccaugauuagcauaaagcacuaaccaug

SEQ ID NO: 511670 - RNA, 64 nt, hsa
augguagccucuggguuguuguuuuuuucuuuuccuccaugauguuaauggguuaucucaaauu

SEQ ID NO: 511671 - RNA, 64 nt, hsa
agaggcacaugguucuagccuggaccuggcugggcuccaugagaaugaguugccuccaaccugu

SEQ ID NO: 511672 - RNA, 64 nt, hsa
cucaggcaccuuuccuccccuggacacccauggucuccaugagugcucccucugcugccccuga

SEQ ID NO: 511673 - RNA, 64 nt, hsa; identical to SEQ ID NO: 119362

SEQ ID NO: 511674 - RNA, 64 nt, hsa; identical to SEQ ID NO: 119363

SEQ ID NO: 511675 - RNA, 64 nt, hsa; identical to SEQ ID NO: 119364

SEQ ID NO: 511676 - RNA, 64 nt, hsa; identical to SEQ ID NO: 119365

SEQ ID NO: 511677 - RNA, 64 nt, hsa; identical to SEQ ID NO: 119366

SEQ ID NO: 511678 - RNA, 64 nt, hsa; identical to SEQ ID NO: 119367

SEQ ID NO: 511679 - RNA, 64 nt, hsa; identical to SEQ ID NO: 119368

SEQ ID NO: 511680 - RNA, 64 nt, hsa; identical to SEQ ID NO: 119369

SEQ ID NO: 511681 - RNA, 64 nt, hsa; identical to SEQ ID NO: 119370

SEQ ID NO: 511682 - RNA, 64 nt, hsa; identical to SEQ ID NO: 119371

SEQ ID NO: 511683 - RNA, 64 nt, hsa; identical to SEQ ID NO: 119372

SEQ ID NO: 511684 - RNA, 64 nt, hsa; identical to SEQ ID NO: 119373

SEQ ID NO: 511685 - RNA, 64 nt, hsa; identical to SEQ ID NO: 119374

SEQ ID NO: 511686 - RNA, 64 nt, hsa; identical to SEQ ID NO: 119375

SEQ ID NO: 511687 - RNA, 64 nt, hsa; identical to SEQ ID NO: 119376

SEQ ID NO: 511688 - RNA, 64 nt, hsa; identical to SEQ ID NO: 119377

SEQ ID NO: 511689 - RNA, 64 nt, hsa; identical to SEQ ID NO: 296587

SEQ ID NO: 511690 - RNA, 64 nt, hsa; identical to SEQ ID NO: 296588

SEQ ID NO: 511691 - RNA, 64 nt, hsa; identical to SEQ ID NO: 270835

SEQ ID NO: 511692 - RNA, 64 nt, hsa; identical to SEQ ID NO: 270836

SEQ ID NO: 511693 - RNA, 64 nt, hsa; identical to SEQ ID NO: 270837

SEQ ID NO: 511694 - RNA, 64 nt, hsa; identical to SEQ ID NO: 270838

SEQ ID NO: 511695 - RNA, 64 nt, hsa
ggggaggguggaagggagggacugauauaaguaaggagaugaguaguuguguuacaguucauuu

SEQ ID NO: 511696 - RNA, 64 nt, hsa
caaugcgaaguauuugggugagaacugagaggugggagaugauuggaggccauggccuauguac

SEQ ID NO: 511697 - RNA, 64 nt, hsa
aagauagucuuggaagcuguuuggaaaagacaguggagaugaggucaguuguguuuuuuaagau

SEQ ID NO: 511698 - RNA, 64 nt, hsa
ggcaagcugaaauuuuagaaauauucacaucuucggagaugaggaguaaaauucaguuuuuuuc

SEQ ID NO: 511699 - RNA, 64 nt, hsa
ucaggacaggaguugaacaauuagguuagcagauggagaugagaggacuggguagaguaccaug

SEQ ID NO: 511700 - RNA, 64 nt, hsa
ugagcagaaaauucauaaaaauguaucaucagcaggagaugagacuaugaauuggcauccagaa

SEQ ID NO: 511701 - RNA, 64 nt, hsa
ggaugcacacuuguuaaauaguguuaagagauguggagaugagauauaccccuuugauguagaa

SEQ ID NO: 511702 - RNA, 64 nt, hsa
gaggaugaauaaaaacagcaaaaccaaauaaaguggagaugagugauugagugagguagauugc

SEQ ID NO: 511703 - RNA, 64 nt, hsa
acgaauauggacguaauugcagaaggaacuucaaggagaugaaugaaugcuaaaaggguucuug

SEQ ID NO: 511704 - RNA, 64 nt, hsa
aacagccuucugauggccaugaaaggacaaguauggagaugaaagcuaucacacugagaauagu

SEQ ID NO: 511705 - RNA, 64 nt, hsa
agcauguauuuuuaucaauuuaacacagaucaaaggagaugaagggacauucugccaugacaua

SEQ ID NO: 511706 - RNA, 64 nt, hsa
agcugcaggguucuuuuugggaggugggaggaagggagaugaguuuuguuauuuugggguuuuc

SEQ ID NO: 511707 - RNA, 64 nt, hsa
gggaagcugaauguugagggagguggaggaaggaggagaugagcagugucaguaaauacugugc

SEQ ID NO: 511708 - RNA, 64 nt, hsa
gauauggcacaugcuaucaguuuuuuggggcaggggagaugaacuuuaaaaaaaaaaaaaaaac

SEQ ID NO: 511709 - RNA, 64 nt, hsa
agcugcccgccguggaaauugaggaagggcggcuggagaugauagagacaaaagucaagcccuc

SEQ ID NO: 511710 - RNA, 64 nt, hsa
ugcggcuuccagagguacagcugcugaaagugucggagaugaaacucccaaaggugccagagau

SEQ ID NO: 511711 - RNA, 64 nt, hsa
gagugucuuaucccugagcaaucuuucgauggauggagaugaucauuagguacuuuuguuucaa

SEQ ID NO: 511712 - RNA, 64 nt, hsa
uccaucaggcuguuuccuaaaggaugugugaacgggagaugaugcacuguguuuugaaaguugu

SEQ ID NO: 511713 - RNA, 64 nt, hsa
gucauuaguggucauaugaaaauggccccaagaaggagaugauucuuucaagggacacaggcag

SEQ ID NO: 511714 - RNA, 64 nt, hsa
ugggguggggcggugugacaggguagaggaggugggagaugagaucuuccgcacaggaacacgc

SEQ ID NO: 511715 - RNA, 64 nt, hsa
gacgucugucccaaacucccccagcccugagcugggagaugacagggggaaagaggcccucuca

SEQ ID NO: 511716 - RNA, 64 nt, hsa
cagcuccuccccggagucccccagcacagucccaggagaugacaggaaggaagcaccagggcaa

SEQ ID NO: 511717 - RNA, 64 nt, hsa; identical to SEQ ID NO: 50929

SEQ ID NO: 511718 - RNA, 64 nt, hsa; identical to SEQ ID NO: 50930

SEQ ID NO: 511719 - RNA, 64 nt, hsa; identical to SEQ ID NO: 50931

SEQ ID NO: 511720 - RNA, 64 nt, hsa; identical to SEQ ID NO: 50932

SEQ ID NO: 511721 - RNA, 64 nt, hsa; identical to SEQ ID NO: 50933

SEQ ID NO: 511722 - RNA, 64 nt, hsa; identical to SEQ ID NO: 50934

SEQ ID NO: 511723 - RNA, 64 nt, hsa; identical to SEQ ID NO: 50935

SEQ ID NO: 511724 - RNA, 64 nt, hsa; identical to SEQ ID NO: 50936

SEQ ID NO: 511725 - RNA, 64 nt, hsa; identical to SEQ ID NO: 50937

SEQ ID NO: 511726 - RNA, 64 nt, hsa; identical to SEQ ID NO: 50938

SEQ ID NO: 511727 - RNA, 64 nt, hsa; identical to SEQ ID NO: 50939

SEQ ID NO: 511728 - RNA, 64 nt, hsa; identical to SEQ ID NO: 50940

SEQ ID NO: 511729 - RNA, 64 nt, hsa; identical to SEQ ID NO: 50941

SEQ ID NO: 511730 - RNA, 64 nt, hsa; identical to SEQ ID NO: 50942

SEQ ID NO: 511731 - RNA, 64 nt, hsa; identical to SEQ ID NO: 50943

SEQ ID NO: 511732 - RNA, 64 nt, hsa; identical to SEQ ID NO: 50944

SEQ ID NO: 511733 - RNA, 64 nt, hsa; identical to SEQ ID NO: 50945

SEQ ID NO: 511734 - RNA, 64 nt, hsa; identical to SEQ ID NO: 50946

SEQ ID NO: 511735 - RNA, 64 nt, hsa; identical to SEQ ID NO: 50947

SEQ ID NO: 511736 - RNA, 64 nt, hsa; identical to SEQ ID NO: 50948

SEQ ID NO: 511737 - RNA, 64 nt, hsa; identical to SEQ ID NO: 50949

SEQ ID NO: 511738 - RNA, 64 nt, hsa; identical to SEQ ID NO: 50950

SEQ ID NO: 511739 - RNA, 64 nt, hsa; identical to SEQ ID NO: 50951

SEQ ID NO: 511740 - RNA, 64 nt, hsa; identical to SEQ ID NO: 50952

SEQ ID NO: 511741 - RNA, 64 nt, hsa; identical to SEQ ID NO: 50953

SEQ ID NO: 511742 - RNA, 64 nt, hsa; identical to SEQ ID NO: 50954

SEQ ID NO: 511743 - RNA, 64 nt, hsa; identical to SEQ ID NO: 50955

SEQ ID NO: 511744 - RNA, 64 nt, hsa; identical to SEQ ID NO: 50956

SEQ ID NO: 511745 - RNA, 64 nt, hsa; identical to SEQ ID NO: 50957

SEQ ID NO: 511746 - RNA, 64 nt, hsa; identical to SEQ ID NO: 50958

SEQ ID NO: 511747 - RNA, 64 nt, hsa; identical to SEQ ID NO: 50959

SEQ ID NO: 511748 - RNA, 64 nt, hsa; identical to SEQ ID NO: 50960

SEQ ID NO: 511749 - RNA, 64 nt, hsa; identical to SEQ ID NO: 50961

SEQ ID NO: 511750 - RNA, 64 nt, hsa; identical to SEQ ID NO: 50962

SEQ ID NO: 511751 - RNA, 64 nt, hsa; identical to SEQ ID NO: 50963

SEQ ID NO: 511752 - RNA, 64 nt, hsa; identical to SEQ ID NO: 50964

SEQ ID NO: 511753 - RNA, 64 nt, hsa; identical to SEQ ID NO: 50965

SEQ ID NO: 511754 - RNA, 64 nt, hsa; identical to SEQ ID NO: 50966

SEQ ID NO: 511755 - RNA, 64 nt, hsa; identical to SEQ ID NO: 50967

SEQ ID NO: 511756 - RNA, 64 nt, hsa; identical to SEQ ID NO: 50968

SEQ ID NO: 511757 - RNA, 64 nt, hsa; identical to SEQ ID NO: 50969

SEQ ID NO: 511758 - RNA, 64 nt, hsa; identical to SEQ ID NO: 50970

SEQ ID NO: 511759 - RNA, 64 nt, hsa; identical to SEQ ID NO: 50971

SEQ ID NO: 511760 - RNA, 64 nt, hsa; identical to SEQ ID NO: 50972

SEQ ID NO: 511761 - RNA, 64 nt, hsa; identical to SEQ ID NO: 50973

SEQ ID NO: 511762 - RNA, 64 nt, hsa; identical to SEQ ID NO: 50974

SEQ ID NO: 511763 - RNA, 64 nt, hsa; identical to SEQ ID NO: 50975

SEQ ID NO: 511764 - RNA, 64 nt, hsa; identical to SEQ ID NO: 50976

SEQ ID NO: 511765 - RNA, 64 nt, hsa; identical to SEQ ID NO: 50977

SEQ ID NO: 511766 - RNA, 64 nt, hsa; identical to SEQ ID NO: 50978

SEQ ID NO: 511767 - RNA, 64 nt, hsa; identical to SEQ ID NO: 50979

SEQ ID NO: 511768 - RNA, 64 nt, hsa; identical to SEQ ID NO: 50980

SEQ ID NO: 511769 - RNA, 64 nt, hsa; identical to SEQ ID NO: 50981

SEQ ID NO: 511770 - RNA, 64 nt, hsa; identical to SEQ ID NO: 50982

SEQ ID NO: 511771 - RNA, 64 nt, hsa; identical to SEQ ID NO: 50983

SEQ ID NO: 511772 - RNA, 64 nt, hsa; identical to SEQ ID NO: 50984

SEQ ID NO: 511773 - RNA, 64 nt, hsa; identical to SEQ ID NO: 50985

SEQ ID NO: 511774 - RNA, 64 nt, hsa; identical to SEQ ID NO: 50986

SEQ ID NO: 511775 - RNA, 64 nt, hsa; identical to SEQ ID NO: 50987

SEQ ID NO: 511776 - RNA, 64 nt, hsa; identical to SEQ ID NO: 50988

SEQ ID NO: 511777 - RNA, 64 nt, hsa; identical to SEQ ID NO: 50989

SEQ ID NO: 511778 - RNA, 64 nt, hsa; identical to SEQ ID NO: 50990

SEQ ID NO: 511779 - RNA, 64 nt, hsa; identical to SEQ ID NO: 50991

SEQ ID NO: 511780 - RNA, 64 nt, hsa; identical to SEQ ID NO: 50992

SEQ ID NO: 511781 - RNA, 64 nt, hsa; identical to SEQ ID NO: 50993

SEQ ID NO: 511782 - RNA, 64 nt, hsa; identical to SEQ ID NO: 50994

SEQ ID NO: 511783 - RNA, 64 nt, hsa
guauguguguacucugcacguauaucucuucugucuugaagacccuguuaacuuugugaaauaa

SEQ ID NO: 511784 - RNA, 64 nt, hsa
acgugagucaccaugcccagccccaaagccauuucuugaagaauuucucgcaaacucacaaccc

SEQ ID NO: 511785 - RNA, 64 nt, hsa
guuuguuaaaccauauggauucucaagcuccucucuugaagauucugauucaguaggucuggga

SEQ ID NO: 511786 - RNA, 64 nt, hsa
uuaggggugaaauuuagaagucuuaguaauguaacuugaagauguuaaacaaaaaucucaagua

SEQ ID NO: 511787 - RNA, 64 nt, hsa
cgucuuaggaauaaaugccauucuuaugcuagaccuugaagaguagaaaauuaagagauggugg

SEQ ID NO: 511788 - RNA, 64 nt, hsa
gucaggaaccagacuacaguggacccuggagaaccuugaagaacauuuuuccuuuucaggaaaa

SEQ ID NO: 511789 - RNA, 64 nt, hsa
aaauucuuccaacucaugggauaaaggggacucccuugaagaauuucauguuuuugggcuguau

SEQ ID NO: 511790 - RNA, 64 nt, hsa
agguucuucuucacaaggcugagagugcuuccuucuugaagacgagugacauucaucacuucag

SEQ ID NO: 511791 - RNA, 64 nt, hsa
cuucacugaagcuaauguuuggaaaaaauauauacuugaagaaccaauccaagugugugccccu

SEQ ID NO: 511792 - RNA, 64 nt, hsa
ucacuuuaccuagcguuuuagaaauauuaauuuacuugaagagauguagaauguagcaaauuau

SEQ ID NO: 511793 - RNA, 64 nt, hsa
ugaauggguucuagugaaaaaggaaugauauauucuugaagacaucgauauacauuuauuuaca

SEQ ID NO: 511794 - RNA, 64 nt, hsa
ggauccuuucauaggagaacacacugaggagauacuugaagaauuuggauucagccgcgaagag

SEQ ID NO: 511795 - RNA, 64 nt, hsa
acguccucucccaggaacauucuuagcucggacucuugaagaaucucuuuagauuuuguuggca

SEQ ID NO: 511796 - RNA, 64 nt, hsa
cccuauaaggcuguggaaccugaggaaguagauacuugaagagauucuguuuaggaagaaacuc

SEQ ID NO: 511797 - RNA, 64 nt, hsa
aaugugaauuucuaccaaauaguagagcauaccacuugaagaaggaaagaaccgaagagcaaac

SEQ ID NO: 511798 - RNA, 64 nt, hsa
cuuugggacuaagcugcggaaucuucuuacuaagcuugaagaguggagaggcgagaggugagcu

SEQ ID NO: 511799 - RNA, 64 nt, hsa
caaaucccuucaccacaggguuucguuuugcuggcuugaagacaaauggucuuagaauucauug

SEQ ID NO: 511800 - RNA, 64 nt, hsa
ccauccuggcaugagcaguggcucacccaccggccuugaagaggugagcuuggccucucugguc

SEQ ID NO: 511801 - RNA, 64 nt, hsa
auucauccuuuaagaaaaacaccaccguacacugcuugaagaguuccucuucuauuacuuaaaa

SEQ ID NO: 511802 - RNA, 64 nt, hsa
gagaauguucuguaaggacuggaaacacuagaaucuugaagaaacgccuggcuagaggugaggg

SEQ ID NO: 511803 - RNA, 64 nt, hsa
uuaaagauccacaaagcaguauuucuaaauaugccuugaagaacuaaaugaaguguauagcacu

SEQ ID NO: 511804 - RNA, 64 nt, hsa
acuacuaaaauguggccacugagucuucccagaucuugaagaaaaucauauaaaaagcauuuga

SEQ ID NO: 511805 - RNA, 64 nt, hsa
aagggacgcaguccuagaggcgugcccuuuggggcuugaagagcacacugugggacgcacgugc

SEQ ID NO: 511806 - RNA, 64 nt, hsa
agccuggaggacuguugggcauguagacuggcaccuugaagauucaccauuguuuaaauaaaau

SEQ ID NO: 511807 - RNA, 64 nt, hsa
uggcauaagacuaacagaugaagucucucauuugcuugaagauauuuuacaaaauaccaacugu

SEQ ID NO: 511808 - RNA, 64 nt, hsa
aagggcugguuuuuaauccucauaagaaaccagccuugaagaauuaacaauucucuucauuggu

SEQ ID NO: 511809 - RNA, 64 nt, hsa
uucaaagaggacauaugauucuuuccaagaugaacuugaagauuacauaaaagugcagaaagcc

SEQ ID NO: 511810 - RNA, 64 nt, hsa
uucaaagaagacauaugacucuuuccaagaugaacuugaagauuacaucaaaguacagaaagcc

SEQ ID NO: 511811 - RNA, 64 nt, hsa; identical to SEQ ID NO: 474199

SEQ ID NO: 511812 - RNA, 64 nt, hsa; identical to SEQ ID NO: 474200

SEQ ID NO: 511813 - RNA, 64 nt, hsa; identical to SEQ ID NO: 474201

SEQ ID NO: 511814 - RNA, 64 nt, hsa; identical to SEQ ID NO: 474202

SEQ ID NO: 511815 - RNA, 64 nt, hsa; identical to SEQ ID NO: 474203

SEQ ID NO: 511816 - RNA, 64 nt, hsa; identical to SEQ ID NO: 474204

SEQ ID NO: 511817 - RNA, 64 nt, hsa; identical to SEQ ID NO: 474205

SEQ ID NO: 511818 - RNA, 64 nt, hsa; identical to SEQ ID NO: 474206

SEQ ID NO: 511819 - RNA, 64 nt, hsa; identical to SEQ ID NO: 474207

SEQ ID NO: 511820 - RNA, 64 nt, hsa; identical to SEQ ID NO: 474208

SEQ ID NO: 511821 - RNA, 64 nt, hsa; identical to SEQ ID NO: 106125

SEQ ID NO: 511822 - RNA, 64 nt, hsa; identical to SEQ ID NO: 106126

SEQ ID NO: 511823 - RNA, 64 nt, hsa; identical to SEQ ID NO: 106127

SEQ ID NO: 511824 - RNA, 64 nt, hsa; identical to SEQ ID NO: 106128

SEQ ID NO: 511825 - RNA, 64 nt, hsa; identical to SEQ ID NO: 106129

SEQ ID NO: 511826 - RNA, 64 nt, hsa; identical to SEQ ID NO: 106130

SEQ ID NO: 511827 - RNA, 64 nt, hsa; identical to SEQ ID NO: 364288

SEQ ID NO: 511828 - RNA, 64 nt, hsa; identical to SEQ ID NO: 364289

SEQ ID NO: 511829 - RNA, 64 nt, hsa; identical to SEQ ID NO: 364290

SEQ ID NO: 511830 - RNA, 64 nt, hsa; identical to SEQ ID NO: 364291

SEQ ID NO: 511831 - RNA, 64 nt, hsa; identical to SEQ ID NO: 364292

SEQ ID NO: 511832 - RNA, 64 nt, hsa; identical to SEQ ID NO: 364293

SEQ ID NO: 511833 - RNA, 64 nt, hsa
uuccccucuuaaaggagaggagcuuuuaauuuacacuuaccaccucauuugcuuuucuggaggc

SEQ ID NO: 511834 - RNA, 64 nt, hsa
augguaacgcuacggccccaggucacugcgaggcacuuaccauguagauacgggcucaaaaguc

SEQ ID NO: 511835 - RNA, 64 nt, hsa
acacucaagacuauguucuccaucccaacacaucacuuaccacuugcacuauucuuaauaggcc

SEQ ID NO: 511836 - RNA, 64 nt, hsa
cauuagugcuaugguuaugaguguaugugccaguacuuaccagucaaugcauuguggauaugag

SEQ ID NO: 511837 - RNA, 64 nt, hsa
gaggccagauggucagauaugauuucugcaaacccaucuugaccuugaguaugugaagggguac

SEQ ID NO: 511838 - RNA, 64 nt, hsa
cuuauuuugaugaucagaggucuugaggucuugacaucuugacauauacacugaaaaaaauggg

SEQ ID NO: 511839 - RNA, 64 nt, hsa
gucacauguuauuauacacuaaaaaauaggaagucaucuugaaaggcaguuaauguacugcaaa

SEQ ID NO: 511840 - RNA, 64 nt, hsa
acacugaucuuauuagaggucagugcuaaguacccaucuugauugaaguuagcucagaugugga

SEQ ID NO: 511841 - RNA, 64 nt, hsa
uaccauggaaugucagaaaugacuuuaucaucgucaucuugaagaaaaauaugaacacugauga

SEQ ID NO: 511842 - RNA, 64 nt, hsa
caaggcuaaaaccugagauuaucgaucuaugagacaucuugauauguaaagcacuuaauauuaa

SEQ ID NO: 511843 - RNA, 64 nt, hsa
uccuggcaggcagacccggcauguagccgcuggccaucuugaauccuagggcaugaaguugccc

SEQ ID NO: 511844 - RNA, 64 nt, hsa
uguucauaguugaaacaguaggauagauauuugucaucuugacaaguagcccuuugcaauuuau

SEQ ID NO: 511845 - RNA, 64 nt, hsa
gucuuacaccaacccccacuuggcuguuggcugucaucuugaacucuauuugaaugugacuuaa

SEQ ID NO: 511846 - RNA, 64 nt, hsa
uaucacaggaguuuagaaagacucugccucccagcaucuugaauaucuccagccuguucacugu

SEQ ID NO: 511847 - RNA, 64 nt, hsa
uuaaaacauauuugaaagguaaguaaaaaacuaccaucuugaaggugaagggaguuaagaaaag

SEQ ID NO: 511848 - RNA, 64 nt, hsa
uuaauaccauauuuuauacaucuccagagccuuucaucuugaggaucucaaagaccguagaaga

SEQ ID NO: 511849 - RNA, 64 nt, hsa
uugaaaauaaagguagggcuucuaaaaacuucaucaucuugauaaguuaaaaaaugaaaguuau

SEQ ID NO: 511850 - RNA, 64 nt, hsa
gggaacuucuuuaaaggaaaauuguaguagaggucaucuugauggaauuguguuuuaaaguuuu

SEQ ID NO: 511851 - RNA, 64 nt, hsa
cuuucagaaucagcaaaaguggggaugacccaggcaucuugauuugcaaaaucacaaaacuaag

SEQ ID NO: 511852 - RNA, 64 nt, hsa
uuguaaguagauucaaauuagauagucaauaaaacaucuugaaaaucccacaagccaauuaugu

SEQ ID NO: 511853 - RNA, 64 nt, hsa
cccacacuuccaaaauuaaacaguguuuucuuagcaucuugaauaucuccugcgguguauauua

SEQ ID NO: 511854 - RNA, 64 nt, hsa
uagcaucuugaauaucuccugcgguguauauuaacaucuugaugagacagauuuccaggcaaca

SEQ ID NO: 511855 - RNA, 63 nt, hsa
uuuugcuuuucagugucuucucagaaacaaccagcugagaaggcuacaagugacgacaaagau

SEQ ID NO: 511856 - RNA, 63 nt, hsa
uuuugcuuuucagugucuucucagaaacaaccagcugagaaggcuacaagugacgagaaagau

SEQ ID NO: 511857 - RNA, 63 nt, hsa
uuagaugccacaggagaagaggcaaacucaaaugcugagaaccccaagcugauaucagcaaug

SEQ ID NO: 511858 - RNA, 63 nt, hsa
caccagacuguuauacugcaccacgggagugcugcugagaaggcuagaaggagauacagcucu

SEQ ID NO: 511859 - RNA, 63 nt, hsa
gcagggugucaugcaugggugcagaggauggaggcugagaaagguagacagcuacccaugauc

SEQ ID NO: 511860 - RNA, 63 nt, hsa
acuugagauguauaaaacuagagcugaaaagaagcugagaaaucaccuugucuggugauuuuc

SEQ ID NO: 511861 - RNA, 63 nt, hsa
augucacaaacacaaucuauucuacaugaggaggcugagaaaggggaagagaaaaacaaacca

SEQ ID NO: 511862 - RNA, 63 nt, hsa
gaggauuucuagccagaggucccagaugccugggcugagaacccagcgauaagggggcguucc

SEQ ID NO: 511863 - RNA, 63 nt, hsa
aagaggcaaagcuacagguuuacuugggagccagcugagaagagagcagacucacaggugcug

SEQ ID NO: 511864 - RNA, 63 nt, hsa
agaacgcagagcucccagccugcuguggaggcagcugagaagugguggccucaggacugagag

SEQ ID NO: 511865 - RNA, 63 nt, hsa
gaguguuuauaauuauguuauuuauugcuggaugcugagaauggucugauauucgugcuaccu

SEQ ID NO: 511866 - RNA, 63 nt, hsa
guggguggaccaguacuccaggugauggggcaugcugagaaauagagaaaagagaccauguuu

SEQ ID NO: 511867 - RNA, 63 nt, hsa
uauccucauaccaccacugcugcuucccacccagcugagaaugcccccuccucccugacuccu

SEQ ID NO: 511868 - RNA, 63 nt, hsa
aucuucugaaggguuuuaaagaauggccaauuagcugagaagaauuaucuaaucaauuaguga

SEQ ID NO: 511869 - RNA, 63 nt, hsa
aagguuuucacugcuuuuucuuuuacauaauaugcugagaauuauuucuuaugcuuuuuacua

SEQ ID NO: 511870 - RNA, 63 nt, hsa
cuagaagaagagaaacaaagggauugauaaaaugcugagaacuagugauuauauauuuuucug

SEQ ID NO: 511871 - RNA, 63 nt, hsa
aggugugcauucucuuucucaaggauguuccuugcugagaaaaagaauucagugauauuucuc

SEQ ID NO: 511872 - RNA, 63 nt, hsa
guacaaguuuucuaauuuuugcaguauggauaggcugagaauuuuccaaaucuccaaguucug

SEQ ID NO: 511873 - RNA, 63 nt, hsa
ccagguucucauaucccagggguucagacuuuggcugagaacagccccuggagaacauggggu

SEQ ID NO: 511874 - RNA, 63 nt, hsa
cacaaagguuuuccauauaauauuauuuaaaaugcugagaaaaugaaaaaaucuaaaugguga

SEQ ID NO: 511875 - RNA, 63 nt, hsa
uccuccccccaaccuccugacccauucauaaaugcugagaaugucucucaugggaacacuguu

SEQ ID NO: 511876 - RNA, 63 nt, hsa
auaaagguauugagagggaacaaaaaacauaaagcugagaaucuugagagagcucaucuaccc

SEQ ID NO: 511877 - RNA, 63 nt, hsa
ucucugccaugauacuuccuugggacugacuuggcugagaacguguucugucagaggauuugu

SEQ ID NO: 511878 - RNA, 64 nt, hsa; identical to SEQ ID NO: 44407

SEQ ID NO: 511879 - RNA, 64 nt, hsa; identical to SEQ ID NO: 44408

SEQ ID NO: 511880 - RNA, 64 nt, hsa; identical to SEQ ID NO: 44409

SEQ ID NO: 511881 - RNA, 64 nt, hsa; identical to SEQ ID NO: 44410

SEQ ID NO: 511882 - RNA, 64 nt, hsa; identical to SEQ ID NO: 44411

SEQ ID NO: 511883 - RNA, 64 nt, hsa; identical to SEQ ID NO: 44412

SEQ ID NO: 511884 - RNA, 64 nt, hsa; identical to SEQ ID NO: 44413

SEQ ID NO: 511885 - RNA, 64 nt, hsa; identical to SEQ ID NO: 44414

SEQ ID NO: 511886 - RNA, 64 nt, hsa; identical to SEQ ID NO: 44415

SEQ ID NO: 511887 - RNA, 64 nt, hsa; identical to SEQ ID NO: 44416

SEQ ID NO: 511888 - RNA, 64 nt, hsa
gcccaaaaggaagaauuaugcugguaguaaaugggacucugagucaaauucagaacgagauguc

SEQ ID NO: 511889 - RNA, 64 nt, hsa
uuggaaaucaagcaaacagcgcacaucaacuucugacucugagggguccuguuccaauucggaa

SEQ ID NO: 511890 - RNA, 64 nt, hsa
ccacggugcucucgcccugcccauggccaccccagacucugaucuccaggaaccccauagcccc

SEQ ID NO: 511891 - RNA, 64 nt, hsa
uaagucccucucuuuaaagaacuucugcgggucagacucugaagccgaguugcugugggcgugc

SEQ ID NO: 511892 - RNA, 64 nt, hsa
uaggacuugguaagaugacucugagaaaaugcgagacucugauggaaugugccaccuguccggc

SEQ ID NO: 511893 - RNA, 64 nt, hsa
agggccacccugcugcacuaggacuugguaagaugacucugagaaaaugcgagacucugaugga

SEQ ID NO: 511894 - RNA, 64 nt, hsa
cacccccaggccuccuaggggaagggggugcaaagacucugagccaagggagggaagggccacc

SEQ ID NO: 511895 - RNA, 64 nt, hsa
cacggaagaugggggccucuguacaguuguuacugacucugauuucuaaggagccaauaaacac

SEQ ID NO: 511896 - RNA, 64 nt, hsa
acuacuacaagcacagucgggccgcgggcccauggacucugaguggcgacugccuccaccucau

SEQ ID NO: 511897 - RNA, 64 nt, hsa
aaauugcuucuuuaccaaggauauuuacagaaaagacucugaccagagaucgagaccauccuag

SEQ ID NO: 511898 - RNA, 64 nt, hsa
agcaagacuccaucucaaaaagaaaagaaaagaagacucugaccuguacucuugaauacaaguu

SEQ ID NO: 511899 - RNA, 64 nt, hsa
uguagaagggacaauuaacuccauccuucuccaugacucugaaauccaaggggggguuccgggu

SEQ ID NO: 511900 - RNA, 64 nt, hsa
uuuguaagaauaaaacagguuuauugggauuugggacucugaacaguucugucucuacuaccug

SEQ ID NO: 511901 - RNA, 64 nt, hsa
gccgcuaacugaccgcguugccauuggcgaccuggacucugaacucagguuuauucuaaaccca

SEQ ID NO: 511902 - RNA, 64 nt, hsa
uuuuucauuuggggauauuaggaucuuccuuggagacucugaaaauggcacacaaagaauggca

SEQ ID NO: 511903 - RNA, 64 nt, hsa; identical to SEQ ID NO: 301526

SEQ ID NO: 511904 - RNA, 64 nt, hsa; identical to SEQ ID NO: 301526

SEQ ID NO: 511905 - RNA, 64 nt, hsa; identical to SEQ ID NO: 301528

SEQ ID NO: 511906 - RNA, 64 nt, hsa; identical to SEQ ID NO: 301529

SEQ ID NO: 511907 - RNA, 64 nt, hsa; identical to SEQ ID NO: 301530

SEQ ID NO: 511908 - RNA, 64 nt, hsa; identical to SEQ ID NO: 210768

SEQ ID NO: 511909 - RNA, 64 nt, hsa; identical to SEQ ID NO: 210769

SEQ ID NO: 511910 - RNA, 64 nt, hsa; identical to SEQ ID NO: 210770

SEQ ID NO: 511911 - RNA, 64 nt, hsa; identical to SEQ ID NO: 210771

SEQ ID NO: 511912 - RNA, 64 nt, hsa; identical to SEQ ID NO: 210772

SEQ ID NO: 511913 - RNA, 64 nt, hsa; identical to SEQ ID NO: 210773

SEQ ID NO: 511914 - RNA, 64 nt, hsa; identical to SEQ ID NO: 210774

SEQ ID NO: 511915 - RNA, 64 nt, hsa; identical to SEQ ID NO: 210775

SEQ ID NO: 511916 - RNA, 64 nt, hsa; identical to SEQ ID NO: 210776

SEQ ID NO: 511917 - RNA, 64 nt, hsa; identical to SEQ ID NO: 210777

SEQ ID NO: 511918 - RNA, 64 nt, hsa; identical to SEQ ID NO: 210778

SEQ ID NO: 511919 - RNA, 64 nt, hsa; identical to SEQ ID NO: 210779

SEQ ID NO: 511920 - RNA, 64 nt, hsa; identical to SEQ ID NO: 210780

SEQ ID NO: 511921 - RNA, 64 nt, hsa; identical to SEQ ID NO: 210781

SEQ ID NO: 511922 - RNA, 64 nt, hsa; identical to SEQ ID NO: 210782

SEQ ID NO: 511923 - RNA, 64 nt, hsa; identical to SEQ ID NO: 210783

SEQ ID NO: 511924 - RNA, 64 nt, hsa; identical to SEQ ID NO: 210784

SEQ ID NO: 511925 - RNA, 64 nt, hsa; identical to SEQ ID NO: 210785

SEQ ID NO: 511926 - RNA, 64 nt, hsa; identical to SEQ ID NO: 210786

SEQ ID NO: 511927 - RNA, 64 nt, hsa; identical to SEQ ID NO: 210787

SEQ ID NO: 511928 - RNA, 64 nt, hsa; identical to SEQ ID NO: 210788

SEQ ID NO: 511929 - RNA, 64 nt, hsa; identical to SEQ ID NO: 210789

SEQ ID NO: 511930 - RNA, 64 nt, hsa; identical to SEQ ID NO: 210790

SEQ ID NO: 511931 - RNA, 64 nt, hsa; identical to SEQ ID NO: 210791

SEQ ID NO: 511932 - RNA, 64 nt, hsa; identical to SEQ ID NO: 210792

SEQ ID NO: 511933 - RNA, 64 nt, hsa; identical to SEQ ID NO: 210793

SEQ ID NO: 511934 - RNA, 64 nt, hsa; identical to SEQ ID NO: 210794

SEQ ID NO: 511935 - RNA, 64 nt, hsa; identical to SEQ ID NO: 210795

SEQ ID NO: 511936 - RNA, 64 nt, hsa; identical to SEQ ID NO: 210796

SEQ ID NO: 511937 - RNA, 64 nt, hsa; identical to SEQ ID NO: 210797

SEQ ID NO: 511938 - RNA, 64 nt, hsa; identical to SEQ ID NO: 210798

SEQ ID NO: 511939 - RNA, 64 nt, hsa; identical to SEQ ID NO: 210799

SEQ ID NO: 511940 - RNA, 64 nt, hsa; identical to SEQ ID NO: 210800

SEQ ID NO: 511941 - RNA, 64 nt, hsa; identical to SEQ ID NO: 210801

SEQ ID NO: 511942 - RNA, 64 nt, hsa; identical to SEQ ID NO: 210802

SEQ ID NO: 511943 - RNA, 64 nt, hsa; identical to SEQ ID NO: 210803

SEQ ID NO: 511944 - RNA, 64 nt, hsa; identical to SEQ ID NO: 210804

SEQ ID NO: 511945 - RNA, 64 nt, hsa; identical to SEQ ID NO: 210805

SEQ ID NO: 511946 - RNA, 64 nt, hsa; identical to SEQ ID NO: 210806

SEQ ID NO: 511947 - RNA, 64 nt, hsa; identical to SEQ ID NO: 210807

SEQ ID NO: 511948 - RNA, 64 nt, hsa; identical to SEQ ID NO: 210808

SEQ ID NO: 511949 - RNA, 64 nt, hsa; identical to SEQ ID NO: 210809

SEQ ID NO: 511950 - RNA, 62 nt, hsa
agcagauucccuaggcaagagcagcagcacaacuaggaaaccccaaagcccaugcuccgaca

SEQ ID NO: 511951 - RNA, 62 nt, hsa
cacagcuuaguggccaguaaacacccuggggacuaggaaaaggaaccaacuguaggcaccuc

SEQ ID NO: 511952 - RNA, 62 nt, hsa
uauaaccagaggaaaaaaggauggagaaauaucuaggaaagugucuucucagaaaccaccaa

SEQ ID NO: 511953 - RNA, 62 nt, hsa
uauaaccagagaaaaaaaggauggagaaauaucuaggaaagugucuucucagaaaccaccag

SEQ ID NO: 511954 - RNA, 62 nt, hsa
cuacccuuaacuuagggaugaacagacuauaacuaggaaaggaggaaagguaucagggauuu

SEQ ID NO: 511955 - RNA, 62 nt, hsa
aagcugucucccuucugacauuuccuaggaagcuaggaaaaggaaagugaaggaauggucua

SEQ ID NO: 511956 - RNA, 62 nt, hsa
cauuuaaauuuucuaaaaauggacuugcucuucuaggaaaagaauaccccuggggcaaaaau

SEQ ID NO: 511957 - RNA, 62 nt, hsa
aagaacagggguuuuacauaaggaaauaaguccuaggaaauuagucaacgcaaauugcauuu

SEQ ID NO: 511958 - RNA, 62 nt, hsa
gaacaaauauaguuucuggcacuauuuuuauacuaggaaaaggaguuacuauguauauuaug

SEQ ID NO: 511959 - RNA, 62 nt, hsa
uggagaaguagauaaugaauuaagcaacuggucuaggaaaggaaaauuuguuucaaauaugc

SEQ ID NO: 511960 - RNA, 62 nt, hsa
guaccacaucccucucaaguguuccacaacaucuaggaaagugagcucuuaaagacagacua

SEQ ID NO: 511961 - RNA, 62 nt, hsa
uugauucuuccauugagaaaagcauaugaauccuaggaaagggcucagccugugauaggcau

SEQ ID NO: 511962 - RNA, 62 nt, hsa
ugcauuuacaagguuaaagauuccucgaaguucuaggaaauucuugaaaauauaaguggugc

SEQ ID NO: 511963 - RNA, 62 nt, hsa
gggaauggucacuaaaguauccugacaaguuccuaggaaaaaaggaauaaaguuuuuuuccu

SEQ ID NO: 511964 - RNA, 62 nt, hsa
ucauuauagcaaaggguuacuggugcaggggacuaggaaaaacccguccaguguggugcuua

SEQ ID NO: 511965 - RNA, 62 nt, hsa
gcucaguaaauauggacgcaauuaaagaugcucuaggaaauuuggggacuguauuuaauuuu

SEQ ID NO: 511966 - RNA, 62 nt, hsa
ucaugccccuuuacauucccuccuugccuucccuaggaaaccguugauuuacauuuuuuacu

SEQ ID NO: 511967 - RNA, 62 nt, hsa
uuugaccucauuugcauugccaccaaggccuccuaggaaaaauuguaggaauuuauggguau

SEQ ID NO: 511968 - RNA, 64 nt, hsa; identical to SEQ ID NO: 237576

SEQ ID NO: 511969 - RNA, 64 nt, hsa; identical to SEQ ID NO: 237577

SEQ ID NO: 511970 - RNA, 64 nt, hsa; identical to SEQ ID NO: 237578

SEQ ID NO: 511971 - RNA, 64 nt, hsa; identical to SEQ ID NO: 237579

SEQ ID NO: 511972 - RNA, 64 nt, hsa; identical to SEQ ID NO: 237580

SEQ ID NO: 511973 - RNA, 64 nt, hsa; identical to SEQ ID NO: 237581

SEQ ID NO: 511974 - RNA, 64 nt, hsa; identical to SEQ ID NO: 237582

SEQ ID NO: 511975 - RNA, 64 nt, hsa; identical to SEQ ID NO: 237583

SEQ ID NO: 511976 - RNA, 64 nt, hsa; identical to SEQ ID NO: 237584

SEQ ID NO: 511977 - RNA, 64 nt, hsa; identical to SEQ ID NO: 237585

SEQ ID NO: 511978 - RNA, 64 nt, hsa; identical to SEQ ID NO: 237586

SEQ ID NO: 511979 - RNA, 64 nt, hsa; identical to SEQ ID NO: 237587

SEQ ID NO: 511980 - RNA, 64 nt, hsa; identical to SEQ ID NO: 237588

SEQ ID NO: 511981 - RNA, 64 nt, hsa; identical to SEQ ID NO: 237589

SEQ ID NO: 511982 - RNA, 64 nt, hsa; identical to SEQ ID NO: 237590

SEQ ID NO: 511983 - RNA, 64 nt, hsa; identical to SEQ ID NO: 237591

SEQ ID NO: 511984 - RNA, 64 nt, hsa; identical to SEQ ID NO: 237592

SEQ ID NO: 511985 - RNA, 64 nt, hsa; identical to SEQ ID NO: 237593

SEQ ID NO: 511986 - RNA, 64 nt, hsa; identical to SEQ ID NO: 237594

SEQ ID NO: 511987 - RNA, 64 nt, hsa; identical to SEQ ID NO: 237595

SEQ ID NO: 511988 - RNA, 64 nt, hsa; identical to SEQ ID NO: 237596

SEQ ID NO: 511989 - RNA, 64 nt, hsa; identical to SEQ ID NO: 237597

SEQ ID NO: 511990 - RNA, 64 nt, hsa; identical to SEQ ID NO: 237598

SEQ ID NO: 511991 - RNA, 64 nt, hsa; identical to SEQ ID NO: 237599

SEQ ID NO: 511992 - RNA, 64 nt, hsa; identical to SEQ ID NO: 237600

SEQ ID NO: 511993 - RNA, 64 nt, hsa; identical to SEQ ID NO: 237601

SEQ ID NO: 511994 - RNA, 64 nt, hsa; identical to SEQ ID NO: 237602

SEQ ID NO: 511995 - RNA, 64 nt, hsa; identical to SEQ ID NO: 237603

SEQ ID NO: 511996 - RNA, 64 nt, hsa; identical to SEQ ID NO: 237604

SEQ ID NO: 511997 - RNA, 64 nt, hsa; identical to SEQ ID NO: 237605

SEQ ID NO: 511998 - RNA, 64 nt, hsa; identical to SEQ ID NO: 237606

SEQ ID NO: 511999 - RNA, 64 nt, hsa; identical to SEQ ID NO: 237607

SEQ ID NO: 512000 - RNA, 64 nt, hsa; identical to SEQ ID NO: 237608

SEQ ID NO: 512001 - RNA, 64 nt, hsa; identical to SEQ ID NO: 237609

SEQ ID NO: 512002 - RNA, 64 nt, hsa; identical to SEQ ID NO: 237610

SEQ ID NO: 512003 - RNA, 64 nt, hsa; identical to SEQ ID NO: 237611

SEQ ID NO: 512004 - RNA, 64 nt, hsa; identical to SEQ ID NO: 237612

SEQ ID NO: 512005 - RNA, 64 nt, hsa; identical to SEQ ID NO: 237613

SEQ ID NO: 512006 - RNA, 64 nt, hsa; identical to SEQ ID NO: 237614

SEQ ID NO: 512007 - RNA, 64 nt, hsa; identical to SEQ ID NO: 237615

SEQ ID NO: 512008 - RNA, 64 nt, hsa; identical to SEQ ID NO: 237616

SEQ ID NO: 512009 - RNA, 64 nt, hsa; identical to SEQ ID NO: 237617

SEQ ID NO: 512010 - RNA, 64 nt, hsa; identical to SEQ ID NO: 237618

SEQ ID NO: 512011 - RNA, 64 nt, hsa; identical to SEQ ID NO: 237619

SEQ ID NO: 512012 - RNA, 64 nt, hsa; identical to SEQ ID NO: 237620

SEQ ID NO: 512013 - RNA, 64 nt, hsa; identical to SEQ ID NO: 237621

SEQ ID NO: 512014 - RNA, 64 nt, hsa; identical to SEQ ID NO: 237622

SEQ ID NO: 512015 - RNA, 64 nt, hsa; identical to SEQ ID NO: 237623

SEQ ID NO: 512016 - RNA, 64 nt, hsa; identical to SEQ ID NO: 237624

SEQ ID NO: 512017 - RNA, 64 nt, hsa; identical to SEQ ID NO: 237625

SEQ ID NO: 512018 - RNA, 64 nt, hsa; identical to SEQ ID NO: 237626

SEQ ID NO: 512019 - RNA, 64 nt, hsa; identical to SEQ ID NO: 237627

SEQ ID NO: 512020 - RNA, 64 nt, hsa; identical to SEQ ID NO: 237628

SEQ ID NO: 512021 - RNA, 64 nt, hsa; identical to SEQ ID NO: 237629

SEQ ID NO: 512022 - RNA, 64 nt, hsa; identical to SEQ ID NO: 237630

SEQ ID NO: 512023 - RNA, 64 nt, hsa; identical to SEQ ID NO: 237631

SEQ ID NO: 512024 - RNA, 64 nt, hsa; identical to SEQ ID NO: 237632

SEQ ID NO: 512025 - RNA, 64 nt, hsa; identical to SEQ ID NO: 237633

SEQ ID NO: 512026 - RNA, 64 nt, hsa; identical to SEQ ID NO: 237634

SEQ ID NO: 512027 - RNA, 64 nt, hsa; identical to SEQ ID NO: 237635

SEQ ID NO: 512028 - RNA, 64 nt, hsa; identical to SEQ ID NO: 237636

SEQ ID NO: 512029 - RNA, 64 nt, hsa; identical to SEQ ID NO: 237637

SEQ ID NO: 512030 - RNA, 64 nt, hsa; identical to SEQ ID NO: 237638

SEQ ID NO: 512031 - RNA, 64 nt, hsa; identical to SEQ ID NO: 237639

SEQ ID NO: 512032 - RNA, 64 nt, hsa; identical to SEQ ID NO: 237640

SEQ ID NO: 512033 - RNA, 64 nt, hsa; identical to SEQ ID NO: 237641

SEQ ID NO: 512034 - RNA, 64 nt, hsa; identical to SEQ ID NO: 237642

SEQ ID NO: 512035 - RNA, 64 nt, hsa; identical to SEQ ID NO: 237643

SEQ ID NO: 512036 - RNA, 64 nt, hsa; identical to SEQ ID NO: 237644

SEQ ID NO: 512037 - RNA, 64 nt, hsa; identical to SEQ ID NO: 237645

SEQ ID NO: 512038 - RNA, 64 nt, hsa; identical to SEQ ID NO: 237646

SEQ ID NO: 512039 - RNA, 64 nt, hsa; identical to SEQ ID NO: 237647

SEQ ID NO: 512040 - RNA, 64 nt, hsa; identical to SEQ ID NO: 237648

SEQ ID NO: 512041 - RNA, 64 nt, hsa; identical to SEQ ID NO: 237649

SEQ ID NO: 512042 - RNA, 64 nt, hsa; identical to SEQ ID NO: 237650

SEQ ID NO: 512043 - RNA, 64 nt, hsa; identical to SEQ ID NO: 237651

SEQ ID NO: 512044 - RNA, 64 nt, hsa; identical to SEQ ID NO: 237652

SEQ ID NO: 512045 - RNA, 64 nt, hsa; identical to SEQ ID NO: 237653

SEQ ID NO: 512046 - RNA, 64 nt, hsa; identical to SEQ ID NO: 237654

SEQ ID NO: 512047 - RNA, 64 nt, hsa; identical to SEQ ID NO: 237655

SEQ ID NO: 512048 - RNA, 64 nt, hsa; identical to SEQ ID NO: 237656

SEQ ID NO: 512049 - RNA, 64 nt, hsa; identical to SEQ ID NO: 237657

SEQ ID NO: 512050 - RNA, 64 nt, hsa; identical to SEQ ID NO: 237658

SEQ ID NO: 512051 - RNA, 64 nt, hsa; identical to SEQ ID NO: 237659

SEQ ID NO: 512052 - RNA, 64 nt, hsa; identical to SEQ ID NO: 237660

SEQ ID NO: 512053 - RNA, 64 nt, hsa; identical to SEQ ID NO: 237661

SEQ ID NO: 512054 - RNA, 64 nt, hsa; identical to SEQ ID NO: 237662

SEQ ID NO: 512055 - RNA, 64 nt, hsa; identical to SEQ ID NO: 237663

SEQ ID NO: 512056 - RNA, 64 nt, hsa; identical to SEQ ID NO: 237664

SEQ ID NO: 512057 - RNA, 64 nt, hsa; identical to SEQ ID NO: 237665

SEQ ID NO: 512058 - RNA, 64 nt, hsa; identical to SEQ ID NO: 237666

SEQ ID NO: 512059 - RNA, 64 nt, hsa; identical to SEQ ID NO: 237667

SEQ ID NO: 512060 - RNA, 64 nt, hsa; identical to SEQ ID NO: 237668

SEQ ID NO: 512061 - RNA, 64 nt, hsa; identical to SEQ ID NO: 237669

SEQ ID NO: 512062 - RNA, 64 nt, hsa; identical to SEQ ID NO: 237670

SEQ ID NO: 512063 - RNA, 64 nt, hsa; identical to SEQ ID NO: 237671

SEQ ID NO: 512064 - RNA, 64 nt, hsa; identical to SEQ ID NO: 237672

SEQ ID NO: 512065 - RNA, 64 nt, hsa; identical to SEQ ID NO: 237673

SEQ ID NO: 512066 - RNA, 64 nt, hsa; identical to SEQ ID NO: 237674

SEQ ID NO: 512067 - RNA, 64 nt, hsa; identical to SEQ ID NO: 237675

SEQ ID NO: 512068 - RNA, 64 nt, hsa; identical to SEQ ID NO: 237676

SEQ ID NO: 512069 - RNA, 64 nt, hsa; identical to SEQ ID NO: 237677

SEQ ID NO: 512070 - RNA, 64 nt, hsa; identical to SEQ ID NO: 237678

SEQ ID NO: 512071 - RNA, 64 nt, hsa; identical to SEQ ID NO: 237679

SEQ ID NO: 512072 - RNA, 64 nt, hsa; identical to SEQ ID NO: 237680

SEQ ID NO: 512073 - RNA, 64 nt, hsa; identical to SEQ ID NO: 237681

SEQ ID NO: 512074 - RNA, 64 nt, hsa; identical to SEQ ID NO: 237682

SEQ ID NO: 512075 - RNA, 64 nt, hsa; identical to SEQ ID NO: 237683

SEQ ID NO: 512076 - RNA, 64 nt, hsa; identical to SEQ ID NO: 237684

SEQ ID NO: 512077 - RNA, 64 nt, hsa; identical to SEQ ID NO: 237685

SEQ ID NO: 512078 - RNA, 64 nt, hsa; identical to SEQ ID NO: 237686

SEQ ID NO: 512079 - RNA, 64 nt, hsa; identical to SEQ ID NO: 237687

SEQ ID NO: 512080 - RNA, 64 nt, hsa; identical to SEQ ID NO: 237688

SEQ ID NO: 512081 - RNA, 64 nt, hsa; identical to SEQ ID NO: 237689

SEQ ID NO: 512082 - RNA, 64 nt, hsa; identical to SEQ ID NO: 237690

SEQ ID NO: 512083 - RNA, 64 nt, hsa; identical to SEQ ID NO: 237691

SEQ ID NO: 512084 - RNA, 64 nt, hsa; identical to SEQ ID NO: 237692

SEQ ID NO: 512085 - RNA, 64 nt, hsa; identical to SEQ ID NO: 237693

SEQ ID NO: 512086 - RNA, 64 nt, hsa; identical to SEQ ID NO: 237694

SEQ ID NO: 512087 - RNA, 64 nt, hsa; identical to SEQ ID NO: 237695

SEQ ID NO: 512088 - RNA, 64 nt, hsa; identical to SEQ ID NO: 237696

SEQ ID NO: 512089 - RNA, 64 nt, hsa; identical to SEQ ID NO: 237697

SEQ ID NO: 512090 - RNA, 64 nt, hsa; identical to SEQ ID NO: 237698

SEQ ID NO: 512091 - RNA, 64 nt, hsa; identical to SEQ ID NO: 237699

SEQ ID NO: 512092 - RNA, 64 nt, hsa; identical to SEQ ID NO: 237700

SEQ ID NO: 512093 - RNA, 64 nt, hsa; identical to SEQ ID NO: 237701

SEQ ID NO: 512094 - RNA, 64 nt, hsa; identical to SEQ ID NO: 237702

SEQ ID NO: 512095 - RNA, 64 nt, hsa; identical to SEQ ID NO: 237703

SEQ ID NO: 512096 - RNA, 64 nt, hsa; identical to SEQ ID NO: 237704

SEQ ID NO: 512097 - RNA, 64 nt, hsa; identical to SEQ ID NO: 237705

SEQ ID NO: 512098 - RNA, 64 nt, hsa; identical to SEQ ID NO: 237706

SEQ ID NO: 512099 - RNA, 64 nt, hsa; identical to SEQ ID NO: 237707

SEQ ID NO: 512100 - RNA, 64 nt, hsa; identical to SEQ ID NO: 237708

SEQ ID NO: 512101 - RNA, 64 nt, hsa; identical to SEQ ID NO: 237709

SEQ ID NO: 512102 - RNA, 64 nt, hsa; identical to SEQ ID NO: 237710

SEQ ID NO: 512103 - RNA, 64 nt, hsa; identical to SEQ ID NO: 237711

SEQ ID NO: 512104 - RNA, 64 nt, hsa; identical to SEQ ID NO: 237712

SEQ ID NO: 512105 - RNA, 64 nt, hsa; identical to SEQ ID NO: 237713

SEQ ID NO: 512106 - RNA, 64 nt, hsa; identical to SEQ ID NO: 237714

SEQ ID NO: 512107 - RNA, 64 nt, hsa; identical to SEQ ID NO: 237715

SEQ ID NO: 512108 - RNA, 64 nt, hsa; identical to SEQ ID NO: 237716

SEQ ID NO: 512109 - RNA, 64 nt, hsa; identical to SEQ ID NO: 237717

SEQ ID NO: 512110 - RNA, 64 nt, hsa; identical to SEQ ID NO: 237718

SEQ ID NO: 512111 - RNA, 64 nt, hsa; identical to SEQ ID NO: 237719

SEQ ID NO: 512112 - RNA, 64 nt, hsa; identical to SEQ ID NO: 237720

SEQ ID NO: 512113 - RNA, 64 nt, hsa; identical to SEQ ID NO: 237721

SEQ ID NO: 512114 - RNA, 64 nt, hsa; identical to SEQ ID NO: 237722

SEQ ID NO: 512115 - RNA, 64 nt, hsa; identical to SEQ ID NO: 237723

SEQ ID NO: 512116 - RNA, 64 nt, hsa; identical to SEQ ID NO: 237724

SEQ ID NO: 512117 - RNA, 64 nt, hsa; identical to SEQ ID NO: 237725

SEQ ID NO: 512118 - RNA, 64 nt, hsa; identical to SEQ ID NO: 237726

SEQ ID NO: 512119 - RNA, 64 nt, hsa; identical to SEQ ID NO: 237727

SEQ ID NO: 512120 - RNA, 64 nt, hsa; identical to SEQ ID NO: 237728

SEQ ID NO: 512121 - RNA, 64 nt, hsa; identical to SEQ ID NO: 237729

SEQ ID NO: 512122 - RNA, 64 nt, hsa; identical to SEQ ID NO: 237730

SEQ ID NO: 512123 - RNA, 64 nt, hsa; identical to SEQ ID NO: 237731

SEQ ID NO: 512124 - RNA, 64 nt, hsa; identical to SEQ ID NO: 237732

SEQ ID NO: 512125 - RNA, 64 nt, hsa; identical to SEQ ID NO: 237733

SEQ ID NO: 512126 - RNA, 64 nt, hsa
augggagggcaugagggaacacuucuuaugagaaaacauuuauaaacaaaagaaacauuuauaa

SEQ ID NO: 512127 - RNA, 64 nt, hsa
cacuucuuaugagaaaacauuuauaaacaaaagaaacauuuauaaacuaaagaaaaacuaaaag

SEQ ID NO: 512128 - RNA, 64 nt, hsa
cauuaauaaaacuuagaaacaguauaauuaguauaacauuuacucugaauuugaagauuuccug

SEQ ID NO: 512129 - RNA, 64 nt, hsa
cauguuuugacauuguaauaucuuuuacuacuugaacauuuaaauuucuaaaugagaaagguau

SEQ ID NO: 512130 - RNA, 64 nt, hsa
uuugagucaaaacugauuuaguguucuuccaaacaacauuuauguguuggccuacagaguuuau

SEQ ID NO: 512131 - RNA, 64 nt, hsa
uucauugaaaucuguucaaaaacagauuaagacaaacauuuaugauggucuguaucaaucagca

SEQ ID NO: 512132 - RNA, 64 nt, hsa
acauucauguacccacuaucagguuaagaaauagaacauuuauuaauauguaggaauguuaaga

SEQ ID NO: 512133 - RNA, 64 nt, hsa
acauuuauuaauauguaggaauguuaagaaauaaaacauuuaauaagaucucagaagacuccag

SEQ ID NO: 512134 - RNA, 64 nt, hsa
ugaaauacuucagaucacaugaaaaugcugauuuaacauuuaaguaucacagcauuaaaagaaa

SEQ ID NO: 512135 - RNA, 64 nt, hsa
ucguggguuuuguuuuuaagcaaaacaaugugaaaacauuuaaguuugaaauguugcauuugaa

SEQ ID NO: 512136 - RNA, 64 nt, hsa
guguggagauauucauaauucugcaauacuuuaaaacauuuagaaaacaccccaggguaggucu

SEQ ID NO: 512137 - RNA, 64 nt, hsa
uggcauuuucacaauaacugcaaugguuugacauaacauuuauaggcagaaaguuaauaaacug

SEQ ID NO: 512138 - RNA, 64 nt, hsa
ugaugcuuuaggcuaguuagugcauuuuuuagcaaacauuuaucuuaaacaucacagauccacu

SEQ ID NO: 512139 - RNA, 64 nt, hsa
agguggauauauaauuuaaaagcuugauuuaauaaacauuuaacccccuaaacuugcaccgugg

SEQ ID NO: 512140 - RNA, 64 nt, hsa
uuugccauuuuugcauuguuucguuuuuaacuggaacauuuagaaagaaggaaaugaaugugca

SEQ ID NO: 512141 - RNA, 64 nt, hsa
ccugccaauugaaugauuucguagcugaaguagaaacauuuagguuucuguagcauuaaauugu

SEQ ID NO: 512142 - RNA, 64 nt, hsa
cagugagcucagaggcccuucucacugagacagcaacauuuaaaccaaaccagaggaaguauuu

SEQ ID NO: 512143 - RNA, 64 nt, hsa
ucagcuggguuuuuaauuagcgcauucucuauccaacauuuaauuguuugaaagccuccauaua

SEQ ID NO: 512144 - RNA, 64 nt, hsa
ggcuggaaccagcaguucagagaucugccuuauaaacauuuaaaaccgguuugugguacacaaa

SEQ ID NO: 512145 - RNA, 64 nt, hsa
uucccuucccucccccuucacccacucccuccagaacauuuaguguagaugaaaauguggugau

SEQ ID NO: 512146 - RNA, 64 nt, hsa
uagaaaugucugaaacuuuagacaaaaacaguaaaacauuuaauauucauuugugaaacuguau

SEQ ID NO: 512147 - RNA, 64 nt, hsa
aaagauuguuauuguaauuuuguuauuccuuaaaaacauuuaaaagcagauuuuuucaaaaucg

SEQ ID NO: 512148 - RNA, 64 nt, hsa
caacaaaauaguguuugucaucagguugguacuaaacauuuauaauuacuguguaauuauaaac

SEQ ID NO: 512149 - RNA, 64 nt, hsa
gguuugggcuugucuucuagucugggccgcucuaaacauuuauaauuccaacauuguggauuuc

SEQ ID NO: 512150 - RNA, 64 nt, hsa
gaugaacaaagacaucuaaauaucuguagauagaaacauuuaucuaucuaaauauauugauaga

SEQ ID NO: 512151 - RNA, 64 nt, hsa
ugugaaauguauucaacaauggaauauuuucuaaaacauuuaguauacauuugaauguauuuua

SEQ ID NO: 512152 - RNA, 64 nt, hsa
uuuuuccggugaacagaagauuuguuuggauuuaaacauuuacuaagacaguaccuauuaggaa

SEQ ID NO: 512153 - RNA, 64 nt, hsa
ucaaccauuuuaacuuucaucucuagggauguuuaacauuuauaauugcaaaauaaaccaacua

SEQ ID NO: 512154 - RNA, 64 nt, hsa
uauaaacaguaauagcuacguuugggaaggaggaaacauuuaaauuauaaaggacugaauaauc

SEQ ID NO: 512155 - RNA, 64 nt, hsa
cauuagagcaaugacuguauuuuguuguccuuauaacauuuauauuauuucaguuuuaagucaa

SEQ ID NO: 512156 - RNA, 64 nt, hsa
uugcagcuagagguuacugucacaucauagauuuaacauuuaccaucuucaaaguacaaaucuu

SEQ ID NO: 512157 - RNA, 64 nt, hsa
cacaaagugcauguguacucacuucuggccauauaacauuuacacagggaaauggaucauugau

SEQ ID NO: 512158 - RNA, 64 nt, hsa
uuaucuggcauuuuuaaacauuuaaaaauuauuaaacauuuaaaaauuaguuuauuaucagaua

SEQ ID NO: 512159 - RNA, 64 nt, hsa
uucuguuagaaauuaguuuuaucuggcauuuuuaaacauuuaaaaauuauuaaacauuuaaaaa

SEQ ID NO: 512160 - RNA, 64 nt, hsa
cccuuaacucacauucaauguauuuucuucccauaacauuuaguauaguuaauauuuucuuaga

SEQ ID NO: 512161 - RNA, 64 nt, hsa
agggaacaguggguaagaaacuuuaugccugaauaacauuuagcaguauugugauugaaaaauu

SEQ ID NO: 512162 - RNA, 64 nt, hsa
uaaacguauuaaguuuaacauauuaaauuaauuuaacauuuagacuaacauuaacauuuaaauu

SEQ ID NO: 512163 - RNA, 64 nt, hsa
cauauuaaauuaauuuaacauuuagacuaacauuaacauuuaaauuaauauguuaagugaauau

SEQ ID NO: 512164 - RNA, 64 nt, hsa
cacuagaguuaccauucauauuugagaagaaaagaacauuuaauaaauguauguguggggcuga

SEQ ID NO: 512165 - RNA, 64 nt, hsa
caugccuucucucucccugcaaagaaaaaucuugaacauuuaugaugucaauuagugaaaguau

SEQ ID NO: 512166 - RNA, 64 nt, hsa
uuguguacauaauuggauauauguguuaaaauuuaacauuuagauuuacuuaauuguagaaaau

SEQ ID NO: 512167 - RNA, 64 nt, hsa
auuuuaauuuucauugucaauauuuugagcuuagaacauuuaugguauaaaaauuuaaacuaau

SEQ ID NO: 512168 - RNA, 64 nt, hsa
gaaacuaagaaauguuuuaauuuauuaccuuuacaacauuuauuuacauuacauacauacauuu

SEQ ID NO: 512169 - RNA, 64 nt, hsa
acaacauuuauuuacauuacauacauacauuuacaacauuuauuaauuuauauuaaaauagcau

SEQ ID NO: 512170 - RNA, 64 nt, hsa
uuacugauuaugcuuuugaaauuuucucuuguaaaacauuuagaaaacaaaaacaaaaaaaaug

SEQ ID NO: 512171 - RNA, 64 nt, hsa
ucaaagacagcaaaaaccucucaaacugaggagcaacauuuauucuuacuaagcagaucaucaa

SEQ ID NO: 512172 - RNA, 64 nt, hsa
ugcacaaaagcccuguucacaggggaaugguguaaacauuuauacuguuuuguucacuguauuu

SEQ ID NO: 512173 - RNA, 64 nt, hsa
ccuugaggauagugcuuagauaacagacucauuaaacauuuacugagugucugucagggaucau

SEQ ID NO: 512174 - RNA, 64 nt, hsa
auaccuauagcuuuggucccaucuuuaauugagaaacauuuaucuguauaaaacauauuuuugg

SEQ ID NO: 512175 - RNA, 64 nt, hsa
cuauaaaaagacugacagguaauuauauuuggaaaacauuuaaugcacuaacuuuaaagaaauu

SEQ ID NO: 512176 - RNA, 64 nt, hsa
uuugggaacaucaauuuuguacuguuaugcaguaaacauuuauaauaauauaauuucagucauu

SEQ ID NO: 512177 - RNA, 64 nt, hsa
acuaauguaccucaguaauuaaauaugcugucacaacauuuaggaauuaagacaguaacaguau

SEQ ID NO: 512178 - RNA, 64 nt, hsa
ucuuuaggaauuucuuucuauagaguucuucauuaacauuuauacgaguuuuuugcugagucag

SEQ ID NO: 512179 - RNA, 64 nt, hsa
uguuuuuaaaguuuccuuuacccugcccuuguugaacauuuauauaaucuaaccuggacaucaa

SEQ ID NO: 512180 - RNA, 64 nt, hsa
gaagauguaaacaaacaaauacacuauuucugggaacauuuauauugagauucuuuguggcuau

SEQ ID NO: 512181 - RNA, 64 nt, hsa
auuugauaauuuuaaacauuguuuuuaaacccaaaacauuuagugguccguugccucugaagau

SEQ ID NO: 512182 - RNA, 64 nt, hsa
agaaaaaaauagaaaaugcacauaagcaaaaggaaacauuuaaaugcuaucuuucaaagauaac

SEQ ID NO: 512183 - RNA, 64 nt, hsa
aacuuugucuugucauuauaauaauaaaaaaaugaacauuuauuauggaauuucuaugagccug

SEQ ID NO: 512184 - RNA, 64 nt, hsa
uuaaaaauaaacauuuuuuaaaucgucagaaggcaacauuuaccauguuccuuucagucuaucc

SEQ ID NO: 512185 - RNA, 64 nt, hsa
aacugccugcugaauggaaggaaagcaacuuuaaaacauuuagaguuuugcugaguauagccaa

SEQ ID NO: 512186 - RNA, 64 nt, hsa
uccucuucuauuacuuaaaacguuuuuauugugcaacauuuaaggcauacaaaaacauauaaag

SEQ ID NO: 512187 - RNA, 64 nt, hsa
aaauccauuuuacauguucacauguaucuauaacaacauuuauauuucuaaaacaaacuuuuca

SEQ ID NO: 512188 - RNA, 64 nt, hsa
auugacuugucaaagacucucuucaagccagcacaacauuuagacacaacacuguagaaauuug

SEQ ID NO: 512189 - RNA, 64 nt, hsa
cugaaggccacgauugcuggcuccacaauuuaguaacauuuauauuaagauauauauauagugg

SEQ ID NO: 512190 - RNA, 64 nt, hsa
uccuaaaaugauaguggauaauagacaaagugaaaacauuuaaaaaggaagagaaacuucagcc

SEQ ID NO: 512191 - RNA, 64 nt, hsa
caauuaauugcauacaguaaaagucugugauuaaaacauuuauauaccucauucuuuaguguug

SEQ ID NO: 512192 - RNA, 64 nt, hsa
gagguuaucccucggaguagcguaaucacacaauaacauuuagaacuuaaauuggcuacaggac

SEQ ID NO: 512193 - RNA, 64 nt, hsa
augaucuuauuuauucccauuuuugcccuuaguuaacauuuacuggugcucaccuaggauuggc

SEQ ID NO: 512194 - RNA, 64 nt, hsa
ucugauuucaaagguaauacaacauuuaaugugaaacauuuagugaauacaguaaaggagaaaa

SEQ ID NO: 512195 - RNA, 64 nt, hsa
uagacaauguaucuucugauuucaaagguaauacaacauuuaaugugaaacauuuagugaauac

SEQ ID NO: 512196 - RNA, 64 nt, hsa
aaauguagccaugauguuguucuaaagaugucuuaacauuuauagugaggauugacagaaauua

SEQ ID NO: 512197 - RNA, 64 nt, hsa
auucugcacuuuggaaucaguucauuagaaugauaacauuuauauggauaaagaugcaguauuc

SEQ ID NO: 512198 - RNA, 64 nt, hsa
caaaugauuaaaugucaguuccccuaaaccaauaaacauuuauacuagauuuuuuauuuccacu

SEQ ID NO: 512199 - RNA, 64 nt, hsa
ugucuucaucaucauacauguagaaaagaaucugaacauuuaagugcgaaguuuucucuagaaa

SEQ ID NO: 512200 - RNA, 64 nt, hsa
aaccuuuagauuugcucauaauguuuaacauaacaacauuuauuucaaaucacugaauucaugg

SEQ ID NO: 512201 - RNA, 64 nt, hsa
acagguugaaagucuuuuaagggcaucacaaauuaacauuuacuccuaaugcacgccuagaaug

SEQ ID NO: 512202 - RNA, 64 nt, hsa
gccuuuauuuuauguuuaggcuuauuuuuaaauuaacauuuaacagaaacauuugaaauagaau

SEQ ID NO: 512203 - RNA, 64 nt, hsa
uuuugggccacuccacggcaggucccuagccugcaacauuuaugucgcaugucaauccgaagag

SEQ ID NO: 512204 - RNA, 64 nt, hsa
gaaggucugauaaacugaugaaauggcacagcauaacauuuaauuauaaugacauucugauuau

SEQ ID NO: 512205 - RNA, 64 nt, hsa
agaauguuuccuuuuacuucaguuaacaaaagaaaacauuuaauaaacauucaauaaugauuac

SEQ ID NO: 512206 - RNA, 64 nt, hsa
uuaccuagaaugccucauuuaaaagugccuugaaaacauuuagcuccccuucuucaugagcauc

SEQ ID NO: 512207 - RNA, 64 nt, hsa
uguuagcagguuuuucuguuaguuuuucccccauaacauuuaauuauuacuaaaauuguauuua

SEQ ID NO: 512208 - RNA, 64 nt, hsa
cacauaguugcuuccugguaucugauuuagaaauaacauuuaaaugccaaguaucugggggauu

SEQ ID NO: 512209 - RNA, 64 nt, hsa
auugaguaauuuuccacuauaaagaauuuuauugaacauuuauuaaaaaauaauguaaugcaug

SEQ ID NO: 512210 - RNA, 64 nt, hsa
agcagacaaaaacuuccucugucaagguguuauaaacauuuaaaaucacauuuuccauuuccau

SEQ ID NO: 512211 - RNA, 64 nt, hsa
aaaacugggaaugugaauguaauauauguagaaaaacauuuagccacagcccaaaucuuccagg

SEQ ID NO: 512212 - RNA, 64 nt, hsa
uguuuagaguaauauucuuuugcauuauaguaagaacauuuaaguuuuguuaaaauuaaaaaau

SEQ ID NO: 512213 - RNA, 64 nt, hsa
gagauauauuuuugcagaugcaguauauauuuaaaacauuuaauccaaaauaagucuauguaaa

SEQ ID NO: 512214 - RNA, 64 nt, hsa
uccucuuacaguucgaugcccauuaguuuuauauaacauuuauuugacacguacugacuucuau

SEQ ID NO: 512215 - RNA, 64 nt, hsa
ccaguuuauggcuauuacaaauaaagcuucuaugaacauuuauguacaaaucuuuguauggaug

SEQ ID NO: 512216 - RNA, 64 nt, hsa
cuuucguuucccuuuccccaaaaguagcguaaccaacauuuaagcuugcuuaaaaacgaaaacc

SEQ ID NO: 512217 - RNA, 64 nt, hsa
uguuuccugacgguguacagaaucaacaaaauaaaacauuuaaagucugauuuuuuacauuuuu

SEQ ID NO: 512218 - RNA, 64 nt, hsa
ccauuguccuaagaacaaugccaacaaagcuuacaacauuuaguuuaaacccaagaagggcacu

SEQ ID NO: 512219 - RNA, 64 nt, hsa
uuaauacuccuccuuuuacagaauuagaaaaguuaacauuuaucuuuaggugguuuccugaaaa

SEQ ID NO: 512220 - RNA, 64 nt, hsa
cagaaauaggguuuucucaucuucaccaucaauaaacauuuauugcguaccuccuauauucugc

SEQ ID NO: 512221 - RNA, 64 nt, hsa
uucuaaugugccauauuuugcugugagugaccuuaacauuuauauuuuuauaugaauuguuuca

SEQ ID NO: 512222 - RNA, 64 nt, hsa
auauuuaccaggagaauuuuuuucuuaacaagccaacauuuaaaauuuauguuuuaugucaaua

SEQ ID NO: 512223 - RNA, 64 nt, hsa
cuaauuauuuuuuucaaugagugcugaaugggaaaacauuuauaucuuacuauaaaagguucug

SEQ ID NO: 512224 - RNA, 64 nt, hsa
auccauaguuuauuguuaguaugaacacaacuguaacauuuaccugguaucuacauccuuaccu

SEQ ID NO: 512225 - RNA, 64 nt, hsa
aaguccuguuuuugaugagcacuccuuguuagcuaacauuuaaauucuuuuugugaccucagaa

SEQ ID NO: 512226 - RNA, 64 nt, hsa
uauacauuuauuaggaaucuaaaucaugucuuugaacauuuauuagguucacucaguagguguu

SEQ ID NO: 512227 - RNA, 64 nt, hsa
gaaacuucuugcacuuauuuaaaauuuaggagagaacauuuaagccacucagguaugcaauuuu

SEQ ID NO: 512228 - RNA, 64 nt, hsa
cuuggaauugauauauaccuuauuaaagcuugaaaacauuuagcauuugaauaguaaguuucau

SEQ ID NO: 512229 - RNA, 64 nt, hsa
uuuucuucagacauuccuaacuugacuagugguuaacauuuagcaccuugguugucuuucaaua

SEQ ID NO: 512230 - RNA, 64 nt, hsa
ucugccuucuaucucuauggauuugccuauucugaacauuuauuauaaauggaaucacauaaua

SEQ ID NO: 512231 - RNA, 64 nt, hsa
auauugauuauuagccauaaaguuucuaacaugaaacauuuaucuauaaauuuugugauuauag

SEQ ID NO: 512232 - RNA, 64 nt, hsa; identical to SEQ ID NO: 209315

SEQ ID NO: 512233 - RNA, 64 nt, hsa; identical to SEQ ID NO: 209316

SEQ ID NO: 512234 - RNA, 64 nt, hsa; identical to SEQ ID NO: 209317

SEQ ID NO: 512235 - RNA, 64 nt, hsa; identical to SEQ ID NO: 209318

SEQ ID NO: 512236 - RNA, 64 nt, hsa; identical to SEQ ID NO: 209319

SEQ ID NO: 512237 - RNA, 64 nt, hsa; identical to SEQ ID NO: 209320

SEQ ID NO: 512238 - RNA, 64 nt, hsa; identical to SEQ ID NO: 209321

SEQ ID NO: 512239 - RNA, 64 nt, hsa; identical to SEQ ID NO: 209322

SEQ ID NO: 512240 - RNA, 64 nt, hsa; identical to SEQ ID NO: 209323

SEQ ID NO: 512241 - RNA, 64 nt, hsa; identical to SEQ ID NO: 209324

SEQ ID NO: 512242 - RNA, 64 nt, hsa; identical to SEQ ID NO: 209325

SEQ ID NO: 512243 - RNA, 64 nt, hsa; identical to SEQ ID NO: 209326

SEQ ID NO: 512244 - RNA, 64 nt, hsa; identical to SEQ ID NO: 209327

SEQ ID NO: 512245 - RNA, 64 nt, hsa; identical to SEQ ID NO: 209328

SEQ ID NO: 512246 - RNA, 64 nt, hsa; identical to SEQ ID NO: 209329

SEQ ID NO: 512247 - RNA, 64 nt, hsa; identical to SEQ ID NO: 209330

SEQ ID NO: 512248 - RNA, 64 nt, hsa; identical to SEQ ID NO: 209331

SEQ ID NO: 512249 - RNA, 64 nt, hsa; identical to SEQ ID NO: 209332

SEQ ID NO: 512250 - RNA, 64 nt, hsa; identical to SEQ ID NO: 209333

SEQ ID NO: 512251 - RNA, 64 nt, hsa; identical to SEQ ID NO: 209334

SEQ ID NO: 512252 - RNA, 64 nt, hsa; identical to SEQ ID NO: 209335

SEQ ID NO: 512253 - RNA, 64 nt, hsa; identical to SEQ ID NO: 209336

SEQ ID NO: 512254 - RNA, 64 nt, hsa; identical to SEQ ID NO: 209337

SEQ ID NO: 512255 - RNA, 64 nt, hsa; identical to SEQ ID NO: 209338

SEQ ID NO: 512256 - RNA, 64 nt, hsa; identical to SEQ ID NO: 209339

SEQ ID NO: 512257 - RNA, 64 nt, hsa; identical to SEQ ID NO: 209340

SEQ ID NO: 512258 - RNA, 64 nt, hsa; identical to SEQ ID NO: 209341

SEQ ID NO: 512259 - RNA, 64 nt, hsa; identical to SEQ ID NO: 209342

SEQ ID NO: 512260 - RNA, 64 nt, hsa; identical to SEQ ID NO: 209343

SEQ ID NO: 512261 - RNA, 64 nt, hsa; identical to SEQ ID NO: 209344

SEQ ID NO: 512262 - RNA, 64 nt, hsa; identical to SEQ ID NO: 209345

SEQ ID NO: 512263 - RNA, 64 nt, hsa; identical to SEQ ID NO: 209346

SEQ ID NO: 512264 - RNA, 64 nt, hsa; identical to SEQ ID NO: 209347

SEQ ID NO: 512265 - RNA, 64 nt, hsa; identical to SEQ ID NO: 209348

SEQ ID NO: 512266 - RNA, 64 nt, hsa; identical to SEQ ID NO: 209349

SEQ ID NO: 512267 - RNA, 64 nt, hsa; identical to SEQ ID NO: 209350

SEQ ID NO: 512268 - RNA, 64 nt, hsa; identical to SEQ ID NO: 209351

SEQ ID NO: 512269 - RNA, 64 nt, hsa; identical to SEQ ID NO: 209352

SEQ ID NO: 512270 - RNA, 64 nt, hsa; identical to SEQ ID NO: 37560

SEQ ID NO: 512271 - RNA, 64 nt, hsa; identical to SEQ ID NO: 37561

SEQ ID NO: 512272 - RNA, 64 nt, hsa; identical to SEQ ID NO: 37562

SEQ ID NO: 512273 - RNA, 64 nt, hsa; identical to SEQ ID NO: 37563

SEQ ID NO: 512274 - RNA, 64 nt, hsa; identical to SEQ ID NO: 37564

SEQ ID NO: 512275 - RNA, 64 nt, hsa; identical to SEQ ID NO: 37565

SEQ ID NO: 512276 - RNA, 64 nt, hsa; identical to SEQ ID NO: 37566

SEQ ID NO: 512277 - RNA, 64 nt, hsa; identical to SEQ ID NO: 37567

SEQ ID NO: 512278 - RNA, 64 nt, hsa; identical to SEQ ID NO: 37568

SEQ ID NO: 512279 - RNA, 64 nt, hsa; identical to SEQ ID NO: 37569

SEQ ID NO: 512280 - RNA, 64 nt, hsa; identical to SEQ ID NO: 37570

SEQ ID NO: 512281 - RNA, 64 nt, hsa; identical to SEQ ID NO: 37571

SEQ ID NO: 512282 - RNA, 64 nt, hsa; identical to SEQ ID NO: 37572

SEQ ID NO: 512283 - RNA, 64 nt, hsa; identical to SEQ ID NO: 37573

SEQ ID NO: 512284 - RNA, 64 nt, hsa; identical to SEQ ID NO: 37574

SEQ ID NO: 512285 - RNA, 64 nt, hsa; identical to SEQ ID NO: 37575

SEQ ID NO: 512286 - RNA, 64 nt, hsa; identical to SEQ ID NO: 37576

SEQ ID NO: 512287 - RNA, 64 nt, hsa; identical to SEQ ID NO: 37577

SEQ ID NO: 512288 - RNA, 64 nt, hsa; identical to SEQ ID NO: 37578

SEQ ID NO: 512289 - RNA, 64 nt, hsa; identical to SEQ ID NO: 37579

SEQ ID NO: 512290 - RNA, 64 nt, hsa; identical to SEQ ID NO: 37580

SEQ ID NO: 512291 - RNA, 64 nt, hsa; identical to SEQ ID NO: 37581

SEQ ID NO: 512292 - RNA, 64 nt, hsa; identical to SEQ ID NO: 155294

SEQ ID NO: 512293 - RNA, 64 nt, hsa; identical to SEQ ID NO: 155295

SEQ ID NO: 512294 - RNA, 64 nt, hsa; identical to SEQ ID NO: 155296

SEQ ID NO: 512295 - RNA, 64 nt, hsa; identical to SEQ ID NO: 155297

SEQ ID NO: 512296 - RNA, 64 nt, hsa; identical to SEQ ID NO: 155298

SEQ ID NO: 512297 - RNA, 64 nt, hsa; identical to SEQ ID NO: 155299

SEQ ID NO: 512298 - RNA, 64 nt, hsa; identical to SEQ ID NO: 155300

SEQ ID NO: 512299 - RNA, 64 nt, hsa; identical to SEQ ID NO: 155301

SEQ ID NO: 512300 - RNA, 64 nt, hsa; identical to SEQ ID NO: 155302

SEQ ID NO: 512301 - RNA, 64 nt, hsa; identical to SEQ ID NO: 155303

SEQ ID NO: 512302 - RNA, 64 nt, hsa; identical to SEQ ID NO: 155304

SEQ ID NO: 512303 - RNA, 64 nt, hsa; identical to SEQ ID NO: 155305

SEQ ID NO: 512304 - RNA, 64 nt, hsa; identical to SEQ ID NO: 155306

SEQ ID NO: 512305 - RNA, 64 nt, hsa; identical to SEQ ID NO: 155307

SEQ ID NO: 512306 - RNA, 64 nt, hsa; identical to SEQ ID NO: 155308

SEQ ID NO: 512307 - RNA, 64 nt, hsa; identical to SEQ ID NO: 155309

SEQ ID NO: 512308 - RNA, 64 nt, hsa; identical to SEQ ID NO: 155310

SEQ ID NO: 512309 - RNA, 64 nt, hsa; identical to SEQ ID NO: 155311

SEQ ID NO: 512310 - RNA, 64 nt, hsa; identical to SEQ ID NO: 155312

SEQ ID NO: 512311 - RNA, 64 nt, hsa; identical to SEQ ID NO: 155313

SEQ ID NO: 512312 - RNA, 64 nt, hsa; identical to SEQ ID NO: 155314

SEQ ID NO: 512313 - RNA, 64 nt, hsa; identical to SEQ ID NO: 155315

SEQ ID NO: 512314 - RNA, 64 nt, hsa; identical to SEQ ID NO: 155316

SEQ ID NO: 512315 - RNA, 64 nt, hsa; identical to SEQ ID NO: 155317

SEQ ID NO: 512316 - RNA, 64 nt, hsa; identical to SEQ ID NO: 155318

SEQ ID NO: 512317 - RNA, 64 nt, hsa; identical to SEQ ID NO: 155319

SEQ ID NO: 512318 - RNA, 64 nt, hsa; identical to SEQ ID NO: 155320

SEQ ID NO: 512319 - RNA, 64 nt, hsa; identical to SEQ ID NO: 155321

SEQ ID NO: 512320 - RNA, 64 nt, hsa; identical to SEQ ID NO: 155322

SEQ ID NO: 512321 - RNA, 64 nt, hsa; identical to SEQ ID NO: 155323

SEQ ID NO: 512322 - RNA, 64 nt, hsa; identical to SEQ ID NO: 155324

SEQ ID NO: 512323 - RNA, 64 nt, hsa; identical to SEQ ID NO: 155325

SEQ ID NO: 512324 - RNA, 64 nt, hsa; identical to SEQ ID NO: 155326

SEQ ID NO: 512325 - RNA, 64 nt, hsa; identical to SEQ ID NO: 155327

SEQ ID NO: 512326 - RNA, 64 nt, hsa; identical to SEQ ID NO: 155328

SEQ ID NO: 512327 - RNA, 64 nt, hsa; identical to SEQ ID NO: 155329

SEQ ID NO: 512328 - RNA, 64 nt, hsa; identical to SEQ ID NO: 155330

SEQ ID NO: 512329 - RNA, 64 nt, hsa; identical to SEQ ID NO: 155331

SEQ ID NO: 512330 - RNA, 64 nt, hsa; identical to SEQ ID NO: 155332

SEQ ID NO: 512331 - RNA, 64 nt, hsa; identical to SEQ ID NO: 155333

SEQ ID NO: 512332 - RNA, 64 nt, hsa; identical to SEQ ID NO: 155334

SEQ ID NO: 512333 - RNA, 64 nt, hsa; identical to SEQ ID NO: 155335

SEQ ID NO: 512334 - RNA, 64 nt, hsa; identical to SEQ ID NO: 155336

SEQ ID NO: 512335 - RNA, 64 nt, hsa; identical to SEQ ID NO: 155337

SEQ ID NO: 512336 - RNA, 64 nt, hsa; identical to SEQ ID NO: 155338

SEQ ID NO: 512337 - RNA, 64 nt, hsa
uuucacaccuugccuggccaaggggcuagaccucccaggcuaagccucagauucagugcaggac

SEQ ID NO: 512338 - RNA, 64 nt, hsa
uuccagggcaggucuggguuuccaagggaggggcccaggcuacauccuugguuuccccacugug

SEQ ID NO: 512339 - RNA, 64 nt, hsa
uuuuuuuuuuagagaggaggucccgcuauguuguccaggcuacuuucccaauauuugagaauaa

SEQ ID NO: 512340 - RNA, 64 nt, hsa
cgacuagcuggcauuacaggcgugcagcaccaccccaggcuaauuuaaaaaacuuuuuuuuuua

SEQ ID NO: 512341 - RNA, 64 nt, hsa
ggaugagaguccugggugugaggaacaccucccaccaggcuagaggcaacugcccaggaaggac

SEQ ID NO: 512342 - RNA, 64 nt, hsa
guuguuguuuuuaagauggaguuucccucuguugccaggcuagagugcaguggcaugaucucgg

SEQ ID NO: 512343 - RNA, 64 nt, hsa
cgaguagcugggaccacaggugccuaccaccaugccaggcuaauuuuuguauuuuuaguaaaga

SEQ ID NO: 512344 - RNA, 64 nt, hsa
guuguuguuguugagacagagucucgcucugucgccaggcuagagugcgguggcgcgaucuuga

SEQ ID NO: 512345 - RNA, 64 nt, hsa
ugaguagcugggacuacaggcacgcaccaccaugccaggcuaauuuuuuuguauuuuagcagag

SEQ ID NO: 512346 - RNA, 64 nt, hsa
ucccuucucagccucauguccaccugccugccagccaggcuacaggugugacuuccuucucuaa

SEQ ID NO: 512347 - RNA, 64 nt, hsa
auuuuuagcagagauggggguuucaccauguuggccaggcuagucucgaacuccugaccucagg

SEQ ID NO: 512348 - RNA, 64 nt, hsa
auuauuuuuuugagacagauucucacucugucucccaggcuagagugcaguggugcaaucucag

SEQ ID NO: 512349 - RNA, 64 nt, hsa
uauuuuuaguacagacaggguuugacuauguuggccaggcuagucuugaacuccugaccucaaa

SEQ ID NO: 512350 - RNA, 64 nt, hsa
guggagaagggaccagggauugcaggccccaucuccaggcuaaggggaggagagcaucaucacu

SEQ ID NO: 512351 - RNA, 64 nt, hsa
uuuguaaaggcaauucuuuugagagcaggauucuccaggcuaaaucaaaggcagcuaauccugu

SEQ ID NO: 512352 - RNA, 64 nt, hsa
ugacccccagaguguggaaagaaagaccaucuccccaggcuaugccaucaccauacacaguggc

SEQ ID NO: 512353 - RNA, 64 nt, hsa
cagcugccaucgaccuggagacugacaaccucauccaggcuaccauccgcacccaguuugauac

SEQ ID NO: 512354 - RNA, 64 nt, hsa
uuuuuuuuuaagagacaaggucuugcuauguugcccaggcuagagugcaguggcuauucacagg

SEQ ID NO: 512355 - RNA, 64 nt, hsa
auuuuguauuucuuuaucugagagaacugaguucccaggcuaaaucacuuaccucccacccccu

SEQ ID NO: 512356 - RNA, 64 nt, hsa
uguauugagcaucuguaaugugccagcauugugcccaggcuagggggcuauagaaacaucuaga

SEQ ID NO: 512357 - RNA, 64 nt, hsa
cuuucuuuuuuuugagauggucuuguucugucaaccaggcuagaaugcagcggugcaaucauga

SEQ ID NO: 512358 - RNA, 64 nt, hsa; identical to SEQ ID NO: 86796

SEQ ID NO: 512359 - RNA, 64 nt, hsa; identical to SEQ ID NO: 86797

SEQ ID NO: 512360 - RNA, 64 nt, hsa; identical to SEQ ID NO: 86798

SEQ ID NO: 512361 - RNA, 64 nt, hsa; identical to SEQ ID NO: 86799

SEQ ID NO: 512362 - RNA, 64 nt, hsa; identical to SEQ ID NO: 86800

SEQ ID NO: 512363 - RNA, 64 nt, hsa; identical to SEQ ID NO: 86801

SEQ ID NO: 512364 - RNA, 64 nt, hsa
uacguccugcuucuugguugagacuacugggauccuucagaaaagaaacacugggucccauagc

SEQ ID NO: 512365 - RNA, 64 nt, hsa
gggucccauagcuaaauucucaaccgccaggcaccuucagaagaauccagccuaauacuggaau

SEQ ID NO: 512366 - RNA, 64 nt, hsa
acugugcaggagaugacuuucccagcuuugcuggcuucagaagccuuuguacauaagagaugcu

SEQ ID NO: 512367 - RNA, 64 nt, hsa
cccaggggcuugugaggugggcagcucucugggccuucagaaccuuugcccccuccuuuuacuc

SEQ ID NO: 512368 - RNA, 64 nt, hsa
acugaugguuauaaugacugugggacaggauuaacuucagaauaaaugaacaggagacacagau

SEQ ID NO: 512369 - RNA, 50 nt, hsa
uuuauucucuguagcuauagcuucagaagcauuuuuacuugcaagacgau

SEQ ID NO: 512370 - RNA, 64 nt, hsa
ugugaggggcaaggcugcccccugccccagggcucuucagaaagcaucugcaugugaacaccau

SEQ ID NO: 512371 - RNA, 64 nt, hsa
uggcagcuggguagcucuuugaagguggauaagacuucagaagaggaaaggccagacuuugcuu

SEQ ID NO: 512372 - RNA, 64 nt, hsa
caaaaggaaaaaugaagugccccaggagaagauacuucagaagggcuguucugaaauuccuaag

SEQ ID NO: 512373 - RNA, 64 nt, hsa
aaauuugaaagauaagauuuauucuuauuuaauacuucagaaaauuucugcagagcccugcccu

SEQ ID NO: 512374 - RNA, 64 nt, hsa
ugcauuauacuaagaauuacaugccauaagaugacuucagaaauccuacuucagaaguguaaua

SEQ ID NO: 512375 - RNA, 64 nt, hsa
aauuacaugccauaagaugacuucagaaauccuacuucagaaguguaauaaauggauggggaaa

SEQ ID NO: 512376 - RNA, 64 nt, hsa
gaaggcucggauuccucuuccaauuccuccucuucuucagaaucaucuucagaaagugaacuug

SEQ ID NO: 512377 - RNA, 64 nt, hsa
uccucuuccaauuccuccucuucuucagaaucaucuucagaaagugaacuugaacaugagagaa

SEQ ID NO: 512378 - RNA, 64 nt, hsa
cauuuauauccuauguauaaauuaaaugagguggcuucagaaauggcagaauaaaucuaaagug

SEQ ID NO: 512379 - RNA, 64 nt, hsa
cuuuaacccuuacauuuauaugauucugggguugcuucagaaguguuauuucaugaaucauuca

SEQ ID NO: 512380 - RNA, 64 nt, hsa
augugauaaugguggcauuauauaugauuaaacacuucagaacuuucuaauguuaucaggagua

SEQ ID NO: 512381 - RNA, 64 nt, hsa
guguauuuuuuaaaaaaauaauuuaguaucaaggcuucagaaaaugccauuuacggcaucccuu

SEQ ID NO: 512382 - RNA, 64 nt, hsa
uuuaccugaauaaaugguaguaaucacaguuggccuucagaaccauccauaguaguaugaugau

SEQ ID NO: 512383 - RNA, 64 nt, hsa
uuauucuguagauucuguggaacaagccuaucagcuucagaauggcauuguacucaauggauuu

SEQ ID NO: 512384 - RNA, 64 nt, hsa
ggggcagaaaaauccccacucuuccuuauugccucuucagaacccuuuagaaaguauaaaauau

SEQ ID NO: 512385 - RNA, 64 nt, hsa
uucacaaaugucccugaacagaaaaugaagcucacuucagaacacacacucucugccuugaaaa

SEQ ID NO: 512386 - RNA, 64 nt, hsa
ccaccaacaccccuagaacuuucagccauggugucuucagaauuguagcgcauuucugaaucua

SEQ ID NO: 512387 - RNA, 64 nt, hsa
ccaaagaaaugugaaaggaccuuuugucacagcacuucagaaaauacacaacagccccuucugc

SEQ ID NO: 512388 - RNA, 64 nt, hsa
uuucauuaaguuguuauuucaguuuuaaauguaccuucagaauaagcuuccccaccccaguuuu

SEQ ID NO: 512389 - RNA, 64 nt, hsa
aaauguacaggaugccaguaaaaaaaaaaaauggcuucagaauuaaaacuaugaaauauuuuac

SEQ ID NO: 512390 - RNA, 64 nt, hsa
cacucauuuuguuucaacgguccaaacgcccaaccuucagaaagaggaagucagauagaaauag

SEQ ID NO: 512391 - RNA, 64 nt, hsa
ccccuccuuccuauuagcuacaaaacuggauaaacuucagaauaugagccaaugaguaggaagg

SEQ ID NO: 512392 - RNA, 64 nt, hsa
uaauguaaagcuggugaaguuuggccaguuugggcuucagaagucuaagucuagugaagguacc

SEQ ID NO: 512393 - RNA, 64 nt, hsa
uauuuuaacuccuaauuuacccuucaggucucagcuucagaacauucacuuauaaagaaacccu

SEQ ID NO: 512394 - RNA, 64 nt, hsa
caugccuguagcucucuuccuuuuguuucucacccuucagaaacauauuuuucaguagcuccag

SEQ ID NO: 512395 - RNA, 64 nt, hsa
ggagaacaacaagguacccagaauuuuuagaagccuucagaagaggcuaaaauauccagcuuug

SEQ ID NO: 512396 - RNA, 64 nt, hsa
agcacugaccaaggagacuuuuaagccagugguucuucagaaucaccuagaugccuccacccuc

SEQ ID NO: 512397 - RNA, 64 nt, hsa
aaaugccauucagucuggacuucaaaucacuugucuucagaaaauaaaagauuuguuccacccg

SEQ ID NO: 512398 - RNA, 64 nt, hsa
uaaaauuguuuuucuaauacuuuauagggcccaacuucagaaaauacuucgcuuuuuucuuuuu

SEQ ID NO: 512399 - RNA, 64 nt, hsa
guggucuuuuccuguuaacaagcuggcagcaaagcuucagaaaauauauaugcaagcacaacuu

SEQ ID NO: 512400 - RNA, 64 nt, hsa
caaaagcuguugggaacgccuucugaacaguugccuucagaacuaguuugagcugcucaauaaa

SEQ ID NO: 512401 - RNA, 64 nt, hsa
gggcccuuuuuguccaagccccacugaaaggccucuucagaaaacuauuaucuuuaaagcccua

SEQ ID NO: 512402 - RNA, 64 nt, hsa
aaaucuagaauucuuggaaguacauuauauugcccuucagaauagauuccaguuccuguugugc

SEQ ID NO: 512403 - RNA, 64 nt, hsa
uuuuaaaaaggacauuucuaucagggauauauaccuucagaaauaaggaaauaggggaaaaaaa

SEQ ID NO: 512404 - RNA, 64 nt, hsa
uuauuagacucugggagagaaaauuaaccaagugcuucagaacagguuuuuaguauuuaauucu

SEQ ID NO: 512405 - RNA, 64 nt, hsa
guuccugcuaaucucccaugucaucuucaaccuucuucagaagcucacugcuuuggcccccuua

SEQ ID NO: 512406 - RNA, 64 nt, hsa
uugaagugacuguuguaccaugguugugcacaugcuucagaauccuauggaagagaauauuccu

SEQ ID NO: 512407 - RNA, 64 nt, hsa
gaucaucaagaaauacuuucgaaauuucauuuuccuucagaauaucuuaagagugcuaaauuuu

SEQ ID NO: 512408 - RNA, 64 nt, hsa
ugcagccaggacccgguaggccugagccucaacucuucagaaaauaguguuuuuaauauuccuc

SEQ ID NO: 512409 - RNA, 64 nt, hsa
caacucuucagaaaauaguguuuuuaauauuccucuucagaaaauaguguuuuuaauauuccga

SEQ ID NO: 512410 - RNA, 64 nt, hsa
uuuuccccuccacucagaaaccccugcccuuucccuucagaaaacgauggcaggcauuccucug

SEQ ID NO: 512411 - RNA, 64 nt, hsa
cugggacagaggcuacaucugcccuagggagguccuucagaaucuguggagcaagaaaggauuu

SEQ ID NO: 512412 - RNA, 64 nt, hsa
caacuucagaagcucuuccacgcuuagaucaugucuucagaacuuagaugugaaaaucuacaca

SEQ ID NO: 512413 - RNA, 64 nt, hsa
agaugugacuugcacucagaagaucaguggucaacuucagaagcucuuccacgcuuagaucaug

SEQ ID NO: 512414 - RNA, 64 nt, hsa
ggcuuggggaggagucccucuagguagaacacagcuucagaaacuagcuuuaagaaauaauucu

SEQ ID NO: 512415 - RNA, 64 nt, hsa
gcuuauuagaggacaagaucaggacugcuuucagcuucagaacacuuuugguucagaacagcga

SEQ ID NO: 512416 - RNA, 64 nt, hsa
uggugguacagaagguaucagucaagcgcaggcucuucagaaaccuagaaacuaaaaagagaug

SEQ ID NO: 512417 - RNA, 64 nt, hsa
aaucacugaaaauagaacacuucuuggaggcuuucuucagaacugaacuagaaacaagguuucc

SEQ ID NO: 512418 - RNA, 64 nt, hsa
ccuuccugaaaugagcagaaauuguucacuaggucuucagaauggacguccuucugccagagac

SEQ ID NO: 512419 - RNA, 64 nt, hsa
ucuggacacuuguuuauucugacggaguucacuucuucagaaccuuccugaaaugagcagaaau

SEQ ID NO: 512420 - RNA, 64 nt, hsa
uacuccaggacucucacaaagcugaugagcuguacuucagaaaaaaauaauaauuuccauguuu

SEQ ID NO: 512421 - RNA, 64 nt, hsa
ggcugaugaauuuguuuucaucugucuuuucccccuucagaauuuuccuuggaaaaaaaauacu

SEQ ID NO: 512422 - RNA, 64 nt, hsa
uuauuugacugugagacguccucuaguuuguggccuucagaaaucagaucuuggggagaguccc

SEQ ID NO: 512423 - RNA, 64 nt, hsa
ugccuuuuguuuuucucugcuauacuugacuugccuucagaauauuacauuccagauaauauga

SEQ ID NO: 512424 - RNA, 64 nt, hsa; identical to SEQ ID NO: 51839

SEQ ID NO: 512425 - RNA, 64 nt, hsa; identical to SEQ ID NO: 51840

SEQ ID NO: 512426 - RNA, 64 nt, hsa; identical to SEQ ID NO: 51841

SEQ ID NO: 512427 - RNA, 64 nt, hsa; identical to SEQ ID NO: 51842

SEQ ID NO: 512428 - RNA, 64 nt, hsa; identical to SEQ ID NO: 51843

SEQ ID NO: 512429 - RNA, 64 nt, hsa; identical to SEQ ID NO: 51844

SEQ ID NO: 512430 - RNA, 64 nt, hsa; identical to SEQ ID NO: 51845

SEQ ID NO: 512431 - RNA, 64 nt, hsa; identical to SEQ ID NO: 51846

SEQ ID NO: 512432 - RNA, 64 nt, hsa; identical to SEQ ID NO: 51847

SEQ ID NO: 512433 - RNA, 64 nt, hsa; identical to SEQ ID NO: 51848

SEQ ID NO: 512434 - RNA, 64 nt, hsa; identical to SEQ ID NO: 51849

SEQ ID NO: 512435 - RNA, 64 nt, hsa; identical to SEQ ID NO: 51850

SEQ ID NO: 512436 - RNA, 64 nt, hsa; identical to SEQ ID NO: 51851

SEQ ID NO: 512437 - RNA, 64 nt, hsa; identical to SEQ ID NO: 51852

SEQ ID NO: 512438 - RNA, 64 nt, hsa; identical to SEQ ID NO: 51853

SEQ ID NO: 512439 - RNA, 64 nt, hsa; identical to SEQ ID NO: 51854

SEQ ID NO: 512440 - RNA, 64 nt, hsa; identical to SEQ ID NO: 51855

SEQ ID NO: 512441 - RNA, 64 nt, hsa; identical to SEQ ID NO: 51856

SEQ ID NO: 512442 - RNA, 64 nt, hsa; identical to SEQ ID NO: 51857

SEQ ID NO: 512443 - RNA, 64 nt, hsa; identical to SEQ ID NO: 51858

SEQ ID NO: 512444 - RNA, 64 nt, hsa; identical to SEQ ID NO: 51859

SEQ ID NO: 512445 - RNA, 64 nt, hsa; identical to SEQ ID NO: 51860

SEQ ID NO: 512446 - RNA, 64 nt, hsa; identical to SEQ ID NO: 51861

SEQ ID NO: 512447 - RNA, 64 nt, hsa; identical to SEQ ID NO: 51862

SEQ ID NO: 512448 - RNA, 64 nt, hsa; identical to SEQ ID NO: 51863

SEQ ID NO: 512449 - RNA, 64 nt, hsa; identical to SEQ ID NO: 51864

SEQ ID NO: 512450 - RNA, 64 nt, hsa; identical to SEQ ID NO: 51865

SEQ ID NO: 512451 - RNA, 64 nt, hsa; identical to SEQ ID NO: 51866

SEQ ID NO: 512452 - RNA, 64 nt, hsa; identical to SEQ ID NO: 51867

SEQ ID NO: 512453 - RNA, 64 nt, hsa; identical to SEQ ID NO: 51868

SEQ ID NO: 512454 - RNA, 64 nt, hsa; identical to SEQ ID NO: 51869

SEQ ID NO: 512455 - RNA, 64 nt, hsa; identical to SEQ ID NO: 51870

SEQ ID NO: 512456 - RNA, 64 nt, hsa; identical to SEQ ID NO: 51871

SEQ ID NO: 512457 - RNA, 64 nt, hsa; identical to SEQ ID NO: 51872

SEQ ID NO: 512458 - RNA, 64 nt, hsa; identical to SEQ ID NO: 51873

SEQ ID NO: 512459 - RNA, 64 nt, hsa; identical to SEQ ID NO: 51874

SEQ ID NO: 512460 - RNA, 64 nt, hsa; identical to SEQ ID NO: 51875

SEQ ID NO: 512461 - RNA, 64 nt, hsa; identical to SEQ ID NO: 51876

SEQ ID NO: 512462 - RNA, 64 nt, hsa; identical to SEQ ID NO: 51877

SEQ ID NO: 512463 - RNA, 64 nt, hsa; identical to SEQ ID NO: 51878

SEQ ID NO: 512464 - RNA, 64 nt, hsa; identical to SEQ ID NO: 51879

SEQ ID NO: 512465 - RNA, 64 nt, hsa; identical to SEQ ID NO: 51880

SEQ ID NO: 512466 - RNA, 64 nt, hsa; identical to SEQ ID NO: 51881

SEQ ID NO: 512467 - RNA, 64 nt, hsa; identical to SEQ ID NO: 51882

SEQ ID NO: 512468 - RNA, 64 nt, hsa; identical to SEQ ID NO: 51883

SEQ ID NO: 512469 - RNA, 64 nt, hsa; identical to SEQ ID NO: 51884

SEQ ID NO: 512470 - RNA, 64 nt, hsa; identical to SEQ ID NO: 51885

SEQ ID NO: 512471 - RNA, 64 nt, hsa; identical to SEQ ID NO: 51886

SEQ ID NO: 512472 - RNA, 64 nt, hsa; identical to SEQ ID NO: 51887

SEQ ID NO: 512473 - RNA, 64 nt, hsa; identical to SEQ ID NO: 51888

SEQ ID NO: 512474 - RNA, 64 nt, hsa; identical to SEQ ID NO: 51889

SEQ ID NO: 512475 - RNA, 64 nt, hsa; identical to SEQ ID NO: 51890

SEQ ID NO: 512476 - RNA, 63 nt, hsa; identical to SEQ ID NO: 51891

SEQ ID NO: 512477 - RNA, 64 nt, hsa; identical to SEQ ID NO: 51892

SEQ ID NO: 512478 - RNA, 64 nt, hsa; identical to SEQ ID NO: 51893

SEQ ID NO: 512479 - RNA, 64 nt, hsa; identical to SEQ ID NO: 51894

SEQ ID NO: 512480 - RNA, 64 nt, hsa; identical to SEQ ID NO: 51895

SEQ ID NO: 512481 - RNA, 64 nt, hsa; identical to SEQ ID NO: 51896

SEQ ID NO: 512482 - RNA, 64 nt, hsa; identical to SEQ ID NO: 51897

SEQ ID NO: 512483 - RNA, 64 nt, hsa; identical to SEQ ID NO: 51898

SEQ ID NO: 512484 - RNA, 64 nt, hsa; identical to SEQ ID NO: 51899

SEQ ID NO: 512485 - RNA, 64 nt, hsa; identical to SEQ ID NO: 51900

SEQ ID NO: 512486 - RNA, 64 nt, hsa; identical to SEQ ID NO: 51901

SEQ ID NO: 512487 - RNA, 64 nt, hsa; identical to SEQ ID NO: 51902

SEQ ID NO: 512488 - RNA, 64 nt, hsa; identical to SEQ ID NO: 51903

SEQ ID NO: 512489 - RNA, 64 nt, hsa; identical to SEQ ID NO: 51904

SEQ ID NO: 512490 - RNA, 64 nt, hsa; identical to SEQ ID NO: 51905

SEQ ID NO: 512491 - RNA, 64 nt, hsa; identical to SEQ ID NO: 51906

SEQ ID NO: 512492 - RNA, 64 nt, hsa; identical to SEQ ID NO: 51907

SEQ ID NO: 512493 - RNA, 64 nt, hsa; identical to SEQ ID NO: 51908

SEQ ID NO: 512494 - RNA, 64 nt, hsa; identical to SEQ ID NO: 51909

SEQ ID NO: 512495 - RNA, 64 nt, hsa; identical to SEQ ID NO: 51910

SEQ ID NO: 512496 - RNA, 64 nt, hsa; identical to SEQ ID NO: 51911

SEQ ID NO: 512497 - RNA, 64 nt, hsa; identical to SEQ ID NO: 51912

SEQ ID NO: 512498 - RNA, 64 nt, hsa; identical to SEQ ID NO: 51913

SEQ ID NO: 512499 - RNA, 64 nt, hsa; identical to SEQ ID NO: 51914

SEQ ID NO: 512500 - RNA, 64 nt, hsa; identical to SEQ ID NO: 51915

SEQ ID NO: 512501 - RNA, 64 nt, hsa; identical to SEQ ID NO: 51916

SEQ ID NO: 512502 - RNA, 64 nt, hsa; identical to SEQ ID NO: 51917

SEQ ID NO: 512503 - RNA, 64 nt, hsa
uuagaaaguuucuuuugguuacguagguagagaauacaacaaagaguucuaagacuuagaaaag

SEQ ID NO: 512504 - RNA, 64 nt, hsa
uucacaaagcuguaaagaccauugucuuaaauacuacaacaacuuaacacccuuuugugaagau

SEQ ID NO: 512505 - RNA, 64 nt, hsa
uuaaauggaguauuuuuauuuuauguauauacuauacaacaauguucuuuuuuguuacagcuau

SEQ ID NO: 512506 - RNA, 64 nt, hsa
cucucuguacaaaaacaaaacaaaacaacaacaauacaacaagaacaacaacaacaauaacaac

SEQ ID NO: 512507 - RNA, 64 nt, hsa
aggaauacagcuaaccagggagaugaaagaucucuacaacaaaaauuacaaaacacugcugaaa

SEQ ID NO: 512508 - RNA, 64 nt, hsa
acuaugcuuuuuaucuggaugaugaaauaaucuguacaacaaacccuggugacaugcaauuuac

SEQ ID NO: 512509 - RNA, 64 nt, hsa
ucacuaacaacagauaagguagagcagugagguuuacaacaagcccuacaauuagagauugcug

SEQ ID NO: 512510 - RNA, 64 nt, hsa
guauugaaauaaucaaagagauaauuucagcucuuacaacaagaacagaaaacaugcuaauuag

SEQ ID NO: 512511 - RNA, 64 nt, hsa; identical to SEQ ID NO: 509252

SEQ ID NO: 512512 - RNA, 64 nt, hsa; identical to SEQ ID NO: 509253

SEQ ID NO: 512513 - RNA, 64 nt, hsa; identical to SEQ ID NO: 509254

SEQ ID NO: 512514 - RNA, 64 nt, hsa; identical to SEQ ID NO: 509255

SEQ ID NO: 512515 - RNA, 64 nt, hsa; identical to SEQ ID NO: 509256

SEQ ID NO: 512516 - RNA, 64 nt, hsa; identical to SEQ ID NO: 509257

SEQ ID NO: 512517 - RNA, 64 nt, hsa; identical to SEQ ID NO: 509258

SEQ ID NO: 512518 - RNA, 64 nt, hsa; identical to SEQ ID NO: 509259

SEQ ID NO: 512519 - RNA, 64 nt, hsa; identical to SEQ ID NO: 509260

SEQ ID NO: 512520 - RNA, 64 nt, hsa; identical to SEQ ID NO: 509261

SEQ ID NO: 512521 - RNA, 64 nt, hsa; identical to SEQ ID NO: 509262

SEQ ID NO: 512522 - RNA, 64 nt, hsa; identical to SEQ ID NO: 509263

SEQ ID NO: 512523 - RNA, 64 nt, hsa; identical to SEQ ID NO: 509264

SEQ ID NO: 512524 - RNA, 64 nt, hsa; identical to SEQ ID NO: 509265

SEQ ID NO: 512525 - RNA, 64 nt, hsa; identical to SEQ ID NO: 509266

SEQ ID NO: 512526 - RNA, 64 nt, hsa; identical to SEQ ID NO: 509267

SEQ ID NO: 512527 - RNA, 64 nt, hsa; identical to SEQ ID NO: 509268

SEQ ID NO: 512528 - RNA, 64 nt, hsa; identical to SEQ ID NO: 509269

SEQ ID NO: 512529 - RNA, 64 nt, hsa; identical to SEQ ID NO: 509270

SEQ ID NO: 512530 - RNA, 64 nt, hsa; identical to SEQ ID NO: 509271

SEQ ID NO: 512531 - RNA, 64 nt, hsa; identical to SEQ ID NO: 509272

SEQ ID NO: 512532 - RNA, 64 nt, hsa; identical to SEQ ID NO: 509273

SEQ ID NO: 512533 - RNA, 64 nt, hsa; identical to SEQ ID NO: 509274

SEQ ID NO: 512534 - RNA, 64 nt, hsa; identical to SEQ ID NO: 509275

SEQ ID NO: 512535 - RNA, 64 nt, hsa; identical to SEQ ID NO: 509276

SEQ ID NO: 512536 - RNA, 64 nt, hsa; identical to SEQ ID NO: 509277

SEQ ID NO: 512537 - RNA, 64 nt, hsa; identical to SEQ ID NO: 509278

SEQ ID NO: 512538 - RNA, 64 nt, hsa; identical to SEQ ID NO: 509279

SEQ ID NO: 512539 - RNA, 64 nt, hsa; identical to SEQ ID NO: 509280

SEQ ID NO: 512540 - RNA, 64 nt, hsa; identical to SEQ ID NO: 509281

SEQ ID NO: 512541 - RNA, 64 nt, hsa; identical to SEQ ID NO: 509282

SEQ ID NO: 512542 - RNA, 64 nt, hsa; identical to SEQ ID NO: 509283

SEQ ID NO: 512543 - RNA, 64 nt, hsa; identical to SEQ ID NO: 509284

SEQ ID NO: 512544 - RNA, 64 nt, hsa; identical to SEQ ID NO: 509285

SEQ ID NO: 512545 - RNA, 64 nt, hsa; identical to SEQ ID NO: 509286

SEQ ID NO: 512546 - RNA, 64 nt, hsa; identical to SEQ ID NO: 509287

SEQ ID NO: 512547 - RNA, 64 nt, hsa; identical to SEQ ID NO: 509288

SEQ ID NO: 512548 - RNA, 64 nt, hsa; identical to SEQ ID NO: 509289

SEQ ID NO: 512549 - RNA, 64 nt, hsa; identical to SEQ ID NO: 509290

SEQ ID NO: 512550 - RNA, 64 nt, hsa; identical to SEQ ID NO: 509291

SEQ ID NO: 512551 - RNA, 64 nt, hsa; identical to SEQ ID NO: 509292

SEQ ID NO: 512552 - RNA, 64 nt, hsa; identical to SEQ ID NO: 509293

SEQ ID NO: 512553 - RNA, 64 nt, hsa; identical to SEQ ID NO: 509294

SEQ ID NO: 512554 - RNA, 64 nt, hsa; identical to SEQ ID NO: 509295

SEQ ID NO: 512555 - RNA, 64 nt, hsa; identical to SEQ ID NO: 509296

SEQ ID NO: 512556 - RNA, 64 nt, hsa; identical to SEQ ID NO: 509297

SEQ ID NO: 512557 - RNA, 64 nt, hsa; identical to SEQ ID NO: 509298

SEQ ID NO: 512558 - RNA, 64 nt, hsa; identical to SEQ ID NO: 509299

SEQ ID NO: 512559 - RNA, 64 nt, hsa; identical to SEQ ID NO: 509300

SEQ ID NO: 512560 - RNA, 64 nt, hsa; identical to SEQ ID NO: 509301

SEQ ID NO: 512561 - RNA, 64 nt, hsa; identical to SEQ ID NO: 509302

SEQ ID NO: 512562 - RNA, 64 nt, hsa; identical to SEQ ID NO: 509303

SEQ ID NO: 512563 - RNA, 64 nt, hsa; identical to SEQ ID NO: 509304

SEQ ID NO: 512564 - RNA, 64 nt, hsa; identical to SEQ ID NO: 509305

SEQ ID NO: 512565 - RNA, 64 nt, hsa; identical to SEQ ID NO: 509306

SEQ ID NO: 512566 - RNA, 64 nt, hsa; identical to SEQ ID NO: 509307

SEQ ID NO: 512567 - RNA, 64 nt, hsa; identical to SEQ ID NO: 509308

SEQ ID NO: 512568 - RNA, 64 nt, hsa; identical to SEQ ID NO: 509309

SEQ ID NO: 512569 - RNA, 64 nt, hsa; identical to SEQ ID NO: 509310

SEQ ID NO: 512570 - RNA, 64 nt, hsa; identical to SEQ ID NO: 509311

SEQ ID NO: 512571 - RNA, 64 nt, hsa; identical to SEQ ID NO: 509312

SEQ ID NO: 512572 - RNA, 64 nt, hsa; identical to SEQ ID NO: 509313

SEQ ID NO: 512573 - RNA, 64 nt, hsa; identical to SEQ ID NO: 509314

SEQ ID NO: 512574 - RNA, 64 nt, hsa; identical to SEQ ID NO: 509315

SEQ ID NO: 512575 - RNA, 64 nt, hsa; identical to SEQ ID NO: 509316

SEQ ID NO: 512576 - RNA, 64 nt, hsa; identical to SEQ ID NO: 509317

SEQ ID NO: 512577 - RNA, 64 nt, hsa; identical to SEQ ID NO: 509318

SEQ ID NO: 512578 - RNA, 64 nt, hsa; identical to SEQ ID NO: 509319

SEQ ID NO: 512579 - RNA, 64 nt, hsa; identical to SEQ ID NO: 509320

SEQ ID NO: 512580 - RNA, 64 nt, hsa; identical to SEQ ID NO: 509321

SEQ ID NO: 512581 - RNA, 64 nt, hsa; identical to SEQ ID NO: 509322

SEQ ID NO: 512582 - RNA, 64 nt, hsa; identical to SEQ ID NO: 509323

SEQ ID NO: 512583 - RNA, 64 nt, hsa; identical to SEQ ID NO: 509324

SEQ ID NO: 512584 - RNA, 64 nt, hsa; identical to SEQ ID NO: 509325

SEQ ID NO: 512585 - RNA, 64 nt, hsa; identical to SEQ ID NO: 509326

SEQ ID NO: 512586 - RNA, 64 nt, hsa; identical to SEQ ID NO: 509327

SEQ ID NO: 512587 - RNA, 64 nt, hsa; identical to SEQ ID NO: 509328

SEQ ID NO: 512588 - RNA, 64 nt, hsa; identical to SEQ ID NO: 509329

SEQ ID NO: 512589 - RNA, 64 nt, hsa; identical to SEQ ID NO: 509330

SEQ ID NO: 512590 - RNA, 64 nt, hsa; identical to SEQ ID NO: 509331

SEQ ID NO: 512591 - RNA, 64 nt, hsa; identical to SEQ ID NO: 509332

SEQ ID NO: 512592 - RNA, 64 nt, hsa; identical to SEQ ID NO: 509333

SEQ ID NO: 512593 - RNA, 64 nt, hsa; identical to SEQ ID NO: 509334

SEQ ID NO: 512594 - RNA, 64 nt, hsa; identical to SEQ ID NO: 509335

SEQ ID NO: 512595 - RNA, 64 nt, hsa; identical to SEQ ID NO: 509336

SEQ ID NO: 512596 - RNA, 64 nt, hsa; identical to SEQ ID NO: 509337

SEQ ID NO: 512597 - RNA, 64 nt, hsa; identical to SEQ ID NO: 509338

SEQ ID NO: 512598 - RNA, 64 nt, hsa; identical to SEQ ID NO: 509339

SEQ ID NO: 512599 - RNA, 64 nt, hsa; identical to SEQ ID NO: 509340

SEQ ID NO: 512600 - RNA, 64 nt, hsa; identical to SEQ ID NO: 509341

SEQ ID NO: 512601 - RNA, 64 nt, hsa; identical to SEQ ID NO: 509342

SEQ ID NO: 512602 - RNA, 64 nt, hsa; identical to SEQ ID NO: 509343

SEQ ID NO: 512603 - RNA, 64 nt, hsa; identical to SEQ ID NO: 509344

SEQ ID NO: 512604 - RNA, 64 nt, hsa; identical to SEQ ID NO: 509345

SEQ ID NO: 512605 - RNA, 64 nt, hsa; identical to SEQ ID NO: 509346

SEQ ID NO: 512606 - RNA, 64 nt, hsa; identical to SEQ ID NO: 509347

SEQ ID NO: 512607 - RNA, 64 nt, hsa; identical to SEQ ID NO: 509348

SEQ ID NO: 512608 - RNA, 64 nt, hsa; identical to SEQ ID NO: 509349

SEQ ID NO: 512609 - RNA, 64 nt, hsa; identical to SEQ ID NO: 509350

SEQ ID NO: 512610 - RNA, 64 nt, hsa; identical to SEQ ID NO: 509351

SEQ ID NO: 512611 - RNA, 64 nt, hsa; identical to SEQ ID NO: 509352

SEQ ID NO: 512612 - RNA, 64 nt, hsa; identical to SEQ ID NO: 509353

SEQ ID NO: 512613 - RNA, 64 nt, hsa; identical to SEQ ID NO: 509354

SEQ ID NO: 512614 - RNA, 64 nt, hsa; identical to SEQ ID NO: 509355

SEQ ID NO: 512615 - RNA, 64 nt, hsa; identical to SEQ ID NO: 509356

SEQ ID NO: 512616 - RNA, 64 nt, hsa; identical to SEQ ID NO: 509357

SEQ ID NO: 512617 - RNA, 64 nt, hsa; identical to SEQ ID NO: 509358

SEQ ID NO: 512618 - RNA, 64 nt, hsa; identical to SEQ ID NO: 509359

SEQ ID NO: 512619 - RNA, 64 nt, hsa; identical to SEQ ID NO: 509360

SEQ ID NO: 512620 - RNA, 64 nt, hsa; identical to SEQ ID NO: 509361

SEQ ID NO: 512621 - RNA, 64 nt, hsa; identical to SEQ ID NO: 509362

SEQ ID NO: 512622 - RNA, 64 nt, hsa; identical to SEQ ID NO: 509363

SEQ ID NO: 512623 - RNA, 64 nt, hsa; identical to SEQ ID NO: 509364

SEQ ID NO: 512624 - RNA, 64 nt, hsa; identical to SEQ ID NO: 509365

SEQ ID NO: 512625 - RNA, 64 nt, hsa; identical to SEQ ID NO: 509366

SEQ ID NO: 512626 - RNA, 64 nt, hsa; identical to SEQ ID NO: 509367

SEQ ID NO: 512627 - RNA, 64 nt, hsa; identical to SEQ ID NO: 509368

SEQ ID NO: 512628 - RNA, 64 nt, hsa; identical to SEQ ID NO: 509369

SEQ ID NO: 512629 - RNA, 64 nt, hsa; identical to SEQ ID NO: 509370

SEQ ID NO: 512630 - RNA, 64 nt, hsa; identical to SEQ ID NO: 509371

SEQ ID NO: 512631 - RNA, 64 nt, hsa; identical to SEQ ID NO: 509372

SEQ ID NO: 512632 - RNA, 64 nt, hsa; identical to SEQ ID NO: 509373

SEQ ID NO: 512633 - RNA, 64 nt, hsa; identical to SEQ ID NO: 509374

SEQ ID NO: 512634 - RNA, 64 nt, hsa; identical to SEQ ID NO: 509375

SEQ ID NO: 512635 - RNA, 64 nt, hsa; identical to SEQ ID NO: 509376

SEQ ID NO: 512636 - RNA, 64 nt, hsa; identical to SEQ ID NO: 509377

SEQ ID NO: 512637 - RNA, 64 nt, hsa; identical to SEQ ID NO: 509378

SEQ ID NO: 512638 - RNA, 64 nt, hsa; identical to SEQ ID NO: 509379

SEQ ID NO: 512639 - RNA, 64 nt, hsa; identical to SEQ ID NO: 509380

SEQ ID NO: 512640 - RNA, 64 nt, hsa; identical to SEQ ID NO: 509381

SEQ ID NO: 512641 - RNA, 64 nt, hsa; identical to SEQ ID NO: 509382

SEQ ID NO: 512642 - RNA, 64 nt, hsa; identical to SEQ ID NO: 509383

SEQ ID NO: 512643 - RNA, 64 nt, hsa; identical to SEQ ID NO: 509384

SEQ ID NO: 512644 - RNA, 64 nt, hsa; identical to SEQ ID NO: 509385

SEQ ID NO: 512645 - RNA, 64 nt, hsa; identical to SEQ ID NO: 509386

SEQ ID NO: 512646 - RNA, 64 nt, hsa; identical to SEQ ID NO: 509387

SEQ ID NO: 512647 - RNA, 64 nt, hsa; identical to SEQ ID NO: 509388

SEQ ID NO: 512648 - RNA, 64 nt, hsa; identical to SEQ ID NO: 509389

SEQ ID NO: 512649 - RNA, 64 nt, hsa; identical to SEQ ID NO: 509390

SEQ ID NO: 512650 - RNA, 64 nt, hsa; identical to SEQ ID NO: 509391

SEQ ID NO: 512651 - RNA, 64 nt, hsa; identical to SEQ ID NO: 509392

SEQ ID NO: 512652 - RNA, 64 nt, hsa; identical to SEQ ID NO: 509393

SEQ ID NO: 512653 - RNA, 64 nt, hsa; identical to SEQ ID NO: 509394

SEQ ID NO: 512654 - RNA, 64 nt, hsa; identical to SEQ ID NO: 509395

SEQ ID NO: 512655 - RNA, 64 nt, hsa; identical to SEQ ID NO: 509396

SEQ ID NO: 512656 - RNA, 64 nt, hsa; identical to SEQ ID NO: 509397

SEQ ID NO: 512657 - RNA, 64 nt, hsa; identical to SEQ ID NO: 509398

SEQ ID NO: 512658 - RNA, 64 nt, hsa; identical to SEQ ID NO: 509399

SEQ ID NO: 512659 - RNA, 64 nt, hsa; identical to SEQ ID NO: 509400

SEQ ID NO: 512660 - RNA, 64 nt, hsa; identical to SEQ ID NO: 509401

SEQ ID NO: 512661 - RNA, 64 nt, hsa; identical to SEQ ID NO: 509402

SEQ ID NO: 512662 - RNA, 64 nt, hsa; identical to SEQ ID NO: 509403

SEQ ID NO: 512663 - RNA, 64 nt, hsa; identical to SEQ ID NO: 509404

SEQ ID NO: 512664 - RNA, 64 nt, hsa; identical to SEQ ID NO: 509405

SEQ ID NO: 512665 - RNA, 64 nt, hsa; identical to SEQ ID NO: 509406

SEQ ID NO: 512666 - RNA, 64 nt, hsa; identical to SEQ ID NO: 509407

SEQ ID NO: 512667 - RNA, 64 nt, hsa; identical to SEQ ID NO: 509408

SEQ ID NO: 512668 - RNA, 64 nt, hsa; identical to SEQ ID NO: 509409

SEQ ID NO: 512669 - RNA, 64 nt, hsa; identical to SEQ ID NO: 509410

SEQ ID NO: 512670 - RNA, 64 nt, hsa; identical to SEQ ID NO: 509411

SEQ ID NO: 512671 - RNA, 64 nt, hsa; identical to SEQ ID NO: 509412

SEQ ID NO: 512672 - RNA, 64 nt, hsa; identical to SEQ ID NO: 509413

SEQ ID NO: 512673 - RNA, 64 nt, hsa; identical to SEQ ID NO: 509414

SEQ ID NO: 512674 - RNA, 64 nt, hsa; identical to SEQ ID NO: 509415

SEQ ID NO: 512675 - RNA, 64 nt, hsa; identical to SEQ ID NO: 509416

SEQ ID NO: 512676 - RNA, 64 nt, hsa; identical to SEQ ID NO: 509417

SEQ ID NO: 512677 - RNA, 64 nt, hsa; identical to SEQ ID NO: 509418

SEQ ID NO: 512678 - RNA, 64 nt, hsa; identical to SEQ ID NO: 509419

SEQ ID NO: 512679 - RNA, 64 nt, hsa; identical to SEQ ID NO: 509420

SEQ ID NO: 512680 - RNA, 64 nt, hsa; identical to SEQ ID NO: 509421

SEQ ID NO: 512681 - RNA, 64 nt, hsa; identical to SEQ ID NO: 509422

SEQ ID NO: 512682 - RNA, 64 nt, hsa; identical to SEQ ID NO: 509423

SEQ ID NO: 512683 - RNA, 64 nt, hsa; identical to SEQ ID NO: 509424

SEQ ID NO: 512684 - RNA, 64 nt, hsa; identical to SEQ ID NO: 509425

SEQ ID NO: 512685 - RNA, 64 nt, hsa; identical to SEQ ID NO: 509426

SEQ ID NO: 512686 - RNA, 64 nt, hsa; identical to SEQ ID NO: 509427

SEQ ID NO: 512687 - RNA, 64 nt, hsa; identical to SEQ ID NO: 509428

SEQ ID NO: 512688 - RNA, 64 nt, hsa; identical to SEQ ID NO: 509429

SEQ ID NO: 512689 - RNA, 64 nt, hsa; identical to SEQ ID NO: 509430

SEQ ID NO: 512690 - RNA, 64 nt, hsa; identical to SEQ ID NO: 509431

SEQ ID NO: 512691 - RNA, 64 nt, hsa; identical to SEQ ID NO: 509432

SEQ ID NO: 512692 - RNA, 64 nt, hsa; identical to SEQ ID NO: 509433

SEQ ID NO: 512693 - RNA, 64 nt, hsa; identical to SEQ ID NO: 509434

SEQ ID NO: 512694 - RNA, 64 nt, hsa; identical to SEQ ID NO: 509435

SEQ ID NO: 512695 - RNA, 64 nt, hsa; identical to SEQ ID NO: 509436

SEQ ID NO: 512696 - RNA, 64 nt, hsa; identical to SEQ ID NO: 509437

SEQ ID NO: 512697 - RNA, 64 nt, hsa; identical to SEQ ID NO: 509438

SEQ ID NO: 512698 - RNA, 64 nt, hsa; identical to SEQ ID NO: 509439

SEQ ID NO: 512699 - RNA, 64 nt, hsa; identical to SEQ ID NO: 509440

SEQ ID NO: 512700 - RNA, 64 nt, hsa; identical to SEQ ID NO: 509441

SEQ ID NO: 512701 - RNA, 64 nt, hsa; identical to SEQ ID NO: 509442

SEQ ID NO: 512702 - RNA, 64 nt, hsa; identical to SEQ ID NO: 509443

SEQ ID NO: 512703 - RNA, 64 nt, hsa; identical to SEQ ID NO: 509444

SEQ ID NO: 512704 - RNA, 64 nt, hsa; identical to SEQ ID NO: 509445

SEQ ID NO: 512705 - RNA, 64 nt, hsa; identical to SEQ ID NO: 509446

SEQ ID NO: 512706 - RNA, 64 nt, hsa; identical to SEQ ID NO: 509447

SEQ ID NO: 512707 - RNA, 64 nt, hsa; identical to SEQ ID NO: 509448

SEQ ID NO: 512708 - RNA, 64 nt, hsa; identical to SEQ ID NO: 509449

SEQ ID NO: 512709 - RNA, 64 nt, hsa; identical to SEQ ID NO: 509450

SEQ ID NO: 512710 - RNA, 64 nt, hsa; identical to SEQ ID NO: 509451

SEQ ID NO: 512711 - RNA, 64 nt, hsa; identical to SEQ ID NO: 509452

SEQ ID NO: 512712 - RNA, 64 nt, hsa; identical to SEQ ID NO: 509453

SEQ ID NO: 512713 - RNA, 64 nt, hsa; identical to SEQ ID NO: 509454

SEQ ID NO: 512714 - RNA, 64 nt, hsa; identical to SEQ ID NO: 509455

SEQ ID NO: 512715 - RNA, 64 nt, hsa; identical to SEQ ID NO: 509456

SEQ ID NO: 512716 - RNA, 64 nt, hsa; identical to SEQ ID NO: 509457

SEQ ID NO: 512717 - RNA, 64 nt, hsa; identical to SEQ ID NO: 509458

SEQ ID NO: 512718 - RNA, 64 nt, hsa; identical to SEQ ID NO: 509459

SEQ ID NO: 512719 - RNA, 64 nt, hsa; identical to SEQ ID NO: 509460

SEQ ID NO: 512720 - RNA, 64 nt, hsa; identical to SEQ ID NO: 509461

SEQ ID NO: 512721 - RNA, 64 nt, hsa; identical to SEQ ID NO: 509462

SEQ ID NO: 512722 - RNA, 64 nt, hsa; identical to SEQ ID NO: 509463

SEQ ID NO: 512723 - RNA, 64 nt, hsa; identical to SEQ ID NO: 509464

SEQ ID NO: 512724 - RNA, 64 nt, hsa; identical to SEQ ID NO: 509465

SEQ ID NO: 512725 - RNA, 54 nt, hsa; identical to SEQ ID NO: 509466

SEQ ID NO: 512726 - RNA, 64 nt, hsa; identical to SEQ ID NO: 509467

SEQ ID NO: 512727 - RNA, 64 nt, hsa; identical to SEQ ID NO: 509468

SEQ ID NO: 512728 - RNA, 64 nt, hsa; identical to SEQ ID NO: 509469

SEQ ID NO: 512729 - RNA, 64 nt, hsa; identical to SEQ ID NO: 509470

SEQ ID NO: 512730 - RNA, 64 nt, hsa; identical to SEQ ID NO: 509471

SEQ ID NO: 512731 - RNA, 64 nt, hsa; identical to SEQ ID NO: 509472

SEQ ID NO: 512732 - RNA, 64 nt, hsa; identical to SEQ ID NO: 509473

SEQ ID NO: 512733 - RNA, 64 nt, hsa; identical to SEQ ID NO: 509474

SEQ ID NO: 512734 - RNA, 64 nt, hsa; identical to SEQ ID NO: 509475

SEQ ID NO: 512735 - RNA, 64 nt, hsa; identical to SEQ ID NO: 509476

SEQ ID NO: 512736 - RNA, 64 nt, hsa; identical to SEQ ID NO: 509477

SEQ ID NO: 512737 - RNA, 64 nt, hsa; identical to SEQ ID NO: 509478

SEQ ID NO: 512738 - RNA, 64 nt, hsa; identical to SEQ ID NO: 509479

SEQ ID NO: 512739 - RNA, 64 nt, hsa; identical to SEQ ID NO: 509480

SEQ ID NO: 512740 - RNA, 64 nt, hsa; identical to SEQ ID NO: 509481

SEQ ID NO: 512741 - RNA, 64 nt, hsa; identical to SEQ ID NO: 509482

SEQ ID NO: 512742 - RNA, 64 nt, hsa; identical to SEQ ID NO: 509483

SEQ ID NO: 512743 - RNA, 64 nt, hsa; identical to SEQ ID NO: 509484

SEQ ID NO: 512744 - RNA, 64 nt, hsa; identical to SEQ ID NO: 509485

SEQ ID NO: 512745 - RNA, 64 nt, hsa; identical to SEQ ID NO: 509486

SEQ ID NO: 512746 - RNA, 64 nt, hsa; identical to SEQ ID NO: 509487

SEQ ID NO: 512747 - RNA, 64 nt, hsa; identical to SEQ ID NO: 509488

SEQ ID NO: 512748 - RNA, 64 nt, hsa; identical to SEQ ID NO: 509489

SEQ ID NO: 512749 - RNA, 64 nt, hsa; identical to SEQ ID NO: 509490

SEQ ID NO: 512750 - RNA, 64 nt, hsa; identical to SEQ ID NO: 509491

SEQ ID NO: 512751 - RNA, 64 nt, hsa; identical to SEQ ID NO: 509492

SEQ ID NO: 512752 - RNA, 64 nt, hsa; identical to SEQ ID NO: 509493

SEQ ID NO: 512753 - RNA, 64 nt, hsa; identical to SEQ ID NO: 509494

SEQ ID NO: 512754 - RNA, 64 nt, hsa; identical to SEQ ID NO: 509495

SEQ ID NO: 512755 - RNA, 64 nt, hsa; identical to SEQ ID NO: 509496

SEQ ID NO: 512756 - RNA, 64 nt, hsa; identical to SEQ ID NO: 509497

SEQ ID NO: 512757 - RNA, 64 nt, hsa; identical to SEQ ID NO: 509498

SEQ ID NO: 512758 - RNA, 64 nt, hsa; identical to SEQ ID NO: 509499

SEQ ID NO: 512759 - RNA, 64 nt, hsa; identical to SEQ ID NO: 509500

SEQ ID NO: 512760 - RNA, 64 nt, hsa; identical to SEQ ID NO: 509501

SEQ ID NO: 512761 - RNA, 64 nt, hsa; identical to SEQ ID NO: 509502

SEQ ID NO: 512762 - RNA, 64 nt, hsa; identical to SEQ ID NO: 509503

SEQ ID NO: 512763 - RNA, 64 nt, hsa; identical to SEQ ID NO: 509504

SEQ ID NO: 512764 - RNA, 64 nt, hsa; identical to SEQ ID NO: 509505

SEQ ID NO: 512765 - RNA, 64 nt, hsa; identical to SEQ ID NO: 509506

SEQ ID NO: 512766 - RNA, 64 nt, hsa; identical to SEQ ID NO: 509507

SEQ ID NO: 512767 - RNA, 64 nt, hsa; identical to SEQ ID NO: 509508

SEQ ID NO: 512768 - RNA, 64 nt, hsa; identical to SEQ ID NO: 509509

SEQ ID NO: 512769 - RNA, 64 nt, hsa; identical to SEQ ID NO: 509510

SEQ ID NO: 512770 - RNA, 64 nt, hsa; identical to SEQ ID NO: 509511

SEQ ID NO: 512771 - RNA, 64 nt, hsa; identical to SEQ ID NO: 509512

SEQ ID NO: 512772 - RNA, 64 nt, hsa; identical to SEQ ID NO: 509513

SEQ ID NO: 512773 - RNA, 64 nt, hsa; identical to SEQ ID NO: 509514

SEQ ID NO: 512774 - RNA, 64 nt, hsa; identical to SEQ ID NO: 509515

SEQ ID NO: 512775 - RNA, 64 nt, hsa; identical to SEQ ID NO: 509516

SEQ ID NO: 512776 - RNA, 64 nt, hsa; identical to SEQ ID NO: 509517

SEQ ID NO: 512777 - RNA, 64 nt, hsa; identical to SEQ ID NO: 509518

SEQ ID NO: 512778 - RNA, 64 nt, hsa; identical to SEQ ID NO: 509519

SEQ ID NO: 512779 - RNA, 64 nt, hsa; identical to SEQ ID NO: 509520

SEQ ID NO: 512780 - RNA, 64 nt, hsa; identical to SEQ ID NO: 509521

SEQ ID NO: 512781 - RNA, 64 nt, hsa; identical to SEQ ID NO: 509522

SEQ ID NO: 512782 - RNA, 64 nt, hsa; identical to SEQ ID NO: 509523

SEQ ID NO: 512783 - RNA, 64 nt, hsa; identical to SEQ ID NO: 509524

SEQ ID NO: 512784 - RNA, 64 nt, hsa; identical to SEQ ID NO: 509525

SEQ ID NO: 512785 - RNA, 64 nt, hsa; identical to SEQ ID NO: 509526

SEQ ID NO: 512786 - RNA, 64 nt, hsa; identical to SEQ ID NO: 509527

SEQ ID NO: 512787 - RNA, 64 nt, hsa; identical to SEQ ID NO: 509528

SEQ ID NO: 512788 - RNA, 64 nt, hsa; identical to SEQ ID NO: 509529

SEQ ID NO: 512789 - RNA, 64 nt, hsa; identical to SEQ ID NO: 509530

SEQ ID NO: 512790 - RNA, 64 nt, hsa; identical to SEQ ID NO: 509531

SEQ ID NO: 512791 - RNA, 64 nt, hsa; identical to SEQ ID NO: 509532

SEQ ID NO: 512792 - RNA, 64 nt, hsa; identical to SEQ ID NO: 509533

SEQ ID NO: 512793 - RNA, 64 nt, hsa; identical to SEQ ID NO: 509534

SEQ ID NO: 512794 - RNA, 64 nt, hsa; identical to SEQ ID NO: 509535

SEQ ID NO: 512795 - RNA, 64 nt, hsa; identical to SEQ ID NO: 509536

SEQ ID NO: 512796 - RNA, 64 nt, hsa; identical to SEQ ID NO: 509537

SEQ ID NO: 512797 - RNA, 64 nt, hsa; identical to SEQ ID NO: 509538

SEQ ID NO: 512798 - RNA, 64 nt, hsa; identical to SEQ ID NO: 509539

SEQ ID NO: 512799 - RNA, 64 nt, hsa; identical to SEQ ID NO: 509540

SEQ ID NO: 512800 - RNA, 64 nt, hsa; identical to SEQ ID NO: 509541

SEQ ID NO: 512801 - RNA, 64 nt, hsa; identical to SEQ ID NO: 509542

SEQ ID NO: 512802 - RNA, 64 nt, hsa; identical to SEQ ID NO: 509543

SEQ ID NO: 512803 - RNA, 64 nt, hsa; identical to SEQ ID NO: 509544

SEQ ID NO: 512804 - RNA, 64 nt, hsa; identical to SEQ ID NO: 509545

SEQ ID NO: 512805 - RNA, 64 nt, hsa; identical to SEQ ID NO: 509546

SEQ ID NO: 512806 - RNA, 64 nt, hsa; identical to SEQ ID NO: 509547

SEQ ID NO: 512807 - RNA, 64 nt, hsa; identical to SEQ ID NO: 509548

SEQ ID NO: 512808 - RNA, 64 nt, hsa; identical to SEQ ID NO: 509549

SEQ ID NO: 512809 - RNA, 64 nt, hsa; identical to SEQ ID NO: 509550

SEQ ID NO: 512810 - RNA, 64 nt, hsa; identical to SEQ ID NO: 509551

SEQ ID NO: 512811 - RNA, 64 nt, hsa; identical to SEQ ID NO: 509552

SEQ ID NO: 512812 - RNA, 64 nt, hsa; identical to SEQ ID NO: 509553

SEQ ID NO: 512813 - RNA, 64 nt, hsa; identical to SEQ ID NO: 509554

SEQ ID NO: 512814 - RNA, 64 nt, hsa; identical to SEQ ID NO: 509555

SEQ ID NO: 512815 - RNA, 64 nt, hsa; identical to SEQ ID NO: 509556

SEQ ID NO: 512816 - RNA, 64 nt, hsa; identical to SEQ ID NO: 509557

SEQ ID NO: 512817 - RNA, 64 nt, hsa; identical to SEQ ID NO: 509558

SEQ ID NO: 512818 - RNA, 64 nt, hsa; identical to SEQ ID NO: 509559

SEQ ID NO: 512819 - RNA, 64 nt, hsa; identical to SEQ ID NO: 509560

SEQ ID NO: 512820 - RNA, 64 nt, hsa; identical to SEQ ID NO: 509561

SEQ ID NO: 512821 - RNA, 64 nt, hsa; identical to SEQ ID NO: 509562

SEQ ID NO: 512822 - RNA, 64 nt, hsa; identical to SEQ ID NO: 509563

SEQ ID NO: 512823 - RNA, 64 nt, hsa; identical to SEQ ID NO: 509564

SEQ ID NO: 512824 - RNA, 64 nt, hsa; identical to SEQ ID NO: 509565

SEQ ID NO: 512825 - RNA, 64 nt, hsa; identical to SEQ ID NO: 509566

SEQ ID NO: 512826 - RNA, 64 nt, hsa; identical to SEQ ID NO: 509567

SEQ ID NO: 512827 - RNA, 64 nt, hsa; identical to SEQ ID NO: 509568

SEQ ID NO: 512828 - RNA, 64 nt, hsa; identical to SEQ ID NO: 509569

SEQ ID NO: 512829 - RNA, 64 nt, hsa; identical to SEQ ID NO: 509570

SEQ ID NO: 512830 - RNA, 64 nt, hsa; identical to SEQ ID NO: 509571

SEQ ID NO: 512831 - RNA, 64 nt, hsa; identical to SEQ ID NO: 509572

SEQ ID NO: 512832 - RNA, 64 nt, hsa; identical to SEQ ID NO: 509573

SEQ ID NO: 512833 - RNA, 64 nt, hsa; identical to SEQ ID NO: 509574

SEQ ID NO: 512834 - RNA, 64 nt, hsa; identical to SEQ ID NO: 509575

SEQ ID NO: 512835 - RNA, 64 nt, hsa; identical to SEQ ID NO: 509576

SEQ ID NO: 512836 - RNA, 64 nt, hsa; identical to SEQ ID NO: 509577

SEQ ID NO: 512837 - RNA, 64 nt, hsa; identical to SEQ ID NO: 509578

SEQ ID NO: 512838 - RNA, 64 nt, hsa; identical to SEQ ID NO: 509579

SEQ ID NO: 512839 - RNA, 64 nt, hsa; identical to SEQ ID NO: 509580

SEQ ID NO: 512840 - RNA, 64 nt, hsa; identical to SEQ ID NO: 509581

SEQ ID NO: 512841 - RNA, 64 nt, hsa; identical to SEQ ID NO: 509582

SEQ ID NO: 512842 - RNA, 64 nt, hsa; identical to SEQ ID NO: 509583

SEQ ID NO: 512843 - RNA, 64 nt, hsa; identical to SEQ ID NO: 509584

SEQ ID NO: 512844 - RNA, 64 nt, hsa; identical to SEQ ID NO: 509585

SEQ ID NO: 512845 - RNA, 64 nt, hsa; identical to SEQ ID NO: 509586

SEQ ID NO: 512846 - RNA, 64 nt, hsa; identical to SEQ ID NO: 509587

SEQ ID NO: 512847 - RNA, 64 nt, hsa; identical to SEQ ID NO: 509588

SEQ ID NO: 512848 - RNA, 64 nt, hsa; identical to SEQ ID NO: 509589

SEQ ID NO: 512849 - RNA, 64 nt, hsa; identical to SEQ ID NO: 509590

SEQ ID NO: 512850 - RNA, 64 nt, hsa; identical to SEQ ID NO: 509591

SEQ ID NO: 512851 - RNA, 64 nt, hsa; identical to SEQ ID NO: 509592

SEQ ID NO: 512852 - RNA, 64 nt, hsa; identical to SEQ ID NO: 509593

SEQ ID NO: 512853 - RNA, 64 nt, hsa; identical to SEQ ID NO: 509594

SEQ ID NO: 512854 - RNA, 64 nt, hsa; identical to SEQ ID NO: 509595

SEQ ID NO: 512855 - RNA, 64 nt, hsa; identical to SEQ ID NO: 509596

SEQ ID NO: 512856 - RNA, 64 nt, hsa; identical to SEQ ID NO: 509597

SEQ ID NO: 512857 - RNA, 64 nt, hsa; identical to SEQ ID NO: 509598

SEQ ID NO: 512858 - RNA, 64 nt, hsa; identical to SEQ ID NO: 509599

SEQ ID NO: 512859 - RNA, 64 nt, hsa; identical to SEQ ID NO: 509600

SEQ ID NO: 512860 - RNA, 64 nt, hsa; identical to SEQ ID NO: 509601

SEQ ID NO: 512861 - RNA, 64 nt, hsa; identical to SEQ ID NO: 509602

SEQ ID NO: 512862 - RNA, 64 nt, hsa; identical to SEQ ID NO: 509603

SEQ ID NO: 512863 - RNA, 64 nt, hsa; identical to SEQ ID NO: 509604

SEQ ID NO: 512864 - RNA, 64 nt, hsa; identical to SEQ ID NO: 509605

SEQ ID NO: 512865 - RNA, 64 nt, hsa; identical to SEQ ID NO: 509606

SEQ ID NO: 512866 - RNA, 64 nt, hsa; identical to SEQ ID NO: 509607

SEQ ID NO: 512867 - RNA, 64 nt, hsa; identical to SEQ ID NO: 509608

SEQ ID NO: 512868 - RNA, 64 nt, hsa; identical to SEQ ID NO: 509609

SEQ ID NO: 512869 - RNA, 64 nt, hsa; identical to SEQ ID NO: 509610

SEQ ID NO: 512870 - RNA, 64 nt, hsa; identical to SEQ ID NO: 509611

SEQ ID NO: 512871 - RNA, 64 nt, hsa; identical to SEQ ID NO: 509612

SEQ ID NO: 512872 - RNA, 64 nt, hsa; identical to SEQ ID NO: 509613

SEQ ID NO: 512873 - RNA, 62 nt, hsa; identical to SEQ ID NO: 509614

SEQ ID NO: 512874 - RNA, 64 nt, hsa; identical to SEQ ID NO: 509615

SEQ ID NO: 512875 - RNA, 64 nt, hsa; identical to SEQ ID NO: 509616

SEQ ID NO: 512876 - RNA, 64 nt, hsa; identical to SEQ ID NO: 509617

SEQ ID NO: 512877 - RNA, 64 nt, hsa; identical to SEQ ID NO: 509618

SEQ ID NO: 512878 - RNA, 64 nt, hsa; identical to SEQ ID NO: 509619

SEQ ID NO: 512879 - RNA, 64 nt, hsa; identical to SEQ ID NO: 509620

SEQ ID NO: 512880 - RNA, 64 nt, hsa; identical to SEQ ID NO: 509621

SEQ ID NO: 512881 - RNA, 64 nt, hsa; identical to SEQ ID NO: 509622

SEQ ID NO: 512882 - RNA, 64 nt, hsa; identical to SEQ ID NO: 509623

SEQ ID NO: 512883 - RNA, 64 nt, hsa; identical to SEQ ID NO: 509624

SEQ ID NO: 512884 - RNA, 64 nt, hsa; identical to SEQ ID NO: 509625

SEQ ID NO: 512885 - RNA, 64 nt, hsa; identical to SEQ ID NO: 509626

SEQ ID NO: 512886 - RNA, 64 nt, hsa; identical to SEQ ID NO: 509627

SEQ ID NO: 512887 - RNA, 64 nt, hsa; identical to SEQ ID NO: 509628

SEQ ID NO: 512888 - RNA, 64 nt, hsa; identical to SEQ ID NO: 509629

SEQ ID NO: 512889 - RNA, 64 nt, hsa; identical to SEQ ID NO: 509630

SEQ ID NO: 512890 - RNA, 64 nt, hsa; identical to SEQ ID NO: 509631

SEQ ID NO: 512891 - RNA, 64 nt, hsa; identical to SEQ ID NO: 509632

SEQ ID NO: 512892 - RNA, 64 nt, hsa; identical to SEQ ID NO: 509633

SEQ ID NO: 512893 - RNA, 64 nt, hsa; identical to SEQ ID NO: 509634

SEQ ID NO: 512894 - RNA, 64 nt, hsa; identical to SEQ ID NO: 509635

SEQ ID NO: 512895 - RNA, 64 nt, hsa; identical to SEQ ID NO: 509636

SEQ ID NO: 512896 - RNA, 64 nt, hsa; identical to SEQ ID NO: 509637

SEQ ID NO: 512897 - RNA, 64 nt, hsa; identical to SEQ ID NO: 509638

SEQ ID NO: 512898 - RNA, 64 nt, hsa; identical to SEQ ID NO: 509639

SEQ ID NO: 512899 - RNA, 64 nt, hsa; identical to SEQ ID NO: 509640

SEQ ID NO: 512900 - RNA, 64 nt, hsa; identical to SEQ ID NO: 509641

SEQ ID NO: 512901 - RNA, 64 nt, hsa; identical to SEQ ID NO: 509642

SEQ ID NO: 512902 - RNA, 64 nt, hsa; identical to SEQ ID NO: 509643

SEQ ID NO: 512903 - RNA, 64 nt, hsa; identical to SEQ ID NO: 509644

SEQ ID NO: 512904 - RNA, 64 nt, hsa; identical to SEQ ID NO: 509645

SEQ ID NO: 512905 - RNA, 64 nt, hsa; identical to SEQ ID NO: 509646

SEQ ID NO: 512906 - RNA, 64 nt, hsa; identical to SEQ ID NO: 509647

SEQ ID NO: 512907 - RNA, 64 nt, hsa; identical to SEQ ID NO: 509648

SEQ ID NO: 512908 - RNA, 64 nt, hsa; identical to SEQ ID NO: 509649

SEQ ID NO: 512909 - RNA, 64 nt, hsa; identical to SEQ ID NO: 509650

SEQ ID NO: 512910 - RNA, 64 nt, hsa; identical to SEQ ID NO: 509651

SEQ ID NO: 512911 - RNA, 64 nt, hsa; identical to SEQ ID NO: 509652

SEQ ID NO: 512912 - RNA, 64 nt, hsa; identical to SEQ ID NO: 509653

SEQ ID NO: 512913 - RNA, 64 nt, hsa; identical to SEQ ID NO: 509654

SEQ ID NO: 512914 - RNA, 64 nt, hsa; identical to SEQ ID NO: 509655

SEQ ID NO: 512915 - RNA, 64 nt, hsa; identical to SEQ ID NO: 509656

SEQ ID NO: 512916 - RNA, 64 nt, hsa; identical to SEQ ID NO: 509657

SEQ ID NO: 512917 - RNA, 64 nt, hsa; identical to SEQ ID NO: 509658

SEQ ID NO: 512918 - RNA, 64 nt, hsa; identical to SEQ ID NO: 509659

SEQ ID NO: 512919 - RNA, 64 nt, hsa; identical to SEQ ID NO: 509660

SEQ ID NO: 512920 - RNA, 64 nt, hsa; identical to SEQ ID NO: 509661

SEQ ID NO: 512921 - RNA, 64 nt, hsa; identical to SEQ ID NO: 509662

SEQ ID NO: 512922 - RNA, 64 nt, hsa; identical to SEQ ID NO: 509663

SEQ ID NO: 512923 - RNA, 64 nt, hsa; identical to SEQ ID NO: 509664

SEQ ID NO: 512924 - RNA, 51 nt, hsa; identical to SEQ ID NO: 509665

SEQ ID NO: 512925 - RNA, 64 nt, hsa; identical to SEQ ID NO: 509666

SEQ ID NO: 512926 - RNA, 64 nt, hsa; identical to SEQ ID NO: 509667

SEQ ID NO: 512927 - RNA, 64 nt, hsa; identical to SEQ ID NO: 509668

SEQ ID NO: 512928 - RNA, 64 nt, hsa; identical to SEQ ID NO: 509669

SEQ ID NO: 512929 - RNA, 64 nt, hsa; identical to SEQ ID NO: 509670

SEQ ID NO: 512930 - RNA, 64 nt, hsa; identical to SEQ ID NO: 509671

SEQ ID NO: 512931 - RNA, 64 nt, hsa; identical to SEQ ID NO: 509672

SEQ ID NO: 512932 - RNA, 64 nt, hsa; identical to SEQ ID NO: 509673

SEQ ID NO: 512933 - RNA, 64 nt, hsa; identical to SEQ ID NO: 509674

SEQ ID NO: 512934 - RNA, 64 nt, hsa; identical to SEQ ID NO: 509675

SEQ ID NO: 512935 - RNA, 64 nt, hsa; identical to SEQ ID NO: 509676

SEQ ID NO: 512936 - RNA, 64 nt, hsa; identical to SEQ ID NO: 509677

SEQ ID NO: 512937 - RNA, 64 nt, hsa; identical to SEQ ID NO: 509678

SEQ ID NO: 512938 - RNA, 64 nt, hsa; identical to SEQ ID NO: 509679

SEQ ID NO: 512939 - RNA, 64 nt, hsa; identical to SEQ ID NO: 509680

SEQ ID NO: 512940 - RNA, 64 nt, hsa; identical to SEQ ID NO: 509681

SEQ ID NO: 512941 - RNA, 64 nt, hsa; identical to SEQ ID NO: 509682

SEQ ID NO: 512942 - RNA, 64 nt, hsa; identical to SEQ ID NO: 509683

SEQ ID NO: 512943 - RNA, 64 nt, hsa; identical to SEQ ID NO: 509684

SEQ ID NO: 512944 - RNA, 64 nt, hsa; identical to SEQ ID NO: 509685

SEQ ID NO: 512945 - RNA, 64 nt, hsa; identical to SEQ ID NO: 509686

SEQ ID NO: 512946 - RNA, 64 nt, hsa; identical to SEQ ID NO: 509687

SEQ ID NO: 512947 - RNA, 64 nt, hsa; identical to SEQ ID NO: 509688

SEQ ID NO: 512948 - RNA, 64 nt, hsa; identical to SEQ ID NO: 509689

SEQ ID NO: 512949 - RNA, 64 nt, hsa; identical to SEQ ID NO: 509690

SEQ ID NO: 512950 - RNA, 64 nt, hsa; identical to SEQ ID NO: 509691

SEQ ID NO: 512951 - RNA, 64 nt, hsa; identical to SEQ ID NO: 509692

SEQ ID NO: 512952 - RNA, 64 nt, hsa; identical to SEQ ID NO: 509693

SEQ ID NO: 512953 - RNA, 64 nt, hsa; identical to SEQ ID NO: 509694

SEQ ID NO: 512954 - RNA, 64 nt, hsa; identical to SEQ ID NO: 509695

SEQ ID NO: 512955 - RNA, 64 nt, hsa; identical to SEQ ID NO: 509696

SEQ ID NO: 512956 - RNA, 64 nt, hsa; identical to SEQ ID NO: 509697

SEQ ID NO: 512957 - RNA, 64 nt, hsa; identical to SEQ ID NO: 509698

SEQ ID NO: 512958 - RNA, 64 nt, hsa; identical to SEQ ID NO: 509699

SEQ ID NO: 512959 - RNA, 64 nt, hsa; identical to SEQ ID NO: 509700

SEQ ID NO: 512960 - RNA, 64 nt, hsa; identical to SEQ ID NO: 509701

SEQ ID NO: 512961 - RNA, 64 nt, hsa; identical to SEQ ID NO: 509702

SEQ ID NO: 512962 - RNA, 64 nt, hsa; identical to SEQ ID NO: 509703

SEQ ID NO: 512963 - RNA, 64 nt, hsa; identical to SEQ ID NO: 509704

SEQ ID NO: 512964 - RNA, 64 nt, hsa; identical to SEQ ID NO: 509705

SEQ ID NO: 512965 - RNA, 64 nt, hsa; identical to SEQ ID NO: 509706

SEQ ID NO: 512966 - RNA, 64 nt, hsa; identical to SEQ ID NO: 509707

SEQ ID NO: 512967 - RNA, 64 nt, hsa; identical to SEQ ID NO: 509708

SEQ ID NO: 512968 - RNA, 64 nt, hsa; identical to SEQ ID NO: 509709

SEQ ID NO: 512969 - RNA, 64 nt, hsa; identical to SEQ ID NO: 509710

SEQ ID NO: 512970 - RNA, 64 nt, hsa; identical to SEQ ID NO: 509711

SEQ ID NO: 512971 - RNA, 64 nt, hsa; identical to SEQ ID NO: 509712

SEQ ID NO: 512972 - RNA, 64 nt, hsa; identical to SEQ ID NO: 509713

SEQ ID NO: 512973 - RNA, 64 nt, hsa; identical to SEQ ID NO: 509714

SEQ ID NO: 512974 - RNA, 64 nt, hsa; identical to SEQ ID NO: 509715

SEQ ID NO: 512975 - RNA, 64 nt, hsa; identical to SEQ ID NO: 509716

SEQ ID NO: 512976 - RNA, 64 nt, hsa; identical to SEQ ID NO: 509717

SEQ ID NO: 512977 - RNA, 64 nt, hsa; identical to SEQ ID NO: 509718

SEQ ID NO: 512978 - RNA, 64 nt, hsa; identical to SEQ ID NO: 509719

SEQ ID NO: 512979 - RNA, 64 nt, hsa; identical to SEQ ID NO: 509720

SEQ ID NO: 512980 - RNA, 64 nt, hsa; identical to SEQ ID NO: 509721

SEQ ID NO: 512981 - RNA, 64 nt, hsa; identical to SEQ ID NO: 509722

SEQ ID NO: 512982 - RNA, 64 nt, hsa; identical to SEQ ID NO: 509723

SEQ ID NO: 512983 - RNA, 64 nt, hsa; identical to SEQ ID NO: 509724

SEQ ID NO: 512984 - RNA, 64 nt, hsa; identical to SEQ ID NO: 509725

SEQ ID NO: 512985 - RNA, 64 nt, hsa; identical to SEQ ID NO: 509726

SEQ ID NO: 512986 - RNA, 64 nt, hsa; identical to SEQ ID NO: 509727

SEQ ID NO: 512987 - RNA, 64 nt, hsa; identical to SEQ ID NO: 509728

SEQ ID NO: 512988 - RNA, 64 nt, hsa; identical to SEQ ID NO: 509729

SEQ ID NO: 512989 - RNA, 64 nt, hsa; identical to SEQ ID NO: 509730

SEQ ID NO: 512990 - RNA, 64 nt, hsa; identical to SEQ ID NO: 509731

SEQ ID NO: 512991 - RNA, 64 nt, hsa; identical to SEQ ID NO: 509732

SEQ ID NO: 512992 - RNA, 64 nt, hsa; identical to SEQ ID NO: 509733

SEQ ID NO: 512993 - RNA, 64 nt, hsa; identical to SEQ ID NO: 509734

SEQ ID NO: 512994 - RNA, 64 nt, hsa; identical to SEQ ID NO: 509735

SEQ ID NO: 512995 - RNA, 64 nt, hsa; identical to SEQ ID NO: 509736

SEQ ID NO: 512996 - RNA, 64 nt, hsa; identical to SEQ ID NO: 509737

SEQ ID NO: 512997 - RNA, 64 nt, hsa; identical to SEQ ID NO: 509738

SEQ ID NO: 512998 - RNA, 64 nt, hsa; identical to SEQ ID NO: 509739

SEQ ID NO: 512999 - RNA, 64 nt, hsa; identical to SEQ ID NO: 509740

SEQ ID NO: 513000 - RNA, 64 nt, hsa; identical to SEQ ID NO: 509741

SEQ ID NO: 513001 - RNA, 64 nt, hsa; identical to SEQ ID NO: 509742

SEQ ID NO: 513002 - RNA, 64 nt, hsa; identical to SEQ ID NO: 509743

SEQ ID NO: 513003 - RNA, 64 nt, hsa; identical to SEQ ID NO: 509744

SEQ ID NO: 513004 - RNA, 64 nt, hsa; identical to SEQ ID NO: 509745

SEQ ID NO: 513005 - RNA, 64 nt, hsa; identical to SEQ ID NO: 509746

SEQ ID NO: 513006 - RNA, 64 nt, hsa; identical to SEQ ID NO: 509747

SEQ ID NO: 513007 - RNA, 64 nt, hsa; identical to SEQ ID NO: 509748

SEQ ID NO: 513008 - RNA, 64 nt, hsa; identical to SEQ ID NO: 509749

SEQ ID NO: 513009 - RNA, 64 nt, hsa; identical to SEQ ID NO: 509750

SEQ ID NO: 513010 - RNA, 64 nt, hsa; identical to SEQ ID NO: 509751

SEQ ID NO: 513011 - RNA, 64 nt, hsa; identical to SEQ ID NO: 509752

SEQ ID NO: 513012 - RNA, 64 nt, hsa; identical to SEQ ID NO: 509753

SEQ ID NO: 513013 - RNA, 64 nt, hsa; identical to SEQ ID NO: 509754

SEQ ID NO: 513014 - RNA, 64 nt, hsa; identical to SEQ ID NO: 509755

SEQ ID NO: 513015 - RNA, 64 nt, hsa; identical to SEQ ID NO: 509756

SEQ ID NO: 513016 - RNA, 64 nt, hsa; identical to SEQ ID NO: 509757

SEQ ID NO: 513017 - RNA, 64 nt, hsa; identical to SEQ ID NO: 509758

SEQ ID NO: 513018 - RNA, 64 nt, hsa; identical to SEQ ID NO: 509759

SEQ ID NO: 513019 - RNA, 64 nt, hsa; identical to SEQ ID NO: 509760

SEQ ID NO: 513020 - RNA, 64 nt, hsa; identical to SEQ ID NO: 509761

SEQ ID NO: 513021 - RNA, 64 nt, hsa; identical to SEQ ID NO: 509762

SEQ ID NO: 513022 - RNA, 64 nt, hsa; identical to SEQ ID NO: 509763

SEQ ID NO: 513023 - RNA, 64 nt, hsa; identical to SEQ ID NO: 509764

SEQ ID NO: 513024 - RNA, 64 nt, hsa; identical to SEQ ID NO: 509765

SEQ ID NO: 513025 - RNA, 64 nt, hsa; identical to SEQ ID NO: 509766

SEQ ID NO: 513026 - RNA, 64 nt, hsa; identical to SEQ ID NO: 509767

SEQ ID NO: 513027 - RNA, 64 nt, hsa; identical to SEQ ID NO: 509768

SEQ ID NO: 513028 - RNA, 64 nt, hsa; identical to SEQ ID NO: 509769

SEQ ID NO: 513029 - RNA, 64 nt, hsa; identical to SEQ ID NO: 509770

SEQ ID NO: 513030 - RNA, 64 nt, hsa; identical to SEQ ID NO: 509771

SEQ ID NO: 513031 - RNA, 64 nt, hsa; identical to SEQ ID NO: 509772

SEQ ID NO: 513032 - RNA, 64 nt, hsa; identical to SEQ ID NO: 509773

SEQ ID NO: 513033 - RNA, 64 nt, hsa; identical to SEQ ID NO: 509774

SEQ ID NO: 513034 - RNA, 64 nt, hsa; identical to SEQ ID NO: 509775

SEQ ID NO: 513035 - RNA, 64 nt, hsa; identical to SEQ ID NO: 509776

SEQ ID NO: 513036 - RNA, 64 nt, hsa; identical to SEQ ID NO: 509777

SEQ ID NO: 513037 - RNA, 64 nt, hsa; identical to SEQ ID NO: 509778

SEQ ID NO: 513038 - RNA, 64 nt, hsa; identical to SEQ ID NO: 509779

SEQ ID NO: 513039 - RNA, 64 nt, hsa; identical to SEQ ID NO: 509780

SEQ ID NO: 513040 - RNA, 64 nt, hsa; identical to SEQ ID NO: 509781

SEQ ID NO: 513041 - RNA, 64 nt, hsa; identical to SEQ ID NO: 509782

SEQ ID NO: 513042 - RNA, 64 nt, hsa; identical to SEQ ID NO: 509783

SEQ ID NO: 513043 - RNA, 64 nt, hsa; identical to SEQ ID NO: 509784

SEQ ID NO: 513044 - RNA, 64 nt, hsa; identical to SEQ ID NO: 509785

SEQ ID NO: 513045 - RNA, 64 nt, hsa; identical to SEQ ID NO: 509786

SEQ ID NO: 513046 - RNA, 64 nt, hsa; identical to SEQ ID NO: 509787

SEQ ID NO: 513047 - RNA, 64 nt, hsa; identical to SEQ ID NO: 509788

SEQ ID NO: 513048 - RNA, 64 nt, hsa; identical to SEQ ID NO: 509789

SEQ ID NO: 513049 - RNA, 64 nt, hsa; identical to SEQ ID NO: 509790

SEQ ID NO: 513050 - RNA, 64 nt, hsa; identical to SEQ ID NO: 509791

SEQ ID NO: 513051 - RNA, 64 nt, hsa; identical to SEQ ID NO: 509792

SEQ ID NO: 513052 - RNA, 64 nt, hsa; identical to SEQ ID NO: 509793

SEQ ID NO: 513053 - RNA, 64 nt, hsa; identical to SEQ ID NO: 509794

SEQ ID NO: 513054 - RNA, 64 nt, hsa; identical to SEQ ID NO: 509795

SEQ ID NO: 513055 - RNA, 64 nt, hsa; identical to SEQ ID NO: 509796

SEQ ID NO: 513056 - RNA, 64 nt, hsa; identical to SEQ ID NO: 509797

SEQ ID NO: 513057 - RNA, 64 nt, hsa; identical to SEQ ID NO: 509798

SEQ ID NO: 513058 - RNA, 64 nt, hsa; identical to SEQ ID NO: 509799

SEQ ID NO: 513059 - RNA, 64 nt, hsa; identical to SEQ ID NO: 509800

SEQ ID NO: 513060 - RNA, 64 nt, hsa; identical to SEQ ID NO: 509801

SEQ ID NO: 513061 - RNA, 64 nt, hsa; identical to SEQ ID NO: 509802

SEQ ID NO: 513062 - RNA, 64 nt, hsa; identical to SEQ ID NO: 509803

SEQ ID NO: 513063 - RNA, 64 nt, hsa; identical to SEQ ID NO: 509804

SEQ ID NO: 513064 - RNA, 64 nt, hsa; identical to SEQ ID NO: 509805

SEQ ID NO: 513065 - RNA, 64 nt, hsa; identical to SEQ ID NO: 509806

SEQ ID NO: 513066 - RNA, 64 nt, hsa; identical to SEQ ID NO: 509807

SEQ ID NO: 513067 - RNA, 64 nt, hsa; identical to SEQ ID NO: 509808

SEQ ID NO: 513068 - RNA, 64 nt, hsa; identical to SEQ ID NO: 509809

SEQ ID NO: 513069 - RNA, 64 nt, hsa; identical to SEQ ID NO: 509810

SEQ ID NO: 513070 - RNA, 64 nt, hsa; identical to SEQ ID NO: 509811

SEQ ID NO: 513071 - RNA, 64 nt, hsa; identical to SEQ ID NO: 509812

SEQ ID NO: 513072 - RNA, 64 nt, hsa; identical to SEQ ID NO: 509813

SEQ ID NO: 513073 - RNA, 64 nt, hsa; identical to SEQ ID NO: 509814

SEQ ID NO: 513074 - RNA, 64 nt, hsa; identical to SEQ ID NO: 509815

SEQ ID NO: 513075 - RNA, 64 nt, hsa; identical to SEQ ID NO: 509816

SEQ ID NO: 513076 - RNA, 64 nt, hsa; identical to SEQ ID NO: 509817

SEQ ID NO: 513077 - RNA, 64 nt, hsa; identical to SEQ ID NO: 509818

SEQ ID NO: 513078 - RNA, 64 nt, hsa; identical to SEQ ID NO: 509819

SEQ ID NO: 513079 - RNA, 64 nt, hsa; identical to SEQ ID NO: 509820

SEQ ID NO: 513080 - RNA, 64 nt, hsa; identical to SEQ ID NO: 509821

SEQ ID NO: 513081 - RNA, 64 nt, hsa; identical to SEQ ID NO: 509822

SEQ ID NO: 513082 - RNA, 64 nt, hsa; identical to SEQ ID NO: 509823

SEQ ID NO: 513083 - RNA, 64 nt, hsa; identical to SEQ ID NO: 509824

SEQ ID NO: 513084 - RNA, 64 nt, hsa; identical to SEQ ID NO: 509825

SEQ ID NO: 513085 - RNA, 64 nt, hsa; identical to SEQ ID NO: 509826

SEQ ID NO: 513086 - RNA, 64 nt, hsa; identical to SEQ ID NO: 509827

SEQ ID NO: 513087 - RNA, 64 nt, hsa; identical to SEQ ID NO: 509828

SEQ ID NO: 513088 - RNA, 64 nt, hsa; identical to SEQ ID NO: 509829

SEQ ID NO: 513089 - RNA, 64 nt, hsa; identical to SEQ ID NO: 509830

SEQ ID NO: 513090 - RNA, 64 nt, hsa; identical to SEQ ID NO: 509831

SEQ ID NO: 513091 - RNA, 64 nt, hsa; identical to SEQ ID NO: 509832

SEQ ID NO: 513092 - RNA, 64 nt, hsa; identical to SEQ ID NO: 509833

SEQ ID NO: 513093 - RNA, 64 nt, hsa; identical to SEQ ID NO: 509834

SEQ ID NO: 513094 - RNA, 64 nt, hsa; identical to SEQ ID NO: 509835

SEQ ID NO: 513095 - RNA, 64 nt, hsa; identical to SEQ ID NO: 509836

SEQ ID NO: 513096 - RNA, 64 nt, hsa; identical to SEQ ID NO: 509837

SEQ ID NO: 513097 - RNA, 64 nt, hsa; identical to SEQ ID NO: 509838

SEQ ID NO: 513098 - RNA, 64 nt, hsa; identical to SEQ ID NO: 509839

SEQ ID NO: 513099 - RNA, 64 nt, hsa; identical to SEQ ID NO: 509840

SEQ ID NO: 513100 - RNA, 64 nt, hsa; identical to SEQ ID NO: 509841

SEQ ID NO: 513101 - RNA, 64 nt, hsa; identical to SEQ ID NO: 509842

SEQ ID NO: 513102 - RNA, 64 nt, hsa; identical to SEQ ID NO: 509843

SEQ ID NO: 513103 - RNA, 64 nt, hsa; identical to SEQ ID NO: 509844

SEQ ID NO: 513104 - RNA, 64 nt, hsa; identical to SEQ ID NO: 509845

SEQ ID NO: 513105 - RNA, 64 nt, hsa; identical to SEQ ID NO: 509846

SEQ ID NO: 513106 - RNA, 64 nt, hsa; identical to SEQ ID NO: 509847

SEQ ID NO: 513107 - RNA, 64 nt, hsa; identical to SEQ ID NO: 509848

SEQ ID NO: 513108 - RNA, 64 nt, hsa; identical to SEQ ID NO: 509849

SEQ ID NO: 513109 - RNA, 64 nt, hsa; identical to SEQ ID NO: 509850

SEQ ID NO: 513110 - RNA, 64 nt, hsa; identical to SEQ ID NO: 509851

SEQ ID NO: 513111 - RNA, 64 nt, hsa; identical to SEQ ID NO: 509852

SEQ ID NO: 513112 - RNA, 64 nt, hsa; identical to SEQ ID NO: 509853

SEQ ID NO: 513113 - RNA, 64 nt, hsa; identical to SEQ ID NO: 509854

SEQ ID NO: 513114 - RNA, 64 nt, hsa; identical to SEQ ID NO: 509855

SEQ ID NO: 513115 - RNA, 59 nt, hsa; identical to SEQ ID NO: 509856

SEQ ID NO: 513116 - RNA, 64 nt, hsa; identical to SEQ ID NO: 509857

SEQ ID NO: 513117 - RNA, 64 nt, hsa; identical to SEQ ID NO: 509858

SEQ ID NO: 513118 - RNA, 64 nt, hsa; identical to SEQ ID NO: 509859

SEQ ID NO: 513119 - RNA, 64 nt, hsa; identical to SEQ ID NO: 509860

SEQ ID NO: 513120 - RNA, 64 nt, hsa; identical to SEQ ID NO: 509861

SEQ ID NO: 513121 - RNA, 64 nt, hsa; identical to SEQ ID NO: 509862

SEQ ID NO: 513122 - RNA, 64 nt, hsa; identical to SEQ ID NO: 509863

SEQ ID NO: 513123 - RNA, 64 nt, hsa; identical to SEQ ID NO: 509864

SEQ ID NO: 513124 - RNA, 64 nt, hsa; identical to SEQ ID NO: 509865

SEQ ID NO: 513125 - RNA, 64 nt, hsa; identical to SEQ ID NO: 509866

SEQ ID NO: 513126 - RNA, 64 nt, hsa; identical to SEQ ID NO: 509867

SEQ ID NO: 513127 - RNA, 64 nt, hsa; identical to SEQ ID NO: 509868

SEQ ID NO: 513128 - RNA, 64 nt, hsa; identical to SEQ ID NO: 509869

SEQ ID NO: 513129 - RNA, 64 nt, hsa; identical to SEQ ID NO: 509870

SEQ ID NO: 513130 - RNA, 64 nt, hsa; identical to SEQ ID NO: 509871

SEQ ID NO: 513131 - RNA, 64 nt, hsa; identical to SEQ ID NO: 509872

SEQ ID NO: 513132 - RNA, 64 nt, hsa; identical to SEQ ID NO: 509873

SEQ ID NO: 513133 - RNA, 64 nt, hsa; identical to SEQ ID NO: 509874

SEQ ID NO: 513134 - RNA, 64 nt, hsa; identical to SEQ ID NO: 509875

SEQ ID NO: 513135 - RNA, 64 nt, hsa; identical to SEQ ID NO: 509876

SEQ ID NO: 513136 - RNA, 64 nt, hsa; identical to SEQ ID NO: 509877

SEQ ID NO: 513137 - RNA, 64 nt, hsa; identical to SEQ ID NO: 509878

SEQ ID NO: 513138 - RNA, 64 nt, hsa; identical to SEQ ID NO: 509879

SEQ ID NO: 513139 - RNA, 64 nt, hsa; identical to SEQ ID NO: 509880

SEQ ID NO: 513140 - RNA, 64 nt, hsa; identical to SEQ ID NO: 509881

SEQ ID NO: 513141 - RNA, 64 nt, hsa; identical to SEQ ID NO: 509882

SEQ ID NO: 513142 - RNA, 64 nt, hsa; identical to SEQ ID NO: 509883

SEQ ID NO: 513143 - RNA, 64 nt, hsa; identical to SEQ ID NO: 509884

SEQ ID NO: 513144 - RNA, 64 nt, hsa; identical to SEQ ID NO: 509885

SEQ ID NO: 513145 - RNA, 64 nt, hsa; identical to SEQ ID NO: 509886

SEQ ID NO: 513146 - RNA, 64 nt, hsa; identical to SEQ ID NO: 509887

SEQ ID NO: 513147 - RNA, 64 nt, hsa; identical to SEQ ID NO: 509888

SEQ ID NO: 513148 - RNA, 64 nt, hsa; identical to SEQ ID NO: 509889

SEQ ID NO: 513149 - RNA, 64 nt, hsa; identical to SEQ ID NO: 509890

SEQ ID NO: 513150 - RNA, 64 nt, hsa; identical to SEQ ID NO: 509891

SEQ ID NO: 513151 - RNA, 64 nt, hsa; identical to SEQ ID NO: 509892

SEQ ID NO: 513152 - RNA, 64 nt, hsa; identical to SEQ ID NO: 509893

SEQ ID NO: 513153 - RNA, 64 nt, hsa; identical to SEQ ID NO: 509894

SEQ ID NO: 513154 - RNA, 64 nt, hsa; identical to SEQ ID NO: 509895

SEQ ID NO: 513155 - RNA, 64 nt, hsa; identical to SEQ ID NO: 509896

SEQ ID NO: 513156 - RNA, 64 nt, hsa; identical to SEQ ID NO: 509897

SEQ ID NO: 513157 - RNA, 64 nt, hsa; identical to SEQ ID NO: 509898

SEQ ID NO: 513158 - RNA, 64 nt, hsa; identical to SEQ ID NO: 509899

SEQ ID NO: 513159 - RNA, 64 nt, hsa; identical to SEQ ID NO: 509900

SEQ ID NO: 513160 - RNA, 64 nt, hsa; identical to SEQ ID NO: 509901

SEQ ID NO: 513161 - RNA, 64 nt, hsa; identical to SEQ ID NO: 509902

SEQ ID NO: 513162 - RNA, 64 nt, hsa; identical to SEQ ID NO: 509903

SEQ ID NO: 513163 - RNA, 64 nt, hsa; identical to SEQ ID NO: 509904

SEQ ID NO: 513164 - RNA, 64 nt, hsa; identical to SEQ ID NO: 509905

SEQ ID NO: 513165 - RNA, 64 nt, hsa; identical to SEQ ID NO: 509906

SEQ ID NO: 513166 - RNA, 64 nt, hsa; identical to SEQ ID NO: 509907

SEQ ID NO: 513167 - RNA, 64 nt, hsa; identical to SEQ ID NO: 509908

SEQ ID NO: 513168 - RNA, 64 nt, hsa; identical to SEQ ID NO: 509909

SEQ ID NO: 513169 - RNA, 64 nt, hsa; identical to SEQ ID NO: 509910

SEQ ID NO: 513170 - RNA, 64 nt, hsa; identical to SEQ ID NO: 509911

SEQ ID NO: 513171 - RNA, 64 nt, hsa; identical to SEQ ID NO: 509912

SEQ ID NO: 513172 - RNA, 64 nt, hsa; identical to SEQ ID NO: 509913

SEQ ID NO: 513173 - RNA, 64 nt, hsa; identical to SEQ ID NO: 509914

SEQ ID NO: 513174 - RNA, 64 nt, hsa; identical to SEQ ID NO: 509915

SEQ ID NO: 513175 - RNA, 64 nt, hsa; identical to SEQ ID NO: 509916

SEQ ID NO: 513176 - RNA, 64 nt, hsa; identical to SEQ ID NO: 509917

SEQ ID NO: 513177 - RNA, 64 nt, hsa; identical to SEQ ID NO: 509918

SEQ ID NO: 513178 - RNA, 64 nt, hsa; identical to SEQ ID NO: 509919

SEQ ID NO: 513179 - RNA, 64 nt, hsa; identical to SEQ ID NO: 509920

SEQ ID NO: 513180 - RNA, 64 nt, hsa; identical to SEQ ID NO: 509921

SEQ ID NO: 513181 - RNA, 64 nt, hsa; identical to SEQ ID NO: 509922

SEQ ID NO: 513182 - RNA, 64 nt, hsa; identical to SEQ ID NO: 509923

SEQ ID NO: 513183 - RNA, 64 nt, hsa; identical to SEQ ID NO: 509924

SEQ ID NO: 513184 - RNA, 64 nt, hsa; identical to SEQ ID NO: 509925

SEQ ID NO: 513185 - RNA, 64 nt, hsa; identical to SEQ ID NO: 509926

SEQ ID NO: 513186 - RNA, 64 nt, hsa; identical to SEQ ID NO: 509927

SEQ ID NO: 513187 - RNA, 64 nt, hsa; identical to SEQ ID NO: 509928

SEQ ID NO: 513188 - RNA, 64 nt, hsa; identical to SEQ ID NO: 509929

SEQ ID NO: 513189 - RNA, 64 nt, hsa; identical to SEQ ID NO: 509930

SEQ ID NO: 513190 - RNA, 64 nt, hsa; identical to SEQ ID NO: 509931

SEQ ID NO: 513191 - RNA, 64 nt, hsa; identical to SEQ ID NO: 509932

SEQ ID NO: 513192 - RNA, 64 nt, hsa; identical to SEQ ID NO: 509933

SEQ ID NO: 513193 - RNA, 64 nt, hsa; identical to SEQ ID NO: 509934

SEQ ID NO: 513194 - RNA, 64 nt, hsa; identical to SEQ ID NO: 509935

SEQ ID NO: 513195 - RNA, 64 nt, hsa; identical to SEQ ID NO: 509936

SEQ ID NO: 513196 - RNA, 64 nt, hsa; identical to SEQ ID NO: 509937

SEQ ID NO: 513197 - RNA, 64 nt, hsa; identical to SEQ ID NO: 509938

SEQ ID NO: 513198 - RNA, 64 nt, hsa; identical to SEQ ID NO: 509939

SEQ ID NO: 513199 - RNA, 64 nt, hsa; identical to SEQ ID NO: 509940

SEQ ID NO: 513200 - RNA, 64 nt, hsa; identical to SEQ ID NO: 509941

SEQ ID NO: 513201 - RNA, 64 nt, hsa; identical to SEQ ID NO: 509942

SEQ ID NO: 513202 - RNA, 64 nt, hsa; identical to SEQ ID NO: 509943

SEQ ID NO: 513203 - RNA, 64 nt, hsa; identical to SEQ ID NO: 509944

SEQ ID NO: 513204 - RNA, 64 nt, hsa; identical to SEQ ID NO: 509945

SEQ ID NO: 513205 - RNA, 64 nt, hsa; identical to SEQ ID NO: 509946

SEQ ID NO: 513206 - RNA, 64 nt, hsa; identical to SEQ ID NO: 509947

SEQ ID NO: 513207 - RNA, 64 nt, hsa; identical to SEQ ID NO: 509948

SEQ ID NO: 513208 - RNA, 64 nt, hsa; identical to SEQ ID NO: 509949

SEQ ID NO: 513209 - RNA, 64 nt, hsa; identical to SEQ ID NO: 509950

SEQ ID NO: 513210 - RNA, 64 nt, hsa; identical to SEQ ID NO: 509951

SEQ ID NO: 513211 - RNA, 64 nt, hsa; identical to SEQ ID NO: 509952

SEQ ID NO: 513212 - RNA, 64 nt, hsa; identical to SEQ ID NO: 509953

SEQ ID NO: 513213 - RNA, 64 nt, hsa; identical to SEQ ID NO: 509954

SEQ ID NO: 513214 - RNA, 64 nt, hsa; identical to SEQ ID NO: 509955

SEQ ID NO: 513215 - RNA, 64 nt, hsa; identical to SEQ ID NO: 509956

SEQ ID NO: 513216 - RNA, 64 nt, hsa; identical to SEQ ID NO: 509957

SEQ ID NO: 513217 - RNA, 64 nt, hsa; identical to SEQ ID NO: 509958

SEQ ID NO: 513218 - RNA, 64 nt, hsa; identical to SEQ ID NO: 509959

SEQ ID NO: 513219 - RNA, 64 nt, hsa; identical to SEQ ID NO: 509960

SEQ ID NO: 513220 - RNA, 64 nt, hsa; identical to SEQ ID NO: 509961

SEQ ID NO: 513221 - RNA, 64 nt, hsa; identical to SEQ ID NO: 509962

SEQ ID NO: 513222 - RNA, 64 nt, hsa; identical to SEQ ID NO: 509963

SEQ ID NO: 513223 - RNA, 64 nt, hsa; identical to SEQ ID NO: 509964

SEQ ID NO: 513224 - RNA, 64 nt, hsa; identical to SEQ ID NO: 509965

SEQ ID NO: 513225 - RNA, 64 nt, hsa; identical to SEQ ID NO: 509966

SEQ ID NO: 513226 - RNA, 64 nt, hsa; identical to SEQ ID NO: 509967

SEQ ID NO: 513227 - RNA, 64 nt, hsa; identical to SEQ ID NO: 509968

SEQ ID NO: 513228 - RNA, 64 nt, hsa; identical to SEQ ID NO: 509969

SEQ ID NO: 513229 - RNA, 64 nt, hsa; identical to SEQ ID NO: 509970

SEQ ID NO: 513230 - RNA, 64 nt, hsa; identical to SEQ ID NO: 509971

SEQ ID NO: 513231 - RNA, 64 nt, hsa; identical to SEQ ID NO: 509972

SEQ ID NO: 513232 - RNA, 64 nt, hsa; identical to SEQ ID NO: 509973

SEQ ID NO: 513233 - RNA, 64 nt, hsa; identical to SEQ ID NO: 509974

SEQ ID NO: 513234 - RNA, 64 nt, hsa; identical to SEQ ID NO: 509975

SEQ ID NO: 513235 - RNA, 64 nt, hsa; identical to SEQ ID NO: 509976

SEQ ID NO: 513236 - RNA, 64 nt, hsa; identical to SEQ ID NO: 509977

SEQ ID NO: 513237 - RNA, 64 nt, hsa; identical to SEQ ID NO: 509978

SEQ ID NO: 513238 - RNA, 64 nt, hsa; identical to SEQ ID NO: 509979

SEQ ID NO: 513239 - RNA, 64 nt, hsa; identical to SEQ ID NO: 509980

SEQ ID NO: 513240 - RNA, 64 nt, hsa; identical to SEQ ID NO: 509981

SEQ ID NO: 513241 - RNA, 64 nt, hsa; identical to SEQ ID NO: 509982

SEQ ID NO: 513242 - RNA, 64 nt, hsa; identical to SEQ ID NO: 509983

SEQ ID NO: 513243 - RNA, 64 nt, hsa; identical to SEQ ID NO: 509984

SEQ ID NO: 513244 - RNA, 64 nt, hsa; identical to SEQ ID NO: 509985

SEQ ID NO: 513245 - RNA, 64 nt, hsa; identical to SEQ ID NO: 509986

SEQ ID NO: 513246 - RNA, 64 nt, hsa; identical to SEQ ID NO: 509987

SEQ ID NO: 513247 - RNA, 64 nt, hsa; identical to SEQ ID NO: 509988

SEQ ID NO: 513248 - RNA, 64 nt, hsa; identical to SEQ ID NO: 509989

SEQ ID NO: 513249 - RNA, 64 nt, hsa; identical to SEQ ID NO: 509990

SEQ ID NO: 513250 - RNA, 64 nt, hsa; identical to SEQ ID NO: 509991

SEQ ID NO: 513251 - RNA, 64 nt, hsa; identical to SEQ ID NO: 509992

SEQ ID NO: 513252 - RNA, 64 nt, hsa; identical to SEQ ID NO: 509993

SEQ ID NO: 513253 - RNA, 64 nt, hsa; identical to SEQ ID NO: 509994

SEQ ID NO: 513254 - RNA, 64 nt, hsa; identical to SEQ ID NO: 509995

SEQ ID NO: 513255 - RNA, 64 nt, hsa; identical to SEQ ID NO: 509996

SEQ ID NO: 513256 - RNA, 64 nt, hsa; identical to SEQ ID NO: 509997

SEQ ID NO: 513257 - RNA, 64 nt, hsa; identical to SEQ ID NO: 509998

SEQ ID NO: 513258 - RNA, 64 nt, hsa; identical to SEQ ID NO: 509999

SEQ ID NO: 513259 - RNA, 64 nt, hsa; identical to SEQ ID NO: 510000

SEQ ID NO: 513260 - RNA, 64 nt, hsa; identical to SEQ ID NO: 510001

SEQ ID NO: 513261 - RNA, 64 nt, hsa; identical to SEQ ID NO: 510002

SEQ ID NO: 513262 - RNA, 64 nt, hsa; identical to SEQ ID NO: 510003

SEQ ID NO: 513263 - RNA, 64 nt, hsa; identical to SEQ ID NO: 510004

SEQ ID NO: 513264 - RNA, 64 nt, hsa; identical to SEQ ID NO: 510005

SEQ ID NO: 513265 - RNA, 64 nt, hsa; identical to SEQ ID NO: 510006

SEQ ID NO: 513266 - RNA, 64 nt, hsa; identical to SEQ ID NO: 510007

SEQ ID NO: 513267 - RNA, 64 nt, hsa; identical to SEQ ID NO: 510008

SEQ ID NO: 513268 - RNA, 64 nt, hsa; identical to SEQ ID NO: 510009

SEQ ID NO: 513269 - RNA, 64 nt, hsa; identical to SEQ ID NO: 510010

SEQ ID NO: 513270 - RNA, 64 nt, hsa; identical to SEQ ID NO: 510011

SEQ ID NO: 513271 - RNA, 64 nt, hsa; identical to SEQ ID NO: 510012

SEQ ID NO: 513272 - RNA, 64 nt, hsa; identical to SEQ ID NO: 510013

SEQ ID NO: 513273 - RNA, 64 nt, hsa; identical to SEQ ID NO: 510014

SEQ ID NO: 513274 - RNA, 64 nt, hsa; identical to SEQ ID NO: 510015

SEQ ID NO: 513275 - RNA, 64 nt, hsa; identical to SEQ ID NO: 510016

SEQ ID NO: 513276 - RNA, 64 nt, hsa; identical to SEQ ID NO: 510017

SEQ ID NO: 513277 - RNA, 64 nt, hsa; identical to SEQ ID NO: 510018

SEQ ID NO: 513278 - RNA, 64 nt, hsa; identical to SEQ ID NO: 510019

SEQ ID NO: 513279 - RNA, 64 nt, hsa; identical to SEQ ID NO: 510020

SEQ ID NO: 513280 - RNA, 64 nt, hsa; identical to SEQ ID NO: 510021

SEQ ID NO: 513281 - RNA, 64 nt, hsa; identical to SEQ ID NO: 510022

SEQ ID NO: 513282 - RNA, 64 nt, hsa; identical to SEQ ID NO: 510023

SEQ ID NO: 513283 - RNA, 64 nt, hsa; identical to SEQ ID NO: 510024

SEQ ID NO: 513284 - RNA, 64 nt, hsa; identical to SEQ ID NO: 510025

SEQ ID NO: 513285 - RNA, 64 nt, hsa; identical to SEQ ID NO: 510026

SEQ ID NO: 513286 - RNA, 64 nt, hsa; identical to SEQ ID NO: 510027

SEQ ID NO: 513287 - RNA, 64 nt, hsa; identical to SEQ ID NO: 510028

SEQ ID NO: 513288 - RNA, 64 nt, hsa; identical to SEQ ID NO: 510029

SEQ ID NO: 513289 - RNA, 64 nt, hsa; identical to SEQ ID NO: 510030

SEQ ID NO: 513290 - RNA, 64 nt, hsa; identical to SEQ ID NO: 510031

SEQ ID NO: 513291 - RNA, 64 nt, hsa; identical to SEQ ID NO: 510032

SEQ ID NO: 513292 - RNA, 64 nt, hsa; identical to SEQ ID NO: 510033

SEQ ID NO: 513293 - RNA, 64 nt, hsa; identical to SEQ ID NO: 510034

SEQ ID NO: 513294 - RNA, 64 nt, hsa; identical to SEQ ID NO: 510035

SEQ ID NO: 513295 - RNA, 64 nt, hsa; identical to SEQ ID NO: 510036

SEQ ID NO: 513296 - RNA, 64 nt, hsa; identical to SEQ ID NO: 510037

SEQ ID NO: 513297 - RNA, 64 nt, hsa; identical to SEQ ID NO: 510038

SEQ ID NO: 513298 - RNA, 64 nt, hsa; identical to SEQ ID NO: 510039

SEQ ID NO: 513299 - RNA, 64 nt, hsa; identical to SEQ ID NO: 510040

SEQ ID NO: 513300 - RNA, 64 nt, hsa; identical to SEQ ID NO: 510041

SEQ ID NO: 513301 - RNA, 64 nt, hsa; identical to SEQ ID NO: 510042

SEQ ID NO: 513302 - RNA, 64 nt, hsa; identical to SEQ ID NO: 510043

SEQ ID NO: 513303 - RNA, 64 nt, hsa; identical to SEQ ID NO: 510044

SEQ ID NO: 513304 - RNA, 64 nt, hsa; identical to SEQ ID NO: 510045

SEQ ID NO: 513305 - RNA, 64 nt, hsa; identical to SEQ ID NO: 510046

SEQ ID NO: 513306 - RNA, 64 nt, hsa; identical to SEQ ID NO: 510047

SEQ ID NO: 513307 - RNA, 64 nt, hsa; identical to SEQ ID NO: 510048

SEQ ID NO: 513308 - RNA, 64 nt, hsa; identical to SEQ ID NO: 510049

SEQ ID NO: 513309 - RNA, 64 nt, hsa; identical to SEQ ID NO: 510050

SEQ ID NO: 513310 - RNA, 64 nt, hsa; identical to SEQ ID NO: 510051

SEQ ID NO: 513311 - RNA, 64 nt, hsa; identical to SEQ ID NO: 510052

SEQ ID NO: 513312 - RNA, 64 nt, hsa; identical to SEQ ID NO: 510053

SEQ ID NO: 513313 - RNA, 64 nt, hsa; identical to SEQ ID NO: 510054

SEQ ID NO: 513314 - RNA, 64 nt, hsa; identical to SEQ ID NO: 510055

SEQ ID NO: 513315 - RNA, 64 nt, hsa; identical to SEQ ID NO: 510056

SEQ ID NO: 513316 - RNA, 64 nt, hsa; identical to SEQ ID NO: 510057

SEQ ID NO: 513317 - RNA, 64 nt, hsa; identical to SEQ ID NO: 510058

SEQ ID NO: 513318 - RNA, 64 nt, hsa; identical to SEQ ID NO: 510059

SEQ ID NO: 513319 - RNA, 64 nt, hsa; identical to SEQ ID NO: 510060

SEQ ID NO: 513320 - RNA, 64 nt, hsa; identical to SEQ ID NO: 510061

SEQ ID NO: 513321 - RNA, 64 nt, hsa; identical to SEQ ID NO: 510062

SEQ ID NO: 513322 - RNA, 64 nt, hsa; identical to SEQ ID NO: 510063

SEQ ID NO: 513323 - RNA, 64 nt, hsa; identical to SEQ ID NO: 510064

SEQ ID NO: 513324 - RNA, 64 nt, hsa; identical to SEQ ID NO: 510065

SEQ ID NO: 513325 - RNA, 64 nt, hsa; identical to SEQ ID NO: 510066

SEQ ID NO: 513326 - RNA, 64 nt, hsa; identical to SEQ ID NO: 510067

SEQ ID NO: 513327 - RNA, 64 nt, hsa; identical to SEQ ID NO: 510068

SEQ ID NO: 513328 - RNA, 64 nt, hsa; identical to SEQ ID NO: 510069

SEQ ID NO: 513329 - RNA, 64 nt, hsa; identical to SEQ ID NO: 510070

SEQ ID NO: 513330 - RNA, 64 nt, hsa; identical to SEQ ID NO: 510071

SEQ ID NO: 513331 - RNA, 64 nt, hsa; identical to SEQ ID NO: 510072

SEQ ID NO: 513332 - RNA, 64 nt, hsa; identical to SEQ ID NO: 510073

SEQ ID NO: 513333 - RNA, 64 nt, hsa; identical to SEQ ID NO: 510074

SEQ ID NO: 513334 - RNA, 64 nt, hsa; identical to SEQ ID NO: 510075

SEQ ID NO: 513335 - RNA, 64 nt, hsa; identical to SEQ ID NO: 510076

SEQ ID NO: 513336 - RNA, 64 nt, hsa; identical to SEQ ID NO: 510077

SEQ ID NO: 513337 - RNA, 64 nt, hsa; identical to SEQ ID NO: 510078

SEQ ID NO: 513338 - RNA, 64 nt, hsa; identical to SEQ ID NO: 510079

SEQ ID NO: 513339 - RNA, 64 nt, hsa; identical to SEQ ID NO: 510080

SEQ ID NO: 513340 - RNA, 64 nt, hsa; identical to SEQ ID NO: 510081

SEQ ID NO: 513341 - RNA, 64 nt, hsa; identical to SEQ ID NO: 510082

SEQ ID NO: 513342 - RNA, 64 nt, hsa; identical to SEQ ID NO: 510083

SEQ ID NO: 513343 - RNA, 64 nt, hsa; identical to SEQ ID NO: 510084

SEQ ID NO: 513344 - RNA, 64 nt, hsa; identical to SEQ ID NO: 510085

SEQ ID NO: 513345 - RNA, 64 nt, hsa; identical to SEQ ID NO: 510086

SEQ ID NO: 513346 - RNA, 64 nt, hsa; identical to SEQ ID NO: 510087

SEQ ID NO: 513347 - RNA, 64 nt, hsa; identical to SEQ ID NO: 510088

SEQ ID NO: 513348 - RNA, 64 nt, hsa; identical to SEQ ID NO: 510089

SEQ ID NO: 513349 - RNA, 64 nt, hsa; identical to SEQ ID NO: 510090

SEQ ID NO: 513350 - RNA, 64 nt, hsa; identical to SEQ ID NO: 510091

SEQ ID NO: 513351 - RNA, 64 nt, hsa; identical to SEQ ID NO: 510092

SEQ ID NO: 513352 - RNA, 64 nt, hsa; identical to SEQ ID NO: 510093

SEQ ID NO: 513353 - RNA, 64 nt, hsa; identical to SEQ ID NO: 510094

SEQ ID NO: 513354 - RNA, 64 nt, hsa; identical to SEQ ID NO: 510095

SEQ ID NO: 513355 - RNA, 64 nt, hsa; identical to SEQ ID NO: 510096

SEQ ID NO: 513356 - RNA, 64 nt, hsa; identical to SEQ ID NO: 510097

SEQ ID NO: 513357 - RNA, 64 nt, hsa; identical to SEQ ID NO: 510098

SEQ ID NO: 513358 - RNA, 64 nt, hsa; identical to SEQ ID NO: 510099

SEQ ID NO: 513359 - RNA, 64 nt, hsa; identical to SEQ ID NO: 509434

SEQ ID NO: 513360 - RNA, 64 nt, hsa; identical to SEQ ID NO: 510101

SEQ ID NO: 513361 - RNA, 64 nt, hsa; identical to SEQ ID NO: 510102

SEQ ID NO: 513362 - RNA, 64 nt, hsa; identical to SEQ ID NO: 510103

SEQ ID NO: 513363 - RNA, 64 nt, hsa; identical to SEQ ID NO: 510104

SEQ ID NO: 513364 - RNA, 64 nt, hsa; identical to SEQ ID NO: 510105

SEQ ID NO: 513365 - RNA, 64 nt, hsa; identical to SEQ ID NO: 510106

SEQ ID NO: 513366 - RNA, 64 nt, hsa; identical to SEQ ID NO: 510107

SEQ ID NO: 513367 - RNA, 64 nt, hsa; identical to SEQ ID NO: 510108

SEQ ID NO: 513368 - RNA, 64 nt, hsa; identical to SEQ ID NO: 510109

SEQ ID NO: 513369 - RNA, 64 nt, hsa; identical to SEQ ID NO: 510110

SEQ ID NO: 513370 - RNA, 64 nt, hsa; identical to SEQ ID NO: 510111

SEQ ID NO: 513371 - RNA, 64 nt, hsa; identical to SEQ ID NO: 510112

SEQ ID NO: 513372 - RNA, 64 nt, hsa; identical to SEQ ID NO: 510113

SEQ ID NO: 513373 - RNA, 64 nt, hsa; identical to SEQ ID NO: 509434

SEQ ID NO: 513374 - RNA, 64 nt, hsa; identical to SEQ ID NO: 509433

SEQ ID NO: 513375 - RNA, 64 nt, hsa; identical to SEQ ID NO: 510116

SEQ ID NO: 513376 - RNA, 64 nt, hsa; identical to SEQ ID NO: 510117

SEQ ID NO: 513377 - RNA, 64 nt, hsa; identical to SEQ ID NO: 510118

SEQ ID NO: 513378 - RNA, 64 nt, hsa; identical to SEQ ID NO: 510119

SEQ ID NO: 513379 - RNA, 64 nt, hsa; identical to SEQ ID NO: 510120

SEQ ID NO: 513380 - RNA, 64 nt, hsa; identical to SEQ ID NO: 510121

SEQ ID NO: 513381 - RNA, 64 nt, hsa; identical to SEQ ID NO: 510122

SEQ ID NO: 513382 - RNA, 64 nt, hsa; identical to SEQ ID NO: 510123

SEQ ID NO: 513383 - RNA, 64 nt, hsa; identical to SEQ ID NO: 510124

SEQ ID NO: 513384 - RNA, 64 nt, hsa; identical to SEQ ID NO: 510125

SEQ ID NO: 513385 - RNA, 64 nt, hsa; identical to SEQ ID NO: 510126

SEQ ID NO: 513386 - RNA, 64 nt, hsa; identical to SEQ ID NO: 510127

SEQ ID NO: 513387 - RNA, 64 nt, hsa; identical to SEQ ID NO: 510128

SEQ ID NO: 513388 - RNA, 64 nt, hsa; identical to SEQ ID NO: 510129

SEQ ID NO: 513389 - RNA, 64 nt, hsa; identical to SEQ ID NO: 510130

SEQ ID NO: 513390 - RNA, 64 nt, hsa; identical to SEQ ID NO: 510131

SEQ ID NO: 513391 - RNA, 64 nt, hsa; identical to SEQ ID NO: 510132

SEQ ID NO: 513392 - RNA, 64 nt, hsa; identical to SEQ ID NO: 510133

SEQ ID NO: 513393 - RNA, 64 nt, hsa; identical to SEQ ID NO: 510134

SEQ ID NO: 513394 - RNA, 64 nt, hsa; identical to SEQ ID NO: 510135

SEQ ID NO: 513395 - RNA, 64 nt, hsa; identical to SEQ ID NO: 510136

SEQ ID NO: 513396 - RNA, 64 nt, hsa; identical to SEQ ID NO: 510137

SEQ ID NO: 513397 - RNA, 64 nt, hsa; identical to SEQ ID NO: 510138

SEQ ID NO: 513398 - RNA, 64 nt, hsa; identical to SEQ ID NO: 510139

SEQ ID NO: 513399 - RNA, 64 nt, hsa; identical to SEQ ID NO: 510140

SEQ ID NO: 513400 - RNA, 64 nt, hsa; identical to SEQ ID NO: 510141

SEQ ID NO: 513401 - RNA, 64 nt, hsa; identical to SEQ ID NO: 510142

SEQ ID NO: 513402 - RNA, 64 nt, hsa; identical to SEQ ID NO: 510143

SEQ ID NO: 513403 - RNA, 64 nt, hsa; identical to SEQ ID NO: 510144

SEQ ID NO: 513404 - RNA, 64 nt, hsa; identical to SEQ ID NO: 510145

SEQ ID NO: 513405 - RNA, 64 nt, hsa; identical to SEQ ID NO: 510146

SEQ ID NO: 513406 - RNA, 64 nt, hsa; identical to SEQ ID NO: 510147

SEQ ID NO: 513407 - RNA, 64 nt, hsa; identical to SEQ ID NO: 510148

SEQ ID NO: 513408 - RNA, 64 nt, hsa; identical to SEQ ID NO: 510149

SEQ ID NO: 513409 - RNA, 64 nt, hsa; identical to SEQ ID NO: 510150

SEQ ID NO: 513410 - RNA, 64 nt, hsa; identical to SEQ ID NO: 510151

SEQ ID NO: 513411 - RNA, 64 nt, hsa; identical to SEQ ID NO: 510152

SEQ ID NO: 513412 - RNA, 64 nt, hsa; identical to SEQ ID NO: 510153

SEQ ID NO: 513413 - RNA, 64 nt, hsa; identical to SEQ ID NO: 510154

SEQ ID NO: 513414 - RNA, 64 nt, hsa; identical to SEQ ID NO: 510155

SEQ ID NO: 513415 - RNA, 64 nt, hsa; identical to SEQ ID NO: 510156

SEQ ID NO: 513416 - RNA, 64 nt, hsa; identical to SEQ ID NO: 510157

SEQ ID NO: 513417 - RNA, 64 nt, hsa; identical to SEQ ID NO: 510158

SEQ ID NO: 513418 - RNA, 64 nt, hsa; identical to SEQ ID NO: 510159

SEQ ID NO: 513419 - RNA, 64 nt, hsa; identical to SEQ ID NO: 510160

SEQ ID NO: 513420 - RNA, 64 nt, hsa; identical to SEQ ID NO: 510161

SEQ ID NO: 513421 - RNA, 64 nt, hsa; identical to SEQ ID NO: 510162

SEQ ID NO: 513422 - RNA, 64 nt, hsa; identical to SEQ ID NO: 510163

SEQ ID NO: 513423 - RNA, 64 nt, hsa; identical to SEQ ID NO: 510164

SEQ ID NO: 513424 - RNA, 53 nt, hsa; identical to SEQ ID NO: 510165

SEQ ID NO: 513425 - RNA, 64 nt, hsa; identical to SEQ ID NO: 510166

SEQ ID NO: 513426 - RNA, 64 nt, hsa; identical to SEQ ID NO: 510167

SEQ ID NO: 513427 - RNA, 64 nt, hsa; identical to SEQ ID NO: 510168

SEQ ID NO: 513428 - RNA, 64 nt, hsa; identical to SEQ ID NO: 510169

SEQ ID NO: 513429 - RNA, 64 nt, hsa; identical to SEQ ID NO: 510170

SEQ ID NO: 513430 - RNA, 64 nt, hsa; identical to SEQ ID NO: 510171

SEQ ID NO: 513431 - RNA, 64 nt, hsa; identical to SEQ ID NO: 510172

SEQ ID NO: 513432 - RNA, 64 nt, hsa; identical to SEQ ID NO: 510173

SEQ ID NO: 513433 - RNA, 64 nt, hsa; identical to SEQ ID NO: 510174

SEQ ID NO: 513434 - RNA, 64 nt, hsa; identical to SEQ ID NO: 510175

SEQ ID NO: 513435 - RNA, 64 nt, hsa; identical to SEQ ID NO: 510176

SEQ ID NO: 513436 - RNA, 64 nt, hsa; identical to SEQ ID NO: 510177

SEQ ID NO: 513437 - RNA, 64 nt, hsa; identical to SEQ ID NO: 510178

SEQ ID NO: 513438 - RNA, 64 nt, hsa; identical to SEQ ID NO: 510179

SEQ ID NO: 513439 - RNA, 64 nt, hsa; identical to SEQ ID NO: 510180

SEQ ID NO: 513440 - RNA, 64 nt, hsa; identical to SEQ ID NO: 510181

SEQ ID NO: 513441 - RNA, 64 nt, hsa; identical to SEQ ID NO: 510182

SEQ ID NO: 513442 - RNA, 64 nt, hsa; identical to SEQ ID NO: 510183

SEQ ID NO: 513443 - RNA, 64 nt, hsa; identical to SEQ ID NO: 510184

SEQ ID NO: 513444 - RNA, 64 nt, hsa; identical to SEQ ID NO: 510185

SEQ ID NO: 513445 - RNA, 64 nt, hsa; identical to SEQ ID NO: 510186

SEQ ID NO: 513446 - RNA, 64 nt, hsa; identical to SEQ ID NO: 510187

SEQ ID NO: 513447 - RNA, 64 nt, hsa; identical to SEQ ID NO: 510188

SEQ ID NO: 513448 - RNA, 64 nt, hsa; identical to SEQ ID NO: 510189

SEQ ID NO: 513449 - RNA, 64 nt, hsa; identical to SEQ ID NO: 510190

SEQ ID NO: 513450 - RNA, 64 nt, hsa; identical to SEQ ID NO: 510191

SEQ ID NO: 513451 - RNA, 64 nt, hsa; identical to SEQ ID NO: 510192

SEQ ID NO: 513452 - RNA, 64 nt, hsa; identical to SEQ ID NO: 510193

SEQ ID NO: 513453 - RNA, 64 nt, hsa; identical to SEQ ID NO: 510194

SEQ ID NO: 513454 - RNA, 64 nt, hsa; identical to SEQ ID NO: 510195

SEQ ID NO: 513455 - RNA, 64 nt, hsa; identical to SEQ ID NO: 510196

SEQ ID NO: 513456 - RNA, 64 nt, hsa; identical to SEQ ID NO: 510197

SEQ ID NO: 513457 - RNA, 64 nt, hsa; identical to SEQ ID NO: 510198

SEQ ID NO: 513458 - RNA, 64 nt, hsa; identical to SEQ ID NO: 510199

SEQ ID NO: 513459 - RNA, 64 nt, hsa; identical to SEQ ID NO: 510200

SEQ ID NO: 513460 - RNA, 64 nt, hsa; identical to SEQ ID NO: 510201

SEQ ID NO: 513461 - RNA, 64 nt, hsa; identical to SEQ ID NO: 510202

SEQ ID NO: 513462 - RNA, 64 nt, hsa; identical to SEQ ID NO: 510203

SEQ ID NO: 513463 - RNA, 64 nt, hsa; identical to SEQ ID NO: 510204

SEQ ID NO: 513464 - RNA, 64 nt, hsa; identical to SEQ ID NO: 510205

SEQ ID NO: 513465 - RNA, 64 nt, hsa; identical to SEQ ID NO: 510206

SEQ ID NO: 513466 - RNA, 62 nt, hsa; identical to SEQ ID NO: 510207

SEQ ID NO: 513467 - RNA, 64 nt, hsa; identical to SEQ ID NO: 510208

SEQ ID NO: 513468 - RNA, 64 nt, hsa; identical to SEQ ID NO: 510209

SEQ ID NO: 513469 - RNA, 64 nt, hsa; identical to SEQ ID NO: 510210

SEQ ID NO: 513470 - RNA, 64 nt, hsa; identical to SEQ ID NO: 510211

SEQ ID NO: 513471 - RNA, 64 nt, hsa; identical to SEQ ID NO: 510212

SEQ ID NO: 513472 - RNA, 64 nt, hsa; identical to SEQ ID NO: 510213

SEQ ID NO: 513473 - RNA, 64 nt, hsa; identical to SEQ ID NO: 510214

SEQ ID NO: 513474 - RNA, 64 nt, hsa; identical to SEQ ID NO: 510215

SEQ ID NO: 513475 - RNA, 64 nt, hsa; identical to SEQ ID NO: 510216

SEQ ID NO: 513476 - RNA, 64 nt, hsa; identical to SEQ ID NO: 510217

SEQ ID NO: 513477 - RNA, 64 nt, hsa; identical to SEQ ID NO: 510218

SEQ ID NO: 513478 - RNA, 64 nt, hsa; identical to SEQ ID NO: 510219

SEQ ID NO: 513479 - RNA, 64 nt, hsa; identical to SEQ ID NO: 510220

SEQ ID NO: 513480 - RNA, 64 nt, hsa; identical to SEQ ID NO: 510221

SEQ ID NO: 513481 - RNA, 64 nt, hsa; identical to SEQ ID NO: 510222

SEQ ID NO: 513482 - RNA, 64 nt, hsa; identical to SEQ ID NO: 510223

SEQ ID NO: 513483 - RNA, 64 nt, hsa; identical to SEQ ID NO: 510224

SEQ ID NO: 513484 - RNA, 64 nt, hsa; identical to SEQ ID NO: 510225

SEQ ID NO: 513485 - RNA, 64 nt, hsa; identical to SEQ ID NO: 510226

SEQ ID NO: 513486 - RNA, 64 nt, hsa; identical to SEQ ID NO: 510227

SEQ ID NO: 513487 - RNA, 64 nt, hsa; identical to SEQ ID NO: 510228

SEQ ID NO: 513488 - RNA, 64 nt, hsa; identical to SEQ ID NO: 510229

SEQ ID NO: 513489 - RNA, 64 nt, hsa; identical to SEQ ID NO: 510230

SEQ ID NO: 513490 - RNA, 64 nt, hsa; identical to SEQ ID NO: 510231

SEQ ID NO: 513491 - RNA, 64 nt, hsa; identical to SEQ ID NO: 510232

SEQ ID NO: 513492 - RNA, 64 nt, hsa; identical to SEQ ID NO: 510233

SEQ ID NO: 513493 - RNA, 64 nt, hsa; identical to SEQ ID NO: 510234

SEQ ID NO: 513494 - RNA, 64 nt, hsa; identical to SEQ ID NO: 510235

SEQ ID NO: 513495 - RNA, 64 nt, hsa; identical to SEQ ID NO: 510236

SEQ ID NO: 513496 - RNA, 64 nt, hsa; identical to SEQ ID NO: 510237

SEQ ID NO: 513497 - RNA, 64 nt, hsa; identical to SEQ ID NO: 510238

SEQ ID NO: 513498 - RNA, 64 nt, hsa; identical to SEQ ID NO: 510239

SEQ ID NO: 513499 - RNA, 64 nt, hsa; identical to SEQ ID NO: 510240

SEQ ID NO: 513500 - RNA, 64 nt, hsa; identical to SEQ ID NO: 510241

SEQ ID NO: 513501 - RNA, 64 nt, hsa; identical to SEQ ID NO: 510242

SEQ ID NO: 513502 - RNA, 64 nt, hsa; identical to SEQ ID NO: 510243

SEQ ID NO: 513503 - RNA, 64 nt, hsa; identical to SEQ ID NO: 510244

SEQ ID NO: 513504 - RNA, 64 nt, hsa; identical to SEQ ID NO: 510245

SEQ ID NO: 513505 - RNA, 64 nt, hsa; identical to SEQ ID NO: 510246

SEQ ID NO: 513506 - RNA, 64 nt, hsa; identical to SEQ ID NO: 510247

SEQ ID NO: 513507 - RNA, 64 nt, hsa; identical to SEQ ID NO: 510248

SEQ ID NO: 513508 - RNA, 64 nt, hsa; identical to SEQ ID NO: 510249

SEQ ID NO: 513509 - RNA, 64 nt, hsa; identical to SEQ ID NO: 510250

SEQ ID NO: 513510 - RNA, 64 nt, hsa; identical to SEQ ID NO: 510251

SEQ ID NO: 513511 - RNA, 64 nt, hsa; identical to SEQ ID NO: 510252

SEQ ID NO: 513512 - RNA, 64 nt, hsa; identical to SEQ ID NO: 510253

SEQ ID NO: 513513 - RNA, 64 nt, hsa; identical to SEQ ID NO: 510254

SEQ ID NO: 513514 - RNA, 64 nt, hsa; identical to SEQ ID NO: 510255

SEQ ID NO: 513515 - RNA, 64 nt, hsa; identical to SEQ ID NO: 510256

SEQ ID NO: 513516 - RNA, 64 nt, hsa; identical to SEQ ID NO: 510257

SEQ ID NO: 513517 - RNA, 64 nt, hsa; identical to SEQ ID NO: 510258

SEQ ID NO: 513518 - RNA, 64 nt, hsa; identical to SEQ ID NO: 510259

SEQ ID NO: 513519 - RNA, 64 nt, hsa; identical to SEQ ID NO: 510260

SEQ ID NO: 513520 - RNA, 64 nt, hsa; identical to SEQ ID NO: 510261

SEQ ID NO: 513521 - RNA, 64 nt, hsa; identical to SEQ ID NO: 510262

SEQ ID NO: 513522 - RNA, 64 nt, hsa; identical to SEQ ID NO: 510263

SEQ ID NO: 513523 - RNA, 64 nt, hsa; identical to SEQ ID NO: 510264

SEQ ID NO: 513524 - RNA, 64 nt, hsa; identical to SEQ ID NO: 510265

SEQ ID NO: 513525 - RNA, 64 nt, hsa; identical to SEQ ID NO: 510266

SEQ ID NO: 513526 - RNA, 64 nt, hsa; identical to SEQ ID NO: 510267

SEQ ID NO: 513527 - RNA, 64 nt, hsa; identical to SEQ ID NO: 510268

SEQ ID NO: 513528 - RNA, 64 nt, hsa; identical to SEQ ID NO: 510269

SEQ ID NO: 513529 - RNA, 64 nt, hsa; identical to SEQ ID NO: 510270

SEQ ID NO: 513530 - RNA, 64 nt, hsa; identical to SEQ ID NO: 510271

SEQ ID NO: 513531 - RNA, 64 nt, hsa; identical to SEQ ID NO: 510272

SEQ ID NO: 513532 - RNA, 64 nt, hsa; identical to SEQ ID NO: 510273

SEQ ID NO: 513533 - RNA, 64 nt, hsa; identical to SEQ ID NO: 510274

SEQ ID NO: 513534 - RNA, 64 nt, hsa; identical to SEQ ID NO: 510275

SEQ ID NO: 513535 - RNA, 64 nt, hsa; identical to SEQ ID NO: 510276

SEQ ID NO: 513536 - RNA, 64 nt, hsa; identical to SEQ ID NO: 510277

SEQ ID NO: 513537 - RNA, 64 nt, hsa; identical to SEQ ID NO: 510278

SEQ ID NO: 513538 - RNA, 64 nt, hsa; identical to SEQ ID NO: 510279

SEQ ID NO: 513539 - RNA, 64 nt, hsa; identical to SEQ ID NO: 510280

SEQ ID NO: 513540 - RNA, 64 nt, hsa; identical to SEQ ID NO: 510281

SEQ ID NO: 513541 - RNA, 64 nt, hsa; identical to SEQ ID NO: 510282

SEQ ID NO: 513542 - RNA, 64 nt, hsa; identical to SEQ ID NO: 510283

SEQ ID NO: 513543 - RNA, 64 nt, hsa; identical to SEQ ID NO: 510284

SEQ ID NO: 513544 - RNA, 64 nt, hsa; identical to SEQ ID NO: 510285

SEQ ID NO: 513545 - RNA, 64 nt, hsa; identical to SEQ ID NO: 510286

SEQ ID NO: 513546 - RNA, 64 nt, hsa; identical to SEQ ID NO: 510287

SEQ ID NO: 513547 - RNA, 64 nt, hsa; identical to SEQ ID NO: 510288

SEQ ID NO: 513548 - RNA, 64 nt, hsa; identical to SEQ ID NO: 510289

SEQ ID NO: 513549 - RNA, 64 nt, hsa; identical to SEQ ID NO: 510290

SEQ ID NO: 513550 - RNA, 64 nt, hsa; identical to SEQ ID NO: 510291

SEQ ID NO: 513551 - RNA, 64 nt, hsa; identical to SEQ ID NO: 510292

SEQ ID NO: 513552 - RNA, 64 nt, hsa; identical to SEQ ID NO: 510293

SEQ ID NO: 513553 - RNA, 64 nt, hsa; identical to SEQ ID NO: 510294

SEQ ID NO: 513554 - RNA, 64 nt, hsa; identical to SEQ ID NO: 510295

SEQ ID NO: 513555 - RNA, 64 nt, hsa; identical to SEQ ID NO: 510296

SEQ ID NO: 513556 - RNA, 64 nt, hsa; identical to SEQ ID NO: 510297

SEQ ID NO: 513557 - RNA, 64 nt, hsa; identical to SEQ ID NO: 510298

SEQ ID NO: 513558 - RNA, 64 nt, hsa; identical to SEQ ID NO: 510299

SEQ ID NO: 513559 - RNA, 64 nt, hsa; identical to SEQ ID NO: 510300

SEQ ID NO: 513560 - RNA, 64 nt, hsa; identical to SEQ ID NO: 510301

SEQ ID NO: 513561 - RNA, 64 nt, hsa; identical to SEQ ID NO: 510302

SEQ ID NO: 513562 - RNA, 64 nt, hsa; identical to SEQ ID NO: 510303

SEQ ID NO: 513563 - RNA, 64 nt, hsa; identical to SEQ ID NO: 510304

SEQ ID NO: 513564 - RNA, 64 nt, hsa; identical to SEQ ID NO: 510305

SEQ ID NO: 513565 - RNA, 64 nt, hsa; identical to SEQ ID NO: 510306

SEQ ID NO: 513566 - RNA, 64 nt, hsa; identical to SEQ ID NO: 510307

SEQ ID NO: 513567 - RNA, 64 nt, hsa; identical to SEQ ID NO: 510308

SEQ ID NO: 513568 - RNA, 64 nt, hsa; identical to SEQ ID NO: 510309

SEQ ID NO: 513569 - RNA, 64 nt, hsa; identical to SEQ ID NO: 510310

SEQ ID NO: 513570 - RNA, 64 nt, hsa; identical to SEQ ID NO: 510311

SEQ ID NO: 513571 - RNA, 64 nt, hsa; identical to SEQ ID NO: 510312

SEQ ID NO: 513572 - RNA, 64 nt, hsa; identical to SEQ ID NO: 510313

SEQ ID NO: 513573 - RNA, 64 nt, hsa; identical to SEQ ID NO: 510314

SEQ ID NO: 513574 - RNA, 64 nt, hsa; identical to SEQ ID NO: 510315

SEQ ID NO: 513575 - RNA, 64 nt, hsa; identical to SEQ ID NO: 510316

SEQ ID NO: 513576 - RNA, 64 nt, hsa; identical to SEQ ID NO: 510317

SEQ ID NO: 513577 - RNA, 64 nt, hsa; identical to SEQ ID NO: 510318

SEQ ID NO: 513578 - RNA, 64 nt, hsa; identical to SEQ ID NO: 510319

SEQ ID NO: 513579 - RNA, 64 nt, hsa; identical to SEQ ID NO: 510320

SEQ ID NO: 513580 - RNA, 64 nt, hsa; identical to SEQ ID NO: 510321

SEQ ID NO: 513581 - RNA, 64 nt, hsa; identical to SEQ ID NO: 510322

SEQ ID NO: 513582 - RNA, 64 nt, hsa; identical to SEQ ID NO: 510323

SEQ ID NO: 513583 - RNA, 64 nt, hsa; identical to SEQ ID NO: 510324

SEQ ID NO: 513584 - RNA, 64 nt, hsa; identical to SEQ ID NO: 510325

SEQ ID NO: 513585 - RNA, 64 nt, hsa; identical to SEQ ID NO: 510326

SEQ ID NO: 513586 - RNA, 64 nt, hsa; identical to SEQ ID NO: 510327

SEQ ID NO: 513587 - RNA, 64 nt, hsa; identical to SEQ ID NO: 510328

SEQ ID NO: 513588 - RNA, 64 nt, hsa; identical to SEQ ID NO: 510329

SEQ ID NO: 513589 - RNA, 64 nt, hsa; identical to SEQ ID NO: 510330

SEQ ID NO: 513590 - RNA, 64 nt, hsa; identical to SEQ ID NO: 510331

SEQ ID NO: 513591 - RNA, 64 nt, hsa; identical to SEQ ID NO: 510332

SEQ ID NO: 513592 - RNA, 64 nt, hsa; identical to SEQ ID NO: 510333

SEQ ID NO: 513593 - RNA, 64 nt, hsa; identical to SEQ ID NO: 510334

SEQ ID NO: 513594 - RNA, 64 nt, hsa; identical to SEQ ID NO: 510335

SEQ ID NO: 513595 - RNA, 64 nt, hsa; identical to SEQ ID NO: 510336

SEQ ID NO: 513596 - RNA, 64 nt, hsa; identical to SEQ ID NO: 510337

SEQ ID NO: 513597 - RNA, 64 nt, hsa; identical to SEQ ID NO: 510338

SEQ ID NO: 513598 - RNA, 64 nt, hsa; identical to SEQ ID NO: 510339

SEQ ID NO: 513599 - RNA, 64 nt, hsa; identical to SEQ ID NO: 510340

SEQ ID NO: 513600 - RNA, 64 nt, hsa; identical to SEQ ID NO: 510341

SEQ ID NO: 513601 - RNA, 64 nt, hsa; identical to SEQ ID NO: 510342

SEQ ID NO: 513602 - RNA, 64 nt, hsa; identical to SEQ ID NO: 510343

SEQ ID NO: 513603 - RNA, 64 nt, hsa; identical to SEQ ID NO: 510344

SEQ ID NO: 513604 - RNA, 64 nt, hsa; identical to SEQ ID NO: 510345

SEQ ID NO: 513605 - RNA, 64 nt, hsa; identical to SEQ ID NO: 510346

SEQ ID NO: 513606 - RNA, 64 nt, hsa; identical to SEQ ID NO: 510347

SEQ ID NO: 513607 - RNA, 64 nt, hsa; identical to SEQ ID NO: 510348

SEQ ID NO: 513608 - RNA, 64 nt, hsa; identical to SEQ ID NO: 510349

SEQ ID NO: 513609 - RNA, 64 nt, hsa; identical to SEQ ID NO: 510350

SEQ ID NO: 513610 - RNA, 64 nt, hsa; identical to SEQ ID NO: 510351

SEQ ID NO: 513611 - RNA, 64 nt, hsa; identical to SEQ ID NO: 510352

SEQ ID NO: 513612 - RNA, 64 nt, hsa; identical to SEQ ID NO: 510353

SEQ ID NO: 513613 - RNA, 64 nt, hsa; identical to SEQ ID NO: 510354

SEQ ID NO: 513614 - RNA, 64 nt, hsa; identical to SEQ ID NO: 510355

SEQ ID NO: 513615 - RNA, 64 nt, hsa; identical to SEQ ID NO: 510356

SEQ ID NO: 513616 - RNA, 64 nt, hsa; identical to SEQ ID NO: 510357

SEQ ID NO: 513617 - RNA, 64 nt, hsa; identical to SEQ ID NO: 510358

SEQ ID NO: 513618 - RNA, 64 nt, hsa; identical to SEQ ID NO: 510359

SEQ ID NO: 513619 - RNA, 64 nt, hsa; identical to SEQ ID NO: 510360

SEQ ID NO: 513620 - RNA, 64 nt, hsa; identical to SEQ ID NO: 510361

SEQ ID NO: 513621 - RNA, 64 nt, hsa; identical to SEQ ID NO: 510362

SEQ ID NO: 513622 - RNA, 64 nt, hsa; identical to SEQ ID NO: 510363

SEQ ID NO: 513623 - RNA, 64 nt, hsa; identical to SEQ ID NO: 510364

SEQ ID NO: 513624 - RNA, 64 nt, hsa; identical to SEQ ID NO: 510365

SEQ ID NO: 513625 - RNA, 64 nt, hsa; identical to SEQ ID NO: 510366

SEQ ID NO: 513626 - RNA, 64 nt, hsa; identical to SEQ ID NO: 510367

SEQ ID NO: 513627 - RNA, 64 nt, hsa; identical to SEQ ID NO: 510368

SEQ ID NO: 513628 - RNA, 64 nt, hsa; identical to SEQ ID NO: 510369

SEQ ID NO: 513629 - RNA, 64 nt, hsa; identical to SEQ ID NO: 510370

SEQ ID NO: 513630 - RNA, 64 nt, hsa; identical to SEQ ID NO: 510371

SEQ ID NO: 513631 - RNA, 64 nt, hsa; identical to SEQ ID NO: 510372

SEQ ID NO: 513632 - RNA, 64 nt, hsa; identical to SEQ ID NO: 510373

SEQ ID NO: 513633 - RNA, 64 nt, hsa; identical to SEQ ID NO: 510374

SEQ ID NO: 513634 - RNA, 64 nt, hsa; identical to SEQ ID NO: 510375

SEQ ID NO: 513635 - RNA, 64 nt, hsa; identical to SEQ ID NO: 510376

SEQ ID NO: 513636 - RNA, 64 nt, hsa; identical to SEQ ID NO: 510377

SEQ ID NO: 513637 - RNA, 64 nt, hsa; identical to SEQ ID NO: 510378

SEQ ID NO: 513638 - RNA, 64 nt, hsa; identical to SEQ ID NO: 510379

SEQ ID NO: 513639 - RNA, 64 nt, hsa; identical to SEQ ID NO: 510380

SEQ ID NO: 513640 - RNA, 64 nt, hsa; identical to SEQ ID NO: 510381

SEQ ID NO: 513641 - RNA, 64 nt, hsa; identical to SEQ ID NO: 510382

SEQ ID NO: 513642 - RNA, 64 nt, hsa; identical to SEQ ID NO: 510383

SEQ ID NO: 513643 - RNA, 64 nt, hsa; identical to SEQ ID NO: 510384

SEQ ID NO: 513644 - RNA, 64 nt, hsa; identical to SEQ ID NO: 510385

SEQ ID NO: 513645 - RNA, 64 nt, hsa; identical to SEQ ID NO: 510386

SEQ ID NO: 513646 - RNA, 64 nt, hsa; identical to SEQ ID NO: 510387

SEQ ID NO: 513647 - RNA, 64 nt, hsa; identical to SEQ ID NO: 510388

SEQ ID NO: 513648 - RNA, 64 nt, hsa; identical to SEQ ID NO: 510389

SEQ ID NO: 513649 - RNA, 64 nt, hsa; identical to SEQ ID NO: 510390

SEQ ID NO: 513650 - RNA, 64 nt, hsa; identical to SEQ ID NO: 510391

SEQ ID NO: 513651 - RNA, 64 nt, hsa; identical to SEQ ID NO: 510392

SEQ ID NO: 513652 - RNA, 64 nt, hsa; identical to SEQ ID NO: 510393

SEQ ID NO: 513653 - RNA, 64 nt, hsa; identical to SEQ ID NO: 510394

SEQ ID NO: 513654 - RNA, 64 nt, hsa; identical to SEQ ID NO: 510395

SEQ ID NO: 513655 - RNA, 64 nt, hsa; identical to SEQ ID NO: 510396

SEQ ID NO: 513656 - RNA, 64 nt, hsa; identical to SEQ ID NO: 510397

SEQ ID NO: 513657 - RNA, 64 nt, hsa; identical to SEQ ID NO: 510398

SEQ ID NO: 513658 - RNA, 64 nt, hsa; identical to SEQ ID NO: 510399

SEQ ID NO: 513659 - RNA, 64 nt, hsa; identical to SEQ ID NO: 510400

SEQ ID NO: 513660 - RNA, 64 nt, hsa; identical to SEQ ID NO: 510401

SEQ ID NO: 513661 - RNA, 64 nt, hsa; identical to SEQ ID NO: 510402

SEQ ID NO: 513662 - RNA, 64 nt, hsa; identical to SEQ ID NO: 510403

SEQ ID NO: 513663 - RNA, 64 nt, hsa; identical to SEQ ID NO: 510404

SEQ ID NO: 513664 - RNA, 64 nt, hsa; identical to SEQ ID NO: 510405

SEQ ID NO: 513665 - RNA, 64 nt, hsa; identical to SEQ ID NO: 510406

SEQ ID NO: 513666 - RNA, 64 nt, hsa; identical to SEQ ID NO: 510407

SEQ ID NO: 513667 - RNA, 64 nt, hsa; identical to SEQ ID NO: 510408

SEQ ID NO: 513668 - RNA, 64 nt, hsa; identical to SEQ ID NO: 510409

SEQ ID NO: 513669 - RNA, 64 nt, hsa; identical to SEQ ID NO: 510410

SEQ ID NO: 513670 - RNA, 64 nt, hsa; identical to SEQ ID NO: 510411

SEQ ID NO: 513671 - RNA, 64 nt, hsa; identical to SEQ ID NO: 510412

SEQ ID NO: 513672 - RNA, 64 nt, hsa; identical to SEQ ID NO: 510413

SEQ ID NO: 513673 - RNA, 64 nt, hsa; identical to SEQ ID NO: 510414

SEQ ID NO: 513674 - RNA, 64 nt, hsa; identical to SEQ ID NO: 510415

SEQ ID NO: 513675 - RNA, 64 nt, hsa; identical to SEQ ID NO: 510416

SEQ ID NO: 513676 - RNA, 64 nt, hsa; identical to SEQ ID NO: 510417

SEQ ID NO: 513677 - RNA, 64 nt, hsa; identical to SEQ ID NO: 510418

SEQ ID NO: 513678 - RNA, 64 nt, hsa; identical to SEQ ID NO: 510419

SEQ ID NO: 513679 - RNA, 64 nt, hsa; identical to SEQ ID NO: 510420

SEQ ID NO: 513680 - RNA, 64 nt, hsa; identical to SEQ ID NO: 510421

SEQ ID NO: 513681 - RNA, 64 nt, hsa; identical to SEQ ID NO: 510422

SEQ ID NO: 513682 - RNA, 64 nt, hsa; identical to SEQ ID NO: 510423

SEQ ID NO: 513683 - RNA, 64 nt, hsa; identical to SEQ ID NO: 510424

SEQ ID NO: 513684 - RNA, 64 nt, hsa; identical to SEQ ID NO: 510425

SEQ ID NO: 513685 - RNA, 64 nt, hsa; identical to SEQ ID NO: 510426

SEQ ID NO: 513686 - RNA, 64 nt, hsa; identical to SEQ ID NO: 510427

SEQ ID NO: 513687 - RNA, 64 nt, hsa; identical to SEQ ID NO: 510428

SEQ ID NO: 513688 - RNA, 64 nt, hsa; identical to SEQ ID NO: 510429

SEQ ID NO: 513689 - RNA, 64 nt, hsa; identical to SEQ ID NO: 510430

SEQ ID NO: 513690 - RNA, 64 nt, hsa; identical to SEQ ID NO: 510431

SEQ ID NO: 513691 - RNA, 64 nt, hsa; identical to SEQ ID NO: 510432

SEQ ID NO: 513692 - RNA, 64 nt, hsa; identical to SEQ ID NO: 510433

SEQ ID NO: 513693 - RNA, 64 nt, hsa; identical to SEQ ID NO: 510434

SEQ ID NO: 513694 - RNA, 64 nt, hsa; identical to SEQ ID NO: 510435

SEQ ID NO: 513695 - RNA, 64 nt, hsa; identical to SEQ ID NO: 510436

SEQ ID NO: 513696 - RNA, 64 nt, hsa; identical to SEQ ID NO: 510437

SEQ ID NO: 513697 - RNA, 64 nt, hsa; identical to SEQ ID NO: 510438

SEQ ID NO: 513698 - RNA, 64 nt, hsa; identical to SEQ ID NO: 510439

SEQ ID NO: 513699 - RNA, 64 nt, hsa; identical to SEQ ID NO: 510440

SEQ ID NO: 513700 - RNA, 64 nt, hsa; identical to SEQ ID NO: 510441

SEQ ID NO: 513701 - RNA, 64 nt, hsa; identical to SEQ ID NO: 510442

SEQ ID NO: 513702 - RNA, 64 nt, hsa; identical to SEQ ID NO: 510443

SEQ ID NO: 513703 - RNA, 64 nt, hsa; identical to SEQ ID NO: 510444

SEQ ID NO: 513704 - RNA, 64 nt, hsa; identical to SEQ ID NO: 510445

SEQ ID NO: 513705 - RNA, 64 nt, hsa; identical to SEQ ID NO: 510446

SEQ ID NO: 513706 - RNA, 64 nt, hsa; identical to SEQ ID NO: 510447

SEQ ID NO: 513707 - RNA, 64 nt, hsa; identical to SEQ ID NO: 510448

SEQ ID NO: 513708 - RNA, 64 nt, hsa; identical to SEQ ID NO: 510449

SEQ ID NO: 513709 - RNA, 64 nt, hsa; identical to SEQ ID NO: 510450

SEQ ID NO: 513710 - RNA, 64 nt, hsa; identical to SEQ ID NO: 510451

SEQ ID NO: 513711 - RNA, 64 nt, hsa; identical to SEQ ID NO: 510452

SEQ ID NO: 513712 - RNA, 64 nt, hsa; identical to SEQ ID NO: 510453

SEQ ID NO: 513713 - RNA, 64 nt, hsa; identical to SEQ ID NO: 510454

SEQ ID NO: 513714 - RNA, 64 nt, hsa; identical to SEQ ID NO: 510455

SEQ ID NO: 513715 - RNA, 64 nt, hsa; identical to SEQ ID NO: 510456

SEQ ID NO: 513716 - RNA, 64 nt, hsa; identical to SEQ ID NO: 510457

SEQ ID NO: 513717 - RNA, 64 nt, hsa; identical to SEQ ID NO: 510458

SEQ ID NO: 513718 - RNA, 64 nt, hsa; identical to SEQ ID NO: 510459

SEQ ID NO: 513719 - RNA, 64 nt, hsa; identical to SEQ ID NO: 510460

SEQ ID NO: 513720 - RNA, 64 nt, hsa; identical to SEQ ID NO: 510461

SEQ ID NO: 513721 - RNA, 64 nt, hsa; identical to SEQ ID NO: 510462

SEQ ID NO: 513722 - RNA, 64 nt, hsa; identical to SEQ ID NO: 510463

SEQ ID NO: 513723 - RNA, 64 nt, hsa; identical to SEQ ID NO: 510464

SEQ ID NO: 513724 - RNA, 64 nt, hsa; identical to SEQ ID NO: 510465

SEQ ID NO: 513725 - RNA, 64 nt, hsa; identical to SEQ ID NO: 510466

SEQ ID NO: 513726 - RNA, 64 nt, hsa; identical to SEQ ID NO: 510467

SEQ ID NO: 513727 - RNA, 64 nt, hsa; identical to SEQ ID NO: 510468

SEQ ID NO: 513728 - RNA, 64 nt, hsa; identical to SEQ ID NO: 510469

SEQ ID NO: 513729 - RNA, 64 nt, hsa; identical to SEQ ID NO: 510470

SEQ ID NO: 513730 - RNA, 64 nt, hsa; identical to SEQ ID NO: 510471

SEQ ID NO: 513731 - RNA, 64 nt, hsa; identical to SEQ ID NO: 510472

SEQ ID NO: 513732 - RNA, 64 nt, hsa; identical to SEQ ID NO: 510473

SEQ ID NO: 513733 - RNA, 64 nt, hsa; identical to SEQ ID NO: 510474

SEQ ID NO: 513734 - RNA, 64 nt, hsa; identical to SEQ ID NO: 510475

SEQ ID NO: 513735 - RNA, 64 nt, hsa; identical to SEQ ID NO: 510476

SEQ ID NO: 513736 - RNA, 64 nt, hsa; identical to SEQ ID NO: 510477

SEQ ID NO: 513737 - RNA, 64 nt, hsa; identical to SEQ ID NO: 510478

SEQ ID NO: 513738 - RNA, 64 nt, hsa; identical to SEQ ID NO: 510479

SEQ ID NO: 513739 - RNA, 64 nt, hsa; identical to SEQ ID NO: 510480

SEQ ID NO: 513740 - RNA, 64 nt, hsa; identical to SEQ ID NO: 510481

SEQ ID NO: 513741 - RNA, 64 nt, hsa; identical to SEQ ID NO: 510482

SEQ ID NO: 513742 - RNA, 64 nt, hsa; identical to SEQ ID NO: 510483

SEQ ID NO: 513743 - RNA, 64 nt, hsa; identical to SEQ ID NO: 510484

SEQ ID NO: 513744 - RNA, 64 nt, hsa; identical to SEQ ID NO: 510485

SEQ ID NO: 513745 - RNA, 64 nt, hsa; identical to SEQ ID NO: 510486

SEQ ID NO: 513746 - RNA, 64 nt, hsa; identical to SEQ ID NO: 510487

SEQ ID NO: 513747 - RNA, 64 nt, hsa; identical to SEQ ID NO: 510488

SEQ ID NO: 513748 - RNA, 64 nt, hsa; identical to SEQ ID NO: 510489

SEQ ID NO: 513749 - RNA, 64 nt, hsa; identical to SEQ ID NO: 510490

SEQ ID NO: 513750 - RNA, 64 nt, hsa; identical to SEQ ID NO: 510491

SEQ ID NO: 513751 - RNA, 64 nt, hsa; identical to SEQ ID NO: 510492

SEQ ID NO: 513752 - RNA, 64 nt, hsa; identical to SEQ ID NO: 510493

SEQ ID NO: 513753 - RNA, 64 nt, hsa; identical to SEQ ID NO: 510494

SEQ ID NO: 513754 - RNA, 64 nt, hsa; identical to SEQ ID NO: 510495

SEQ ID NO: 513755 - RNA, 64 nt, hsa; identical to SEQ ID NO: 510496

SEQ ID NO: 513756 - RNA, 64 nt, hsa; identical to SEQ ID NO: 510497

SEQ ID NO: 513757 - RNA, 64 nt, hsa; identical to SEQ ID NO: 510498

SEQ ID NO: 513758 - RNA, 64 nt, hsa; identical to SEQ ID NO: 510499

SEQ ID NO: 513759 - RNA, 64 nt, hsa; identical to SEQ ID NO: 510500

SEQ ID NO: 513760 - RNA, 64 nt, hsa; identical to SEQ ID NO: 510501

SEQ ID NO: 513761 - RNA, 64 nt, hsa; identical to SEQ ID NO: 510502

SEQ ID NO: 513762 - RNA, 64 nt, hsa; identical to SEQ ID NO: 510503

SEQ ID NO: 513763 - RNA, 64 nt, hsa; identical to SEQ ID NO: 510504

SEQ ID NO: 513764 - RNA, 64 nt, hsa; identical to SEQ ID NO: 510505

SEQ ID NO: 513765 - RNA, 64 nt, hsa; identical to SEQ ID NO: 510506

SEQ ID NO: 513766 - RNA, 64 nt, hsa; identical to SEQ ID NO: 510507

SEQ ID NO: 513767 - RNA, 64 nt, hsa; identical to SEQ ID NO: 510508

SEQ ID NO: 513768 - RNA, 64 nt, hsa; identical to SEQ ID NO: 510509

SEQ ID NO: 513769 - RNA, 64 nt, hsa; identical to SEQ ID NO: 510510

SEQ ID NO: 513770 - RNA, 64 nt, hsa; identical to SEQ ID NO: 510511

SEQ ID NO: 513771 - RNA, 64 nt, hsa; identical to SEQ ID NO: 510512

SEQ ID NO: 513772 - RNA, 64 nt, hsa; identical to SEQ ID NO: 510513

SEQ ID NO: 513773 - RNA, 64 nt, hsa; identical to SEQ ID NO: 510514

SEQ ID NO: 513774 - RNA, 64 nt, hsa; identical to SEQ ID NO: 510515

SEQ ID NO: 513775 - RNA, 64 nt, hsa; identical to SEQ ID NO: 510516

SEQ ID NO: 513776 - RNA, 64 nt, hsa; identical to SEQ ID NO: 510517

SEQ ID NO: 513777 - RNA, 64 nt, hsa; identical to SEQ ID NO: 510518

SEQ ID NO: 513778 - RNA, 64 nt, hsa; identical to SEQ ID NO: 510519

SEQ ID NO: 513779 - RNA, 64 nt, hsa; identical to SEQ ID NO: 510520

SEQ ID NO: 513780 - RNA, 64 nt, hsa; identical to SEQ ID NO: 510521

SEQ ID NO: 513781 - RNA, 64 nt, hsa; identical to SEQ ID NO: 510522

SEQ ID NO: 513782 - RNA, 64 nt, hsa; identical to SEQ ID NO: 510523

SEQ ID NO: 513783 - RNA, 64 nt, hsa; identical to SEQ ID NO: 510524

SEQ ID NO: 513784 - RNA, 64 nt, hsa; identical to SEQ ID NO: 510525

SEQ ID NO: 513785 - RNA, 64 nt, hsa; identical to SEQ ID NO: 510526

SEQ ID NO: 513786 - RNA, 64 nt, hsa; identical to SEQ ID NO: 510527

SEQ ID NO: 513787 - RNA, 64 nt, hsa; identical to SEQ ID NO: 510528

SEQ ID NO: 513788 - RNA, 64 nt, hsa; identical to SEQ ID NO: 510529

SEQ ID NO: 513789 - RNA, 64 nt, hsa; identical to SEQ ID NO: 510530

SEQ ID NO: 513790 - RNA, 64 nt, hsa; identical to SEQ ID NO: 510531

SEQ ID NO: 513791 - RNA, 64 nt, hsa; identical to SEQ ID NO: 510532

SEQ ID NO: 513792 - RNA, 64 nt, hsa; identical to SEQ ID NO: 510533

SEQ ID NO: 513793 - RNA, 64 nt, hsa; identical to SEQ ID NO: 510534

SEQ ID NO: 513794 - RNA, 64 nt, hsa; identical to SEQ ID NO: 510535

SEQ ID NO: 513795 - RNA, 64 nt, hsa; identical to SEQ ID NO: 510536

SEQ ID NO: 513796 - RNA, 64 nt, hsa; identical to SEQ ID NO: 510537

SEQ ID NO: 513797 - RNA, 64 nt, hsa; identical to SEQ ID NO: 510538

SEQ ID NO: 513798 - RNA, 64 nt, hsa; identical to SEQ ID NO: 510539

SEQ ID NO: 513799 - RNA, 64 nt, hsa; identical to SEQ ID NO: 510540

SEQ ID NO: 513800 - RNA, 64 nt, hsa; identical to SEQ ID NO: 510541

SEQ ID NO: 513801 - RNA, 64 nt, hsa; identical to SEQ ID NO: 510542

SEQ ID NO: 513802 - RNA, 64 nt, hsa; identical to SEQ ID NO: 510543

SEQ ID NO: 513803 - RNA, 64 nt, hsa; identical to SEQ ID NO: 510544

SEQ ID NO: 513804 - RNA, 64 nt, hsa; identical to SEQ ID NO: 510545

SEQ ID NO: 513805 - RNA, 64 nt, hsa; identical to SEQ ID NO: 510546

SEQ ID NO: 513806 - RNA, 64 nt, hsa; identical to SEQ ID NO: 510547

SEQ ID NO: 513807 - RNA, 64 nt, hsa; identical to SEQ ID NO: 510548

SEQ ID NO: 513808 - RNA, 64 nt, hsa; identical to SEQ ID NO: 510549

SEQ ID NO: 513809 - RNA, 64 nt, hsa; identical to SEQ ID NO: 510550

SEQ ID NO: 513810 - RNA, 64 nt, hsa; identical to SEQ ID NO: 510551

SEQ ID NO: 513811 - RNA, 64 nt, hsa; identical to SEQ ID NO: 510552

SEQ ID NO: 513812 - RNA, 64 nt, hsa; identical to SEQ ID NO: 510553

SEQ ID NO: 513813 - RNA, 64 nt, hsa; identical to SEQ ID NO: 510554

SEQ ID NO: 513814 - RNA, 64 nt, hsa; identical to SEQ ID NO: 510555

SEQ ID NO: 513815 - RNA, 64 nt, hsa; identical to SEQ ID NO: 510556

SEQ ID NO: 513816 - RNA, 64 nt, hsa; identical to SEQ ID NO: 510557

SEQ ID NO: 513817 - RNA, 64 nt, hsa; identical to SEQ ID NO: 510558

SEQ ID NO: 513818 - RNA, 64 nt, hsa; identical to SEQ ID NO: 510559

SEQ ID NO: 513819 - RNA, 64 nt, hsa; identical to SEQ ID NO: 510560

SEQ ID NO: 513820 - RNA, 64 nt, hsa; identical to SEQ ID NO: 510561

SEQ ID NO: 513821 - RNA, 64 nt, hsa; identical to SEQ ID NO: 510562

SEQ ID NO: 513822 - RNA, 64 nt, hsa; identical to SEQ ID NO: 510563

SEQ ID NO: 513823 - RNA, 64 nt, hsa; identical to SEQ ID NO: 510564

SEQ ID NO: 513824 - RNA, 64 nt, hsa; identical to SEQ ID NO: 510565

SEQ ID NO: 513825 - RNA, 64 nt, hsa; identical to SEQ ID NO: 510566

SEQ ID NO: 513826 - RNA, 64 nt, hsa; identical to SEQ ID NO: 510567

SEQ ID NO: 513827 - RNA, 64 nt, hsa; identical to SEQ ID NO: 510568

SEQ ID NO: 513828 - RNA, 64 nt, hsa; identical to SEQ ID NO: 510569

SEQ ID NO: 513829 - RNA, 64 nt, hsa; identical to SEQ ID NO: 510570

SEQ ID NO: 513830 - RNA, 64 nt, hsa; identical to SEQ ID NO: 510571

SEQ ID NO: 513831 - RNA, 64 nt, hsa; identical to SEQ ID NO: 510572

SEQ ID NO: 513832 - RNA, 64 nt, hsa; identical to SEQ ID NO: 510573

SEQ ID NO: 513833 - RNA, 64 nt, hsa; identical to SEQ ID NO: 510574

SEQ ID NO: 513834 - RNA, 64 nt, hsa; identical to SEQ ID NO: 510575

SEQ ID NO: 513835 - RNA, 64 nt, hsa; identical to SEQ ID NO: 510576

SEQ ID NO: 513836 - RNA, 64 nt, hsa; identical to SEQ ID NO: 510577

SEQ ID NO: 513837 - RNA, 64 nt, hsa; identical to SEQ ID NO: 510578

SEQ ID NO: 513838 - RNA, 64 nt, hsa; identical to SEQ ID NO: 510579

SEQ ID NO: 513839 - RNA, 64 nt, hsa; identical to SEQ ID NO: 510580

SEQ ID NO: 513840 - RNA, 64 nt, hsa; identical to SEQ ID NO: 510581

SEQ ID NO: 513841 - RNA, 64 nt, hsa; identical to SEQ ID NO: 510582

SEQ ID NO: 513842 - RNA, 64 nt, hsa; identical to SEQ ID NO: 510583

SEQ ID NO: 513843 - RNA, 64 nt, hsa; identical to SEQ ID NO: 510584

SEQ ID NO: 513844 - RNA, 64 nt, hsa; identical to SEQ ID NO: 510585

SEQ ID NO: 513845 - RNA, 64 nt, hsa; identical to SEQ ID NO: 510586

SEQ ID NO: 513846 - RNA, 64 nt, hsa; identical to SEQ ID NO: 510587

SEQ ID NO: 513847 - RNA, 64 nt, hsa; identical to SEQ ID NO: 510588

SEQ ID NO: 513848 - RNA, 64 nt, hsa; identical to SEQ ID NO: 510589

SEQ ID NO: 513849 - RNA, 64 nt, hsa; identical to SEQ ID NO: 510590

SEQ ID NO: 513850 - RNA, 64 nt, hsa; identical to SEQ ID NO: 510591

SEQ ID NO: 513851 - RNA, 64 nt, hsa; identical to SEQ ID NO: 510592

SEQ ID NO: 513852 - RNA, 64 nt, hsa; identical to SEQ ID NO: 510593

SEQ ID NO: 513853 - RNA, 64 nt, hsa; identical to SEQ ID NO: 510594

SEQ ID NO: 513854 - RNA, 64 nt, hsa; identical to SEQ ID NO: 510595

SEQ ID NO: 513855 - RNA, 64 nt, hsa; identical to SEQ ID NO: 510596

SEQ ID NO: 513856 - RNA, 64 nt, hsa; identical to SEQ ID NO: 510597

SEQ ID NO: 513857 - RNA, 64 nt, hsa; identical to SEQ ID NO: 510598

SEQ ID NO: 513858 - RNA, 64 nt, hsa; identical to SEQ ID NO: 510599

SEQ ID NO: 513859 - RNA, 64 nt, hsa; identical to SEQ ID NO: 510600

SEQ ID NO: 513860 - RNA, 64 nt, hsa; identical to SEQ ID NO: 510601

SEQ ID NO: 513861 - RNA, 64 nt, hsa; identical to SEQ ID NO: 510602

SEQ ID NO: 513862 - RNA, 64 nt, hsa; identical to SEQ ID NO: 510603

SEQ ID NO: 513863 - RNA, 64 nt, hsa; identical to SEQ ID NO: 510604

SEQ ID NO: 513864 - RNA, 64 nt, hsa; identical to SEQ ID NO: 510605

SEQ ID NO: 513865 - RNA, 64 nt, hsa; identical to SEQ ID NO: 510606

SEQ ID NO: 513866 - RNA, 64 nt, hsa; identical to SEQ ID NO: 510607

SEQ ID NO: 513867 - RNA, 64 nt, hsa; identical to SEQ ID NO: 510608

SEQ ID NO: 513868 - RNA, 64 nt, hsa; identical to SEQ ID NO: 510609

SEQ ID NO: 513869 - RNA, 64 nt, hsa; identical to SEQ ID NO: 510610

SEQ ID NO: 513870 - RNA, 64 nt, hsa; identical to SEQ ID NO: 510611

SEQ ID NO: 513871 - RNA, 64 nt, hsa; identical to SEQ ID NO: 510612

SEQ ID NO: 513872 - RNA, 64 nt, hsa; identical to SEQ ID NO: 510613

SEQ ID NO: 513873 - RNA, 64 nt, hsa; identical to SEQ ID NO: 510614

SEQ ID NO: 513874 - RNA, 64 nt, hsa; identical to SEQ ID NO: 510615

SEQ ID NO: 513875 - RNA, 64 nt, hsa; identical to SEQ ID NO: 510616

SEQ ID NO: 513876 - RNA, 64 nt, hsa; identical to SEQ ID NO: 510617

SEQ ID NO: 513877 - RNA, 64 nt, hsa; identical to SEQ ID NO: 510618

SEQ ID NO: 513878 - RNA, 64 nt, hsa; identical to SEQ ID NO: 510619

SEQ ID NO: 513879 - RNA, 64 nt, hsa; identical to SEQ ID NO: 510620

SEQ ID NO: 513880 - RNA, 64 nt, hsa; identical to SEQ ID NO: 510621

SEQ ID NO: 513881 - RNA, 64 nt, hsa; identical to SEQ ID NO: 510622

SEQ ID NO: 513882 - RNA, 64 nt, hsa; identical to SEQ ID NO: 510623

SEQ ID NO: 513883 - RNA, 64 nt, hsa; identical to SEQ ID NO: 510624

SEQ ID NO: 513884 - RNA, 64 nt, hsa; identical to SEQ ID NO: 510625

SEQ ID NO: 513885 - RNA, 64 nt, hsa; identical to SEQ ID NO: 510626

SEQ ID NO: 513886 - RNA, 64 nt, hsa; identical to SEQ ID NO: 510627

SEQ ID NO: 513887 - RNA, 64 nt, hsa; identical to SEQ ID NO: 510628

SEQ ID NO: 513888 - RNA, 64 nt, hsa; identical to SEQ ID NO: 510629

SEQ ID NO: 513889 - RNA, 64 nt, hsa; identical to SEQ ID NO: 510630

SEQ ID NO: 513890 - RNA, 64 nt, hsa; identical to SEQ ID NO: 510631

SEQ ID NO: 513891 - RNA, 64 nt, hsa; identical to SEQ ID NO: 510632

SEQ ID NO: 513892 - RNA, 64 nt, hsa; identical to SEQ ID NO: 510633

SEQ ID NO: 513893 - RNA, 64 nt, hsa; identical to SEQ ID NO: 510634

SEQ ID NO: 513894 - RNA, 64 nt, hsa; identical to SEQ ID NO: 510635

SEQ ID NO: 513895 - RNA, 64 nt, hsa; identical to SEQ ID NO: 510636

SEQ ID NO: 513896 - RNA, 64 nt, hsa; identical to SEQ ID NO: 510637

SEQ ID NO: 513897 - RNA, 64 nt, hsa; identical to SEQ ID NO: 510638

SEQ ID NO: 513898 - RNA, 64 nt, hsa; identical to SEQ ID NO: 510639

SEQ ID NO: 513899 - RNA, 64 nt, hsa; identical to SEQ ID NO: 510640

SEQ ID NO: 513900 - RNA, 64 nt, hsa; identical to SEQ ID NO: 510641

SEQ ID NO: 513901 - RNA, 64 nt, hsa; identical to SEQ ID NO: 510642

SEQ ID NO: 513902 - RNA, 64 nt, hsa; identical to SEQ ID NO: 510643

SEQ ID NO: 513903 - RNA, 64 nt, hsa; identical to SEQ ID NO: 510644

SEQ ID NO: 513904 - RNA, 64 nt, hsa; identical to SEQ ID NO: 510645

SEQ ID NO: 513905 - RNA, 64 nt, hsa; identical to SEQ ID NO: 510646

SEQ ID NO: 513906 - RNA, 64 nt, hsa; identical to SEQ ID NO: 510647

SEQ ID NO: 513907 - RNA, 64 nt, hsa; identical to SEQ ID NO: 510648

SEQ ID NO: 513908 - RNA, 64 nt, hsa; identical to SEQ ID NO: 510649

SEQ ID NO: 513909 - RNA, 64 nt, hsa; identical to SEQ ID NO: 510650

SEQ ID NO: 513910 - RNA, 64 nt, hsa; identical to SEQ ID NO: 510651

SEQ ID NO: 513911 - RNA, 64 nt, hsa; identical to SEQ ID NO: 510652

SEQ ID NO: 513912 - RNA, 64 nt, hsa; identical to SEQ ID NO: 510653

SEQ ID NO: 513913 - RNA, 64 nt, hsa; identical to SEQ ID NO: 510654

SEQ ID NO: 513914 - RNA, 64 nt, hsa; identical to SEQ ID NO: 510655

SEQ ID NO: 513915 - RNA, 64 nt, hsa; identical to SEQ ID NO: 510656

SEQ ID NO: 513916 - RNA, 64 nt, hsa; identical to SEQ ID NO: 510657

SEQ ID NO: 513917 - RNA, 64 nt, hsa; identical to SEQ ID NO: 510658

SEQ ID NO: 513918 - RNA, 64 nt, hsa; identical to SEQ ID NO: 510659

SEQ ID NO: 513919 - RNA, 64 nt, hsa; identical to SEQ ID NO: 510660

SEQ ID NO: 513920 - RNA, 64 nt, hsa; identical to SEQ ID NO: 510661

SEQ ID NO: 513921 - RNA, 64 nt, hsa; identical to SEQ ID NO: 510662

SEQ ID NO: 513922 - RNA, 64 nt, hsa; identical to SEQ ID NO: 510663

SEQ ID NO: 513923 - RNA, 64 nt, hsa; identical to SEQ ID NO: 510664

SEQ ID NO: 513924 - RNA, 64 nt, hsa; identical to SEQ ID NO: 510665

SEQ ID NO: 513925 - RNA, 64 nt, hsa; identical to SEQ ID NO: 510666

SEQ ID NO: 513926 - RNA, 64 nt, hsa; identical to SEQ ID NO: 510667

SEQ ID NO: 513927 - RNA, 64 nt, hsa; identical to SEQ ID NO: 510668

SEQ ID NO: 513928 - RNA, 64 nt, hsa; identical to SEQ ID NO: 510669

SEQ ID NO: 513929 - RNA, 64 nt, hsa; identical to SEQ ID NO: 510670

SEQ ID NO: 513930 - RNA, 64 nt, hsa; identical to SEQ ID NO: 510671

SEQ ID NO: 513931 - RNA, 64 nt, hsa; identical to SEQ ID NO: 510672

SEQ ID NO: 513932 - RNA, 64 nt, hsa; identical to SEQ ID NO: 510673

SEQ ID NO: 513933 - RNA, 64 nt, hsa; identical to SEQ ID NO: 510674

SEQ ID NO: 513934 - RNA, 64 nt, hsa; identical to SEQ ID NO: 510675

SEQ ID NO: 513935 - RNA, 64 nt, hsa; identical to SEQ ID NO: 510676

SEQ ID NO: 513936 - RNA, 64 nt, hsa; identical to SEQ ID NO: 510677

SEQ ID NO: 513937 - RNA, 64 nt, hsa; identical to SEQ ID NO: 510678

SEQ ID NO: 513938 - RNA, 64 nt, hsa; identical to SEQ ID NO: 510679

SEQ ID NO: 513939 - RNA, 64 nt, hsa; identical to SEQ ID NO: 510680

SEQ ID NO: 513940 - RNA, 64 nt, hsa; identical to SEQ ID NO: 510681

SEQ ID NO: 513941 - RNA, 64 nt, hsa; identical to SEQ ID NO: 510682

SEQ ID NO: 513942 - RNA, 64 nt, hsa; identical to SEQ ID NO: 510683

SEQ ID NO: 513943 - RNA, 64 nt, hsa; identical to SEQ ID NO: 510684

SEQ ID NO: 513944 - RNA, 64 nt, hsa; identical to SEQ ID NO: 510685

SEQ ID NO: 513945 - RNA, 64 nt, hsa; identical to SEQ ID NO: 510686

SEQ ID NO: 513946 - RNA, 64 nt, hsa; identical to SEQ ID NO: 510687

SEQ ID NO: 513947 - RNA, 64 nt, hsa; identical to SEQ ID NO: 510688

SEQ ID NO: 513948 - RNA, 64 nt, hsa; identical to SEQ ID NO: 510689

SEQ ID NO: 513949 - RNA, 64 nt, hsa; identical to SEQ ID NO: 510690

SEQ ID NO: 513950 - RNA, 64 nt, hsa; identical to SEQ ID NO: 510691

SEQ ID NO: 513951 - RNA, 64 nt, hsa; identical to SEQ ID NO: 510692

SEQ ID NO: 513952 - RNA, 64 nt, hsa; identical to SEQ ID NO: 510693

SEQ ID NO: 513953 - RNA, 64 nt, hsa; identical to SEQ ID NO: 510694

SEQ ID NO: 513954 - RNA, 64 nt, hsa; identical to SEQ ID NO: 510695

SEQ ID NO: 513955 - RNA, 64 nt, hsa; identical to SEQ ID NO: 510696

SEQ ID NO: 513956 - RNA, 64 nt, hsa; identical to SEQ ID NO: 510697

SEQ ID NO: 513957 - RNA, 64 nt, hsa; identical to SEQ ID NO: 510698

SEQ ID NO: 513958 - RNA, 64 nt, hsa; identical to SEQ ID NO: 510699

SEQ ID NO: 513959 - RNA, 64 nt, hsa; identical to SEQ ID NO: 510700

SEQ ID NO: 513960 - RNA, 64 nt, hsa; identical to SEQ ID NO: 510701

SEQ ID NO: 513961 - RNA, 64 nt, hsa; identical to SEQ ID NO: 510702

SEQ ID NO: 513962 - RNA, 64 nt, hsa; identical to SEQ ID NO: 510703

SEQ ID NO: 513963 - RNA, 64 nt, hsa; identical to SEQ ID NO: 510704

SEQ ID NO: 513964 - RNA, 64 nt, hsa; identical to SEQ ID NO: 510705

SEQ ID NO: 513965 - RNA, 64 nt, hsa; identical to SEQ ID NO: 510706

SEQ ID NO: 513966 - RNA, 64 nt, hsa; identical to SEQ ID NO: 510707

SEQ ID NO: 513967 - RNA, 64 nt, hsa; identical to SEQ ID NO: 510708

SEQ ID NO: 513968 - RNA, 64 nt, hsa; identical to SEQ ID NO: 510709

SEQ ID NO: 513969 - RNA, 64 nt, hsa; identical to SEQ ID NO: 510710

SEQ ID NO: 513970 - RNA, 64 nt, hsa; identical to SEQ ID NO: 510711

SEQ ID NO: 513971 - RNA, 64 nt, hsa; identical to SEQ ID NO: 510712

SEQ ID NO: 513972 - RNA, 64 nt, hsa; identical to SEQ ID NO: 510713

SEQ ID NO: 513973 - RNA, 64 nt, hsa; identical to SEQ ID NO: 510714

SEQ ID NO: 513974 - RNA, 64 nt, hsa; identical to SEQ ID NO: 510715

SEQ ID NO: 513975 - RNA, 64 nt, hsa; identical to SEQ ID NO: 510716

SEQ ID NO: 513976 - RNA, 64 nt, hsa; identical to SEQ ID NO: 510717

SEQ ID NO: 513977 - RNA, 64 nt, hsa; identical to SEQ ID NO: 510718

SEQ ID NO: 513978 - RNA, 64 nt, hsa; identical to SEQ ID NO: 510719

SEQ ID NO: 513979 - RNA, 64 nt, hsa; identical to SEQ ID NO: 510720

SEQ ID NO: 513980 - RNA, 64 nt, hsa; identical to SEQ ID NO: 510721

SEQ ID NO: 513981 - RNA, 64 nt, hsa; identical to SEQ ID NO: 510722

SEQ ID NO: 513982 - RNA, 64 nt, hsa; identical to SEQ ID NO: 510723

SEQ ID NO: 513983 - RNA, 64 nt, hsa; identical to SEQ ID NO: 510724

SEQ ID NO: 513984 - RNA, 64 nt, hsa; identical to SEQ ID NO: 510725

SEQ ID NO: 513985 - RNA, 64 nt, hsa; identical to SEQ ID NO: 510726

SEQ ID NO: 513986 - RNA, 64 nt, hsa; identical to SEQ ID NO: 510727

SEQ ID NO: 513987 - RNA, 64 nt, hsa; identical to SEQ ID NO: 510728

SEQ ID NO: 513988 - RNA, 64 nt, hsa; identical to SEQ ID NO: 510729

SEQ ID NO: 513989 - RNA, 64 nt, hsa; identical to SEQ ID NO: 510730

SEQ ID NO: 513990 - RNA, 64 nt, hsa; identical to SEQ ID NO: 510731

SEQ ID NO: 513991 - RNA, 64 nt, hsa; identical to SEQ ID NO: 510732

SEQ ID NO: 513992 - RNA, 64 nt, hsa; identical to SEQ ID NO: 510733

SEQ ID NO: 513993 - RNA, 64 nt, hsa; identical to SEQ ID NO: 510734

SEQ ID NO: 513994 - RNA, 64 nt, hsa; identical to SEQ ID NO: 510735

SEQ ID NO: 513995 - RNA, 64 nt, hsa; identical to SEQ ID NO: 510736

SEQ ID NO: 513996 - RNA, 64 nt, hsa; identical to SEQ ID NO: 510737

SEQ ID NO: 513997 - RNA, 64 nt, hsa; identical to SEQ ID NO: 510738

SEQ ID NO: 513998 - RNA, 64 nt, hsa; identical to SEQ ID NO: 510739

SEQ ID NO: 513999 - RNA, 64 nt, hsa; identical to SEQ ID NO: 510740

SEQ ID NO: 514000 - RNA, 64 nt, hsa; identical to SEQ ID NO: 510741

SEQ ID NO: 514001 - RNA, 64 nt, hsa; identical to SEQ ID NO: 510742

SEQ ID NO: 514002 - RNA, 64 nt, hsa; identical to SEQ ID NO: 510743

SEQ ID NO: 514003 - RNA, 64 nt, hsa; identical to SEQ ID NO: 510744

SEQ ID NO: 514004 - RNA, 64 nt, hsa; identical to SEQ ID NO: 510745

SEQ ID NO: 514005 - RNA, 64 nt, hsa; identical to SEQ ID NO: 510746

SEQ ID NO: 514006 - RNA, 64 nt, hsa; identical to SEQ ID NO: 510747

SEQ ID NO: 514007 - RNA, 64 nt, hsa; identical to SEQ ID NO: 510748

SEQ ID NO: 514008 - RNA, 64 nt, hsa; identical to SEQ ID NO: 510749

SEQ ID NO: 514009 - RNA, 64 nt, hsa; identical to SEQ ID NO: 510750

SEQ ID NO: 514010 - RNA, 64 nt, hsa; identical to SEQ ID NO: 510751

SEQ ID NO: 514011 - RNA, 64 nt, hsa; identical to SEQ ID NO: 510752

SEQ ID NO: 514012 - RNA, 64 nt, hsa; identical to SEQ ID NO: 510753

SEQ ID NO: 514013 - RNA, 64 nt, hsa; identical to SEQ ID NO: 510754

SEQ ID NO: 514014 - RNA, 64 nt, hsa; identical to SEQ ID NO: 510755

SEQ ID NO: 514015 - RNA, 64 nt, hsa; identical to SEQ ID NO: 510756

SEQ ID NO: 514016 - RNA, 64 nt, hsa; identical to SEQ ID NO: 510757

SEQ ID NO: 514017 - RNA, 64 nt, hsa; identical to SEQ ID NO: 510758

SEQ ID NO: 514018 - RNA, 64 nt, hsa; identical to SEQ ID NO: 510759

SEQ ID NO: 514019 - RNA, 64 nt, hsa; identical to SEQ ID NO: 510760

SEQ ID NO: 514020 - RNA, 64 nt, hsa; identical to SEQ ID NO: 510761

SEQ ID NO: 514021 - RNA, 64 nt, hsa; identical to SEQ ID NO: 510762

SEQ ID NO: 514022 - RNA, 64 nt, hsa; identical to SEQ ID NO: 510763

SEQ ID NO: 514023 - RNA, 64 nt, hsa; identical to SEQ ID NO: 510764

SEQ ID NO: 514024 - RNA, 64 nt, hsa; identical to SEQ ID NO: 510765

SEQ ID NO: 514025 - RNA, 64 nt, hsa; identical to SEQ ID NO: 510766

SEQ ID NO: 514026 - RNA, 64 nt, hsa; identical to SEQ ID NO: 510767

SEQ ID NO: 514027 - RNA, 64 nt, hsa; identical to SEQ ID NO: 510768

SEQ ID NO: 514028 - RNA, 64 nt, hsa; identical to SEQ ID NO: 510769

SEQ ID NO: 514029 - RNA, 64 nt, hsa; identical to SEQ ID NO: 510770

SEQ ID NO: 514030 - RNA, 64 nt, hsa; identical to SEQ ID NO: 510771

SEQ ID NO: 514031 - RNA, 64 nt, hsa; identical to SEQ ID NO: 510772

SEQ ID NO: 514032 - RNA, 64 nt, hsa; identical to SEQ ID NO: 510773

SEQ ID NO: 514033 - RNA, 64 nt, hsa; identical to SEQ ID NO: 510774

SEQ ID NO: 514034 - RNA, 64 nt, hsa; identical to SEQ ID NO: 510775

SEQ ID NO: 514035 - RNA, 64 nt, hsa; identical to SEQ ID NO: 510776

SEQ ID NO: 514036 - RNA, 64 nt, hsa; identical to SEQ ID NO: 510777

SEQ ID NO: 514037 - RNA, 64 nt, hsa; identical to SEQ ID NO: 510778

SEQ ID NO: 514038 - RNA, 64 nt, hsa; identical to SEQ ID NO: 510779

SEQ ID NO: 514039 - RNA, 64 nt, hsa; identical to SEQ ID NO: 510780

SEQ ID NO: 514040 - RNA, 64 nt, hsa; identical to SEQ ID NO: 510781

SEQ ID NO: 514041 - RNA, 64 nt, hsa; identical to SEQ ID NO: 510782

SEQ ID NO: 514042 - RNA, 64 nt, hsa; identical to SEQ ID NO: 510783

SEQ ID NO: 514043 - RNA, 64 nt, hsa; identical to SEQ ID NO: 510784

SEQ ID NO: 514044 - RNA, 64 nt, hsa; identical to SEQ ID NO: 510785

SEQ ID NO: 514045 - RNA, 64 nt, hsa; identical to SEQ ID NO: 510786

SEQ ID NO: 514046 - RNA, 64 nt, hsa; identical to SEQ ID NO: 510787

SEQ ID NO: 514047 - RNA, 64 nt, hsa; identical to SEQ ID NO: 510788

SEQ ID NO: 514048 - RNA, 64 nt, hsa; identical to SEQ ID NO: 510789

SEQ ID NO: 514049 - RNA, 64 nt, hsa; identical to SEQ ID NO: 510790

SEQ ID NO: 514050 - RNA, 64 nt, hsa; identical to SEQ ID NO: 510791

SEQ ID NO: 514051 - RNA, 64 nt, hsa; identical to SEQ ID NO: 510792

SEQ ID NO: 514052 - RNA, 64 nt, hsa; identical to SEQ ID NO: 510793

SEQ ID NO: 514053 - RNA, 64 nt, hsa; identical to SEQ ID NO: 510794

SEQ ID NO: 514054 - RNA, 64 nt, hsa; identical to SEQ ID NO: 510795

SEQ ID NO: 514055 - RNA, 64 nt, hsa; identical to SEQ ID NO: 510796

SEQ ID NO: 514056 - RNA, 64 nt, hsa; identical to SEQ ID NO: 510797

SEQ ID NO: 514057 - RNA, 64 nt, hsa; identical to SEQ ID NO: 510798

SEQ ID NO: 514058 - RNA, 64 nt, hsa; identical to SEQ ID NO: 510799

SEQ ID NO: 514059 - RNA, 64 nt, hsa; identical to SEQ ID NO: 510800

SEQ ID NO: 514060 - RNA, 64 nt, hsa; identical to SEQ ID NO: 510801

SEQ ID NO: 514061 - RNA, 64 nt, hsa; identical to SEQ ID NO: 510802

SEQ ID NO: 514062 - RNA, 64 nt, hsa; identical to SEQ ID NO: 510803

SEQ ID NO: 514063 - RNA, 64 nt, hsa; identical to SEQ ID NO: 510804

SEQ ID NO: 514064 - RNA, 64 nt, hsa; identical to SEQ ID NO: 510805

SEQ ID NO: 514065 - RNA, 64 nt, hsa; identical to SEQ ID NO: 510806

SEQ ID NO: 514066 - RNA, 64 nt, hsa; identical to SEQ ID NO: 510807

SEQ ID NO: 514067 - RNA, 64 nt, hsa; identical to SEQ ID NO: 510808

SEQ ID NO: 514068 - RNA, 64 nt, hsa; identical to SEQ ID NO: 510809

SEQ ID NO: 514069 - RNA, 64 nt, hsa; identical to SEQ ID NO: 510810

SEQ ID NO: 514070 - RNA, 64 nt, hsa; identical to SEQ ID NO: 510811

SEQ ID NO: 514071 - RNA, 64 nt, hsa; identical to SEQ ID NO: 510812

SEQ ID NO: 514072 - RNA, 64 nt, hsa; identical to SEQ ID NO: 510813

SEQ ID NO: 514073 - RNA, 64 nt, hsa; identical to SEQ ID NO: 510814

SEQ ID NO: 514074 - RNA, 64 nt, hsa; identical to SEQ ID NO: 510815

SEQ ID NO: 514075 - RNA, 64 nt, hsa; identical to SEQ ID NO: 510816

SEQ ID NO: 514076 - RNA, 64 nt, hsa
uuuuuuccuuccucuccuacaucucccuuuucccccgauccaaguuguagauggaauagaagcc

SEQ ID NO: 514077 - RNA, 64 nt, hsa
cccccaggacuccuacgaucugguuacugccuggccgauccaaggcuguggagucccagagcca

SEQ ID NO: 514078 - RNA, 64 nt, hsa
ucucuuucucgcauaacuccccaccccuuucuccccgauccacccaggccuuucuguaaauaaa

SEQ ID NO: 514079 - RNA, 64 nt, hsa
uuucuauuuagagaaugcuuaagggauuccaaucccgauccaaaucauaauuuguucuuaagua

SEQ ID NO: 514080 - RNA, 64 nt, hsa
ccuuuggaaacugaaugccauaaucucgaucaaaccgauccagaauaccgaagguauggacagg

SEQ ID NO: 514081 - RNA, 64 nt, hsa
cagggugcagguaacccuuggucuguaagcaccaccgauccagggaucauugucuaaauagguu

SEQ ID NO: 514082 - RNA, 64 nt, hsa
uacaaucaaguuugcuggaaacauuguaucgaaaccgauccaaccuagagaccauuuuuaggau

SEQ ID NO: 514083 - RNA, 64 nt, hsa
ucagcguuguggaucccuagagguggcccccugcccgauccaccguccugaggcagaguguuga

SEQ ID NO: 514084 - RNA, 64 nt, hsa
gccagcagauucggacuccgcugagggcuguuucccgauccauagauggugccuucucgcugua

SEQ ID NO: 514085 - RNA, 64 nt, hsa
agcugccccacagccucagcaucuucagcacuuaccgauccagagccucccggccuucuccggu

SEQ ID NO: 514086 - RNA, 64 nt, hsa
uggcuggggcugggcagagaggguaagcugaucuccgauccacaaauaccaccagcugcuucau

SEQ ID NO: 514087 - RNA, 64 nt, hsa
acuccgaagagauguagacgaugcuuuaaagccuccgauccauguuccauggaagguacaucag

SEQ ID NO: 514088 - RNA, 64 nt, hsa
ccccuucgcaggauucgccgagucuguagccuccccgauccaaguuccuagaccucauggcugu

SEQ ID NO: 514089 - RNA, 64 nt, hsa
uaaauuacaggggacucagaggccgugcuccugaccgauccagacacuauuacuggcuuuuuuu

SEQ ID NO: 514090 - RNA, 64 nt, hsa
uuuaaagaucugguccccuuuaugagaaugcaagccgauccacauccugacuuaagagaucuga

SEQ ID NO: 514091 - RNA, 64 nt, hsa
ugaacaaugggagcacauagcccuguugaccugcccgauccagauucccaggccaggcucccga

SEQ ID NO: 514092 - RNA, 64 nt, hsa
agagauacaacaggaugaauaccaucccccagacccgauccauucagucacgguuccugcagag

SEQ ID NO: 514093 - RNA, 64 nt, hsa
uccaggugcugccacaugacaggcacggugggcaccgauccacagugggccccgccuuccccag

SEQ ID NO: 514094 - RNA, 64 nt, hsa
uaguuacagcgccuccgucucucuccauuguguuccgauccauuucuguguguucccccaaccu

SEQ ID NO: 514095 - RNA, 64 nt, hsa
uguucagagugggguagggguucuccgccguuacccgauccacuccaucccccacccucugagg

SEQ ID NO: 514096 - RNA, 64 nt, hsa
auggcuuuuggcagggacagacuuggacacaaaaccgauccauagaagggcuucccaaaccuug

SEQ ID NO: 514097 - RNA, 64 nt, hsa
ccccaccucccucucggcugugccuuacggagccccgauccaggccuccuguggcuguuggguu

SEQ ID NO: 514098 - RNA, 53 nt, hsa
acgccugccgccugcucugaggcccgauccagugggcaggccaaggccugcug

SEQ ID NO: 514099 - RNA, 64 nt, hsa
cccuccccucucuucuccucccaaccaaaacccuccgauccagccccaggccccucuguaccau

SEQ ID NO: 514100 - RNA, 64 nt, hsa
ugugggggcuggugcuguggcucuuugaguaucaccgauccacccugcagcccucgcugcaguc

SEQ ID NO: 514101 - RNA, 64 nt, hsa
agggauagagacgcagauuucagauguaagaagcccgauccacauugcauaaguggacccagcu

SEQ ID NO: 514102 - RNA, 64 nt, hsa
acagguggcuggagcagcugcuuugcaaccugaucaccuugaguucugagcagggacuaggcuu

SEQ ID NO: 514103 - RNA, 64 nt, hsa
gcagcugugccaggauagcuggguccauucagagcaccuugagaaguguugcagggagguguua

SEQ ID NO: 514104 - RNA, 64 nt, hsa
uccucauggucaaugaacauguucaggaagcgaucaccuugaugcuugaacccaaccccagaca

SEQ ID NO: 514105 - RNA, 64 nt, hsa
uaguuacuuuugccuuucgcucuucuaucacagccaccuugaccuuggguaaaacccaaggucu

SEQ ID NO: 514106 - RNA, 64 nt, hsa
uauccauuacauauuuaguuuuaaaaggaggagucaccuugaauuauuuucugagucaccuuga

SEQ ID NO: 514107 - RNA, 64 nt, hsa
aaaaggaggagucaccuugaauuauuuucugagucaccuugaguuauuugaucucucagccugc

SEQ ID NO: 514108 - RNA, 64 nt, hsa
agcgauugaccugugcuucugacagcccccgagacaccuugaggaggccgcuccuucccagaca

SEQ ID NO: 514109 - RNA, 64 nt, hsa
cguuccccaggggagcuggggaauuccugccaagcaccuugaaugggaggggccucacagaggg

SEQ ID NO: 514110 - RNA, 64 nt, hsa
cugggucacauugcuucuuauccugaacacuugacaccuugaggguagaauuuagcguuugguu

SEQ ID NO: 514111 - RNA, 64 nt, hsa
uuuccuaguuguccuggugcuaacacaggagcuacaccuugauccucuccuggcaugaaaauaa

SEQ ID NO: 514112 - RNA, 64 nt, hsa
aaacuccaagugauaaccagacccaucucuccuccaccuugacaaaagcagauuauaguauaca

SEQ ID NO: 514113 - RNA, 64 nt, hsa
caggacgacaccggguucaggaauauguggcuaucaccuugagcacugacaguggccuuccagg

SEQ ID NO: 514114 - RNA, 64 nt, hsa
aagagcugggcaacagcuggcuugugaaaugagacaccuugaccaauaugcuuuggguggacgg

SEQ ID NO: 514115 - RNA, 64 nt, hsa
ucagggacccaggaacucagcuuccaaacaucugcaccuugaccggacucgccaucccgccgug

SEQ ID NO: 514116 - RNA, 64 nt, hsa
ugucuuccucccgagccauggccucugcuagcuccaccuugaaggagccccccacauccucccc

SEQ ID NO: 514117 - RNA, 64 nt, hsa
ccugagagcuaaaaaacugaaaggaauuuuuccacaccuugaagucacaguguuuuagaguaaa

SEQ ID NO: 514118 - RNA, 64 nt, hsa
uaagcauuaggaaggcuagccaguuauucaauagcaccuugauaaugugggcaaacccuucuac

SEQ ID NO: 514119 - RNA, 64 nt, hsa; identical to SEQ ID NO: 179925

SEQ ID NO: 514120 - RNA, 64 nt, hsa; identical to SEQ ID NO: 179926

SEQ ID NO: 514121 - RNA, 64 nt, hsa; identical to SEQ ID NO: 179927

SEQ ID NO: 514122 - RNA, 64 nt, hsa; identical to SEQ ID NO: 179928

SEQ ID NO: 514123 - RNA, 64 nt, hsa; identical to SEQ ID NO: 179929

SEQ ID NO: 514124 - RNA, 64 nt, hsa; identical to SEQ ID NO: 179930

SEQ ID NO: 514125 - RNA, 64 nt, hsa; identical to SEQ ID NO: 179931

SEQ ID NO: 514126 - RNA, 64 nt, hsa; identical to SEQ ID NO: 179932

SEQ ID NO: 514127 - RNA, 64 nt, hsa; identical to SEQ ID NO: 179933

SEQ ID NO: 514128 - RNA, 64 nt, hsa; identical to SEQ ID NO: 179934

SEQ ID NO: 514129 - RNA, 64 nt, hsa; identical to SEQ ID NO: 179935

SEQ ID NO: 514130 - RNA, 64 nt, hsa; identical to SEQ ID NO: 179936

SEQ ID NO: 514131 - RNA, 64 nt, hsa; identical to SEQ ID NO: 179937

SEQ ID NO: 514132 - RNA, 64 nt, hsa; identical to SEQ ID NO: 179938

SEQ ID NO: 514133 - RNA, 64 nt, hsa; identical to SEQ ID NO: 179939

SEQ ID NO: 514134 - RNA, 64 nt, hsa; identical to SEQ ID NO: 179940

SEQ ID NO: 514135 - RNA, 64 nt, hsa; identical to SEQ ID NO: 179941

SEQ ID NO: 514136 - RNA, 64 nt, hsa; identical to SEQ ID NO: 179942

SEQ ID NO: 514137 - RNA, 64 nt, hsa; identical to SEQ ID NO: 179943

SEQ ID NO: 514138 - RNA, 64 nt, hsa; identical to SEQ ID NO: 439551

SEQ ID NO: 514139 - RNA, 64 nt, hsa; identical to SEQ ID NO: 439552

SEQ ID NO: 514140 - RNA, 64 nt, hsa; identical to SEQ ID NO: 439553

SEQ ID NO: 514141 - RNA, 64 nt, hsa; identical to SEQ ID NO: 439554

SEQ ID NO: 514142 - RNA, 64 nt, hsa; identical to SEQ ID NO: 439555

SEQ ID NO: 514143 - RNA, 64 nt, hsa; identical to SEQ ID NO: 439556

SEQ ID NO: 514144 - RNA, 64 nt, hsa; identical to SEQ ID NO: 439557

SEQ ID NO: 514145 - RNA, 64 nt, hsa; identical to SEQ ID NO: 439558

SEQ ID NO: 514146 - RNA, 64 nt, hsa; identical to SEQ ID NO: 439559

SEQ ID NO: 514147 - RNA, 64 nt, hsa; identical to SEQ ID NO: 439560

SEQ ID NO: 514148 - RNA, 64 nt, hsa; identical to SEQ ID NO: 439561

SEQ ID NO: 514149 - RNA, 64 nt, hsa; identical to SEQ ID NO: 439562

SEQ ID NO: 514150 - RNA, 64 nt, hsa; identical to SEQ ID NO: 439563

SEQ ID NO: 514151 - RNA, 64 nt, hsa; identical to SEQ ID NO: 439564

SEQ ID NO: 514152 - RNA, 64 nt, hsa; identical to SEQ ID NO: 439565

SEQ ID NO: 514153 - RNA, 64 nt, hsa; identical to SEQ ID NO: 439566

SEQ ID NO: 514154 - RNA, 64 nt, hsa; identical to SEQ ID NO: 439567

SEQ ID NO: 514155 - RNA, 64 nt, hsa; identical to SEQ ID NO: 439568

SEQ ID NO: 514156 - RNA, 64 nt, hsa; identical to SEQ ID NO: 439569

SEQ ID NO: 514157 - RNA, 64 nt, hsa; identical to SEQ ID NO: 439570

SEQ ID NO: 514158 - RNA, 64 nt, hsa; identical to SEQ ID NO: 439571

SEQ ID NO: 514159 - RNA, 64 nt, hsa; identical to SEQ ID NO: 439572

SEQ ID NO: 514160 - RNA, 64 nt, hsa; identical to SEQ ID NO: 439573

SEQ ID NO: 514161 - RNA, 64 nt, hsa; identical to SEQ ID NO: 439574

SEQ ID NO: 514162 - RNA, 64 nt, hsa; identical to SEQ ID NO: 439575

SEQ ID NO: 514163 - RNA, 64 nt, hsa; identical to SEQ ID NO: 439576

SEQ ID NO: 514164 - RNA, 64 nt, hsa; identical to SEQ ID NO: 439577

SEQ ID NO: 514165 - RNA, 64 nt, hsa; identical to SEQ ID NO: 439578

SEQ ID NO: 514166 - RNA, 64 nt, hsa; identical to SEQ ID NO: 439579

SEQ ID NO: 514167 - RNA, 64 nt, hsa; identical to SEQ ID NO: 439580

SEQ ID NO: 514168 - RNA, 64 nt, hsa; identical to SEQ ID NO: 439581

SEQ ID NO: 514169 - RNA, 64 nt, hsa; identical to SEQ ID NO: 439582

SEQ ID NO: 514170 - RNA, 64 nt, hsa; identical to SEQ ID NO: 439583

SEQ ID NO: 514171 - RNA, 64 nt, hsa; identical to SEQ ID NO: 439584

SEQ ID NO: 514172 - RNA, 64 nt, hsa; identical to SEQ ID NO: 439585

SEQ ID NO: 514173 - RNA, 64 nt, hsa; identical to SEQ ID NO: 439586

SEQ ID NO: 514174 - RNA, 64 nt, hsa; identical to SEQ ID NO: 439587

SEQ ID NO: 514175 - RNA, 64 nt, hsa; identical to SEQ ID NO: 439588

SEQ ID NO: 514176 - RNA, 64 nt, hsa; identical to SEQ ID NO: 439589

SEQ ID NO: 514177 - RNA, 64 nt, hsa; identical to SEQ ID NO: 439590

SEQ ID NO: 514178 - RNA, 64 nt, hsa; identical to SEQ ID NO: 439591

SEQ ID NO: 514179 - RNA, 64 nt, hsa; identical to SEQ ID NO: 439592

SEQ ID NO: 514180 - RNA, 64 nt, hsa; identical to SEQ ID NO: 439593

SEQ ID NO: 514181 - RNA, 64 nt, hsa; identical to SEQ ID NO: 439594

SEQ ID NO: 514182 - RNA, 64 nt, hsa; identical to SEQ ID NO: 439595

SEQ ID NO: 514183 - RNA, 64 nt, hsa; identical to SEQ ID NO: 439596

SEQ ID NO: 514184 - RNA, 64 nt, hsa; identical to SEQ ID NO: 439597

SEQ ID NO: 514185 - RNA, 64 nt, hsa; identical to SEQ ID NO: 439598

SEQ ID NO: 514186 - RNA, 64 nt, hsa; identical to SEQ ID NO: 179925

SEQ ID NO: 514187 - RNA, 64 nt, hsa; identical to SEQ ID NO: 179926

SEQ ID NO: 514188 - RNA, 64 nt, hsa; identical to SEQ ID NO: 179927

SEQ ID NO: 514189 - RNA, 64 nt, hsa; identical to SEQ ID NO: 179928

SEQ ID NO: 514190 - RNA, 64 nt, hsa; identical to SEQ ID NO: 179929

SEQ ID NO: 514191 - RNA, 64 nt, hsa; identical to SEQ ID NO: 179930

SEQ ID NO: 514192 - RNA, 64 nt, hsa; identical to SEQ ID NO: 179931

SEQ ID NO: 514193 - RNA, 64 nt, hsa; identical to SEQ ID NO: 179932

SEQ ID NO: 514194 - RNA, 64 nt, hsa; identical to SEQ ID NO: 179933

SEQ ID NO: 514195 - RNA, 64 nt, hsa; identical to SEQ ID NO: 179934

SEQ ID NO: 514196 - RNA, 64 nt, hsa; identical to SEQ ID NO: 179935

SEQ ID NO: 514197 - RNA, 64 nt, hsa; identical to SEQ ID NO: 179936

SEQ ID NO: 514198 - RNA, 64 nt, hsa; identical to SEQ ID NO: 179937

SEQ ID NO: 514199 - RNA, 64 nt, hsa; identical to SEQ ID NO: 179938

SEQ ID NO: 514200 - RNA, 64 nt, hsa; identical to SEQ ID NO: 179939

SEQ ID NO: 514201 - RNA, 64 nt, hsa; identical to SEQ ID NO: 179940

SEQ ID NO: 514202 - RNA, 64 nt, hsa; identical to SEQ ID NO: 179941

SEQ ID NO: 514203 - RNA, 64 nt, hsa; identical to SEQ ID NO: 179942

SEQ ID NO: 514204 - RNA, 64 nt, hsa; identical to SEQ ID NO: 179943

SEQ ID NO: 514205 - RNA, 64 nt, hsa; identical to SEQ ID NO: 439551

SEQ ID NO: 514206 - RNA, 64 nt, hsa; identical to SEQ ID NO: 439552

SEQ ID NO: 514207 - RNA, 64 nt, hsa; identical to SEQ ID NO: 439553

SEQ ID NO: 514208 - RNA, 64 nt, hsa; identical to SEQ ID NO: 439554

SEQ ID NO: 514209 - RNA, 64 nt, hsa; identical to SEQ ID NO: 439555

SEQ ID NO: 514210 - RNA, 64 nt, hsa; identical to SEQ ID NO: 439556

SEQ ID NO: 514211 - RNA, 64 nt, hsa; identical to SEQ ID NO: 439557

SEQ ID NO: 514212 - RNA, 64 nt, hsa; identical to SEQ ID NO: 439558

SEQ ID NO: 514213 - RNA, 64 nt, hsa; identical to SEQ ID NO: 439559

SEQ ID NO: 514214 - RNA, 64 nt, hsa; identical to SEQ ID NO: 439560

SEQ ID NO: 514215 - RNA, 64 nt, hsa; identical to SEQ ID NO: 439561

SEQ ID NO: 514216 - RNA, 64 nt, hsa; identical to SEQ ID NO: 439562

SEQ ID NO: 514217 - RNA, 64 nt, hsa; identical to SEQ ID NO: 439563

SEQ ID NO: 514218 - RNA, 64 nt, hsa; identical to SEQ ID NO: 439564

SEQ ID NO: 514219 - RNA, 64 nt, hsa; identical to SEQ ID NO: 439565

SEQ ID NO: 514220 - RNA, 64 nt, hsa; identical to SEQ ID NO: 439566

SEQ ID NO: 514221 - RNA, 64 nt, hsa; identical to SEQ ID NO: 439567

SEQ ID NO: 514222 - RNA, 64 nt, hsa; identical to SEQ ID NO: 439568

SEQ ID NO: 514223 - RNA, 64 nt, hsa; identical to SEQ ID NO: 439569

SEQ ID NO: 514224 - RNA, 64 nt, hsa; identical to SEQ ID NO: 439570

SEQ ID NO: 514225 - RNA, 64 nt, hsa; identical to SEQ ID NO: 439571

SEQ ID NO: 514226 - RNA, 64 nt, hsa; identical to SEQ ID NO: 439572

SEQ ID NO: 514227 - RNA, 64 nt, hsa; identical to SEQ ID NO: 439573

SEQ ID NO: 514228 - RNA, 64 nt, hsa; identical to SEQ ID NO: 439574

SEQ ID NO: 514229 - RNA, 64 nt, hsa; identical to SEQ ID NO: 439575

SEQ ID NO: 514230 - RNA, 64 nt, hsa; identical to SEQ ID NO: 439576

SEQ ID NO: 514231 - RNA, 64 nt, hsa; identical to SEQ ID NO: 439577

SEQ ID NO: 514232 - RNA, 64 nt, hsa; identical to SEQ ID NO: 439578

SEQ ID NO: 514233 - RNA, 64 nt, hsa; identical to SEQ ID NO: 439579

SEQ ID NO: 514234 - RNA, 64 nt, hsa; identical to SEQ ID NO: 439580

SEQ ID NO: 514235 - RNA, 64 nt, hsa; identical to SEQ ID NO: 439581

SEQ ID NO: 514236 - RNA, 64 nt, hsa; identical to SEQ ID NO: 439582

SEQ ID NO: 514237 - RNA, 64 nt, hsa; identical to SEQ ID NO: 439583

SEQ ID NO: 514238 - RNA, 64 nt, hsa; identical to SEQ ID NO: 439584

SEQ ID NO: 514239 - RNA, 64 nt, hsa; identical to SEQ ID NO: 439585

SEQ ID NO: 514240 - RNA, 64 nt, hsa; identical to SEQ ID NO: 439586

SEQ ID NO: 514241 - RNA, 64 nt, hsa; identical to SEQ ID NO: 439587

SEQ ID NO: 514242 - RNA, 64 nt, hsa; identical to SEQ ID NO: 439588

SEQ ID NO: 514243 - RNA, 64 nt, hsa; identical to SEQ ID NO: 439589

SEQ ID NO: 514244 - RNA, 64 nt, hsa; identical to SEQ ID NO: 439590

SEQ ID NO: 514245 - RNA, 64 nt, hsa; identical to SEQ ID NO: 439591

SEQ ID NO: 514246 - RNA, 64 nt, hsa; identical to SEQ ID NO: 439592

SEQ ID NO: 514247 - RNA, 64 nt, hsa; identical to SEQ ID NO: 439593

SEQ ID NO: 514248 - RNA, 64 nt, hsa; identical to SEQ ID NO: 439594

SEQ ID NO: 514249 - RNA, 64 nt, hsa; identical to SEQ ID NO: 439595

SEQ ID NO: 514250 - RNA, 64 nt, hsa; identical to SEQ ID NO: 439596

SEQ ID NO: 514251 - RNA, 64 nt, hsa; identical to SEQ ID NO: 439597

SEQ ID NO: 514252 - RNA, 64 nt, hsa; identical to SEQ ID NO: 439598

SEQ ID NO: 514253 - RNA, 64 nt, hsa
cggguuuggggagggagcacucugggacugugagacaaggaagcagggccagcagugagacuau

SEQ ID NO: 514254 - RNA, 64 nt, hsa
aguggagcaugaggagggagcaguccagaugccaacaaggaaaugcguuuauggcuacaagagu

SEQ ID NO: 514255 - RNA, 64 nt, hsa
aaaccucaguguuuuuccucugcugguuuggggcacaaggaagccuuaggguauggggaaaggc

SEQ ID NO: 514256 - RNA, 64 nt, hsa
uuagaaggcccuggaagggaagugaggaggagggacaaggaagaugacuaguuacggaggguga

SEQ ID NO: 514257 - RNA, 64 nt, hsa
aaacagcuuauguuuacauaaaauuuuaucauucacaaggaaguuuuaagcacacugucucauu

SEQ ID NO: 514258 - RNA, 64 nt, hsa
auggauuagcuauaaaaaaugucaauaagauuguacaaggaaaauuagagaaagucacauuuag

SEQ ID NO: 514259 - RNA, 64 nt, hsa
gacgugguuuuagagucuaccuaauauguuaaggacaaggaaaccucugagucuaccuaauaug

SEQ ID NO: 514260 - RNA, 64 nt, hsa
aaggaaaccucugagucuaccuaauauguuaaggacaaggaaaccucuggacagugguauauug

SEQ ID NO: 514261 - RNA, 64 nt, hsa
uuuugaaaaauuacagcuucacccugucaaguuaacaaggaaugccugugccaauaaaaguuuu

SEQ ID NO: 514262 - RNA, 64 nt, hsa
aggaguuguuucugacccacugaucucuacuaccacaaggaaaauaguuuaggagaaaccagcu

SEQ ID NO: 514263 - RNA, 64 nt, hsa
ggaagccaaaguuuucaaacugcugcauacuuugacaaggaaaaucuauauuugucuuccgauc

SEQ ID NO: 514264 - RNA, 64 nt, hsa
ggugcuuggugagucuugguucuaaagguaccaaacaaggaagccaaaguuuucaaacugcugc

SEQ ID NO: 514265 - RNA, 64 nt, hsa
gauuuugggauauuaaaaguuaacagaacacugaacaaggaaagaauggcauagaucuaucuuu

SEQ ID NO: 514266 - RNA, 64 nt, hsa
gccugaagauucuuucuucugaaagccaagcaccacaaggaaaaaaaaaauuauuaauagcuca

SEQ ID NO: 514267 - RNA, 64 nt, hsa
ugacauuuaucagcaaaucucuugcaagaacagcacaaggaaaaucagucuaauaagcugcucu

SEQ ID NO: 514268 - RNA, 64 nt, hsa
agcaguguaaguuguauauuacuguuucuuauguacaaggaacaacaauaaaucauauggaaau

SEQ ID NO: 514269 - RNA, 64 nt, hsa
cccaccuccaguccccuggacaaucggguacaagagacuuaagguugggcaugggaaggguggg

SEQ ID NO: 514270 - RNA, 64 nt, hsa
cauucaucgcucucaaaauuagcuucagugacaaagacuuaaaucucucuccuaucugcagcac

SEQ ID NO: 514271 - RNA, 64 nt, hsa
guuccugugauguaacuguaagccuucucgacuuagacuuaaaaaguggucacauagauuaauu

SEQ ID NO: 514272 - RNA, 64 nt, hsa
uaacuguugaacucaugaaagaagauaguguaugagacuuaagccaugaguuuuguaucauuuc

SEQ ID NO: 514273 - RNA, 64 nt, hsa
aucuuuggauuucagucuugauguuuguucuaucagacuuaaccuuuuauuuccuguccuuccu

SEQ ID NO: 514274 - RNA, 64 nt, hsa
gacuuuuagauuuagugaagaugguaggguggaaagacuuaauuuccuuguugagaacaggaaa

SEQ ID NO: 514275 - RNA, 64 nt, hsa
agcacaauuuccacacugugaaggcaguauuagaagacuuaauuguaaaagcucucuugucacu

SEQ ID NO: 514276 - RNA, 64 nt, hsa
uuaauuugaguuccaacuguuaagcauauuucucagacuuaaauuugauuauguccccaucaaa

SEQ ID NO: 514277 - RNA, 64 nt, hsa
uaauuuaaauuugaugcaauuuaaauauaacaggagacuuaaaauauuuuauuauaaauuagau

SEQ ID NO: 514278 - RNA, 64 nt, hsa
uuccauuuucaaacuucuaucauauuuguauauuagacuuaauagcaaagcauauuuauugaac

SEQ ID NO: 514279 - RNA, 64 nt, hsa
uuucugcucgacucgccccugauuuucaaguucaagacuuaacucaggguucaggucuuccagg

SEQ ID NO: 514280 - RNA, 64 nt, hsa
ucucuccagucccguuguuauagucuucacucauagacuuaagaugaucccaucaccagagagg

SEQ ID NO: 514281 - RNA, 64 nt, hsa
uaagaaacacucguuuguuguuuuuaaaggcaacagacuuaaaguuguccucagccaaggaaaa

SEQ ID NO: 514282 - RNA, 64 nt, hsa
uuuuaaaaauucauaacagcaaccuugaaaaaauagacuuaaaugaaugcuucuagaaacuucc

SEQ ID NO: 514283 - RNA, 64 nt, hsa
ccugccacugcacuccagccugggcgcaagaccaagacuuaaacgcaaaaaaaaaaaaaaaaaa

SEQ ID NO: 514284 - RNA, 64 nt, hsa
ucuaaaauguaagucaaauauguuuuaauaacaaagacuuaaauggcuuuucucccuagagacu

SEQ ID NO: 514285 - RNA, 64 nt, hsa
uguucuuaaaaugcuuuaaccuugaaguugcuugagacuuaagaggucauguugcuuuagguuu

SEQ ID NO: 514286 - RNA, 64 nt, hsa
uuaacugucaguauuuugggggcauuagguuaauagacuuaauugccuagguacaagcaggacu

SEQ ID NO: 514287 - RNA, 64 nt, hsa
uuuuuaagugugaaugcaagugauuaaugaauacagacuuaacaagugugguucuaaaguuccu

SEQ ID NO: 514288 - RNA, 64 nt, hsa
uacucucccauuaaagaggaagagaagauuuuaaagacuuaaugaugucuuauugggcauaaaa

SEQ ID NO: 514289 - RNA, 64 nt, hsa
ugucauaaagcuucaccaaucaagucccaugaaaagacuuaauguaacaacucuucugucauag

SEQ ID NO: 514290 - RNA, 64 nt, hsa
cacgauauacaaaaaucaacucaagauggauuaaagacuuaaauauaaaaccuaaaaguauuaa

SEQ ID NO: 514291 - RNA, 64 nt, hsa
caggaaaugccauucuggacauaagugcuggaaaagacuuaaugaugaacaccccaaagcaauu

SEQ ID NO: 514292 - RNA, 64 nt, hsa
ugccuccauuauuuccuccacaguuuugguauuugucagacauuuguucugcugucuuucuaau

SEQ ID NO: 514293 - RNA, 64 nt, hsa
gauuaucaaagcuaauuugacuaguuugaaccucgucagacauucauuccuuuggccauugcca

SEQ ID NO: 514294 - RNA, 64 nt, hsa
gaagagguuugagacaggcggcauccugcacugagucagacaagugggagcuguaggaacugca

SEQ ID NO: 514295 - RNA, 64 nt, hsa
gcuuucucaccagguucagcaaggaggccugggggucagacaccaauguugagcaccuccugag

SEQ ID NO: 514296 - RNA, 64 nt, hsa
auccuuuuaucacacuccucucaagcaagcuauagucagacagaugaugaaaguaacaugaaaa

SEQ ID NO: 514297 - RNA, 64 nt, hsa
gggcggcuguacgauguucacaugucugcguuuggucagacaucaucuccuuggcugcccuuug

SEQ ID NO: 514298 - RNA, 64 nt, hsa
cugucaccuacccucccugcagcucaggaaggcugucagacaggcugggggccucacucuguuu

SEQ ID NO: 514299 - RNA, 64 nt, hsa
ugggggagggagggacagagacccagagggcagcgucagacacccagaguuggagacagaacaa

SEQ ID NO: 514300 - RNA, 64 nt, hsa; identical to SEQ ID NO: 444750

SEQ ID NO: 514301 - RNA, 64 nt, hsa; identical to SEQ ID NO: 444751

SEQ ID NO: 514302 - RNA, 64 nt, hsa; identical to SEQ ID NO: 444752

SEQ ID NO: 514303 - RNA, 64 nt, hsa; identical to SEQ ID NO: 444753

SEQ ID NO: 514304 - RNA, 60 nt, hsa; identical to SEQ ID NO: 444754

SEQ ID NO: 514305 - RNA, 64 nt, hsa; identical to SEQ ID NO: 444755

SEQ ID NO: 514306 - RNA, 64 nt, hsa; identical to SEQ ID NO: 444756

SEQ ID NO: 514307 - RNA, 64 nt, hsa; identical to SEQ ID NO: 444757

SEQ ID NO: 514308 - RNA, 64 nt, hsa; identical to SEQ ID NO: 444758

SEQ ID NO: 514309 - RNA, 64 nt, hsa; identical to SEQ ID NO: 444759

SEQ ID NO: 514310 - RNA, 64 nt, hsa; identical to SEQ ID NO: 444760

SEQ ID NO: 514311 - RNA, 64 nt, hsa; identical to SEQ ID NO: 444761

SEQ ID NO: 514312 - RNA, 52 nt, hsa; identical to SEQ ID NO: 444762

SEQ ID NO: 514313 - RNA, 64 nt, hsa; identical to SEQ ID NO: 444763

SEQ ID NO: 514314 - RNA, 64 nt, hsa; identical to SEQ ID NO: 444764

SEQ ID NO: 514315 - RNA, 64 nt, hsa; identical to SEQ ID NO: 444765

SEQ ID NO: 514316 - RNA, 64 nt, hsa; identical to SEQ ID NO: 444766

SEQ ID NO: 514317 - RNA, 64 nt, hsa; identical to SEQ ID NO: 444767

SEQ ID NO: 514318 - RNA, 64 nt, hsa; identical to SEQ ID NO: 444768

SEQ ID NO: 514319 - RNA, 64 nt, hsa; identical to SEQ ID NO: 444769

SEQ ID NO: 514320 - RNA, 64 nt, hsa; identical to SEQ ID NO: 444770

SEQ ID NO: 514321 - RNA, 64 nt, hsa; identical to SEQ ID NO: 444771

SEQ ID NO: 514322 - RNA, 64 nt, hsa; identical to SEQ ID NO: 444772

SEQ ID NO: 514323 - RNA, 64 nt, hsa; identical to SEQ ID NO: 444773

SEQ ID NO: 514324 - RNA, 64 nt, hsa; identical to SEQ ID NO: 444774

SEQ ID NO: 514325 - RNA, 64 nt, hsa; identical to SEQ ID NO: 444775

SEQ ID NO: 514326 - RNA, 64 nt, hsa; identical to SEQ ID NO: 444776

SEQ ID NO: 514327 - RNA, 64 nt, hsa; identical to SEQ ID NO: 444777

SEQ ID NO: 514328 - RNA, 64 nt, hsa; identical to SEQ ID NO: 444778

SEQ ID NO: 514329 - RNA, 64 nt, hsa; identical to SEQ ID NO: 444779

SEQ ID NO: 514330 - RNA, 64 nt, hsa; identical to SEQ ID NO: 444780

SEQ ID NO: 514331 - RNA, 64 nt, hsa; identical to SEQ ID NO: 444781

SEQ ID NO: 514332 - RNA, 64 nt, hsa; identical to SEQ ID NO: 444782

SEQ ID NO: 514333 - RNA, 64 nt, hsa; identical to SEQ ID NO: 444783

SEQ ID NO: 514334 - RNA, 64 nt, hsa; identical to SEQ ID NO: 444784

SEQ ID NO: 514335 - RNA, 64 nt, hsa; identical to SEQ ID NO: 444785

SEQ ID NO: 514336 - RNA, 64 nt, hsa; identical to SEQ ID NO: 444786

SEQ ID NO: 514337 - RNA, 64 nt, hsa; identical to SEQ ID NO: 444787

SEQ ID NO: 514338 - RNA, 64 nt, hsa; identical to SEQ ID NO: 444788

SEQ ID NO: 514339 - RNA, 60 nt, hsa; identical to SEQ ID NO: 444789

SEQ ID NO: 514340 - RNA, 64 nt, hsa; identical to SEQ ID NO: 444790

SEQ ID NO: 514341 - RNA, 64 nt, hsa; identical to SEQ ID NO: 444791

SEQ ID NO: 514342 - RNA, 64 nt, hsa; identical to SEQ ID NO: 444792

SEQ ID NO: 514343 - RNA, 64 nt, hsa; identical to SEQ ID NO: 444793

SEQ ID NO: 514344 - RNA, 64 nt, hsa; identical to SEQ ID NO: 444794

SEQ ID NO: 514345 - RNA, 64 nt, hsa; identical to SEQ ID NO: 444795

SEQ ID NO: 514346 - RNA, 64 nt, hsa; identical to SEQ ID NO: 444796

SEQ ID NO: 514347 - RNA, 64 nt, hsa; identical to SEQ ID NO: 444797

SEQ ID NO: 514348 - RNA, 64 nt, hsa; identical to SEQ ID NO: 444798

SEQ ID NO: 514349 - RNA, 64 nt, hsa; identical to SEQ ID NO: 444799

SEQ ID NO: 514350 - RNA, 64 nt, hsa; identical to SEQ ID NO: 444800

SEQ ID NO: 514351 - RNA, 64 nt, hsa; identical to SEQ ID NO: 444801

SEQ ID NO: 514352 - RNA, 64 nt, hsa; identical to SEQ ID NO: 444802

SEQ ID NO: 514353 - RNA, 64 nt, hsa; identical to SEQ ID NO: 444803

SEQ ID NO: 514354 - RNA, 64 nt, hsa; identical to SEQ ID NO: 444804

SEQ ID NO: 514355 - RNA, 64 nt, hsa; identical to SEQ ID NO: 444805

SEQ ID NO: 514356 - RNA, 64 nt, hsa; identical to SEQ ID NO: 444806

SEQ ID NO: 514357 - RNA, 60 nt, hsa; identical to SEQ ID NO: 444807

SEQ ID NO: 514358 - RNA, 64 nt, hsa; identical to SEQ ID NO: 444808

SEQ ID NO: 514359 - RNA, 64 nt, hsa; identical to SEQ ID NO: 444809

SEQ ID NO: 514360 - RNA, 64 nt, hsa; identical to SEQ ID NO: 444810

SEQ ID NO: 514361 - RNA, 64 nt, hsa; identical to SEQ ID NO: 444811

SEQ ID NO: 514362 - RNA, 64 nt, hsa; identical to SEQ ID NO: 444812

SEQ ID NO: 514363 - RNA, 51 nt, hsa; identical to SEQ ID NO: 444813

SEQ ID NO: 514364 - RNA, 64 nt, hsa; identical to SEQ ID NO: 444814

SEQ ID NO: 514365 - RNA, 64 nt, hsa; identical to SEQ ID NO: 444815

SEQ ID NO: 514366 - RNA, 64 nt, hsa; identical to SEQ ID NO: 444816

SEQ ID NO: 514367 - RNA, 64 nt, hsa; identical to SEQ ID NO: 444817

SEQ ID NO: 514368 - RNA, 64 nt, hsa; identical to SEQ ID NO: 444818

SEQ ID NO: 514369 - RNA, 62 nt, hsa; identical to SEQ ID NO: 444819

SEQ ID NO: 514370 - RNA, 64 nt, hsa; identical to SEQ ID NO: 444820

SEQ ID NO: 514371 - RNA, 64 nt, hsa; identical to SEQ ID NO: 444821

SEQ ID NO: 514372 - RNA, 64 nt, hsa; identical to SEQ ID NO: 444822

SEQ ID NO: 514373 - RNA, 64 nt, hsa; identical to SEQ ID NO: 444823

SEQ ID NO: 514374 - RNA, 64 nt, hsa; identical to SEQ ID NO: 444824

SEQ ID NO: 514375 - RNA, 64 nt, hsa; identical to SEQ ID NO: 444825

SEQ ID NO: 514376 - RNA, 64 nt, hsa; identical to SEQ ID NO: 444826

SEQ ID NO: 514377 - RNA, 64 nt, hsa; identical to SEQ ID NO: 444827

SEQ ID NO: 514378 - RNA, 64 nt, hsa; identical to SEQ ID NO: 444828

SEQ ID NO: 514379 - RNA, 64 nt, hsa; identical to SEQ ID NO: 444829

SEQ ID NO: 514380 - RNA, 64 nt, hsa; identical to SEQ ID NO: 444830

SEQ ID NO: 514381 - RNA, 64 nt, hsa; identical to SEQ ID NO: 444831

SEQ ID NO: 514382 - RNA, 64 nt, hsa; identical to SEQ ID NO: 444832

SEQ ID NO: 514383 - RNA, 64 nt, hsa; identical to SEQ ID NO: 444833

SEQ ID NO: 514384 - RNA, 64 nt, hsa; identical to SEQ ID NO: 444834

SEQ ID NO: 514385 - RNA, 64 nt, hsa; identical to SEQ ID NO: 444835

SEQ ID NO: 514386 - RNA, 64 nt, hsa; identical to SEQ ID NO: 444836

SEQ ID NO: 514387 - RNA, 64 nt, hsa; identical to SEQ ID NO: 444837

SEQ ID NO: 514388 - RNA, 64 nt, hsa; identical to SEQ ID NO: 444838

SEQ ID NO: 514389 - RNA, 64 nt, hsa; identical to SEQ ID NO: 444839

SEQ ID NO: 514390 - RNA, 64 nt, hsa; identical to SEQ ID NO: 444840

SEQ ID NO: 514391 - RNA, 64 nt, hsa; identical to SEQ ID NO: 444841

SEQ ID NO: 514392 - RNA, 64 nt, hsa; identical to SEQ ID NO: 444842

SEQ ID NO: 514393 - RNA, 64 nt, hsa; identical to SEQ ID NO: 444843

SEQ ID NO: 514394 - RNA, 64 nt, hsa; identical to SEQ ID NO: 444844

SEQ ID NO: 514395 - RNA, 64 nt, hsa; identical to SEQ ID NO: 444845

SEQ ID NO: 514396 - RNA, 64 nt, hsa; identical to SEQ ID NO: 444846

SEQ ID NO: 514397 - RNA, 64 nt, hsa; identical to SEQ ID NO: 444847

SEQ ID NO: 514398 - RNA, 64 nt, hsa; identical to SEQ ID NO: 444848

SEQ ID NO: 514399 - RNA, 64 nt, hsa; identical to SEQ ID NO: 444849

SEQ ID NO: 514400 - RNA, 64 nt, hsa; identical to SEQ ID NO: 444850

SEQ ID NO: 514401 - RNA, 64 nt, hsa; identical to SEQ ID NO: 444851

SEQ ID NO: 514402 - RNA, 64 nt, hsa; identical to SEQ ID NO: 444852

SEQ ID NO: 514403 - RNA, 64 nt, hsa
uaggugaaugucccuaaguguuuacuguuuuuauccagucaaggauuugcuuuuccuugaacau

SEQ ID NO: 514404 - RNA, 64 nt, hsa
gagcuuugguuuucuaauguauuauccccacuugccagucaacuggaccccuuccuccucgguu

SEQ ID NO: 514405 - RNA, 64 nt, hsa
ggacugucguggcuccccucaucagcuccccacaccagucaaggcuucucagcuggagaaccgg

SEQ ID NO: 514406 - RNA, 64 nt, hsa
aucagagaagaggaaguaaaggacaaucagaacaccagucaaacccaccaaauugcuuuauucc

SEQ ID NO: 514407 - RNA, 64 nt, hsa
caacuuaagcuugacuugggguuuguagcgggacccagucaaaccccauucaggucaugguaga

SEQ ID NO: 514408 - RNA, 64 nt, hsa
uauggggaaaagagaauuugggguguucugcaagccagucaaaguggcacagcaaaucauauaa

SEQ ID NO: 514409 - RNA, 64 nt, hsa
agauuggucauacauucccaauuuacucucaguuccagucaagcugguugcucugaaaguaacc

SEQ ID NO: 514410 - RNA, 64 nt, hsa
uuuucugauucaaaagugaacuugauuuuaaaaaccagucaagagcaaucaaagcagcacaugg

SEQ ID NO: 514411 - RNA, 64 nt, hsa
agagugaggaaauuguccuguagucuauugaaaaccagucaaggugguuuuaguucauagauuu

SEQ ID NO: 514412 - RNA, 64 nt, hsa
cucguucaucccuggugcuugagccccucaagcuccagucaaugauccaguccuuccccuuuga

SEQ ID NO: 514413 - RNA, 64 nt, hsa
uacuuaacuuuacauuccucuuauuuuucaguuuccagucaagauuauaaaaagcaaaugauug

SEQ ID NO: 514414 - RNA, 64 nt, hsa
gccugagauauuuuucuacagcuucauagagcaaccagucaaaaccagagcgagaacccucaac

SEQ ID NO: 514415 - RNA, 64 nt, hsa
aggaauauuacagcuguaaauuauaugagacuugccagucaaaugcuauuugguuuaaaaaaau

SEQ ID NO: 514416 - RNA, 64 nt, hsa
ggauucaucaauaucaugagcacuuuugcugguuccagucaaaucaauggcauuuaauaaauuu

SEQ ID NO: 514417 - RNA, 64 nt, hsa
ccgugacaacugccaugucacaagaaaauaccugccagucaacagguaccucguucuuauccuu

SEQ ID NO: 514418 - RNA, 64 nt, hsa
uauccuugaggucauccauauucuuacaggccuuccagucaauaauggaagagcucacucuaua

SEQ ID NO: 514419 - RNA, 64 nt, hsa
uacuuucacaauuucccuucauauggauaugauuccagucaaaaauaaaaugcacaccaaaaug

SEQ ID NO: 514420 - RNA, 64 nt, hsa
guguuuucuuuugaaacuguaaugaauauguuugccagucaaauggcuucaugagaacaguaga

SEQ ID NO: 514421 - RNA, 64 nt, hsa
uggcuccagagauggucacaugacccaggccuggccagucaaaguagucucuccccuggccaca

SEQ ID NO: 514422 - RNA, 64 nt, hsa
ccucuuugaacacucaagauugcauggcaaagacccagucaaaaugauuuaccccugguuaagu

SEQ ID NO: 514423 - RNA, 64 nt, hsa
ugguggugguuaaugcuuuguuagauagcuucauccagucaauaguugaaaaguuuucacauaa

SEQ ID NO: 514424 - RNA, 64 nt, hsa
uaagcuuuccauuuccuagguaauuuuuuaaaagccagucaaaacaaaaacuuuacugaaaaug

SEQ ID NO: 514425 - RNA, 64 nt, hsa
gguuucuuuuguacacauuacuuaaacuuucuuuccagucaacaauauauuguggauuuauuuu

SEQ ID NO: 514426 - RNA, 64 nt, hsa
aagggagccaucuuggaagcagauccuccagccuccagucaagucuucagauaauugcaacuuc

SEQ ID NO: 514427 - RNA, 64 nt, hsa
acuugaaaaauauuucuuaauuuuuguuuuugcuccagucaauuccugauuauccacaggucaa

SEQ ID NO: 514428 - RNA, 64 nt, hsa
auuuuugagaaguugcuucuuuuacaucagaaaaccagucaaucauauggagacuucuuuugug

SEQ ID NO: 514429 - RNA, 64 nt, hsa
acccagaccccgagguugucugguucaaagaugaccagucaaucagggagucccgccacuucca

SEQ ID NO: 514430 - RNA, 64 nt, hsa
agacuaucaggaaaggagcuggccagggccacagccagucaagaucucugagcaacuuagagac

SEQ ID NO: 514431 - RNA, 64 nt, hsa
ccugaaauuuuaaaaaaguuguguaauacgccaaccagucaaguuguguuuuggccagagauuu

SEQ ID NO: 514432 - RNA, 64 nt, hsa
ugccaguguaaugaaacugcccuuauuuuaaaagccagucaaagauuccacugauugacauuug

SEQ ID NO: 514433 - RNA, 64 nt, hsa
ucuauggaauaaagcgucgccucucugccucgaaccagucaaauggaguauugcggcugcacgu

SEQ ID NO: 514434 - RNA, 64 nt, hsa
uggacuaguccucauuagcauguuugcauagcaaccagucaagagcauuuacacuauuucugcu

SEQ ID NO: 514435 - RNA, 64 nt, hsa
guuuagagauuaauuuuuacccccuaaggaauauccagucaaagacgcugagugggagcuguca

SEQ ID NO: 514436 - RNA, 64 nt, hsa
aaugucgaacucugaaacaaaaguauuuaacgacccagucaaugaaaacugaaucaagaaauga

SEQ ID NO: 514437 - RNA, 64 nt, hsa
auggcuugaugugaagacagcaaggaaagaagcaccagucaaguugugaacaagcaccaaauua

SEQ ID NO: 514438 - RNA, 64 nt, hsa
gauagguuaaugacaauuguacugcuauauuaucccagucaaaaccaauacuuucuuuucuuua

SEQ ID NO: 514439 - RNA, 64 nt, hsa
cagaaagauuuguagugacauuaggcagaaauggccagucaaacacauagcaguguuccauaga

SEQ ID NO: 514440 - RNA, 64 nt, hsa
uagaugugagaaugguggaacuuuuuaaaagaacccagucaaauguauuuucugcugaaaucug

SEQ ID NO: 514441 - RNA, 64 nt, hsa
ccccuuuugagcugccaguucccuacagccauccccagucaagggugaggguguggccuucacc

SEQ ID NO: 514442 - RNA, 64 nt, hsa
auccaggcauagggaacuaguuguuucauagcucccagucaaaaagaaagugagagaagcuguu

SEQ ID NO: 514443 - RNA, 64 nt, hsa
cucuaguguaccuuccuccucuuacucauccaucccagucaacaugauguugucaaugaaauaa

SEQ ID NO: 514444 - RNA, 64 nt, hsa
ccugcaaggagagaaaugcaaccauacaugggcuccagucaacuaugggacugaagguccuaau

SEQ ID NO: 514445 - RNA, 64 nt, hsa
ccuuuguggucugcauguuucuugguaagggugcccagucaagugucucugggagcccccucuu

SEQ ID NO: 514446 - RNA, 64 nt, hsa
aggagauaaauuugaaaacagauaaauguaacaaccagucaaagaagcaggggaaaaguaagcu

SEQ ID NO: 514447 - RNA, 64 nt, hsa
aguuuacgccugauagguaaacaaaucauacuccccagucaagacuucccugacagucccacua

SEQ ID NO: 514448 - RNA, 64 nt, hsa
gaaggacuagaauacagcagcuguuauaacacgaccagucaauguggaacaaacuguuucugug

SEQ ID NO: 514449 - RNA, 64 nt, hsa
uuuucuugcccaguguggcaagaccucagaaaaaccagucaauuacgccuaagaucauuuugcu

SEQ ID NO: 514450 - RNA, 64 nt, hsa
ucugaugcccaaucagcacggcugccuuccugacccagucaaggccucugucugaaaugagucg

SEQ ID NO: 514451 - RNA, 64 nt, hsa
aaaaaaaaagaauaaagaaagaaaagugcgaugcccagucaaucacaaauaagaucauccuggu

SEQ ID NO: 514452 - RNA, 64 nt, hsa
ugcugcacuuuauuaccaagccucugggauuuuaccagucaaacauauuugugcauuacauuuc

SEQ ID NO: 514453 - RNA, 64 nt, hsa
aaugagcauagguagcuuguccaaggucucaugaccagucaagggcaagcuggaguuaauaauc

SEQ ID NO: 514454 - RNA, 64 nt, hsa
cucaccuuguucuaaaauagguuauuucagugucccagucaaauuccuauucuaacaugcuguc

SEQ ID NO: 514455 - RNA, 64 nt, hsa
uguuucccuauuccucuccuuagaacuuucauagccagucaagcauagaauugcauccauucuu

SEQ ID NO: 514456 - RNA, 64 nt, hsa
aacuuguguagcugcagaauaaccaaguggcuauccagucaaguaaauacaguuugcuuacaua

SEQ ID NO: 514457 - RNA, 64 nt, hsa
ucuccagcuccaauacuuauuaaggcuguugcugccagucaaggccacccaggagucugaaggc

SEQ ID NO: 514458 - RNA, 64 nt, hsa
ccagagggguguuggagcccagcccacccacauaccagucaagcucuuaggggagcagaagaaa

SEQ ID NO: 514459 - RNA, 64 nt, hsa
ucugaggcccuggggauccucacauccccgucccccagucaagagcuccucugcuccucgcuug

SEQ ID NO: 514460 - RNA, 64 nt, hsa
auccugugccaggcucccuuucauugucuauauuccagucaagcuggccuucaaaauuucagca

SEQ ID NO: 514461 - RNA, 64 nt, hsa
auuuuaacauuguuugguuaaaaaaggugaaguuccagucaaccacuuuuuaccccugaaauuu

SEQ ID NO: 514462 - RNA, 64 nt, hsa
cccuuugaaaauucuauuuuccuuuguccucaauccagucaacaccuacuauguaccaggcacc

SEQ ID NO: 514463 - RNA, 64 nt, hsa
ugccaacaggguccuuuuaggcagaacccagaaaccagucaaaucuguagagaagcagugugac

SEQ ID NO: 514464 - RNA, 64 nt, hsa
uauuuuggggggacagugccaaguccaucuuugcccagucaauucagugauugauagcaauuua

SEQ ID NO: 514465 - RNA, 64 nt, hsa
acucuaacauacuuuagaggaggagaaagagauuccagucaaaauugucugcuaccuuuuauga

SEQ ID NO: 514466 - RNA, 64 nt, hsa
cuuuuuguauuugagagaaucuacuaaguucaguccagucaagaaaagaaccuaauagcaccaa

SEQ ID NO: 514467 - RNA, 64 nt, hsa
uaaaugacgcaccauccucccucccacccuucucccagucaacuuuuuuucuuuuucuagaacu

SEQ ID NO: 514468 - RNA, 64 nt, hsa
agaagaugaauacaaacaauggaaacugaaugcuccagucaacaaacuauuucuuauauaugug

SEQ ID NO: 514469 - RNA, 64 nt, hsa
auucauguaccugugauccagcaagaagggaguuccagucaagagucacuacaacugauuaguu

SEQ ID NO: 514470 - RNA, 64 nt, hsa
ucuagaguuaucuucuuuauuauuccuagucuuuccagucaacaucguggauguagugauuaaa

SEQ ID NO: 514471 - RNA, 64 nt, hsa
agagucauuaagcgggaucccagcaucucagaguccagucaaguucccuccugcagccugaccc

SEQ ID NO: 514472 - RNA, 64 nt, hsa; identical to SEQ ID NO: 514471

SEQ ID NO: 514473 - RNA, 64 nt, hsa
cuucccccuuccccugagacugguggacugaacuccagucaaguugaguucaagugaaagauuc

SEQ ID NO: 514474 - RNA, 64 nt, hsa
uagcuuuaaugcauggaaaaacuucaguuacugaccagucaagagaauuucucaagaaaaaucc

SEQ ID NO: 514475 - RNA, 64 nt, hsa
gucaggagauucacagcaacugaucaaagggaguccagucaacgugagcaagcgugauuaugau

SEQ ID NO: 514476 - RNA, 64 nt, hsa
ucugaguaguggccacuggggugccuucacugggccagucaacggggggcuccugcccaggcca

SEQ ID NO: 514477 - RNA, 64 nt, hsa
cagugagcuguguccucguccccccacccccuucccagucaaggugguggccugggccgcucca

SEQ ID NO: 514478 - RNA, 64 nt, hsa
acugacguacccaucaggacagugagcucugcugccagucaaggccugcauaugcagaaugacg

SEQ ID NO: 514479 - RNA, 64 nt, hsa
uuuguacugcauggguggcaguugugaggaaaagccagucaaaugaccuuuuuacaaaagaaau

SEQ ID NO: 514480 - RNA, 64 nt, hsa
gggauuuuuuuuuuuuguauucccccugcccccgccagucaaagguuucuuuucccuuuuuacc

SEQ ID NO: 514481 - RNA, 64 nt, hsa
ggcuuucuucaaugggauguucaauugaguacuuccagucaacagugcuucccaaagugggugg

SEQ ID NO: 514482 - RNA, 64 nt, hsa
aagauucuguggugugacaucucuguuauuguuuccagucaauauuuacaaagcauccuaaaga

SEQ ID NO: 514483 - RNA, 64 nt, hsa
guccugucauccauauggugccuggaaauauuuaccagucaaggucaaggucagcaucuguggu

SEQ ID NO: 514484 - RNA, 64 nt, hsa
aacugcaucaagacuucaauccugauuagugucuccagucaagcucuggguacugaauugccug

SEQ ID NO: 514485 - RNA, 64 nt, hsa
gagccaccaagagggacgccugggggugccaggaccagucaaccugggcaaagccuagugaagg

SEQ ID NO: 514486 - RNA, 64 nt, hsa
uaagaaauaaagggaagugucugcuacuuaguugccagucaaaauguuaguucucucucucuac

SEQ ID NO: 514487 - RNA, 64 nt, hsa
ccuccagaggaaucuguuugcuuccugauuagauccagucaauguuuuaaagguauugucagag

SEQ ID NO: 514488 - RNA, 64 nt, hsa
acuauauauaacuuccuaugcaaauauuuuaccaccagucaauaauacauuuuugccaagacau

SEQ ID NO: 514489 - RNA, 64 nt, hsa
ggcaguggaggugggguguuugggaggcugcgugccagucaagaagaaaaagguuugcauucuc

SEQ ID NO: 514490 - RNA, 64 nt, hsa
ugucaugaaaccacuuauuuuaaaaagcagaggcccagucaaaugagcauugcaucccaugagg

SEQ ID NO: 514491 - RNA, 64 nt, hsa
accugggauaacuacuuuaaagaaauaaaaaauuccagucaauuauuccucaacugaaaguuua

SEQ ID NO: 514492 - RNA, 64 nt, hsa
caucuauuuggaacccaagccucauauuuucuguccagucaauguugguuacuaaauagaaaac

SEQ ID NO: 514493 - RNA, 64 nt, hsa
gaugauauucugauggacugguuuggucuuaauaccagucaaccguuguccuucuggaaauaua

SEQ ID NO: 514494 - RNA, 64 nt, hsa
cucuauuuggcucauuuuauauuuaguuccuuccccagucaacaacugaccacaucugccucug

SEQ ID NO: 514495 - RNA, 64 nt, hsa
agggcaggaacuugcacaaaaucacacagccaagccagucaaggauggaugcagauccagaggu

SEQ ID NO: 514496 - RNA, 64 nt, hsa
ggaaaccacguguucugguuuccaugaugcccauccagucaaucucauggaggguggaguaugg

SEQ ID NO: 514497 - RNA, 64 nt, hsa
guaucagagccuuagggugcccccauccccuuccccagucaacuguggcaccuguaaccucccg

SEQ ID NO: 514498 - RNA, 64 nt, hsa
ggugauucuggaaguauuggcuauagcggugggcccagucaacucuuccuuguggacuuacgac

SEQ ID NO: 514499 - RNA, 64 nt, hsa
caucauuaaguccugucaucccuaccagccaaucccagucaaagaaguuaugcuuuauucacuu

SEQ ID NO: 514500 - RNA, 64 nt, hsa
uuaccaggguuuuuacuguuugguuugaggcaccccagucaacuccuagauuucaaaaaccuuu

SEQ ID NO: 514501 - RNA, 64 nt, hsa
aaagaguuugaaaugucauuuugggaaaagagagccagucaagcuaguaggcugauugugaaga

SEQ ID NO: 514502 - RNA, 64 nt, hsa
gagugaucuaugcugaauaaacaguggaaugugaccagucaaguagaaaucuugaguaaucaga

SEQ ID NO: 514503 - RNA, 64 nt, hsa
ugaggcuggucauaccuccaggaacaauacagagccagucaacuuccuggaauccaagaccaga

SEQ ID NO: 514504 - RNA, 64 nt, hsa
auuugauggugguauugugaccacugaauucacuccagucaacagauucagaaugagaauggac

SEQ ID NO: 514505 - RNA, 64 nt, hsa
accuugcugauaaaacagauugugauaagaaaagccagucaaaacccaccaaaaccaagauggc

SEQ ID NO: 514506 - RNA, 64 nt, hsa
aauuguugcuauugucagcaucuuaaagguauuuccagucaaggcaaggcuaagugcuuuguga

SEQ ID NO: 514507 - RNA, 64 nt, hsa
gaugaaaaaccuaaugcauagaaagauaaguagaccagucaaggucuacagcuaguaaaaugcu

SEQ ID NO: 514508 - RNA, 64 nt, hsa
uuugauaaauugauauacccauguaaccaacacuccagucaagcuucagaauauuuccaucacc

SEQ ID NO: 514509 - RNA, 64 nt, hsa
agugauguaucaguaauguaucaauaaucccagcccagucaaagcaccgccaccuguaggcuuc

SEQ ID NO: 514510 - RNA, 64 nt, hsa
ggugagccaggucuagcccaacagucuaaacuauccagucaauaccgagugaaguggcagccag

SEQ ID NO: 514511 - RNA, 64 nt, hsa
uugggagccuuggggccagcuggccugcugcucuccagucaaguagcgaagcuccuaccaccca

SEQ ID NO: 514512 - RNA, 64 nt, hsa
gggccaucgcaagucacagaaaaugcaccucauuccagucaagcagaaaaacaggcacaggcuc

SEQ ID NO: 514513 - RNA, 64 nt, hsa
augccagaagaagaauaguacagcccaugauugaccagucaaaucgagcaggcaaguuccaagu

SEQ ID NO: 514514 - RNA, 64 nt, hsa
gagccuaggagggaaggcucugauuuggauuucuccagucaaagcucacagaaaaaaaccuggc

SEQ ID NO: 514515 - RNA, 64 nt, hsa
auccauugccuuugaugauguucccagccauacuccagucaacggggacuacuagucccucacu

SEQ ID NO: 514516 - RNA, 64 nt, hsa
caaccuugaccaaccccagcaauuuuuccaaaagccagucaagggcauuacauuuguuccuggg

SEQ ID NO: 514517 - RNA, 64 nt, hsa
augucaacagccagacagggcuccagggcuugucccagucaauacagaguucccucugcugucu

SEQ ID NO: 514518 - RNA, 64 nt, hsa
gggaaaaaccauauugccuuguguguugcuuuucccagucaaaagggucugaccuuagaaaguc

SEQ ID NO: 514519 - RNA, 64 nt, hsa
aggagauccuggauucuuaauuguuggcuaaguuccagucaaguaggaaucagugcagccugua

SEQ ID NO: 514520 - RNA, 64 nt, hsa
gagauucuggaucuugacaugcccaucuuagaagccagucaagcuauggaacuaaugcggaggc

SEQ ID NO: 514521 - RNA, 64 nt, hsa
uuuucuuccgagcuugucuuaucucaaaccccuuccagucaaggaacuagaaucagcaacgaga

SEQ ID NO: 514522 - RNA, 64 nt, hsa
gaagccagugacucccaguucucaacacauggccccagucaagacagaacaccauggaaaaaac

SEQ ID NO: 514523 - RNA, 64 nt, hsa
agaggacacagucccggccugggcugcccccgcuccagucaaugcucacugaaagucugucuua

SEQ ID NO: 514524 - RNA, 64 nt, hsa
cccgcacgccgccucacggcccccaugcuucccgccagucaagauggucuguggacuuagggcc

SEQ ID NO: 514525 - RNA, 64 nt, hsa
cgcucugaaucucucugcagucuacaaaaucgccccagucaacucuccacuuggagggaauugu

SEQ ID NO: 514526 - RNA, 64 nt, hsa
gagucaauguugggaggaaggguaccugguguccccagucaagcccaugaagcccaugcggccu

SEQ ID NO: 514527 - RNA, 64 nt, hsa
uaagaaugugaugggccacaaggaaagagagaccccagucaagcuccuaguaugcccuguaauu

SEQ ID NO: 514528 - RNA, 64 nt, hsa
caacauccaacccaggucauugaaaugaaauuggccagucaaaaaaaaaaagacuucaaucauu

SEQ ID NO: 514529 - RNA, 64 nt, hsa
aagaagguucugugcugucucauugaaaaccgagccagucaaccacaaggcuggcaggguguga

SEQ ID NO: 514530 - RNA, 64 nt, hsa
uagucaaaauaaguaaaagaaauauaggaauauuccagucaaucucugaaauguuuaugaaaaa

SEQ ID NO: 514531 - RNA, 64 nt, hsa
gaaacaugguggcaacgucucuuuggauguuuuaccagucaaagguccucaggguucuccucuu

SEQ ID NO: 514532 - RNA, 64 nt, hsa
gaaagagauaacuauauaacagcuuuuuaacuauccagucaacuuucagcuuuucuacauuuag

SEQ ID NO: 514533 - RNA, 64 nt, hsa
aaaagagacuagcauaaggagacuuaacaggaacccagucaaggccauucauggccaugggacc

SEQ ID NO: 514534 - RNA, 64 nt, hsa
gugaagacggauccagacacagaagaacaaagacccagucaaagaucuuuuccagauuaugugg

SEQ ID NO: 514535 - RNA, 64 nt, hsa
cuuuuuuuuuuuuuucuuaacccguucagugcugccagucaaccaagggucugugagugucagc

SEQ ID NO: 514536 - RNA, 64 nt, hsa
cuugcaggcuggaagcaccagggaauuaauucccccagucaaccaauggcauccagagagggca

SEQ ID NO: 514537 - RNA, 64 nt, hsa
guuuccagaauuucuagagugggugggcaugauuccagucaaugggggaccgcccgugucuaag

SEQ ID NO: 514538 - RNA, 64 nt, hsa
uuuuggagggguucacagaauccuggcagcagcuccagucaagaaugucacugguuggcaugau

SEQ ID NO: 514539 - RNA, 64 nt, hsa
cccuguagcccccagcuucaggccucagugucugccagucaagcuucacaggcauugugauggg

SEQ ID NO: 514540 - RNA, 64 nt, hsa
acaaguguaaugaguguggcaaagccuuuagugaccagucaacacuuaccaucaggccauucau

SEQ ID NO: 514541 - RNA, 64 nt, hsa
ugcauuaacguacuuuccccugaaacagagcaacccagucaacaccacagaaccucagcuuuga

SEQ ID NO: 514542 - RNA, 64 nt, hsa
uuugcaggcuggaagcaccagggaauuaauucccccagucaaccaauggcacccagagagggca

SEQ ID NO: 514543 - RNA, 64 nt, hsa
ggcccuguagggggugcaccccccacccuauggaccagucaaauaaaagccuucaggccccuca

SEQ ID NO: 514544 - RNA, 64 nt, hsa
uucugugagccucugauccaaacauuuuuaucaaccagucaacacauaaccuucuucuaugggu

SEQ ID NO: 514545 - RNA, 62 nt, hsa
ucuauuaaaccaaaaaguuuucuugugcccauuuccagucaaucccaccuccagugccaagu

SEQ ID NO: 514546 - RNA, 64 nt, hsa
ugugugugugugugugugugugugugaccuugauccagucaaccacuucaaauuccuacacugu

SEQ ID NO: 514547 - RNA, 64 nt, hsa
acgucuuuauuacccaagucuucucccguccauuccagucaaaucugggcucacucaccccagc

SEQ ID NO: 514548 - RNA, 64 nt, hsa
cagaucauuuacauguccuuauuuuccaccucccccagucaaaaugcuuucuaaaucauuuuca

SEQ ID NO: 514549 - RNA, 64 nt, hsa
guguaugcaggggucaugaacaagaccugagugaccagucaagccucauguuaccccagagaga

SEQ ID NO: 514550 - RNA, 64 nt, hsa
uaguucuuaugagcuagcauggcccgggccuuauccagucaaagcggaugcuggccacagaaag

SEQ ID NO: 514551 - RNA, 64 nt, hsa
uauuaaacagaaauaauguuuuaccaucucuucaccagucaaguugacacguaaaauuaaccau

SEQ ID NO: 514552 - RNA, 64 nt, hsa
gaaaaaaaaguagaggaaaaagugugugguuaagccagucaauuaugacaagguuaaagaagua

SEQ ID NO: 514553 - RNA, 64 nt, hsa
ggaagguugggcuucaaguuaacaggaucagacaccagucaagcagccucaggucaucuugcga

SEQ ID NO: 514554 - RNA, 64 nt, hsa
aagcccgccagcuuccugcuccacucagcuccguccagucaaccugaacccacccaguccagcu

SEQ ID NO: 514555 - RNA, 64 nt, hsa
ccagccugcagggaggccccaggaggggaucuggccagucaaggguccacagggugccagccuc

SEQ ID NO: 514556 - RNA, 64 nt, hsa
accccugaccaaggugcccagcagccugucuucaccagucaaggaauccgccaucuuggcugua

SEQ ID NO: 514557 - RNA, 64 nt, hsa
ucaagaaguagcuccaaagucuuugagcccuuucccagucaaaugcucccaacaaggcaucccu

SEQ ID NO: 514558 - RNA, 64 nt, hsa
uuagacuuacccuccucccucuuuccaccagcugccagucaagggcagugggaucucgauggag

SEQ ID NO: 514559 - RNA, 64 nt, hsa
caguguucucaacuugguuaaggaggaagaaaacccagucaaugaaauucaaugaaauucuugg

SEQ ID NO: 514560 - RNA, 64 nt, hsa
gugcuaugguuaugaguguaugugccaguacuuaccagucaaugcauuguggauaugagcuuuc

SEQ ID NO: 514561 - RNA, 64 nt, hsa
aacugaaagagaggccuucucauccccaagcucuccagucaacacagggcucccuguggugaca

SEQ ID NO: 514562 - RNA, 64 nt, hsa
uugcuacauggggucugggugggggcaaagagacccagucaauuacauguuugguaccaagaaa

SEQ ID NO: 514563 - RNA, 64 nt, hsa
uaggaaaaauggaaggugccggggguaaucauggccagucaauaauuauauaaaggaguucaaa

SEQ ID NO: 514564 - RNA, 64 nt, hsa
auuccaucccagccagagcacccccaccaucaggccagucaacugcacaauacacaacuguauu

SEQ ID NO: 514565 - RNA, 64 nt, hsa
gauagaaaauucaccccucugaacuggcuccuucccagucaagguuaucugguuugauuguaua

SEQ ID NO: 514566 - RNA, 64 nt, hsa
uggugaguccucggccuugagguugcugacucucaggcguuaggcagcuggaugacuucccgcu

SEQ ID NO: 514567 - RNA, 64 nt, hsa
gucagaagaaaguuggaaacuuuuccuacauauuaggcguuaguaugaggacauuuguuugaau

SEQ ID NO: 514568 - RNA, 64 nt, hsa
guuuaugcauucacaaggugacugggauguagagaggcguuagugggcagguggccacagcagg

SEQ ID NO: 514569 - RNA, 64 nt, hsa
ccaccugccucggccuccccaaagugcugagauuaggcguuagccaccgcgcccggccagaaau

SEQ ID NO: 514570 - RNA, 64 nt, hsa
gggucaagaggaaagaaugcgugcugguuuuguuaggcguuaguauaccguuuuuuuguggccu

SEQ ID NO: 514571 - RNA, 64 nt, hsa
cacauccuuucaucagaagcccauucccucuauaaggcguuauuacauuuaugagaauggaguc

SEQ ID NO: 514572 - RNA, 64 nt, hsa
caugcuuuauuauaaauaaaauucuagcuuugaaaggcguuauguguugaacaguaugcuucag

SEQ ID NO: 514573 - RNA, 64 nt, hsa
uaagccuuuuugagguguagagauucucagguccaggcguuaaaaaauaauggucaaaagaaua

SEQ ID NO: 514574 - RNA, 64 nt, hsa
ugauacaugaagagccaagagcaggaugagguggaggcguuacaacuaccugcucugugugugg

SEQ ID NO: 514575 - RNA, 64 nt, hsa
aacuccaagguccagcagaguguccagcaaaaguaggcguuagagcauucaacagcaugaauuc

SEQ ID NO: 514576 - RNA, 64 nt, hsa
acagccaguggcacugacaaggggacggaguccaaggcguuauugggccaccugacagcuggac

SEQ ID NO: 514577 - RNA, 64 nt, hsa
cacccgccucggccucccaaagugcugggauuacaggcguuagccacugcgcccggcccgagaa

SEQ ID NO: 514578 - RNA, 64 nt, hsa
cacuucguacuucuguauagaacuaacagcaaaaaggcguuaaacagcaagugucaucuacauc

SEQ ID NO: 514579 - RNA, 64 nt, hsa
cacaaacuguuucugcaucccagggcucugacgaaggcguuaagaaacagaugcuguucccgcg

SEQ ID NO: 514580 - RNA, 64 nt, hsa
uguggaguccagagugcugccaggacccaggcacaggcguuagcucccguaggagaaaaugggg

SEQ ID NO: 514581 - RNA, 64 nt, hsa
cuccccucagucugaucuugucuaaguagaauccaggcguuaguuggaaucauaucauaaguau

SEQ ID NO: 514582 - RNA, 64 nt, hsa
cuggauauggaggaacaagcaaucuuauuuuggaaggcguuaaaaaauuaucugacaguuacau

SEQ ID NO: 514583 - RNA, 64 nt, hsa
uaauacaauuucugcuauaauuuuuguaugcaguaggcguuacuaauaaacauuucugcuguga

SEQ ID NO: 514584 - RNA, 64 nt, hsa
ugaucaguucccacucugacaacuggcaaauaccaggcguuaucauccuguaugcauuaacgua

SEQ ID NO: 514585 - RNA, 64 nt, hsa
uuguaaaucauucuacuuuugcacuuugaaagaaaggcguuaaucauaaagaagcaagaauggu

SEQ ID NO: 514586 - RNA, 64 nt, hsa
gcacucuugaccccgucagcguccaacguggaaaaggcguuaccucuucucccagcgcuggccg

SEQ ID NO: 514587 - RNA, 64 nt, hsa
cuuagaagcuaacuucccugagacugcauggcucaggcguuaauaauggacauaaaaagucaua

SEQ ID NO: 514588 - RNA, 64 nt, hsa
cugcggggugggggcaucgcugccuggggagcugaggcguuaccgcuguguugggggcagcuug

SEQ ID NO: 514589 - RNA, 64 nt, hsa
ugagcugggugggugucuguuuugagcuuauuuagaguccuaguuuuccuacuuauaaaguaga

SEQ ID NO: 514590 - RNA, 64 nt, hsa
uacucauuucuuaugaaucuuuccagggauuuuugaguccuauucaaauuccuauuuuuaaaua

SEQ ID NO: 514591 - RNA, 64 nt, hsa
cuaaguauuaauuauugccaccaucaaacucauugaguccuaugguucacaucuuguuuccuau

SEQ ID NO: 514592 - RNA, 64 nt, hsa
uugauuguacuuaaucuaauuugauuagauuauagaguccuaaguauuaauuauugccaccauc

SEQ ID NO: 514593 - RNA, 62 nt, hsa
cccccacucugccgugcucacacagacacacccagcugcacacaugaggcaucccacaugac

SEQ ID NO: 514594 - RNA, 62 nt, hsa
auggggcugggcugagccagggaggaaggacccagcugcaccuaggagacaccuuuguucuu

SEQ ID NO: 514595 - RNA, 62 nt, hsa
ugcguagcccacagagggcccaggccccugcccagcugcagucucccagccuccacuuucag

SEQ ID NO: 514596 - RNA, 62 nt, hsa
cccaguuuguguguuugagcucugcauucaggcagcugcaacauuccaguguuugaacuguc

SEQ ID NO: 514597 - RNA, 62 nt, hsa
acugucacagcagagucaccuuagaaauuggacagcugcauguucugugcucuccaguuugu

SEQ ID NO: 514598 - RNA, 62 nt, hsa
cguuggcacaccagcucagacaggggccugcgcagcugcaggggacagacgccaaucacugu

SEQ ID NO: 514599 - RNA, 54 nt, hsa; identical to SEQ ID NO: 333546

SEQ ID NO: 514600 - RNA, 62 nt, hsa
ggaagacaggaacuaaaccuccaggucagcugcagcugcaaaaugacuacagccugaagggc

SEQ ID NO: 514601 - RNA, 60 nt, hsa; identical to SEQ ID NO: 333548

SEQ ID NO: 514602 - RNA, 62 nt, hsa
uggggucgccguaccaggggcccuggcagggucagcugcaagaacaucaaaccagagugccc

SEQ ID NO: 514603 - RNA, 62 nt, hsa
cucgguugucucugcggcuccuuagggcagaacagcugcauguggcacuugugacacucacu

SEQ ID NO: 514604 - RNA, 62 nt, hsa
acugaaucagccuggaauggcugcugagagcucagcugcaaguugcugguccaucuggggcc

SEQ ID NO: 514605 - RNA, 62 nt, hsa
gguuagaggguggggaggugagagcaaaggcccagcugcagcccucagcuagaguccaagac

SEQ ID NO: 514606 - RNA, 62 nt, hsa
aggaauggugucccaaguuggaggcuuugugucagcugcaaauccuaccaguuauguccaag

SEQ ID NO: 514607 - RNA, 62 nt, hsa
cucugcuuccagcuuuguguaauucucuuugccagcugcacaaagcugauuuuuuccaaagu

SEQ ID NO: 514608 - RNA, 62 nt, hsa
cacagggcgggugggucagcguugacucuuuccagcugcacacucauaugccgugugucuua

SEQ ID NO: 514609 - RNA, 62 nt, hsa
ggcccacucagcggcccacauuggccagcauucagcugcacgugugugcugcgugcuucaca

SEQ ID NO: 514610 - RNA, 62 nt, hsa
ugagccacuaccugggcaucagucuggaucugcagcugcaguuggagcagcuccgagggagg

SEQ ID NO: 514611 - RNA, 62 nt, hsa
gcuguggacuggacccaggagccccggcggcgcagcugcaagguugccaggacccacccuca

SEQ ID NO: 514612 - RNA, 62 nt, hsa
ugcugcccaacaugagcagugaucuccaaggccagcugcagggccugcucguacacuugcuc

SEQ ID NO: 514613 - RNA, 62 nt, hsa
cuccacucgacacagccugcgguuugcagugccagcugcacguuggagucuccugggaagcu

SEQ ID NO: 514614 - RNA, 62 nt, hsa
gacggccggcugccccgcaccaucccucuccccagcugcaaacugagugugccggacccuga

SEQ ID NO: 514615 - RNA, 62 nt, hsa
cucuccugccacacagacccgcuggaccaaagcagcugcagccgccuccucguuccucuccu

SEQ ID NO: 514616 - RNA, 62 nt, hsa
gaggacgggacccugagccugugugugucgggcagcugcaggguaggcguguguggacauug

SEQ ID NO: 514617 - RNA, 62 nt, hsa
gcuaaucuguggccagggugcuggcaugguggcagcugcaaauguccaugcacccagguggc

SEQ ID NO: 514618 - RNA, 62 nt, hsa
ccuccccuuagugaccccaagucuguuucccucagcugcauaaggaggcgauauaguuugaa

SEQ ID NO: 514619 - RNA, 62 nt, hsa
ugggccugccuggggaaagguggaaggagaaacagcugcaggaggggggagcugaaaggaau

SEQ ID NO: 514620 - RNA, 62 nt, hsa
cugccuccuaaugcuagguuucuagagucuuccagcugcaucuucaugccggcagcauuuug

SEQ ID NO: 514621 - RNA, 62 nt, hsa
gggucuaccucagagcucucccugucaaaaagcagcugcaagccucgcaaggguggaguggg

SEQ ID NO: 514622 - RNA, 62 nt, hsa
cuucaaaagugugagcccugcuucgggcugagcagcugcagggagcccccuuucugaugaug

SEQ ID NO: 514623 - RNA, 62 nt, hsa
aguccuugcuucccucagaaauaaaaggagcucagcugcagcguugcauugggcuucuuggc

SEQ ID NO: 514624 - RNA, 62 nt, hsa
guggucaagagccgucugagccuaaugagucccagcugcauuagguuaagagacucuuccag

SEQ ID NO: 514625 - RNA, 62 nt, hsa
aggccacgcaccagcggaagcuccggcagaagcagcugcagcagcaguuccgggagcggaug

SEQ ID NO: 514626 - RNA, 62 nt, hsa
gcugccgaccgaacauggcccugggacacccacagcugcagcaggugaccuccccuuccaga

SEQ ID NO: 514627 - RNA, 62 nt, hsa
ggcagaggguggggcugcacagaggggaacaucagcugcagcucugcaccaggccggucccu

SEQ ID NO: 514628 - RNA, 62 nt, hsa
gcuuugggaggauuucucaggcuaugccauggcagcugcagaggcccagggagagguaaccu

SEQ ID NO: 514629 - RNA, 62 nt, hsa
ucaggugggaagaggaguacacggugcggauccagcugcaagaccguguaaaugagcuccag

SEQ ID NO: 514630 - RNA, 62 nt, hsa
ucacauugaccgcaacucacacauucccccaccagcugcagccccuugcucucagcugccaa

SEQ ID NO: 514631 - RNA, 62 nt, hsa
gaaugaacccaagagcaagggcuugauggugacagcugcaagccagggaugaagaaagacuc

SEQ ID NO: 514632 - RNA, 62 nt, hsa
ccucacugaagaagcagauugccaagugccagcagcugcagcaagaauacagccgcaaggag

SEQ ID NO: 514633 - RNA, 62 nt, hsa
uggaggaucugauuggcaagcuuaccagucuucagcugcaacaccuguuuaugauccuggcc

SEQ ID NO: 514634 - RNA, 62 nt, hsa
uagaaauucuacugcacugccuggcucagcugcagcugcagacauuucugcaggaggagcag

SEQ ID NO: 514635 - RNA, 62 nt, hsa
ucuuucuagaaauucuacugcacugccuggcucagcugcagcugcagacauuucugcaggag

SEQ ID NO: 514636 - RNA, 62 nt, hsa
gggcugcucugcacccacgggagaggcuggcccagcugcagacugcuuagggacuucugugu

SEQ ID NO: 514637 - RNA, 62 nt, hsa
cucagugccugagacuuuucuaccaagccacacagcugcagcaacugcagauacugcgggcu

SEQ ID NO: 514638 - RNA, 62 nt, hsa
gaggucaccuuccgaaagccuaccuucugcgacagcugcaguggcuucgugagcaccccacc

SEQ ID NO: 514639 - RNA, 62 nt, hsa
ggacaaguucauucacguggcacaggcuccaccagcugcagaauuucaacacgcugauggca

SEQ ID NO: 514640 - RNA, 62 nt, hsa
acaugaaguguaccuuuucuaaagacgguuuccagcugcaacggcuccacuuugcaggcuug

SEQ ID NO: 514641 - RNA, 62 nt, hsa
acgugcuucuuauuccuggcaggcuucaagaacagcugcacaugugccgcuaacugaccgcg

SEQ ID NO: 514642 - RNA, 62 nt, hsa
cuccccugcuagucaccuaccaggugucugagcagcugcaugcucccuggcucaagugggca

SEQ ID NO: 514643 - RNA, 62 nt, hsa
aaagaugagaaaagccaccccaucuggcaccacagcugcaucuugcuugugagaaaugggga

SEQ ID NO: 514644 - RNA, 64 nt, hsa; identical to SEQ ID NO: 511888

SEQ ID NO: 514645 - RNA, 64 nt, hsa; identical to SEQ ID NO: 511889

SEQ ID NO: 514646 - RNA, 64 nt, hsa; identical to SEQ ID NO: 511890

SEQ ID NO: 514647 - RNA, 64 nt, hsa; identical to SEQ ID NO: 511891

SEQ ID NO: 514648 - RNA, 64 nt, hsa; identical to SEQ ID NO: 511892

SEQ ID NO: 514649 - RNA, 64 nt, hsa; identical to SEQ ID NO: 511893

SEQ ID NO: 514650 - RNA, 64 nt, hsa; identical to SEQ ID NO: 511894

SEQ ID NO: 514651 - RNA, 64 nt, hsa; identical to SEQ ID NO: 511895

SEQ ID NO: 514652 - RNA, 64 nt, hsa; identical to SEQ ID NO: 511896

SEQ ID NO: 514653 - RNA, 64 nt, hsa; identical to SEQ ID NO: 511897

SEQ ID NO: 514654 - RNA, 64 nt, hsa; identical to SEQ ID NO: 511898

SEQ ID NO: 514655 - RNA, 64 nt, hsa; identical to SEQ ID NO: 511899

SEQ ID NO: 514656 - RNA, 64 nt, hsa; identical to SEQ ID NO: 511900

SEQ ID NO: 514657 - RNA, 64 nt, hsa; identical to SEQ ID NO: 511901

SEQ ID NO: 514658 - RNA, 64 nt, hsa; identical to SEQ ID NO: 511902

SEQ ID NO: 514659 - RNA, 64 nt, hsa; identical to SEQ ID NO: 219988

SEQ ID NO: 514660 - RNA, 64 nt, hsa; identical to SEQ ID NO: 219989

SEQ ID NO: 514661 - RNA, 64 nt, hsa; identical to SEQ ID NO: 219990

SEQ ID NO: 514662 - RNA, 64 nt, hsa; identical to SEQ ID NO: 219991

SEQ ID NO: 514663 - RNA, 64 nt, hsa; identical to SEQ ID NO: 219992

SEQ ID NO: 514664 - RNA, 64 nt, hsa; identical to SEQ ID NO: 219993

SEQ ID NO: 514665 - RNA, 64 nt, hsa; identical to SEQ ID NO: 219994

SEQ ID NO: 514666 - RNA, 64 nt, hsa; identical to SEQ ID NO: 219995

SEQ ID NO: 514667 - RNA, 64 nt, hsa; identical to SEQ ID NO: 219996

SEQ ID NO: 514668 - RNA, 64 nt, hsa; identical to SEQ ID NO: 219997

SEQ ID NO: 514669 - RNA, 64 nt, hsa; identical to SEQ ID NO: 219998

SEQ ID NO: 514670 - RNA, 64 nt, hsa; identical to SEQ ID NO: 219999

SEQ ID NO: 514671 - RNA, 64 nt, hsa; identical to SEQ ID NO: 220000

SEQ ID NO: 514672 - RNA, 64 nt, hsa; identical to SEQ ID NO: 220001

SEQ ID NO: 514673 - RNA, 64 nt, hsa; identical to SEQ ID NO: 220002

SEQ ID NO: 514674 - RNA, 64 nt, hsa; identical to SEQ ID NO: 220003

SEQ ID NO: 514675 - RNA, 64 nt, hsa; identical to SEQ ID NO: 220004

SEQ ID NO: 514676 - RNA, 64 nt, hsa; identical to SEQ ID NO: 220005

SEQ ID NO: 514677 - RNA, 64 nt, hsa; identical to SEQ ID NO: 220005

SEQ ID NO: 514678 - RNA, 64 nt, hsa; identical to SEQ ID NO: 220004

SEQ ID NO: 514679 - RNA, 64 nt, hsa; identical to SEQ ID NO: 220008

SEQ ID NO: 514680 - RNA, 64 nt, hsa; identical to SEQ ID NO: 220009

SEQ ID NO: 514681 - RNA, 64 nt, hsa; identical to SEQ ID NO: 220010

SEQ ID NO: 514682 - RNA, 64 nt, hsa; identical to SEQ ID NO: 220011

SEQ ID NO: 514683 - RNA, 64 nt, hsa; identical to SEQ ID NO: 220012

SEQ ID NO: 514684 - RNA, 64 nt, hsa; identical to SEQ ID NO: 220013

SEQ ID NO: 514685 - RNA, 64 nt, hsa; identical to SEQ ID NO: 220014

SEQ ID NO: 514686 - RNA, 64 nt, hsa; identical to SEQ ID NO: 220015

SEQ ID NO: 514687 - RNA, 64 nt, hsa; identical to SEQ ID NO: 220016

SEQ ID NO: 514688 - RNA, 64 nt, hsa; identical to SEQ ID NO: 220017

SEQ ID NO: 514689 - RNA, 64 nt, hsa; identical to SEQ ID NO: 220018

SEQ ID NO: 514690 - RNA, 64 nt, hsa; identical to SEQ ID NO: 220019

SEQ ID NO: 514691 - RNA, 64 nt, hsa; identical to SEQ ID NO: 433597

SEQ ID NO: 514692 - RNA, 64 nt, hsa; identical to SEQ ID NO: 433598

SEQ ID NO: 514693 - RNA, 64 nt, hsa; identical to SEQ ID NO: 433599

SEQ ID NO: 514694 - RNA, 64 nt, hsa; identical to SEQ ID NO: 433600

SEQ ID NO: 514695 - RNA, 64 nt, hsa; identical to SEQ ID NO: 433601

SEQ ID NO: 514696 - RNA, 64 nt, hsa; identical to SEQ ID NO: 433602

SEQ ID NO: 514697 - RNA, 64 nt, hsa; identical to SEQ ID NO: 433603

SEQ ID NO: 514698 - RNA, 64 nt, hsa; identical to SEQ ID NO: 433604

SEQ ID NO: 514699 - RNA, 64 nt, hsa; identical to SEQ ID NO: 433605

SEQ ID NO: 514700 - RNA, 64 nt, hsa; identical to SEQ ID NO: 433606

SEQ ID NO: 514701 - RNA, 64 nt, hsa; identical to SEQ ID NO: 433607

SEQ ID NO: 514702 - RNA, 64 nt, hsa; identical to SEQ ID NO: 433608

SEQ ID NO: 514703 - RNA, 64 nt, hsa; identical to SEQ ID NO: 433609

SEQ ID NO: 514704 - RNA, 64 nt, hsa; identical to SEQ ID NO: 433610

SEQ ID NO: 514705 - RNA, 64 nt, hsa; identical to SEQ ID NO: 433611

SEQ ID NO: 514706 - RNA, 64 nt, hsa; identical to SEQ ID NO: 433612

SEQ ID NO: 514707 - RNA, 64 nt, hsa
cucaggcugcagcuggacagaggggacucugggcuauggacacagggugacggugacaaagaug

SEQ ID NO: 514708 - RNA, 64 nt, hsa
uggggaggugucacauggugccccuagcuuuauauauggacauggcaggccgauuugggaacca

SEQ ID NO: 514709 - RNA, 64 nt, hsa
auauuauuugcagcaagaaguucauucugugcaauauggacauguuugcaaaccauaccaaggg

SEQ ID NO: 514710 - RNA, 64 nt, hsa
cugacugggcuacaauccauuguucuuaguccaauauggacacugccuuaggcaauggucuaua

SEQ ID NO: 514711 - RNA, 64 nt, hsa
ucuguuguuucuaaugccguacuaaucaagacuguauggacacuugcaucuuaaguacuaagga

SEQ ID NO: 514712 - RNA, 64 nt, hsa
auccguuucccucauauauuuuggacaagauuuauauggacaaaauuaagucuuuaaaauuuag

SEQ ID NO: 514713 - RNA, 64 nt, hsa
aaagccuucuguguaaauauauacugauaaugccuauggacauuuggguaaaacccuguauaga

SEQ ID NO: 514714 - RNA, 64 nt, hsa
gugcuuaauuuggaccaaauuuuauuuagcuuaauauggacacugacacauuuugggggguaua

SEQ ID NO: 514715 - RNA, 64 nt, hsa; identical to SEQ ID NO: 290194

SEQ ID NO: 514716 - RNA, 64 nt, hsa; identical to SEQ ID NO: 290195

SEQ ID NO: 514717 - RNA, 64 nt, hsa; identical to SEQ ID NO: 290196

SEQ ID NO: 514718 - RNA, 64 nt, hsa; identical to SEQ ID NO: 290197

SEQ ID NO: 514719 - RNA, 64 nt, hsa; identical to SEQ ID NO: 290198

SEQ ID NO: 514720 - RNA, 64 nt, hsa; identical to SEQ ID NO: 290199

SEQ ID NO: 514721 - RNA, 64 nt, hsa; identical to SEQ ID NO: 290200

SEQ ID NO: 514722 - RNA, 64 nt, hsa; identical to SEQ ID NO: 290201

SEQ ID NO: 514723 - RNA, 64 nt, hsa; identical to SEQ ID NO: 290202

SEQ ID NO: 514724 - RNA, 64 nt, hsa; identical to SEQ ID NO: 290203

SEQ ID NO: 514725 - RNA, 64 nt, hsa; identical to SEQ ID NO: 290204

SEQ ID NO: 514726 - RNA, 64 nt, hsa; identical to SEQ ID NO: 290205

SEQ ID NO: 514727 - RNA, 64 nt, hsa; identical to SEQ ID NO: 290206

SEQ ID NO: 514728 - RNA, 64 nt, hsa; identical to SEQ ID NO: 290207

SEQ ID NO: 514729 - RNA, 64 nt, hsa; identical to SEQ ID NO: 290208

SEQ ID NO: 514730 - RNA, 64 nt, hsa; identical to SEQ ID NO: 290209

SEQ ID NO: 514731 - RNA, 64 nt, hsa; identical to SEQ ID NO: 290210

SEQ ID NO: 514732 - RNA, 64 nt, hsa; identical to SEQ ID NO: 290211

SEQ ID NO: 514733 - RNA, 64 nt, hsa; identical to SEQ ID NO: 290212

SEQ ID NO: 514734 - RNA, 64 nt, hsa; identical to SEQ ID NO: 290213

SEQ ID NO: 514735 - RNA, 64 nt, hsa; identical to SEQ ID NO: 290214

SEQ ID NO: 514736 - RNA, 64 nt, hsa; identical to SEQ ID NO: 290215

SEQ ID NO: 514737 - RNA, 64 nt, hsa; identical to SEQ ID NO: 290216

SEQ ID NO: 514738 - RNA, 64 nt, hsa; identical to SEQ ID NO: 290217

SEQ ID NO: 514739 - RNA, 64 nt, hsa; identical to SEQ ID NO: 290218

SEQ ID NO: 514740 - RNA, 64 nt, hsa; identical to SEQ ID NO: 290219

SEQ ID NO: 514741 - RNA, 64 nt, hsa; identical to SEQ ID NO: 290220

SEQ ID NO: 514742 - RNA, 64 nt, hsa; identical to SEQ ID NO: 290221

SEQ ID NO: 514743 - RNA, 64 nt, hsa; identical to SEQ ID NO: 290222

SEQ ID NO: 514744 - RNA, 64 nt, hsa; identical to SEQ ID NO: 290223

SEQ ID NO: 514745 - RNA, 64 nt, hsa; identical to SEQ ID NO: 290224

SEQ ID NO: 514746 - RNA, 64 nt, hsa; identical to SEQ ID NO: 290225

SEQ ID NO: 514747 - RNA, 64 nt, hsa; identical to SEQ ID NO: 290226

SEQ ID NO: 514748 - RNA, 64 nt, hsa; identical to SEQ ID NO: 290227

SEQ ID NO: 514749 - RNA, 64 nt, hsa; identical to SEQ ID NO: 290228

SEQ ID NO: 514750 - RNA, 64 nt, hsa; identical to SEQ ID NO: 290229

SEQ ID NO: 514751 - RNA, 64 nt, hsa; identical to SEQ ID NO: 283135

SEQ ID NO: 514752 - RNA, 64 nt, hsa; identical to SEQ ID NO: 283136

SEQ ID NO: 514753 - RNA, 64 nt, hsa; identical to SEQ ID NO: 283137

SEQ ID NO: 514754 - RNA, 64 nt, hsa; identical to SEQ ID NO: 283138

SEQ ID NO: 514755 - RNA, 64 nt, hsa; identical to SEQ ID NO: 283139

SEQ ID NO: 514756 - RNA, 64 nt, hsa; identical to SEQ ID NO: 283140

SEQ ID NO: 514757 - RNA, 64 nt, hsa; identical to SEQ ID NO: 283141

SEQ ID NO: 514758 - RNA, 64 nt, hsa; identical to SEQ ID NO: 283142

SEQ ID NO: 514759 - RNA, 64 nt, hsa; identical to SEQ ID NO: 283143

SEQ ID NO: 514760 - RNA, 64 nt, hsa; identical to SEQ ID NO: 283144

SEQ ID NO: 514761 - RNA, 64 nt, hsa; identical to SEQ ID NO: 283145

SEQ ID NO: 514762 - RNA, 64 nt, hsa; identical to SEQ ID NO: 283146

SEQ ID NO: 514763 - RNA, 64 nt, hsa; identical to SEQ ID NO: 283147

SEQ ID NO: 514764 - RNA, 64 nt, hsa; identical to SEQ ID NO: 283148

SEQ ID NO: 514765 - RNA, 64 nt, hsa; identical to SEQ ID NO: 283149

SEQ ID NO: 514766 - RNA, 64 nt, hsa; identical to SEQ ID NO: 283150

SEQ ID NO: 514767 - RNA, 64 nt, hsa; identical to SEQ ID NO: 283151

SEQ ID NO: 514768 - RNA, 64 nt, hsa; identical to SEQ ID NO: 283152

SEQ ID NO: 514769 - RNA, 64 nt, hsa; identical to SEQ ID NO: 283153

SEQ ID NO: 514770 - RNA, 64 nt, hsa; identical to SEQ ID NO: 283154

SEQ ID NO: 514771 - RNA, 64 nt, hsa; identical to SEQ ID NO: 283155

SEQ ID NO: 514772 - RNA, 64 nt, hsa; identical to SEQ ID NO: 283156

SEQ ID NO: 514773 - RNA, 64 nt, hsa; identical to SEQ ID NO: 283157

SEQ ID NO: 514774 - RNA, 64 nt, hsa; identical to SEQ ID NO: 283158

SEQ ID NO: 514775 - RNA, 64 nt, hsa; identical to SEQ ID NO: 283159

SEQ ID NO: 514776 - RNA, 64 nt, hsa; identical to SEQ ID NO: 283160

SEQ ID NO: 514777 - RNA, 64 nt, hsa; identical to SEQ ID NO: 283161

SEQ ID NO: 514778 - RNA, 64 nt, hsa; identical to SEQ ID NO: 283162

SEQ ID NO: 514779 - RNA, 64 nt, hsa; identical to SEQ ID NO: 283163

SEQ ID NO: 514780 - RNA, 64 nt, hsa; identical to SEQ ID NO: 283164

SEQ ID NO: 514781 - RNA, 64 nt, hsa; identical to SEQ ID NO: 283165

SEQ ID NO: 514782 - RNA, 64 nt, hsa; identical to SEQ ID NO: 283166

SEQ ID NO: 514783 - RNA, 64 nt, hsa; identical to SEQ ID NO: 283167

SEQ ID NO: 514784 - RNA, 64 nt, hsa; identical to SEQ ID NO: 157920

SEQ ID NO: 514785 - RNA, 64 nt, hsa; identical to SEQ ID NO: 157921

SEQ ID NO: 514786 - RNA, 64 nt, hsa; identical to SEQ ID NO: 157922

SEQ ID NO: 514787 - RNA, 64 nt, hsa; identical to SEQ ID NO: 157923

SEQ ID NO: 514788 - RNA, 64 nt, hsa; identical to SEQ ID NO: 157924

SEQ ID NO: 514789 - RNA, 64 nt, hsa; identical to SEQ ID NO: 157925

SEQ ID NO: 514790 - RNA, 64 nt, hsa; identical to SEQ ID NO: 157926

SEQ ID NO: 514791 - RNA, 64 nt, hsa; identical to SEQ ID NO: 157927

SEQ ID NO: 514792 - RNA, 64 nt, hsa; identical to SEQ ID NO: 157928

SEQ ID NO: 514793 - RNA, 64 nt, hsa; identical to SEQ ID NO: 157929

SEQ ID NO: 514794 - RNA, 64 nt, hsa; identical to SEQ ID NO: 157930

SEQ ID NO: 514795 - RNA, 64 nt, hsa; identical to SEQ ID NO: 157931

SEQ ID NO: 514796 - RNA, 64 nt, hsa; identical to SEQ ID NO: 157932

SEQ ID NO: 514797 - RNA, 64 nt, hsa; identical to SEQ ID NO: 157933

SEQ ID NO: 514798 - RNA, 64 nt, hsa; identical to SEQ ID NO: 157934

SEQ ID NO: 514799 - RNA, 64 nt, hsa; identical to SEQ ID NO: 157935

SEQ ID NO: 514800 - RNA, 64 nt, hsa; identical to SEQ ID NO: 157936

SEQ ID NO: 514801 - RNA, 64 nt, hsa; identical to SEQ ID NO: 157937

SEQ ID NO: 514802 - RNA, 64 nt, hsa; identical to SEQ ID NO: 157938

SEQ ID NO: 514803 - RNA, 64 nt, hsa; identical to SEQ ID NO: 157939

SEQ ID NO: 514804 - RNA, 64 nt, hsa; identical to SEQ ID NO: 157940

SEQ ID NO: 514805 - RNA, 64 nt, hsa; identical to SEQ ID NO: 157941

SEQ ID NO: 514806 - RNA, 64 nt, hsa; identical to SEQ ID NO: 157942

SEQ ID NO: 514807 - RNA, 64 nt, hsa; identical to SEQ ID NO: 157943

SEQ ID NO: 514808 - RNA, 64 nt, hsa; identical to SEQ ID NO: 157944

SEQ ID NO: 514809 - RNA, 64 nt, hsa; identical to SEQ ID NO: 157945

SEQ ID NO: 514810 - RNA, 64 nt, hsa; identical to SEQ ID NO: 157946

SEQ ID NO: 514811 - RNA, 64 nt, hsa; identical to SEQ ID NO: 157947

SEQ ID NO: 514812 - RNA, 64 nt, hsa; identical to SEQ ID NO: 157948

SEQ ID NO: 514813 - RNA, 64 nt, hsa; identical to SEQ ID NO: 157949

SEQ ID NO: 514814 - RNA, 62 nt, hsa; identical to SEQ ID NO: 115690

SEQ ID NO: 514815 - RNA, 64 nt, hsa; identical to SEQ ID NO: 157951

SEQ ID NO: 514816 - RNA, 64 nt, hsa; identical to SEQ ID NO: 157952

SEQ ID NO: 514817 - RNA, 64 nt, hsa; identical to SEQ ID NO: 157953

SEQ ID NO: 514818 - RNA, 64 nt, hsa; identical to SEQ ID NO: 157954

SEQ ID NO: 514819 - RNA, 64 nt, hsa; identical to SEQ ID NO: 157955

SEQ ID NO: 514820 - RNA, 64 nt, hsa; identical to SEQ ID NO: 157956

SEQ ID NO: 514821 - RNA, 64 nt, hsa; identical to SEQ ID NO: 157955

SEQ ID NO: 514822 - RNA, 64 nt, hsa; identical to SEQ ID NO: 157958

SEQ ID NO: 514823 - RNA, 64 nt, hsa; identical to SEQ ID NO: 157959

SEQ ID NO: 514824 - RNA, 64 nt, hsa; identical to SEQ ID NO: 157960

SEQ ID NO: 514825 - RNA, 64 nt, hsa; identical to SEQ ID NO: 157961

SEQ ID NO: 514826 - RNA, 64 nt, hsa; identical to SEQ ID NO: 157962

SEQ ID NO: 514827 - RNA, 64 nt, hsa; identical to SEQ ID NO: 157963

SEQ ID NO: 514828 - RNA, 64 nt, hsa; identical to SEQ ID NO: 157964

SEQ ID NO: 514829 - RNA, 64 nt, hsa; identical to SEQ ID NO: 157965

SEQ ID NO: 514830 - RNA, 64 nt, hsa; identical to SEQ ID NO: 157966

SEQ ID NO: 514831 - RNA, 64 nt, hsa; identical to SEQ ID NO: 157967

SEQ ID NO: 514832 - RNA, 64 nt, hsa; identical to SEQ ID NO: 157968

SEQ ID NO: 514833 - RNA, 64 nt, hsa; identical to SEQ ID NO: 157969

SEQ ID NO: 514834 - RNA, 64 nt, hsa; identical to SEQ ID NO: 157970

SEQ ID NO: 514835 - RNA, 64 nt, hsa; identical to SEQ ID NO: 157971

SEQ ID NO: 514836 - RNA, 64 nt, hsa; identical to SEQ ID NO: 157972

SEQ ID NO: 514837 - RNA, 64 nt, hsa; identical to SEQ ID NO: 157973

SEQ ID NO: 514838 - RNA, 64 nt, hsa; identical to SEQ ID NO: 106172

SEQ ID NO: 514839 - RNA, 64 nt, hsa; identical to SEQ ID NO: 106173

SEQ ID NO: 514840 - RNA, 64 nt, hsa; identical to SEQ ID NO: 106174

SEQ ID NO: 514841 - RNA, 64 nt, hsa; identical to SEQ ID NO: 106175

SEQ ID NO: 514842 - RNA, 64 nt, hsa; identical to SEQ ID NO: 106176

SEQ ID NO: 514843 - RNA, 64 nt, hsa; identical to SEQ ID NO: 106177

SEQ ID NO: 514844 - RNA, 64 nt, hsa; identical to SEQ ID NO: 106178

SEQ ID NO: 514845 - RNA, 64 nt, hsa; identical to SEQ ID NO: 106179

SEQ ID NO: 514846 - RNA, 64 nt, hsa; identical to SEQ ID NO: 106180

SEQ ID NO: 514847 - RNA, 64 nt, hsa; identical to SEQ ID NO: 106181

SEQ ID NO: 514848 - RNA, 64 nt, hsa; identical to SEQ ID NO: 106182

SEQ ID NO: 514849 - RNA, 64 nt, hsa; identical to SEQ ID NO: 106183

SEQ ID NO: 514850 - RNA, 64 nt, hsa; identical to SEQ ID NO: 106184

SEQ ID NO: 514851 - RNA, 64 nt, hsa; identical to SEQ ID NO: 106185

SEQ ID NO: 514852 - RNA, 64 nt, hsa; identical to SEQ ID NO: 106186

SEQ ID NO: 514853 - RNA, 64 nt, hsa; identical to SEQ ID NO: 106187

SEQ ID NO: 514854 - RNA, 64 nt, hsa; identical to SEQ ID NO: 106188

SEQ ID NO: 514855 - RNA, 64 nt, hsa; identical to SEQ ID NO: 106189

SEQ ID NO: 514856 - RNA, 64 nt, hsa; identical to SEQ ID NO: 125388

SEQ ID NO: 514857 - RNA, 64 nt, hsa; identical to SEQ ID NO: 125389

SEQ ID NO: 514858 - RNA, 64 nt, hsa; identical to SEQ ID NO: 125390

SEQ ID NO: 514859 - RNA, 64 nt, hsa; identical to SEQ ID NO: 125391

SEQ ID NO: 514860 - RNA, 64 nt, hsa; identical to SEQ ID NO: 125392

SEQ ID NO: 514861 - RNA, 64 nt, hsa; identical to SEQ ID NO: 125393

SEQ ID NO: 514862 - RNA, 64 nt, hsa; identical to SEQ ID NO: 125394

SEQ ID NO: 514863 - RNA, 64 nt, hsa; identical to SEQ ID NO: 125395

SEQ ID NO: 514864 - RNA, 64 nt, hsa; identical to SEQ ID NO: 125396

SEQ ID NO: 514865 - RNA, 64 nt, hsa; identical to SEQ ID NO: 125397

SEQ ID NO: 514866 - RNA, 64 nt, hsa; identical to SEQ ID NO: 125398

SEQ ID NO: 514867 - RNA, 64 nt, hsa; identical to SEQ ID NO: 125399

SEQ ID NO: 514868 - RNA, 64 nt, hsa; identical to SEQ ID NO: 125400

SEQ ID NO: 514869 - RNA, 64 nt, hsa; identical to SEQ ID NO: 125401

SEQ ID NO: 514870 - RNA, 64 nt, hsa; identical to SEQ ID NO: 255986

SEQ ID NO: 514871 - RNA, 64 nt, hsa; identical to SEQ ID NO: 255987

SEQ ID NO: 514872 - RNA, 64 nt, hsa; identical to SEQ ID NO: 255988

SEQ ID NO: 514873 - RNA, 64 nt, hsa; identical to SEQ ID NO: 255989

SEQ ID NO: 514874 - RNA, 64 nt, hsa; identical to SEQ ID NO: 255990

SEQ ID NO: 514875 - RNA, 64 nt, hsa; identical to SEQ ID NO: 255991

SEQ ID NO: 514876 - RNA, 64 nt, hsa; identical to SEQ ID NO: 255992

SEQ ID NO: 514877 - RNA, 64 nt, hsa; identical to SEQ ID NO: 255993

SEQ ID NO: 514878 - RNA, 64 nt, hsa; identical to SEQ ID NO: 255994

SEQ ID NO: 514879 - RNA, 64 nt, hsa; identical to SEQ ID NO: 255995

SEQ ID NO: 514880 - RNA, 64 nt, hsa; identical to SEQ ID NO: 50853

SEQ ID NO: 514881 - RNA, 64 nt, hsa; identical to SEQ ID NO: 50854

SEQ ID NO: 514882 - RNA, 64 nt, hsa; identical to SEQ ID NO: 50855

SEQ ID NO: 514883 - RNA, 64 nt, hsa; identical to SEQ ID NO: 50856

SEQ ID NO: 514884 - RNA, 64 nt, hsa; identical to SEQ ID NO: 50857

SEQ ID NO: 514885 - RNA, 64 nt, hsa; identical to SEQ ID NO: 50858

SEQ ID NO: 514886 - RNA, 64 nt, hsa; identical to SEQ ID NO: 50859

SEQ ID NO: 514887 - RNA, 64 nt, hsa; identical to SEQ ID NO: 50860

SEQ ID NO: 514888 - RNA, 64 nt, hsa; identical to SEQ ID NO: 50861

SEQ ID NO: 514889 - RNA, 64 nt, hsa; identical to SEQ ID NO: 50862

SEQ ID NO: 514890 - RNA, 64 nt, hsa; identical to SEQ ID NO: 50863

SEQ ID NO: 514891 - RNA, 64 nt, hsa; identical to SEQ ID NO: 50864

SEQ ID NO: 514892 - RNA, 64 nt, hsa; identical to SEQ ID NO: 50865

SEQ ID NO: 514893 - RNA, 64 nt, hsa; identical to SEQ ID NO: 50866

SEQ ID NO: 514894 - RNA, 64 nt, hsa; identical to SEQ ID NO: 50867

SEQ ID NO: 514895 - RNA, 64 nt, hsa; identical to SEQ ID NO: 50868

SEQ ID NO: 514896 - RNA, 64 nt, hsa; identical to SEQ ID NO: 50869

SEQ ID NO: 514897 - RNA, 64 nt, hsa; identical to SEQ ID NO: 50870

SEQ ID NO: 514898 - RNA, 64 nt, hsa; identical to SEQ ID NO: 50871

SEQ ID NO: 514899 - RNA, 64 nt, hsa; identical to SEQ ID NO: 50872

SEQ ID NO: 514900 - RNA, 64 nt, hsa; identical to SEQ ID NO: 50873

SEQ ID NO: 514901 - RNA, 64 nt, hsa; identical to SEQ ID NO: 50874

SEQ ID NO: 514902 - RNA, 64 nt, hsa; identical to SEQ ID NO: 50875

SEQ ID NO: 514903 - RNA, 64 nt, hsa; identical to SEQ ID NO: 50876

SEQ ID NO: 514904 - RNA, 64 nt, hsa; identical to SEQ ID NO: 50877

SEQ ID NO: 514905 - RNA, 64 nt, hsa; identical to SEQ ID NO: 50878

SEQ ID NO: 514906 - RNA, 64 nt, hsa; identical to SEQ ID NO: 50879

SEQ ID NO: 514907 - RNA, 64 nt, hsa; identical to SEQ ID NO: 50880

SEQ ID NO: 514908 - RNA, 64 nt, hsa; identical to SEQ ID NO: 50881

SEQ ID NO: 514909 - RNA, 64 nt, hsa; identical to SEQ ID NO: 50882

SEQ ID NO: 514910 - RNA, 64 nt, hsa; identical to SEQ ID NO: 50883

SEQ ID NO: 514911 - RNA, 64 nt, hsa; identical to SEQ ID NO: 50884

SEQ ID NO: 514912 - RNA, 64 nt, hsa; identical to SEQ ID NO: 50885

SEQ ID NO: 514913 - RNA, 64 nt, hsa; identical to SEQ ID NO: 50886

SEQ ID NO: 514914 - RNA, 64 nt, hsa; identical to SEQ ID NO: 50887

SEQ ID NO: 514915 - RNA, 64 nt, hsa; identical to SEQ ID NO: 50888

SEQ ID NO: 514916 - RNA, 64 nt, hsa; identical to SEQ ID NO: 50889

SEQ ID NO: 514917 - RNA, 64 nt, hsa; identical to SEQ ID NO: 50890

SEQ ID NO: 514918 - RNA, 64 nt, hsa; identical to SEQ ID NO: 50891

SEQ ID NO: 514919 - RNA, 64 nt, hsa; identical to SEQ ID NO: 50892

SEQ ID NO: 514920 - RNA, 64 nt, hsa; identical to SEQ ID NO: 50893

SEQ ID NO: 514921 - RNA, 64 nt, hsa; identical to SEQ ID NO: 50894

SEQ ID NO: 514922 - RNA, 64 nt, hsa; identical to SEQ ID NO: 50895

SEQ ID NO: 514923 - RNA, 64 nt, hsa; identical to SEQ ID NO: 50896

SEQ ID NO: 514924 - RNA, 64 nt, hsa; identical to SEQ ID NO: 50897

SEQ ID NO: 514925 - RNA, 64 nt, hsa; identical to SEQ ID NO: 50898

SEQ ID NO: 514926 - RNA, 64 nt, hsa; identical to SEQ ID NO: 50899

SEQ ID NO: 514927 - RNA, 64 nt, hsa; identical to SEQ ID NO: 50900

SEQ ID NO: 514928 - RNA, 64 nt, hsa; identical to SEQ ID NO: 50901

SEQ ID NO: 514929 - RNA, 64 nt, hsa; identical to SEQ ID NO: 50902

SEQ ID NO: 514930 - RNA, 64 nt, hsa; identical to SEQ ID NO: 50903

SEQ ID NO: 514931 - RNA, 64 nt, hsa; identical to SEQ ID NO: 50904

SEQ ID NO: 514932 - RNA, 64 nt, hsa; identical to SEQ ID NO: 50905

SEQ ID NO: 514933 - RNA, 64 nt, hsa; identical to SEQ ID NO: 50906

SEQ ID NO: 514934 - RNA, 64 nt, hsa; identical to SEQ ID NO: 50907

SEQ ID NO: 514935 - RNA, 64 nt, hsa; identical to SEQ ID NO: 50908

SEQ ID NO: 514936 - RNA, 64 nt, hsa; identical to SEQ ID NO: 50909

SEQ ID NO: 514937 - RNA, 64 nt, hsa; identical to SEQ ID NO: 50910

SEQ ID NO: 514938 - RNA, 64 nt, hsa; identical to SEQ ID NO: 50911

SEQ ID NO: 514939 - RNA, 64 nt, hsa; identical to SEQ ID NO: 50912

SEQ ID NO: 514940 - RNA, 64 nt, hsa; identical to SEQ ID NO: 50913

SEQ ID NO: 514941 - RNA, 64 nt, hsa; identical to SEQ ID NO: 50914

SEQ ID NO: 514942 - RNA, 64 nt, hsa; identical to SEQ ID NO: 50915

SEQ ID NO: 514943 - RNA, 64 nt, hsa; identical to SEQ ID NO: 50916

SEQ ID NO: 514944 - RNA, 64 nt, hsa; identical to SEQ ID NO: 50917

SEQ ID NO: 514945 - RNA, 64 nt, hsa; identical to SEQ ID NO: 50918

SEQ ID NO: 514946 - RNA, 64 nt, hsa; identical to SEQ ID NO: 50919

SEQ ID NO: 514947 - RNA, 64 nt, hsa; identical to SEQ ID NO: 50920

SEQ ID NO: 514948 - RNA, 64 nt, hsa; identical to SEQ ID NO: 50921

SEQ ID NO: 514949 - RNA, 64 nt, hsa; identical to SEQ ID NO: 50922

SEQ ID NO: 514950 - RNA, 64 nt, hsa; identical to SEQ ID NO: 50923

SEQ ID NO: 514951 - RNA, 64 nt, hsa; identical to SEQ ID NO: 50924

SEQ ID NO: 514952 - RNA, 64 nt, hsa; identical to SEQ ID NO: 50925

SEQ ID NO: 514953 - RNA, 64 nt, hsa; identical to SEQ ID NO: 50926

SEQ ID NO: 514954 - RNA, 64 nt, hsa; identical to SEQ ID NO: 50927

SEQ ID NO: 514955 - RNA, 64 nt, hsa; identical to SEQ ID NO: 50928

SEQ ID NO: 514956 - RNA, 64 nt, hsa; identical to SEQ ID NO: 494526

SEQ ID NO: 514957 - RNA, 64 nt, hsa; identical to SEQ ID NO: 494527

SEQ ID NO: 514958 - RNA, 64 nt, hsa; identical to SEQ ID NO: 494528

SEQ ID NO: 514959 - RNA, 64 nt, hsa; identical to SEQ ID NO: 494529

SEQ ID NO: 514960 - RNA, 64 nt, hsa; identical to SEQ ID NO: 494530

SEQ ID NO: 514961 - RNA, 64 nt, hsa; identical to SEQ ID NO: 494531

SEQ ID NO: 514962 - RNA, 64 nt, hsa; identical to SEQ ID NO: 494532

SEQ ID NO: 514963 - RNA, 64 nt, hsa; identical to SEQ ID NO: 494533

SEQ ID NO: 514964 - RNA, 64 nt, hsa; identical to SEQ ID NO: 494534

SEQ ID NO: 514965 - RNA, 64 nt, hsa; identical to SEQ ID NO: 494535

SEQ ID NO: 514966 - RNA, 64 nt, hsa; identical to SEQ ID NO: 494536

SEQ ID NO: 514967 - RNA, 64 nt, hsa; identical to SEQ ID NO: 494537

SEQ ID NO: 514968 - RNA, 64 nt, hsa; identical to SEQ ID NO: 494538

SEQ ID NO: 514969 - RNA, 64 nt, hsa; identical to SEQ ID NO: 494539

SEQ ID NO: 514970 - RNA, 64 nt, hsa; identical to SEQ ID NO: 494540

SEQ ID NO: 514971 - RNA, 64 nt, hsa; identical to SEQ ID NO: 494541

SEQ ID NO: 514972 - RNA, 64 nt, hsa; identical to SEQ ID NO: 218512

SEQ ID NO: 514973 - RNA, 64 nt, hsa; identical to SEQ ID NO: 218513

SEQ ID NO: 514974 - RNA, 64 nt, hsa; identical to SEQ ID NO: 218514

SEQ ID NO: 514975 - RNA, 64 nt, hsa; identical to SEQ ID NO: 218515

SEQ ID NO: 514976 - RNA, 64 nt, hsa; identical to SEQ ID NO: 218516

SEQ ID NO: 514977 - RNA, 64 nt, hsa; identical to SEQ ID NO: 218517

SEQ ID NO: 514978 - RNA, 64 nt, hsa; identical to SEQ ID NO: 218518

SEQ ID NO: 514979 - RNA, 64 nt, hsa; identical to SEQ ID NO: 218519

SEQ ID NO: 514980 - RNA, 64 nt, hsa
cuguucuguuuaagaggaauugaauuuaaaaaugagagaguauuaaaacucauguggcaguauc

SEQ ID NO: 514981 - RNA, 64 nt, hsa
uguuugccuuugauaaaauacaggauuuaagaacagagaguacugcaaaaugccaugcagacuu

SEQ ID NO: 514982 - RNA, 64 nt, hsa
gucuaguucaacgugagaguugaauaguugcaucagagaguauaugguccacaagccuaacuua

SEQ ID NO: 514983 - RNA, 64 nt, hsa
agcuaaaaauuacaauaaucaaacuuaaggagauagagaguagaaugaugguuaccagaggcug

SEQ ID NO: 514984 - RNA, 64 nt, hsa
guggagaaaggguuuugcaaacugaaagaucuguagagaguagcaguauuucauugguaccugg

SEQ ID NO: 514985 - RNA, 64 nt, hsa
uauguaaaagugaaagaguucacuccaaaucaguagagaguaauauugaagacaaaauauuugg

SEQ ID NO: 514986 - RNA, 64 nt, hsa; identical to SEQ ID NO: 99898

SEQ ID NO: 514987 - RNA, 64 nt, hsa; identical to SEQ ID NO: 99899

SEQ ID NO: 514988 - RNA, 64 nt, hsa; identical to SEQ ID NO: 99900

SEQ ID NO: 514989 - RNA, 64 nt, hsa; identical to SEQ ID NO: 99901

SEQ ID NO: 514990 - RNA, 64 nt, hsa; identical to SEQ ID NO: 99902

SEQ ID NO: 514991 - RNA, 64 nt, hsa; identical to SEQ ID NO: 99903

SEQ ID NO: 514992 - RNA, 64 nt, hsa; identical to SEQ ID NO: 99904

SEQ ID NO: 514993 - RNA, 64 nt, hsa; identical to SEQ ID NO: 99905

SEQ ID NO: 514994 - RNA, 64 nt, hsa; identical to SEQ ID NO: 99906

SEQ ID NO: 514995 - RNA, 64 nt, hsa; identical to SEQ ID NO: 99907

SEQ ID NO: 514996 - RNA, 64 nt, hsa; identical to SEQ ID NO: 99908

SEQ ID NO: 514997 - RNA, 64 nt, hsa; identical to SEQ ID NO: 99909

SEQ ID NO: 514998 - RNA, 64 nt, hsa; identical to SEQ ID NO: 99910

SEQ ID NO: 514999 - RNA, 64 nt, hsa; identical to SEQ ID NO: 99911

SEQ ID NO: 515000 - RNA, 64 nt, hsa; identical to SEQ ID NO: 99912

SEQ ID NO: 515001 - RNA, 64 nt, hsa; identical to SEQ ID NO: 99913

SEQ ID NO: 515002 - RNA, 64 nt, hsa; identical to SEQ ID NO: 99914

SEQ ID NO: 515003 - RNA, 64 nt, hsa; identical to SEQ ID NO: 99915

SEQ ID NO: 515004 - RNA, 64 nt, hsa; identical to SEQ ID NO: 99916

SEQ ID NO: 515005 - RNA, 64 nt, hsa; identical to SEQ ID NO: 99917

SEQ ID NO: 515006 - RNA, 64 nt, hsa; identical to SEQ ID NO: 99918

SEQ ID NO: 515007 - RNA, 64 nt, hsa; identical to SEQ ID NO: 99919

SEQ ID NO: 515008 - RNA, 64 nt, hsa; identical to SEQ ID NO: 99920

SEQ ID NO: 515009 - RNA, 64 nt, hsa; identical to SEQ ID NO: 99921

SEQ ID NO: 515010 - RNA, 64 nt, hsa; identical to SEQ ID NO: 99922

SEQ ID NO: 515011 - RNA, 64 nt, hsa; identical to SEQ ID NO: 99923

SEQ ID NO: 515012 - RNA, 64 nt, hsa; identical to SEQ ID NO: 99924

SEQ ID NO: 515013 - RNA, 64 nt, hsa; identical to SEQ ID NO: 99925

SEQ ID NO: 515014 - RNA, 64 nt, hsa; identical to SEQ ID NO: 99926

SEQ ID NO: 515015 - RNA, 64 nt, hsa; identical to SEQ ID NO: 99927

SEQ ID NO: 515016 - RNA, 64 nt, hsa; identical to SEQ ID NO: 99928

SEQ ID NO: 515017 - RNA, 64 nt, hsa; identical to SEQ ID NO: 99929

SEQ ID NO: 515018 - RNA, 64 nt, hsa; identical to SEQ ID NO: 99930

SEQ ID NO: 515019 - RNA, 64 nt, hsa; identical to SEQ ID NO: 99931

SEQ ID NO: 515020 - RNA, 64 nt, hsa; identical to SEQ ID NO: 99932

SEQ ID NO: 515021 - RNA, 64 nt, hsa; identical to SEQ ID NO: 99933

SEQ ID NO: 515022 - RNA, 64 nt, hsa; identical to SEQ ID NO: 99934

SEQ ID NO: 515023 - RNA, 64 nt, hsa; identical to SEQ ID NO: 99935

SEQ ID NO: 515024 - RNA, 64 nt, hsa; identical to SEQ ID NO: 99936

SEQ ID NO: 515025 - RNA, 64 nt, hsa; identical to SEQ ID NO: 99937

SEQ ID NO: 515026 - RNA, 64 nt, hsa; identical to SEQ ID NO: 99938

SEQ ID NO: 515027 - RNA, 64 nt, hsa; identical to SEQ ID NO: 99939

SEQ ID NO: 515028 - RNA, 64 nt, hsa; identical to SEQ ID NO: 99940

SEQ ID NO: 515029 - RNA, 64 nt, hsa; identical to SEQ ID NO: 99941

SEQ ID NO: 515030 - RNA, 64 nt, hsa; identical to SEQ ID NO: 99942

SEQ ID NO: 515031 - RNA, 64 nt, hsa; identical to SEQ ID NO: 99943

SEQ ID NO: 515032 - RNA, 64 nt, hsa; identical to SEQ ID NO: 99944

SEQ ID NO: 515033 - RNA, 64 nt, hsa; identical to SEQ ID NO: 99945

SEQ ID NO: 515034 - RNA, 64 nt, hsa; identical to SEQ ID NO: 99946

SEQ ID NO: 515035 - RNA, 64 nt, hsa
aaacaacagaaauuuauucucuuaacaguuccagagacuaaauguccagacucacaauguccca

SEQ ID NO: 515036 - RNA, 64 nt, hsa
gauaaguuacuucaauuauaaaauugaauuuugcagacuaaauuauuuuauaaggcuguugcua

SEQ ID NO: 515037 - RNA, 64 nt, hsa
gucauaauaagcaaauuauuggcuucuuucuucuagacuaaaagaaauuaaagagaugaaacaa

SEQ ID NO: 515038 - RNA, 64 nt, hsa
gauaucauuaauuuuauaucaggauucauguaagagacuaaaaaugauccauagugguuaguac

SEQ ID NO: 515039 - RNA, 64 nt, hsa
agaauuuaacuaaaggguaguuguuuuacaaugaagacuaaaacugaacaagauguugcaugcu

SEQ ID NO: 515040 - RNA, 64 nt, hsa
auuauaagaaagaguaguuguugauuaaauuuucagacuaaauauaggacagguacaauuuugg

SEQ ID NO: 515041 - RNA, 64 nt, hsa
gaauucgucauucucaaccuuugaauuaaagcuuagacuaaauaguaauauaucgugggaagga

SEQ ID NO: 515042 - RNA, 64 nt, hsa
uguuaccauaauguaagagaagguccuggaacagagacuaaaucccacgaaacugacauuguua

SEQ ID NO: 515043 - RNA, 64 nt, hsa
ugcauuguuauuuuuuuuuaaacucaguuuaaaaagacuaaaacguucuuucaaaagaggcauc

SEQ ID NO: 515044 - RNA, 64 nt, hsa
aagacacuuugguaugaugcauauacaaguuggaagacuaaagaggugcagugugaucugagcc

SEQ ID NO: 515045 - RNA, 64 nt, hsa
uaacuccuggauuucagcuucacuuuuaaccugcagacuaaauuucuuucucaauuaugucaga

SEQ ID NO: 515046 - RNA, 64 nt, hsa
aaaauauuuuucuuaugaauucuuaaaguacuaaagacuaaaaugcaaaaagcaauacuuaaua

SEQ ID NO: 515047 - RNA, 64 nt, hsa; identical to SEQ ID NO: 277303

SEQ ID NO: 515048 - RNA, 64 nt, hsa; identical to SEQ ID NO: 277304

SEQ ID NO: 515049 - RNA, 64 nt, hsa; identical to SEQ ID NO: 277305

SEQ ID NO: 515050 - RNA, 64 nt, hsa; identical to SEQ ID NO: 277306

SEQ ID NO: 515051 - RNA, 64 nt, hsa; identical to SEQ ID NO: 277307

SEQ ID NO: 515052 - RNA, 64 nt, hsa; identical to SEQ ID NO: 277308

SEQ ID NO: 515053 - RNA, 64 nt, hsa; identical to SEQ ID NO: 277309

SEQ ID NO: 515054 - RNA, 64 nt, hsa; identical to SEQ ID NO: 277310

SEQ ID NO: 515055 - RNA, 64 nt, hsa; identical to SEQ ID NO: 277311

SEQ ID NO: 515056 - RNA, 64 nt, hsa; identical to SEQ ID NO: 277312

SEQ ID NO: 515057 - RNA, 64 nt, hsa; identical to SEQ ID NO: 277313

SEQ ID NO: 515058 - RNA, 64 nt, hsa; identical to SEQ ID NO: 277314

SEQ ID NO: 515059 - RNA, 64 nt, hsa; identical to SEQ ID NO: 277315

SEQ ID NO: 515060 - RNA, 64 nt, hsa; identical to SEQ ID NO: 277316

SEQ ID NO: 515061 - RNA, 64 nt, hsa; identical to SEQ ID NO: 277317

SEQ ID NO: 515062 - RNA, 64 nt, hsa; identical to SEQ ID NO: 277318

SEQ ID NO: 515063 - RNA, 64 nt, hsa; identical to SEQ ID NO: 277319

SEQ ID NO: 515064 - RNA, 64 nt, hsa; identical to SEQ ID NO: 277320

SEQ ID NO: 515065 - RNA, 64 nt, hsa; identical to SEQ ID NO: 277321

SEQ ID NO: 515066 - RNA, 64 nt, hsa; identical to SEQ ID NO: 277322

SEQ ID NO: 515067 - RNA, 62 nt, hsa; identical to SEQ ID NO: 277323

SEQ ID NO: 515068 - RNA, 64 nt, hsa; identical to SEQ ID NO: 277324

SEQ ID NO: 515069 - RNA, 64 nt, hsa; identical to SEQ ID NO: 277325

SEQ ID NO: 515070 - RNA, 64 nt, hsa; identical to SEQ ID NO: 277326

SEQ ID NO: 515071 - RNA, 64 nt, hsa; identical to SEQ ID NO: 277327

SEQ ID NO: 515072 - RNA, 64 nt, hsa; identical to SEQ ID NO: 277328

SEQ ID NO: 515073 - RNA, 64 nt, hsa; identical to SEQ ID NO: 277329

SEQ ID NO: 515074 - RNA, 64 nt, hsa; identical to SEQ ID NO: 277330

SEQ ID NO: 515075 - RNA, 64 nt, hsa; identical to SEQ ID NO: 277331

SEQ ID NO: 515076 - RNA, 64 nt, hsa; identical to SEQ ID NO: 277332

SEQ ID NO: 515077 - RNA, 64 nt, hsa; identical to SEQ ID NO: 93178

SEQ ID NO: 515078 - RNA, 64 nt, hsa; identical to SEQ ID NO: 93179

SEQ ID NO: 515079 - RNA, 64 nt, hsa; identical to SEQ ID NO: 93180

SEQ ID NO: 515080 - RNA, 64 nt, hsa; identical to SEQ ID NO: 93181

SEQ ID NO: 515081 - RNA, 64 nt, hsa; identical to SEQ ID NO: 169676

SEQ ID NO: 515082 - RNA, 64 nt, hsa; identical to SEQ ID NO: 169677

SEQ ID NO: 515083 - RNA, 64 nt, hsa; identical to SEQ ID NO: 169678

SEQ ID NO: 515084 - RNA, 64 nt, hsa; identical to SEQ ID NO: 169679

SEQ ID NO: 515085 - RNA, 64 nt, hsa; identical to SEQ ID NO: 169680

SEQ ID NO: 515086 - RNA, 64 nt, hsa; identical to SEQ ID NO: 169681

SEQ ID NO: 515087 - RNA, 64 nt, hsa; identical to SEQ ID NO: 169682

SEQ ID NO: 515088 - RNA, 64 nt, hsa; identical to SEQ ID NO: 169683

SEQ ID NO: 515089 - RNA, 64 nt, hsa; identical to SEQ ID NO: 169684

SEQ ID NO: 515090 - RNA, 64 nt, hsa; identical to SEQ ID NO: 169685

SEQ ID NO: 515091 - RNA, 64 nt, hsa; identical to SEQ ID NO: 169686

SEQ ID NO: 515092 - RNA, 64 nt, hsa; identical to SEQ ID NO: 169687

SEQ ID NO: 515093 - RNA, 64 nt, hsa; identical to SEQ ID NO: 169688

SEQ ID NO: 515094 - RNA, 64 nt, hsa; identical to SEQ ID NO: 169689

SEQ ID NO: 515095 - RNA, 64 nt, hsa; identical to SEQ ID NO: 169690

SEQ ID NO: 515096 - RNA, 64 nt, hsa; identical to SEQ ID NO: 169691

SEQ ID NO: 515097 - RNA, 64 nt, hsa; identical to SEQ ID NO: 169692

SEQ ID NO: 515098 - RNA, 64 nt, hsa; identical to SEQ ID NO: 169693

SEQ ID NO: 515099 - RNA, 64 nt, hsa; identical to SEQ ID NO: 169694

SEQ ID NO: 515100 - RNA, 64 nt, hsa; identical to SEQ ID NO: 169695

SEQ ID NO: 515101 - RNA, 64 nt, hsa; identical to SEQ ID NO: 169696

SEQ ID NO: 515102 - RNA, 64 nt, hsa; identical to SEQ ID NO: 169697

SEQ ID NO: 515103 - RNA, 64 nt, hsa; identical to SEQ ID NO: 169698

SEQ ID NO: 515104 - RNA, 64 nt, hsa; identical to SEQ ID NO: 169699

SEQ ID NO: 515105 - RNA, 64 nt, hsa; identical to SEQ ID NO: 169700

SEQ ID NO: 515106 - RNA, 64 nt, hsa; identical to SEQ ID NO: 169701

SEQ ID NO: 515107 - RNA, 64 nt, hsa; identical to SEQ ID NO: 169702

SEQ ID NO: 515108 - RNA, 64 nt, hsa; identical to SEQ ID NO: 169703

SEQ ID NO: 515109 - RNA, 64 nt, hsa; identical to SEQ ID NO: 169704

SEQ ID NO: 515110 - RNA, 64 nt, hsa; identical to SEQ ID NO: 169705

SEQ ID NO: 515111 - RNA, 64 nt, hsa; identical to SEQ ID NO: 169706

SEQ ID NO: 515112 - RNA, 64 nt, hsa; identical to SEQ ID NO: 169707

SEQ ID NO: 515113 - RNA, 64 nt, hsa; identical to SEQ ID NO: 169708

SEQ ID NO: 515114 - RNA, 64 nt, hsa; identical to SEQ ID NO: 169709

SEQ ID NO: 515115 - RNA, 64 nt, hsa; identical to SEQ ID NO: 169710

SEQ ID NO: 515116 - RNA, 64 nt, hsa; identical to SEQ ID NO: 169711

SEQ ID NO: 515117 - RNA, 64 nt, hsa; identical to SEQ ID NO: 169712

SEQ ID NO: 515118 - RNA, 64 nt, hsa; identical to SEQ ID NO: 169713

SEQ ID NO: 515119 - RNA, 64 nt, hsa; identical to SEQ ID NO: 169714

SEQ ID NO: 515120 - RNA, 64 nt, hsa; identical to SEQ ID NO: 169715

SEQ ID NO: 515121 - RNA, 64 nt, hsa; identical to SEQ ID NO: 169716

SEQ ID NO: 515122 - RNA, 64 nt, hsa; identical to SEQ ID NO: 169717

SEQ ID NO: 515123 - RNA, 64 nt, hsa; identical to SEQ ID NO: 169718

SEQ ID NO: 515124 - RNA, 64 nt, hsa; identical to SEQ ID NO: 169719

SEQ ID NO: 515125 - RNA, 64 nt, hsa; identical to SEQ ID NO: 169720

SEQ ID NO: 515126 - RNA, 62 nt, hsa; identical to SEQ ID NO: 169721

SEQ ID NO: 515127 - RNA, 64 nt, hsa; identical to SEQ ID NO: 169722

SEQ ID NO: 515128 - RNA, 64 nt, hsa; identical to SEQ ID NO: 169723

SEQ ID NO: 515129 - RNA, 64 nt, hsa; identical to SEQ ID NO: 169724

SEQ ID NO: 515130 - RNA, 64 nt, hsa; identical to SEQ ID NO: 169725

SEQ ID NO: 515131 - RNA, 64 nt, hsa; identical to SEQ ID NO: 169726

SEQ ID NO: 515132 - RNA, 64 nt, hsa; identical to SEQ ID NO: 169727

SEQ ID NO: 515133 - RNA, 64 nt, hsa; identical to SEQ ID NO: 169728

SEQ ID NO: 515134 - RNA, 64 nt, hsa; identical to SEQ ID NO: 169729

SEQ ID NO: 515135 - RNA, 64 nt, hsa; identical to SEQ ID NO: 169730

SEQ ID NO: 515136 - RNA, 64 nt, hsa; identical to SEQ ID NO: 169731

SEQ ID NO: 515137 - RNA, 64 nt, hsa; identical to SEQ ID NO: 169732

SEQ ID NO: 515138 - RNA, 64 nt, hsa; identical to SEQ ID NO: 169733

SEQ ID NO: 515139 - RNA, 64 nt, hsa; identical to SEQ ID NO: 169734

SEQ ID NO: 515140 - RNA, 64 nt, hsa; identical to SEQ ID NO: 343169

SEQ ID NO: 515141 - RNA, 64 nt, hsa; identical to SEQ ID NO: 343170

SEQ ID NO: 515142 - RNA, 64 nt, hsa; identical to SEQ ID NO: 343171

SEQ ID NO: 515143 - RNA, 64 nt, hsa; identical to SEQ ID NO: 343172

SEQ ID NO: 515144 - RNA, 64 nt, hsa; identical to SEQ ID NO: 343173

SEQ ID NO: 515145 - RNA, 64 nt, hsa; identical to SEQ ID NO: 343174

SEQ ID NO: 515146 - RNA, 64 nt, hsa; identical to SEQ ID NO: 343175

SEQ ID NO: 515147 - RNA, 64 nt, hsa; identical to SEQ ID NO: 343176

SEQ ID NO: 515148 - RNA, 64 nt, hsa; identical to SEQ ID NO: 343177

SEQ ID NO: 515149 - RNA, 64 nt, hsa; identical to SEQ ID NO: 343178

SEQ ID NO: 515150 - RNA, 64 nt, hsa; identical to SEQ ID NO: 343179

SEQ ID NO: 515151 - RNA, 64 nt, hsa; identical to SEQ ID NO: 343180

SEQ ID NO: 515152 - RNA, 64 nt, hsa; identical to SEQ ID NO: 343181

SEQ ID NO: 515153 - RNA, 64 nt, hsa; identical to SEQ ID NO: 343182

SEQ ID NO: 515154 - RNA, 64 nt, hsa; identical to SEQ ID NO: 343183

SEQ ID NO: 515155 - RNA, 64 nt, hsa; identical to SEQ ID NO: 343184

SEQ ID NO: 515156 - RNA, 64 nt, hsa; identical to SEQ ID NO: 343185

SEQ ID NO: 515157 - RNA, 64 nt, hsa; identical to SEQ ID NO: 343186

SEQ ID NO: 515158 - RNA, 64 nt, hsa; identical to SEQ ID NO: 343187

SEQ ID NO: 515159 - RNA, 64 nt, hsa; identical to SEQ ID NO: 343188

SEQ ID NO: 515160 - RNA, 64 nt, hsa; identical to SEQ ID NO: 343189

SEQ ID NO: 515161 - RNA, 64 nt, hsa; identical to SEQ ID NO: 343190

SEQ ID NO: 515162 - RNA, 64 nt, hsa; identical to SEQ ID NO: 343191

SEQ ID NO: 515163 - RNA, 64 nt, hsa; identical to SEQ ID NO: 343192

SEQ ID NO: 515164 - RNA, 64 nt, hsa; identical to SEQ ID NO: 343193

SEQ ID NO: 515165 - RNA, 64 nt, hsa; identical to SEQ ID NO: 343194

SEQ ID NO: 515166 - RNA, 64 nt, hsa; identical to SEQ ID NO: 343195

SEQ ID NO: 515167 - RNA, 64 nt, hsa; identical to SEQ ID NO: 343196

SEQ ID NO: 515168 - RNA, 64 nt, hsa; identical to SEQ ID NO: 343197

SEQ ID NO: 515169 - RNA, 64 nt, hsa; identical to SEQ ID NO: 343198

SEQ ID NO: 515170 - RNA, 64 nt, hsa; identical to SEQ ID NO: 343199

SEQ ID NO: 515171 - RNA, 64 nt, hsa; identical to SEQ ID NO: 343200

SEQ ID NO: 515172 - RNA, 64 nt, hsa; identical to SEQ ID NO: 343201

SEQ ID NO: 515173 - RNA, 64 nt, hsa; identical to SEQ ID NO: 343202

SEQ ID NO: 515174 - RNA, 64 nt, hsa; identical to SEQ ID NO: 343203

SEQ ID NO: 515175 - RNA, 64 nt, hsa; identical to SEQ ID NO: 343204

SEQ ID NO: 515176 - RNA, 64 nt, hsa; identical to SEQ ID NO: 343205

SEQ ID NO: 515177 - RNA, 53 nt, hsa; identical to SEQ ID NO: 343206

SEQ ID NO: 515178 - RNA, 64 nt, hsa; identical to SEQ ID NO: 343207

SEQ ID NO: 515179 - RNA, 64 nt, hsa; identical to SEQ ID NO: 343208

SEQ ID NO: 515180 - RNA, 64 nt, hsa; identical to SEQ ID NO: 343209

SEQ ID NO: 515181 - RNA, 64 nt, hsa; identical to SEQ ID NO: 343210

SEQ ID NO: 515182 - RNA, 64 nt, hsa; identical to SEQ ID NO: 343211

SEQ ID NO: 515183 - RNA, 64 nt, hsa; identical to SEQ ID NO: 343212

SEQ ID NO: 515184 - RNA, 64 nt, hsa; identical to SEQ ID NO: 343213

SEQ ID NO: 515185 - RNA, 64 nt, hsa; identical to SEQ ID NO: 343214

SEQ ID NO: 515186 - RNA, 64 nt, hsa; identical to SEQ ID NO: 343215

SEQ ID NO: 515187 - RNA, 64 nt, hsa; identical to SEQ ID NO: 343216

SEQ ID NO: 515188 - RNA, 64 nt, hsa; identical to SEQ ID NO: 343217

SEQ ID NO: 515189 - RNA, 64 nt, hsa; identical to SEQ ID NO: 343218

SEQ ID NO: 515190 - RNA, 64 nt, hsa; identical to SEQ ID NO: 343219

SEQ ID NO: 515191 - RNA, 64 nt, hsa; identical to SEQ ID NO: 343220

SEQ ID NO: 515192 - RNA, 64 nt, hsa; identical to SEQ ID NO: 343221

SEQ ID NO: 515193 - RNA, 64 nt, hsa; identical to SEQ ID NO: 343222

SEQ ID NO: 515194 - RNA, 64 nt, hsa; identical to SEQ ID NO: 343223

SEQ ID NO: 515195 - RNA, 64 nt, hsa; identical to SEQ ID NO: 343224

SEQ ID NO: 515196 - RNA, 64 nt, hsa; identical to SEQ ID NO: 343225

SEQ ID NO: 515197 - RNA, 64 nt, hsa; identical to SEQ ID NO: 343226

SEQ ID NO: 515198 - RNA, 64 nt, hsa; identical to SEQ ID NO: 343227

SEQ ID NO: 515199 - RNA, 64 nt, hsa; identical to SEQ ID NO: 343228

SEQ ID NO: 515200 - RNA, 64 nt, hsa; identical to SEQ ID NO: 343229

SEQ ID NO: 515201 - RNA, 64 nt, hsa; identical to SEQ ID NO: 343230

SEQ ID NO: 515202 - RNA, 64 nt, hsa; identical to SEQ ID NO: 343231

SEQ ID NO: 515203 - RNA, 64 nt, hsa; identical to SEQ ID NO: 343232

SEQ ID NO: 515204 - RNA, 64 nt, hsa; identical to SEQ ID NO: 343233

SEQ ID NO: 515205 - RNA, 64 nt, hsa; identical to SEQ ID NO: 343234

SEQ ID NO: 515206 - RNA, 64 nt, hsa; identical to SEQ ID NO: 343235

SEQ ID NO: 515207 - RNA, 64 nt, hsa; identical to SEQ ID NO: 343236

SEQ ID NO: 515208 - RNA, 64 nt, hsa; identical to SEQ ID NO: 343237

SEQ ID NO: 515209 - RNA, 64 nt, hsa; identical to SEQ ID NO: 343238

SEQ ID NO: 515210 - RNA, 64 nt, hsa; identical to SEQ ID NO: 343239

SEQ ID NO: 515211 - RNA, 64 nt, hsa; identical to SEQ ID NO: 343240

SEQ ID NO: 515212 - RNA, 64 nt, hsa; identical to SEQ ID NO: 343241

SEQ ID NO: 515213 - RNA, 64 nt, hsa; identical to SEQ ID NO: 343242

SEQ ID NO: 515214 - RNA, 64 nt, hsa; identical to SEQ ID NO: 343243

SEQ ID NO: 515215 - RNA, 64 nt, hsa; identical to SEQ ID NO: 343237

SEQ ID NO: 515216 - RNA, 64 nt, hsa; identical to SEQ ID NO: 343245

SEQ ID NO: 515217 - RNA, 64 nt, hsa; identical to SEQ ID NO: 343246

SEQ ID NO: 515218 - RNA, 64 nt, hsa; identical to SEQ ID NO: 343247

SEQ ID NO: 515219 - RNA, 64 nt, hsa; identical to SEQ ID NO: 343248

SEQ ID NO: 515220 - RNA, 64 nt, hsa; identical to SEQ ID NO: 343249

SEQ ID NO: 515221 - RNA, 64 nt, hsa; identical to SEQ ID NO: 343250

SEQ ID NO: 515222 - RNA, 64 nt, hsa; identical to SEQ ID NO: 343251

SEQ ID NO: 515223 - RNA, 64 nt, hsa; identical to SEQ ID NO: 343252

SEQ ID NO: 515224 - RNA, 64 nt, hsa; identical to SEQ ID NO: 343253

SEQ ID NO: 515225 - RNA, 64 nt, hsa; identical to SEQ ID NO: 343254

SEQ ID NO: 515226 - RNA, 64 nt, hsa; identical to SEQ ID NO: 343255

SEQ ID NO: 515227 - RNA, 64 nt, hsa; identical to SEQ ID NO: 343256

SEQ ID NO: 515228 - RNA, 64 nt, hsa; identical to SEQ ID NO: 343257

SEQ ID NO: 515229 - RNA, 64 nt, hsa; identical to SEQ ID NO: 343258

SEQ ID NO: 515230 - RNA, 64 nt, hsa; identical to SEQ ID NO: 343259

SEQ ID NO: 515231 - RNA, 64 nt, hsa; identical to SEQ ID NO: 343260

SEQ ID NO: 515232 - RNA, 64 nt, hsa; identical to SEQ ID NO: 343261

SEQ ID NO: 515233 - RNA, 64 nt, hsa; identical to SEQ ID NO: 343262

SEQ ID NO: 515234 - RNA, 64 nt, hsa; identical to SEQ ID NO: 343263

SEQ ID NO: 515235 - RNA, 64 nt, hsa; identical to SEQ ID NO: 343264

SEQ ID NO: 515236 - RNA, 64 nt, hsa; identical to SEQ ID NO: 343265

SEQ ID NO: 515237 - RNA, 64 nt, hsa; identical to SEQ ID NO: 343266

SEQ ID NO: 515238 - RNA, 64 nt, hsa; identical to SEQ ID NO: 343267

SEQ ID NO: 515239 - RNA, 64 nt, hsa; identical to SEQ ID NO: 343268

SEQ ID NO: 515240 - RNA, 64 nt, hsa; identical to SEQ ID NO: 343269

SEQ ID NO: 515241 - RNA, 64 nt, hsa; identical to SEQ ID NO: 343270

SEQ ID NO: 515242 - RNA, 64 nt, hsa; identical to SEQ ID NO: 343271

SEQ ID NO: 515243 - RNA, 64 nt, hsa; identical to SEQ ID NO: 343272

SEQ ID NO: 515244 - RNA, 64 nt, hsa; identical to SEQ ID NO: 343273

SEQ ID NO: 515245 - RNA, 64 nt, hsa; identical to SEQ ID NO: 343274

SEQ ID NO: 515246 - RNA, 64 nt, hsa; identical to SEQ ID NO: 343275

SEQ ID NO: 515247 - RNA, 64 nt, hsa; identical to SEQ ID NO: 343276

SEQ ID NO: 515248 - RNA, 64 nt, hsa; identical to SEQ ID NO: 343277

SEQ ID NO: 515249 - RNA, 64 nt, hsa; identical to SEQ ID NO: 343278

SEQ ID NO: 515250 - RNA, 64 nt, hsa; identical to SEQ ID NO: 343279

SEQ ID NO: 515251 - RNA, 64 nt, hsa; identical to SEQ ID NO: 343280

SEQ ID NO: 515252 - RNA, 64 nt, hsa; identical to SEQ ID NO: 343281

SEQ ID NO: 515253 - RNA, 64 nt, hsa; identical to SEQ ID NO: 343282

SEQ ID NO: 515254 - RNA, 64 nt, hsa; identical to SEQ ID NO: 343283

SEQ ID NO: 515255 - RNA, 64 nt, hsa; identical to SEQ ID NO: 343284

SEQ ID NO: 515256 - RNA, 64 nt, hsa; identical to SEQ ID NO: 343285

SEQ ID NO: 515257 - RNA, 64 nt, hsa; identical to SEQ ID NO: 343286

SEQ ID NO: 515258 - RNA, 64 nt, hsa; identical to SEQ ID NO: 343287

SEQ ID NO: 515259 - RNA, 64 nt, hsa; identical to SEQ ID NO: 343288

SEQ ID NO: 515260 - RNA, 64 nt, hsa; identical to SEQ ID NO: 343289

SEQ ID NO: 515261 - RNA, 64 nt, hsa; identical to SEQ ID NO: 343290

SEQ ID NO: 515262 - RNA, 64 nt, hsa; identical to SEQ ID NO: 343291

SEQ ID NO: 515263 - RNA, 64 nt, hsa; identical to SEQ ID NO: 343292

SEQ ID NO: 515264 - RNA, 64 nt, hsa; identical to SEQ ID NO: 343293

SEQ ID NO: 515265 - RNA, 64 nt, hsa; identical to SEQ ID NO: 343294

SEQ ID NO: 515266 - RNA, 64 nt, hsa; identical to SEQ ID NO: 343295

SEQ ID NO: 515267 - RNA, 64 nt, hsa; identical to SEQ ID NO: 343296

SEQ ID NO: 515268 - RNA, 64 nt, hsa; identical to SEQ ID NO: 343297

SEQ ID NO: 515269 - RNA, 64 nt, hsa; identical to SEQ ID NO: 343298

SEQ ID NO: 515270 - RNA, 64 nt, hsa; identical to SEQ ID NO: 343299

SEQ ID NO: 515271 - RNA, 64 nt, hsa; identical to SEQ ID NO: 343299

SEQ ID NO: 515272 - RNA, 64 nt, hsa; identical to SEQ ID NO: 343301

SEQ ID NO: 515273 - RNA, 64 nt, hsa; identical to SEQ ID NO: 343302

SEQ ID NO: 515274 - RNA, 64 nt, hsa; identical to SEQ ID NO: 343303

SEQ ID NO: 515275 - RNA, 64 nt, hsa; identical to SEQ ID NO: 343304

SEQ ID NO: 515276 - RNA, 64 nt, hsa; identical to SEQ ID NO: 343305

SEQ ID NO: 515277 - RNA, 64 nt, hsa; identical to SEQ ID NO: 343306

SEQ ID NO: 515278 - RNA, 64 nt, hsa; identical to SEQ ID NO: 343307

SEQ ID NO: 515279 - RNA, 64 nt, hsa; identical to SEQ ID NO: 343308

SEQ ID NO: 515280 - RNA, 64 nt, hsa; identical to SEQ ID NO: 343309

SEQ ID NO: 515281 - RNA, 64 nt, hsa; identical to SEQ ID NO: 343310

SEQ ID NO: 515282 - RNA, 64 nt, hsa; identical to SEQ ID NO: 343311

SEQ ID NO: 515283 - RNA, 62 nt, hsa; identical to SEQ ID NO: 343312

SEQ ID NO: 515284 - RNA, 64 nt, hsa; identical to SEQ ID NO: 343313

SEQ ID NO: 515285 - RNA, 64 nt, hsa; identical to SEQ ID NO: 343314

SEQ ID NO: 515286 - RNA, 64 nt, hsa; identical to SEQ ID NO: 343315

SEQ ID NO: 515287 - RNA, 64 nt, hsa; identical to SEQ ID NO: 343316

SEQ ID NO: 515288 - RNA, 64 nt, hsa; identical to SEQ ID NO: 343317

SEQ ID NO: 515289 - RNA, 64 nt, hsa; identical to SEQ ID NO: 343318

SEQ ID NO: 515290 - RNA, 64 nt, hsa; identical to SEQ ID NO: 343319

SEQ ID NO: 515291 - RNA, 64 nt, hsa; identical to SEQ ID NO: 343320

SEQ ID NO: 515292 - RNA, 64 nt, hsa; identical to SEQ ID NO: 343321

SEQ ID NO: 515293 - RNA, 64 nt, hsa; identical to SEQ ID NO: 343322

SEQ ID NO: 515294 - RNA, 64 nt, hsa; identical to SEQ ID NO: 343323

SEQ ID NO: 515295 - RNA, 64 nt, hsa; identical to SEQ ID NO: 343324

SEQ ID NO: 515296 - RNA, 64 nt, hsa; identical to SEQ ID NO: 343325

SEQ ID NO: 515297 - RNA, 64 nt, hsa; identical to SEQ ID NO: 343326

SEQ ID NO: 515298 - RNA, 64 nt, hsa; identical to SEQ ID NO: 343327

SEQ ID NO: 515299 - RNA, 64 nt, hsa; identical to SEQ ID NO: 343328

SEQ ID NO: 515300 - RNA, 64 nt, hsa; identical to SEQ ID NO: 343329

SEQ ID NO: 515301 - RNA, 64 nt, hsa; identical to SEQ ID NO: 343330

SEQ ID NO: 515302 - RNA, 64 nt, hsa; identical to SEQ ID NO: 343331

SEQ ID NO: 515303 - RNA, 64 nt, hsa; identical to SEQ ID NO: 343332

SEQ ID NO: 515304 - RNA, 64 nt, hsa; identical to SEQ ID NO: 343333

SEQ ID NO: 515305 - RNA, 64 nt, hsa; identical to SEQ ID NO: 343334

SEQ ID NO: 515306 - RNA, 58 nt, hsa; identical to SEQ ID NO: 343335

SEQ ID NO: 515307 - RNA, 64 nt, hsa; identical to SEQ ID NO: 343336

SEQ ID NO: 515308 - RNA, 64 nt, hsa; identical to SEQ ID NO: 343337

SEQ ID NO: 515309 - RNA, 64 nt, hsa; identical to SEQ ID NO: 343338

SEQ ID NO: 515310 - RNA, 64 nt, hsa; identical to SEQ ID NO: 343339

SEQ ID NO: 515311 - RNA, 64 nt, hsa; identical to SEQ ID NO: 343340

SEQ ID NO: 515312 - RNA, 64 nt, hsa; identical to SEQ ID NO: 343341

SEQ ID NO: 515313 - RNA, 64 nt, hsa; identical to SEQ ID NO: 343342

SEQ ID NO: 515314 - RNA, 64 nt, hsa; identical to SEQ ID NO: 343343

SEQ ID NO: 515315 - RNA, 64 nt, hsa; identical to SEQ ID NO: 343344

SEQ ID NO: 515316 - RNA, 64 nt, hsa; identical to SEQ ID NO: 343345

SEQ ID NO: 515317 - RNA, 64 nt, hsa; identical to SEQ ID NO: 343346

SEQ ID NO: 515318 - RNA, 64 nt, hsa; identical to SEQ ID NO: 343347

SEQ ID NO: 515319 - RNA, 64 nt, hsa; identical to SEQ ID NO: 343348

SEQ ID NO: 515320 - RNA, 64 nt, hsa; identical to SEQ ID NO: 343349

SEQ ID NO: 515321 - RNA, 64 nt, hsa; identical to SEQ ID NO: 343350

SEQ ID NO: 515322 - RNA, 64 nt, hsa; identical to SEQ ID NO: 343351

SEQ ID NO: 515323 - RNA, 64 nt, hsa; identical to SEQ ID NO: 343352

SEQ ID NO: 515324 - RNA, 64 nt, hsa; identical to SEQ ID NO: 343353

SEQ ID NO: 515325 - RNA, 64 nt, hsa; identical to SEQ ID NO: 343351

SEQ ID NO: 515326 - RNA, 64 nt, hsa; identical to SEQ ID NO: 343355

SEQ ID NO: 515327 - RNA, 64 nt, hsa; identical to SEQ ID NO: 343356

SEQ ID NO: 515328 - RNA, 64 nt, hsa; identical to SEQ ID NO: 343357

SEQ ID NO: 515329 - RNA, 64 nt, hsa; identical to SEQ ID NO: 343358

SEQ ID NO: 515330 - RNA, 64 nt, hsa; identical to SEQ ID NO: 343359

SEQ ID NO: 515331 - RNA, 64 nt, hsa; identical to SEQ ID NO: 343360

SEQ ID NO: 515332 - RNA, 64 nt, hsa; identical to SEQ ID NO: 343361

SEQ ID NO: 515333 - RNA, 64 nt, hsa; identical to SEQ ID NO: 77261

SEQ ID NO: 515334 - RNA, 64 nt, hsa; identical to SEQ ID NO: 77262

SEQ ID NO: 515335 - RNA, 64 nt, hsa; identical to SEQ ID NO: 77263

SEQ ID NO: 515336 - RNA, 64 nt, hsa; identical to SEQ ID NO: 77264

SEQ ID NO: 515337 - RNA, 64 nt, hsa; identical to SEQ ID NO: 77265

SEQ ID NO: 515338 - RNA, 64 nt, hsa; identical to SEQ ID NO: 77266

SEQ ID NO: 515339 - RNA, 64 nt, hsa; identical to SEQ ID NO: 77267

SEQ ID NO: 515340 - RNA, 64 nt, hsa; identical to SEQ ID NO: 77268

SEQ ID NO: 515341 - RNA, 64 nt, hsa; identical to SEQ ID NO: 77269

SEQ ID NO: 515342 - RNA, 64 nt, hsa; identical to SEQ ID NO: 77270

SEQ ID NO: 515343 - RNA, 64 nt, hsa; identical to SEQ ID NO: 77271

SEQ ID NO: 515344 - RNA, 64 nt, hsa; identical to SEQ ID NO: 77272

SEQ ID NO: 515345 - RNA, 64 nt, hsa; identical to SEQ ID NO: 77273

SEQ ID NO: 515346 - RNA, 64 nt, hsa; identical to SEQ ID NO: 77274

SEQ ID NO: 515347 - RNA, 64 nt, hsa; identical to SEQ ID NO: 77275

SEQ ID NO: 515348 - RNA, 64 nt, hsa; identical to SEQ ID NO: 77276

SEQ ID NO: 515349 - RNA, 64 nt, hsa; identical to SEQ ID NO: 168067

SEQ ID NO: 515350 - RNA, 64 nt, hsa; identical to SEQ ID NO: 168068

SEQ ID NO: 515351 - RNA, 64 nt, hsa; identical to SEQ ID NO: 168069

SEQ ID NO: 515352 - RNA, 64 nt, hsa; identical to SEQ ID NO: 168070

SEQ ID NO: 515353 - RNA, 64 nt, hsa; identical to SEQ ID NO: 168071

SEQ ID NO: 515354 - RNA, 64 nt, hsa; identical to SEQ ID NO: 168072

SEQ ID NO: 515355 - RNA, 64 nt, hsa; identical to SEQ ID NO: 168073

SEQ ID NO: 515356 - RNA, 64 nt, hsa; identical to SEQ ID NO: 168074

SEQ ID NO: 515357 - RNA, 64 nt, hsa; identical to SEQ ID NO: 168075

SEQ ID NO: 515358 - RNA, 64 nt, hsa; identical to SEQ ID NO: 168076

SEQ ID NO: 515359 - RNA, 64 nt, hsa; identical to SEQ ID NO: 168077

SEQ ID NO: 515360 - RNA, 64 nt, hsa; identical to SEQ ID NO: 168078

SEQ ID NO: 515361 - RNA, 64 nt, hsa; identical to SEQ ID NO: 168079

SEQ ID NO: 515362 - RNA, 64 nt, hsa; identical to SEQ ID NO: 168080

SEQ ID NO: 515363 - RNA, 64 nt, hsa; identical to SEQ ID NO: 372672

SEQ ID NO: 515364 - RNA, 64 nt, hsa; identical to SEQ ID NO: 372673

SEQ ID NO: 515365 - RNA, 64 nt, hsa; identical to SEQ ID NO: 372674

SEQ ID NO: 515366 - RNA, 62 nt, hsa; identical to SEQ ID NO: 372675

SEQ ID NO: 515367 - RNA, 64 nt, hsa; identical to SEQ ID NO: 372676

SEQ ID NO: 515368 - RNA, 64 nt, hsa; identical to SEQ ID NO: 372677

SEQ ID NO: 515369 - RNA, 64 nt, hsa
uuuuguauuuuuaguagagaugggguuucaccguaucggcgaggaugaucucuaucucuugacc

SEQ ID NO: 515370 - RNA, 64 nt, hsa
ggcucccagccuccuucccgcuacagaaucgcucaucggcgaggcucagcagaaagacccugaa

SEQ ID NO: 515371 - RNA, 64 nt, hsa
aucaaauuacauuuauguuccuauauauuacaacaucggcgaggaaaugaaagcgauucuccuu

SEQ ID NO: 515372 - RNA, 64 nt, hsa
uaauuaaaugucaguacauuuuaagagcauaaaaaucggcgauuuuguacuugaagagaacaug

SEQ ID NO: 515373 - RNA, 64 nt, hsa
cacuuuaugcacguauuauugacauuaauaccuaaucggcgagugcccaucugccccaccugcu

SEQ ID NO: 515374 - RNA, 64 nt, hsa
ucaaagagcuugauaauuuaguugucaaaagugcaucggcgacauuaucuuuaauuguauguau

SEQ ID NO: 515375 - RNA, 64 nt, hsa
gcguccugcccccaccuccuaaauaaauaaaggaaucggcgaacaccuucuucuuuuaugacau

SEQ ID NO: 515376 - RNA, 64 nt, hsa
caacacagcuugucucuugccugccacugugugaaucggcgacggagcacugcaccugccucca

SEQ ID NO: 515377 - RNA, 64 nt, hsa
aaacugcugcggccuuccaacuccugguaucugcaucggcgaauggcccuucuugccuugaucc

SEQ ID NO: 515378 - RNA, 64 nt, hsa; identical to SEQ ID NO: 169421

SEQ ID NO: 515379 - RNA, 64 nt, hsa; identical to SEQ ID NO: 169422

SEQ ID NO: 515380 - RNA, 64 nt, hsa; identical to SEQ ID NO: 169423

SEQ ID NO: 515381 - RNA, 64 nt, hsa; identical to SEQ ID NO: 169424

SEQ ID NO: 515382 - RNA, 64 nt, hsa; identical to SEQ ID NO: 169425

SEQ ID NO: 515383 - RNA, 64 nt, hsa; identical to SEQ ID NO: 169426

SEQ ID NO: 515384 - RNA, 64 nt, hsa; identical to SEQ ID NO: 169427

SEQ ID NO: 515385 - RNA, 64 nt, hsa; identical to SEQ ID NO: 169428

SEQ ID NO: 515386 - RNA, 64 nt, hsa; identical to SEQ ID NO: 169429

SEQ ID NO: 515387 - RNA, 64 nt, hsa; identical to SEQ ID NO: 169430

SEQ ID NO: 515388 - RNA, 64 nt, hsa; identical to SEQ ID NO: 169431

SEQ ID NO: 515389 - RNA, 64 nt, hsa; identical to SEQ ID NO: 169432

SEQ ID NO: 515390 - RNA, 64 nt, hsa; identical to SEQ ID NO: 169433

SEQ ID NO: 515391 - RNA, 64 nt, hsa; identical to SEQ ID NO: 169434

SEQ ID NO: 515392 - RNA, 64 nt, hsa; identical to SEQ ID NO: 169435

SEQ ID NO: 515393 - RNA, 64 nt, hsa; identical to SEQ ID NO: 169436

SEQ ID NO: 515394 - RNA, 64 nt, hsa; identical to SEQ ID NO: 169437

SEQ ID NO: 515395 - RNA, 64 nt, hsa; identical to SEQ ID NO: 169438

SEQ ID NO: 515396 - RNA, 64 nt, hsa; identical to SEQ ID NO: 169439

SEQ ID NO: 515397 - RNA, 64 nt, hsa; identical to SEQ ID NO: 169440

SEQ ID NO: 515398 - RNA, 64 nt, hsa; identical to SEQ ID NO: 169441

SEQ ID NO: 515399 - RNA, 64 nt, hsa; identical to SEQ ID NO: 169442

SEQ ID NO: 515400 - RNA, 64 nt, hsa; identical to SEQ ID NO: 169443

SEQ ID NO: 515401 - RNA, 64 nt, hsa; identical to SEQ ID NO: 169442

SEQ ID NO: 515402 - RNA, 64 nt, hsa; identical to SEQ ID NO: 169443

SEQ ID NO: 515403 - RNA, 64 nt, hsa
aauuucaaaauugcuaaaauguguuugagcuuuagacuauaacauuuguuguaauaauugcuag

SEQ ID NO: 515404 - RNA, 64 nt, hsa
acuuucuacguacuacuccaaagacugugauugugacuauaauacauuuuugguaauuuuuuua

SEQ ID NO: 515405 - RNA, 64 nt, hsa
ugucugccccugcccugccugggacccacagggagacuauaaucuccuuauuuuuuuacuccua

SEQ ID NO: 515406 - RNA, 64 nt, hsa
uauguccagcacuuuguagccaugggaggaaagggacuauaaaaguguacaauguuaauggaau

SEQ ID NO: 515407 - RNA, 64 nt, hsa
uugaaauuuugucuuuaagcagagaguuauuugugacuauaagcuuugugcuuagagaauguau

SEQ ID NO: 515408 - RNA, 64 nt, hsa
auguguaauguggauggagacaauuauaagauuugacuauaacuauuuggagggucuuuaacau

SEQ ID NO: 515409 - RNA, 64 nt, hsa
uuguggucgacaucaaucuaaagauacagugucugacuauaaccuuguuccaaaaaccuaggca

SEQ ID NO: 515410 - RNA, 64 nt, hsa
uuaguuuccuaucugaauuaacaacuuuaaaggagacuauaauaguuaaaaguggaagaauaga

SEQ ID NO: 515411 - RNA, 64 nt, hsa
guuuuuuaauaaucgacuuuuuaaaugugaucaggacuauaauauuguacaguuauuauagggc

SEQ ID NO: 515412 - RNA, 64 nt, hsa
guggauuuuguggaggugagaaaaggggcauugagacuauaaagcaguagacaauccccacaua

SEQ ID NO: 515413 - RNA, 64 nt, hsa
uauuccugacccucccuaccugaggccuaucugagacuauaacugucaucuagccccuucgagg

SEQ ID NO: 515414 - RNA, 64 nt, hsa
uguuuaaacacuuuauuuuuaacaaguguaagaagacuauaacuuuugaugccauugagauuca

SEQ ID NO: 515415 - RNA, 64 nt, hsa
cuugauuugggagcauuuacuuggaaauccuaaggacuauaauaaaaguuuucaacauauuucu

SEQ ID NO: 515416 - RNA, 64 nt, hsa
acaugaaacgaaucaaacuggagauaaacccuaugacuauaagcaauaagguaaagcauucaau

SEQ ID NO: 515417 - RNA, 64 nt, hsa
acgcauauacgaguugguuuaucuuuguguacaugacuauaacccagugaugcugaggucaugu

SEQ ID NO: 515418 - RNA, 64 nt, hsa
uggcaacauuuuuauucuucagagucagguaaaugacuauaauaguuugguuucuaaugaaaag

SEQ ID NO: 515419 - RNA, 64 nt, hsa
agaauugaagguucuuaucagaugggauacuggggacuauaaacaauggaaauaaagccacugu

SEQ ID NO: 515420 - RNA, 53 nt, hsa
agacucuuguuuuaaaaugacuugacuauaaaaaaaaauuaaaaaauaaaaau

SEQ ID NO: 515421 - RNA, 64 nt, hsa
accauacagugagccagccuugcaguaggcaguagacuauaagcagaagcacauaugaacugga

SEQ ID NO: 515422 - RNA, 64 nt, hsa
uuccucugugcuacccuuaacuuagggaugaacagacuauaacuaggaaaggaggaaagguauc

SEQ ID NO: 515423 - RNA, 63 nt, hsa
ucagcauuaaagaaaacauugauuuuccuuuccugacuauaaaacuaauugugcauuauagaa

SEQ ID NO: 515424 - RNA, 64 nt, hsa
augacucaucucguccugcccaccccucacacuggacuauaaauacccucccugggucugugug

SEQ ID NO: 515425 - RNA, 64 nt, hsa
ugauuggguacagauuuggugacucugugguaaagacuauaauuauuucuauaaagaauauuuu

SEQ ID NO: 515426 - RNA, 64 nt, hsa
gaggaucauggacaaugaauaaaugcacacuucugacuauaauuuugagcagugaaggaaggau

SEQ ID NO: 515427 - RNA, 64 nt, hsa
ugaauuuacuucgacuucuuaaauuuuuguaaaagacuauaaguuuagacaucuuucucauuca

SEQ ID NO: 515428 - RNA, 64 nt, hsa
aaauuggaaaagaaaaacucaguuuaaauacggagacuauaaugauaacacugaauuccccuau

SEQ ID NO: 515429 - RNA, 64 nt, hsa
uguuucauuaauauguacacaaauguacacauuggacuauaauguaaaaugugucuuuuauugu

SEQ ID NO: 515430 - RNA, 64 nt, hsa
guggcuggaugcuguuaauuucuuuaauagccaugacuauaauuuaagccuaugagaagauaga

SEQ ID NO: 515431 - RNA, 64 nt, hsa
uuugaaauuaucacccauauaaaagagggacauggacuauaacguugauuucuuauugcuguac

SEQ ID NO: 515432 - RNA, 64 nt, hsa
cagagccagaugccaugcuuggcagcagcaguaggacuauaaaccacagcugucccccaggauc

SEQ ID NO: 515433 - RNA, 64 nt, hsa
cuuuuuggcaauuuuuauugaccuguugaaucuugacuauaaaaugaucugagaaguaaggaag

SEQ ID NO: 515434 - RNA, 64 nt, hsa
ccaaacaggcuguuuauggcucuagcugcguacugacuauaaaauagaugcuggacucugguug

SEQ ID NO: 515435 - RNA, 64 nt, hsa
ugcuucuauuuauagccucugucaaaagucaaaagacuauaaaugcuuugcaaaaaugguuuca

SEQ ID NO: 515436 - RNA, 64 nt, hsa
uagugaguacuagagaguucuguauuuuauuauugacuauaauaauuaguuuaauuagcuuugc

SEQ ID NO: 515437 - RNA, 64 nt, hsa
cauguaacccucaugaaaauuaucuuuauacguggacuauaauaaaauauugaauuaaaaccuu

SEQ ID NO: 515438 - RNA, 64 nt, hsa
auuguguuuacaauuuuauaaucucaguugauaagacuauaagaaagcugauuauuuaaaucac

SEQ ID NO: 515439 - RNA, 64 nt, hsa
gacccauggguggcuaaauccacuggacugugaagacuauaauuuauuuccauaauuuauuugg

SEQ ID NO: 515440 - RNA, 64 nt, hsa
cccuagaauuagggcacauugcaaacugaaauaugacuauaauucuuaugggaccaaauuuaag

SEQ ID NO: 515441 - RNA, 64 nt, hsa
gggagcacccacaggucucugugggggagacagggacuauaacagggaggcagaauucagguug

SEQ ID NO: 515442 - RNA, 64 nt, hsa
ccugucuggcagucagcuucccagacagacuauagacuauaaauaugucuccaucugccuuacc

SEQ ID NO: 515443 - RNA, 64 nt, hsa
aucuugggcugggguugucuuuaggaaaaguugagacuauaagagucauaaauaaguccuugug

SEQ ID NO: 515444 - RNA, 64 nt, hsa
ugugaaaguguaaaauagaauguuacuuuggaaugacuauaaacauuaaaagaagacuggaagc

SEQ ID NO: 515445 - RNA, 64 nt, hsa
caucaauaaaacaguuggcaugcaucccacugcugacuauaaugccucuccuuaaaugcuucua

SEQ ID NO: 515446 - RNA, 64 nt, hsa
guuuuagaaacuaaacuuucuagagcaauaaaaugacuauaauguuaaguaaacauaauguuga

SEQ ID NO: 515447 - RNA, 64 nt, hsa
ucaguuacaaaugggcauuuaguauaguuauauugacuauaacauguaaguaaauagcuuucua

SEQ ID NO: 515448 - RNA, 64 nt, hsa
gcaguucucccaccucagccucucgacuaacagggacuauaaucuugcagcaccaugccgagcu

SEQ ID NO: 515449 - RNA, 64 nt, hsa
uuugauuuuguaugcuauuuuuucacuauaggaugacuauaauucuggucacuaaauauacacu

SEQ ID NO: 515450 - RNA, 64 nt, hsa
cgaaacgucuaauacuaugacuguuaaaaugucagacuauaacaaauaucuaucuuuuauuuuu

SEQ ID NO: 515451 - RNA, 64 nt, hsa
aguguuccacauauauguauauguauauuuuaaugacuauaauguaauaaaguuuauaucaugu

SEQ ID NO: 515452 - RNA, 64 nt, hsa
ugucacauuauguaaaaggcagaaacauaccuuugacuauaagaaauuaaaaaaaaaacaccaa

SEQ ID NO: 515453 - RNA, 64 nt, hsa
aaucugugugacugacugaugcacacuuuuucuggacuauaauaacugaugcugcucuacugcu

SEQ ID NO: 515454 - RNA, 64 nt, hsa
guuugguaccauagugugaaaugcugggaacaaugacuauaagacaugcuauggcacauauauu

SEQ ID NO: 515455 - RNA, 64 nt, hsa
auacuauaaauuaauguaauacugugugaauucagacuauaaaaaacaucauucagaaaacuuu

SEQ ID NO: 515456 - RNA, 64 nt, hsa
gguuguugaaauggccaacacugguacagacacggacuauaaaaaucuccaagcuugugcuuac

SEQ ID NO: 515457 - RNA, 64 nt, hsa
uuugagauccauccuuuaucaagaagucugaagcgacuauaaagguuuuugaauucagauuuaa

SEQ ID NO: 515458 - RNA, 64 nt, hsa
uuguucuuuuucuuauagguccuucagucuuggagacuauaagggagccucugcacccagggaa

SEQ ID NO: 515459 - RNA, 64 nt, hsa
uuuuuauauacaauuaggauaauuagcauugucagacuauaaaccuuugcuuuuuaaaguuuau

SEQ ID NO: 515460 - RNA, 64 nt, hsa
ugaaacugcaaaaacacugaacauauaaccaucagacuauaauucuggccauguuuuucaucau

SEQ ID NO: 515461 - RNA, 64 nt, hsa
cggauccuucucaggaagcuucaugucuaauggagacuauaauuauaacuccuguucugcauag

SEQ ID NO: 515462 - RNA, 64 nt, hsa
cucuugauguuuacaugcacaagcuuugcguucugacuauaaaaagugugaacaaaucaaugcc

SEQ ID NO: 515463 - RNA, 64 nt, hsa
uugacuaaugcucuauaaauccgaagagaguucggacuauaaguauuuaggcuaucauuauguu

SEQ ID NO: 515464 - RNA, 64 nt, hsa
cuuguauauuuuuuugucucuuguuugcuggauugacuauaacuuaagugcugauugugauuuu

SEQ ID NO: 515465 - RNA, 64 nt, hsa
gugaacauuccuuauagaaaccuuucacaugaaugacuauaaacugaagcuuuaaaugagcugu

SEQ ID NO: 515466 - RNA, 64 nt, hsa
aauaauuauuuauuacauaauuuaguuguuucuagacuauaaauguugcuaugugccuuauguu

SEQ ID NO: 515467 - RNA, 64 nt, hsa
ucuuuugaaaaguaaauuccuuguuuacugguuugacuauaauucucuguuaucuuuacgaggu

SEQ ID NO: 515468 - RNA, 64 nt, hsa
uaagcaccauucccuuagaguggauccagguguugacuauaaccagauuuacucuuugcuuacu

SEQ ID NO: 515469 - RNA, 64 nt, hsa
aucauuuacaggugguauaaaauccaaaauaucugacuauaaaauauuuuuuugaguuuuuugu

SEQ ID NO: 515470 - RNA, 64 nt, hsa
ugcuaauaaacgauucuuguuggcagguuaaugggacuauaaaugcuggagcccagcacucaca

SEQ ID NO: 515471 - RNA, 64 nt, hsa
cagaaagacuauuauuuccuaaccaugagaagcagacuauaauauucauauuuaaacaaagcaa

SEQ ID NO: 515472 - RNA, 64 nt, hsa
augaauaaaauauugauuugauuacaguggcuuugacuauaaugugggagccaauuuuugccuc

SEQ ID NO: 515473 - RNA, 64 nt, hsa
guaauugaaaaaaaugcaguuuccuuuaauccuugacuauaaguuauacuauguugcguacaug

SEQ ID NO: 515474 - RNA, 64 nt, hsa
ucuguaucuaaauguauaccauccacuuguaaaugacuauaaacuauuaugugauugcuuuuuu

SEQ ID NO: 515475 - RNA, 64 nt, hsa
ccaugggaaacagaauuucaugcacaauccaaaagacuauaaauauaggauuaugauuucauca

SEQ ID NO: 515476 - RNA, 64 nt, hsa
acuuuuuguguuaucuggcacaggccuuugaaaagacuauaauucuacuuuguuuaauguagag

SEQ ID NO: 515477 - RNA, 64 nt, hsa
ggcccuuugaagaguuagcuuccuccucaucuuugacuauaaaauuguuuaaucaauggaauuu

SEQ ID NO: 515478 - RNA, 64 nt, hsa
gugaaaccuaaaggaagugguucuguugcaaauggacuauaaacagggacauuauauucuuaca

SEQ ID NO: 515479 - RNA, 64 nt, hsa
ucagaaucuuccuuuggacaaaacaucacuagcugacuauaaaaacaaaagugucaucauugaa

SEQ ID NO: 515480 - RNA, 64 nt, hsa
ggaaucacauauuucacaacagggccgaagagaugacuauaaaauguucaugagggacugaaua

SEQ ID NO: 515481 - RNA, 64 nt, hsa
uagaguuugcuuaaaauacaaauuaauuauucuugacuauaaccuuguaaagguaaaucuaaug

SEQ ID NO: 515482 - RNA, 64 nt, hsa
acuauagcauuguacauuugaaaguaguguucuagacuauaaaaccaaugaacuucuacaugag

SEQ ID NO: 515483 - RNA, 64 nt, hsa
ggccaaaauguguuuuuuuuuuaauaaguaacuugacuauaaaauaaagccguccgugggacga

SEQ ID NO: 515484 - RNA, 64 nt, hsa
aaauucuagcagaaggccccauggguuagaaaaggacuauaagaauaauuucuuauuuaauuuu

SEQ ID NO: 515485 - RNA, 64 nt, hsa
uuuagucugaaacacaauugugcugaaucugucugacuauaacucugaccacacagaaccaggg

SEQ ID NO: 515486 - RNA, 64 nt, hsa
gaauccaggucuaaaacacacuagaguagcuggugacuauaaauaauauuuuaaaaugcugugu

SEQ ID NO: 515487 - RNA, 64 nt, hsa
aaauagaucuauuucccuuaucacuucaauuaaagacuauaaacaacaaaaaucucauuguguc

SEQ ID NO: 515488 - RNA, 64 nt, hsa
acauaaccucauucugaauaaugucccucauuuugacuauaacugugcuugguuucaaaagcaa

SEQ ID NO: 515489 - RNA, 64 nt, hsa
acgaagaggacaugguaucaagcagucauucaaugacuauaaccucuacucccuugggauugua

SEQ ID NO: 515490 - RNA, 64 nt, hsa
aaauugcaguggcuaggaccuccagcagaaugcugacuauaaguagugauaguggguauucuug

SEQ ID NO: 515491 - RNA, 64 nt, hsa
uucuuccuugugcuucuaauuuuaacaauauaaugacuauaaaaugacacauggaacuaaugga

SEQ ID NO: 515492 - RNA, 64 nt, hsa
guuuguccuuuuaauuuguuucuugauauaugaagacuauaaacuugaaacaaagaguuagcug

SEQ ID NO: 515493 - RNA, 64 nt, hsa
uuucaaaugccauggguuacacuuuuaugggcaugacuauaaccauuuuuguaaagaguaagag

SEQ ID NO: 515494 - RNA, 64 nt, hsa
augaagaaauuaguccuaacaacacuaugagauggacuauaacuugcccaaauuuuuuuuuuuu

SEQ ID NO: 515495 - RNA, 64 nt, hsa
cccacucagcaccaccggccuggccuugccugcagacuauaaacuauaaccacuagcucgacac

SEQ ID NO: 515496 - RNA, 64 nt, hsa
acuaugugaaaguuaacugcggagccaagaguuggacuauaauuaaauuaccuuccuuguacuu

SEQ ID NO: 515497 - RNA, 64 nt, hsa
uugggugggagaggaaagcaaauuuuauuuucuugacuauaaauuuguuauucuugguaucauu

SEQ ID NO: 515498 - RNA, 64 nt, hsa
uuuccaugagaagcacugcauacuuaccuauguggacuauaauaaccugucuccaaaaccaugc

SEQ ID NO: 515499 - RNA, 64 nt, hsa
uaaggggauauuagguuugcuaaauucuuucacagacuauaaaacaaaaaauuuugaggaacac

SEQ ID NO: 515500 - RNA, 64 nt, hsa
gcccuacaaagagaaaccaaaugagcugauuacugacuauaaguucucagccuuuauggaccua

SEQ ID NO: 515501 - RNA, 64 nt, hsa
uccaagaagaaagcaccaagacaacauuucauaugacuauaaugcauguacuauauaagcugau

SEQ ID NO: 515502 - RNA, 64 nt, hsa
gcuccaugggcauggggaaggcacugaaacagaggacuauaaaacauccuucucuuauucucca

SEQ ID NO: 515503 - RNA, 64 nt, hsa
gacuuuaugccuugacauauuuuagugggagccagacuauaaggaauaaaaggaaaaacuuucu

SEQ ID NO: 515504 - RNA, 64 nt, hsa
uaguucugaguaugcuaaacugugugcuuauauagacuauaaccaguugugccuuccuucgcau

SEQ ID NO: 515505 - RNA, 64 nt, hsa
ccacguaucuuccagucucuuuuauaaagucucagacuauaauaaacacagcuugcccaguuua

SEQ ID NO: 515506 - RNA, 64 nt, hsa
acggcaaguaagaguuggaaacuuugagaacacagacuauaaaggcagcagcccgaacacuguc

SEQ ID NO: 515507 - RNA, 64 nt, hsa
uggacaacuugauguaacugacuuuauuuuaugugacuauaauaaaaagcauaauuuucucauu

SEQ ID NO: 515508 - RNA, 64 nt, hsa
gauuaacuggaaaauauaucugaauucaacugcugacuauaaaugguauucuaauaaaauugug

SEQ ID NO: 515509 - RNA, 64 nt, hsa
aguauuugggguuuuguuuguuuacaaauaaucagacuauaauauuuaaacaugcaaaauaacu

SEQ ID NO: 515510 - RNA, 64 nt, hsa
aagucacaucuaccuauuacucccagcauugauugacuauaagaaaggaugcaccuguacucuc

SEQ ID NO: 515511 - RNA, 64 nt, hsa
agucacaucugccuguuacuucccagcauugacugacuauaagaaaggacacaucuguacucug

SEQ ID NO: 515512 - RNA, 64 nt, hsa
caugccaccccaaauccuggcuuaucaagucccagacuauaaauuaugaacucccauuagcuug

SEQ ID NO: 515513 - RNA, 64 nt, hsa
ccuuaugaggcucucgcuguauuguuauuuuaaggacuauaaagaguuugauuuaaaauuaugc

SEQ ID NO: 515514 - RNA, 64 nt, hsa
auuucauuaugaacuuuuauuuacaugacucuaagacuauaagaaaaucugauggcagugacaa

SEQ ID NO: 515515 - RNA, 64 nt, hsa
gugaugagacaaacugaaaauuauugcaagcauugacuauaauuaugcaguacguucucaggau

SEQ ID NO: 515516 - RNA, 64 nt, hsa
uaaaaccaaucaauaauagcuagcuauuacugcagacuauaaaaucuggauauagaaaggagac

SEQ ID NO: 515517 - RNA, 64 nt, hsa
uuugcgguuagaaucccauggauguuucuucuuugacuauaacaaaaucuggggaggacaaagg

SEQ ID NO: 515518 - RNA, 64 nt, hsa
uugaguuauuuccucauucuuuuaaaaaauaagggacuauaaaucaguuauguaguaucuuuug

SEQ ID NO: 515519 - RNA, 64 nt, hsa
gucuugcaaguuaaggcuucccccuuuacuauaagacuauaaauaaaaacuuauuuuauccuuc

SEQ ID NO: 515520 - RNA, 64 nt, hsa
uuuaagaaaaagcuaaaaagaauggaaaucgcaugacuauaacuuaagucuuucuucaaagugc

SEQ ID NO: 515521 - RNA, 64 nt, hsa
ugaacuagauagacccugccuuaguagagggugggacuauaaccuuagaggccagaacuugauc

SEQ ID NO: 515522 - RNA, 64 nt, hsa
ccucuuucuuguuugucagcaucugaccaucugugacuauaaagcuguuauucuuguuauacca

SEQ ID NO: 515523 - RNA, 64 nt, hsa
uugaagaaaaagcuaaaaagaauggaaaucgcaugacuauaacuuaagucuuucuucaaagugc

SEQ ID NO: 515524 - RNA, 64 nt, hsa
ccugccacugagcagucuggggacgguuuggucagacuauaaauaagauagguuugagggcaua

SEQ ID NO: 515525 - RNA, 64 nt, hsa
cuaaacuuuugcgaaagugggucauuuuuuguuugacuauaauagcaggaagaauuauagcaau

SEQ ID NO: 515526 - RNA, 64 nt, hsa
acauaaguuuuguuagagguaaaaauuaaauuuggacuauaauguccuugcuuuauuugagaac

SEQ ID NO: 515527 - RNA, 64 nt, hsa
aacuggaauauuugucuucagaaaauggaaacaagacuauaaaugauaagcccugucccuagca

SEQ ID NO: 515528 - RNA, 64 nt, hsa
auuuuuggcuaaauaaaugagcugcugccacuuugacuauaacccgccugucugcccccucgac

SEQ ID NO: 515529 - RNA, 64 nt, hsa
cauacaauuguauuucuagaacuccagacuaggagacuauaaacaguagucuauuggaacacca

SEQ ID NO: 515530 - RNA, 64 nt, hsa
gaucagcauugugacuuggagauaauaaaauuuagacuauaaacuuggcucccuugccaguguu

SEQ ID NO: 515531 - RNA, 64 nt, hsa
uugggcacucccaagggcguuggggucauaaggagacuauaacucuacagauugugaauauauu

SEQ ID NO: 515532 - RNA, 64 nt, hsa
acaaaaaacugccuuugauacaggcaauucaguggacuauaauaauaguggaggguugagaugu

SEQ ID NO: 515533 - RNA, 64 nt, hsa
ucagaccagugagcaaaaggaauaugaaaacagagacuauaaagauuucacaaaacaggaccug

SEQ ID NO: 515534 - RNA, 64 nt, hsa
uggccuggggugcucucacacccugcacgaucuugacuauaauaaagcuucccuacugcaaauc

SEQ ID NO: 515535 - RNA, 64 nt, hsa
uugaagagcuacacauuguauauauaucaccacagacuauaaggaaauggaauuauuucccucu

SEQ ID NO: 515536 - RNA, 64 nt, hsa
ccuuauaguuuaugaaugucuuguuugugaaagugacuauaacccaaacuuuuuuuuuuuuuua

SEQ ID NO: 515537 - RNA, 64 nt, hsa
auuauuuacucggauucuaauuuaaugugacauugacuauaagaaggucugauaaacugaugaa

SEQ ID NO: 515538 - RNA, 58 nt, hsa
uagaaaagaagaaagauugagacuugaugacuauaaaauauuuguuaggacuucaaau

SEQ ID NO: 515539 - RNA, 64 nt, hsa
gccuaauuucugugauuuccaaccaacaugaaaugacuauaaaugguuuuuuaaugaaaaaaga

SEQ ID NO: 515540 - RNA, 64 nt, hsa
cguaaagguaucagggccgggcgcuguggcucaugacuauaaucccagcuguuugagaggccaa

SEQ ID NO: 515541 - RNA, 64 nt, hsa
aauauugaaaacgacgauauaauuauuauaaguagacuauaauauauuuaguaauauauauuau

SEQ ID NO: 515542 - RNA, 64 nt, hsa
auuguauacugagaaaaauccuaugaauguggcagacuauaaaagccuuuggugggaagauaaa

SEQ ID NO: 515543 - RNA, 64 nt, hsa
aauuacuaccgugacugggaugcaagagaauuaggacuauaauuuuccuauuugaugugugugu

SEQ ID NO: 515544 - RNA, 64 nt, hsa
auuuauuaccuaggguacaguccuugacagaauugacuauaacguugaacaguccuguaucaaa

SEQ ID NO: 515545 - RNA, 64 nt, hsa
gaaaaaagugaauucaaagcaaaaauaacuauuugacuauaauauaggccacaaaaaaucuuga

SEQ ID NO: 515546 - RNA, 64 nt, hsa
gcuuuguauauuuugauuacuuguuuucguuuuugacuauaaaggagcuuuuuuauuuugggag

SEQ ID NO: 515547 - RNA, 64 nt, hsa
ugugauacaugccgaaugccacacguaaacacuugacuauaaaaacugccccccuccuuuccaa

SEQ ID NO: 515548 - RNA, 64 nt, hsa
gagagaaaugaugccguuuuuuaaaugugaagcagacuauaauucucagcucucuuuucuucuu

SEQ ID NO: 515549 - RNA, 64 nt, hsa
uuuuacaccauggagaugagaucagcagaauccagacuauaagaaacuacaggacacaugaccu

SEQ ID NO: 515550 - RNA, 64 nt, hsa
aacauuugacacacauacucaaaaaaauguaacugacuauaaacacuuuaaccuaaucaucugu

SEQ ID NO: 515551 - RNA, 64 nt, hsa
gggauagggacuggagggggugugggguauguaugacuauaaagggaugacgcaaggaguuccu

SEQ ID NO: 515552 - RNA, 64 nt, hsa
cuagaaggaaaagcuuuuaagucucauguuugcugacuauaaaaauaaaucauaguaauaauau

SEQ ID NO: 515553 - RNA, 64 nt, hsa
augauuaugaauuuguuuacuugggaagagauaugacuauaaauaaauguucucuacauguuag

SEQ ID NO: 515554 - RNA, 64 nt, hsa
gcuagaaggaaaagcaugaagucucauguuugcugacuauaaaaauaaaucauaguaauaauau

SEQ ID NO: 515555 - RNA, 64 nt, hsa; identical to SEQ ID NO: 85480

SEQ ID NO: 515556 - RNA, 64 nt, hsa; identical to SEQ ID NO: 85481

SEQ ID NO: 515557 - RNA, 64 nt, hsa; identical to SEQ ID NO: 85482

SEQ ID NO: 515558 - RNA, 64 nt, hsa; identical to SEQ ID NO: 85483

SEQ ID NO: 515559 - RNA, 64 nt, hsa; identical to SEQ ID NO: 85484

SEQ ID NO: 515560 - RNA, 64 nt, hsa; identical to SEQ ID NO: 85485

SEQ ID NO: 515561 - RNA, 64 nt, hsa; identical to SEQ ID NO: 85486

SEQ ID NO: 515562 - RNA, 64 nt, hsa; identical to SEQ ID NO: 85487

SEQ ID NO: 515563 - RNA, 64 nt, hsa; identical to SEQ ID NO: 85488

SEQ ID NO: 515564 - RNA, 64 nt, hsa; identical to SEQ ID NO: 85489

SEQ ID NO: 515565 - RNA, 64 nt, hsa; identical to SEQ ID NO: 85490

SEQ ID NO: 515566 - RNA, 64 nt, hsa; identical to SEQ ID NO: 85491

SEQ ID NO: 515567 - RNA, 64 nt, hsa; identical to SEQ ID NO: 85492

SEQ ID NO: 515568 - RNA, 64 nt, hsa; identical to SEQ ID NO: 85493

SEQ ID NO: 515569 - RNA, 64 nt, hsa; identical to SEQ ID NO: 85494

SEQ ID NO: 515570 - RNA, 64 nt, hsa; identical to SEQ ID NO: 85495

SEQ ID NO: 515571 - RNA, 64 nt, hsa; identical to SEQ ID NO: 85496

SEQ ID NO: 515572 - RNA, 64 nt, hsa; identical to SEQ ID NO: 85497

SEQ ID NO: 515573 - RNA, 64 nt, hsa; identical to SEQ ID NO: 85498

SEQ ID NO: 515574 - RNA, 64 nt, hsa; identical to SEQ ID NO: 85499

SEQ ID NO: 515575 - RNA, 64 nt, hsa; identical to SEQ ID NO: 85500

SEQ ID NO: 515576 - RNA, 64 nt, hsa; identical to SEQ ID NO: 85501

SEQ ID NO: 515577 - RNA, 64 nt, hsa; identical to SEQ ID NO: 85502

SEQ ID NO: 515578 - RNA, 64 nt, hsa; identical to SEQ ID NO: 85503

SEQ ID NO: 515579 - RNA, 64 nt, hsa; identical to SEQ ID NO: 85504

SEQ ID NO: 515580 - RNA, 64 nt, hsa; identical to SEQ ID NO: 85505

SEQ ID NO: 515581 - RNA, 64 nt, hsa; identical to SEQ ID NO: 85506

SEQ ID NO: 515582 - RNA, 64 nt, hsa; identical to SEQ ID NO: 85507

SEQ ID NO: 515583 - RNA, 64 nt, hsa; identical to SEQ ID NO: 85508

SEQ ID NO: 515584 - RNA, 64 nt, hsa; identical to SEQ ID NO: 85509

SEQ ID NO: 515585 - RNA, 64 nt, hsa; identical to SEQ ID NO: 85510

SEQ ID NO: 515586 - RNA, 64 nt, hsa; identical to SEQ ID NO: 85511

SEQ ID NO: 515587 - RNA, 64 nt, hsa; identical to SEQ ID NO: 85512

SEQ ID NO: 515588 - RNA, 64 nt, hsa; identical to SEQ ID NO: 85513

SEQ ID NO: 515589 - RNA, 64 nt, hsa; identical to SEQ ID NO: 85514

SEQ ID NO: 515590 - RNA, 64 nt, hsa; identical to SEQ ID NO: 85515

SEQ ID NO: 515591 - RNA, 64 nt, hsa; identical to SEQ ID NO: 85516

SEQ ID NO: 515592 - RNA, 64 nt, hsa; identical to SEQ ID NO: 85517

SEQ ID NO: 515593 - RNA, 64 nt, hsa; identical to SEQ ID NO: 85518

SEQ ID NO: 515594 - RNA, 64 nt, hsa; identical to SEQ ID NO: 85519

SEQ ID NO: 515595 - RNA, 64 nt, hsa; identical to SEQ ID NO: 85520

SEQ ID NO: 515596 - RNA, 64 nt, hsa; identical to SEQ ID NO: 85521

SEQ ID NO: 515597 - RNA, 64 nt, hsa; identical to SEQ ID NO: 85522

SEQ ID NO: 515598 - RNA, 64 nt, hsa; identical to SEQ ID NO: 85523

SEQ ID NO: 515599 - RNA, 60 nt, hsa
cauugugaagaggaggaaaagugaaucacggagagagaaaggaaaggauagaaucacagg

SEQ ID NO: 515600 - RNA, 60 nt, hsa
augucugugacacaggacggugggaagccugagagagagugaaauuaugugauacacuga

SEQ ID NO: 515601 - RNA, 60 nt, hsa
cccacagugguggccucugccucuuuccuggagagagaaggacagugcacggagagguuu

SEQ ID NO: 515602 - RNA, 60 nt, hsa
cccuaccugucuuuccugaguguuugaggggagagagagacccacaucuccccaaagaga

SEQ ID NO: 515603 - RNA, 60 nt, hsa
cuaccugucuuuccugaguguuugaggggagagagagacccacaucuccccaaagagaug

SEQ ID NO: 515604 - RNA, 60 nt, hsa
aggcucacugccaggccagccuccgagagggagagagagagagagaggacagcuugagcc

SEQ ID NO: 515605 - RNA, 60 nt, hsa
gcucacugccaggccagccuccgagagggagagagagagagagaggacagcuugagccgg

SEQ ID NO: 515606 - RNA, 60 nt, hsa
ucacugccaggccagccuccgagagggagagagagagagagaggacagcuugagccgggc

SEQ ID NO: 515607 - RNA, 60 nt, hsa
acugccaggccagccuccgagagggagagagagagagagaggacagcuugagccgggccc

SEQ ID NO: 515608 - RNA, 60 nt, hsa
ugccaggccagccuccgagagggagagagagagagagaggacagcuugagccgggccccu

SEQ ID NO: 515609 - RNA, 60 nt, hsa
gaucuuacagguaucaggcacaggcaggaagagagagagagagguucuggggaggaaggg

SEQ ID NO: 515610 - RNA, 60 nt, hsa
ucuuacagguaucaggcacaggcaggaagagagagagagagguucuggggaggaagggcc

SEQ ID NO: 515611 - RNA, 60 nt, hsa
uuacagguaucaggcacaggcaggaagagagagagagagguucuggggaggaagggccag

SEQ ID NO: 515612 - RNA, 60 nt, hsa
gagagagagguucuggggaggaagggccaggagagagaucuagaaaguggguucacuaga

SEQ ID NO: 515613 - RNA, 60 nt, hsa
ccuuucccugucuggcuucucccuuaagaagagagagauacuuguagaauuggguggggg

SEQ ID NO: 515614 - RNA, 60 nt, hsa
ccuuccauuugggauauguuacauuagagugagagagagaauaaggagccuuucuuaugg

SEQ ID NO: 515615 - RNA, 60 nt, hsa
uuccauuugggauauguuacauuagagugagagagagaauaaggagccuuucuuauggaa

SEQ ID NO: 515616 - RNA, 60 nt, hsa
ugggaccucgaggcucgagcugaagcaggcgagagagaaacagcuacugcgugcgugcgc

SEQ ID NO: 515617 - RNA, 60 nt, hsa
ucugucgaagaaagaagcucugucaaguuagagagagacaauguguaggaaauguucuuu

SEQ ID NO: 515618 - RNA, 60 nt, hsa
acucuccguccccccggggcccuccggagggagagagagaggaacugcuguuuaucucac

SEQ ID NO: 515619 - RNA, 60 nt, hsa
ucuccguccccccggggcccuccggagggagagagagaggaacugcuguuuaucucacuc

SEQ ID NO: 515620 - RNA, 60 nt, hsa
aagagcauguacaugggagugagagaaaaagagagagagagacagaguggcgggggcggg

SEQ ID NO: 515621 - RNA, 60 nt, hsa
gagcauguacaugggagugagagaaaaagagagagagagacagaguggcgggggcgggga

SEQ ID NO: 515622 - RNA, 60 nt, hsa
gcauguacaugggagugagagaaaaagagagagagagacagaguggcgggggcggggagg

SEQ ID NO: 515623 - RNA, 60 nt, hsa
aguuccuaaaugauucucacaagcaacccugagagagacagucuugugagggagaucugg

SEQ ID NO: 515624 - RNA, 60 nt, hsa
aaacaaaaaacaauggaaaagaugaagcuggagagagaggaaccaguugccaagguagag

SEQ ID NO: 515625 - RNA, 60 nt, hsa
gcagcagccucagcagcugucuugguaaaggagagagagagacauggggccaguaauucc

SEQ ID NO: 515626 - RNA, 60 nt, hsa
agcagccucagcagcugucuugguaaaggagagagagagacauggggccaguaauuccgg

SEQ ID NO: 515627 - RNA, 60 nt, hsa
cagccucagcagcugucuugguaaaggagagagagagacauggggccaguaauuccgggg

SEQ ID NO: 515628 - RNA, 60 nt, hsa
gaaacugaggagucugcaauuuggaauauggagagagagacugauuugcugaauuuccuu

SEQ ID NO: 515629 - RNA, 60 nt, hsa
aacugaggagucugcaauuuggaauauggagagagagacugauuugcugaauuuccuucu

SEQ ID NO: 515630 - RNA, 60 nt, hsa
gaaccacaaugcacauuagcauauuagucugagagagaacuuauaguaaggaaacucacu

SEQ ID NO: 515631 - RNA, 60 nt, hsa
ccuggaaacuuugacaagcuuuauuaaguugagagagagagaggggaaaaaaaaaagccu

SEQ ID NO: 515632 - RNA, 60 nt, hsa
uggaaacuuugacaagcuuuauuaaguugagagagagagaggggaaaaaaaaaagccuuu

SEQ ID NO: 515633 - RNA, 60 nt, hsa
gaaacuuugacaagcuuuauuaaguugagagagagagaggggaaaaaaaaaagccuuucg

SEQ ID NO: 515634 - RNA, 60 nt, hsa
ggcggccgcggcugggcccugcaggagggagagagagacacagucauggcccccuuccuc

SEQ ID NO: 515635 - RNA, 60 nt, hsa
ucggcggccgcggcugggcccugcaggagggagagagagacacagucauggcccccuucc

SEQ ID NO: 515636 - RNA, 60 nt, hsa
gaaauguccagaauaggcaaaucuguuugagagagagaaaguagaugaguacuugccuag

SEQ ID NO: 515637 - RNA, 60 nt, hsa
augaaauguccagaauaggcaaaucuguuugagagagagaaaguagaugaguacuugccu

SEQ ID NO: 515638 - RNA, 60 nt, hsa
guucuccccccuacacccucugcagguggagagagagaagcugggcccagccgggccgug

SEQ ID NO: 515639 - RNA, 60 nt, hsa
ggguucuccccccuacacccucugcagguggagagagagaagcugggcccagccgggccg

SEQ ID NO: 515640 - RNA, 60 nt, hsa
ucucuagagguagaaauuugccuugcugcagagagagaaggaauggcgugggauggggga

SEQ ID NO: 515641 - RNA, 60 nt, hsa
agacacaggucucccgucccugcaccagcugagagagacuugccgcaaagcacaaggcug

SEQ ID NO: 515642 - RNA, 60 nt, hsa
aaauaaaaagaagagagggaggaagaaagggagagagaagaaaagaaaaaugaagaaaag

SEQ ID NO: 515643 - RNA, 60 nt, hsa
cuagggucugcuuuagagaagggggauaaagagagagaaggacuguuaugaaaaacagaa

SEQ ID NO: 515644 - RNA, 60 nt, hsa
gggacuccaggucuugaggagagagacagagagagagaauggauccucauaggucaggga

SEQ ID NO: 515645 - RNA, 60 nt, hsa
cugggacuccaggucuugaggagagagacagagagagagaauggauccucauaggucagg

SEQ ID NO: 515646 - RNA, 60 nt, hsa
gagcacuguucugggacuccaggucuugaggagagagacagagagagagaauggauccuc

SEQ ID NO: 515647 - RNA, 60 nt, hsa
agagccccacaaaacuuuggggacaagggagagagagacucaucugacacuucuuuugga

SEQ ID NO: 515648 - RNA, 60 nt, hsa
ggagagccccacaaaacuuuggggacaagggagagagagacucaucugacacuucuuuug

SEQ ID NO: 515649 - RNA, 60 nt, hsa
gagacagaaagagagagagagagagagagagagagagauccucagaguggaaggaggggg

SEQ ID NO: 515650 - RNA, 60 nt, hsa
gagagacagaaagagagagagagagagagagagagagagauccucagaguggaaggaggg

SEQ ID NO: 515651 - RNA, 60 nt, hsa
gagagagacagaaagagagagagagagagagagagagagagauccucagaguggaaggag

SEQ ID NO: 515652 - RNA, 60 nt, hsa
gagagagagacagaaagagagagagagagagagagagagagagauccucagaguggaagg

SEQ ID NO: 515653 - RNA, 60 nt, hsa
gagagagagagacagaaagagagagagagagagagagagagagagauccucagaguggaa

SEQ ID NO: 515654 - RNA, 60 nt, hsa
cagagagagagagacagaaagagagagagagagagagagagagagagauccucagagugg

SEQ ID NO: 515655 - RNA, 60 nt, hsa
agcagagagagagagacagaaagagagagagagagagagagagagagagauccucagagu

SEQ ID NO: 515656 - RNA, 60 nt, hsa
guagcagagagagagagacagaaagagagagagagagagagagagagagagauccucaga

SEQ ID NO: 515657 - RNA, 60 nt, hsa
ggguagcagagagagagagacagaaagagagagagagagagagagagagagagauccuca

SEQ ID NO: 515658 - RNA, 60 nt, hsa
aaggguagcagagagagagagacagaaagagagagagagagagagagagagagagauccu

SEQ ID NO: 515659 - RNA, 60 nt, hsa
ggaaggguagcagagagagagagacagaaagagagagagagagagagagagagagagauc

SEQ ID NO: 515660 - RNA, 60 nt, hsa
cugagggcagguugggaaggguagcagagagagagagacagaaagagagagagagagaga

SEQ ID NO: 515661 - RNA, 60 nt, hsa
gucugagggcagguugggaaggguagcagagagagagagacagaaagagagagagagaga

SEQ ID NO: 515662 - RNA, 60 nt, hsa
gugucugagggcagguugggaaggguagcagagagagagagacagaaagagagagagaga

SEQ ID NO: 515663 - RNA, 60 nt, hsa
aauguguguguguguucugugugugugugagagagagaguacuugauucauuaaaaaguc

SEQ ID NO: 515664 - RNA, 60 nt, hsa
aaaauguguguguguguucugugugugugugagagagagaguacuugauucauuaaaaag

SEQ ID NO: 515665 - RNA, 60 nt, hsa
uuggagaaggacugggucagagaucuguuggagagagagaauaaagagauuauuuuucau

SEQ ID NO: 515666 - RNA, 60 nt, hsa
ggagaaggacugggucagagaucuguuggagagagagaauaaagagauuauuuuucauua

SEQ ID NO: 515667 - RNA, 60 nt, hsa
cacacauaaaagcacaaagacagagacgcagagagagagagagagccacggagaggaaaa

SEQ ID NO: 515668 - RNA, 60 nt, hsa
cacauaaaagcacaaagacagagacgcagagagagagagagagccacggagaggaaaagc

SEQ ID NO: 515669 - RNA, 60 nt, hsa
cauaaaagcacaaagacagagacgcagagagagagagagagccacggagaggaaaagcag

SEQ ID NO: 515670 - RNA, 60 nt, hsa
uaaaagcacaaagacagagacgcagagagagagagagagccacggagaggaaaagcagau

SEQ ID NO: 515671 - RNA, 60 nt, hsa
gcccagcaccccugcugauaccaccagacagagagagagagcacuugauucuucccgaga

SEQ ID NO: 515672 - RNA, 60 nt, hsa
ccagcaccccugcugauaccaccagacagagagagagagcacuugauucuucccgagaua

SEQ ID NO: 515673 - RNA, 60 nt, hsa
uccacagguggacaaagggauccccagccagagagagagagaccagccaacagcuugaua

SEQ ID NO: 515674 - RNA, 60 nt, hsa
cacagguggacaaagggauccccagccagagagagagagaccagccaacagcuugauaga

SEQ ID NO: 515675 - RNA, 60 nt, hsa
cagguggacaaagggauccccagccagagagagagagaccagccaacagcuugauagacc

SEQ ID NO: 515676 - RNA, 60 nt, hsa
guguguguguguguguguguguguguggcagagagagagaaagagagagagagagagaaa

SEQ ID NO: 515677 - RNA, 60 nt, hsa
guguguguguguguguguguguguggcagagagagagaaagagagagagagagagaaauu

SEQ ID NO: 515678 - RNA, 60 nt, hsa
guguguguguguguggcagagagagagaaagagagagagagagagaaauucuguuaaaau

SEQ ID NO: 515679 - RNA, 60 nt, hsa
guguguguguguggcagagagagagaaagagagagagagagagaaauucuguuaaaaucu

SEQ ID NO: 515680 - RNA, 60 nt, hsa
guguguguguggcagagagagagaaagagagagagagagagaaauucuguuaaaaucuau

SEQ ID NO: 515681 - RNA, 60 nt, hsa
guguguguggcagagagagagaaagagagagagagagagaaauucuguuaaaaucuauuc

SEQ ID NO: 515682 - RNA, 60 nt, hsa
guguguggcagagagagagaaagagagagagagagagaaauucuguuaaaaucuauucug

SEQ ID NO: 515683 - RNA, 60 nt, hsa
gauagcagugaggucagaagucuuucccgggagagagauggccuggguuaucauugcuga

SEQ ID NO: 515684 - RNA, 60 nt, hsa
cauaggacugagccaaggaagagucugccugagagagacgcuuggccugugcuuugcugc

SEQ ID NO: 515685 - RNA, 60 nt, hsa
uccaguuccguucugagagaaaaagagagagagagagaaaaagaccaugcugcauacauu

SEQ ID NO: 515686 - RNA, 60 nt, hsa
uuuccaguuccguucugagagaaaaagagagagagagagaaaaagaccaugcugcauaca

SEQ ID NO: 515687 - RNA, 60 nt, hsa
uguuuccaguuccguucugagagaaaaagagagagagagagaaaaagaccaugcugcaua

SEQ ID NO: 515688 - RNA, 60 nt, hsa
gcuguuuccaguuccguucugagagaaaaagagagagagagagaaaaagaccaugcugca

SEQ ID NO: 515689 - RNA, 60 nt, hsa
uucugaaagaucuagugguucacacagagagagagagaguacugaaaaagcaacuccucu

SEQ ID NO: 515690 - RNA, 60 nt, hsa
cuuucugaaagaucuagugguucacacagagagagagagaguacugaaaaagcaacuccu

SEQ ID NO: 515691 - RNA, 60 nt, hsa
ggcuuucugaaagaucuagugguucacacagagagagagagaguacugaaaaagcaacuc

SEQ ID NO: 515692 - RNA, 60 nt, hsa
ugggauguggauggaugugugcauaagagagagagagaauaugugugugugugugugcgu

SEQ ID NO: 515693 - RNA, 60 nt, hsa
guugggauguggauggaugugugcauaagagagagagagaauaugugugugugugugugc

SEQ ID NO: 515694 - RNA, 60 nt, hsa
uuguugggauguggauggaugugugcauaagagagagagagaauaugugugugugugugu

SEQ ID NO: 515695 - RNA, 60 nt, hsa
ggaaaagagagagagagagagagagagagagagagagaaagauggaggagaagaacuugg

SEQ ID NO: 515696 - RNA, 60 nt, hsa
ggggaaaagagagagagagagagagagagagagagagagaaagauggaggagaagaacuu

SEQ ID NO: 515697 - RNA, 60 nt, hsa
agggggaaaagagagagagagagagagagagagagagagagaaagauggaggagaagaac

SEQ ID NO: 515698 - RNA, 60 nt, hsa
ggagggggaaaagagagagagagagagagagagagagagagagaaagauggaggagaaga

SEQ ID NO: 515699 - RNA, 60 nt, hsa
ggggagggggaaaagagagagagagagagagagagagagagagagaaagauggaggagaa

SEQ ID NO: 515700 - RNA, 60 nt, hsa
gaggggagggggaaaagagagagagagagagagagagagagagagagaaagauggaggag

SEQ ID NO: 515701 - RNA, 60 nt, hsa
cagaggggagggggaaaagagagagagagagagagagagagagagagagaaagauggagg

SEQ ID NO: 515702 - RNA, 60 nt, hsa
ugcagaggggagggggaaaagagagagagagagagagagagagagagagagaaagaugga

SEQ ID NO: 515703 - RNA, 60 nt, hsa
auugcagaggggagggggaaaagagagagagagagagagagagagagagagagaaagaug

SEQ ID NO: 515704 - RNA, 60 nt, hsa
gaauugcagaggggagggggaaaagagagagagagagagagagagagagagagagaaaga

SEQ ID NO: 515705 - RNA, 60 nt, hsa
gugaauugcagaggggagggggaaaagagagagagagagagagagagagagagagagaaa

SEQ ID NO: 515706 - RNA, 60 nt, hsa
aagugaauugcagaggggagggggaaaagagagagagagagagagagagagagagagaga

SEQ ID NO: 515707 - RNA, 60 nt, hsa
ggaagugaauugcagaggggagggggaaaagagagagagagagagagagagagagagaga

SEQ ID NO: 515708 - RNA, 60 nt, hsa
acucaucugaaucaucaguuccuugauggagagagagaaggagauggaaugugucuggua

SEQ ID NO: 515709 - RNA, 60 nt, hsa
gaacucaucugaaucaucaguuccuugauggagagagagaaggagauggaaugugucugg

SEQ ID NO: 515710 - RNA, 60 nt, hsa
uucgacugggagguucuggaaagaaagagagagagagaaaagagguaaaggagggagcca

SEQ ID NO: 515711 - RNA, 60 nt, hsa
uguucgacugggagguucuggaaagaaagagagagagagaaaagagguaaaggagggagc

SEQ ID NO: 515712 - RNA, 60 nt, hsa
ccuguucgacugggagguucuggaaagaaagagagagagagaaaagagguaaaggaggga

SEQ ID NO: 515713 - RNA, 60 nt, hsa
ggcuagaaaccuggcuggcugugagucagagagagagaggauggacgugggagaaagcaa

SEQ ID NO: 515714 - RNA, 60 nt, hsa
aaggcuagaaaccuggcuggcugugagucagagagagagaggauggacgugggagaaagc

SEQ ID NO: 515715 - RNA, 60 nt, hsa
aucuagggguuucuuggccacauuucccuugagagagagugggauuugcccuauccacag

SEQ ID NO: 515716 - RNA, 60 nt, hsa
uucaaaaagaaaaaaauaauaaaaauaaaagagagagagaaucagaccuggguggaacuc

SEQ ID NO: 515717 - RNA, 60 nt, hsa
caaaaagaaaaaaauaauaaaaauaaaagagagagagaaucagaccuggguggaacucuc

SEQ ID NO: 515718 - RNA, 60 nt, hsa
cugggguggacauucagcagagugcgaguggagagagagagaugguguuuacucagaacc

SEQ ID NO: 515719 - RNA, 60 nt, hsa
gggguggacauucagcagagugcgaguggagagagagagaugguguuuacucagaaccug

SEQ ID NO: 515720 - RNA, 60 nt, hsa
gguggacauucagcagagugcgaguggagagagagagaugguguuuacucagaaccugcu

SEQ ID NO: 515721 - RNA, 60 nt, hsa
caaggaaucauuguuuggcauugaaaauaggagagagaucaugagaaauuaccaaaaugu

SEQ ID NO: 515722 - RNA, 60 nt, hsa
gaagucuuguucaggguauggggcuaggaugagagagaaugccacagaguaugaaggaag

SEQ ID NO: 515723 - RNA, 60 nt, hsa
aagucaacaaagaacuuaccuuggaggauagagagagagaagggaccaauuaugaggacu

SEQ ID NO: 515724 - RNA, 60 nt, hsa
gucaacaaagaacuuaccuuggaggauagagagagagaagggaccaauuaugaggacuga

SEQ ID NO: 515725 - RNA, 60 nt, hsa
cuuaguguuuggguauauucauuucaaagggagagagagagguuuuuuucuguucugucu

SEQ ID NO: 515726 - RNA, 60 nt, hsa
uaguguuuggguauauucauuucaaagggagagagagagguuuuuuucuguucugucuca

SEQ ID NO: 515727 - RNA, 60 nt, hsa
guuuugaugcuagagaggaaaaaggacuuggagagagagaaggaauggcugguccagagg

SEQ ID NO: 515728 - RNA, 60 nt, hsa
uuugaugcuagagaggaaaaaggacuuggagagagagaaggaauggcugguccagaggcu

SEQ ID NO: 515729 - RNA, 50 nt, hsa; identical to SEQ ID NO: 157121

SEQ ID NO: 515730 - RNA, 52 nt, hsa; identical to SEQ ID NO: 157122

SEQ ID NO: 515731 - RNA, 54 nt, hsa; identical to SEQ ID NO: 157123

SEQ ID NO: 515732 - RNA, 56 nt, hsa; identical to SEQ ID NO: 157124

SEQ ID NO: 515733 - RNA, 58 nt, hsa; identical to SEQ ID NO: 157125

SEQ ID NO: 515734 - RNA, 60 nt, hsa; identical to SEQ ID NO: 157126

SEQ ID NO: 515735 - RNA, 60 nt, hsa
uucacugagauggagugagagagagagagagagagagaugacaaggagcacaagaagugg

SEQ ID NO: 515736 - RNA, 60 nt, hsa
agggaauaagcaaagggggaagaauugaaagagagagagaagaaagaauacagagagcuu

SEQ ID NO: 515737 - RNA, 60 nt, hsa
ggaauaagcaaagggggaagaauugaaagagagagagaagaaagaauacagagagcuuac

SEQ ID NO: 515738 - RNA, 60 nt, hsa
cuuuauguguguguaugugugucagagaaagagagagagagagagagaagggaggaugag

SEQ ID NO: 515739 - RNA, 60 nt, hsa
uuauguguguguaugugugucagagaaagagagagagagagagagaagggaggaugagaa

SEQ ID NO: 515740 - RNA, 60 nt, hsa
auguguguguaugugugucagagaaagagagagagagagagagaagggaggaugagaacg

SEQ ID NO: 515741 - RNA, 60 nt, hsa
guguguguaugugugucagagaaagagagagagagagagagaagggaggaugagaacgaa

SEQ ID NO: 515742 - RNA, 60 nt, hsa
guguguaugugugucagagaaagagagagagagagagagaagggaggaugagaacgaaug

SEQ ID NO: 515743 - RNA, 60 nt, hsa
guguaugugugucagagaaagagagagagagagagagaagggaggaugagaacgaauggg

SEQ ID NO: 515744 - RNA, 60 nt, hsa
aagaaccaaaagagaucacaauacucaaaagagagagagagagaaaaaagagagaucuug

SEQ ID NO: 515745 - RNA, 60 nt, hsa
gaaccaaaagagaucacaauacucaaaagagagagagagagaaaaaagagagaucuugau

SEQ ID NO: 515746 - RNA, 60 nt, hsa
accaaaagagaucacaauacucaaaagagagagagagagaaaaaagagagaucuugaucc

SEQ ID NO: 515747 - RNA, 60 nt, hsa
caaaagagaucacaauacucaaaagagagagagagagaaaaaagagagaucuugauccac

SEQ ID NO: 515748 - RNA, 60 nt, hsa
ugugcagaaaucaaaugacagagaggaagugagagagagaggugucggggaggugccagg

SEQ ID NO: 515749 - RNA, 60 nt, hsa
ugcagaaaucaaaugacagagaggaagugagagagagaggugucggggaggugccaggcu

SEQ ID NO: 515750 - RNA, 60 nt, hsa
ggugcuacacagcuagaauagauauauuuagagagagagauauuuuuaagacaaagccca

SEQ ID NO: 515751 - RNA, 60 nt, hsa
ugcuacacagcuagaauagauauauuuagagagagagauauuuuuaagacaaagcccaca

SEQ ID NO: 515752 - RNA, 60 nt, hsa
gcauuggaagcuuauucuuuuuguucacuggagagagagagaacuguuuacaguuaaucu

SEQ ID NO: 515753 - RNA, 60 nt, hsa
auuggaagcuuauucuuuuuguucacuggagagagagagaacuguuuacaguuaaucugu

SEQ ID NO: 515754 - RNA, 60 nt, hsa
uggaagcuuauucuuuuuguucacuggagagagagagaacuguuuacaguuaaucugugu

SEQ ID NO: 515755 - RNA, 60 nt, hsa
caggaccaucacagcuucugaacugagccggagagagagaauggaauugcugaccccugg

SEQ ID NO: 515756 - RNA, 60 nt, hsa
ggaccaucacagcuucugaacugagccggagagagagaauggaauugcugaccccuggaa

SEQ ID NO: 515757 - RNA, 60 nt, hsa
aaaaacauagacuggaggagguaauccauggagagagaaaaagaagagggcucaggacaa

SEQ ID NO: 515758 - RNA, 60 nt, hsa
uauugauggcaacagucaagauggugugaugagagagaugggaggggcacaaagaggagg

SEQ ID NO: 515759 - RNA, 60 nt, hsa
ccuuguauuagcauccaagaaaugaugagagagagagaaauuauauacuaugaaaagugc

SEQ ID NO: 515760 - RNA, 60 nt, hsa
gaccuuguauuagcauccaagaaaugaugagagagagagaaauuauauacuaugaaaagu

SEQ ID NO: 515761 - RNA, 60 nt, hsa
gagaccuuguauuagcauccaagaaaugaugagagagagagaaauuauauacuaugaaaa

SEQ ID NO: 515762 - RNA, 60 nt, hsa
gagugagacuccaucucaaaaaaaaaaagagagagagaugaaaagaguaggaaaaugaga

SEQ ID NO: 515763 - RNA, 60 nt, hsa
cagagugagacuccaucucaaaaaaaaaaagagagagagaugaaaagaguaggaaaauga

SEQ ID NO: 515764 - RNA, 60 nt, hsa
ccugccccgaagacuccuaauaggucaagagagagagacccagacaagcaaacucaaaau

SEQ ID NO: 515765 - RNA, 60 nt, hsa
caccugccccgaagacuccuaauaggucaagagagagagacccagacaagcaaacucaaa

SEQ ID NO: 515766 - RNA, 60 nt, hsa
ucauuaauaauaugagaaaugauaccuggagagagagauuaugagcaaauguauugcuuc

SEQ ID NO: 515767 - RNA, 60 nt, hsa
uuucauuaauaauaugagaaaugauaccuggagagagagauuaugagcaaauguauugcu

SEQ ID NO: 515768 - RNA, 60 nt, hsa
gagcaagaaaagagaaaauauuaaaacgaggagagagaaaaauaauauuaacacaaaaaa

SEQ ID NO: 515769 - RNA, 60 nt, hsa
guuuuguaggagcggguuugggggagucuggagagagacuggacaggggagugcuggaac

SEQ ID NO: 515770 - RNA, 60 nt, hsa
aaaaaaaaaaagaugacaaagaaaaacagagagagagaauauuggagauguccugaauuu

SEQ ID NO: 515771 - RNA, 60 nt, hsa
uaaaaaaaaaaaagaugacaaagaaaaacagagagagagaauauuggagauguccugaau

SEQ ID NO: 515772 - RNA, 60 nt, hsa
cucuuaaaaaaaaaaaaaaaaaaaaaaaaagagagagagagaauaaauagaaaagaaugu

SEQ ID NO: 515773 - RNA, 60 nt, hsa
cuuaaaaaaaaaaaaaaaaaaaaaaaaagagagagagagaauaaauagaaaagaaugugg

SEQ ID NO: 515774 - RNA, 60 nt, hsa
uaaaaaaaaaaaaaaaaaaaaaaaaagagagagagagaauaaauagaaaagaauguggcu

SEQ ID NO: 515775 - RNA, 60 nt, hsa
aauaauguucaacugaaucucacagaugaggagagagaagaaacggaagaggaaguuuau

SEQ ID NO: 515776 - RNA, 60 nt, hsa
ggaauggaggaguuguuuggggagggaaaggagagagaaggaaaggagugagguauuucc

SEQ ID NO: 515777 - RNA, 60 nt, hsa
ugacaaauucaaaagagagagagagaucuugagagagaaaugcuguucguucaaaagugg

SEQ ID NO: 515778 - RNA, 60 nt, hsa
cguaacuccaucugacaaauucaaaagagagagagagaucuugagagagaaaugcuguuc

SEQ ID NO: 515779 - RNA, 60 nt, hsa
ugcguaacuccaucugacaaauucaaaagagagagagagaucuugagagagaaaugcugu

SEQ ID NO: 515780 - RNA, 60 nt, hsa
ccugcguaacuccaucugacaaauucaaaagagagagagagaucuugagagagaaaugcu

SEQ ID NO: 515781 - RNA, 60 nt, hsa
acuguguugugauucauaguacauuaaaaagagagagagagagaaagaaucccacagggc

SEQ ID NO: 515782 - RNA, 60 nt, hsa
uguguugugauucauaguacauuaaaaagagagagagagagaaagaaucccacagggcac

SEQ ID NO: 515783 - RNA, 60 nt, hsa
uguugugauucauaguacauuaaaaagagagagagagagaaagaaucccacagggcacua

SEQ ID NO: 515784 - RNA, 60 nt, hsa
uugugauucauaguacauuaaaaagagagagagagagaaagaaucccacagggcacuauu

SEQ ID NO: 515785 - RNA, 60 nt, hsa
gacuucugcuagguagaggcauuugucuuagagagagagagagcgcgggagagagugaga

SEQ ID NO: 515786 - RNA, 60 nt, hsa
cuucugcuagguagaggcauuugucuuagagagagagagagcgcgggagagagugagaga

SEQ ID NO: 515787 - RNA, 60 nt, hsa
ucugcuagguagaggcauuugucuuagagagagagagagcgcgggagagagugagagaga

SEQ ID NO: 515788 - RNA, 60 nt, hsa
cuuagagagagagagagcgcgggagagagugagagagagugagagcacaaagauaacgca

SEQ ID NO: 515789 - RNA, 60 nt, hsa
agagagagugagagcacaaagauaacgcaggagagagagagagaaagaaugagaaagaaa

SEQ ID NO: 515790 - RNA, 60 nt, hsa
agagagugagagcacaaagauaacgcaggagagagagagagaaagaaugagaaagaaaag

SEQ ID NO: 515791 - RNA, 60 nt, hsa
agagugagagcacaaagauaacgcaggagagagagagagaaagaaugagaaagaaaagga

SEQ ID NO: 515792 - RNA, 60 nt, hsa
agugagagcacaaagauaacgcaggagagagagagagaaagaaugagaaagaaaaggaau

SEQ ID NO: 515793 - RNA, 60 nt, hsa
acaauagauuauuucuguuuuacuccaaaagagagagagagagugagugugagugugugu

SEQ ID NO: 515794 - RNA, 60 nt, hsa
aauagauuauuucuguuuuacuccaaaagagagagagagagugagugugagugugugugu

SEQ ID NO: 515795 - RNA, 60 nt, hsa
uagauuauuucuguuuuacuccaaaagagagagagagagugagugugagugugugugugu

SEQ ID NO: 515796 - RNA, 60 nt, hsa
auccaaacuuccugcaacauuuucuuagaggagagagagaaauauuaaaagagaaaugaa

SEQ ID NO: 515797 - RNA, 60 nt, hsa
ccaaacuuccugcaacauuuucuuagaggagagagagaaauauuaaaagagaaaugaaac

SEQ ID NO: 515798 - RNA, 60 nt, hsa
aagucgagacaccaucccagguguguguaagagagagagagagaacagggaggauacaga

SEQ ID NO: 515799 - RNA, 60 nt, hsa
gucgagacaccaucccagguguguguaagagagagagagagaacagggaggauacagaag

SEQ ID NO: 515800 - RNA, 60 nt, hsa
cgagacaccaucccagguguguguaagagagagagagagaacagggaggauacagaagua

SEQ ID NO: 515801 - RNA, 60 nt, hsa
agacaccaucccagguguguguaagagagagagagagaacagggaggauacagaaguauu

SEQ ID NO: 515802 - RNA, 60 nt, hsa
uaagaugcauuuaauaaaaaaaaagagagagagagagaggugugagggacaaaaugcaaa

SEQ ID NO: 515803 - RNA, 60 nt, hsa
gcuaagaugcauuuaauaaaaaaaaagagagagagagagaggugugagggacaaaaugca

SEQ ID NO: 515804 - RNA, 60 nt, hsa
uugcuaagaugcauuuaauaaaaaaaaagagagagagagagaggugugagggacaaaaug

SEQ ID NO: 515805 - RNA, 60 nt, hsa
uuuugcuaagaugcauuuaauaaaaaaaaagagagagagagagaggugugagggacaaaa

SEQ ID NO: 515806 - RNA, 60 nt, hsa
uccuccccuugcuuccagggaagaugaagagagagagauuuggaaggggcucuggcuccc

SEQ ID NO: 515807 - RNA, 60 nt, hsa
cuuccuccccuugcuuccagggaagaugaagagagagagauuuggaaggggcucuggcuc

SEQ ID NO: 515808 - RNA, 60 nt, hsa
uuccucagugcccuuuggcuguugaggagugagagagagagagagagagagagagagaga

SEQ ID NO: 515809 - RNA, 60 nt, hsa
ccucagugcccuuuggcuguugaggagugagagagagagagagagagagagagagagaga

SEQ ID NO: 515810 - RNA, 60 nt, hsa
ucagugcccuuuggcuguugaggagugagagagagagagagagagagagagagagagaga

SEQ ID NO: 515811 - RNA, 60 nt, hsa
agugcccuuuggcuguugaggagugagagagagagagagagagagagagagagagagaga

SEQ ID NO: 515812 - RNA, 60 nt, hsa
ugcccuuuggcuguugaggagugagagagagagagagagagagagagagagagagagaga

SEQ ID NO: 515813 - RNA, 60 nt, hsa
cccuuuggcuguugaggagugagagagagagagagagagagagagagagagagagagaga

SEQ ID NO: 515814 - RNA, 60 nt, hsa
cuuuggcuguugaggagugagagagagagagagagagagagagagagagagagagagaga

SEQ ID NO: 515815 - RNA, 60 nt, hsa
uuggcuguugaggagugagagagagagagagagagagagagagagagagagagagagaca

SEQ ID NO: 515816 - RNA, 60 nt, hsa
ggcuguugaggagugagagagagagagagagagagagagagagagagagagagagacaag

SEQ ID NO: 515817 - RNA, 60 nt, hsa
cuguugaggagugagagagagagagagagagagagagagagagagagagagagacaagca

SEQ ID NO: 515818 - RNA, 60 nt, hsa
guugaggagugagagagagagagagagagagagagagagagagagagagagacaagcagg

SEQ ID NO: 515819 - RNA, 60 nt, hsa
ugaggagugagagagagagagagagagagagagagagagagagagagagacaagcaggag

SEQ ID NO: 515820 - RNA, 60 nt, hsa
aggagugagagagagagagagagagagagagagagagagagagagagacaagcaggagcg

SEQ ID NO: 515821 - RNA, 60 nt, hsa
gagugagagagagagagagagagagagagagagagagagagagagacaagcaggagcgug

SEQ ID NO: 515822 - RNA, 60 nt, hsa
gugagagagagagagagagagagagagagagagagagagagagacaagcaggagcguggc

SEQ ID NO: 515823 - RNA, 60 nt, hsa
gagagagagagagagagagagagagagagagagagagagagacaagcaggagcguggcug

SEQ ID NO: 515824 - RNA, 60 nt, hsa
gagagagagagagagagagagagagagagagagagagagacaagcaggagcguggcugcu

SEQ ID NO: 515825 - RNA, 60 nt, hsa
gagagagagagagagagagagagagagagagagagagacaagcaggagcguggcugcucg

SEQ ID NO: 515826 - RNA, 60 nt, hsa
gucacauucgaauucggguggcauccuccggagagagagagaggaaggagauuccacaca

SEQ ID NO: 515827 - RNA, 60 nt, hsa
cacauucgaauucggguggcauccuccggagagagagagaggaaggagauuccacacagg

SEQ ID NO: 515828 - RNA, 60 nt, hsa
cauucgaauucggguggcauccuccggagagagagagaggaaggagauuccacacagggg

SEQ ID NO: 515829 - RNA, 60 nt, hsa
accuagaaacguuuucauucgucauuccaagagagagagaggaaagaaaaauacaacuuu

SEQ ID NO: 515830 - RNA, 60 nt, hsa
cuagaaacguuuucauucgucauuccaagagagagagaggaaagaaaaauacaacuuuca

SEQ ID NO: 515831 - RNA, 60 nt, hsa
agccuagugggagagagugggggagaggaagagagagagagagcauguauacccguaugu

SEQ ID NO: 515832 - RNA, 60 nt, hsa
ccuagugggagagagugggggagaggaagagagagagagagcauguauacccguauguua

SEQ ID NO: 515833 - RNA, 60 nt, hsa
uagugggagagagugggggagaggaagagagagagagagcauguauacccguauguuauc

SEQ ID NO: 515834 - RNA, 60 nt, hsa
agagugaggagagugugugauagcuagaaagagagagagacagagagauggcaagcacug

SEQ ID NO: 515835 - RNA, 60 nt, hsa
agugaggagagugugugauagcuagaaagagagagagacagagagauggcaagcacugag

SEQ ID NO: 515836 - RNA, 60 nt, hsa
uaaaagagccuugauuuuaaaaaaaaaagagagagagauguaauuuaaaaaguuuauuau

SEQ ID NO: 515837 - RNA, 60 nt, hsa
cauaaaagagccuugauuuuaaaaaaaaaagagagagagauguaauuuaaaaaguuuauu

SEQ ID NO: 515838 - RNA, 60 nt, hsa
gccuuauuugacuucaaagaauccacaugagagagagacugcauaaauguaauaacugag

SEQ ID NO: 515839 - RNA, 60 nt, hsa
uggccuuauuugacuucaaagaauccacaugagagagagacugcauaaauguaauaacug

SEQ ID NO: 515840 - RNA, 59 nt, hsa
ggauaacagcaaaaaaacugaaaauaaagagagagagagaucuggguguuggugguugc

SEQ ID NO: 515841 - RNA, 60 nt, hsa
cuggauaacagcaaaaaaacugaaaauaaagagagagagagaucuggguguuggugguug

SEQ ID NO: 515842 - RNA, 60 nt, hsa
gcuccauaucugcauuccacuggggaaagagagagagaaaagagcagauuuuaaaaaaaa

SEQ ID NO: 515843 - RNA, 60 nt, hsa
cagcuccauaucugcauuccacuggggaaagagagagagaaaagagcagauuuuaaaaaa

SEQ ID NO: 515844 - RNA, 60 nt, hsa
acaauggagagagaaagagagagagagcgcgagagagaucaagacccaaguuuugaaucu

SEQ ID NO: 515845 - RNA, 60 nt, hsa
guuuuucuagagacaauggagagagaaagagagagagagcgcgagagagaucaagaccca

SEQ ID NO: 515846 - RNA, 60 nt, hsa
caguuuuucuagagacaauggagagagaaagagagagagagcgcgagagagaucaagacc

SEQ ID NO: 515847 - RNA, 60 nt, hsa
guccuugccacaguuuuucuagagacaauggagagagaaagagagagagagcgcgagaga

SEQ ID NO: 515848 - RNA, 60 nt, hsa
ugacauggugggcacacuggcgcccaguaagagagagagagagccaaagcuguccguuuu

SEQ ID NO: 515849 - RNA, 60 nt, hsa
acauggugggcacacuggcgcccaguaagagagagagagagccaaagcuguccguuuugc

SEQ ID NO: 515850 - RNA, 60 nt, hsa
auggugggcacacuggcgcccaguaagagagagagagagccaaagcuguccguuuugcag

SEQ ID NO: 515851 - RNA, 60 nt, hsa
ccaggacacagcucagcuugcucacgcccagagagagaaaaaguuaagcugcugacccug

SEQ ID NO: 515852 - RNA, 60 nt, hsa
gucccaaagugaguaaaauccccuagagcagagagagagagagagagagagagugucuuc

SEQ ID NO: 515853 - RNA, 60 nt, hsa
cccaaagugaguaaaauccccuagagcagagagagagagagagagagagagugucuucau

SEQ ID NO: 515854 - RNA, 60 nt, hsa
caaagugaguaaaauccccuagagcagagagagagagagagagagagagugucuucaugc

SEQ ID NO: 515855 - RNA, 60 nt, hsa
aagugaguaaaauccccuagagcagagagagagagagagagagagagugucuucaugcca

SEQ ID NO: 515856 - RNA, 60 nt, hsa
gugaguaaaauccccuagagcagagagagagagagagagagagagugucuucaugccaac

SEQ ID NO: 515857 - RNA, 60 nt, hsa
gaguaaaauccccuagagcagagagagagagagagagagagagugucuucaugccaacca

SEQ ID NO: 515858 - RNA, 60 nt, hsa
guaaaauccccuagagcagagagagagagagagagagagagugucuucaugccaaccaca

SEQ ID NO: 515859 - RNA, 60 nt, hsa
aaaauccccuagagcagagagagagagagagagagagagugucuucaugccaaccacagc

SEQ ID NO: 515860 - RNA, 60 nt, hsa
ccuuugggucgacauaguauggaaguauuugagagagagaaccuuuccacucccacugcc

SEQ ID NO: 515861 - RNA, 60 nt, hsa
uuugggucgacauaguauggaaguauuugagagagagaaccuuuccacucccacugccag

SEQ ID NO: 515862 - RNA, 60 nt, hsa
caaauguacuuaagucaucauucagagugagagagagaaagcacggcugaggcugaguca

SEQ ID NO: 515863 - RNA, 60 nt, hsa
agcaaauguacuuaagucaucauucagagugagagagagaaagcacggcugaggcugagu

SEQ ID NO: 515864 - RNA, 60 nt, hsa
gcaaaugcuuuagaaaucucugauaauggagagagagacagaggacccuccucacuaccc

SEQ ID NO: 515865 - RNA, 60 nt, hsa
uugcaaaugcuuuagaaaucucugauaauggagagagagacagaggacccuccucacuac

SEQ ID NO: 515866 - RNA, 60 nt, hsa
ugaggagaaugguagagaggagaggagagagagagagaaugugauuuuuggccuuguggc

SEQ ID NO: 515867 - RNA, 60 nt, hsa
acugaggagaaugguagagaggagaggagagagagagagaaugugauuuuuggccuugug

SEQ ID NO: 515868 - RNA, 60 nt, hsa
gcacugaggagaaugguagagaggagaggagagagagagagaaugugauuuuuggccuug

SEQ ID NO: 515869 - RNA, 60 nt, hsa
uggcacugaggagaaugguagagaggagaggagagagagagagaaugugauuuuuggccu

SEQ ID NO: 515870 - RNA, 60 nt, hsa
agacuccaucucaaaaaaaaaaaagagagagagagagaaagaaauagaagagaagagcca

SEQ ID NO: 515871 - RNA, 60 nt, hsa
ugagacuccaucucaaaaaaaaaaaagagagagagagagaaagaaauagaagagaagagc

SEQ ID NO: 515872 - RNA, 60 nt, hsa
agugagacuccaucucaaaaaaaaaaaagagagagagagagaaagaaauagaagagaaga

SEQ ID NO: 515873 - RNA, 60 nt, hsa
agagugagacuccaucucaaaaaaaaaaaagagagagagagagaaagaaauagaagagaa

SEQ ID NO: 515874 - RNA, 60 nt, hsa
agaagagggagggagagagaaagacgaagggagagagaaagcaguuuccaaggauauguu

SEQ ID NO: 515875 - RNA, 60 nt, hsa
acugaagagaaaugggaaagaagagggagggagagagaaagacgaagggagagagaaagc

SEQ ID NO: 515876 - RNA, 60 nt, hsa
ugcacugaacucgggauguuggggauuggagagagagaauugccaaaguaacagcaaaaa

SEQ ID NO: 515877 - RNA, 60 nt, hsa
ugugcacugaacucgggauguuggggauuggagagagagaauugccaaaguaacagcaaa

SEQ ID NO: 515878 - RNA, 60 nt, hsa
cugugaucaugccacugcauuccagccugggagagagagaggaccugucuguugaaaaaa

SEQ ID NO: 515879 - RNA, 60 nt, hsa
gugaucaugccacugcauuccagccugggagagagagaggaccugucuguugaaaaaaac

SEQ ID NO: 515880 - RNA, 60 nt, hsa
ugggcucagagcucaggagucgccuuaccugagagagauguucuagcugagagggccugg

SEQ ID NO: 515881 - RNA, 60 nt, hsa
gucccuguccccagagggaggagcaggcaggagagagaggggaaggagguaugaauccca

SEQ ID NO: 515882 - RNA, 60 nt, hsa
uugacuuaagugagggggaaauaaaacccagagagagagagagagcgagagagagagaca

SEQ ID NO: 515883 - RNA, 60 nt, hsa
gacuuaagugagggggaaauaaaacccagagagagagagagagcgagagagagagacaug

SEQ ID NO: 515884 - RNA, 60 nt, hsa
cuuaagugagggggaaauaaaacccagagagagagagagagcgagagagagagacauguu

SEQ ID NO: 515885 - RNA, 60 nt, hsa
uaagugagggggaaauaaaacccagagagagagagagagcgagagagagagacauguuac

SEQ ID NO: 515886 - RNA, 60 nt, hsa
ggaaauaaaacccagagagagagagagagcgagagagagagacauguuacuaugaaagac

SEQ ID NO: 515887 - RNA, 60 nt, hsa
aaauaaaacccagagagagagagagagcgagagagagagacauguuacuaugaaagacuu

SEQ ID NO: 515888 - RNA, 60 nt, hsa
auaaaacccagagagagagagagagcgagagagagagacauguuacuaugaaagacuugu

SEQ ID NO: 515889 - RNA, 60 nt, hsa
cagcaguggagugccgggacccucagaguggagagagagacccgggaugugugugcugua

SEQ ID NO: 515890 - RNA, 60 nt, hsa
gcaguggagugccgggacccucagaguggagagagagacccgggaugugugugcuguacc

SEQ ID NO: 515891 - RNA, 60 nt, hsa
cccucgcggcgggcgcccccagggccaggagagagagacagggcuggcuccucucgcccc

SEQ ID NO: 515892 - RNA, 60 nt, hsa
cgcccucgcggcgggcgcccccagggccaggagagagagacagggcuggcuccucucgcc

SEQ ID NO: 515893 - RNA, 60 nt, hsa
aaccaggacacaaaagcagcaagaagcggggagagagagggauagaaaacaagcgcagga

SEQ ID NO: 515894 - RNA, 60 nt, hsa
cacucauccugagacuuucuuuuugcaguggagagagagaauaaucuaguuggggcaaac

SEQ ID NO: 515895 - RNA, 60 nt, hsa
cucauccugagacuuucuuuuugcaguggagagagagaauaaucuaguuggggcaaacac

SEQ ID NO: 515896 - RNA, 60 nt, hsa
ugggagcugugugugucugugugugugugagagagagaucuugucugcgugugugugugu

SEQ ID NO: 515897 - RNA, 60 nt, hsa
uuugggagcugugugugucugugugugugugagagagagaucuugucugcgugugugugu

SEQ ID NO: 515898 - RNA, 60 nt, hsa
cccgacauuuuuuuucuguuucuauucugagagagagaugaucaaguuuuaauuugggua

SEQ ID NO: 515899 - RNA, 60 nt, hsa
gucccgacauuuuuuuucuguuucuauucugagagagagaugaucaaguuuuaauuuggg

SEQ ID NO: 515900 - RNA, 60 nt, hsa
agugagccaagaucgcaccaccgcaugagagagagagauuacuauuucuugucccuuuuu

SEQ ID NO: 515901 - RNA, 60 nt, hsa
gcagugagccaagaucgcaccaccgcaugagagagagagauuacuauuucuugucccuuu

SEQ ID NO: 515902 - RNA, 60 nt, hsa
uugcagugagccaagaucgcaccaccgcaugagagagagagauuacuauuucuugucccu

SEQ ID NO: 515903 - RNA, 60 nt, hsa
guguguguguguguguguguguaugagagagagagagacuuugacgguuguagauauuuu

SEQ ID NO: 515904 - RNA, 60 nt, hsa
guguguguguguguguguguguguaugagagagagagagacuuugacgguuguagauauu

SEQ ID NO: 515905 - RNA, 60 nt, hsa
guguguguguguguguguguguguguaugagagagagagagacuuugacgguuguagaua

SEQ ID NO: 515906 - RNA, 60 nt, hsa
guguguguguguguguguguguguguguaugagagagagagagacuuugacgguuguaga

SEQ ID NO: 515907 - RNA, 60 nt, hsa
cagcgccuuugucugucuaucuggugacaagagagagacaaguaaaugggggccguuggg

SEQ ID NO: 515908 - RNA, 60 nt, hsa
acuccaucucaaaaaauaaauaaauagaaagagagagagaggaaaaaaaaagaaaagaac

SEQ ID NO: 515909 - RNA, 60 nt, hsa
uccaucucaaaaaauaaauaaauagaaagagagagagaggaaaaaaaaagaaaagaacac

SEQ ID NO: 515910 - RNA, 60 nt, hsa
cuaucuccugcaaccucagugccucagccugagagagagaugagaugcucuuggacuccc

SEQ ID NO: 515911 - RNA, 60 nt, hsa
aucuccugcaaccucagugccucagccugagagagagaugagaugcucuuggacucccca

SEQ ID NO: 515912 - RNA, 60 nt, hsa
gagacacagagagaaggagaaagagggagggagagagagaaagagagagaaagagagaga

SEQ ID NO: 515913 - RNA, 60 nt, hsa
gacacagagagaaggagaaagagggagggagagagagaaagagagagaaagagagagaga

SEQ ID NO: 515914 - RNA, 60 nt, hsa
gaaggagaaagagggagggagagagagaaagagagagaaagagagagagagagagagaga

SEQ ID NO: 515915 - RNA, 60 nt, hsa
gagggagggagagagagaaagagagagaaagagagagagagagagagagagagaaagcug

SEQ ID NO: 515916 - RNA, 60 nt, hsa
gggagggagagagagaaagagagagaaagagagagagagagagagagagagaaagcugaa

SEQ ID NO: 515917 - RNA, 60 nt, hsa
gagggagagagagaaagagagagaaagagagagagagagagagagagagaaagcugaacg

SEQ ID NO: 515918 - RNA, 60 nt, hsa
gggagagagagaaagagagagaaagagagagagagagagagagagagaaagcugaacgug

SEQ ID NO: 515919 - RNA, 60 nt, hsa
gagagagagaaagagagagaaagagagagagagagagagagagagaaagcugaacgugca

SEQ ID NO: 515920 - RNA, 60 nt, hsa
gagagagaaagagagagaaagagagagagagagagagagagagaaagcugaacgugcacu

SEQ ID NO: 515921 - RNA, 60 nt, hsa
gagagaaagagagagaaagagagagagagagagagagagagaaagcugaacgugcacucu

SEQ ID NO: 515922 - RNA, 60 nt, hsa
gagaaagagagagaaagagagagagagagagagagagagaaagcugaacgugcacucuga

SEQ ID NO: 515923 - RNA, 60 nt, hsa
gaaagagagagaaagagagagagagagagagagagagaaagcugaacgugcacucugaca

SEQ ID NO: 515924 - RNA, 60 nt, hsa
caggggcugguagacaagaacugugaaagagagagagaaaaaaccucaacuguguauuuu

SEQ ID NO: 515925 - RNA, 60 nt, hsa
gccaggggcugguagacaagaacugugaaagagagagagaaaaaaccucaacuguguauu

SEQ ID NO: 515926 - RNA, 60 nt, hsa
gcagccaggcgcucuggagccagcuggagagagagagauccugauaccucuguggggacu

SEQ ID NO: 515927 - RNA, 60 nt, hsa
gagcagccaggcgcucuggagccagcuggagagagagagauccugauaccucugugggga

SEQ ID NO: 515928 - RNA, 60 nt, hsa
uggagcagccaggcgcucuggagccagcuggagagagagagauccugauaccucuguggg

SEQ ID NO: 515929 - RNA, 60 nt, hsa
aaaugcaacuuguauaaaacaaaaaugggagagagagagguauuaaacaaauaccccccu

SEQ ID NO: 515930 - RNA, 60 nt, hsa
agaaaugcaacuuguauaaaacaaaaaugggagagagagagguauuaaacaaauaccccc

SEQ ID NO: 515931 - RNA, 60 nt, hsa
gugugugugugugagagagagagagagagagagagagaccagcaucuucaagagaaguau

SEQ ID NO: 515932 - RNA, 60 nt, hsa
gugugugugugugugagagagagagagagagagagagagaccagcaucuucaagagaagu

SEQ ID NO: 515933 - RNA, 60 nt, hsa
gugugugugugugugugagagagagagagagagagagagagaccagcaucuucaagagaa

SEQ ID NO: 515934 - RNA, 60 nt, hsa
gugugugugugugugugugagagagagagagagagagagagagaccagcaucuucaagag

SEQ ID NO: 515935 - RNA, 60 nt, hsa
uugugugugugugugugugugagagagagagagagagagagagagaccagcaucuucaag

SEQ ID NO: 515936 - RNA, 60 nt, hsa
guuugugugugugugugugugugagagagagagagagagagagagagaccagcaucuuca

SEQ ID NO: 515937 - RNA, 60 nt, hsa
guguuugugugugugugugugugugagagagagagagagagagagagagaccagcaucuu

SEQ ID NO: 515938 - RNA, 60 nt, hsa
guguguuugugugugugugugugugugagagagagagagagagagagagagaccagcauc

SEQ ID NO: 515939 - RNA, 60 nt, hsa
guguguguuugugugugugugugugugugagagagagagagagagagagagagaccagca

SEQ ID NO: 515940 - RNA, 60 nt, hsa
guguguguguuugugugugugugugugugugagagagagagagagagagagagagaccag

SEQ ID NO: 515941 - RNA, 60 nt, hsa
guauuuucaggauuuguuucuaugagacgagagagagaagccuccgcuccuuaaugugaa

SEQ ID NO: 515942 - RNA, 60 nt, hsa
gaguauuuucaggauuuguuucuaugagacgagagagagaagccuccgcuccuuaaugug

SEQ ID NO: 515943 - RNA, 60 nt, hsa
uuuuucaacaaaggaguguguucagaaaaggagagagaggcugagaucauucaggaguuu

SEQ ID NO: 515944 - RNA, 60 nt, hsa
agagaacucagcaagccaaccugggaaucagagagagaaggagaaggaggggagccuguc

SEQ ID NO: 515945 - RNA, 60 nt, hsa
ucauauuucuaaaaggggccaaugcaaaaggagagagaaggacuggauuuaagccaguuu

SEQ ID NO: 515946 - RNA, 60 nt, hsa
gaacuaauuuuuuuaaggauacugaaaaaugagagagaguggucgaaugccugaaauuuu

SEQ ID NO: 515947 - RNA, 60 nt, hsa
agucuuuguugcuauauuuuguggggcugggagagagagauuagauuauuuugacauggg

SEQ ID NO: 515948 - RNA, 60 nt, hsa
ucuuuguugcuauauuuuguggggcugggagagagagauuagauuauuuugacaugggau

SEQ ID NO: 515949 - RNA, 60 nt, hsa
aaaaagauuacccaaaaacugucuuuaaaagagagagagagaaaaaaaaaauaguauuug

SEQ ID NO: 515950 - RNA, 60 nt, hsa
aaagauuacccaaaaacugucuuuaaaagagagagagagaaaaaaaaaauaguauuugca

SEQ ID NO: 515951 - RNA, 60 nt, hsa
agauuacccaaaaacugucuuuaaaagagagagagagaaaaaaaaaauaguauuugcaua

SEQ ID NO: 515952 - RNA, 60 nt, hsa
ucgccuuuuccuuccaucaguugaguggcugagagagaagugccucaucccugagccaca

SEQ ID NO: 515953 - RNA, 60 nt, hsa
ggacaaaaccgguugaccagaaaaugggcagagagagaugaccucggaagcauuuccaca

SEQ ID NO: 515954 - RNA, 60 nt, hsa
ucucauggaugguucucaaagguaaaaaaagagagagaaagagagagagcuagcuguggg

SEQ ID NO: 515955 - RNA, 60 nt, hsa
gguucucaaagguaaaaaaagagagagaaagagagagagcuagcugugggauucugugua

SEQ ID NO: 515956 - RNA, 60 nt, hsa
ccuguuuccugggcuagucuuggaccccacgagagagaaucguuccucagccucauggug

SEQ ID NO: 515957 - RNA, 60 nt, hsa
aucuccguaaaugugcucugcuccucagcugagagagaaaaaaauaaacuguauuuggcu

SEQ ID NO: 515958 - RNA, 60 nt, hsa
acuggaaaagauguuaacaguaaagauggagagagagagugugugcguguguguguauau

SEQ ID NO: 515959 - RNA, 60 nt, hsa
uaacuggaaaagauguuaacaguaaagauggagagagagagugugugcguguguguguau

SEQ ID NO: 515960 - RNA, 60 nt, hsa
gcagaauucuuuugguucuuugguuccagagagagagaagaugcuugugccagguggcac

SEQ ID NO: 515961 - RNA, 60 nt, hsa
gugcagaauucuuuugguucuuugguuccagagagagagaagaugcuugugccagguggc

SEQ ID NO: 515962 - RNA, 60 nt, hsa
uuaucucaaaaaaaaaaaaaaaaagagagagagagagaaaaagaaaugcuguguuuaauc

SEQ ID NO: 515963 - RNA, 60 nt, hsa
ccuuaucucaaaaaaaaaaaaaaaaagagagagagagagaaaaagaaaugcuguguuuaa

SEQ ID NO: 515964 - RNA, 60 nt, hsa
gaccuuaucucaaaaaaaaaaaaaaaaagagagagagagagaaaaagaaaugcuguguuu

SEQ ID NO: 515965 - RNA, 60 nt, hsa
gagaccuuaucucaaaaaaaaaaaaaaaaagagagagagagagaaaaagaaaugcugugu

SEQ ID NO: 515966 - RNA, 60 nt, hsa
uguguguguguguacucuguguguguaugagagagagaaaugcuaaccuuguagcaugug

SEQ ID NO: 515967 - RNA, 60 nt, hsa
uguguguguguguguacucuguguguguaugagagagagaaaugcuaaccuuguagcaug

SEQ ID NO: 515968 - RNA, 60 nt, hsa
guauggcugagcaagagagagagagaaugagagagagacugugugugugugugugugugu

SEQ ID NO: 515969 - RNA, 60 nt, hsa
uuguauggcugagcaagagagagagagaaugagagagagacugugugugugugugugugu

SEQ ID NO: 515970 - RNA, 60 nt, hsa
uggagggguguuguauggcugagcaagagagagagagaaugagagagagacugugugugu

SEQ ID NO: 515971 - RNA, 60 nt, hsa
ccuggagggguguuguauggcugagcaagagagagagagaaugagagagagacugugugu

SEQ ID NO: 515972 - RNA, 60 nt, hsa
auccuggagggguguuguauggcugagcaagagagagagagaaugagagagagacugugu

SEQ ID NO: 515973 - RNA, 60 nt, hsa
aagaaaaauuuccaaaacuauugagagagagagagagaaaguauugaaauuuuguucugc

SEQ ID NO: 515974 - RNA, 60 nt, hsa
ccaagaaaaauuuccaaaacuauugagagagagagagagaaaguauugaaauuuuguucu

SEQ ID NO: 515975 - RNA, 60 nt, hsa
uaccaagaaaaauuuccaaaacuauugagagagagagagagaaaguauugaaauuuuguu

SEQ ID NO: 515976 - RNA, 60 nt, hsa
gguaccaagaaaaauuuccaaaacuauugagagagagagagagaaaguauugaaauuuug

SEQ ID NO: 515977 - RNA, 60 nt, hsa
uugguaccaagaaaaauuuccaaaacuauugagagagagagagagaaaguauugaaauuu

SEQ ID NO: 515978 - RNA, 60 nt, hsa
uuugaaucuaucuuaaaauacugagguguggagagagagacaggaucaggagcgauagag

SEQ ID NO: 515979 - RNA, 60 nt, hsa
ugaaucuaucuuaaaauacugagguguggagagagagacaggaucaggagcgauagagag

SEQ ID NO: 515980 - RNA, 60 nt, hsa
guguguguguguguguguguguguguguaugagagagagagagagagacaacagagacag

SEQ ID NO: 515981 - RNA, 60 nt, hsa
guguguguguguguguguguguguguaugagagagagagagagagacaacagagacagag

SEQ ID NO: 515982 - RNA, 60 nt, hsa
guguguguguguguguguguguguaugagagagagagagagagacaacagagacagagag

SEQ ID NO: 515983 - RNA, 60 nt, hsa
guguguguguguguguguguguaugagagagagagagagagacaacagagacagagagag

SEQ ID NO: 515984 - RNA, 60 nt, hsa
guguguguguguguguguguaugagagagagagagagagacaacagagacagagagaggc

SEQ ID NO: 515985 - RNA, 60 nt, hsa
guguguguguguguguguaugagagagagagagagagacaacagagacagagagaggcag

SEQ ID NO: 515986 - RNA, 60 nt, hsa
cagagagaggcagagaggcauagagagacagagagagagacaagaaacagagauagacag

SEQ ID NO: 515987 - RNA, 60 nt, hsa
gagagaggcagagaggcauagagagacagagagagagacaagaaacagagauagacagaa

SEQ ID NO: 515988 - RNA, 60 nt, hsa
ugucucagaaaaaaaaaaaaaaaagagagagagagagaaagagaacaauauuugggagag

SEQ ID NO: 515989 - RNA, 60 nt, hsa
ucugucucagaaaaaaaaaaaaaaaagagagagagagagaaagagaacaauauuugggag

SEQ ID NO: 515990 - RNA, 60 nt, hsa
acucugucucagaaaaaaaaaaaaaaaagagagagagagagaaagagaacaauauuuggg

SEQ ID NO: 515991 - RNA, 60 nt, hsa
agacucugucucagaaaaaaaaaaaaaaaagagagagagagagaaagagaacaauauuug

SEQ ID NO: 515992 - RNA, 60 nt, hsa
gugcuguucucaggugaaaagagagagagagagagagacauaagaaauuuagagaaaaau

SEQ ID NO: 515993 - RNA, 60 nt, hsa
aggugcuguucucaggugaaaagagagagagagagagagacauaagaaauuuagagaaaa

SEQ ID NO: 515994 - RNA, 60 nt, hsa
guaggugcuguucucaggugaaaagagagagagagagagagacauaagaaauuuagagaa

SEQ ID NO: 515995 - RNA, 60 nt, hsa
cuguaggugcuguucucaggugaaaagagagagagagagagagacauaagaaauuuagag

SEQ ID NO: 515996 - RNA, 60 nt, hsa
aacuguaggugcuguucucaggugaaaagagagagagagagagagacauaagaaauuuag

SEQ ID NO: 515997 - RNA, 60 nt, hsa
gaaacuguaggugcuguucucaggugaaaagagagagagagagagagacauaagaaauuu

SEQ ID NO: 515998 - RNA, 60 nt, hsa
uugaccaugauaaugcaaauaacagaaggagagagagaaugaacccuuucuggguguuuc

SEQ ID NO: 515999 - RNA, 60 nt, hsa
uguugaccaugauaaugcaaauaacagaaggagagagagaaugaacccuuucuggguguu

SEQ ID NO: 516000 - RNA, 60 nt, hsa
gaggaggcugaauuucucaagccauuaggagagagagaaauugggagugguccccaaaga

SEQ ID NO: 516001 - RNA, 60 nt, hsa
gagaggaggcugaauuucucaagccauuaggagagagagaaauugggagugguccccaaa

SEQ ID NO: 516002 - RNA, 60 nt, hsa
agagagagagagaggagaaagagagagaaggagagagacaguagccaagagaaccccacg

SEQ ID NO: 516003 - RNA, 60 nt, hsa
uccuagagaaagagagagagagaggagaaagagagagaaggagagagacaguagccaaga

SEQ ID NO: 516004 - RNA, 60 nt, hsa
uucacaacagacauuuccuagagaaagagagagagagaggagaaagagagagaaggagag

SEQ ID NO: 516005 - RNA, 60 nt, hsa
gcuucacaacagacauuuccuagagaaagagagagagagaggagaaagagagagaaggag

SEQ ID NO: 516006 - RNA, 60 nt, hsa
cugcuucacaacagacauuuccuagagaaagagagagagagaggagaaagagagagaagg

SEQ ID NO: 516007 - RNA, 60 nt, hsa
ccacuugcuugauuuaucaugagagaagaggagagagagagagacugagcgcuaggagug

SEQ ID NO: 516008 - RNA, 60 nt, hsa
acuugcuugauuuaucaugagagaagaggagagagagagagacugagcgcuaggagugug

SEQ ID NO: 516009 - RNA, 60 nt, hsa
uugcuugauuuaucaugagagaagaggagagagagagagacugagcgcuaggagugugug

SEQ ID NO: 516010 - RNA, 60 nt, hsa
gcuugauuuaucaugagagaagaggagagagagagagacugagcgcuaggagugugugua

SEQ ID NO: 516011 - RNA, 60 nt, hsa
gagguggggagggagacagagacagaaacagagagagacagagacagagagagacugagg

SEQ ID NO: 516012 - RNA, 60 nt, hsa
cagagacagaaacagagagagacagagacagagagagacugagggagagacucugaggac

SEQ ID NO: 516013 - RNA, 60 nt, hsa
agagacugagggagagacucugaggacauggagagagacucaaagagacuccaagauuca

SEQ ID NO: 516014 - RNA, 60 nt, hsa
aagagagcgggagggagggaaggagggagggagagagauagagagagagagagagagaga

SEQ ID NO: 516015 - RNA, 60 nt, hsa
gagggagggaaggagggagggagagagauagagagagagagagagagagaggaugugugg

SEQ ID NO: 516016 - RNA, 60 nt, hsa
gggagggaaggagggagggagagagauagagagagagagagagagagaggaugugugggc

SEQ ID NO: 516017 - RNA, 60 nt, hsa
gagggaaggagggagggagagagauagagagagagagagagagagaggaugugugggccc

SEQ ID NO: 516018 - RNA, 60 nt, hsa
gggaaggagggagggagagagauagagagagagagagagagagaggaugugugggcccua

SEQ ID NO: 516019 - RNA, 60 nt, hsa
gaaggagggagggagagagauagagagagagagagagagagaggaugugugggcccuaag

SEQ ID NO: 516020 - RNA, 60 nt, hsa
gagggagagagauagagagagagagagagagagagagagaggaugugugggcccuaaggc

SEQ ID NO: 516021 - RNA, 60 nt, hsa
gggagagagauagagagagagagagagagagagagagaggaugugugggcccuaaggcug

SEQ ID NO: 516022 - RNA, 60 nt, hsa
agaucgcaccacuugcacugcagccugagagagagagagccagaccuugucucaaaaaau

SEQ ID NO: 516023 - RNA, 60 nt, hsa
caagaucgcaccacuugcacugcagccugagagagagagagccagaccuugucucaaaaa

SEQ ID NO: 516024 - RNA, 60 nt, hsa
gucaagaucgcaccacuugcacugcagccugagagagagagagccagaccuugucucaaa

SEQ ID NO: 516025 - RNA, 60 nt, hsa
gugugugugugugugugugagagagagagagagagagaugggugguggugagaaguguug

SEQ ID NO: 516026 - RNA, 60 nt, hsa
gugugugugugugugugugugagagagagagagagagagaugggugguggugagaagugu

SEQ ID NO: 516027 - RNA, 60 nt, hsa
gugugugugugugugugugugugagagagagagagagagagaugggugguggugagaagu

SEQ ID NO: 516028 - RNA, 60 nt, hsa
gugugugugugugugugugugugugagagagagagagagagagaugggugguggugagaa

SEQ ID NO: 516029 - RNA, 60 nt, hsa
gugugugugugugugugugugugugugagagagagagagagagagaugggugguggugag

SEQ ID NO: 516030 - RNA, 60 nt, hsa
gugugugugugugugugugugugugugugagagagagagagagagagaugggugguggug

SEQ ID NO: 516031 - RNA, 60 nt, hsa
aagugugugugugugugugugugugugugugagagagagagagagagagauggguggugg

SEQ ID NO: 516032 - RNA, 60 nt, hsa
acacacacacacacacacacacgaaggagagagagagaaaacugauggggaaaacaagcu

SEQ ID NO: 516033 - RNA, 60 nt, hsa
acacacacacacacacacacacacgaaggagagagagagaaaacugauggggaaaacaag

SEQ ID NO: 516034 - RNA, 60 nt, hsa
acacacacacacacacacacacacacgaaggagagagagagaaaacugauggggaaaaca

SEQ ID NO: 516035 - RNA, 60 nt, hsa
ccuggccuuuccuuuuguaauaagaaagaagagagagaacuugaugcaaaguccacgaaa

SEQ ID NO: 516036 - RNA, 60 nt, hsa
cucugaccucccugcuugcauugggucugggagagagaguggaauauuugguagggaccu

SEQ ID NO: 516037 - RNA, 60 nt, hsa
gucauuccccacacacguccuguucaccucgagagagagagagagagagcaccuuucuuc

SEQ ID NO: 516038 - RNA, 60 nt, hsa
cauuccccacacacguccuguucaccucgagagagagagagagagagcaccuuucuuccg

SEQ ID NO: 516039 - RNA, 60 nt, hsa
uuccccacacacguccuguucaccucgagagagagagagagagagcaccuuucuuccguc

SEQ ID NO: 516040 - RNA, 60 nt, hsa
ccccacacacguccuguucaccucgagagagagagagagagagcaccuuucuuccgucug

SEQ ID NO: 516041 - RNA, 60 nt, hsa
ccacacacguccuguucaccucgagagagagagagagagagcaccuuucuuccgucuguu

SEQ ID NO: 516042 - RNA, 60 nt, hsa
acacacguccuguucaccucgagagagagagagagagagcaccuuucuuccgucuguuca

SEQ ID NO: 516043 - RNA, 60 nt, hsa
auuuuaaguguugaggagcagaggugagaagagagagagagagagaaagucaaauaaagu

SEQ ID NO: 516044 - RNA, 60 nt, hsa
uuuaaguguugaggagcagaggugagaagagagagagagagagaaagucaaauaaaguca

SEQ ID NO: 516045 - RNA, 60 nt, hsa
uaaguguugaggagcagaggugagaagagagagagagagagaaagucaaauaaagucaaa

SEQ ID NO: 516046 - RNA, 60 nt, hsa
aguguugaggagcagaggugagaagagagagagagagagaaagucaaauaaagucaaaga

SEQ ID NO: 516047 - RNA, 60 nt, hsa
uguugaggagcagaggugagaagagagagagagagagaaagucaaauaaagucaaagacc

SEQ ID NO: 516048 - RNA, 60 nt, hsa
cacccaagacauuuuaauaguaaauagagagagagagaagaguuaaugaacaugagguag

SEQ ID NO: 516049 - RNA, 60 nt, hsa
cccacccaagacauuuuaauaguaaauagagagagagagaagaguuaaugaacaugaggu

SEQ ID NO: 516050 - RNA, 60 nt, hsa
cccccacccaagacauuuuaauaguaaauagagagagagagaagaguuaaugaacaugag

SEQ ID NO: 516051 - RNA, 60 nt, hsa
gccuagaaauugaaaggcaaaaacuagagagagagagaauggaacgcgaacgcuuggaaa

SEQ ID NO: 516052 - RNA, 60 nt, hsa
gcgccuagaaauugaaaggcaaaaacuagagagagagagaauggaacgcgaacgcuugga

SEQ ID NO: 516053 - RNA, 60 nt, hsa
gagcgccuagaaauugaaaggcaaaaacuagagagagagagaauggaacgcgaacgcuug

SEQ ID NO: 516054 - RNA, 60 nt, hsa
gaacgggaagaacgggaacgcuuacagagagagagagagcgccuagaaauugaaaggcaa

SEQ ID NO: 516055 - RNA, 60 nt, hsa
gugaacgggaagaacgggaacgcuuacagagagagagagagcgccuagaaauugaaaggc

SEQ ID NO: 516056 - RNA, 60 nt, hsa
ucgugaacgggaagaacgggaacgcuuacagagagagagagagcgccuagaaauugaaag

SEQ ID NO: 516057 - RNA, 60 nt, hsa
cugauuuuugguagacgaagagagauugcagagagagagcgucgagagcgagaacgcauu

SEQ ID NO: 516058 - RNA, 60 nt, hsa
cagauggagauccuuucagggagagagagagagagagaggagaagacagagagauuaaag

SEQ ID NO: 516059 - RNA, 60 nt, hsa
aacagauggagauccuuucagggagagagagagagagagaggagaagacagagagauuaa

SEQ ID NO: 516060 - RNA, 60 nt, hsa
gcaacagauggagauccuuucagggagagagagagagagagaggagaagacagagagauu

SEQ ID NO: 516061 - RNA, 60 nt, hsa
gugcaacagauggagauccuuucagggagagagagagagagagaggagaagacagagaga

SEQ ID NO: 516062 - RNA, 60 nt, hsa
uggugcaacagauggagauccuuucagggagagagagagagagagaggagaagacagaga

SEQ ID NO: 516063 - RNA, 60 nt, hsa
ccuggugcaacagauggagauccuuucagggagagagagagagagagaggagaagacaga

SEQ ID NO: 516064 - RNA, 60 nt, hsa
gcauuuccugcugggguccugguuccucaggagagagagaccacagggugagagugagcc

SEQ ID NO: 516065 - RNA, 60 nt, hsa
auuuccugcugggguccugguuccucaggagagagagaccacagggugagagugagccag

SEQ ID NO: 516066 - RNA, 60 nt, hsa
cauggccuuggcaguuauuuuuccaucaccgagagagagagacagagagagaaaauaaac

SEQ ID NO: 516067 - RNA, 60 nt, hsa
uggccuuggcaguuauuuuuccaucaccgagagagagagacagagagagaaaauaaacua

SEQ ID NO: 516068 - RNA, 60 nt, hsa
gccuuggcaguuauuuuuccaucaccgagagagagagacagagagagaaaauaaacuacc

SEQ ID NO: 516069 - RNA, 60 nt, hsa
uuauuuuuccaucaccgagagagagagacagagagagaaaauaaacuaccccuccuauuc

SEQ ID NO: 516070 - RNA, 60 nt, hsa
gaaagagagugagagagagagagaaagagagagagagaugcuguugaaucagaaacagau

SEQ ID NO: 516071 - RNA, 60 nt, hsa
gagaaagagagugagagagagagagaaagagagagagagaugcuguugaaucagaaacag

SEQ ID NO: 516072 - RNA, 60 nt, hsa
gagagaaagagagugagagagagagagaaagagagagagagaugcuguugaaucagaaac

SEQ ID NO: 516073 - RNA, 60 nt, hsa
gagagugagagagagaaagagagugagagagagagagaaagagagagagagaugcuguug

SEQ ID NO: 516074 - RNA, 60 nt, hsa
cagagagugagagagagaaagagagugagagagagagagaaagagagagagagaugcugu

SEQ ID NO: 516075 - RNA, 60 nt, hsa
gccagagagugagagagagaaagagagugagagagagagagaaagagagagagagaugcu

SEQ ID NO: 516076 - RNA, 60 nt, hsa
gagccagagagugagagagagaaagagagugagagagagagagaaagagagagagagaug

SEQ ID NO: 516077 - RNA, 60 nt, hsa
guaaccaguuuccagagagccagagagugagagagagaaagagagugagagagagagaga

SEQ ID NO: 516078 - RNA, 60 nt, hsa
gaguaaccaguuuccagagagccagagagugagagagagaaagagagugagagagagaga

SEQ ID NO: 516079 - RNA, 60 nt, hsa
ugaggccgcugguagacuuuuguuaaaagagagagagacagagacagagaaauaagcauu

SEQ ID NO: 516080 - RNA, 60 nt, hsa
ccugaggccgcugguagacuuuuguuaaaagagagagagacagagacagagaaauaagca

SEQ ID NO: 516081 - RNA, 60 nt, hsa
cuuuacaaaggaaauuugaauaaauggagagagagagaagccuuguuguuggauaggaaa

SEQ ID NO: 516082 - RNA, 60 nt, hsa
cacuuuacaaaggaaauuugaauaaauggagagagagagaagccuuguuguuggauagga

SEQ ID NO: 516083 - RNA, 60 nt, hsa
gccacuuuacaaaggaaauuugaauaaauggagagagagagaagccuuguuguuggauag

SEQ ID NO: 516084 - RNA, 60 nt, hsa
gaagugcuggggcagggaggcccaggagaugagagagaagguccgaguaggugauagaag

SEQ ID NO: 516085 - RNA, 60 nt, hsa
acggaguugccaggagcaaaccaaagugaagagagagauaggaagcugccucggggccac

SEQ ID NO: 516086 - RNA, 60 nt, hsa
aaaggucuaaaugcccacuugaaugaagcugagagagagaucuagcaaaagcuaaaacuc

SEQ ID NO: 516087 - RNA, 60 nt, hsa
aggucuaaaugcccacuugaaugaagcugagagagagaucuagcaaaagcuaaaacucau

SEQ ID NO: 516088 - RNA, 60 nt, hsa
acuccggagugagaagcuuugcccuccuaagagagagagacagagagacagagagagaga

SEQ ID NO: 516089 - RNA, 60 nt, hsa
uccggagugagaagcuuugcccuccuaagagagagagacagagagacagagagagagaaa

SEQ ID NO: 516090 - RNA, 60 nt, hsa
gcccuccuaagagagagagacagagagacagagagagagaaagagagagugugugggucu

SEQ ID NO: 516091 - RNA, 60 nt, hsa
ccuccuaagagagagagacagagagacagagagagagaaagagagagugugugggucuau

SEQ ID NO: 516092 - RNA, 60 nt, hsa
auuuaucucugugaccugccagggagaggggagagagagagagaugcuguugagcacaug

SEQ ID NO: 516093 - RNA, 60 nt, hsa
uuaucucugugaccugccagggagaggggagagagagagagaugcuguugagcacaugac

SEQ ID NO: 516094 - RNA, 60 nt, hsa
aucucugugaccugccagggagaggggagagagagagagaugcuguugagcacaugacaa

SEQ ID NO: 516095 - RNA, 60 nt, hsa
cucugugaccugccagggagaggggagagagagagagaugcuguugagcacaugacaaaa

SEQ ID NO: 516096 - RNA, 60 nt, hsa
ugggagcuauuuacaaauguccaugugggagagagagagcaugagagcacaguagcccag

SEQ ID NO: 516097 - RNA, 60 nt, hsa
ccugggagcuauuuacaaauguccaugugggagagagagagcaugagagcacaguagccc

SEQ ID NO: 516098 - RNA, 60 nt, hsa
ggcagagagacagagagggagagagggacagagagagauagagcaggaggucggggcacu

SEQ ID NO: 516099 - RNA, 60 nt, hsa
gagacagagagggagagagagacagagggagagagagacagaggggaagagaggcagaga

SEQ ID NO: 516100 - RNA, 60 nt, hsa
aggagacagagagggagagagagacagagggagagagagacagaggggaagagaggcaga

SEQ ID NO: 516101 - RNA, 60 nt, hsa
agggagagaaacagaggagacagagagggagagagagacagagggagagagagacagagg

SEQ ID NO: 516102 - RNA, 60 nt, hsa
agagggagagaaacagaggagacagagagggagagagagacagagggagagagagacaga

SEQ ID NO: 516103 - RNA, 60 nt, hsa
agguggggagaggggagagagauaugaggagagagagacagaggaggcagagagggagag

SEQ ID NO: 516104 - RNA, 60 nt, hsa
agagguggggagaggggagagagauaugaggagagagagacagaggaggcagagagggag

SEQ ID NO: 516105 - RNA, 60 nt, hsa
ggggagagagaaagagagguggggagaggggagagagauaugaggagagagagacagagg

SEQ ID NO: 516106 - RNA, 60 nt, hsa
aaggaggagggagagagauggagaggaggggagagagaaagagagguggggagaggggag

SEQ ID NO: 516107 - RNA, 60 nt, hsa
aaaugggggucagggagggaaaggaggagggagagagauggagaggaggggagagagaaa

SEQ ID NO: 516108 - RNA, 60 nt, hsa
gccugauuggaaaaaaaaaaaaaagagagagagagagaagaagaagaagaagagacacaa

SEQ ID NO: 516109 - RNA, 60 nt, hsa
gugccugauuggaaaaaaaaaaaaaagagagagagagagaagaagaagaagaagagacac

SEQ ID NO: 516110 - RNA, 60 nt, hsa
gagugccugauuggaaaaaaaaaaaaaagagagagagagagaagaagaagaagaagagac

SEQ ID NO: 516111 - RNA, 60 nt, hsa
gagagugccugauuggaaaaaaaaaaaaaagagagagagagagaagaagaagaagaagag

SEQ ID NO: 516112 - RNA, 60 nt, hsa
ucagcaucuggcauccaaagcaacaucagagagagagaacacagaagaaaagcaauugcc

SEQ ID NO: 516113 - RNA, 60 nt, hsa
uaucagcaucuggcauccaaagcaacaucagagagagagaacacagaagaaaagcaauug

SEQ ID NO: 516114 - RNA, 60 nt, hsa
guuauuuggaaagaaagaaagaaagagagagagagagaaagaaagaaagaaaggcugccu

SEQ ID NO: 516115 - RNA, 60 nt, hsa
aaguuauuuggaaagaaagaaagaaagagagagagagagaaagaaagaaagaaaggcugc

SEQ ID NO: 516116 - RNA, 60 nt, hsa
aaaaguuauuuggaaagaaagaaagaaagagagagagagagaaagaaagaaagaaaggcu

SEQ ID NO: 516117 - RNA, 60 nt, hsa
gaaaaaguuauuuggaaagaaagaaagaaagagagagagagagaaagaaagaaagaaagg

SEQ ID NO: 516118 - RNA, 60 nt, hsa
augggcagaggugagagagagagagagaaagagagagaaugaaugcaguugcauugauuc

SEQ ID NO: 516119 - RNA, 60 nt, hsa
ugccuuuugaaugggcagaggugagagagagagagagaaagagagagaaugaaugcaguu

SEQ ID NO: 516120 - RNA, 60 nt, hsa
agugccuuuugaaugggcagaggugagagagagagagagaaagagagagaaugaaugcag

SEQ ID NO: 516121 - RNA, 60 nt, hsa
ccagugccuuuugaaugggcagaggugagagagagagagagaaagagagagaaugaaugc

SEQ ID NO: 516122 - RNA, 60 nt, hsa
cuccagugccuuuugaaugggcagaggugagagagagagagagaaagagagagaaugaau

SEQ ID NO: 516123 - RNA, 60 nt, hsa
gacuccagugccuuuugaaugggcagaggugagagagagagagagaaagagagagaauga

SEQ ID NO: 516124 - RNA, 60 nt, hsa
uauggacacggaguggggcgggcaucuggagagagagagggagcggaggcuaaggacugg

SEQ ID NO: 516125 - RNA, 60 nt, hsa
gcuauggacacggaguggggcgggcaucuggagagagagagggagcggaggcuaaggacu

SEQ ID NO: 516126 - RNA, 60 nt, hsa
gaauuucagugggucucuguguguguaugagagagagaguguguguuuguguguuucaag

SEQ ID NO: 516127 - RNA, 60 nt, hsa
aggaauuucagugggucucuguguguguaugagagagagaguguguguuuguguguuuca

SEQ ID NO: 516128 - RNA, 60 nt, hsa
acaaaguguugauccccuucuuucccaugagagagagaacuggugauacuccaacaccgu

SEQ ID NO: 516129 - RNA, 60 nt, hsa
cuacaaaguguugauccccuucuuucccaugagagagagaacuggugauacuccaacacc

SEQ ID NO: 516130 - RNA, 60 nt, hsa
agcaucuguaacagcauuaacugucuuaaagagagagagagagaauuccgaauuggggaa

SEQ ID NO: 516131 - RNA, 60 nt, hsa
caucuguaacagcauuaacugucuuaaagagagagagagagaauuccgaauuggggaaca

SEQ ID NO: 516132 - RNA, 60 nt, hsa
ucuguaacagcauuaacugucuuaaagagagagagagagaauuccgaauuggggaacaca

SEQ ID NO: 516133 - RNA, 60 nt, hsa
uguaacagcauuaacugucuuaaagagagagagagagaauuccgaauuggggaacacacg

SEQ ID NO: 516134 - RNA, 60 nt, hsa
gaacgggcccacccacacguuguauauucagagagagagagggagucaaggugugaccgu

SEQ ID NO: 516135 - RNA, 60 nt, hsa
acgggcccacccacacguuguauauucagagagagagagggagucaaggugugaccgucg

SEQ ID NO: 516136 - RNA, 60 nt, hsa
cugaaagaaagagagaaagaaagaaagaaagagagagaaagaaagaaagaaagaaaggga

SEQ ID NO: 516137 - RNA, 60 nt, hsa
uggaaggaaggaaggaaaaagaaagagaaagagagagagagagaaagaaaaagaaagaaa

SEQ ID NO: 516138 - RNA, 60 nt, hsa
gaaggaaggaaggaaaaagaaagagaaagagagagagagagaaagaaaaagaaagaaaag

SEQ ID NO: 516139 - RNA, 60 nt, hsa
aggaaggaaggaaaaagaaagagaaagagagagagagagaaagaaaaagaaagaaaagua

SEQ ID NO: 516140 - RNA, 60 nt, hsa
gaaggaaggaaaaagaaagagaaagagagagagagagaaagaaaaagaaagaaaaguaag

SEQ ID NO: 516141 - RNA, 60 nt, hsa
cucgagcucaagaauucaagaccugggcaagagagagagacuuugucucuauuaaaaaua

SEQ ID NO: 516142 - RNA, 60 nt, hsa
cgagcucaagaauucaagaccugggcaagagagagagacuuugucucuauuaaaaauaaa

SEQ ID NO: 516143 - RNA, 60 nt, hsa
uagacacacaaaacaaacaaacacaugggggagagagacuuggaagaggaggaggaggag

SEQ ID NO: 516144 - RNA, 60 nt, hsa
uuggaagaggaggaggaggaggagaaggaggagagagaggggaagagacaaagugggugu

SEQ ID NO: 516145 - RNA, 60 nt, hsa
caccauuucccuccucuagaccucaucuuggagagagagauguuggauggggccaucuau

SEQ ID NO: 516146 - RNA, 60 nt, hsa
ccauuucccuccucuagaccucaucuuggagagagagauguuggauggggccaucuauuc

SEQ ID NO: 516147 - RNA, 60 nt, hsa
guggaaccccgaagccuggcgggagagagagagagagaagucuccucugcauuuuggguu

SEQ ID NO: 516148 - RNA, 60 nt, hsa
ccguggaaccccgaagccuggcgggagagagagagagagaagucuccucugcauuuuggg

SEQ ID NO: 516149 - RNA, 60 nt, hsa
ccccguggaaccccgaagccuggcgggagagagagagagagaagucuccucugcauuuug

SEQ ID NO: 516150 - RNA, 60 nt, hsa
ggccccguggaaccccgaagccuggcgggagagagagagagagaagucuccucugcauuu

SEQ ID NO: 516151 - RNA, 60 nt, hsa
ugggccccguggaaccccgaagccuggcgggagagagagagagagaagucuccucugcau

SEQ ID NO: 516152 - RNA, 60 nt, hsa
ugcgcacgcccuuuugugcagugagagagagagagagauugcacacaugugucucuguag

SEQ ID NO: 516153 - RNA, 60 nt, hsa
ugugcgcacgcccuuuugugcagugagagagagagagagauugcacacaugugucucugu

SEQ ID NO: 516154 - RNA, 60 nt, hsa
ugugugcgcacgcccuuuugugcagugagagagagagagagauugcacacaugugucucu

SEQ ID NO: 516155 - RNA, 60 nt, hsa
ugugugugcgcacgcccuuuugugcagugagagagagagagagauugcacacaugugucu

SEQ ID NO: 516156 - RNA, 60 nt, hsa
ugugugugugcgcacgcccuuuugugcagugagagagagagagagauugcacacaugugu

SEQ ID NO: 516157 - RNA, 60 nt, hsa
aaaaaaaaaagcgagcgagagagagagcgagagagagagcgagagcagaagaaauuccua

SEQ ID NO: 516158 - RNA, 60 nt, hsa
aaaaaaaaaaaagcgagcgagagagagagcgagagagagagcgagagcagaagaaauucc

SEQ ID NO: 516159 - RNA, 60 nt, hsa
aagacaaaaaaaaaaaaaaaaagcgagcgagagagagagcgagagagagagcgagagcag

SEQ ID NO: 516160 - RNA, 60 nt, hsa
aaaagacaaaaaaaaaaaaaaaaagcgagcgagagagagagcgagagagagagcgagagc

SEQ ID NO: 516161 - RNA, 60 nt, hsa
cagggucuggugauggcagggauggggggagagagagaaaauccacaaauuccaauguca

SEQ ID NO: 516162 - RNA, 60 nt, hsa
cccagggucuggugauggcagggauggggggagagagagaaaauccacaaauuccaaugu

SEQ ID NO: 516163 - RNA, 60 nt, hsa
aaacagaaacccgagaaagagagagacagagagagagaaaaaaaaucacccaccaccccc

SEQ ID NO: 516164 - RNA, 60 nt, hsa
gaaaacagaaacccgagaaagagagagacagagagagagaaaaaaaaucacccaccaccc

SEQ ID NO: 516165 - RNA, 60 nt, hsa
accaaaaagagaaaacagaaacccgagaaagagagagacagagagagagaaaaaaaauca

SEQ ID NO: 516166 - RNA, 60 nt, hsa
cagagagagagagagagaaagagagagagagagagagaaggggcccaagagagacagcac

SEQ ID NO: 516167 - RNA, 60 nt, hsa
agcagagagagagagagagaaagagagagagagagagagaaggggcccaagagagacagc

SEQ ID NO: 516168 - RNA, 60 nt, hsa
gcagcagagagagagagagagaaagagagagagagagagagaaggggcccaagagagaca

SEQ ID NO: 516169 - RNA, 60 nt, hsa
gggcagcagagagagagagagagaaagagagagagagagagagaaggggcccaagagaga

SEQ ID NO: 516170 - RNA, 60 nt, hsa
ccgggcagcagagagagagagagagaaagagagagagagagagagaaggggcccaagaga

SEQ ID NO: 516171 - RNA, 60 nt, hsa
ccccgggcagcagagagagagagagagaaagagagagagagagagagaaggggcccaaga

SEQ ID NO: 516172 - RNA, 60 nt, hsa
cccacccccuccccgggcagcagagagagagagagagaaagagagagagagagagagaag

SEQ ID NO: 516173 - RNA, 60 nt, hsa
cucccacccccuccccgggcagcagagagagagagagagaaagagagagagagagagaga

SEQ ID NO: 516174 - RNA, 60 nt, hsa
cccucccacccccuccccgggcagcagagagagagagagagaaagagagagagagagaga

SEQ ID NO: 516175 - RNA, 60 nt, hsa
ugcccucccacccccuccccgggcagcagagagagagagagagaaagagagagagagaga

SEQ ID NO: 516176 - RNA, 60 nt, hsa
ccugcccucccacccccuccccgggcagcagagagagagagagagaaagagagagagaga

SEQ ID NO: 516177 - RNA, 60 nt, hsa
uccauuaaguacaugugccaggaaacaagagagagagaaaguaaaggcaguaaugccuuc

SEQ ID NO: 516178 - RNA, 60 nt, hsa
uuuccauuaaguacaugugccaggaaacaagagagagagaaaguaaaggcaguaaugccu

SEQ ID NO: 516179 - RNA, 60 nt, hsa
uauauauuauauagagagagggaggagagcgagagagagugaggacaccgaacugggcug

SEQ ID NO: 516180 - RNA, 60 nt, hsa
agauacagagagucaaauagagagaauggagagagagaaacauauauuauauauuauaua

SEQ ID NO: 516181 - RNA, 60 nt, hsa
aaagauacagagagucaaauagagagaauggagagagagaaacauauauuauauauuaua

SEQ ID NO: 516182 - RNA, 60 nt, hsa
cugugacucaaggccacggcucuacuaaaagagagagaggaagcgagagagagagagaaa

SEQ ID NO: 516183 - RNA, 60 nt, hsa
cacggcucuacuaaaagagagagaggaagcgagagagagagagaaaaaacaaaaaacaga

SEQ ID NO: 516184 - RNA, 60 nt, hsa
cggcucuacuaaaagagagagaggaagcgagagagagagagaaaaaacaaaaaacagaaa

SEQ ID NO: 516185 - RNA, 60 nt, hsa
gcucuacuaaaagagagagaggaagcgagagagagagagaaaaaacaaaaaacagaaaac

SEQ ID NO: 516186 - RNA, 60 nt, hsa
ucuacuaaaagagagagaggaagcgagagagagagagaaaaaacaaaaaacagaaaacac

SEQ ID NO: 516187 - RNA, 60 nt, hsa
cgcuuuaguuuucaaccuuguuggugcugagagagagaaccgagaggucccaguacaagg

SEQ ID NO: 516188 - RNA, 60 nt, hsa
cucgcuuuaguuuucaaccuuguuggugcugagagagagaaccgagaggucccaguacaa

SEQ ID NO: 516189 - RNA, 60 nt, hsa
cgccgccuccuagacucgagcagagccggagagagagacgagagggugggaggucccgga

SEQ ID NO: 516190 - RNA, 60 nt, hsa
agcgccgccuccuagacucgagcagagccggagagagagacgagagggugggaggucccg

SEQ ID NO: 516191 - RNA, 60 nt, hsa
ccccuggugucugcacagccuuuauaaagagagagagagcuccgaagcaauaacaacacc

SEQ ID NO: 516192 - RNA, 60 nt, hsa
uuccccuggugucugcacagccuuuauaaagagagagagagcuccgaagcaauaacaaca

SEQ ID NO: 516193 - RNA, 60 nt, hsa
uagcacuguucacuacauuaacaugcaagagagagagaagccuuguuacauuuccugcua

SEQ ID NO: 516194 - RNA, 60 nt, hsa
auuagcacuguucacuacauuaacaugcaagagagagagaagccuuguuacauuuccugc

SEQ ID NO: 516195 - RNA, 60 nt, hsa
auucccagacugaggcagggcagguuugcagagagagacccagagugcacgugacccgca

SEQ ID NO: 516196 - RNA, 60 nt, hsa
uccuuaccacccaccaggccagauuuacaggagagagaaauccacuccacucuuccuuaa

SEQ ID NO: 516197 - RNA, 60 nt, hsa
uuauaggauuuuuuuuucuucuuuuuuagagagagagauuagaaaacgacauuaggaauu

SEQ ID NO: 516198 - RNA, 60 nt, hsa
aauuauaggauuuuuuuuucuucuuuuuuagagagagagauuagaaaacgacauuaggaa

SEQ ID NO: 516199 - RNA, 60 nt, hsa
aagacagugguucugauggguucagcccuagagagagagagagaagcggggagaauaaga

SEQ ID NO: 516200 - RNA, 60 nt, hsa
gacagugguucugauggguucagcccuagagagagagagagaagcggggagaauaagagu

SEQ ID NO: 516201 - RNA, 60 nt, hsa
cagugguucugauggguucagcccuagagagagagagagaagcggggagaauaagagugc

SEQ ID NO: 516202 - RNA, 60 nt, hsa
gugguucugauggguucagcccuagagagagagagagaagcggggagaauaagagugcac

SEQ ID NO: 516203 - RNA, 60 nt, hsa
agccagaaaguaacacagagcucaugcuuggagagagagagucuuggccauggcuuuccu

SEQ ID NO: 516204 - RNA, 60 nt, hsa
ccagaaaguaacacagagcucaugcuuggagagagagagucuuggccauggcuuuccugc

SEQ ID NO: 516205 - RNA, 60 nt, hsa
ucuccggaucugucgauuuggagaccuuccgagagagaaccaagggugcagucagcuuaa

SEQ ID NO: 516206 - RNA, 60 nt, hsa
auauuuagaaguaaaacacaaaacaaaaaagagagagaaaagaaaagaaaucacaaugua

SEQ ID NO: 516207 - RNA, 60 nt, hsa
ucugggccuccagcgcuggguuugucgagugagagagagagaggagcuuggguugcuucc

SEQ ID NO: 516208 - RNA, 60 nt, hsa
ugggccuccagcgcuggguuugucgagugagagagagagaggagcuuggguugcuucccu

SEQ ID NO: 516209 - RNA, 60 nt, hsa
ggccuccagcgcuggguuugucgagugagagagagagaggagcuuggguugcuucccugu

SEQ ID NO: 516210 - RNA, 60 nt, hsa
agaagagggaaggaaagagagaaggaaagagagagagaaagaaagucuccagaccaggaa

SEQ ID NO: 516211 - RNA, 60 nt, hsa
auagaagagggaaggaaagagagaaggaaagagagagagaaagaaagucuccagaccagg

SEQ ID NO: 516212 - RNA, 60 nt, hsa
ucaaaauguuacaaccgcuguaaaaugacggagagagagagaaagaaucccagacauuaa

SEQ ID NO: 516213 - RNA, 60 nt, hsa
aaaauguuacaaccgcuguaaaaugacggagagagagagaaagaaucccagacauuaacg

SEQ ID NO: 516214 - RNA, 60 nt, hsa
aauguuacaaccgcuguaaaaugacggagagagagagaaagaaucccagacauuaacggu

SEQ ID NO: 516215 - RNA, 64 nt, hsa; identical to SEQ ID NO: 107849

SEQ ID NO: 516216 - RNA, 64 nt, hsa; identical to SEQ ID NO: 107850

SEQ ID NO: 516217 - RNA, 64 nt, hsa; identical to SEQ ID NO: 107851

SEQ ID NO: 516218 - RNA, 64 nt, hsa; identical to SEQ ID NO: 107852

SEQ ID NO: 516219 - RNA, 64 nt, hsa; identical to SEQ ID NO: 107853

SEQ ID NO: 516220 - RNA, 64 nt, hsa; identical to SEQ ID NO: 107854

SEQ ID NO: 516221 - RNA, 64 nt, hsa; identical to SEQ ID NO: 107855

SEQ ID NO: 516222 - RNA, 64 nt, hsa; identical to SEQ ID NO: 107856

SEQ ID NO: 516223 - RNA, 64 nt, hsa; identical to SEQ ID NO: 107857

SEQ ID NO: 516224 - RNA, 64 nt, hsa; identical to SEQ ID NO: 107858

SEQ ID NO: 516225 - RNA, 64 nt, hsa; identical to SEQ ID NO: 107859

SEQ ID NO: 516226 - RNA, 64 nt, hsa; identical to SEQ ID NO: 107860

SEQ ID NO: 516227 - RNA, 64 nt, hsa; identical to SEQ ID NO: 107861

SEQ ID NO: 516228 - RNA, 64 nt, hsa; identical to SEQ ID NO: 107862

SEQ ID NO: 516229 - RNA, 64 nt, hsa; identical to SEQ ID NO: 107863

SEQ ID NO: 516230 - RNA, 63 nt, hsa; identical to SEQ ID NO: 107864

SEQ ID NO: 516231 - RNA, 64 nt, hsa; identical to SEQ ID NO: 107865

SEQ ID NO: 516232 - RNA, 64 nt, hsa; identical to SEQ ID NO: 107866

SEQ ID NO: 516233 - RNA, 64 nt, hsa; identical to SEQ ID NO: 107867

SEQ ID NO: 516234 - RNA, 64 nt, hsa; identical to SEQ ID NO: 107868

SEQ ID NO: 516235 - RNA, 64 nt, hsa; identical to SEQ ID NO: 107869

SEQ ID NO: 516236 - RNA, 64 nt, hsa; identical to SEQ ID NO: 107870

SEQ ID NO: 516237 - RNA, 64 nt, hsa; identical to SEQ ID NO: 107871

SEQ ID NO: 516238 - RNA, 64 nt, hsa; identical to SEQ ID NO: 107872

SEQ ID NO: 516239 - RNA, 64 nt, hsa; identical to SEQ ID NO: 107873

SEQ ID NO: 516240 - RNA, 64 nt, hsa; identical to SEQ ID NO: 107874

SEQ ID NO: 516241 - RNA, 64 nt, hsa; identical to SEQ ID NO: 107875

SEQ ID NO: 516242 - RNA, 64 nt, hsa; identical to SEQ ID NO: 107876

SEQ ID NO: 516243 - RNA, 64 nt, hsa; identical to SEQ ID NO: 107877

SEQ ID NO: 516244 - RNA, 64 nt, hsa; identical to SEQ ID NO: 107878

SEQ ID NO: 516245 - RNA, 64 nt, hsa; identical to SEQ ID NO: 107879

SEQ ID NO: 516246 - RNA, 64 nt, hsa; identical to SEQ ID NO: 107880

SEQ ID NO: 516247 - RNA, 64 nt, hsa; identical to SEQ ID NO: 107881

SEQ ID NO: 516248 - RNA, 64 nt, hsa; identical to SEQ ID NO: 107882

SEQ ID NO: 516249 - RNA, 64 nt, hsa; identical to SEQ ID NO: 107883

SEQ ID NO: 516250 - RNA, 64 nt, hsa; identical to SEQ ID NO: 107884

SEQ ID NO: 516251 - RNA, 64 nt, hsa; identical to SEQ ID NO: 107885

SEQ ID NO: 516252 - RNA, 64 nt, hsa; identical to SEQ ID NO: 107886

SEQ ID NO: 516253 - RNA, 64 nt, hsa; identical to SEQ ID NO: 107887

SEQ ID NO: 516254 - RNA, 64 nt, hsa; identical to SEQ ID NO: 107888

SEQ ID NO: 516255 - RNA, 64 nt, hsa; identical to SEQ ID NO: 107889

SEQ ID NO: 516256 - RNA, 64 nt, hsa; identical to SEQ ID NO: 107890

SEQ ID NO: 516257 - RNA, 64 nt, hsa; identical to SEQ ID NO: 107891

SEQ ID NO: 516258 - RNA, 64 nt, hsa; identical to SEQ ID NO: 107892

SEQ ID NO: 516259 - RNA, 64 nt, hsa; identical to SEQ ID NO: 107893

SEQ ID NO: 516260 - RNA, 64 nt, hsa; identical to SEQ ID NO: 107894

SEQ ID NO: 516261 - RNA, 64 nt, hsa; identical to SEQ ID NO: 107895

SEQ ID NO: 516262 - RNA, 64 nt, hsa; identical to SEQ ID NO: 107896

SEQ ID NO: 516263 - RNA, 64 nt, hsa; identical to SEQ ID NO: 107897

SEQ ID NO: 516264 - RNA, 64 nt, hsa; identical to SEQ ID NO: 107898

SEQ ID NO: 516265 - RNA, 64 nt, hsa; identical to SEQ ID NO: 107899

SEQ ID NO: 516266 - RNA, 64 nt, hsa; identical to SEQ ID NO: 107900

SEQ ID NO: 516267 - RNA, 64 nt, hsa; identical to SEQ ID NO: 107901

SEQ ID NO: 516268 - RNA, 64 nt, hsa; identical to SEQ ID NO: 107902

SEQ ID NO: 516269 - RNA, 64 nt, hsa; identical to SEQ ID NO: 107903

SEQ ID NO: 516270 - RNA, 64 nt, hsa; identical to SEQ ID NO: 107904

SEQ ID NO: 516271 - RNA, 64 nt, hsa; identical to SEQ ID NO: 107905

SEQ ID NO: 516272 - RNA, 64 nt, hsa; identical to SEQ ID NO: 107906

SEQ ID NO: 516273 - RNA, 64 nt, hsa; identical to SEQ ID NO: 107907

SEQ ID NO: 516274 - RNA, 64 nt, hsa; identical to SEQ ID NO: 107908

SEQ ID NO: 516275 - RNA, 64 nt, hsa; identical to SEQ ID NO: 107909

SEQ ID NO: 516276 - RNA, 64 nt, hsa; identical to SEQ ID NO: 107910

SEQ ID NO: 516277 - RNA, 64 nt, hsa; identical to SEQ ID NO: 107911

SEQ ID NO: 516278 - RNA, 64 nt, hsa; identical to SEQ ID NO: 107912

SEQ ID NO: 516279 - RNA, 64 nt, hsa; identical to SEQ ID NO: 107913

SEQ ID NO: 516280 - RNA, 64 nt, hsa; identical to SEQ ID NO: 107914

SEQ ID NO: 516281 - RNA, 64 nt, hsa; identical to SEQ ID NO: 107915

SEQ ID NO: 516282 - RNA, 64 nt, hsa; identical to SEQ ID NO: 107916

SEQ ID NO: 516283 - RNA, 64 nt, hsa; identical to SEQ ID NO: 107917

SEQ ID NO: 516284 - RNA, 64 nt, hsa; identical to SEQ ID NO: 107918

SEQ ID NO: 516285 - RNA, 64 nt, hsa; identical to SEQ ID NO: 107919

SEQ ID NO: 516286 - RNA, 64 nt, hsa; identical to SEQ ID NO: 107920

SEQ ID NO: 516287 - RNA, 64 nt, hsa; identical to SEQ ID NO: 107921

SEQ ID NO: 516288 - RNA, 64 nt, hsa; identical to SEQ ID NO: 107922

SEQ ID NO: 516289 - RNA, 64 nt, hsa; identical to SEQ ID NO: 107923

SEQ ID NO: 516290 - RNA, 64 nt, hsa; identical to SEQ ID NO: 107924

SEQ ID NO: 516291 - RNA, 64 nt, hsa; identical to SEQ ID NO: 107925

SEQ ID NO: 516292 - RNA, 64 nt, hsa; identical to SEQ ID NO: 107926

SEQ ID NO: 516293 - RNA, 64 nt, hsa; identical to SEQ ID NO: 107927

SEQ ID NO: 516294 - RNA, 64 nt, hsa; identical to SEQ ID NO: 107928

SEQ ID NO: 516295 - RNA, 64 nt, hsa; identical to SEQ ID NO: 107929

SEQ ID NO: 516296 - RNA, 64 nt, hsa; identical to SEQ ID NO: 107930

SEQ ID NO: 516297 - RNA, 64 nt, hsa; identical to SEQ ID NO: 107931

SEQ ID NO: 516298 - RNA, 64 nt, hsa; identical to SEQ ID NO: 107932

SEQ ID NO: 516299 - RNA, 64 nt, hsa; identical to SEQ ID NO: 107933

SEQ ID NO: 516300 - RNA, 64 nt, hsa
uaguaaguacaacauuuuuaacucucauuuggcagacuacuacuaaucacagaccacaagggua

SEQ ID NO: 516301 - RNA, 64 nt, hsa
aagaguggaaacuauucuaucauaacuacccaaggacuacuaaaaggaaaaauuguguuaccuu

SEQ ID NO: 516302 - RNA, 64 nt, hsa
auuuuugucacagcauuuucauaccuucaugguggacuacuagucacugcuuccauaaauauug

SEQ ID NO: 516303 - RNA, 64 nt, hsa
aaauugguuaacuuuacaaaugucagcuaguuuugacuacuaauugggggaaauuuuagauaau

SEQ ID NO: 516304 - RNA, 64 nt, hsa; identical to SEQ ID NO: 385550

SEQ ID NO: 516305 - RNA, 64 nt, hsa; identical to SEQ ID NO: 385551

SEQ ID NO: 516306 - RNA, 64 nt, hsa; identical to SEQ ID NO: 385552

SEQ ID NO: 516307 - RNA, 64 nt, hsa; identical to SEQ ID NO: 385553

SEQ ID NO: 516308 - RNA, 64 nt, hsa; identical to SEQ ID NO: 385554

SEQ ID NO: 516309 - RNA, 64 nt, hsa; identical to SEQ ID NO: 385555

SEQ ID NO: 516310 - RNA, 64 nt, hsa; identical to SEQ ID NO: 385556

SEQ ID NO: 516311 - RNA, 64 nt, hsa; identical to SEQ ID NO: 385557

SEQ ID NO: 516312 - RNA, 64 nt, hsa; identical to SEQ ID NO: 385558

SEQ ID NO: 516313 - RNA, 64 nt, hsa; identical to SEQ ID NO: 385559

SEQ ID NO: 516314 - RNA, 64 nt, hsa; identical to SEQ ID NO: 385560

SEQ ID NO: 516315 - RNA, 64 nt, hsa; identical to SEQ ID NO: 385561

SEQ ID NO: 516316 - RNA, 64 nt, hsa; identical to SEQ ID NO: 385562

SEQ ID NO: 516317 - RNA, 64 nt, hsa; identical to SEQ ID NO: 385563

SEQ ID NO: 516318 - RNA, 64 nt, hsa; identical to SEQ ID NO: 385564

SEQ ID NO: 516319 - RNA, 64 nt, hsa; identical to SEQ ID NO: 385565

SEQ ID NO: 516320 - RNA, 64 nt, hsa; identical to SEQ ID NO: 385566

SEQ ID NO: 516321 - RNA, 64 nt, hsa; identical to SEQ ID NO: 385567

SEQ ID NO: 516322 - RNA, 64 nt, hsa; identical to SEQ ID NO: 385568

SEQ ID NO: 516323 - RNA, 64 nt, hsa; identical to SEQ ID NO: 385569

SEQ ID NO: 516324 - RNA, 64 nt, hsa; identical to SEQ ID NO: 385570

SEQ ID NO: 516325 - RNA, 64 nt, hsa; identical to SEQ ID NO: 385571

SEQ ID NO: 516326 - RNA, 64 nt, hsa; identical to SEQ ID NO: 385572

SEQ ID NO: 516327 - RNA, 64 nt, hsa; identical to SEQ ID NO: 385573

SEQ ID NO: 516328 - RNA, 64 nt, hsa; identical to SEQ ID NO: 385574

SEQ ID NO: 516329 - RNA, 64 nt, hsa; identical to SEQ ID NO: 385575

SEQ ID NO: 516330 - RNA, 64 nt, hsa; identical to SEQ ID NO: 385576

SEQ ID NO: 516331 - RNA, 64 nt, hsa; identical to SEQ ID NO: 385577

SEQ ID NO: 516332 - RNA, 64 nt, hsa; identical to SEQ ID NO: 385578

SEQ ID NO: 516333 - RNA, 64 nt, hsa; identical to SEQ ID NO: 385579

SEQ ID NO: 516334 - RNA, 64 nt, hsa; identical to SEQ ID NO: 385580

SEQ ID NO: 516335 - RNA, 64 nt, hsa; identical to SEQ ID NO: 385581

SEQ ID NO: 516336 - RNA, 64 nt, hsa; identical to SEQ ID NO: 385582

SEQ ID NO: 516337 - RNA, 64 nt, hsa; identical to SEQ ID NO: 385583

SEQ ID NO: 516338 - RNA, 64 nt, hsa; identical to SEQ ID NO: 385584

SEQ ID NO: 516339 - RNA, 64 nt, hsa; identical to SEQ ID NO: 385585

SEQ ID NO: 516340 - RNA, 64 nt, hsa; identical to SEQ ID NO: 385586

SEQ ID NO: 516341 - RNA, 64 nt, hsa; identical to SEQ ID NO: 385587

SEQ ID NO: 516342 - RNA, 64 nt, hsa; identical to SEQ ID NO: 385588

SEQ ID NO: 516343 - RNA, 64 nt, hsa; identical to SEQ ID NO: 443174

SEQ ID NO: 516344 - RNA, 64 nt, hsa; identical to SEQ ID NO: 443175

SEQ ID NO: 516345 - RNA, 64 nt, hsa; identical to SEQ ID NO: 443176

SEQ ID NO: 516346 - RNA, 64 nt, hsa; identical to SEQ ID NO: 443177

SEQ ID NO: 516347 - RNA, 64 nt, hsa; identical to SEQ ID NO: 443178

SEQ ID NO: 516348 - RNA, 64 nt, hsa; identical to SEQ ID NO: 443179

SEQ ID NO: 516349 - RNA, 64 nt, hsa; identical to SEQ ID NO: 443180

SEQ ID NO: 516350 - RNA, 64 nt, hsa; identical to SEQ ID NO: 443181

SEQ ID NO: 516351 - RNA, 64 nt, hsa; identical to SEQ ID NO: 443182

SEQ ID NO: 516352 - RNA, 64 nt, hsa; identical to SEQ ID NO: 443183

SEQ ID NO: 516353 - RNA, 64 nt, hsa; identical to SEQ ID NO: 443184

SEQ ID NO: 516354 - RNA, 64 nt, hsa; identical to SEQ ID NO: 443185

SEQ ID NO: 516355 - RNA, 64 nt, hsa; identical to SEQ ID NO: 443186

SEQ ID NO: 516356 - RNA, 64 nt, hsa; identical to SEQ ID NO: 443187

SEQ ID NO: 516357 - RNA, 64 nt, hsa; identical to SEQ ID NO: 443188

SEQ ID NO: 516358 - RNA, 64 nt, hsa; identical to SEQ ID NO: 443189

SEQ ID NO: 516359 - RNA, 64 nt, hsa; identical to SEQ ID NO: 443190

SEQ ID NO: 516360 - RNA, 64 nt, hsa; identical to SEQ ID NO: 443191

SEQ ID NO: 516361 - RNA, 64 nt, hsa; identical to SEQ ID NO: 443192

SEQ ID NO: 516362 - RNA, 64 nt, hsa; identical to SEQ ID NO: 443193

SEQ ID NO: 516363 - RNA, 64 nt, hsa; identical to SEQ ID NO: 443194

SEQ ID NO: 516364 - RNA, 64 nt, hsa; identical to SEQ ID NO: 443195

SEQ ID NO: 516365 - RNA, 64 nt, hsa; identical to SEQ ID NO: 443196

SEQ ID NO: 516366 - RNA, 64 nt, hsa; identical to SEQ ID NO: 443197

SEQ ID NO: 516367 - RNA, 64 nt, hsa; identical to SEQ ID NO: 443198

SEQ ID NO: 516368 - RNA, 64 nt, hsa; identical to SEQ ID NO: 443199

SEQ ID NO: 516369 - RNA, 64 nt, hsa; identical to SEQ ID NO: 443200

SEQ ID NO: 516370 - RNA, 64 nt, hsa; identical to SEQ ID NO: 443201

SEQ ID NO: 516371 - RNA, 64 nt, hsa; identical to SEQ ID NO: 443202

SEQ ID NO: 516372 - RNA, 64 nt, hsa; identical to SEQ ID NO: 443203

SEQ ID NO: 516373 - RNA, 64 nt, hsa; identical to SEQ ID NO: 443204

SEQ ID NO: 516374 - RNA, 64 nt, hsa; identical to SEQ ID NO: 443205

SEQ ID NO: 516375 - RNA, 64 nt, hsa; identical to SEQ ID NO: 443206

SEQ ID NO: 516376 - RNA, 64 nt, hsa; identical to SEQ ID NO: 443207

SEQ ID NO: 516377 - RNA, 64 nt, hsa; identical to SEQ ID NO: 443208

SEQ ID NO: 516378 - RNA, 64 nt, hsa; identical to SEQ ID NO: 443209

SEQ ID NO: 516379 - RNA, 64 nt, hsa; identical to SEQ ID NO: 443210

SEQ ID NO: 516380 - RNA, 64 nt, hsa; identical to SEQ ID NO: 443211

SEQ ID NO: 516381 - RNA, 64 nt, hsa; identical to SEQ ID NO: 443212

SEQ ID NO: 516382 - RNA, 64 nt, hsa; identical to SEQ ID NO: 443213

SEQ ID NO: 516383 - RNA, 64 nt, hsa; identical to SEQ ID NO: 443214

SEQ ID NO: 516384 - RNA, 64 nt, hsa; identical to SEQ ID NO: 443215

SEQ ID NO: 516385 - RNA, 64 nt, hsa; identical to SEQ ID NO: 443216

SEQ ID NO: 516386 - RNA, 64 nt, hsa; identical to SEQ ID NO: 443217

SEQ ID NO: 516387 - RNA, 64 nt, hsa; identical to SEQ ID NO: 443218

SEQ ID NO: 516388 - RNA, 64 nt, hsa; identical to SEQ ID NO: 443219

SEQ ID NO: 516389 - RNA, 64 nt, hsa; identical to SEQ ID NO: 443220

SEQ ID NO: 516390 - RNA, 64 nt, hsa; identical to SEQ ID NO: 443221

SEQ ID NO: 516391 - RNA, 64 nt, hsa; identical to SEQ ID NO: 443222

SEQ ID NO: 516392 - RNA, 64 nt, hsa; identical to SEQ ID NO: 443223

SEQ ID NO: 516393 - RNA, 64 nt, hsa; identical to SEQ ID NO: 443224

SEQ ID NO: 516394 - RNA, 64 nt, hsa; identical to SEQ ID NO: 443225

SEQ ID NO: 516395 - RNA, 64 nt, hsa; identical to SEQ ID NO: 443226

SEQ ID NO: 516396 - RNA, 64 nt, hsa; identical to SEQ ID NO: 443227

SEQ ID NO: 516397 - RNA, 64 nt, hsa; identical to SEQ ID NO: 443228

SEQ ID NO: 516398 - RNA, 64 nt, hsa; identical to SEQ ID NO: 443229

SEQ ID NO: 516399 - RNA, 64 nt, hsa; identical to SEQ ID NO: 443230

SEQ ID NO: 516400 - RNA, 64 nt, hsa; identical to SEQ ID NO: 443231

SEQ ID NO: 516401 - RNA, 64 nt, hsa; identical to SEQ ID NO: 443232

SEQ ID NO: 516402 - RNA, 64 nt, hsa; identical to SEQ ID NO: 443233

SEQ ID NO: 516403 - RNA, 64 nt, hsa; identical to SEQ ID NO: 443234

SEQ ID NO: 516404 - RNA, 64 nt, hsa; identical to SEQ ID NO: 443235

SEQ ID NO: 516405 - RNA, 64 nt, hsa; identical to SEQ ID NO: 443236

SEQ ID NO: 516406 - RNA, 64 nt, hsa; identical to SEQ ID NO: 443237

SEQ ID NO: 516407 - RNA, 64 nt, hsa; identical to SEQ ID NO: 443238

SEQ ID NO: 516408 - RNA, 64 nt, hsa; identical to SEQ ID NO: 443239

SEQ ID NO: 516409 - RNA, 64 nt, hsa; identical to SEQ ID NO: 37560

SEQ ID NO: 516410 - RNA, 64 nt, hsa; identical to SEQ ID NO: 37561

SEQ ID NO: 516411 - RNA, 64 nt, hsa; identical to SEQ ID NO: 37562

SEQ ID NO: 516412 - RNA, 64 nt, hsa; identical to SEQ ID NO: 37563

SEQ ID NO: 516413 - RNA, 64 nt, hsa; identical to SEQ ID NO: 37564

SEQ ID NO: 516414 - RNA, 64 nt, hsa; identical to SEQ ID NO: 37565

SEQ ID NO: 516415 - RNA, 64 nt, hsa; identical to SEQ ID NO: 37566

SEQ ID NO: 516416 - RNA, 64 nt, hsa; identical to SEQ ID NO: 37567

SEQ ID NO: 516417 - RNA, 64 nt, hsa; identical to SEQ ID NO: 37568

SEQ ID NO: 516418 - RNA, 64 nt, hsa; identical to SEQ ID NO: 37569

SEQ ID NO: 516419 - RNA, 64 nt, hsa; identical to SEQ ID NO: 37570

SEQ ID NO: 516420 - RNA, 64 nt, hsa; identical to SEQ ID NO: 37571

SEQ ID NO: 516421 - RNA, 64 nt, hsa; identical to SEQ ID NO: 37572

SEQ ID NO: 516422 - RNA, 64 nt, hsa; identical to SEQ ID NO: 37573

SEQ ID NO: 516423 - RNA, 64 nt, hsa; identical to SEQ ID NO: 37574

SEQ ID NO: 516424 - RNA, 64 nt, hsa; identical to SEQ ID NO: 37575

SEQ ID NO: 516425 - RNA, 64 nt, hsa; identical to SEQ ID NO: 37576

SEQ ID NO: 516426 - RNA, 64 nt, hsa; identical to SEQ ID NO: 37577

SEQ ID NO: 516427 - RNA, 64 nt, hsa; identical to SEQ ID NO: 37578

SEQ ID NO: 516428 - RNA, 64 nt, hsa; identical to SEQ ID NO: 37579

SEQ ID NO: 516429 - RNA, 64 nt, hsa; identical to SEQ ID NO: 37580

SEQ ID NO: 516430 - RNA, 64 nt, hsa; identical to SEQ ID NO: 37581

SEQ ID NO: 516431 - RNA, 64 nt, hsa; identical to SEQ ID NO: 265005

SEQ ID NO: 516432 - RNA, 64 nt, hsa; identical to SEQ ID NO: 265006

SEQ ID NO: 516433 - RNA, 64 nt, hsa; identical to SEQ ID NO: 265007

SEQ ID NO: 516434 - RNA, 64 nt, hsa; identical to SEQ ID NO: 265008

SEQ ID NO: 516435 - RNA, 64 nt, hsa; identical to SEQ ID NO: 265009

SEQ ID NO: 516436 - RNA, 64 nt, hsa; identical to SEQ ID NO: 265010

SEQ ID NO: 516437 - RNA, 64 nt, hsa; identical to SEQ ID NO: 265011

SEQ ID NO: 516438 - RNA, 64 nt, hsa; identical to SEQ ID NO: 265012

SEQ ID NO: 516439 - RNA, 64 nt, hsa; identical to SEQ ID NO: 265013

SEQ ID NO: 516440 - RNA, 64 nt, hsa; identical to SEQ ID NO: 265014

SEQ ID NO: 516441 - RNA, 64 nt, hsa; identical to SEQ ID NO: 265015

SEQ ID NO: 516442 - RNA, 64 nt, hsa; identical to SEQ ID NO: 265016

SEQ ID NO: 516443 - RNA, 64 nt, hsa; identical to SEQ ID NO: 265017

SEQ ID NO: 516444 - RNA, 64 nt, hsa; identical to SEQ ID NO: 265018

SEQ ID NO: 516445 - RNA, 64 nt, hsa; identical to SEQ ID NO: 265019

SEQ ID NO: 516446 - RNA, 64 nt, hsa; identical to SEQ ID NO: 265020

SEQ ID NO: 516447 - RNA, 64 nt, hsa; identical to SEQ ID NO: 265021

SEQ ID NO: 516448 - RNA, 64 nt, hsa; identical to SEQ ID NO: 265022

SEQ ID NO: 516449 - RNA, 64 nt, hsa; identical to SEQ ID NO: 265023

SEQ ID NO: 516450 - RNA, 64 nt, hsa; identical to SEQ ID NO: 265024

SEQ ID NO: 516451 - RNA, 64 nt, hsa; identical to SEQ ID NO: 265025

SEQ ID NO: 516452 - RNA, 64 nt, hsa; identical to SEQ ID NO: 265026

SEQ ID NO: 516453 - RNA, 64 nt, hsa; identical to SEQ ID NO: 265027

SEQ ID NO: 516454 - RNA, 64 nt, hsa; identical to SEQ ID NO: 265028

SEQ ID NO: 516455 - RNA, 64 nt, hsa; identical to SEQ ID NO: 265029

SEQ ID NO: 516456 - RNA, 64 nt, hsa; identical to SEQ ID NO: 265030

SEQ ID NO: 516457 - RNA, 64 nt, hsa; identical to SEQ ID NO: 265031

SEQ ID NO: 516458 - RNA, 64 nt, hsa; identical to SEQ ID NO: 265032

SEQ ID NO: 516459 - RNA, 64 nt, hsa; identical to SEQ ID NO: 265033

SEQ ID NO: 516460 - RNA, 64 nt, hsa; identical to SEQ ID NO: 265034

SEQ ID NO: 516461 - RNA, 64 nt, hsa
gcucaccuucuuccugguaacggguaacgggggcagcgcccaggaucacccagagcugggccuu

SEQ ID NO: 516462 - RNA, 64 nt, hsa
cugggccuuaaaggaugcggacucauccucagccagcgcccauguugugauacagggguguuug

SEQ ID NO: 516463 - RNA, 64 nt, hsa
uugcauccuuguguuuugcugugguuuuuaaaggagcgcccacgaaguguaguggcugacgauu

SEQ ID NO: 516464 - RNA, 64 nt, hsa
ggaagcccagccgugggcuuaggagagagggaccagcgcccagcguuagggcuggaagacggca

SEQ ID NO: 516465 - RNA, 64 nt, hsa
uggcuuccaggccacccaucugucacccuuggacagcgcccacacccuucuagcaccuccugac

SEQ ID NO: 516466 - RNA, 64 nt, hsa
caguguguuggcgcuuugcuuuggucuaucuuugagcgcccacuagacccacuggacucaccuc

SEQ ID NO: 516467 - RNA, 64 nt, hsa
guggcccccagccucggccaggccugcucugcucagcgcccaccgcccaccaccccuccugcuu

SEQ ID NO: 516468 - RNA, 64 nt, hsa
agguggguaaccaaguucaccagcaauaaaacccagcgcccagguagccuccagcagugcggcu

SEQ ID NO: 516469 - RNA, 64 nt, hsa
cucugaaaguccucaugccuggcagucggaggagagcgcccagacucugaacucagcagaaagu

SEQ ID NO: 516470 - RNA, 64 nt, hsa
gaaugaaagauacuugaauuauugugcgccugugagcgcccagcuucuguuucauagucuuaac

SEQ ID NO: 516471 - RNA, 64 nt, hsa
cuggugccgucuugcaugaaacgcaugagccgugagcgcccaguucagacuggggccagggagg

SEQ ID NO: 516472 - RNA, 54 nt, hsa
ucccauuugagcagcugugagcugagcgcccacuagaggggcacccaccaguug

SEQ ID NO: 516473 - RNA, 64 nt, hsa
aggagaagacucggaauucccugagucccaccauagcgcccaagcucagcuuagaaguucgaaa

SEQ ID NO: 516474 - RNA, 64 nt, hsa
ugaccucacacccucugggcccgccucuggagccagcgcccagggucccucugugcuuuuucgc

SEQ ID NO: 516475 - RNA, 62 nt, hsa
ccaagauggacuugcugugaauggugccacacagcgcccacagacugggcccucgcacccuu

SEQ ID NO: 516476 - RNA, 64 nt, hsa
guucagauugccccuggggaucuucugugucuucagcgcccagcccugcguguuccuggugaag

SEQ ID NO: 516477 - RNA, 64 nt, hsa
ugaaggcaugagacaucuguacaggaagcaucccagcgcccacaugggcaugagacagucugca

SEQ ID NO: 516478 - RNA, 64 nt, hsa
uccugccugugagucggccuuacuccguuuccuuagcgcccaugacacgccaagucccguuucg

SEQ ID NO: 516479 - RNA, 64 nt, hsa
acccguugaauguuuugaaugcccugacucuaccagcgcccauaaaugaucucuagaaggacug

SEQ ID NO: 516480 - RNA, 64 nt, hsa
ccgcuaguggcagaugugaacugacaaggagugaagcgcccacccagcggauggacagcaccca

SEQ ID NO: 516481 - RNA, 64 nt, hsa
cagaccccaccccgucuaccccuccagucagcccagcgcccauccugcagcucagcugggagca

SEQ ID NO: 516482 - RNA, 64 nt, hsa
cccucgggggagaccgcaggcuccucuggccgccagcgcccacuuucgggacaccagugcgcaa

SEQ ID NO: 516483 - RNA, 64 nt, hsa
cugcugaaggggucccccauuguuuugcuuccccagcgcccaggaugagcgguuuaccaucgag

SEQ ID NO: 516484 - RNA, 64 nt, hsa
cugcugugcuccacacccugcaggcgccucgggaagcgcccaaaggauuccccuucacguuggu

SEQ ID NO: 516485 - RNA, 64 nt, hsa
caguguaacuuuuagaccugcgugacaucuacaaagcgcccaauaaagaaagaggaagccacgg

SEQ ID NO: 516486 - RNA, 64 nt, hsa
ugaagguacgccacccaccuccgucgcccaccucagcgcccaggagccuugggacuuccuucca

SEQ ID NO: 516487 - RNA, 64 nt, hsa
ucgugacagguggcggguguggcugucacugcacagcgcccacggcuacagcugcgccggaucu

SEQ ID NO: 516488 - RNA, 64 nt, hsa
cuagucaccgacagcggccuugaagacagagcaaagcgcccacccaggucccccgacugccugu

SEQ ID NO: 516489 - RNA, 64 nt, hsa
gacccaacgccaacaccuggugccuucugcagccagcgcccacccauccgugcccggacccuug

SEQ ID NO: 516490 - RNA, 64 nt, hsa
agcccgggccaccucgugggggacaagucucgccagcgcccacccccauggcucgggucagucc

SEQ ID NO: 516491 - RNA, 64 nt, hsa
ugugaguggaggcagaggagugaggcccacgggcagcgcccaggagcccaccuuccccucuggc

SEQ ID NO: 516492 - RNA, 64 nt, hsa
uuuuuacgcauagcuccgucaagcugccuggaugagcgcccaugcagcaaggcuuggaggaagc

SEQ ID NO: 516493 - RNA, 64 nt, hsa
ccccaaagcaagcagggggccaguggcggggcccagcgcccagcaggacacccaugcaagaggc

SEQ ID NO: 516494 - RNA, 64 nt, hsa
cgcaggggacaccgugccggcuucagacacucccagcgcccacucuuacaggcccaggacugga

SEQ ID NO: 516495 - RNA, 64 nt, hsa
gugggcuaaugcugaaggggcagccagucaccagagcgcccaccuggcacaccccccucacccc

SEQ ID NO: 516496 - RNA, 64 nt, hsa
uuugcuuuaagaaaaaaggaggcaagguagggagagcgcccacacuguccaugcuccaggcccc

SEQ ID NO: 516497 - RNA, 64 nt, hsa
ggccagugcgccugcuccugaccacugcaaucccagcgcccaaggaaggccacuucucaacugg

SEQ ID NO: 516498 - RNA, 64 nt, hsa
ccacccccacccgucccaggcccaggccgaagccagcgcccagcuuuccucacuguuccugugg

SEQ ID NO: 516499 - RNA, 64 nt, hsa
uaggcaggugggcucugcuucccgauucccugugagcgcccacccucucgaaagaauuuucugc

SEQ ID NO: 516500 - RNA, 64 nt, hsa
ugggggcugcaguucgacucugugcuggccagcgagcgcccagcuccugacacugcuggagagg

SEQ ID NO: 516501 - RNA, 64 nt, hsa
aaaguuccaaagaggugguuucugaggaagucagagcgcccagggccagagcagucaguaaugg

SEQ ID NO: 516502 - RNA, 64 nt, hsa
aaacacacuauggaacucugcugauggggacccaagcgcccacgugcucagccacccucuggcu

SEQ ID NO: 516503 - RNA, 64 nt, hsa
agggagugagcuccccagacccccucgccacuccagcgcccaguccuucuccugcccgagagau

SEQ ID NO: 516504 - RNA, 64 nt, hsa
agcaacgguguugucagugugcgaacuccagagaagcgcccacaucugaaggaccugcucgcga

SEQ ID NO: 516505 - RNA, 64 nt, hsa
cuggcugcugggagagcccaugggaaccuugcuuagcgcccaagguagaugagagacagggcag

SEQ ID NO: 516506 - RNA, 64 nt, hsa
gagcaccaugcuggaggucacccagcacuguggcagcgcccaggagggcauagggcagccuacc

SEQ ID NO: 516507 - RNA, 64 nt, hsa
augcggcugcuucaugagaugcagaacccccaggagcgcccaggcuugggcagcaaccccugca

SEQ ID NO: 516508 - RNA, 64 nt, hsa
gugaggggaugacgcgcugugggugggaggaggcagcgcccaucucagcagcaccaggacugcc

SEQ ID NO: 516509 - RNA, 64 nt, hsa
acggaccgcucuuggcuccugacucccaggguacagcgcccaguaacucauccuucauucagag

SEQ ID NO: 516510 - RNA, 64 nt, hsa
gcugacagacacaggcccggcuccaggcuccuuuagcgcccaguuggguggaugccugguggca

SEQ ID NO: 516511 - RNA, 64 nt, hsa
gcauaucuggucagaacugcagggccuauaugccagcgcccagggaggagucaguaccccuggu

SEQ ID NO: 516512 - RNA, 64 nt, hsa
gagccuccccaaggagcgccgcccccugcuccacagcgcccagucccaucgaccacccaagggc

SEQ ID NO: 516513 - RNA, 64 nt, hsa
uccucccuugccccaggccagguagcaagagagcagcgcccaggccugcuggcaucaggucugg

SEQ ID NO: 516514 - RNA, 64 nt, hsa
aguaucaguacaugccuagaccugggcuccggccagcgcccaacagcguggaugucgaugacuu

SEQ ID NO: 516515 - RNA, 64 nt, hsa
acucacacucguccccagcuuagcacagagcuggagcgcccauuucuggaauuuuccguuuggg

SEQ ID NO: 516516 - RNA, 64 nt, hsa
gcuucucagccggcugucccagccagccccgcagagcgcccacggacaguguccacucuggcaa

SEQ ID NO: 516517 - RNA, 64 nt, hsa
cucggguuauuucagccccggccugcagaguggaagcgcccagcggccuuuccucgcucaccag

SEQ ID NO: 516518 - RNA, 64 nt, hsa
cugcugccucccucuggaguggccacuuggccaaagcgcccauccacaucuggaaagucggagc

SEQ ID NO: 516519 - RNA, 64 nt, hsa
agugcagacuucggggucuccaccccaggccagcagcgcccacugggcuacagcaagccaacag

SEQ ID NO: 516520 - RNA, 64 nt, hsa
gcuccaggcucccaccaucuacagaggggcuuacagcgcccauucuggucuuggggaacccauc

SEQ ID NO: 516521 - RNA, 64 nt, hsa
agccgacgcccuugccccugccccuaccccugccagcgcccacccccagccagggccccucgcc

SEQ ID NO: 516522 - RNA, 64 nt, hsa
uacaggguccaacauagagccggguguccccaacagcgcccaaaggacgcacugagcaacgcua

SEQ ID NO: 516523 - RNA, 64 nt, hsa
cugcucugagcugggagcagccagaggcggugcaagcgcccagcuccccagagcuccccaaccu

SEQ ID NO: 516524 - RNA, 64 nt, hsa
gcccucccuggccucuccacugucuccacucuccagcgcccauucaagucucugcuuugaguca

SEQ ID NO: 516525 - RNA, 64 nt, hsa
gccagcuccugucuguaugggcgagaugacugagagcgcccacgucccuaaggcuguccugacc

SEQ ID NO: 516526 - RNA, 64 nt, hsa
cuuauaccaccucucaaccauuacucacacuuccagcgcccagguccaagucugagccugaccu

SEQ ID NO: 516527 - RNA, 64 nt, hsa
auuccccuaggagcgcuuggccagcugggaaggcagcgcccagcugcacuuguuguugauacag

SEQ ID NO: 516528 - RNA, 64 nt, hsa
ccuggccggugucacuguggcccggccaccccugagcgcccagcucccuaccuccuggacgucu

SEQ ID NO: 516529 - RNA, 64 nt, hsa
cauugacaguccugacgggagcucagggcugcccagcgcccagcgugcacgggacggccccacg

SEQ ID NO: 516530 - RNA, 64 nt, hsa
auaugucagcaccuggaaguggagugcaggcugcagcgcccagccaugugggccaggugcauuc

SEQ ID NO: 516531 - RNA, 64 nt, hsa
ccugauggcacacaaggagccuccuuccuguagcagcgcccaguuuucauguggauggauugua

SEQ ID NO: 516532 - RNA, 64 nt, hsa
gggugaugcagaggccacaggugcugcacgcuccagcgcccacucuagacaucagccuccaggu

SEQ ID NO: 516533 - RNA, 64 nt, hsa
cucaguuccuaccuccaagggggaggguccuggaagcgcccacccaggcgccgccccugugcuu

SEQ ID NO: 516534 - RNA, 64 nt, hsa
uccauucggcccccaggccggcgggcgcgcccgaagcgcccauccucgugguaggcaacaagcg

SEQ ID NO: 516535 - RNA, 60 nt, hsa
agaccauccucaagaacugagaccccggccagcgcccaccccagccuucugcccgcccca

SEQ ID NO: 516536 - RNA, 64 nt, hsa
gcccagugacccccagacgcggaaaccggguggcagcgcccagccuggccccaagcauggaaac

SEQ ID NO: 516537 - RNA, 64 nt, hsa
acccucaugaacacagggauuggggagggaccagagcgcccaauacacacagcuccauuaugca

SEQ ID NO: 516538 - RNA, 64 nt, hsa; identical to SEQ ID NO: 50556

SEQ ID NO: 516539 - RNA, 64 nt, hsa; identical to SEQ ID NO: 50557

SEQ ID NO: 516540 - RNA, 64 nt, hsa; identical to SEQ ID NO: 50558

SEQ ID NO: 516541 - RNA, 64 nt, hsa; identical to SEQ ID NO: 50559

SEQ ID NO: 516542 - RNA, 64 nt, hsa; identical to SEQ ID NO: 50560

SEQ ID NO: 516543 - RNA, 64 nt, hsa; identical to SEQ ID NO: 50561

SEQ ID NO: 516544 - RNA, 64 nt, hsa; identical to SEQ ID NO: 50562

SEQ ID NO: 516545 - RNA, 64 nt, hsa; identical to SEQ ID NO: 50563

SEQ ID NO: 516546 - RNA, 64 nt, hsa; identical to SEQ ID NO: 50564

SEQ ID NO: 516547 - RNA, 64 nt, hsa; identical to SEQ ID NO: 50565

SEQ ID NO: 516548 - RNA, 64 nt, hsa; identical to SEQ ID NO: 50566

SEQ ID NO: 516549 - RNA, 64 nt, hsa; identical to SEQ ID NO: 50567

SEQ ID NO: 516550 - RNA, 64 nt, hsa; identical to SEQ ID NO: 50568

SEQ ID NO: 516551 - RNA, 64 nt, hsa; identical to SEQ ID NO: 50569

SEQ ID NO: 516552 - RNA, 64 nt, hsa; identical to SEQ ID NO: 50570

SEQ ID NO: 516553 - RNA, 64 nt, hsa; identical to SEQ ID NO: 50571

SEQ ID NO: 516554 - RNA, 64 nt, hsa; identical to SEQ ID NO: 50572

SEQ ID NO: 516555 - RNA, 64 nt, hsa; identical to SEQ ID NO: 50573

SEQ ID NO: 516556 - RNA, 64 nt, hsa; identical to SEQ ID NO: 50574

SEQ ID NO: 516557 - RNA, 64 nt, hsa; identical to SEQ ID NO: 50575

SEQ ID NO: 516558 - RNA, 64 nt, hsa; identical to SEQ ID NO: 50576

SEQ ID NO: 516559 - RNA, 64 nt, hsa; identical to SEQ ID NO: 50577

SEQ ID NO: 516560 - RNA, 64 nt, hsa; identical to SEQ ID NO: 50578

SEQ ID NO: 516561 - RNA, 64 nt, hsa; identical to SEQ ID NO: 50579

SEQ ID NO: 516562 - RNA, 64 nt, hsa; identical to SEQ ID NO: 50580

SEQ ID NO: 516563 - RNA, 64 nt, hsa; identical to SEQ ID NO: 50581

SEQ ID NO: 516564 - RNA, 64 nt, hsa; identical to SEQ ID NO: 50582

SEQ ID NO: 516565 - RNA, 64 nt, hsa; identical to SEQ ID NO: 50583

SEQ ID NO: 516566 - RNA, 64 nt, hsa; identical to SEQ ID NO: 50584

SEQ ID NO: 516567 - RNA, 64 nt, hsa; identical to SEQ ID NO: 50585

SEQ ID NO: 516568 - RNA, 64 nt, hsa; identical to SEQ ID NO: 50586

SEQ ID NO: 516569 - RNA, 64 nt, hsa; identical to SEQ ID NO: 50587

SEQ ID NO: 516570 - RNA, 64 nt, hsa; identical to SEQ ID NO: 50588

SEQ ID NO: 516571 - RNA, 64 nt, hsa; identical to SEQ ID NO: 50589

SEQ ID NO: 516572 - RNA, 64 nt, hsa; identical to SEQ ID NO: 50590

SEQ ID NO: 516573 - RNA, 64 nt, hsa; identical to SEQ ID NO: 50591

SEQ ID NO: 516574 - RNA, 64 nt, hsa; identical to SEQ ID NO: 50592

SEQ ID NO: 516575 - RNA, 64 nt, hsa; identical to SEQ ID NO: 50593

SEQ ID NO: 516576 - RNA, 64 nt, hsa; identical to SEQ ID NO: 50594

SEQ ID NO: 516577 - RNA, 64 nt, hsa; identical to SEQ ID NO: 50595

SEQ ID NO: 516578 - RNA, 64 nt, hsa; identical to SEQ ID NO: 50596

SEQ ID NO: 516579 - RNA, 64 nt, hsa; identical to SEQ ID NO: 50597

SEQ ID NO: 516580 - RNA, 64 nt, hsa; identical to SEQ ID NO: 50598

SEQ ID NO: 516581 - RNA, 64 nt, hsa; identical to SEQ ID NO: 50599

SEQ ID NO: 516582 - RNA, 64 nt, hsa; identical to SEQ ID NO: 50600

SEQ ID NO: 516583 - RNA, 64 nt, hsa; identical to SEQ ID NO: 50601

SEQ ID NO: 516584 - RNA, 64 nt, hsa; identical to SEQ ID NO: 50602

SEQ ID NO: 516585 - RNA, 64 nt, hsa; identical to SEQ ID NO: 50603

SEQ ID NO: 516586 - RNA, 64 nt, hsa; identical to SEQ ID NO: 50604

SEQ ID NO: 516587 - RNA, 64 nt, hsa; identical to SEQ ID NO: 50605

SEQ ID NO: 516588 - RNA, 64 nt, hsa; identical to SEQ ID NO: 50606

SEQ ID NO: 516589 - RNA, 64 nt, hsa; identical to SEQ ID NO: 50607

SEQ ID NO: 516590 - RNA, 64 nt, hsa; identical to SEQ ID NO: 50608

SEQ ID NO: 516591 - RNA, 64 nt, hsa; identical to SEQ ID NO: 50609

SEQ ID NO: 516592 - RNA, 64 nt, hsa; identical to SEQ ID NO: 50610

SEQ ID NO: 516593 - RNA, 64 nt, hsa; identical to SEQ ID NO: 50611

SEQ ID NO: 516594 - RNA, 64 nt, hsa; identical to SEQ ID NO: 50612

SEQ ID NO: 516595 - RNA, 64 nt, hsa; identical to SEQ ID NO: 50613

SEQ ID NO: 516596 - RNA, 64 nt, hsa; identical to SEQ ID NO: 50614

SEQ ID NO: 516597 - RNA, 64 nt, hsa; identical to SEQ ID NO: 50615

SEQ ID NO: 516598 - RNA, 64 nt, hsa; identical to SEQ ID NO: 50616

SEQ ID NO: 516599 - RNA, 64 nt, hsa; identical to SEQ ID NO: 50617

SEQ ID NO: 516600 - RNA, 64 nt, hsa; identical to SEQ ID NO: 50618

SEQ ID NO: 516601 - RNA, 64 nt, hsa; identical to SEQ ID NO: 50619

SEQ ID NO: 516602 - RNA, 64 nt, hsa; identical to SEQ ID NO: 50620

SEQ ID NO: 516603 - RNA, 64 nt, hsa; identical to SEQ ID NO: 50621

SEQ ID NO: 516604 - RNA, 64 nt, hsa; identical to SEQ ID NO: 50622

SEQ ID NO: 516605 - RNA, 64 nt, hsa; identical to SEQ ID NO: 50623

SEQ ID NO: 516606 - RNA, 64 nt, hsa; identical to SEQ ID NO: 50624

SEQ ID NO: 516607 - RNA, 64 nt, hsa; identical to SEQ ID NO: 50625

SEQ ID NO: 516608 - RNA, 64 nt, hsa; identical to SEQ ID NO: 50626

SEQ ID NO: 516609 - RNA, 64 nt, hsa; identical to SEQ ID NO: 50627

SEQ ID NO: 516610 - RNA, 64 nt, hsa; identical to SEQ ID NO: 50628

SEQ ID NO: 516611 - RNA, 64 nt, hsa; identical to SEQ ID NO: 50629

SEQ ID NO: 516612 - RNA, 64 nt, hsa; identical to SEQ ID NO: 50630

SEQ ID NO: 516613 - RNA, 64 nt, hsa; identical to SEQ ID NO: 50631

SEQ ID NO: 516614 - RNA, 64 nt, hsa; identical to SEQ ID NO: 50632

SEQ ID NO: 516615 - RNA, 64 nt, hsa; identical to SEQ ID NO: 50633

SEQ ID NO: 516616 - RNA, 64 nt, hsa; identical to SEQ ID NO: 50634

SEQ ID NO: 516617 - RNA, 64 nt, hsa; identical to SEQ ID NO: 50635

SEQ ID NO: 516618 - RNA, 64 nt, hsa; identical to SEQ ID NO: 50636

SEQ ID NO: 516619 - RNA, 64 nt, hsa; identical to SEQ ID NO: 50637

SEQ ID NO: 516620 - RNA, 64 nt, hsa; identical to SEQ ID NO: 50638

SEQ ID NO: 516621 - RNA, 64 nt, hsa; identical to SEQ ID NO: 50639

SEQ ID NO: 516622 - RNA, 64 nt, hsa; identical to SEQ ID NO: 50640

SEQ ID NO: 516623 - RNA, 64 nt, hsa; identical to SEQ ID NO: 50641

SEQ ID NO: 516624 - RNA, 64 nt, hsa; identical to SEQ ID NO: 50642

SEQ ID NO: 516625 - RNA, 64 nt, hsa; identical to SEQ ID NO: 50643

SEQ ID NO: 516626 - RNA, 64 nt, hsa; identical to SEQ ID NO: 50644

SEQ ID NO: 516627 - RNA, 64 nt, hsa; identical to SEQ ID NO: 80484

SEQ ID NO: 516628 - RNA, 64 nt, hsa; identical to SEQ ID NO: 80485

SEQ ID NO: 516629 - RNA, 64 nt, hsa; identical to SEQ ID NO: 80486

SEQ ID NO: 516630 - RNA, 64 nt, hsa; identical to SEQ ID NO: 80487

SEQ ID NO: 516631 - RNA, 64 nt, hsa; identical to SEQ ID NO: 80488

SEQ ID NO: 516632 - RNA, 64 nt, hsa; identical to SEQ ID NO: 80489

SEQ ID NO: 516633 - RNA, 64 nt, hsa; identical to SEQ ID NO: 80490

SEQ ID NO: 516634 - RNA, 64 nt, hsa; identical to SEQ ID NO: 80491

SEQ ID NO: 516635 - RNA, 64 nt, hsa; identical to SEQ ID NO: 80492

SEQ ID NO: 516636 - RNA, 64 nt, hsa; identical to SEQ ID NO: 80493

SEQ ID NO: 516637 - RNA, 64 nt, hsa; identical to SEQ ID NO: 80494

SEQ ID NO: 516638 - RNA, 64 nt, hsa; identical to SEQ ID NO: 80495

SEQ ID NO: 516639 - RNA, 64 nt, hsa; identical to SEQ ID NO: 80496

SEQ ID NO: 516640 - RNA, 64 nt, hsa; identical to SEQ ID NO: 80497

SEQ ID NO: 516641 - RNA, 64 nt, hsa; identical to SEQ ID NO: 80498

SEQ ID NO: 516642 - RNA, 64 nt, hsa; identical to SEQ ID NO: 80499

SEQ ID NO: 516643 - RNA, 64 nt, hsa; identical to SEQ ID NO: 80500

SEQ ID NO: 516644 - RNA, 64 nt, hsa; identical to SEQ ID NO: 80501

SEQ ID NO: 516645 - RNA, 64 nt, hsa; identical to SEQ ID NO: 80502

SEQ ID NO: 516646 - RNA, 64 nt, hsa; identical to SEQ ID NO: 80503

SEQ ID NO: 516647 - RNA, 64 nt, hsa; identical to SEQ ID NO: 80504

SEQ ID NO: 516648 - RNA, 64 nt, hsa; identical to SEQ ID NO: 80505

SEQ ID NO: 516649 - RNA, 64 nt, hsa; identical to SEQ ID NO: 80506

SEQ ID NO: 516650 - RNA, 64 nt, hsa; identical to SEQ ID NO: 80507

SEQ ID NO: 516651 - RNA, 64 nt, hsa; identical to SEQ ID NO: 80508

SEQ ID NO: 516652 - RNA, 64 nt, hsa; identical to SEQ ID NO: 80509

SEQ ID NO: 516653 - RNA, 64 nt, hsa; identical to SEQ ID NO: 80510

SEQ ID NO: 516654 - RNA, 64 nt, hsa; identical to SEQ ID NO: 80511

SEQ ID NO: 516655 - RNA, 64 nt, hsa; identical to SEQ ID NO: 80512

SEQ ID NO: 516656 - RNA, 64 nt, hsa; identical to SEQ ID NO: 80513

SEQ ID NO: 516657 - RNA, 64 nt, hsa; identical to SEQ ID NO: 80514

SEQ ID NO: 516658 - RNA, 64 nt, hsa; identical to SEQ ID NO: 80515

SEQ ID NO: 516659 - RNA, 64 nt, hsa; identical to SEQ ID NO: 80516

SEQ ID NO: 516660 - RNA, 64 nt, hsa; identical to SEQ ID NO: 80517

SEQ ID NO: 516661 - RNA, 64 nt, hsa; identical to SEQ ID NO: 80518

SEQ ID NO: 516662 - RNA, 64 nt, hsa; identical to SEQ ID NO: 80519

SEQ ID NO: 516663 - RNA, 64 nt, hsa; identical to SEQ ID NO: 474570

SEQ ID NO: 516664 - RNA, 64 nt, hsa; identical to SEQ ID NO: 474571

SEQ ID NO: 516665 - RNA, 64 nt, hsa; identical to SEQ ID NO: 474572

SEQ ID NO: 516666 - RNA, 64 nt, hsa; identical to SEQ ID NO: 474573

SEQ ID NO: 516667 - RNA, 64 nt, hsa; identical to SEQ ID NO: 474574

SEQ ID NO: 516668 - RNA, 64 nt, hsa; identical to SEQ ID NO: 474575

SEQ ID NO: 516669 - RNA, 64 nt, hsa; identical to SEQ ID NO: 474576

SEQ ID NO: 516670 - RNA, 64 nt, hsa; identical to SEQ ID NO: 474577

SEQ ID NO: 516671 - RNA, 64 nt, hsa; identical to SEQ ID NO: 474578

SEQ ID NO: 516672 - RNA, 64 nt, hsa; identical to SEQ ID NO: 474579

SEQ ID NO: 516673 - RNA, 64 nt, hsa; identical to SEQ ID NO: 474580

SEQ ID NO: 516674 - RNA, 64 nt, hsa; identical to SEQ ID NO: 474581

SEQ ID NO: 516675 - RNA, 64 nt, hsa; identical to SEQ ID NO: 474582

SEQ ID NO: 516676 - RNA, 64 nt, hsa; identical to SEQ ID NO: 474583

SEQ ID NO: 516677 - RNA, 64 nt, hsa; identical to SEQ ID NO: 96836

SEQ ID NO: 516678 - RNA, 64 nt, hsa; identical to SEQ ID NO: 96837

SEQ ID NO: 516679 - RNA, 64 nt, hsa; identical to SEQ ID NO: 96838

SEQ ID NO: 516680 - RNA, 64 nt, hsa; identical to SEQ ID NO: 96839

SEQ ID NO: 516681 - RNA, 64 nt, hsa; identical to SEQ ID NO: 96840

SEQ ID NO: 516682 - RNA, 64 nt, hsa; identical to SEQ ID NO: 96841

SEQ ID NO: 516683 - RNA, 64 nt, hsa; identical to SEQ ID NO: 96842

SEQ ID NO: 516684 - RNA, 64 nt, hsa; identical to SEQ ID NO: 96843

SEQ ID NO: 516685 - RNA, 64 nt, hsa; identical to SEQ ID NO: 96844

SEQ ID NO: 516686 - RNA, 64 nt, hsa; identical to SEQ ID NO: 96845

SEQ ID NO: 516687 - RNA, 64 nt, hsa; identical to SEQ ID NO: 96846

SEQ ID NO: 516688 - RNA, 64 nt, hsa; identical to SEQ ID NO: 96847

SEQ ID NO: 516689 - RNA, 64 nt, hsa; identical to SEQ ID NO: 96848

SEQ ID NO: 516690 - RNA, 64 nt, hsa; identical to SEQ ID NO: 96849

SEQ ID NO: 516691 - RNA, 64 nt, hsa; identical to SEQ ID NO: 96850

SEQ ID NO: 516692 - RNA, 64 nt, hsa; identical to SEQ ID NO: 96851

SEQ ID NO: 516693 - RNA, 64 nt, hsa; identical to SEQ ID NO: 96852

SEQ ID NO: 516694 - RNA, 64 nt, hsa; identical to SEQ ID NO: 96853

SEQ ID NO: 516695 - RNA, 64 nt, hsa; identical to SEQ ID NO: 96854

SEQ ID NO: 516696 - RNA, 64 nt, hsa; identical to SEQ ID NO: 96855

SEQ ID NO: 516697 - RNA, 64 nt, hsa; identical to SEQ ID NO: 96856

SEQ ID NO: 516698 - RNA, 64 nt, hsa; identical to SEQ ID NO: 96857

SEQ ID NO: 516699 - RNA, 64 nt, hsa; identical to SEQ ID NO: 96858

SEQ ID NO: 516700 - RNA, 64 nt, hsa; identical to SEQ ID NO: 96859

SEQ ID NO: 516701 - RNA, 64 nt, hsa; identical to SEQ ID NO: 96860

SEQ ID NO: 516702 - RNA, 64 nt, hsa; identical to SEQ ID NO: 96861

SEQ ID NO: 516703 - RNA, 64 nt, hsa; identical to SEQ ID NO: 96862

SEQ ID NO: 516704 - RNA, 64 nt, hsa; identical to SEQ ID NO: 96863

SEQ ID NO: 516705 - RNA, 64 nt, hsa; identical to SEQ ID NO: 96864

SEQ ID NO: 516706 - RNA, 64 nt, hsa; identical to SEQ ID NO: 96865

SEQ ID NO: 516707 - RNA, 64 nt, hsa; identical to SEQ ID NO: 96866

SEQ ID NO: 516708 - RNA, 64 nt, hsa; identical to SEQ ID NO: 96867

SEQ ID NO: 516709 - RNA, 64 nt, hsa; identical to SEQ ID NO: 96868

SEQ ID NO: 516710 - RNA, 64 nt, hsa; identical to SEQ ID NO: 96869

SEQ ID NO: 516711 - RNA, 64 nt, hsa; identical to SEQ ID NO: 96870

SEQ ID NO: 516712 - RNA, 64 nt, hsa; identical to SEQ ID NO: 96871

SEQ ID NO: 516713 - RNA, 64 nt, hsa; identical to SEQ ID NO: 96872

SEQ ID NO: 516714 - RNA, 64 nt, hsa; identical to SEQ ID NO: 96873

SEQ ID NO: 516715 - RNA, 64 nt, hsa; identical to SEQ ID NO: 96874

SEQ ID NO: 516716 - RNA, 64 nt, hsa; identical to SEQ ID NO: 96875

SEQ ID NO: 516717 - RNA, 64 nt, hsa
auuggcccuuuggcucuugcccuuggcucccuugggcagacagcaggcuuaggccauugauauc

SEQ ID NO: 516718 - RNA, 64 nt, hsa
gggucugaacugccuccauccuagggcaaccuggggcagacaggccuggugggggguggggaaa

SEQ ID NO: 516719 - RNA, 64 nt, hsa
gucgaggcugguaagggaccuucagggagagcugggcagacaggugggagauggagguagggcu

SEQ ID NO: 516720 - RNA, 64 nt, hsa
ugagaaagacaucugaggaaaauggaagaccuaaggcagacaggaaggaagcacaaaagacaag

SEQ ID NO: 516721 - RNA, 64 nt, hsa
accccaggcagaccgauaaaaagaccuccagauaggcagacagacagauggaccaccaaccugg

SEQ ID NO: 516722 - RNA, 64 nt, hsa
cagacuccuaaccaaccagauggacugccagacaggcagacaucagccacauggaauccugaca

SEQ ID NO: 516723 - RNA, 64 nt, hsa
ugggcgagcgugcaccaucccuuuuugaaguguaggcagacacagggacuugaaguuguuacua

SEQ ID NO: 516724 - RNA, 64 nt, hsa
aaaacugcguuaaaggcucgauuuuguaucugcaggcagacacggaucugagaaucuuuauuga

SEQ ID NO: 516725 - RNA, 64 nt, hsa
cccaaaaggugacuuaauuaauaaagggcauuugggcagacacacuguguuggaccaacaaagu

SEQ ID NO: 516726 - RNA, 64 nt, hsa
gggccugaaaagaggggcugcccuccugcgccaaggcagacacaagcugcgggcugugcggucc

SEQ ID NO: 516727 - RNA, 64 nt, hsa
guaaagaugagcaaacauuuggaauuuacaugugggcagacauugggauaacaacuuucaucac

SEQ ID NO: 516728 - RNA, 64 nt, hsa
aaguucugaucauuauauaagaagggaaaugccuggcagacaccauguaaguuauaagugucug

SEQ ID NO: 516729 - RNA, 64 nt, hsa
aaugaauuaagaacacauucuaacaagggucuguggcagacauugccgagugacuuucuuaguc

SEQ ID NO: 516730 - RNA, 64 nt, hsa
aaugaauuaagaacacauucuaacaagggucuguggcagacauugccgagugacuuucuaacau

SEQ ID NO: 516731 - RNA, 64 nt, hsa
caagguucugcccuuauggagcucacacuccaguggcagacaaacagaccauaaauaaggaaac

SEQ ID NO: 516732 - RNA, 64 nt, hsa
cucaagaccagagacccaacagcagugaucucagggcagacagcccuccacuccagcucugaga

SEQ ID NO: 516733 - RNA, 64 nt, hsa
guuauugggccaccugacagcuggacagaaaaggggcagacacaccgaggaugcgauuuaaaau

SEQ ID NO: 516734 - RNA, 64 nt, hsa
cugggcacggugacugcgguuauuccuggaggucggcagacaugccaaccuugggcuauuugag

SEQ ID NO: 516735 - RNA, 64 nt, hsa
acacagagauggaauagaaaagaugagaggcagaggcagacaggcgcuggacagaggggcaggg

SEQ ID NO: 516736 - RNA, 64 nt, hsa
cagaggggcaggggagugccaagguuguccuggaggcagacagcccagcugagccuccuuaccu

SEQ ID NO: 516737 - RNA, 64 nt, hsa
auguguggcucagugccuggacaaaugaugccauggcagacaguagacagaacaacacuucccu

SEQ ID NO: 516738 - RNA, 64 nt, hsa
caaagggugaaauccgcauugauggccucaauguggcagacaucggccuccaugaccugcgcuc

SEQ ID NO: 516739 - RNA, 64 nt, hsa
uacucugggucaagagaccagggaugcaggguuaggcagacagguccccagaguccucacccug

SEQ ID NO: 516740 - RNA, 64 nt, hsa
aaacccaaaccaaaaacgcaaaccaaagcaggcaggcagacagcugcugggggaaauccugggg

SEQ ID NO: 516741 - RNA, 64 nt, hsa
agcacgaaucaugauucugcuuucuguuagcuuaggcagacauugggccuucaccuacaaguuu

SEQ ID NO: 516742 - RNA, 64 nt, hsa
gccauuugaaucagggucuccaguuucuagaaaaggcagacacugguugggaccaaagucucca

SEQ ID NO: 516743 - RNA, 64 nt, hsa
uucucagacuugggaccugggugccugggauccuggcagacagagguuguguccagacagccag

SEQ ID NO: 516744 - RNA, 64 nt, hsa
cucaggaagccggccugcagcaggagcagaggaaggcagacacccacaagaagaugacugaguu

SEQ ID NO: 516745 - RNA, 64 nt, hsa
gccaucccaaauacuugggcagcagcucagcaugggcagacaugggggcuguggauucuuccag

SEQ ID NO: 516746 - RNA, 64 nt, hsa
uaggaacugagcccaaggaaauagcgggguugcaggcagacauugagcugcgagacaaugggaa

SEQ ID NO: 516747 - RNA, 64 nt, hsa
agcugugccccaucccccaagccuccugggaggauccagccaaaucuugcgacuccuggcacac

SEQ ID NO: 516748 - RNA, 64 nt, hsa
ugggucagacaucaaugucccuguccccccuggguccagccaagcugugccccaucccccaagc

SEQ ID NO: 516749 - RNA, 64 nt, hsa
aaagucauguguuugcaugcuggaugcuauacuguccagccaggacacaagacuucugauuucu

SEQ ID NO: 516750 - RNA, 64 nt, hsa
agagcugaggcccgggcgcuggcugcagcucacguccagccaugggaaucccacggaccucucg

SEQ ID NO: 516751 - RNA, 64 nt, hsa
ccuccugcggcgccuugcccuccuccgaccccuuuccagccaaaguccccccaccccuucagag

SEQ ID NO: 516752 - RNA, 64 nt, hsa
ccugucaucuaaccucaguccugccuacugcaguuccagccaaccugcucuuuccugaguucaa

SEQ ID NO: 516753 - RNA, 64 nt, hsa
aaaggccuuagugugccccagcagucuggcugcguccagccaccaucacccggaaggaugccca

SEQ ID NO: 516754 - RNA, 64 nt, hsa
uucuagucccucauaccagcccuccuugccucccuccagccacuggaccccagccuuggcucuu

SEQ ID NO: 516755 - RNA, 64 nt, hsa
cugcagcaaacuuugguguaaaauuccaccaguuuccagccaccuuccugacuucuaucugggc

SEQ ID NO: 516756 - RNA, 64 nt, hsa
ccagauagucacagucaagguuggagagucuccuuccagccagugaccuacccaaaccuuuugu

SEQ ID NO: 516757 - RNA, 64 nt, hsa
ucguuuuggaggauagcucaaguugaauuuucuuuccagccaguuacccuuucaaccuacccau

SEQ ID NO: 516758 - RNA, 64 nt, hsa
gucuugugagcaugaagugaacgggcuguuuugcuccagccacuuuucuuguacaaccacaugg

SEQ ID NO: 516759 - RNA, 64 nt, hsa
uugcacaaacccuaucaagagcugcugcuucccuuccagccagaaaagugguaagcggagcaag

SEQ ID NO: 516760 - RNA, 64 nt, hsa
uccacagaagcccauccgcugccuccguggcuucuccagccauugaacuggucccacacgcacc

SEQ ID NO: 516761 - RNA, 64 nt, hsa
acccagauuuccacagugcugcuaauaucccagcuccagccagcaccccaucugcaccugaauc

SEQ ID NO: 516762 - RNA, 64 nt, hsa
cgccuccuguagcaguagggcccccagccagcgcuccagccaaagcggcggccccaggguuaau

SEQ ID NO: 516763 - RNA, 64 nt, hsa
uggaggcaaaaggcagcucacggggccuuccauuuccagccaggccucaucugggguagggcca

SEQ ID NO: 516764 - RNA, 64 nt, hsa
accucacucccagccaggcucccaaagggcucauuccagccauuccaaucucuucuucuuuaug

SEQ ID NO: 516765 - RNA, 64 nt, hsa
augccugaaaaucagcacgugcagggccucccuauccagccagcauuuuccuuccagcugaggc

SEQ ID NO: 516766 - RNA, 64 nt, hsa
cucagacugccuuccugcuucugggcuaaccuguuccagccaggcuccucaugugaccucgcag

SEQ ID NO: 516767 - RNA, 64 nt, hsa
cuccaccuucuggguggaggcgccauccuaaccauccagccaggccacccacaacccgagaauc

SEQ ID NO: 516768 - RNA, 64 nt, hsa
ccagccccuccagcuuuggagccaaggccaucguuccagccacuugacuguccucgacggccug

SEQ ID NO: 516769 - RNA, 64 nt, hsa
uugaccagaacgcacaccucgucggggggcccaguccagccaccccccagcacuuuauguagag

SEQ ID NO: 516770 - RNA, 64 nt, hsa
uuuguacauguaauguauuauauggggucugggcuccagccagagaacaaucuuuuauuucugu

SEQ ID NO: 516771 - RNA, 64 nt, hsa
caaacaucuucacccuaauagucccuccuccaauuccagccacuugucaggcucuccucuugac

SEQ ID NO: 516772 - RNA, 64 nt, hsa
caauuagugcugauaauuccuauguggaaaugauuccagccaugguccccucacuugagcaugu

SEQ ID NO: 516773 - RNA, 64 nt, hsa
cuccaucaagugguaauauguuugcagccugcuguccagccaagagugacagauacuucuagug

SEQ ID NO: 516774 - RNA, 64 nt, hsa
ugggggcagucgccgagagccuccuuccccuccguccagccagcaaggcuuucccaagcguccu

SEQ ID NO: 516775 - RNA, 64 nt, hsa
ggaccuucguguuuuuccggggcucaggucucacuccagccaucgcuguggccaguggagagcc

SEQ ID NO: 516776 - RNA, 64 nt, hsa
uuuuuuggggggugguccccgucuggggggccccuccagccaguacuccaggucucccugucuc

SEQ ID NO: 516777 - RNA, 64 nt, hsa
ccaccccuucuggggucacuccauccaugcucucuccagccagccaucucaaggagaaacauag

SEQ ID NO: 516778 - RNA, 64 nt, hsa; identical to SEQ ID NO: 311765

SEQ ID NO: 516779 - RNA, 64 nt, hsa; identical to SEQ ID NO: 311766

SEQ ID NO: 516780 - RNA, 64 nt, hsa; identical to SEQ ID NO: 311767

SEQ ID NO: 516781 - RNA, 64 nt, hsa; identical to SEQ ID NO: 311768

SEQ ID NO: 516782 - RNA, 64 nt, hsa; identical to SEQ ID NO: 311769

SEQ ID NO: 516783 - RNA, 64 nt, hsa; identical to SEQ ID NO: 311770

SEQ ID NO: 516784 - RNA, 64 nt, hsa; identical to SEQ ID NO: 311771

SEQ ID NO: 516785 - RNA, 64 nt, hsa; identical to SEQ ID NO: 311772

SEQ ID NO: 516786 - RNA, 64 nt, hsa; identical to SEQ ID NO: 311773

SEQ ID NO: 516787 - RNA, 64 nt, hsa; identical to SEQ ID NO: 311774

SEQ ID NO: 516788 - RNA, 64 nt, hsa; identical to SEQ ID NO: 311775

SEQ ID NO: 516789 - RNA, 64 nt, hsa; identical to SEQ ID NO: 311776

SEQ ID NO: 516790 - RNA, 64 nt, hsa; identical to SEQ ID NO: 311777

SEQ ID NO: 516791 - RNA, 64 nt, hsa; identical to SEQ ID NO: 311778

SEQ ID NO: 516792 - RNA, 64 nt, hsa; identical to SEQ ID NO: 311779

SEQ ID NO: 516793 - RNA, 64 nt, hsa; identical to SEQ ID NO: 311780

SEQ ID NO: 516794 - RNA, 64 nt, hsa; identical to SEQ ID NO: 311781

SEQ ID NO: 516795 - RNA, 64 nt, hsa; identical to SEQ ID NO: 311782

SEQ ID NO: 516796 - RNA, 64 nt, hsa; identical to SEQ ID NO: 311783

SEQ ID NO: 516797 - RNA, 64 nt, hsa; identical to SEQ ID NO: 311784

SEQ ID NO: 516798 - RNA, 64 nt, hsa; identical to SEQ ID NO: 311785

SEQ ID NO: 516799 - RNA, 64 nt, hsa; identical to SEQ ID NO: 311786

SEQ ID NO: 516800 - RNA, 64 nt, hsa; identical to SEQ ID NO: 311787

SEQ ID NO: 516801 - RNA, 64 nt, hsa; identical to SEQ ID NO: 311788

SEQ ID NO: 516802 - RNA, 64 nt, hsa; identical to SEQ ID NO: 311789

SEQ ID NO: 516803 - RNA, 64 nt, hsa; identical to SEQ ID NO: 311790

SEQ ID NO: 516804 - RNA, 64 nt, hsa; identical to SEQ ID NO: 311791

SEQ ID NO: 516805 - RNA, 64 nt, hsa; identical to SEQ ID NO: 311792

SEQ ID NO: 516806 - RNA, 64 nt, hsa; identical to SEQ ID NO: 311793

SEQ ID NO: 516807 - RNA, 64 nt, hsa; identical to SEQ ID NO: 311794

SEQ ID NO: 516808 - RNA, 64 nt, hsa; identical to SEQ ID NO: 311795

SEQ ID NO: 516809 - RNA, 64 nt, hsa; identical to SEQ ID NO: 311796

SEQ ID NO: 516810 - RNA, 64 nt, hsa; identical to SEQ ID NO: 311797

SEQ ID NO: 516811 - RNA, 64 nt, hsa; identical to SEQ ID NO: 311798

SEQ ID NO: 516812 - RNA, 64 nt, hsa; identical to SEQ ID NO: 311799

SEQ ID NO: 516813 - RNA, 64 nt, hsa; identical to SEQ ID NO: 311800

SEQ ID NO: 516814 - RNA, 64 nt, hsa; identical to SEQ ID NO: 311801

SEQ ID NO: 516815 - RNA, 64 nt, hsa; identical to SEQ ID NO: 311802

SEQ ID NO: 516816 - RNA, 51 nt, hsa
uuauugcaccaaagaagugauaauuuccacaugauuaauuuccaacaagac

SEQ ID NO: 516817 - RNA, 64 nt, hsa
auugcaccaaagaagugauaauuuccacaugauuaauuuccaacaagacacuugggaguuauuu

SEQ ID NO: 516818 - RNA, 64 nt, hsa
uucuuccuuucccacuaauaugcacauccagaaaaauuuccaucugagauucuaguacuucaaa

SEQ ID NO: 516819 - RNA, 64 nt, hsa
acuuucccagugaggaaaauuucuguguuuucagaauuuccauuucuacuaaccucuuggagaa

SEQ ID NO: 516820 - RNA, 64 nt, hsa
ccuaaagacauguggaggaagucacuguuaaaugaauuuccaccugaucacccuguguucacag

SEQ ID NO: 516821 - RNA, 64 nt, hsa
caggcacggucccgcuuuccuuagugcuuggagcaauuuccauaaaacauucaccagaaaccuu

SEQ ID NO: 516822 - RNA, 64 nt, hsa
aaaaagauagccaauuuccauuacauggguuuacaauuuccauucuuuugugccacgaguguua

SEQ ID NO: 516823 - RNA, 64 nt, hsa
uuugaggggcacauguggggucaaaaagauagccaauuuccauuacauggguuuacaauuucca

SEQ ID NO: 516824 - RNA, 64 nt, hsa
uagaaaagagggaaaaaaauccaguguuacuaguaauuuccaugguaauacagauaaaauacau

SEQ ID NO: 516825 - RNA, 64 nt, hsa
caauuguguaggauugacaaggaacucagauaaaaauuuccagggugcacuuccagaaccagcu

SEQ ID NO: 516826 - RNA, 64 nt, hsa
caucagaucugcaacacagaaaugcucugccugaaauuuccaccaugccuaggacucaccccau

SEQ ID NO: 516827 - RNA, 64 nt, hsa
agucucccagccuucucagagagcuaaaaccagaaauuuccagacucaugaaagcaacccccca

SEQ ID NO: 516828 - RNA, 64 nt, hsa
ucacaaggucuuuacuuaugcacauuugugcauaaauuuccacccaauuuccaagacaguugua

SEQ ID NO: 516829 - RNA, 64 nt, hsa
uuacuuaugcacauuugugcauaaauuuccacccaauuuccaagacaguuguaucacaaagcug

SEQ ID NO: 516830 - RNA, 64 nt, hsa
ugaauuucuuuauuauuuucagccuuuaaaauguaauuuccaucucuugcaaugaauuuguuuc

SEQ ID NO: 516831 - RNA, 64 nt, hsa
cuagucuuugagaguuacgguucuuucguagaacaauuuccauguuguuaacuguuguagacuu

SEQ ID NO: 516832 - RNA, 64 nt, hsa
accaugggguuuaugaacauuuauaacuuuuuauaauuuccauauuacauuucucauaguaugg

SEQ ID NO: 516833 - RNA, 64 nt, hsa
aacucuuaucaaaauauauuuuaccaguuuccagaauuuccaguacaggaccgccugaagagag

SEQ ID NO: 516834 - RNA, 64 nt, hsa
aaagccaaaaauauuuaucuugguuuuacauuuuaauuuccauucuuaauuguaauuuuuuucu

SEQ ID NO: 516835 - RNA, 64 nt, hsa
gucacugauuuuuuagcucaaaaucaucacuguuaauuuccagucaccccaaauaugguuaaaa

SEQ ID NO: 516836 - RNA, 64 nt, hsa
aaaauuuccacuucuauaucuaggcuuugucaguaauuuccacaccuuaauuaucauucaacuu

SEQ ID NO: 516837 - RNA, 64 nt, hsa
cuguaaauaagauuuacaacugauguuucuagaaaauuuccacuucuauaucuaggcuuuguca

SEQ ID NO: 516838 - RNA, 64 nt, hsa
aaaaaccaaaaagcaaaccaaaagaaaaaucugaaauuuccaucuggggauuaacuucugucuu

SEQ ID NO: 516839 - RNA, 64 nt, hsa
gauguauugacaucuuuccccaacagcacagcuaaauuuccaagucgcauaagcccuggggcuu

SEQ ID NO: 516840 - RNA, 64 nt, hsa
uauuaguagucacuuguuuucauuaucauaauugaauuuccaagaacaacuugauaucauucag

SEQ ID NO: 516841 - RNA, 64 nt, hsa
agcaauuaagugggaacauuuuuaauuuaaaaaaaauuuccaaauauuuguggguccgacagua

SEQ ID NO: 516842 - RNA, 64 nt, hsa
cgaaagagugagacuccaucucaaaaaaaaagaaaauuuccaagcaugguaucaucucacuuuu

SEQ ID NO: 516843 - RNA, 64 nt, hsa
gaacacccaagacacaagcuucagcagcaucggaaauuuccagcugggcaugguggcucacacc

SEQ ID NO: 516844 - RNA, 64 nt, hsa
uccuugcagacaguuaucccuuguuuagaacacgaauuuccauuuaccuggugggaacacgaaa

SEQ ID NO: 516845 - RNA, 64 nt, hsa
agaaaaacacgcauuugcaacguuaaccuaacgaaauuuccaugaagaaccaagucagggcagc

SEQ ID NO: 516846 - RNA, 64 nt, hsa
aacaagagcagaacaguuuuaaaaaucuaauuagaauuuccaaauaaaacaguuuccauaaggu

SEQ ID NO: 516847 - RNA, 64 nt, hsa
caacagugacauuggaaucauuuccauaggagguaauuuccauagcaacuaaucauagugaccc

SEQ ID NO: 516848 - RNA, 64 nt, hsa
ugcucuuuacauucaauuuucuguguguggugcuaauuuccauugugacuuuggaauuuaggga

SEQ ID NO: 516849 - RNA, 64 nt, hsa
guugaaaucaguauuucugaauucaaauugcuugaauuuccaaaauagucaguaaaggaucuaa

SEQ ID NO: 516850 - RNA, 64 nt, hsa
acgugaagggcuggaauguauauuaccaaaugggaauuuccauuguagguuuuugcuaguccca

SEQ ID NO: 516851 - RNA, 64 nt, hsa
ucugugaaggaucuaaggagacacaugcaccggaaauuuccauaagccaguugcaguuuucagg

SEQ ID NO: 516852 - RNA, 64 nt, hsa
ugauuuuauuuuaggagcuuauaaggcaugagacaauuuccauauaaauauauuaauuauugcc

SEQ ID NO: 516853 - RNA, 64 nt, hsa
cauuguuucucacuagaccccagggcaccagaugaauuuccaaguuuaaacucuuuccugcagg

SEQ ID NO: 516854 - RNA, 64 nt, hsa
uacccccuuuucccugaaccacguccuuuugaauaauuuccagauggauuucuguagccauacc

SEQ ID NO: 516855 - RNA, 64 nt, hsa
uauaugucaauauuuaguaaagcuuuucuuuuuuaauuuccaggaaaaaauaaaaagaguauga

SEQ ID NO: 516856 - RNA, 64 nt, hsa
guuuuacccacaugacuuauuaugcauaaagccaaauuuccaguuuaaguaauugccuacaaua

SEQ ID NO: 516857 - RNA, 64 nt, hsa
aucgguucuucaaauauuucauguuuacauuaaaaauuuccagagaagcauaaaaguauucacu

SEQ ID NO: 516858 - RNA, 64 nt, hsa
aaguaccuaauguuuugcugaacuuuuaaaaguuaauuuccaaaauguauagggauucaugaua

SEQ ID NO: 516859 - RNA, 64 nt, hsa
uagaaguuuacuuuuuccucuucugguuuuggaaaauuuccagauaagacaugucaccauuaau

SEQ ID NO: 516860 - RNA, 64 nt, hsa
cagcaggaaacagagaaauuugugucaucugaacaauuuccagauguucuuaauccagggcugu

SEQ ID NO: 516861 - RNA, 64 nt, hsa
auaaacuguauccuugucugacacuuuagcuaaaaauuuccaguuaggggaguuuauugccaaa

SEQ ID NO: 516862 - RNA, 64 nt, hsa
uuuugguucuuggagggaaaagauucuuuauuccaauuuccagagagaagagaaaacucaccca

SEQ ID NO: 516863 - RNA, 64 nt, hsa
aaaaggucacauaguguacuguccuuuuauaugaaauuuccagaacaggccaaucugaagagau

SEQ ID NO: 516864 - RNA, 64 nt, hsa
gccaaacuguuuccaaagcaucugcaucguguuuaauuuccauaaguaacguaugagaauucua

SEQ ID NO: 516865 - RNA, 64 nt, hsa
uuuaaauuuuggucacuguauguaucaguucuaaaauuuccauuuuguucucuauauuuuaaau

SEQ ID NO: 516866 - RNA, 64 nt, hsa
ucuuccuucauuauuuuccaaauuucguucugcaaauuuccacuuccucugauagacguuuuuu

SEQ ID NO: 516867 - RNA, 64 nt, hsa; identical to SEQ ID NO: 214333

SEQ ID NO: 516868 - RNA, 64 nt, hsa; identical to SEQ ID NO: 214334

SEQ ID NO: 516869 - RNA, 64 nt, hsa
cugcaaucuacuauaguacuccagaucucuuucggcuuccuaugagaaacaccagaagcauuac

SEQ ID NO: 516870 - RNA, 64 nt, hsa
uguuugucccugauuuuuuuuuuuuaauucuauggcuuccuaucuggcagcuuaauggguaauu

SEQ ID NO: 516871 - RNA, 64 nt, hsa
acuccuugcuuguuguguugcuuccuauuggcuagcuuccuaaggggggagggaaccgaguuau

SEQ ID NO: 516872 - RNA, 64 nt, hsa
guggcuucccaugacacuccuugcuuguuguguugcuuccuauuggcuagcuuccuaagggggg

SEQ ID NO: 516873 - RNA, 64 nt, hsa
auaaaaaauaaucaucaaccaggcaaauuacuuugcuuccuagcugaugucaucccacauuggu

SEQ ID NO: 516874 - RNA, 64 nt, hsa
aaaaauuauguuuaagggucauaguguauaaguagcuuccuaggaaacccuuuguguaucuuuu

SEQ ID NO: 516875 - RNA, 64 nt, hsa
gaggagcacaacagaugccacgucuucgugcauucgccaacacgugcccucacagggccagcgu

SEQ ID NO: 516876 - RNA, 64 nt, hsa
ggcugccugugucuucaccuguccuguccaccagcgccaacagccguggggaagccaaggagac

SEQ ID NO: 516877 - RNA, 64 nt, hsa
aaaugucacucaaaaauuucuuuuccaugucauucuugggaaugucuuccacaggauuugagaa

SEQ ID NO: 516878 - RNA, 64 nt, hsa
uuggaauccuugaguuaauuccagugaagcaaaacuugggaagagucaggauuggccacauugc

SEQ ID NO: 516879 - RNA, 64 nt, hsa
ugcccuguaucacagaagauucaggaaaaaugcacuugggaaucaaagaaaauggaacuucuuu

SEQ ID NO: 516880 - RNA, 64 nt, hsa
cuaaggcugggagagaaagggugccaacaggucccuugggaaugaguuggcucuggacguuucu

SEQ ID NO: 516881 - RNA, 64 nt, hsa
uauuguguauugauugaagucacuuuaaauccuucuugggaaugacacaguauauaaauaagga

SEQ ID NO: 516882 - RNA, 64 nt, hsa
cugcccagaacccuggccauucucaaaaugagaacuugggaauguuuaagaagaaaucaaacau

SEQ ID NO: 516883 - RNA, 64 nt, hsa
gugugucaucagcaucaccuagguuuccagcugacuugggaacugcaagucugagucuaacagu

SEQ ID NO: 516884 - RNA, 64 nt, hsa
ccuuuucuccuuguuauuugcccuucagaaugcacuugggaaaggcugguuccuuagccuccug

SEQ ID NO: 516885 - RNA, 64 nt, hsa
aacaaacauguuuuugugaaagcuacugaagugccuugggaaaugagaaaguuuuaauaaguaa

SEQ ID NO: 516886 - RNA, 64 nt, hsa
ucgaagcuggucuuuaaugagucuuuugcaaugacuugggaaaaacacccucccucacuacagg

SEQ ID NO: 516887 - RNA, 64 nt, hsa
cccugcauggaggcaacagcauuucaagauguaccuugggaagucaggauagcuggaaguaagg

SEQ ID NO: 516888 - RNA, 64 nt, hsa
gugaugaguacggaaaagucuucagagguuggaacuugggaaaaaucagugagugaauucauau

SEQ ID NO: 516889 - RNA, 64 nt, hsa
auagcuaccuggacuuuacagagcugucagaagacuugggaagguuugccagcauuggaaaaag

SEQ ID NO: 516890 - RNA, 64 nt, hsa
agaaacuaacgggacugguuuucaaagcaguuaucuugggaaacuguuuauuccagcgauguga

SEQ ID NO: 516891 - RNA, 64 nt, hsa
guuccauucaugccuucuuggagggugaggguggcuugggaaccgacccagugaucaugccuac

SEQ ID NO: 516892 - RNA, 64 nt, hsa
cugcagccagcgcccacccauccgugcccggacccuugggaaugcccgcggcuccagaggaaaa

SEQ ID NO: 516893 - RNA, 64 nt, hsa
ggacggggccuccguugcggggggucggcugcuucuugggaacuuugucguuuccggcgcuggc

SEQ ID NO: 516894 - RNA, 64 nt, hsa
uuuuuauccagcucuuuugcucacaucgcguaaccuugggaaagcuguuuaaagucgcugauca

SEQ ID NO: 516895 - RNA, 64 nt, hsa
gcaggaauugggaggccuagggugggcaugaaagcuugggaagcacugucgucucucagacagg

SEQ ID NO: 516896 - RNA, 64 nt, hsa
cucuacagaggugaaauuccagaugagucagucucuugggaaguguguuuagaaggguucagga

SEQ ID NO: 516897 - RNA, 64 nt, hsa
cccacggaauggggaaagcgggaacccuggaguucuugggaaucuuggagccuaaagagaaacc

SEQ ID NO: 516898 - RNA, 64 nt, hsa
aaggauauuagcaaaagcagaaguugcuagugaccuugggaagccgaagcugcuuacaguagcu

SEQ ID NO: 516899 - RNA, 64 nt, hsa
gagagcagcaccaccccacuggggcauccccagacuugggaaacgugacucuuucuuaaugcca

SEQ ID NO: 516900 - RNA, 64 nt, hsa
ugggcuccugcuggcuucugagguuucuugucagcuugggaaagacccaccuuuauuuuugccc

SEQ ID NO: 516901 - RNA, 64 nt, hsa
aauuucucucuguccccugagaucugaaggcuaccuugggaagaggcaucagccaucuugcuug

SEQ ID NO: 516902 - RNA, 64 nt, hsa
aaaagcacguugauuuuuuacaaauguaagugugcuugggaauuccuuaaauuuugugcaauaa

SEQ ID NO: 516903 - RNA, 64 nt, hsa
ccucacaaaagagaguccucaaguuguggcuguucuugggaaaggggucaccgugucugacaaa

SEQ ID NO: 516904 - RNA, 64 nt, hsa
cacgccucuuuccgaggugaaggugggaccauuccuugggaaaggauucacaguaagguuuuuu

SEQ ID NO: 516905 - RNA, 64 nt, hsa
gauccaaaugaugaugugcaauuucauguuuuaacuugggaaacugaaaguguucccauauagc

SEQ ID NO: 516906 - RNA, 64 nt, hsa
ggccugcuuccugucuuugggagaaaacgucuugcuugggaaggggccuuugucuugucaaggu

SEQ ID NO: 516907 - RNA, 64 nt, hsa
auuaaaacaugcacaaaaagaugcaucuaccgcucuugggaaauaugucaaaggucuaaaaaua

SEQ ID NO: 516908 - RNA, 64 nt, hsa
cccccucacccauuccuagugcucuugguauacacuugggaaaauaauguccuccaggagaaag

SEQ ID NO: 516909 - RNA, 64 nt, hsa
cgucuauacaguauaaacuaccucacuugccuuucuugggaaaaaaaaaaugaauggacuuuaa

SEQ ID NO: 516910 - RNA, 64 nt, hsa
ucagagagaugcugaguuaggccugucaggucuccuugggaaaggcuucauauuugcaacuuug

SEQ ID NO: 516911 - RNA, 64 nt, hsa
augaaggugaugcugccaaagcacaagccaguuucuugggaaaauucaaguuacaguggaguau

SEQ ID NO: 516912 - RNA, 64 nt, hsa
gacgacuucugcuugggaacugccaacgcuucugcuugggaauugcgugcagcagagccuagag

SEQ ID NO: 516913 - RNA, 64 nt, hsa
uccuccccuauucccggggcccggacgacuucugcuugggaacugccaacgcuucugcuuggga

SEQ ID NO: 516914 - RNA, 64 nt, hsa
acucaaugaacuacuuaugguuugucugacaucccucacuuaccaauuaauuauaaauauguuu

SEQ ID NO: 516915 - RNA, 64 nt, hsa
ccugaugacaguagcugucuccaagagaaaaauccucacuuauuaacucucuuuucuugcaucu

SEQ ID NO: 516916 - RNA, 64 nt, hsa
ggcucuggccuuuugcuguaacaugccugugucacucacuuagccuuggcauuugugcagacau

SEQ ID NO: 516917 - RNA, 64 nt, hsa
gcauaccagcaauuauuacuguguucgcacaguucucacuuaacuggugcuaugugaagacucu

SEQ ID NO: 516918 - RNA, 64 nt, hsa; identical to SEQ ID NO: 215532

SEQ ID NO: 516919 - RNA, 64 nt, hsa; identical to SEQ ID NO: 215533

SEQ ID NO: 516920 - RNA, 64 nt, hsa; identical to SEQ ID NO: 215534

SEQ ID NO: 516921 - RNA, 64 nt, hsa; identical to SEQ ID NO: 215535

SEQ ID NO: 516922 - RNA, 58 nt, hsa; identical to SEQ ID NO: 160291

SEQ ID NO: 516923 - RNA, 62 nt, hsa
cuccaaggucccuuaaaaagugccuuuuagaggcugggcaugguggcucacgcuuguaaucc

SEQ ID NO: 516924 - RNA, 62 nt, hsa
caggggcgcccgagcccucuccuggggggccugcugggcaggcgaccugcugacccacgguc

SEQ ID NO: 516925 - RNA, 62 nt, hsa
caugggaggcggcgcugcucuccccgagggcggcugggcagagcacaucccccaggacuuga

SEQ ID NO: 516926 - RNA, 62 nt, hsa
gaaaccccgucucuucuaaaaauacaaaauuagcugggcaugguggugcaugccuguaauuc

SEQ ID NO: 516927 - RNA, 62 nt, hsa
gaaguuauucuucauaaaaaauguuaacgugggcugggcaugguggcucaugccuguaaucc

SEQ ID NO: 516928 - RNA, 62 nt, hsa
guaaauguugcaaaaagaguuuuccaaguagagcugggcacuacguaaucagccccacaagu

SEQ ID NO: 516929 - RNA, 62 nt, hsa
ucuacuaaaaauacaaaaaaaaaaaaaaauuagcugggcaugguggcacacaccuguagucc

SEQ ID NO: 516930 - RNA, 62 nt, hsa
aaaacccugugucuacaaaaaauaaaaaauuagcugggcaugacggccagagcccauggucc

SEQ ID NO: 516931 - RNA, 62 nt, hsa
uugaucugguuuuugaagucucuuaauuauuggcugggcauggugacucaugccuguaaucc

SEQ ID NO: 516932 - RNA, 62 nt, hsa
gugagacuccgucucuacaaaaaauaaauuuagcugggcaugguggugcacaucuguagucc

SEQ ID NO: 516933 - RNA, 62 nt, hsa
cucacccaacaccaguggaacuggagccucuggcugggcacaguggcucacuuugggaggcu

SEQ ID NO: 516934 - RNA, 62 nt, hsa
ucccuuggggaaagaggugcuucuggggaagugcugggcauucacucuauugaccaaacauu

SEQ ID NO: 516935 - RNA, 62 nt, hsa
ccugcugucauuggcucucccuccaggcugcugcugggcaugucauagaugggaugaaugac

SEQ ID NO: 516936 - RNA, 62 nt, hsa
gucuuuaggaguagggugggauggggagggaggcugggcaucagggaucacaucacucuuaa

SEQ ID NO: 516937 - RNA, 62 nt, hsa
ggggccaggcaggccagcccagcccacgccgagcugggcagcgucugcucugguaggacugu

SEQ ID NO: 516938 - RNA, 62 nt, hsa
gucagggccugccgagcugccugccccuuccagcugggcagaguccccugcaaggaggcagg

SEQ ID NO: 516939 - RNA, 62 nt, hsa
ggauguagggauagcugauuuuaaaacacucggcugggcacaguggcucacaccuguaaucc

SEQ ID NO: 516940 - RNA, 62 nt, hsa
aaacccugucucuacaaaaaauacaaaaauuagcugggcaugguggugcgugccugaagucc

SEQ ID NO: 516941 - RNA, 62 nt, hsa
gcaggacgccgccucacgcaagcugggacacugcugggcacggcccuggcguucggcacuag

SEQ ID NO: 516942 - RNA, 62 nt, hsa
ggaacaguugacuucccagaaugcagugggcugcugggcaccccucucacgguuggggagga

SEQ ID NO: 516943 - RNA, 62 nt, hsa
uguguacugcaugcccacccggguagcaggcugcugggcaguucugcucuguggaggggcgg

SEQ ID NO: 516944 - RNA, 62 nt, hsa
gccccacgaagcccccaguggcuggcuguccagcugggcaaacaguggcaccccucccagcu

SEQ ID NO: 516945 - RNA, 62 nt, hsa
cuucuguuucaacaacuccuccacugggcagagcugggcaucuggcagggcuggcucugucc

SEQ ID NO: 516946 - RNA, 62 nt, hsa
gggaacacaggaaccuaggggaggaggggagcgcugggcauccucaggcuggcggccaaggc

SEQ ID NO: 516947 - RNA, 62 nt, hsa
ccugugggucccugcagucgacaucauguuuggcugggcaucgaugccuccuuucugggacu

SEQ ID NO: 516948 - RNA, 62 nt, hsa
ccuggaaaaugugaaacugucuccugcaaccugcugggcaugugggccuggcuguguucaau

SEQ ID NO: 516949 - RNA, 62 nt, hsa
cuguaagucuguucauuuuaacaacauacagggcugggcacgguggcucacgccuguaaucc

SEQ ID NO: 516950 - RNA, 62 nt, hsa
aaaccccgucucuaugaaaaauauaaaaauuagcugggcaugguggcaggcaccuguaaucc

SEQ ID NO: 516951 - RNA, 62 nt, hsa
guugaauccauaguguggggcccaugacucuagcugggcaccuuggaccuccagcuggccaa

SEQ ID NO: 516952 - RNA, 62 nt, hsa
uaguaaguccucuuccaaagagauggcaauaugcugggcaucuacuuuaaaacaaaguuguc

SEQ ID NO: 516953 - RNA, 62 nt, hsa
acucuccccaccccuggcccacuguggugugugcugggcaaauguggccugaaugcuaggua

SEQ ID NO: 516954 - RNA, 62 nt, hsa
gcucugccugggacugagcgaguggacuuagggcugggcaggcaguagccaccagagggcag

SEQ ID NO: 516955 - RNA, 62 nt, hsa
auagagaucuccucugcaguguagagaccagagcugggcagugcagggcauggagaccugca

SEQ ID NO: 516956 - RNA, 62 nt, hsa
aaaaaauaauaauaauaacaauauaagaacuagcugggcaugguggcgcaugcauguagucc

SEQ ID NO: 516957 - RNA, 62 nt, hsa
aaacuccaucucuacuaaaaguacaaaaauuagcugggcaugauggcacgcaccugcagucc

SEQ ID NO: 516958 - RNA, 62 nt, hsa
accugcagaguccagugaaaugauauauucuggcugggcacaguggcucacaccuguaaucc

SEQ ID NO: 516959 - RNA, 62 nt, hsa
cagcaaugcugaguucaagaaaaguacuucaggcugggcacaguggcucaugccugaaaucc

SEQ ID NO: 516960 - RNA, 62 nt, hsa
aaccccaucgcuacuaaaaauauaaaaaauuagcugggcaugguggcgcacgccuguaguuc

SEQ ID NO: 516961 - RNA, 62 nt, hsa
auccaccucgcuuuaaaaauaagcacaugauggcugggcaccguggcucacgccuguaaucc

SEQ ID NO: 516962 - RNA, 62 nt, hsa
uuuggaauuuccuggaugagaaggaagucugggcugggcaugguggcucacgccuguaaccc

SEQ ID NO: 516963 - RNA, 62 nt, hsa
aaaccccauuucuacaaaaaauacaaaaauuagcugggcaugguggcacccgccuguagucc

SEQ ID NO: 516964 - RNA, 62 nt, hsa
cauuguucuggaaaucuccaggcugcugggcagcugggcagagcucugggaagugaagucau

SEQ ID NO: 516965 - RNA, 62 nt, hsa
cuacuccccauuguucuggaaaucuccaggcugcugggcagcugggcagagcucugggaagu

SEQ ID NO: 516966 - RNA, 62 nt, hsa
aaaugccgucucuacuaaaaauacaaaaauuagcugggcaugauggcgagugucuguaaucc

SEQ ID NO: 516967 - RNA, 62 nt, hsa
uuuaaauaauuucuuuaaaagcguaagcuuuggcugggcaugguggcuuaugccuguaaucc

SEQ ID NO: 516968 - RNA, 62 nt, hsa
auguggcagugagggacgauggggugaagucagcugggcauucaaagaagcuagacugagaa

SEQ ID NO: 516969 - RNA, 62 nt, hsa
aaaccccaugucuacuaaaaauacaaaaauuagcugggcaugguggcacacacuuguagucc

SEQ ID NO: 516970 - RNA, 62 nt, hsa
uccaguuuuguuauuuuaacaaauuucucuaggcugggcaugguggcucaugccuauaaucc

SEQ ID NO: 516971 - RNA, 62 nt, hsa
gaccuuaucucuacaaaaaaauuuagaaauuagcugggcaugguggcacccaucuguagucc

SEQ ID NO: 516972 - RNA, 62 nt, hsa
aaaccccaucucuacuaaaaauacaaaaauuggcugggcaugguggcgggugccuguaaucc

SEQ ID NO: 516973 - RNA, 62 nt, hsa
guagggggcaggaagaggagcagaaaagaagggcugggcaaggcauaguggcuuaugccugu

SEQ ID NO: 516974 - RNA, 62 nt, hsa
gaaauccugucucuacuaaaaauauaaaauuagcugggcaugguggugcacaccugucgucu

SEQ ID NO: 516975 - RNA, 62 nt, hsa
ggcuaugacagugaugaggagguggacagcgagcugggcaccugggagcaccagcugcggcg

SEQ ID NO: 516976 - RNA, 62 nt, hsa
ucuccaccuucucuccacagaauguuugcagagcugggcaguugaggaaaggacagccccug

SEQ ID NO: 516977 - RNA, 62 nt, hsa
ccugggacuccuaucaggaagcuugacaggcagcugggcaucagugcagcugauaucguuug

SEQ ID NO: 516978 - RNA, 62 nt, hsa
uaccaggcuucgugggcacagacaccuccugggcugggcagagugacagugcuagaagaccc

SEQ ID NO: 516979 - RNA, 62 nt, hsa
cuggccggugugcuggaugcaugcccaagggugcugggcaucacugguccuugugaggaugc

SEQ ID NO: 516980 - RNA, 62 nt, hsa
ucugcugccacaugccguucccaugcccggcugcugggcaccugggagagcuuccagaaucc

SEQ ID NO: 516981 - RNA, 62 nt, hsa
ucugccacagcccugcauacugaccccgggaggcugggcagguggacagccccagccaccac

SEQ ID NO: 516982 - RNA, 62 nt, hsa
cccacucccugcacgccugccgucccugccccgcugggcagcccuucaguguggcuggcguu

SEQ ID NO: 516983 - RNA, 62 nt, hsa
ggcaaccguugucaaggcuaugcucacgggaggcugggcaccacaguguuuccaagagcaag

SEQ ID NO: 516984 - RNA, 62 nt, hsa
uccaagagagcuuaggaugacagcaccccugagcugggcaaagguacucaggaccucauagg

SEQ ID NO: 516985 - RNA, 64 nt, hsa; identical to SEQ ID NO: 196000

SEQ ID NO: 516986 - RNA, 64 nt, hsa; identical to SEQ ID NO: 196001

SEQ ID NO: 516987 - RNA, 64 nt, hsa; identical to SEQ ID NO: 196002

SEQ ID NO: 516988 - RNA, 64 nt, hsa; identical to SEQ ID NO: 196003

SEQ ID NO: 516989 - RNA, 64 nt, hsa; identical to SEQ ID NO: 196004

SEQ ID NO: 516990 - RNA, 64 nt, hsa; identical to SEQ ID NO: 196005

SEQ ID NO: 516991 - RNA, 64 nt, hsa; identical to SEQ ID NO: 196006

SEQ ID NO: 516992 - RNA, 64 nt, hsa; identical to SEQ ID NO: 196007

SEQ ID NO: 516993 - RNA, 64 nt, hsa; identical to SEQ ID NO: 196008

SEQ ID NO: 516994 - RNA, 64 nt, hsa; identical to SEQ ID NO: 196009

SEQ ID NO: 516995 - RNA, 64 nt, hsa; identical to SEQ ID NO: 196010

SEQ ID NO: 516996 - RNA, 64 nt, hsa; identical to SEQ ID NO: 196011

SEQ ID NO: 516997 - RNA, 64 nt, hsa; identical to SEQ ID NO: 196012

SEQ ID NO: 516998 - RNA, 64 nt, hsa; identical to SEQ ID NO: 196013

SEQ ID NO: 516999 - RNA, 64 nt, hsa; identical to SEQ ID NO: 196014

SEQ ID NO: 517000 - RNA, 64 nt, hsa; identical to SEQ ID NO: 196015

SEQ ID NO: 517001 - RNA, 64 nt, hsa; identical to SEQ ID NO: 196016

SEQ ID NO: 517002 - RNA, 64 nt, hsa; identical to SEQ ID NO: 196017

SEQ ID NO: 517003 - RNA, 64 nt, hsa; identical to SEQ ID NO: 196018

SEQ ID NO: 517004 - RNA, 64 nt, hsa; identical to SEQ ID NO: 196019

SEQ ID NO: 517005 - RNA, 64 nt, hsa; identical to SEQ ID NO: 196020

SEQ ID NO: 517006 - RNA, 64 nt, hsa; identical to SEQ ID NO: 196021

SEQ ID NO: 517007 - RNA, 64 nt, hsa; identical to SEQ ID NO: 196022

SEQ ID NO: 517008 - RNA, 64 nt, hsa; identical to SEQ ID NO: 196023

SEQ ID NO: 517009 - RNA, 64 nt, hsa; identical to SEQ ID NO: 196024

SEQ ID NO: 517010 - RNA, 64 nt, hsa; identical to SEQ ID NO: 196025

SEQ ID NO: 517011 - RNA, 64 nt, hsa; identical to SEQ ID NO: 196026

SEQ ID NO: 517012 - RNA, 64 nt, hsa; identical to SEQ ID NO: 196027

SEQ ID NO: 517013 - RNA, 64 nt, hsa; identical to SEQ ID NO: 196028

SEQ ID NO: 517014 - RNA, 64 nt, hsa; identical to SEQ ID NO: 196029

SEQ ID NO: 517015 - RNA, 64 nt, hsa; identical to SEQ ID NO: 196030

SEQ ID NO: 517016 - RNA, 64 nt, hsa; identical to SEQ ID NO: 196031

SEQ ID NO: 517017 - RNA, 64 nt, hsa
uugucaggcucucugucagcuuucauguacauaugguauagaaaccauggaguuaggcacuucc

SEQ ID NO: 517018 - RNA, 64 nt, hsa
uuggcuagugauucuuguuuucagaagggagagugguauagauagaaaaugacaaagauggcaa

SEQ ID NO: 517019 - RNA, 64 nt, hsa
uuaacaauaguuuauuauuguggcuuaaugggaagguauagaagcuaccugucauagccuccuu

SEQ ID NO: 517020 - RNA, 64 nt, hsa
ucaucuuuuccauugauuagcucagagaacuguagguauagacuucuuagaaagauaauuucau

SEQ ID NO: 517021 - RNA, 64 nt, hsa; identical to SEQ ID NO: 223226

SEQ ID NO: 517022 - RNA, 64 nt, hsa; identical to SEQ ID NO: 223227

SEQ ID NO: 517023 - RNA, 64 nt, hsa; identical to SEQ ID NO: 223228

SEQ ID NO: 517024 - RNA, 64 nt, hsa; identical to SEQ ID NO: 223229

SEQ ID NO: 517025 - RNA, 64 nt, hsa; identical to SEQ ID NO: 223230

SEQ ID NO: 517026 - RNA, 64 nt, hsa; identical to SEQ ID NO: 223231

SEQ ID NO: 517027 - RNA, 64 nt, hsa; identical to SEQ ID NO: 223232

SEQ ID NO: 517028 - RNA, 64 nt, hsa; identical to SEQ ID NO: 223233

SEQ ID NO: 517029 - RNA, 64 nt, hsa; identical to SEQ ID NO: 223234

SEQ ID NO: 517030 - RNA, 64 nt, hsa; identical to SEQ ID NO: 223235

SEQ ID NO: 517031 - RNA, 64 nt, hsa; identical to SEQ ID NO: 223236

SEQ ID NO: 517032 - RNA, 64 nt, hsa; identical to SEQ ID NO: 223237

SEQ ID NO: 517033 - RNA, 64 nt, hsa; identical to SEQ ID NO: 223238

SEQ ID NO: 517034 - RNA, 64 nt, hsa; identical to SEQ ID NO: 223239

SEQ ID NO: 517035 - RNA, 64 nt, hsa; identical to SEQ ID NO: 223240

SEQ ID NO: 517036 - RNA, 64 nt, hsa; identical to SEQ ID NO: 223241

SEQ ID NO: 517037 - RNA, 64 nt, hsa; identical to SEQ ID NO: 223242

SEQ ID NO: 517038 - RNA, 64 nt, hsa; identical to SEQ ID NO: 223243

SEQ ID NO: 517039 - RNA, 64 nt, hsa; identical to SEQ ID NO: 223244

SEQ ID NO: 517040 - RNA, 64 nt, hsa; identical to SEQ ID NO: 223245

SEQ ID NO: 517041 - RNA, 64 nt, hsa; identical to SEQ ID NO: 223246

SEQ ID NO: 517042 - RNA, 64 nt, hsa; identical to SEQ ID NO: 223247

SEQ ID NO: 517043 - RNA, 64 nt, hsa; identical to SEQ ID NO: 223248

SEQ ID NO: 517044 - RNA, 64 nt, hsa; identical to SEQ ID NO: 223249

SEQ ID NO: 517045 - RNA, 64 nt, hsa; identical to SEQ ID NO: 223250

SEQ ID NO: 517046 - RNA, 64 nt, hsa; identical to SEQ ID NO: 223251

SEQ ID NO: 517047 - RNA, 64 nt, hsa; identical to SEQ ID NO: 223252

SEQ ID NO: 517048 - RNA, 64 nt, hsa; identical to SEQ ID NO: 223253

SEQ ID NO: 517049 - RNA, 64 nt, hsa; identical to SEQ ID NO: 223254

SEQ ID NO: 517050 - RNA, 64 nt, hsa; identical to SEQ ID NO: 223255

SEQ ID NO: 517051 - RNA, 64 nt, hsa; identical to SEQ ID NO: 223256

SEQ ID NO: 517052 - RNA, 64 nt, hsa; identical to SEQ ID NO: 223257

SEQ ID NO: 517053 - RNA, 64 nt, hsa; identical to SEQ ID NO: 223258

SEQ ID NO: 517054 - RNA, 64 nt, hsa; identical to SEQ ID NO: 223259

SEQ ID NO: 517055 - RNA, 64 nt, hsa; identical to SEQ ID NO: 223260

SEQ ID NO: 517056 - RNA, 64 nt, hsa; identical to SEQ ID NO: 223261

SEQ ID NO: 517057 - RNA, 64 nt, hsa; identical to SEQ ID NO: 223262

SEQ ID NO: 517058 - RNA, 64 nt, hsa; identical to SEQ ID NO: 223263

SEQ ID NO: 517059 - RNA, 64 nt, hsa; identical to SEQ ID NO: 223264

SEQ ID NO: 517060 - RNA, 64 nt, hsa; identical to SEQ ID NO: 223265

SEQ ID NO: 517061 - RNA, 64 nt, hsa; identical to SEQ ID NO: 223266

SEQ ID NO: 517062 - RNA, 64 nt, hsa; identical to SEQ ID NO: 223267

SEQ ID NO: 517063 - RNA, 64 nt, hsa; identical to SEQ ID NO: 223268

SEQ ID NO: 517064 - RNA, 64 nt, hsa; identical to SEQ ID NO: 223269

SEQ ID NO: 517065 - RNA, 64 nt, hsa; identical to SEQ ID NO: 223270

SEQ ID NO: 517066 - RNA, 64 nt, hsa; identical to SEQ ID NO: 223271

SEQ ID NO: 517067 - RNA, 64 nt, hsa; identical to SEQ ID NO: 223272

SEQ ID NO: 517068 - RNA, 64 nt, hsa; identical to SEQ ID NO: 223273

SEQ ID NO: 517069 - RNA, 64 nt, hsa; identical to SEQ ID NO: 223274

SEQ ID NO: 517070 - RNA, 64 nt, hsa; identical to SEQ ID NO: 223275

SEQ ID NO: 517071 - RNA, 64 nt, hsa; identical to SEQ ID NO: 223276

SEQ ID NO: 517072 - RNA, 64 nt, hsa; identical to SEQ ID NO: 223277

SEQ ID NO: 517073 - RNA, 64 nt, hsa; identical to SEQ ID NO: 223278

SEQ ID NO: 517074 - RNA, 64 nt, hsa; identical to SEQ ID NO: 223279

SEQ ID NO: 517075 - RNA, 64 nt, hsa; identical to SEQ ID NO: 223280

SEQ ID NO: 517076 - RNA, 64 nt, hsa; identical to SEQ ID NO: 223281

SEQ ID NO: 517077 - RNA, 64 nt, hsa; identical to SEQ ID NO: 223282

SEQ ID NO: 517078 - RNA, 64 nt, hsa; identical to SEQ ID NO: 223283

SEQ ID NO: 517079 - RNA, 64 nt, hsa; identical to SEQ ID NO: 223284

SEQ ID NO: 517080 - RNA, 64 nt, hsa; identical to SEQ ID NO: 223285

SEQ ID NO: 517081 - RNA, 64 nt, hsa; identical to SEQ ID NO: 223286

SEQ ID NO: 517082 - RNA, 64 nt, hsa; identical to SEQ ID NO: 223287

SEQ ID NO: 517083 - RNA, 64 nt, hsa; identical to SEQ ID NO: 223288

SEQ ID NO: 517084 - RNA, 64 nt, hsa; identical to SEQ ID NO: 223289

SEQ ID NO: 517085 - RNA, 64 nt, hsa; identical to SEQ ID NO: 223290

SEQ ID NO: 517086 - RNA, 64 nt, hsa; identical to SEQ ID NO: 223291

SEQ ID NO: 517087 - RNA, 64 nt, hsa; identical to SEQ ID NO: 223292

SEQ ID NO: 517088 - RNA, 64 nt, hsa; identical to SEQ ID NO: 223293

SEQ ID NO: 517089 - RNA, 64 nt, hsa; identical to SEQ ID NO: 223294

SEQ ID NO: 517090 - RNA, 64 nt, hsa; identical to SEQ ID NO: 223295

SEQ ID NO: 517091 - RNA, 64 nt, hsa; identical to SEQ ID NO: 223296

SEQ ID NO: 517092 - RNA, 64 nt, hsa; identical to SEQ ID NO: 223297

SEQ ID NO: 517093 - RNA, 64 nt, hsa; identical to SEQ ID NO: 223298

SEQ ID NO: 517094 - RNA, 64 nt, hsa; identical to SEQ ID NO: 223299

SEQ ID NO: 517095 - RNA, 64 nt, hsa; identical to SEQ ID NO: 223300

SEQ ID NO: 517096 - RNA, 64 nt, hsa; identical to SEQ ID NO: 223301

SEQ ID NO: 517097 - RNA, 64 nt, hsa; identical to SEQ ID NO: 223302

SEQ ID NO: 517098 - RNA, 64 nt, hsa; identical to SEQ ID NO: 223303

SEQ ID NO: 517099 - RNA, 64 nt, hsa; identical to SEQ ID NO: 223304

SEQ ID NO: 517100 - RNA, 64 nt, hsa; identical to SEQ ID NO: 223305

SEQ ID NO: 517101 - RNA, 64 nt, hsa; identical to SEQ ID NO: 223306

SEQ ID NO: 517102 - RNA, 64 nt, hsa; identical to SEQ ID NO: 223307

SEQ ID NO: 517103 - RNA, 64 nt, hsa; identical to SEQ ID NO: 223308

SEQ ID NO: 517104 - RNA, 64 nt, hsa; identical to SEQ ID NO: 223309

SEQ ID NO: 517105 - RNA, 64 nt, hsa; identical to SEQ ID NO: 223310

SEQ ID NO: 517106 - RNA, 64 nt, hsa; identical to SEQ ID NO: 223311

SEQ ID NO: 517107 - RNA, 64 nt, hsa; identical to SEQ ID NO: 223312

SEQ ID NO: 517108 - RNA, 64 nt, hsa; identical to SEQ ID NO: 223313

SEQ ID NO: 517109 - RNA, 64 nt, hsa; identical to SEQ ID NO: 223314

SEQ ID NO: 517110 - RNA, 64 nt, hsa; identical to SEQ ID NO: 223315

SEQ ID NO: 517111 - RNA, 64 nt, hsa; identical to SEQ ID NO: 223316

SEQ ID NO: 517112 - RNA, 64 nt, hsa; identical to SEQ ID NO: 223317

SEQ ID NO: 517113 - RNA, 64 nt, hsa; identical to SEQ ID NO: 223318

SEQ ID NO: 517114 - RNA, 64 nt, hsa; identical to SEQ ID NO: 223319

SEQ ID NO: 517115 - RNA, 64 nt, hsa; identical to SEQ ID NO: 223320

SEQ ID NO: 517116 - RNA, 64 nt, hsa; identical to SEQ ID NO: 223321

SEQ ID NO: 517117 - RNA, 64 nt, hsa; identical to SEQ ID NO: 223322

SEQ ID NO: 517118 - RNA, 64 nt, hsa; identical to SEQ ID NO: 223323

SEQ ID NO: 517119 - RNA, 64 nt, hsa; identical to SEQ ID NO: 223324

SEQ ID NO: 517120 - RNA, 64 nt, hsa; identical to SEQ ID NO: 223325

SEQ ID NO: 517121 - RNA, 64 nt, hsa; identical to SEQ ID NO: 223326

SEQ ID NO: 517122 - RNA, 64 nt, hsa; identical to SEQ ID NO: 223327

SEQ ID NO: 517123 - RNA, 64 nt, hsa; identical to SEQ ID NO: 223328

SEQ ID NO: 517124 - RNA, 64 nt, hsa; identical to SEQ ID NO: 223329

SEQ ID NO: 517125 - RNA, 64 nt, hsa; identical to SEQ ID NO: 223330

SEQ ID NO: 517126 - RNA, 64 nt, hsa; identical to SEQ ID NO: 223331

SEQ ID NO: 517127 - RNA, 64 nt, hsa; identical to SEQ ID NO: 223332

SEQ ID NO: 517128 - RNA, 64 nt, hsa; identical to SEQ ID NO: 223333

SEQ ID NO: 517129 - RNA, 64 nt, hsa; identical to SEQ ID NO: 223334

SEQ ID NO: 517130 - RNA, 64 nt, hsa; identical to SEQ ID NO: 223335

SEQ ID NO: 517131 - RNA, 64 nt, hsa; identical to SEQ ID NO: 223336

SEQ ID NO: 517132 - RNA, 64 nt, hsa; identical to SEQ ID NO: 223337

SEQ ID NO: 517133 - RNA, 64 nt, hsa; identical to SEQ ID NO: 223338

SEQ ID NO: 517134 - RNA, 64 nt, hsa; identical to SEQ ID NO: 223339

SEQ ID NO: 517135 - RNA, 64 nt, hsa; identical to SEQ ID NO: 223340

SEQ ID NO: 517136 - RNA, 64 nt, hsa; identical to SEQ ID NO: 223341

SEQ ID NO: 517137 - RNA, 64 nt, hsa; identical to SEQ ID NO: 223342

SEQ ID NO: 517138 - RNA, 64 nt, hsa; identical to SEQ ID NO: 223343

SEQ ID NO: 517139 - RNA, 64 nt, hsa; identical to SEQ ID NO: 223344

SEQ ID NO: 517140 - RNA, 64 nt, hsa; identical to SEQ ID NO: 223345

SEQ ID NO: 517141 - RNA, 64 nt, hsa; identical to SEQ ID NO: 223346

SEQ ID NO: 517142 - RNA, 64 nt, hsa; identical to SEQ ID NO: 223347

SEQ ID NO: 517143 - RNA, 64 nt, hsa; identical to SEQ ID NO: 223348

SEQ ID NO: 517144 - RNA, 64 nt, hsa; identical to SEQ ID NO: 223349

SEQ ID NO: 517145 - RNA, 64 nt, hsa; identical to SEQ ID NO: 223350

SEQ ID NO: 517146 - RNA, 64 nt, hsa; identical to SEQ ID NO: 223351

SEQ ID NO: 517147 - RNA, 64 nt, hsa; identical to SEQ ID NO: 223352

SEQ ID NO: 517148 - RNA, 64 nt, hsa; identical to SEQ ID NO: 223353

SEQ ID NO: 517149 - RNA, 64 nt, hsa; identical to SEQ ID NO: 223354

SEQ ID NO: 517150 - RNA, 64 nt, hsa; identical to SEQ ID NO: 223355

SEQ ID NO: 517151 - RNA, 64 nt, hsa; identical to SEQ ID NO: 223356

SEQ ID NO: 517152 - RNA, 64 nt, hsa; identical to SEQ ID NO: 223357

SEQ ID NO: 517153 - RNA, 64 nt, hsa; identical to SEQ ID NO: 223358

SEQ ID NO: 517154 - RNA, 64 nt, hsa; identical to SEQ ID NO: 223359

SEQ ID NO: 517155 - RNA, 64 nt, hsa; identical to SEQ ID NO: 223360

SEQ ID NO: 517156 - RNA, 64 nt, hsa; identical to SEQ ID NO: 223361

SEQ ID NO: 517157 - RNA, 64 nt, hsa; identical to SEQ ID NO: 223362

SEQ ID NO: 517158 - RNA, 64 nt, hsa; identical to SEQ ID NO: 223363

SEQ ID NO: 517159 - RNA, 64 nt, hsa; identical to SEQ ID NO: 223364

SEQ ID NO: 517160 - RNA, 64 nt, hsa; identical to SEQ ID NO: 223365

SEQ ID NO: 517161 - RNA, 64 nt, hsa; identical to SEQ ID NO: 223366

SEQ ID NO: 517162 - RNA, 64 nt, hsa; identical to SEQ ID NO: 223367

SEQ ID NO: 517163 - RNA, 64 nt, hsa; identical to SEQ ID NO: 223368

SEQ ID NO: 517164 - RNA, 64 nt, hsa; identical to SEQ ID NO: 223369

SEQ ID NO: 517165 - RNA, 64 nt, hsa; identical to SEQ ID NO: 223370

SEQ ID NO: 517166 - RNA, 64 nt, hsa; identical to SEQ ID NO: 223371

SEQ ID NO: 517167 - RNA, 64 nt, hsa; identical to SEQ ID NO: 223372

SEQ ID NO: 517168 - RNA, 64 nt, hsa; identical to SEQ ID NO: 223373

SEQ ID NO: 517169 - RNA, 64 nt, hsa; identical to SEQ ID NO: 223374

SEQ ID NO: 517170 - RNA, 64 nt, hsa; identical to SEQ ID NO: 223375

SEQ ID NO: 517171 - RNA, 64 nt, hsa; identical to SEQ ID NO: 223376

SEQ ID NO: 517172 - RNA, 64 nt, hsa; identical to SEQ ID NO: 223377

SEQ ID NO: 517173 - RNA, 64 nt, hsa; identical to SEQ ID NO: 223378

SEQ ID NO: 517174 - RNA, 64 nt, hsa; identical to SEQ ID NO: 223379

SEQ ID NO: 517175 - RNA, 64 nt, hsa; identical to SEQ ID NO: 223380

SEQ ID NO: 517176 - RNA, 64 nt, hsa; identical to SEQ ID NO: 223381

SEQ ID NO: 517177 - RNA, 64 nt, hsa; identical to SEQ ID NO: 223382

SEQ ID NO: 517178 - RNA, 64 nt, hsa; identical to SEQ ID NO: 223383

SEQ ID NO: 517179 - RNA, 64 nt, hsa; identical to SEQ ID NO: 223384

SEQ ID NO: 517180 - RNA, 64 nt, hsa; identical to SEQ ID NO: 223385

SEQ ID NO: 517181 - RNA, 64 nt, hsa; identical to SEQ ID NO: 223386

SEQ ID NO: 517182 - RNA, 64 nt, hsa; identical to SEQ ID NO: 223387

SEQ ID NO: 517183 - RNA, 64 nt, hsa; identical to SEQ ID NO: 223388

SEQ ID NO: 517184 - RNA, 64 nt, hsa; identical to SEQ ID NO: 223389

SEQ ID NO: 517185 - RNA, 64 nt, hsa; identical to SEQ ID NO: 223390

SEQ ID NO: 517186 - RNA, 64 nt, hsa; identical to SEQ ID NO: 223391

SEQ ID NO: 517187 - RNA, 64 nt, hsa; identical to SEQ ID NO: 223392

SEQ ID NO: 517188 - RNA, 64 nt, hsa; identical to SEQ ID NO: 223393

SEQ ID NO: 517189 - RNA, 64 nt, hsa; identical to SEQ ID NO: 223394

SEQ ID NO: 517190 - RNA, 64 nt, hsa; identical to SEQ ID NO: 223395

SEQ ID NO: 517191 - RNA, 64 nt, hsa; identical to SEQ ID NO: 223396

SEQ ID NO: 517192 - RNA, 64 nt, hsa; identical to SEQ ID NO: 223397

SEQ ID NO: 517193 - RNA, 64 nt, hsa; identical to SEQ ID NO: 223398

SEQ ID NO: 517194 - RNA, 64 nt, hsa; identical to SEQ ID NO: 223399

SEQ ID NO: 517195 - RNA, 64 nt, hsa; identical to SEQ ID NO: 223400

SEQ ID NO: 517196 - RNA, 64 nt, hsa; identical to SEQ ID NO: 223401

SEQ ID NO: 517197 - RNA, 64 nt, hsa; identical to SEQ ID NO: 223402

SEQ ID NO: 517198 - RNA, 56 nt, hsa; identical to SEQ ID NO: 223403

SEQ ID NO: 517199 - RNA, 51 nt, hsa; identical to SEQ ID NO: 223404

SEQ ID NO: 517200 - RNA, 64 nt, hsa; identical to SEQ ID NO: 223405

SEQ ID NO: 517201 - RNA, 64 nt, hsa; identical to SEQ ID NO: 223406

SEQ ID NO: 517202 - RNA, 64 nt, hsa; identical to SEQ ID NO: 223407

SEQ ID NO: 517203 - RNA, 64 nt, hsa; identical to SEQ ID NO: 223408

SEQ ID NO: 517204 - RNA, 64 nt, hsa; identical to SEQ ID NO: 223409

SEQ ID NO: 517205 - RNA, 64 nt, hsa; identical to SEQ ID NO: 223410

SEQ ID NO: 517206 - RNA, 64 nt, hsa; identical to SEQ ID NO: 223411

SEQ ID NO: 517207 - RNA, 64 nt, hsa; identical to SEQ ID NO: 223412

SEQ ID NO: 517208 - RNA, 64 nt, hsa; identical to SEQ ID NO: 223413

SEQ ID NO: 517209 - RNA, 64 nt, hsa; identical to SEQ ID NO: 223414

SEQ ID NO: 517210 - RNA, 64 nt, hsa; identical to SEQ ID NO: 223415

SEQ ID NO: 517211 - RNA, 64 nt, hsa; identical to SEQ ID NO: 223416

SEQ ID NO: 517212 - RNA, 64 nt, hsa; identical to SEQ ID NO: 223417

SEQ ID NO: 517213 - RNA, 64 nt, hsa; identical to SEQ ID NO: 223418

SEQ ID NO: 517214 - RNA, 64 nt, hsa; identical to SEQ ID NO: 223419

SEQ ID NO: 517215 - RNA, 64 nt, hsa; identical to SEQ ID NO: 223420

SEQ ID NO: 517216 - RNA, 64 nt, hsa; identical to SEQ ID NO: 223421

SEQ ID NO: 517217 - RNA, 64 nt, hsa; identical to SEQ ID NO: 223422

SEQ ID NO: 517218 - RNA, 64 nt, hsa; identical to SEQ ID NO: 223423

SEQ ID NO: 517219 - RNA, 64 nt, hsa; identical to SEQ ID NO: 223424

SEQ ID NO: 517220 - RNA, 64 nt, hsa; identical to SEQ ID NO: 223425

SEQ ID NO: 517221 - RNA, 64 nt, hsa; identical to SEQ ID NO: 223426

SEQ ID NO: 517222 - RNA, 64 nt, hsa; identical to SEQ ID NO: 223427

SEQ ID NO: 517223 - RNA, 64 nt, hsa; identical to SEQ ID NO: 223428

SEQ ID NO: 517224 - RNA, 64 nt, hsa; identical to SEQ ID NO: 223429

SEQ ID NO: 517225 - RNA, 64 nt, hsa; identical to SEQ ID NO: 223430

SEQ ID NO: 517226 - RNA, 64 nt, hsa; identical to SEQ ID NO: 223431

SEQ ID NO: 517227 - RNA, 64 nt, hsa; identical to SEQ ID NO: 223432

SEQ ID NO: 517228 - RNA, 64 nt, hsa; identical to SEQ ID NO: 223433

SEQ ID NO: 517229 - RNA, 64 nt, hsa; identical to SEQ ID NO: 223434

SEQ ID NO: 517230 - RNA, 64 nt, hsa; identical to SEQ ID NO: 223435

SEQ ID NO: 517231 - RNA, 64 nt, hsa; identical to SEQ ID NO: 223436

SEQ ID NO: 517232 - RNA, 64 nt, hsa; identical to SEQ ID NO: 223437

SEQ ID NO: 517233 - RNA, 64 nt, hsa; identical to SEQ ID NO: 223438

SEQ ID NO: 517234 - RNA, 64 nt, hsa; identical to SEQ ID NO: 223439

SEQ ID NO: 517235 - RNA, 64 nt, hsa; identical to SEQ ID NO: 223440

SEQ ID NO: 517236 - RNA, 64 nt, hsa; identical to SEQ ID NO: 223441

SEQ ID NO: 517237 - RNA, 64 nt, hsa; identical to SEQ ID NO: 223442

SEQ ID NO: 517238 - RNA, 64 nt, hsa; identical to SEQ ID NO: 223443

SEQ ID NO: 517239 - RNA, 64 nt, hsa; identical to SEQ ID NO: 223444

SEQ ID NO: 517240 - RNA, 64 nt, hsa; identical to SEQ ID NO: 223445

SEQ ID NO: 517241 - RNA, 64 nt, hsa; identical to SEQ ID NO: 223446

SEQ ID NO: 517242 - RNA, 64 nt, hsa; identical to SEQ ID NO: 223447

SEQ ID NO: 517243 - RNA, 64 nt, hsa; identical to SEQ ID NO: 223448

SEQ ID NO: 517244 - RNA, 64 nt, hsa; identical to SEQ ID NO: 223449

SEQ ID NO: 517245 - RNA, 64 nt, hsa; identical to SEQ ID NO: 223450

SEQ ID NO: 517246 - RNA, 64 nt, hsa; identical to SEQ ID NO: 223451

SEQ ID NO: 517247 - RNA, 64 nt, hsa; identical to SEQ ID NO: 223452

SEQ ID NO: 517248 - RNA, 64 nt, hsa; identical to SEQ ID NO: 223453

SEQ ID NO: 517249 - RNA, 64 nt, hsa; identical to SEQ ID NO: 223454

SEQ ID NO: 517250 - RNA, 64 nt, hsa; identical to SEQ ID NO: 223455

SEQ ID NO: 517251 - RNA, 64 nt, hsa; identical to SEQ ID NO: 223456

SEQ ID NO: 517252 - RNA, 64 nt, hsa; identical to SEQ ID NO: 223457

SEQ ID NO: 517253 - RNA, 64 nt, hsa; identical to SEQ ID NO: 223458

SEQ ID NO: 517254 - RNA, 64 nt, hsa; identical to SEQ ID NO: 332183

SEQ ID NO: 517255 - RNA, 64 nt, hsa; identical to SEQ ID NO: 332184

SEQ ID NO: 517256 - RNA, 64 nt, hsa; identical to SEQ ID NO: 332185

SEQ ID NO: 517257 - RNA, 64 nt, hsa; identical to SEQ ID NO: 332186

SEQ ID NO: 517258 - RNA, 64 nt, hsa; identical to SEQ ID NO: 332187

SEQ ID NO: 517259 - RNA, 64 nt, hsa; identical to SEQ ID NO: 332188

SEQ ID NO: 517260 - RNA, 64 nt, hsa; identical to SEQ ID NO: 332189

SEQ ID NO: 517261 - RNA, 64 nt, hsa; identical to SEQ ID NO: 332190

SEQ ID NO: 517262 - RNA, 64 nt, hsa; identical to SEQ ID NO: 332191

SEQ ID NO: 517263 - RNA, 64 nt, hsa; identical to SEQ ID NO: 332192

SEQ ID NO: 517264 - RNA, 64 nt, hsa; identical to SEQ ID NO: 332193

SEQ ID NO: 517265 - RNA, 64 nt, hsa; identical to SEQ ID NO: 332194

SEQ ID NO: 517266 - RNA, 64 nt, hsa
ucgggggcugggagauguuccuggaggaggacacucccaucagaacuuggcagccuugaaguug

SEQ ID NO: 517267 - RNA, 64 nt, hsa
ccgcugggggccugaagacauuccuggaggacacucccaucagaaccuggcagccccaaaacug

SEQ ID NO: 517268 - RNA, 64 nt, hsa
guuguuauagucuucacucauagacuuaagaugaucccaucaccagagagguuucucuaccauu

SEQ ID NO: 517269 - RNA, 64 nt, hsa
auugcaucuuggguccauaaacccuaauccauaaucccaucaagaaaagcucugcugcucuuag

SEQ ID NO: 517270 - RNA, 64 nt, hsa
cuggagauaaccauaguugcuauuuugcugccugucccaucagucguuuaucuguuguuugaga

SEQ ID NO: 517271 - RNA, 64 nt, hsa
uuagaauaucuaagaaucuuuguuagauauuaggucccaucaauucuuagaauaucuaaacauc

SEQ ID NO: 517272 - RNA, 64 nt, hsa
uucuuaaugacauuucacugaugcuucuaucaggucccaucaauucuuagaauaucuaagaauc

SEQ ID NO: 517273 - RNA, 64 nt, hsa
uaaucccaccuuuuggcccuaaauuguuuuuuguucccaucaguuucaggccaggacuggagag

SEQ ID NO: 517274 - RNA, 64 nt, hsa
uuccuuccagucaggguguguccuauacaaaacuucccaucaguucuccucaauauuccccauu

SEQ ID NO: 517275 - RNA, 64 nt, hsa
ccauugaggagcuucaucuguauuuauggcuacuucccaucacucgaauuaccaccugaacucc

SEQ ID NO: 517276 - RNA, 64 nt, hsa
uuuuuuaaaucaagacuuuuaaaacuggauuuccucccaucacuguuuuuugaagguccuccaa

SEQ ID NO: 517277 - RNA, 64 nt, hsa
aagcaguuacugaacauccaggaguacaacuccuucccaucauucccauguggaagggucucuc

SEQ ID NO: 517278 - RNA, 64 nt, hsa
acuccuucccaucauucccauguggaagggucucucccaucaaggagaacauguggcaucucug

SEQ ID NO: 517279 - RNA, 64 nt, hsa
cuacuggccaaguucaagugaguaagccgcgucccccaacuacagcuggagacggggccagcuc

SEQ ID NO: 517280 - RNA, 64 nt, hsa
acgugcugacggcaaggggcaauggagugaguuucccaacuaagaaaccacuauuauauauuuu

SEQ ID NO: 517281 - RNA, 64 nt, hsa
gaccagcacagaacugaggaacaucugcaggaggcccaacuagugaaaggcuuugccuccgggg

SEQ ID NO: 517282 - RNA, 64 nt, hsa
auguggcagcccauggguaugacauaggccaaggcccaacuaacagucaagaaacagcuccucg

SEQ ID NO: 517283 - RNA, 64 nt, hsa
uaucuuuuuaaucauaaucaacaucaguuuuugacccaacuaaccuugacuguauucaaacuua

SEQ ID NO: 517284 - RNA, 64 nt, hsa
uuacuuauuguuuuuagaauuacuuuuacauuuucccaacuagauggccuagaguccaacauua

SEQ ID NO: 517285 - RNA, 64 nt, hsa
aaauuagcugggcaugguggccugugccuauagucccaacuacuuagaggaggaucgcuugauc

SEQ ID NO: 517286 - RNA, 64 nt, hsa
ugcauuuaaaaggaauaaccuccuucucccuuuccccaacuacaaaaauguuuggcaacuuugu

SEQ ID NO: 517287 - RNA, 64 nt, hsa
aaauuagcuggacaugguggcaaucagcucuagucccaacuacuuggaggcugaagcaggaaga

SEQ ID NO: 517288 - RNA, 64 nt, hsa
agggaaguuuauaauagccuaacacuaccccacccccaacuaggaggaaccucuguuuucaaga

SEQ ID NO: 517289 - RNA, 64 nt, hsa
acucucaaaaauaaucuuaaauacugcaaauagucccaacuaagauucagucaguauguuuguu

SEQ ID NO: 517290 - RNA, 64 nt, hsa
gccuagaguggcaaauggaacuucucugaucucccccaacuagacuggagcccccgaaggaugg

SEQ ID NO: 517291 - RNA, 64 nt, hsa
aauuuagcugggcaugguggcaugugccuguaaucccaacuacuagggacagugaggcagaagg

SEQ ID NO: 517292 - RNA, 64 nt, hsa
ccuccagggcucaaggauccuccugccucagucucccaacuaagugggacuacaggcacgugcc

SEQ ID NO: 517293 - RNA, 64 nt, hsa
uaaagaaaagacgaauauuuaaggugacagauaucccaacuacgcugauuugaucuuuacaaau

SEQ ID NO: 517294 - RNA, 64 nt, hsa
ggauuacaggcgugagccaccgugccuggccacgcccaacuaauuuuuguauuuuuaguagaga

SEQ ID NO: 517295 - RNA, 64 nt, hsa
agauuucuaaaauauucuaugugugauuucuguucccaacuagguucuaagugccaucaaagca

SEQ ID NO: 517296 - RNA, 64 nt, hsa
cauuuaaccccuugguacugaaaaugagaaaauccccaacuaugcaugccaagggguuaaugaa

SEQ ID NO: 517297 - RNA, 64 nt, hsa
gcauuucauuuaagauaaggcucauauaguauuacccaacuaguugguaaugugauuauguggu

SEQ ID NO: 517298 - RNA, 55 nt, hsa; identical to SEQ ID NO: 130216

SEQ ID NO: 517299 - RNA, 64 nt, hsa
uuuuuuaaaaaggaucacgucuaaugcccauuuucccaacuauucuuuccaaaguaagauauaa

SEQ ID NO: 517300 - RNA, 64 nt, hsa
aaauuagcugggcaugguggcauauaccuguaaccccaacuacuuggguggcugaggcaggaga

SEQ ID NO: 517301 - RNA, 64 nt, hsa
ccugaguagcuggauuacaggcaugugccacccacccaacuaauuuuuguguuuuuaauaaaga

SEQ ID NO: 517302 - RNA, 64 nt, hsa
gguuuagaaagaggaacaccagauugaccacauucccaacuagaaaaaucuucuugcgucaauc

SEQ ID NO: 517303 - RNA, 64 nt, hsa
aaauuagccaagugugguggcauaugccuguaaucccaacuacucagaaggccgaggcaggaga

SEQ ID NO: 517304 - RNA, 64 nt, hsa
cagcuuuggaagcugucaaucccggagcaacuuucccaacuacccaaccccaccauggccagga

SEQ ID NO: 517305 - RNA, 64 nt, hsa
ggacacaggagcuccuccaggagcaggcugggaucccaacuaucgcuuguugccucuuuuucaa

SEQ ID NO: 517306 - RNA, 64 nt, hsa
aaauuagccaggugugguggcgggcgccuguaaucccaacuacucaggaggcugaggcuagaga

SEQ ID NO: 517307 - RNA, 64 nt, hsa
ccacccacaccuaagucacagaauuucuaaguuccccaacuacucucacacccuuuuaaagaua

SEQ ID NO: 517308 - RNA, 64 nt, hsa
gccccugcacacucccacccaggacagcccccagcccaacuaggaaagggccaugggcagaggg

SEQ ID NO: 517309 - RNA, 64 nt, hsa
aagagcaugguccuucagaaaaggcaauaaacggcccaacuagugcuucuggcgaugacauuuc

SEQ ID NO: 517310 - RNA, 64 nt, hsa
ggggcagcagcgcccccacggggcucgcugggcgcccaacuacgacccgcucugcucacucugc

SEQ ID NO: 517311 - RNA, 64 nt, hsa
ggguccaggaccagaccucucuacaaaaaauugccccaacuacaguuugcaaccccaaaccaca

SEQ ID NO: 517312 - RNA, 64 nt, hsa
cuggugggcccagguccuuguaucaugccacggucccaacuacaggguccuagcugggggccug

SEQ ID NO: 517313 - RNA, 64 nt, hsa
uuucauuucagggcauagucaaaggcaucauccucccaacuacccacuugauuauguauuucag

SEQ ID NO: 517314 - RNA, 64 nt, hsa
caaccaccuuuccagccauagagauuuuaauuagcccaacuagaagccuagugugugugcuuuc

SEQ ID NO: 517315 - RNA, 64 nt, hsa
gcugcaguucuacaggcuacaccgggaagaaaggcccaacuaccgucucgagugccugcagugg

SEQ ID NO: 517316 - RNA, 64 nt, hsa
uugaguauauauuuuaucucuuauaccuguaucucccaacuagaaacagcuccaguguuuuuaa

SEQ ID NO: 517317 - RNA, 64 nt, hsa
uagugaugcccuucaccccagggaggugucuguucccaacuaguuuauguggcacugagacauc

SEQ ID NO: 517318 - RNA, 64 nt, hsa
uaggguaucgcauacucaaaugguagacaaugaccccaacuaaaucuuccugauguuacacugc

SEQ ID NO: 517319 - RNA, 64 nt, hsa
acagccaaauagcuuauaaggcuuauggcaaugucccaacuauugcaaucauaaaacccuaguu

SEQ ID NO: 517320 - RNA, 64 nt, hsa
ugugauuaauuauugaaagugggguguugaagaccccaacuacuauuguagaguggucuauuuc

SEQ ID NO: 517321 - RNA, 64 nt, hsa
aguuaggaagugauaaaacaucucucuucuccuucccaacuacugcaugaagaaauucuacuuc

SEQ ID NO: 517322 - RNA, 64 nt, hsa
guaacauuccuucaaccacuugaagauccaaauucccaacuaguauucucuucuccacacuuaa

SEQ ID NO: 517323 - RNA, 64 nt, hsa
cugcgccucuggacgugcuagccauuuccagugucccaacuacugucaucgugagguuuucauc

SEQ ID NO: 517324 - RNA, 64 nt, hsa
aaauuagcugggcgugguggcgcaugccuguagucccaacuacuagggaggcugaggcaggaga

SEQ ID NO: 517325 - RNA, 64 nt, hsa
aauccagugaccucucucucugggacuugguuuccccaacuaaaauuugaaguaguugaauggg

SEQ ID NO: 517326 - RNA, 64 nt, hsa
uuuuuuccuuuuagccaucuuuuguucuuguaaucccaacuagauaggcuuuaugcucacauca

SEQ ID NO: 517327 - RNA, 64 nt, hsa
caaguaacuaagacuacaggcaugcaccaccauacccaacuaauuuuauuuuuuauuuuuugca

SEQ ID NO: 517328 - RNA, 64 nt, hsa
uaauagccaggggcuacaggcauauaccaccaugcccaacuaauuuuuuaauuuuuuguagaga

SEQ ID NO: 517329 - RNA, 64 nt, hsa
caucacguugacauuagaccaaauacuuuugauucccaacuacucguuuguucuuuuucuccuu

SEQ ID NO: 517330 - RNA, 64 nt, hsa
ugcauuuaguugaaugaagucuucuuggauuucacccaacuaaaaggauuuuuaaaaauaaaua

SEQ ID NO: 517331 - RNA, 64 nt, hsa
aaauaagccaggugugguggugcaugacuguaaucccaacuacucagcaggagaagcacuugaa

SEQ ID NO: 517332 - RNA, 64 nt, hsa
uuuuuuuuuuugagacggagucccacucuugucgcccaacuagaguguaguggcacaaucucgg

SEQ ID NO: 517333 - RNA, 64 nt, hsa
uccuuaacugucccaucugugcagaguccauugccccaacuagacugugagcuccuccucugag

SEQ ID NO: 517334 - RNA, 64 nt, hsa
cugccugguacuggugggggaaauaguccguauccccaacuauuaaggauuugucccaggccaa

SEQ ID NO: 517335 - RNA, 64 nt, hsa
uggguuuuguucccccuccaucucgauucucguacccaacuaaaaaaaaaaaaauaaagaaaaa

SEQ ID NO: 517336 - RNA, 64 nt, hsa
ucccaccaugaagagaaagcaaacaaacagaaaccccaacuaggucacaccauuuuucuucuug

SEQ ID NO: 517337 - RNA, 64 nt, hsa
ucuccucuucuugaaggccaaccuggagcaguuccccaacuacaccccgccuccccucaucugc

SEQ ID NO: 517338 - RNA, 64 nt, hsa
uaugauaucaaaagaauaaucaauuuaguuaccucccaacuaaaaaguaaaaaugaaaaagacg

SEQ ID NO: 517339 - RNA, 64 nt, hsa
ucagaaaacucaguuucuuuauuccuucuuuucucccaacuacuguuacugguuauagaggucu

SEQ ID NO: 517340 - RNA, 64 nt, hsa
ugaugugaaaaaggacuauggccacauucaaucgcccaacuacccagacgauuaccggcccagc

SEQ ID NO: 517341 - RNA, 64 nt, hsa
ugagaagaaaacaucuauucucuccaaaaaugcacccaacuagcucuauguuuacaaauggaca

SEQ ID NO: 517342 - RNA, 64 nt, hsa
uauuaaaguuuguguguuguguccauuuugcaaacccaacuaagccaggaccccaaugcgacaa

SEQ ID NO: 517343 - RNA, 64 nt, hsa
ucacacacgcccacaugacaaucaucugaaaguccccaacuauacacauucuguucaaccaacu

SEQ ID NO: 517344 - RNA, 64 nt, hsa
auuugcauuaaauuacagaaauuuaauucagaaccccaacuacuguguuaugcaaaagcaagcu

SEQ ID NO: 517345 - RNA, 64 nt, hsa
ugucucugaagacaaauaauuaaaccuuuuuuuucccaacuaaagaauggauuuaauuaaacua

SEQ ID NO: 517346 - RNA, 64 nt, hsa
agccaggauugauggcagcugagggaaauucuugcccaacuaaacccagaacucaaacuuaaca

SEQ ID NO: 517347 - RNA, 64 nt, hsa
ucagucacugugcuauccuuguggagucuuguggcccaacuaccagagaacgcugucccccgac

SEQ ID NO: 517348 - RNA, 64 nt, hsa
ugugacugauucccagccuguggcagggcguggucccaacuacucagccuagcacaggcuggca

SEQ ID NO: 517349 - RNA, 64 nt, hsa
gagaggagaaaauuaauaaaucuuaaacuuggugcccaacuauuguaagaaauauuuaauuaca

SEQ ID NO: 517350 - RNA, 64 nt, hsa
uccgacuucuccuaugugucacuuauuccaagaacccaacuaugcccuuagguagaaagauuug

SEQ ID NO: 517351 - RNA, 64 nt, hsa
aaauuagccaggcgugacggugcgugccuguagucccaacuacucggaaggcugaggcaggaga

SEQ ID NO: 517352 - RNA, 64 nt, hsa
uguagauauguuugaauauagaaacuuuuuuuaccccaacuacugaauccaggaguaccaaaua

SEQ ID NO: 517353 - RNA, 64 nt, hsa
aggauuacagcgugaucuaccacaccuggccaaucccaacuacucuggaagcugaagcagcaag

SEQ ID NO: 517354 - RNA, 64 nt, hsa
gcuuucugaucaaggccuuauuggaaagcagucccccaacuacccccagcugugcuuaugguac

SEQ ID NO: 517355 - RNA, 64 nt, hsa
uacugacccugccuugggccuugcugcugcugcacccaacuacugagcugagaccacugaguac

SEQ ID NO: 517356 - RNA, 64 nt, hsa
caaguagcugggauuacaggcacccaccaccaugcccaacuaauuuuuguauuuuuauagagau

SEQ ID NO: 517357 - RNA, 64 nt, hsa
caggccagccccaucuugguccugucacccuggccccaacuauuaaagugccauuuccugucug

SEQ ID NO: 517358 - RNA, 64 nt, hsa
aacacuuaggacuagaagauuagaaacuaccaaucccaacuacguaauaggaaaauguaggauc

SEQ ID NO: 517359 - RNA, 64 nt, hsa
uaccugcauuucccacaugacuuucuggaagccucccaacuauucuugcuuuucccagacagcu

SEQ ID NO: 517360 - RNA, 64 nt, hsa
ccuggaaaucccugcccuguucagccccacagcucccaacuauuugguuccugcuccauggucg

SEQ ID NO: 517361 - RNA, 64 nt, hsa
ccucagcugccuccccagcucuaucccaaccucucccaacuauaaaacuaggugcugcagcccc

SEQ ID NO: 517362 - RNA, 64 nt, hsa
gaaaaagcuauuuucauugguacauuuaaagucccccaacuauggggagguaccaauucuggac

SEQ ID NO: 517363 - RNA, 64 nt, hsa
accucauccggggcuuuggauagagugagaauuccccaacuaaauuggacuucucugcuuuauc

SEQ ID NO: 517364 - RNA, 62 nt, hsa; identical to SEQ ID NO: 130282

SEQ ID NO: 517365 - RNA, 64 nt, hsa
auguucuugcgcuuugugcacuuggaggggaaaacccaacuacauaugcacuuucuugguugug

SEQ ID NO: 517366 - RNA, 64 nt, hsa
aucagauauacaugucuagauguuacagcaaagccccaacuaaucuuuagaagcauauuggaac

SEQ ID NO: 517367 - RNA, 64 nt, hsa
gauagcuuacauuuccucuuuuugccuuuaucuccccaacuaaaauacaauggggaagaagucu

SEQ ID NO: 517368 - RNA, 64 nt, hsa
caccuccuccaccugcuucaaccugcucaagcugcccaacuacagcaagaagagcguccuccgc

SEQ ID NO: 517369 - RNA, 64 nt, hsa
ggccucucaccucugugccucugucuccuuguugcccaacuacuaucucagagauauugugagg

SEQ ID NO: 517370 - RNA, 64 nt, hsa
caaaugcagagaugaggcuaaggcaagaauaugccccaacuaaagcauagauuccccaaaguga

SEQ ID NO: 517371 - RNA, 64 nt, hsa
gcaccauacuuucuuguacauuugugucucccuucccaacuagacuguaagugccuugcgguca

SEQ ID NO: 517372 - RNA, 64 nt, hsa
ggcuagaaacucucaguccaaaccuugcuccuuccccaacuaggggaccgauuuggacuugucu

SEQ ID NO: 517373 - RNA, 64 nt, hsa
aacuuccaaaggucaauaugucguccuuuggcaucccaacuaacaauaaagaauaggcuauaag

SEQ ID NO: 517374 - RNA, 64 nt, hsa
aacuucuaaaggucaauauaucauccuuuggcaucccaacuaacaauaaagaguaggcuauaag

SEQ ID NO: 517375 - RNA, 64 nt, hsa
ccuauggggcccagggggaaaggccaaacagaaacccaacuacccccuaaugaagggccuggag

SEQ ID NO: 517376 - RNA, 64 nt, hsa
aaauuauccuggcggaguuaugcacgcuuguagucccaacuaccugggaggcugaggcgggaga

SEQ ID NO: 517377 - RNA, 64 nt, hsa
aaguaaacacaauugaagccucucugaaguuaaacccaacuauguuuauuaaaaugugugaaac

SEQ ID NO: 517378 - RNA, 64 nt, hsa
cauugccgaguucuuauuuucaccuuuucauaaucccaacuacaauaacaagaauuuuauugac

SEQ ID NO: 517379 - RNA, 64 nt, hsa
cuguaguuuccgcuuugcuugcuuguuuaacaaacccaacuaaagugcuugaggcuaccucuac

SEQ ID NO: 517380 - RNA, 64 nt, hsa
gggaaccauuccuuuauguugccccuuacugaugcccaacuaauguguuucugguuacuaacag

SEQ ID NO: 517381 - RNA, 64 nt, hsa
uaacauaaccaaaaauuaaauugaaacaaaaugucccaacuaagaaaauauauagagcauuuua

SEQ ID NO: 517382 - RNA, 64 nt, hsa
uguuaaguagcagagccagaauggacuucagaaucccaacuacaauacaaauguuuauuuaaau

SEQ ID NO: 517383 - RNA, 64 nt, hsa
aaaaauuuaccuccuuugcaggccauaggacuagcccaacuaugagaaauagcuguucugugaa

SEQ ID NO: 517384 - RNA, 64 nt, hsa
aaaaagccaggcauugguggugugugccuauagucccaacuacuagggaggcugaggugggagg

SEQ ID NO: 517385 - RNA, 64 nt, hsa
ccuaauuugcuuuggugggguccuuaaaacauuucccaacuaaagaauagaauuguaaaggaaa

SEQ ID NO: 517386 - RNA, 64 nt, hsa
caaccucuauccuggaaccuguccucccuuucuccccaacuaugcaucuguugucugcuccucu

SEQ ID NO: 517387 - RNA, 64 nt, hsa
cuccuggguucaagugauucuucugccucagccucccaacuagcugggacuacagguacaccac

SEQ ID NO: 517388 - RNA, 64 nt, hsa
guauuuaguguguucagugaugauaucacugguucccaacuagaugcuuguuggccacgggaag

SEQ ID NO: 517389 - RNA, 64 nt, hsa
cugggaauuguguggguauuaauguuuccauguucccaacuauguugagaaguggaaaaaaacc

SEQ ID NO: 517390 - RNA, 64 nt, hsa
gagagauggcaaacacaguggcaagacaacauuacccaacuauagaagagaggcuaacuagcaa

SEQ ID NO: 517391 - RNA, 64 nt, hsa
ccaagugucucuugacuggcucaagaauuagggccccaacuacacacccccaagccacagggaa

SEQ ID NO: 517392 - RNA, 64 nt, hsa
acgcuggcuccuucuagacauuucuugccacuuccccaacuagaccacuccuagugauuacuga

SEQ ID NO: 517393 - RNA, 64 nt, hsa
cuucugugauaaaaugaauucaccacucugguuacccaacuacagaaccuccuuugaucaggcc

SEQ ID NO: 517394 - RNA, 64 nt, hsa
cuuauugcuuuaaacaaguuugugcuuaaucugucccaacuaaaauggagcuuauaaacuuacu

SEQ ID NO: 517395 - RNA, 64 nt, hsa
aaauuagccaggcaugguggcaaacgccuguaaucccaacuacuugggaggcugaggcaggaga

SEQ ID NO: 517396 - RNA, 64 nt, hsa
gacuuucccagcccuuugguuuguggguaucugccccaacuacuguugggaucagccuccuguc

SEQ ID NO: 517397 - RNA, 64 nt, hsa
ccuauuggagacaauccuuugaucauaaauucuccccaacuauaaaucauuuuaugucuuuauc

SEQ ID NO: 517398 - RNA, 64 nt, hsa
cgucuuuugcccaccccccuggcauucagcuggacccaacuaggccaucaugaguggcuucucc

SEQ ID NO: 517399 - RNA, 64 nt, hsa
caaguagcugggacuacaggcacacgccaccacacccaacuaauuuuuguauuuuuaguagaga

SEQ ID NO: 517400 - RNA, 64 nt, hsa
cugugacaaaugguugaaaaggagucaacauggccccaacuauagugccggaaccuuuucauca

SEQ ID NO: 517401 - RNA, 64 nt, hsa
aaauuagccagaugugguggugcacaccuguagucccaacuauucggcaggcugaggcaguaga

SEQ ID NO: 517402 - RNA, 64 nt, hsa
agacuccgucacaacaacaacaacaaaaagcuuccccaacuaaagccuagaagagcuucugagg

SEQ ID NO: 517403 - RNA, 64 nt, hsa
gcagccaagaaacucacccaaagccuguagccuccccaacuacuccagacuguccugcucaccc

SEQ ID NO: 517404 - RNA, 64 nt, hsa
auggaggaaaaaugacuaaggacugagcccccuacccaacuacccccaccccaaucccaccuuc

SEQ ID NO: 517405 - RNA, 64 nt, hsa
cuuggcaggacauggaauuuggccucaugacaggcccaacuagggauaggaaggaaaaugaaga

SEQ ID NO: 517406 - RNA, 64 nt, hsa
ccaggcccuggcucuguaaccauuaaccucuucccccaacuaacaccaaugaaaacaccauucc

SEQ ID NO: 517407 - RNA, 64 nt, hsa
aggguguggcuuuuuuucucuccuuuuuaccaaccccaacuaaacugggaguaagacuuaguca

SEQ ID NO: 517408 - RNA, 64 nt, hsa
gaaaucuugcagagguagcuccgaaaccaucuggcccaacuagccucaacugacagcugaggaa

SEQ ID NO: 517409 - RNA, 64 nt, hsa
aaaguagccgggcgugguggugggcgccuguagucccaacuacucaggaggcugaggcaggaga

SEQ ID NO: 517410 - RNA, 64 nt, hsa
ccacauccaccuccauccccaacccauccucauccccaacuacagccccaaacccagccccaga

SEQ ID NO: 517411 - RNA, 64 nt, hsa
aucuuaaaggaagcaggggcuggaugccuuucaucccaacuauucucugugguaucaaaaagaa

SEQ ID NO: 517412 - RNA, 64 nt, hsa
ggagcagccagcccucugccccugcccagggcuccccaacuauaggccugggacccccgcccag

SEQ ID NO: 517413 - RNA, 64 nt, hsa
cuaguagcuggcauuacaggcacaugccaccacgcccaacuaauuuuuauauuuuuaguagaga

SEQ ID NO: 517414 - RNA, 64 nt, hsa
cccuuuccccucuucccugucuuccccaccuucccccaacuacccgggccugacccggccccua

SEQ ID NO: 517415 - RNA, 64 nt, hsa
gcagugccacccacuccuugggccccuaggaugacccaacuacccccauaacuuucugcuuccc

SEQ ID NO: 517416 - RNA, 64 nt, hsa
gguuauggucaaucccaaaagucaccacuccauucccaacuagacauuaccaaagugaccuacc

SEQ ID NO: 517417 - RNA, 64 nt, hsa
ugaguagcugggauuacaggcaugcgccaccacgcccaacuaauuuuguauuuuuaguagagac

SEQ ID NO: 517418 - RNA, 64 nt, hsa
uccugagucaggcgugguggugcgugcaucuagucccaacuauuugggaggcugaggcaggagg

SEQ ID NO: 517419 - RNA, 64 nt, hsa
cugaucaccaccaacaucauaggucuauaaaucacccaacuaagaucagggguguuucauggga

SEQ ID NO: 517420 - RNA, 64 nt, hsa
cauauccucucuugccagcuuuuucccgugcucccccaacuauguaucagauaagauucuuuga

SEQ ID NO: 517421 - RNA, 64 nt, hsa
caauggaacccuugauuuccuaccucaguguacacccaacuauugguuguaucaguuuguguau

SEQ ID NO: 517422 - RNA, 59 nt, hsa; identical to SEQ ID NO: 130340

SEQ ID NO: 517423 - RNA, 64 nt, hsa
ccaguagcugggaccacaggugcccgccaccacacccaacuaauuuuuguauuuuuaguagaga

SEQ ID NO: 517424 - RNA, 64 nt, hsa
ccaaucuggaacaaugucccuccucuuagaaugucccaacuaaagaccaguuaaaauauuaggg

SEQ ID NO: 517425 - RNA, 64 nt, hsa
aacaucacauuuuggugucucucaggcuuucccccccaacuaugguuucuuugcuuuuuguuuu

SEQ ID NO: 517426 - RNA, 64 nt, hsa
ugucugccaagaucuuucuuuugaauguuuugaacccaacuacuugucauagauguuugacugu

SEQ ID NO: 517427 - RNA, 64 nt, hsa
cagcccaggguucccauuuggcuucuggcaguggcccaacuagccaagucugguguucccucau

SEQ ID NO: 517428 - RNA, 64 nt, hsa
gcuggagggaugccacaccccucacagggcagcccccaacuacaucuucccugcuuacucucug

SEQ ID NO: 517429 - RNA, 64 nt, hsa
cuugccagauuguggucuauguuugaucuguguccccaacuagacagggaguucucugaggaca

SEQ ID NO: 517430 - RNA, 64 nt, hsa
uuagaugucagucucguuaccagcagccuuuugacccaacuacggcgcucuauauuuuaguaga

SEQ ID NO: 517431 - RNA, 64 nt, hsa
aauucacaaaacuucuugcuucaaaugaaaaaaucccaacuauugagcauguuuaaaucuuugc

SEQ ID NO: 517432 - RNA, 64 nt, hsa
uuagaugucaaucucguuaccagcagccuuuugacccaacuacagcgcucuauauuuuaguaga

SEQ ID NO: 517433 - RNA, 64 nt, hsa
uuaggugucacucuuguuaccagcagacuuuugacccaacuacagugcucugucuuuuaguaga

SEQ ID NO: 517434 - RNA, 64 nt, hsa
ucugucucuuccugcuuuagacagccauuaagaucccaacuaauuuuaccgaaccuaaaaccca

SEQ ID NO: 517435 - RNA, 64 nt, hsa
acugugugguaacagaaagcuucuuaccaauuuccccaacuauguugcacaucagccucauuuu

SEQ ID NO: 517436 - RNA, 64 nt, hsa; identical to SEQ ID NO: 43951

SEQ ID NO: 517437 - RNA, 64 nt, hsa; identical to SEQ ID NO: 43952

SEQ ID NO: 517438 - RNA, 64 nt, hsa; identical to SEQ ID NO: 43953

SEQ ID NO: 517439 - RNA, 64 nt, hsa; identical to SEQ ID NO: 43954

SEQ ID NO: 517440 - RNA, 64 nt, hsa; identical to SEQ ID NO: 43955

SEQ ID NO: 517441 - RNA, 64 nt, hsa; identical to SEQ ID NO: 43956

SEQ ID NO: 517442 - RNA, 64 nt, hsa; identical to SEQ ID NO: 43957

SEQ ID NO: 517443 - RNA, 64 nt, hsa; identical to SEQ ID NO: 43958

SEQ ID NO: 517444 - RNA, 64 nt, hsa; identical to SEQ ID NO: 43959

SEQ ID NO: 517445 - RNA, 64 nt, hsa; identical to SEQ ID NO: 43960

SEQ ID NO: 517446 - RNA, 64 nt, hsa; identical to SEQ ID NO: 43961

SEQ ID NO: 517447 - RNA, 64 nt, hsa; identical to SEQ ID NO: 43962

SEQ ID NO: 517448 - RNA, 64 nt, hsa; identical to SEQ ID NO: 43963

SEQ ID NO: 517449 - RNA, 64 nt, hsa; identical to SEQ ID NO: 43964

SEQ ID NO: 517450 - RNA, 64 nt, hsa; identical to SEQ ID NO: 43965

SEQ ID NO: 517451 - RNA, 64 nt, hsa; identical to SEQ ID NO: 43966

SEQ ID NO: 517452 - RNA, 64 nt, hsa; identical to SEQ ID NO: 43967

SEQ ID NO: 517453 - RNA, 64 nt, hsa; identical to SEQ ID NO: 43968

SEQ ID NO: 517454 - RNA, 64 nt, hsa; identical to SEQ ID NO: 43969

SEQ ID NO: 517455 - RNA, 64 nt, hsa; identical to SEQ ID NO: 43970

SEQ ID NO: 517456 - RNA, 64 nt, hsa; identical to SEQ ID NO: 43971

SEQ ID NO: 517457 - RNA, 64 nt, hsa; identical to SEQ ID NO: 43972

SEQ ID NO: 517458 - RNA, 64 nt, hsa; identical to SEQ ID NO: 43973

SEQ ID NO: 517459 - RNA, 64 nt, hsa; identical to SEQ ID NO: 43974

SEQ ID NO: 517460 - RNA, 64 nt, hsa; identical to SEQ ID NO: 43975

SEQ ID NO: 517461 - RNA, 64 nt, hsa; identical to SEQ ID NO: 43976

SEQ ID NO: 517462 - RNA, 64 nt, hsa; identical to SEQ ID NO: 43977

SEQ ID NO: 517463 - RNA, 64 nt, hsa; identical to SEQ ID NO: 43978

SEQ ID NO: 517464 - RNA, 64 nt, hsa; identical to SEQ ID NO: 43979

SEQ ID NO: 517465 - RNA, 64 nt, hsa; identical to SEQ ID NO: 43980

SEQ ID NO: 517466 - RNA, 64 nt, hsa; identical to SEQ ID NO: 43981

SEQ ID NO: 517467 - RNA, 64 nt, hsa; identical to SEQ ID NO: 43982

SEQ ID NO: 517468 - RNA, 64 nt, hsa; identical to SEQ ID NO: 43983

SEQ ID NO: 517469 - RNA, 64 nt, hsa; identical to SEQ ID NO: 43984

SEQ ID NO: 517470 - RNA, 64 nt, hsa; identical to SEQ ID NO: 43985

SEQ ID NO: 517471 - RNA, 64 nt, hsa; identical to SEQ ID NO: 43986

SEQ ID NO: 517472 - RNA, 64 nt, hsa; identical to SEQ ID NO: 43987

SEQ ID NO: 517473 - RNA, 64 nt, hsa; identical to SEQ ID NO: 43988

SEQ ID NO: 517474 - RNA, 64 nt, hsa; identical to SEQ ID NO: 43951

SEQ ID NO: 517475 - RNA, 64 nt, hsa; identical to SEQ ID NO: 43952

SEQ ID NO: 517476 - RNA, 64 nt, hsa; identical to SEQ ID NO: 43953

SEQ ID NO: 517477 - RNA, 64 nt, hsa; identical to SEQ ID NO: 43954

SEQ ID NO: 517478 - RNA, 64 nt, hsa; identical to SEQ ID NO: 43955

SEQ ID NO: 517479 - RNA, 64 nt, hsa; identical to SEQ ID NO: 43956

SEQ ID NO: 517480 - RNA, 64 nt, hsa; identical to SEQ ID NO: 43957

SEQ ID NO: 517481 - RNA, 64 nt, hsa; identical to SEQ ID NO: 43958

SEQ ID NO: 517482 - RNA, 64 nt, hsa; identical to SEQ ID NO: 43959

SEQ ID NO: 517483 - RNA, 64 nt, hsa; identical to SEQ ID NO: 43960

SEQ ID NO: 517484 - RNA, 64 nt, hsa; identical to SEQ ID NO: 43961

SEQ ID NO: 517485 - RNA, 64 nt, hsa; identical to SEQ ID NO: 43962

SEQ ID NO: 517486 - RNA, 64 nt, hsa; identical to SEQ ID NO: 43963

SEQ ID NO: 517487 - RNA, 64 nt, hsa; identical to SEQ ID NO: 43964

SEQ ID NO: 517488 - RNA, 64 nt, hsa; identical to SEQ ID NO: 43965

SEQ ID NO: 517489 - RNA, 64 nt, hsa; identical to SEQ ID NO: 43966

SEQ ID NO: 517490 - RNA, 64 nt, hsa; identical to SEQ ID NO: 43967

SEQ ID NO: 517491 - RNA, 64 nt, hsa; identical to SEQ ID NO: 43968

SEQ ID NO: 517492 - RNA, 64 nt, hsa; identical to SEQ ID NO: 43969

SEQ ID NO: 517493 - RNA, 64 nt, hsa; identical to SEQ ID NO: 43970

SEQ ID NO: 517494 - RNA, 64 nt, hsa; identical to SEQ ID NO: 43971

SEQ ID NO: 517495 - RNA, 64 nt, hsa; identical to SEQ ID NO: 43972

SEQ ID NO: 517496 - RNA, 64 nt, hsa; identical to SEQ ID NO: 43973

SEQ ID NO: 517497 - RNA, 64 nt, hsa; identical to SEQ ID NO: 43974

SEQ ID NO: 517498 - RNA, 64 nt, hsa; identical to SEQ ID NO: 43975

SEQ ID NO: 517499 - RNA, 64 nt, hsa; identical to SEQ ID NO: 43976

SEQ ID NO: 517500 - RNA, 64 nt, hsa; identical to SEQ ID NO: 43977

SEQ ID NO: 517501 - RNA, 64 nt, hsa; identical to SEQ ID NO: 43978

SEQ ID NO: 517502 - RNA, 64 nt, hsa; identical to SEQ ID NO: 43979

SEQ ID NO: 517503 - RNA, 64 nt, hsa; identical to SEQ ID NO: 43980

SEQ ID NO: 517504 - RNA, 64 nt, hsa; identical to SEQ ID NO: 43981

SEQ ID NO: 517505 - RNA, 64 nt, hsa; identical to SEQ ID NO: 43982

SEQ ID NO: 517506 - RNA, 64 nt, hsa; identical to SEQ ID NO: 43983

SEQ ID NO: 517507 - RNA, 64 nt, hsa; identical to SEQ ID NO: 43984

SEQ ID NO: 517508 - RNA, 64 nt, hsa; identical to SEQ ID NO: 43985

SEQ ID NO: 517509 - RNA, 64 nt, hsa; identical to SEQ ID NO: 43986

SEQ ID NO: 517510 - RNA, 64 nt, hsa; identical to SEQ ID NO: 43987

SEQ ID NO: 517511 - RNA, 64 nt, hsa; identical to SEQ ID NO: 43988

SEQ ID NO: 517512 - RNA, 64 nt, hsa; identical to SEQ ID NO: 194676

SEQ ID NO: 517513 - RNA, 64 nt, hsa; identical to SEQ ID NO: 194677

SEQ ID NO: 517514 - RNA, 64 nt, hsa; identical to SEQ ID NO: 194678

SEQ ID NO: 517515 - RNA, 64 nt, hsa; identical to SEQ ID NO: 194679

SEQ ID NO: 517516 - RNA, 64 nt, hsa; identical to SEQ ID NO: 194680

SEQ ID NO: 517517 - RNA, 64 nt, hsa; identical to SEQ ID NO: 194681

SEQ ID NO: 517518 - RNA, 64 nt, hsa; identical to SEQ ID NO: 194682

SEQ ID NO: 517519 - RNA, 64 nt, hsa; identical to SEQ ID NO: 194683

SEQ ID NO: 517520 - RNA, 64 nt, hsa; identical to SEQ ID NO: 194684

SEQ ID NO: 517521 - RNA, 64 nt, hsa; identical to SEQ ID NO: 194685

SEQ ID NO: 517522 - RNA, 64 nt, hsa; identical to SEQ ID NO: 194686

SEQ ID NO: 517523 - RNA, 64 nt, hsa; identical to SEQ ID NO: 194687

SEQ ID NO: 517524 - RNA, 64 nt, hsa; identical to SEQ ID NO: 194688

SEQ ID NO: 517525 - RNA, 64 nt, hsa; identical to SEQ ID NO: 194689

SEQ ID NO: 517526 - RNA, 64 nt, hsa; identical to SEQ ID NO: 194690

SEQ ID NO: 517527 - RNA, 64 nt, hsa; identical to SEQ ID NO: 194691

SEQ ID NO: 517528 - RNA, 64 nt, hsa; identical to SEQ ID NO: 194692

SEQ ID NO: 517529 - RNA, 64 nt, hsa; identical to SEQ ID NO: 194693

SEQ ID NO: 517530 - RNA, 64 nt, hsa; identical to SEQ ID NO: 194694

SEQ ID NO: 517531 - RNA, 64 nt, hsa; identical to SEQ ID NO: 194695

SEQ ID NO: 517532 - RNA, 64 nt, hsa; identical to SEQ ID NO: 194696

SEQ ID NO: 517533 - RNA, 64 nt, hsa; identical to SEQ ID NO: 194697

SEQ ID NO: 517534 - RNA, 64 nt, hsa; identical to SEQ ID NO: 194698

SEQ ID NO: 517535 - RNA, 64 nt, hsa; identical to SEQ ID NO: 194699

SEQ ID NO: 517536 - RNA, 64 nt, hsa; identical to SEQ ID NO: 194700

SEQ ID NO: 517537 - RNA, 64 nt, hsa; identical to SEQ ID NO: 194701

SEQ ID NO: 517538 - RNA, 64 nt, hsa; identical to SEQ ID NO: 194702

SEQ ID NO: 517539 - RNA, 64 nt, hsa; identical to SEQ ID NO: 194703

SEQ ID NO: 517540 - RNA, 64 nt, hsa; identical to SEQ ID NO: 194704

SEQ ID NO: 517541 - RNA, 64 nt, hsa; identical to SEQ ID NO: 194705

SEQ ID NO: 517542 - RNA, 60 nt, hsa; identical to SEQ ID NO: 194706

SEQ ID NO: 517543 - RNA, 64 nt, hsa; identical to SEQ ID NO: 194707

SEQ ID NO: 517544 - RNA, 64 nt, hsa; identical to SEQ ID NO: 194708

SEQ ID NO: 517545 - RNA, 64 nt, hsa; identical to SEQ ID NO: 194709

SEQ ID NO: 517546 - RNA, 64 nt, hsa; identical to SEQ ID NO: 194710

SEQ ID NO: 517547 - RNA, 64 nt, hsa; identical to SEQ ID NO: 194711

SEQ ID NO: 517548 - RNA, 64 nt, hsa; identical to SEQ ID NO: 194712

SEQ ID NO: 517549 - RNA, 64 nt, hsa; identical to SEQ ID NO: 194713

SEQ ID NO: 517550 - RNA, 64 nt, hsa; identical to SEQ ID NO: 194714

SEQ ID NO: 517551 - RNA, 64 nt, hsa
aaaaauguuuauugucuucaguacaaaaaguuaaaaccaugauuggauucauaaugcacuuguc

SEQ ID NO: 517552 - RNA, 64 nt, hsa
cuuuucucaguacaacagccauagugauucuguuaaccaugaauuugauugugucacuucccug

SEQ ID NO: 517553 - RNA, 64 nt, hsa
uccuucagauaauucauguggagauuuuuggagaaaccaugacggauaguuuaggaugacuaca

SEQ ID NO: 517554 - RNA, 64 nt, hsa
uaaaaugucacuuuuuugguuuuuauuauacaaaaaccaugaaguacuuuuuuuauuugcuaaa

SEQ ID NO: 517555 - RNA, 64 nt, hsa
cucuggcuguuugccugaaguucacagaacacacaaccaugaaaggcuuuuugaggugagaggc

SEQ ID NO: 517556 - RNA, 64 nt, hsa
aagacaguuauuguuggaagacugucauguagauaaccaugagcaauggcucgccucagaauca

SEQ ID NO: 517557 - RNA, 64 nt, hsa
ugugaccuaagaacaaaacuguaacugcauuagaaaccaugaaaaaauuagauauuguuuugug

SEQ ID NO: 517558 - RNA, 64 nt, hsa
uuguuuugugacuuuuagacagugguaaauauagaaccaugaauucuggucacauuccauuucu

SEQ ID NO: 517559 - RNA, 64 nt, hsa
gaucugcaacaacccugaagacaacaaggaaagaaaccaugaaagucugucuguacugcagugg

SEQ ID NO: 517560 - RNA, 64 nt, hsa
gcagggauucuuaaccuggauagaagccagggguaaccaugaacuugauggaagaaaauguuac

SEQ ID NO: 517561 - RNA, 64 nt, hsa
cccaaauggagacacucgcagaccugcaguucucagaccgaaggugcugccuucauccucccca

SEQ ID NO: 517562 - RNA, 64 nt, hsa
uaccaggcuguagauuugauaagcuagaugcaguagaccgaaaccauccaaaaccuguuuagcu

SEQ ID NO: 517563 - RNA, 64 nt, hsa
agaguuuaugacuaaauagucugugcagguucauagaccgaagauacuacacacuuuaaaccaa

SEQ ID NO: 517564 - RNA, 64 nt, hsa
auuuuguuggguuuuaaaauugcacagaacacuaagaccgaaaggcuggacucuuguuucuccu

SEQ ID NO: 517565 - RNA, 64 nt, hsa
agguuuggccuuccauuuuuacugagauuuggcgagaccgaauggaagcguccgcacaguaacu

SEQ ID NO: 517566 - RNA, 64 nt, hsa
ccauacacauccccagccagaaguuaguguccgaagaccgaauuuuauuuuacagagcuugaaa

SEQ ID NO: 517567 - RNA, 64 nt, hsa
cuuacgcucgugagcgugagaagccauaagagagagaccgaauucuguggcucagcacacagga

SEQ ID NO: 517568 - RNA, 64 nt, hsa
ugaccuucccucacccccagaaacacuugcuuacagaccgaaacuggcaucuuacucuuggcac

SEQ ID NO: 517569 - RNA, 64 nt, hsa
gacaaucuugacaccaauuuuaagaauagcugugagaccgaauuaaagauaaucccuaccaagu

SEQ ID NO: 517570 - RNA, 64 nt, hsa
guuacguacccaguaucacacucacaguuagaaaagaccgaaucacaauuuagaaucacuuuuc

SEQ ID NO: 517571 - RNA, 61 nt, hsa
cuucuauuaggaaagaguaagacuguuaagaagaccgaagcauguauuaaugcuguggcua

SEQ ID NO: 517572 - RNA, 64 nt, hsa
aguccacuaucugccagaggagcaagggugccuuagaccgaagccaggggaagaagcaucuuca

SEQ ID NO: 517573 - RNA, 64 nt, hsa
guggccgccacagagaguguuaccaccagcacccagaccgaacccccaccggccaaauguggug

SEQ ID NO: 517574 - RNA, 64 nt, hsa
ucuccuacaagucccacugaauuggaguuucaggagaccgaagcccaggcacauguauuuugca

SEQ ID NO: 517575 - RNA, 64 nt, hsa
aaucuaggauucucucccuggcugacagguggggagaccgaaucccucccugggaagauucuug

SEQ ID NO: 517576 - RNA, 59 nt, hsa
cugcagaaauuauggccuaacuuccugagagaccgaacccccucaccugaaucccccuc

SEQ ID NO: 517577 - RNA, 64 nt, hsa
agcuaugaggccucacugggggcagaacuuggggagaccgaagccggcccuuccacuccccuaa

SEQ ID NO: 517578 - RNA, 64 nt, hsa
guuuuagagaggcaagacaaguuugcauuagggaagaccgaaaacuaaauuuuguuuuauuuca

SEQ ID NO: 517579 - RNA, 64 nt, hsa
agucaguucuaaucccaugugugucugggccaccagaccgaaaugguugcugagaaacuugucu

SEQ ID NO: 517580 - RNA, 64 nt, hsa
aacaaauuuuuuucuuguuuuuguuuuguuuuugagaccgaaucucacucuguugcccaggcug

SEQ ID NO: 517581 - RNA, 64 nt, hsa
gcaguguggggggacagacaggagguggauuuggagaccgaagacugggaugccugucuugagu

SEQ ID NO: 517582 - RNA, 64 nt, hsa
cucucucucaaaaaaaaaaaaaaaaaaaaauucuagaccgaaguguacggcagugccaucuggu

SEQ ID NO: 517583 - RNA, 64 nt, hsa
uguugugguauaauuuugcucuuuauaaagagaaagaccgaagcucagaugaguuaaguggucu

SEQ ID NO: 517584 - RNA, 64 nt, hsa
ucuuuggccauugucucagccucugccacuucccagaccgaaagccuggacucagcucacugcc

SEQ ID NO: 517585 - RNA, 64 nt, hsa
ccaggugcucacgccguaaugccaacacuuugguagaccgaagugggcagaucaccugagguca

SEQ ID NO: 517586 - RNA, 64 nt, hsa
agggcggcccaggccccacgcuagaaggcuggcgagaccgaaggcagcaugugaggccucuccu

SEQ ID NO: 517587 - RNA, 64 nt, hsa
agaaaagauguagauuuauuucaucauauuauacagaccgaacuguuguauaaauuuauuuacu

SEQ ID NO: 517588 - RNA, 64 nt, hsa
ccuugcauggugccccuuccugcauaggacuggaagaccgaaguuuuuuuauggccauauuuuc

SEQ ID NO: 517589 - RNA, 64 nt, hsa
ugcauguagcaguuguugggcgaaugguguuuaaagaccgaaaaugaauuguaauuuucuuuuc

SEQ ID NO: 517590 - RNA, 64 nt, hsa
uggcuuuagcagauguuuuuaaaguuucuuuuguagaccgaacuucugaagaguaauaccaaau

SEQ ID NO: 517591 - RNA, 64 nt, hsa
aaagaagagaaagauuuuuuuuuuuuuuaauggcagaccgaaguggagaucuuguagccuagau

SEQ ID NO: 517592 - RNA, 64 nt, hsa
uguguagaauuguguucgggaggugggggaucugagaccgaaguggacagugguuaagauugug

SEQ ID NO: 517593 - RNA, 64 nt, hsa
ccggacuuucauuuugaggaggauggaugaacagagaccgaacgucgaggaacagaugugugug

SEQ ID NO: 517594 - RNA, 64 nt, hsa
aggucgucacuggggugggagaagaggggcugguagaccgaagccuugugcauaaggauuuuuu

SEQ ID NO: 517595 - RNA, 64 nt, hsa
ucaaaguaaaauccuaguuggcaggauuguaaguagaccgaauucuaauuuuucccaacacaua

SEQ ID NO: 517596 - RNA, 64 nt, hsa
gauuaggucacauuacauuaacauuuaggaacccagaccgaaaaguugcugaaagggaaggaga

SEQ ID NO: 517597 - RNA, 64 nt, hsa
uggagaccugccgccggcucaucacccagucuggagaccgaaagucuccugcuuucacugcggu

SEQ ID NO: 517598 - RNA, 64 nt, hsa
cuucugaaauuaauccuuaaaacaaacuuccugaagaccgaaaaguugaaugauuuauuguuac

SEQ ID NO: 517599 - RNA, 64 nt, hsa
cuccagguuuuucaauuaaacggauuauuuuuucagaccgaaaagagauggucugaguuugucu

SEQ ID NO: 517600 - RNA, 64 nt, hsa
aguugaauggggcggcaauugcggggcccaccuuagaccgaaggggaaaacccgcucucucagg

SEQ ID NO: 517601 - RNA, 64 nt, hsa
gugugccacccuguguuccugugauugcaaugugagaccgaauguaauauggaaaaccuaccag

SEQ ID NO: 517602 - RNA, 64 nt, hsa
ggguguagccucccgcugauggggggagccauccagaccgaacagcgcccuccacggccgaguc

SEQ ID NO: 517603 - RNA, 64 nt, hsa
ugguggcucaugccuguaaucccugcaauuugggagaccgaaugagaaggauugcuugagccca

SEQ ID NO: 517604 - RNA, 64 nt, hsa
aucuucuucagaggaucacccgggaaaacgaccgagaccgaagauuggcuacuguaaagcaguu

SEQ ID NO: 517605 - RNA, 64 nt, hsa
aguggagcaggggcaggcgaaccucuuucuuugcagaccgaacagugaaaagcuuucaguggag

SEQ ID NO: 517606 - RNA, 64 nt, hsa
gagccuggggaagaaggggguuugaagcccaccaagaccgaaacuggagaagggcuggaccugg

SEQ ID NO: 517607 - RNA, 64 nt, hsa
gugaauaaagaucuaucaaaggaaaaggaaacugagaccgaaaacuuagggucuaaguuguucu

SEQ ID NO: 517608 - RNA, 64 nt, hsa
gagcaucaggccgccacaagugccugcuuuuaggagaccgaaguccgcagaaccugccuguguc

SEQ ID NO: 517609 - RNA, 64 nt, hsa
guuguaagccagguucaguuccucauugguugucagaccgaaggugucuguuugucagugucug

SEQ ID NO: 517610 - RNA, 64 nt, hsa
uucuuggcuccccuguucaaaguggccacagcgcagaccgaagcaaaauucuuguauacauugg

SEQ ID NO: 517611 - RNA, 64 nt, hsa
ccugacuuaacaucucuaaacucagauugaaaagagaccgaaugugcagauuccacagucuuaa

SEQ ID NO: 517612 - RNA, 64 nt, hsa
cacaaauaaauaaugacugucauacauccagaggagaccgaaccugcccagcugauguacuguu

SEQ ID NO: 517613 - RNA, 64 nt, hsa
gcaauaaggaacccauccuaguugauuuuaagacagaccgaaaagguaacaaguucuuuuuugg

SEQ ID NO: 517614 - RNA, 64 nt, hsa
agaaaguucuggaaugaugaagcuguucaugccaagaccgaaagugcuggcccaguaugagucc

SEQ ID NO: 517615 - RNA, 64 nt, hsa
cacugugggucuucccgugggaugcgggauccugagaccgaaggguguuugguuuaaaaagaag

SEQ ID NO: 517616 - RNA, 64 nt, hsa
gcuaaauuuggcuauaaaaauaaaauugaucugagcaccauauaaaauggaauccuggaggguc

SEQ ID NO: 517617 - RNA, 64 nt, hsa
cagcauagaaguaacuuacuuaggugugggggaagcaccauaacuuuguuuagcccaaaaccaa

SEQ ID NO: 517618 - RNA, 64 nt, hsa
uagaccccuccucccauggcuagaaguggggccugcaccauacaucuguguccgcccccucuac

SEQ ID NO: 517619 - RNA, 64 nt, hsa
auuccugaucccauggccaggugguugucuuauugcaccauacuccuugcuuccugaugcuggg

SEQ ID NO: 517620 - RNA, 64 nt, hsa
uuauaagcugagaccgguggcucucuucuuaaaagcaccauauuaaaacuuggaaaacuaacug

SEQ ID NO: 517621 - RNA, 64 nt, hsa
ccauuggccuccccaggggcuuuccacccacacugcaccauaaccgccacacccuucggggggg

SEQ ID NO: 517622 - RNA, 64 nt, hsa
agcucugugcugaaggguggaaggcuacccugacgcaccauaaucuaagcccggggcauaaaac

SEQ ID NO: 517623 - RNA, 64 nt, hsa
ugguagacuuuggcagugccaccuuugaccaugagcaccauagcaccauugucuccacucgcca

SEQ ID NO: 517624 - RNA, 64 nt, hsa
gggaagauuaguccagugauuacauaagaguugggcaccauaaauucucuauauuuugccuccc

SEQ ID NO: 517625 - RNA, 64 nt, hsa
gaaucuuuuugaugucgauguucaacuauuuuuggcaccauaguagaacaugguugcuuucuau

SEQ ID NO: 517626 - RNA, 64 nt, hsa
ucacuuugaaacaggccucaucccacuuccaccagcaccauagaagaauaauucugggcagaag

SEQ ID NO: 517627 - RNA, 64 nt, hsa
ugauugccacgaugugauugcaauacucuuagaagcaccauauuaucccagacauguucuuuca

SEQ ID NO: 517628 - RNA, 64 nt, hsa
auucauuucuugcuuaugagugccugcauggugugcaccauagguuuccgcuuucaugggacau

SEQ ID NO: 517629 - RNA, 64 nt, hsa
gucuuaggggcuugguaguuuggaaaguucuuaggcaccauagaagaacagcagauggcgguga

SEQ ID NO: 517630 - RNA, 64 nt, hsa
augugcccccagaugucagaaugaggcgacuagggcaccauacucacuuuccagggcuggggga

SEQ ID NO: 517631 - RNA, 64 nt, hsa
gccuagcaguuuaaaccccacuuuccuccacuuagcaccauaggcaagggggcagaucccagag

SEQ ID NO: 517632 - RNA, 64 nt, hsa
uguuacugcuguuugcuuuuacuuacuuucaguagcaccauaacgaaguagcuuuaagugaaac

SEQ ID NO: 517633 - RNA, 64 nt, hsa
cuucuggagacuccggccccuaggaguggccucugcaccauagccugcggcuccccuauucagg

SEQ ID NO: 517634 - RNA, 64 nt, hsa
cuggccaagcugaugaccuucugaagugucacuggcaccauaugcaacaagaaccaccauucac

SEQ ID NO: 517635 - RNA, 64 nt, hsa
cugaaacuagcuaaaccugaauguaccuacuagggcaccauaauacugcagcaagaccaaagug

SEQ ID NO: 517636 - RNA, 64 nt, hsa
ugacguguguauaguaaaugcaggcccucuggcagcaccauaauuggucgguuacccugagccc

SEQ ID NO: 517637 - RNA, 64 nt, hsa
uauugggggaaguuauucaaaagcaggcuuuugagcaccauagucuaaaugccaauaaaaauaa

SEQ ID NO: 517638 - RNA, 64 nt, hsa
cacaucucauugaauuugaugguugacuuaauuggcaccauaacuuuguaugauauuauacauu

SEQ ID NO: 517639 - RNA, 64 nt, hsa
aaaaccaaguaucacacuuuaauguacaugggccgcaccauaaugagaugugagccuugugcau

SEQ ID NO: 517640 - RNA, 64 nt, hsa
ggagaccaaauucuauccugugaggcuuuuaauugcaccauaguaugcucugaguagcuuuaca

SEQ ID NO: 517641 - RNA, 64 nt, hsa
uggugagaggaaucguugcugcccccuuccccuagcaccauauaugagucucaaguuuuauuau

SEQ ID NO: 517642 - RNA, 64 nt, hsa
acagcgaaucuuaaccuaacagccuugacaaacugcaccauagguguuuuuagacucauauaau

SEQ ID NO: 517643 - RNA, 64 nt, hsa
ggcagcuagaaaugggagggaagcuucuggguaggcaccauaguaggggaaugucuaaagaccc

SEQ ID NO: 517644 - RNA, 64 nt, hsa
aaggaagaaugaaauuaaaaggagacuuucuuaagcaccauauagauaggguuauguauaaaag

SEQ ID NO: 517645 - RNA, 64 nt, hsa
aaaugcuguuuuaguauuuucuaccucuuaauaagcaccauauuuuagaucuuguauaaaaagu

SEQ ID NO: 517646 - RNA, 64 nt, hsa
accuggccagcucuguuagugggagagaucgcuggcaccauagccuuauggccaacaggugguc

SEQ ID NO: 517647 - RNA, 64 nt, hsa
ccauggggucugggagagcagccauccccugcuggcaccauagacccacacaaggagccugcac

SEQ ID NO: 517648 - RNA, 64 nt, hsa
uauauauagcuuaaaauauaauuuuuagcauuuggcaccauauguaugccauuauauuugauuu

SEQ ID NO: 517649 - RNA, 64 nt, hsa
auuaagguuaugcacugccugccauguaguuggggcaccauacauuauuucuucccagaaucuc

SEQ ID NO: 517650 - RNA, 64 nt, hsa
acaguuccuguguuucuucuuguuuuguacuuaagcaccauauauuagaguugaauuugcauau

SEQ ID NO: 517651 - RNA, 64 nt, hsa
gucugccacccuugccccuugccuccuuggucgggcaccauaccuccuccccuccaccccacac

SEQ ID NO: 517652 - RNA, 64 nt, hsa
ggggagcuuaacugcuuguugcucccugucgucugcaccauaguaaaugccacaaggguagucg

SEQ ID NO: 517653 - RNA, 64 nt, hsa
uuuaaacuuuuauuacaagauuucaauuaaacaggcaccauagcacuggcauaccgcuguguga

SEQ ID NO: 517654 - RNA, 64 nt, hsa
guuaugcccaauuggaaauaugcugucaguuugugcaccauauggugaccacgccugugcucag

SEQ ID NO: 517655 - RNA, 64 nt, hsa
gggacccagagccaagaaagcugagauauccugugcaccauagggacuucaccaauggauuaca

SEQ ID NO: 517656 - RNA, 64 nt, hsa
aacuuguauuaauccuauauaauagauugaucaugcaccauauccacaggagguuggaaaaacc

SEQ ID NO: 517657 - RNA, 64 nt, hsa
agcuaauuuuuauauuuuuaguagagacaggauugcaccauauuggucagccuggucucaaacu

SEQ ID NO: 517658 - RNA, 64 nt, hsa
uaagaaucauugugcuuaauaauaccaagacuaagcaccauaaccaagaaauacuaauguaaag

SEQ ID NO: 517659 - RNA, 64 nt, hsa
caccucugacucccuaacuccaucagaccucuacgcaccauaagacucugccagaacugagaag

SEQ ID NO: 517660 - RNA, 64 nt, hsa
ugugacacaaggaagccaguggggugggagggaggcaccauaaucccucccuaaaacccacaga

SEQ ID NO: 517661 - RNA, 64 nt, hsa
uugacacucaaaucaguguuuagucuucugcuuggcaccauagcuuaaccugcaguuucuucaa

SEQ ID NO: 517662 - RNA, 64 nt, hsa
uaccaucuuguaacucacuguguuaguauauaaagcaccauaagaaauccaauggcagauaacc

SEQ ID NO: 517663 - RNA, 64 nt, hsa
uguauuuugagcuuagugcuaggacugagaggcugcaccauagggaauguaugggagaugguga

SEQ ID NO: 517664 - RNA, 64 nt, hsa
agcacacuauaacaucugcuggaguguugcuguugcaccauacuuucuuguacauuugugucuc

SEQ ID NO: 517665 - RNA, 64 nt, hsa
aguaccccccuaccacacacaccccuguccuccagcaccauagagaggcgcuagagcccauucc

SEQ ID NO: 517666 - RNA, 64 nt, hsa
agggccaauucaaccccauucuuuccagcgccccgcaccauagcaccugcccaccugagaacca

SEQ ID NO: 517667 - RNA, 64 nt, hsa
caccacagcacaccucaccacaccacaccgcacugcaccauaccucaccacaucucaccacacc

SEQ ID NO: 517668 - RNA, 64 nt, hsa
uccagaacuaucacuucagauguuucuauuuugggcaccauaacuauuugagcucauauuuuua

SEQ ID NO: 517669 - RNA, 64 nt, hsa
ugcacccuccgggaagccauggagucugcuggaggcaccauaucagccugcgggacuagggugg

SEQ ID NO: 517670 - RNA, 64 nt, hsa
gaagcagagcagagugcgagauccugacccaagagcaccauaacauagcuccgaaagggagagc

SEQ ID NO: 517671 - RNA, 64 nt, hsa
agaagagccccacgggcuuccugcaucuuccaccgcaccauaccuggagcccuccgaggggugu

SEQ ID NO: 517672 - RNA, 64 nt, hsa
aauucuuaggguguguacguacgcagccuccagggcaccauacuguuuccagcagccaacccuu

SEQ ID NO: 517673 - RNA, 64 nt, hsa
uagaauaugaauugauuuuggaaucagaacacaagcaccauacugaaggacuagcagccaaaua

SEQ ID NO: 517674 - RNA, 64 nt, hsa
ccagcagccgcaggcauaucucaacggaugccgugcaccauauucccuggaugcugaagacaug

SEQ ID NO: 517675 - RNA, 64 nt, hsa
ccagaaaagaaccauuucuucugccaucuuuuaugcaccauagacaucgagacuccaggggguc

SEQ ID NO: 517676 - RNA, 64 nt, hsa
uugucauuguuucuuuaaaaaaaaauacaauaaugcaccauaucccuaugcauaaagugcuucu

SEQ ID NO: 517677 - RNA, 64 nt, hsa
uccagaauauuuuaccuuuaaaaaaaugucauuggcaccauaaauaaggacugugagagacugu

SEQ ID NO: 517678 - RNA, 64 nt, hsa
cuugguuguccccgugaagaagccuucaaacccugcaccauaaauacauguguccauauauuau

SEQ ID NO: 517679 - RNA, 64 nt, hsa
gcccuugguguggacacacccucucaugcuaccagcaccauaauccagugggggugacugggug

SEQ ID NO: 517680 - RNA, 64 nt, hsa
uagucauuuguucaucuuuacuuuuagcagauuagcaccauaacuaacuuaaaacuaaguuugu

SEQ ID NO: 517681 - RNA, 64 nt, hsa
uguuguuugcacagagagauuguuuuaaaaaauggcaccauauuuggccuagcaggauuuauuu

SEQ ID NO: 517682 - RNA, 64 nt, hsa
ucugugcggcuccagccucgcccccuccccacgugcaccauaccuggggaguuccugguccagg

SEQ ID NO: 517683 - RNA, 64 nt, hsa
aguaaguuaagaaggcauuagucaugguuuggaagcaccauacagggagacagcugugugaaua

SEQ ID NO: 517684 - RNA, 64 nt, hsa
ugggagcacugguguucacgugggaccacaggcugcaccauaagacccacucacaauaaaaaaa

SEQ ID NO: 517685 - RNA, 64 nt, hsa
accugccuguagcccccaucagacccugccccaagcaccauauggaaauaaaguucuuucuuac

SEQ ID NO: 517686 - RNA, 64 nt, hsa
ucaagcuucagccuuuaaccuauaccuuuguagugcaccauauggugugugacuuucacaggac

SEQ ID NO: 517687 - RNA, 64 nt, hsa
agggucuggucuggugagcuccugaggccacacagcaccauaaagucucgcaucuacaggccuu

SEQ ID NO: 517688 - RNA, 64 nt, hsa
agugcugcuuuuuuguauacucauggggcugauugcaccauagcugagaacguggaaugcagaa

SEQ ID NO: 517689 - RNA, 64 nt, hsa
uuuauuuuauuucuaaagguauucaaauguuucagcaccauauaauagaaauacccaauuauau

SEQ ID NO: 517690 - RNA, 64 nt, hsa
acuagauuugccucuucuaagugucuaugagcuugcaccauauuuaauaaauugggaauggguu

SEQ ID NO: 517691 - RNA, 64 nt, hsa
cuccuaguggguuugggggguuggguuccugaaugcaccauaaucgcuguaugaaauauuaaaa

SEQ ID NO: 517692 - RNA, 64 nt, hsa
cuuugucuuagucaguuugagcugcuauaauaaagcaccauagacuugguggcuuauaaacaac

SEQ ID NO: 517693 - RNA, 64 nt, hsa
ugugagugccuauucuaugucaaacacuguguuggcaccauauuuuacaaguuuuuuuccucuu

SEQ ID NO: 517694 - RNA, 64 nt, hsa
ugggaacucaacuugaaggucugucuuccaucuggcaccauaaaaacaugaacuuauugcauaa

SEQ ID NO: 517695 - RNA, 64 nt, hsa
ucagaugccuauuaugggcauaugucucugcuaagcaccauaguugucaaugugcugugcaaau

SEQ ID NO: 517696 - RNA, 64 nt, hsa
gaaaaggcauauauguacuaguggcauggagaaugcaccauacucaugcaugcaaauuagacaa

SEQ ID NO: 517697 - RNA, 64 nt, hsa
aagacucccauuugagacuuuccggacauacgcagcaccauacaauauuucacaagcaauggaa

SEQ ID NO: 517698 - RNA, 64 nt, hsa
aguacagguaguuuuugagcugacagcagcaaaggcaccauaagucaaaauauugguuuuggug

SEQ ID NO: 517699 - RNA, 64 nt, hsa
augucuccuucacaaucaggcgugggaauaucuggcuuaggacuguuucucucuaagacaccau

SEQ ID NO: 517700 - RNA, 64 nt, hsa
gaucacccagcuguguucagaauuuucuuacugugcuuaggacugcacgcaagugagcagacac

SEQ ID NO: 517701 - RNA, 64 nt, hsa
cugcuacagaggggcagggccucccccagcccacgcuuaggaaugcuuggccucuggcaggcag

SEQ ID NO: 517702 - RNA, 64 nt, hsa
ccaaccuccccauugcacagauggggaaacugaggcuuaggaagagaaugaaacuuguggagag

SEQ ID NO: 517703 - RNA, 64 nt, hsa
ugagaaugacuuucagucucucugaaaaugaaaagcuuaggaccagaagagagaauuggagcug

SEQ ID NO: 517704 - RNA, 64 nt, hsa
cacaaucugugcggaaguagcuugccucacuucugcuuaggaaagcggcuguugcuccauaacu

SEQ ID NO: 517705 - RNA, 64 nt, hsa
ccucaccgaagcuuaggcccacaucucccaggcugcuuaggagacagaauggaaacggaggccg

SEQ ID NO: 517706 - RNA, 64 nt, hsa
aaagggacauggauaugaggauacaucuggacgugcuuaggaacagggugcugguugagggccc

SEQ ID NO: 517707 - RNA, 64 nt, hsa
gcuguacucagccuuugcaauuuuuguagauguagcuuaggacgugaguuauuuuuccgcagac

SEQ ID NO: 517708 - RNA, 64 nt, hsa
ucaagaauuaaaaguuauucaagaaaaugaacaugcucuucaaaaagaugcacuuaguauuaag

SEQ ID NO: 517709 - RNA, 64 nt, hsa
agagaaaacacuuaguucauuggcuuuaguauuugcucuucaccacuacaagcccacuccccuu

SEQ ID NO: 517710 - RNA, 64 nt, hsa
gaaaauuggacagauugccuguuucugauuugcugcucuucaucccauuccaggcagccucugu

SEQ ID NO: 517711 - RNA, 64 nt, hsa
ccaaccagaccuggaagaacaggccucuccauuugcucuucagaugccacuucuaagaaaagcc

SEQ ID NO: 517712 - RNA, 64 nt, hsa
uauauuucacucaaggcuuguacaucugaaguuugcucuucaaggaaugggaaccuuccuguua

SEQ ID NO: 517713 - RNA, 64 nt, hsa
auuuuuguuaaaauaugugcucaucuccuaaguagcucuucagagucugaccguaaguaaaaac

SEQ ID NO: 517714 - RNA, 64 nt, hsa
ugaacaacaucgcgguggccgagcagaucggggagcucuucauccacugccggcacggcugccg

SEQ ID NO: 517715 - RNA, 64 nt, hsa
uguggugucucugcgucuacuccaugggugaccugcucuucaguggcuccucugacaagaccau

SEQ ID NO: 517716 - RNA, 64 nt, hsa
acccggugugcacgcuggucuccucacacaacgugcucuucagcggcucccugaaggccaucaa

SEQ ID NO: 517717 - RNA, 64 nt, hsa
ugaagccuaaugacaagccaggucuuacagcugggcucuucagaaaaccagguuucuacaucca

SEQ ID NO: 517718 - RNA, 64 nt, hsa
gccugguuuguagacuuccaacaucuacacugcugcucuucaccauuggaauucacugugguau

SEQ ID NO: 517719 - RNA, 64 nt, hsa
gcauggugguacagaagguaucagucaagcgcaggcucuucagaaaccuagaaacuaaaaagag

SEQ ID NO: 517720 - RNA, 64 nt, hsa
aagguucagcacagcuggaauuguacgguagugagcucuucaaaaugaaaacagaaugaccgga

SEQ ID NO: 517721 - RNA, 64 nt, hsa
aguggcugacgguccuccuacucugccucuaccugcucuucaccaacauccugcugcucaaccu

SEQ ID NO: 517722 - RNA, 64 nt, hsa
cgccgccccccuucauccuccucagccaccugcagcucuucaucaagagggugguccugaagac

SEQ ID NO: 517723 - RNA, 64 nt, hsa; identical to SEQ ID NO: 145359

SEQ ID NO: 517724 - RNA, 64 nt, hsa; identical to SEQ ID NO: 145360

SEQ ID NO: 517725 - RNA, 64 nt, hsa; identical to SEQ ID NO: 145361

SEQ ID NO: 517726 - RNA, 64 nt, hsa; identical to SEQ ID NO: 145362

SEQ ID NO: 517727 - RNA, 64 nt, hsa; identical to SEQ ID NO: 145363

SEQ ID NO: 517728 - RNA, 64 nt, hsa; identical to SEQ ID NO: 145364

SEQ ID NO: 517729 - RNA, 64 nt, hsa; identical to SEQ ID NO: 145365

SEQ ID NO: 517730 - RNA, 64 nt, hsa; identical to SEQ ID NO: 145366

SEQ ID NO: 517731 - RNA, 64 nt, hsa; identical to SEQ ID NO: 145367

SEQ ID NO: 517732 - RNA, 64 nt, hsa; identical to SEQ ID NO: 145368

SEQ ID NO: 517733 - RNA, 64 nt, hsa; identical to SEQ ID NO: 145369

SEQ ID NO: 517734 - RNA, 64 nt, hsa; identical to SEQ ID NO: 145370

SEQ ID NO: 517735 - RNA, 64 nt, hsa; identical to SEQ ID NO: 145371

SEQ ID NO: 517736 - RNA, 64 nt, hsa; identical to SEQ ID NO: 145372

SEQ ID NO: 517737 - RNA, 64 nt, hsa; identical to SEQ ID NO: 145373

SEQ ID NO: 517738 - RNA, 64 nt, hsa; identical to SEQ ID NO: 145374

SEQ ID NO: 517739 - RNA, 64 nt, hsa; identical to SEQ ID NO: 145375

SEQ ID NO: 517740 - RNA, 64 nt, hsa; identical to SEQ ID NO: 145376

SEQ ID NO: 517741 - RNA, 64 nt, hsa; identical to SEQ ID NO: 145377

SEQ ID NO: 517742 - RNA, 64 nt, hsa; identical to SEQ ID NO: 145378

SEQ ID NO: 517743 - RNA, 64 nt, hsa; identical to SEQ ID NO: 145379

SEQ ID NO: 517744 - RNA, 64 nt, hsa; identical to SEQ ID NO: 145380

SEQ ID NO: 517745 - RNA, 64 nt, hsa; identical to SEQ ID NO: 145381

SEQ ID NO: 517746 - RNA, 64 nt, hsa; identical to SEQ ID NO: 145382

SEQ ID NO: 517747 - RNA, 64 nt, hsa; identical to SEQ ID NO: 145383

SEQ ID NO: 517748 - RNA, 64 nt, hsa; identical to SEQ ID NO: 145384

SEQ ID NO: 517749 - RNA, 64 nt, hsa; identical to SEQ ID NO: 145385

SEQ ID NO: 517750 - RNA, 64 nt, hsa; identical to SEQ ID NO: 145386

SEQ ID NO: 517751 - RNA, 64 nt, hsa; identical to SEQ ID NO: 145387

SEQ ID NO: 517752 - RNA, 64 nt, hsa; identical to SEQ ID NO: 145388

SEQ ID NO: 517753 - RNA, 64 nt, hsa; identical to SEQ ID NO: 145389

SEQ ID NO: 517754 - RNA, 64 nt, hsa; identical to SEQ ID NO: 145390

SEQ ID NO: 517755 - RNA, 64 nt, hsa; identical to SEQ ID NO: 145391

SEQ ID NO: 517756 - RNA, 64 nt, hsa; identical to SEQ ID NO: 145392

SEQ ID NO: 517757 - RNA, 64 nt, hsa; identical to SEQ ID NO: 145393

SEQ ID NO: 517758 - RNA, 64 nt, hsa; identical to SEQ ID NO: 145394

SEQ ID NO: 517759 - RNA, 64 nt, hsa; identical to SEQ ID NO: 145395

SEQ ID NO: 517760 - RNA, 64 nt, hsa; identical to SEQ ID NO: 145396

SEQ ID NO: 517761 - RNA, 64 nt, hsa; identical to SEQ ID NO: 145397

SEQ ID NO: 517762 - RNA, 64 nt, hsa; identical to SEQ ID NO: 145398

SEQ ID NO: 517763 - RNA, 64 nt, hsa; identical to SEQ ID NO: 145399

SEQ ID NO: 517764 - RNA, 64 nt, hsa; identical to SEQ ID NO: 151188

SEQ ID NO: 517765 - RNA, 64 nt, hsa; identical to SEQ ID NO: 151189

SEQ ID NO: 517766 - RNA, 64 nt, hsa; identical to SEQ ID NO: 151190

SEQ ID NO: 517767 - RNA, 64 nt, hsa; identical to SEQ ID NO: 151191

SEQ ID NO: 517768 - RNA, 64 nt, hsa; identical to SEQ ID NO: 151192

SEQ ID NO: 517769 - RNA, 64 nt, hsa; identical to SEQ ID NO: 151193

SEQ ID NO: 517770 - RNA, 64 nt, hsa; identical to SEQ ID NO: 151194

SEQ ID NO: 517771 - RNA, 64 nt, hsa; identical to SEQ ID NO: 151195

SEQ ID NO: 517772 - RNA, 64 nt, hsa; identical to SEQ ID NO: 151196

SEQ ID NO: 517773 - RNA, 64 nt, hsa; identical to SEQ ID NO: 151197

SEQ ID NO: 517774 - RNA, 64 nt, hsa; identical to SEQ ID NO: 151198

SEQ ID NO: 517775 - RNA, 64 nt, hsa; identical to SEQ ID NO: 151199

SEQ ID NO: 517776 - RNA, 64 nt, hsa; identical to SEQ ID NO: 151200

SEQ ID NO: 517777 - RNA, 64 nt, hsa; identical to SEQ ID NO: 151201

SEQ ID NO: 517778 - RNA, 64 nt, hsa; identical to SEQ ID NO: 151202

SEQ ID NO: 517779 - RNA, 64 nt, hsa; identical to SEQ ID NO: 151203

SEQ ID NO: 517780 - RNA, 64 nt, hsa; identical to SEQ ID NO: 151204

SEQ ID NO: 517781 - RNA, 64 nt, hsa; identical to SEQ ID NO: 151205

SEQ ID NO: 517782 - RNA, 64 nt, hsa; identical to SEQ ID NO: 151206

SEQ ID NO: 517783 - RNA, 64 nt, hsa; identical to SEQ ID NO: 151207

SEQ ID NO: 517784 - RNA, 64 nt, hsa; identical to SEQ ID NO: 151208

SEQ ID NO: 517785 - RNA, 64 nt, hsa; identical to SEQ ID NO: 151209

SEQ ID NO: 517786 - RNA, 64 nt, hsa; identical to SEQ ID NO: 151210

SEQ ID NO: 517787 - RNA, 64 nt, hsa; identical to SEQ ID NO: 151211

SEQ ID NO: 517788 - RNA, 64 nt, hsa; identical to SEQ ID NO: 151212

SEQ ID NO: 517789 - RNA, 64 nt, hsa; identical to SEQ ID NO: 151213

SEQ ID NO: 517790 - RNA, 64 nt, hsa; identical to SEQ ID NO: 151214

SEQ ID NO: 517791 - RNA, 64 nt, hsa; identical to SEQ ID NO: 151215

SEQ ID NO: 517792 - RNA, 64 nt, hsa; identical to SEQ ID NO: 151216

SEQ ID NO: 517793 - RNA, 64 nt, hsa; identical to SEQ ID NO: 151217

SEQ ID NO: 517794 - RNA, 64 nt, hsa; identical to SEQ ID NO: 151218

SEQ ID NO: 517795 - RNA, 64 nt, hsa; identical to SEQ ID NO: 151219

SEQ ID NO: 517796 - RNA, 64 nt, hsa; identical to SEQ ID NO: 151220

SEQ ID NO: 517797 - RNA, 64 nt, hsa; identical to SEQ ID NO: 151221

SEQ ID NO: 517798 - RNA, 64 nt, hsa; identical to SEQ ID NO: 151222

SEQ ID NO: 517799 - RNA, 64 nt, hsa; identical to SEQ ID NO: 151223

SEQ ID NO: 517800 - RNA, 64 nt, hsa; identical to SEQ ID NO: 151224

SEQ ID NO: 517801 - RNA, 64 nt, hsa; identical to SEQ ID NO: 151225

SEQ ID NO: 517802 - RNA, 64 nt, hsa; identical to SEQ ID NO: 151226

SEQ ID NO: 517803 - RNA, 64 nt, hsa; identical to SEQ ID NO: 151227

SEQ ID NO: 517804 - RNA, 64 nt, hsa
aacaucagggugaccacauuaagcccaguauuccaguuggcaccagaagauauggacuuggaau

SEQ ID NO: 517805 - RNA, 64 nt, hsa
gcacguggauguaguuuggcucaggugucccugcaguuggcaaggagucaguacucagucccug

SEQ ID NO: 517806 - RNA, 64 nt, hsa
cuuaauguggaaguuaacccuuaccaaaaaaggaaguuggcaaaaacagccuucuagcacacuu

SEQ ID NO: 517807 - RNA, 64 nt, hsa
accauuuuuaaaaugugaagauggacuucaugcaaguuggcagugguucugguacuaaaaauug

SEQ ID NO: 517808 - RNA, 64 nt, hsa
auaaacaaggaagucagcucuuucacuuuuuacaaguuggcaaaaacagacuuccggggaauuu

SEQ ID NO: 517809 - RNA, 64 nt, hsa
cugcaacuguggggccugcacacagcccuuccacaguuggcacugcaggugcaggccaacccuu

SEQ ID NO: 517810 - RNA, 64 nt, hsa
aauuuuauuuugugaagugaaggauuuguguuuuaguuggcaguuguuaaguccuuggcuugcc

SEQ ID NO: 517811 - RNA, 64 nt, hsa
gugguagguguuugaacagaggccacauuacuagaguuggcaugacucuugacucuugccugcc

SEQ ID NO: 517812 - RNA, 64 nt, hsa
cucuuuaaacacagagaccugccaagacgcccucucguccaacuaugcccaggcugaaguccuc

SEQ ID NO: 517813 - RNA, 64 nt, hsa
ccaggauuggcacaagcucccuggugagggagccucguccaaggcaguucuguguccucgcacu

SEQ ID NO: 517814 - RNA, 64 nt, hsa
agauuauauauuccgcacucaaggaguaaccaggucguccaagcaaaaacaaaugggaaaaugu

SEQ ID NO: 517815 - RNA, 64 nt, hsa
gauauuaaagggcuaauaaaaaaugagaaaccggucguccaagguggaugcugucaaugcccga

SEQ ID NO: 517816 - RNA, 64 nt, hsa
agagagagccguagcccuuuguaaaggcuuucguucguccaaacaacacuugauccaaccaaag

SEQ ID NO: 517817 - RNA, 64 nt, hsa
gacugcugaaugucugagagaaccagaguuguucucguccaagguagaaagguacgaagauaca

SEQ ID NO: 517818 - RNA, 64 nt, hsa
gaaauacagagagaaccucuuccacuuuuacuuuucguccaaauaaaaugcaugguguaccaga

SEQ ID NO: 517819 - RNA, 64 nt, hsa
ugggacgguugcggugggucugggcgcugggaagucguccaagaugauuaaaaaauucgacaag

SEQ ID NO: 517820 - RNA, 64 nt, hsa
gcucugggcugauucagagguuacugcuuuauauucguccaaacuguguuagucuaggcuuagg

SEQ ID NO: 517821 - RNA, 64 nt, hsa
uuaguaauuuauuuuugauucuuuguuuucuuuuucguccaacuaaaacaacuguaauguacuu

SEQ ID NO: 517822 - RNA, 64 nt, hsa
gugggaggagggcuacagcccacaucccacccccucguccaaucccauaauccaugaugaaagg

SEQ ID NO: 517823 - RNA, 64 nt, hsa
auuacagcuuucuagaugcuaauacaugugacuaucguccaauuugcuuucuuuuguagugaca

SEQ ID NO: 517824 - RNA, 64 nt, hsa
aguugggacaccaagucugagcuuggaguggcagucguccaaaccccaggaagagagcucuaaa

SEQ ID NO: 517825 - RNA, 64 nt, hsa
aaacacuuaacuggauuuuggaauaauaaaacucucguccaauuuggcuuuuaaaaagcaggcu

SEQ ID NO: 517826 - RNA, 64 nt, hsa
gugccuaaagcaugucgauguggcgucaaguacaucguccaaaucccugucucuucagcuucuc

SEQ ID NO: 517827 - RNA, 64 nt, hsa
gaacuaagagacuuaagaggucgugguuccuauaucguccaaaaaauaggcuguuacauauccu

SEQ ID NO: 517828 - RNA, 64 nt, hsa
acgucgcaggacaguugugaaaauaacaugacgcucguccaaggccacuuccugagggcaaguc

SEQ ID NO: 517829 - RNA, 64 nt, hsa
cccugcagcucugggccaccugcugguguccaccucguccaacagagucguggugcuggaugcu

SEQ ID NO: 517830 - RNA, 64 nt, hsa
uccugauucagcacuuugcucuuuuaauaacaaaucguccaaagaucucaaaguaaggguuuuu

SEQ ID NO: 517831 - RNA, 64 nt, hsa
uaggaccugcauccuuccuggggacgaauuccacucguccaagggacagcccacggucuggagg

SEQ ID NO: 517832 - RNA, 64 nt, hsa
ggaugggguggugccuuggucucucuugacuaccucguccaaagagagcacugcccuuagacaa

SEQ ID NO: 517833 - RNA, 64 nt, hsa
cuacucuguuccuucacguccucccuucucagccucguccaagcaccgggaagaccuccaggcu

SEQ ID NO: 517834 - RNA, 64 nt, hsa
uccaaaguucucaguuaucaagaccucauccagcucguccaaaggcuucagggauggaaacaaa

SEQ ID NO: 517835 - RNA, 64 nt, hsa
gcauggucccuggagccgagccuucaccacgcacucguccaaguucggaugcgggaaccugguc

SEQ ID NO: 517836 - RNA, 64 nt, hsa
cccugagggcagcaggaugguggccuggguggggucguccaacuagguuugcuaaccugagggg

SEQ ID NO: 517837 - RNA, 64 nt, hsa
ucuugcguauuucuggaucuccuucccuccuuucucguccaaaucaugaaauguuuggccuuag

SEQ ID NO: 517838 - RNA, 64 nt, hsa
cagccacaacuucagaaagcagccaucccgcgugucguccaaacagcagugccugcgucccgcu

SEQ ID NO: 517839 - RNA, 64 nt, hsa
cuuccuuugucuaaugugggauuccugacucccuucguccaaggcaccggugugugugugucuu

SEQ ID NO: 517840 - RNA, 64 nt, hsa
aagaggaggacaaaaagggggaggagaagguucuucguccaaaggaggaaggagaagaaguaga

SEQ ID NO: 517841 - RNA, 64 nt, hsa
gagguuuccagcugacuagaacccucuuuucuacucguccaaaccacucccgucaccugccuug

SEQ ID NO: 517842 - RNA, 64 nt, hsa
gguugucuugggguggggcccauccgccgagguggggaccgauaggagaagccgguggguugua

SEQ ID NO: 517843 - RNA, 64 nt, hsa
uggguuugggaagagugagggugguuggggagaggggaccgaugugccucauuguuuaguggug

SEQ ID NO: 517844 - RNA, 64 nt, hsa
ccugcugguaauaucgggaaagauuuuaaugaaaccaggguagaauuguuuggcaaugcacuga

SEQ ID NO: 517845 - RNA, 64 nt, hsa
cucugcggggaggacccgggaccacagcugcuggccaggguagacuuggagcuguccuccagag

SEQ ID NO: 517846 - RNA, 64 nt, hsa
cucuugguaccuguggguuagcaucaaguucuccccaggguagaauucaaucagagcuccaguu

SEQ ID NO: 517847 - RNA, 64 nt, hsa
ccgcucccuucccuccauagccacgcuccaaaccccaggguagccauggccggguaaagcaagg

SEQ ID NO: 517848 - RNA, 64 nt, hsa
ugugcccuugcucucuaacuucugagcccaccucccaggguaggcaccugggggcaugcaggug

SEQ ID NO: 517849 - RNA, 64 nt, hsa
gguaggcaccugggggcaugcaggugcccaccucccaggguaggcaccugggggcaugcaggua

SEQ ID NO: 517850 - RNA, 64 nt, hsa
cuaacaacuguccccucacccaccagcuauuuccccaggguagagugggcaauucucaccuuca

SEQ ID NO: 517851 - RNA, 64 nt, hsa
ugugucccuguuucaguugcacugggguuggagcccaggguagggguuuccagcuuccccaggc

SEQ ID NO: 517852 - RNA, 64 nt, hsa; identical to SEQ ID NO: 441022

SEQ ID NO: 517853 - RNA, 64 nt, hsa; identical to SEQ ID NO: 441023

SEQ ID NO: 517854 - RNA, 64 nt, hsa; identical to SEQ ID NO: 441024

SEQ ID NO: 517855 - RNA, 64 nt, hsa; identical to SEQ ID NO: 441025

SEQ ID NO: 517856 - RNA, 64 nt, hsa; identical to SEQ ID NO: 441026

SEQ ID NO: 517857 - RNA, 64 nt, hsa; identical to SEQ ID NO: 441027

SEQ ID NO: 517858 - RNA, 64 nt, hsa; identical to SEQ ID NO: 441028

SEQ ID NO: 517859 - RNA, 64 nt, hsa; identical to SEQ ID NO: 441029

SEQ ID NO: 517860 - RNA, 64 nt, hsa; identical to SEQ ID NO: 441030

SEQ ID NO: 517861 - RNA, 64 nt, hsa; identical to SEQ ID NO: 441031

SEQ ID NO: 517862 - RNA, 64 nt, hsa; identical to SEQ ID NO: 441032

SEQ ID NO: 517863 - RNA, 64 nt, hsa; identical to SEQ ID NO: 441033

SEQ ID NO: 517864 - RNA, 64 nt, hsa; identical to SEQ ID NO: 441034

SEQ ID NO: 517865 - RNA, 64 nt, hsa; identical to SEQ ID NO: 441035

SEQ ID NO: 517866 - RNA, 64 nt, hsa; identical to SEQ ID NO: 441036

SEQ ID NO: 517867 - RNA, 64 nt, hsa; identical to SEQ ID NO: 441037

SEQ ID NO: 517868 - RNA, 64 nt, hsa; identical to SEQ ID NO: 441038

SEQ ID NO: 517869 - RNA, 64 nt, hsa; identical to SEQ ID NO: 441039

SEQ ID NO: 517870 - RNA, 64 nt, hsa; identical to SEQ ID NO: 441040

SEQ ID NO: 517871 - RNA, 64 nt, hsa; identical to SEQ ID NO: 441041

SEQ ID NO: 517872 - RNA, 64 nt, hsa; identical to SEQ ID NO: 441042

SEQ ID NO: 517873 - RNA, 63 nt, hsa
gguuuuguuuuuuuuuuaaaggaaaugcagccuagucuugagaacauaauuuuauauaaucaa

SEQ ID NO: 517874 - RNA, 63 nt, hsa
uaucuaauaagaguucaaagaguuaugaguugaagucuugaaugcaggaaacuaucugauagu

SEQ ID NO: 517875 - RNA, 63 nt, hsa
aagugaggccaguguuauuucccgggaguguucagucuugacccuagucacugauuuuuucua

SEQ ID NO: 517876 - RNA, 63 nt, hsa
aaagccaaacuccaagaccaaguaaguuagaggagucuugauuuuuuagacuucacugcggag

SEQ ID NO: 517877 - RNA, 63 nt, hsa
acaagcaugcaccacggcacccagcagaauuccagucuugagaaacaggucaaggacagcuuc

SEQ ID NO: 517878 - RNA, 63 nt, hsa
gagacagaaucuugcuauguugugcggcaagcuagucuugaacucauggccucaagucauccu

SEQ ID NO: 517879 - RNA, 64 nt, hsa; identical to SEQ ID NO: 385306

SEQ ID NO: 517880 - RNA, 64 nt, hsa; identical to SEQ ID NO: 385307

SEQ ID NO: 517881 - RNA, 64 nt, hsa; identical to SEQ ID NO: 385308

SEQ ID NO: 517882 - RNA, 64 nt, hsa; identical to SEQ ID NO: 385309

SEQ ID NO: 517883 - RNA, 64 nt, hsa; identical to SEQ ID NO: 385310

SEQ ID NO: 517884 - RNA, 64 nt, hsa; identical to SEQ ID NO: 385311

SEQ ID NO: 517885 - RNA, 64 nt, hsa; identical to SEQ ID NO: 385312

SEQ ID NO: 517886 - RNA, 64 nt, hsa; identical to SEQ ID NO: 385313

SEQ ID NO: 517887 - RNA, 64 nt, hsa; identical to SEQ ID NO: 385314

SEQ ID NO: 517888 - RNA, 57 nt, hsa; identical to SEQ ID NO: 385315

SEQ ID NO: 517889 - RNA, 64 nt, hsa; identical to SEQ ID NO: 385316

SEQ ID NO: 517890 - RNA, 64 nt, hsa; identical to SEQ ID NO: 385317

SEQ ID NO: 517891 - RNA, 64 nt, hsa; identical to SEQ ID NO: 385318

SEQ ID NO: 517892 - RNA, 64 nt, hsa; identical to SEQ ID NO: 385319

SEQ ID NO: 517893 - RNA, 64 nt, hsa; identical to SEQ ID NO: 385320

SEQ ID NO: 517894 - RNA, 64 nt, hsa; identical to SEQ ID NO: 385321

SEQ ID NO: 517895 - RNA, 64 nt, hsa; identical to SEQ ID NO: 385322

SEQ ID NO: 517896 - RNA, 64 nt, hsa; identical to SEQ ID NO: 385323

SEQ ID NO: 517897 - RNA, 64 nt, hsa; identical to SEQ ID NO: 385324

SEQ ID NO: 517898 - RNA, 64 nt, hsa; identical to SEQ ID NO: 385325

SEQ ID NO: 517899 - RNA, 64 nt, hsa; identical to SEQ ID NO: 385326

SEQ ID NO: 517900 - RNA, 64 nt, hsa; identical to SEQ ID NO: 385327

SEQ ID NO: 517901 - RNA, 64 nt, hsa; identical to SEQ ID NO: 385328

SEQ ID NO: 517902 - RNA, 64 nt, hsa; identical to SEQ ID NO: 385329

SEQ ID NO: 517903 - RNA, 64 nt, hsa; identical to SEQ ID NO: 385330

SEQ ID NO: 517904 - RNA, 64 nt, hsa; identical to SEQ ID NO: 385331

SEQ ID NO: 517905 - RNA, 64 nt, hsa; identical to SEQ ID NO: 385332

SEQ ID NO: 517906 - RNA, 64 nt, hsa; identical to SEQ ID NO: 385333

SEQ ID NO: 517907 - RNA, 64 nt, hsa; identical to SEQ ID NO: 385334

SEQ ID NO: 517908 - RNA, 64 nt, hsa; identical to SEQ ID NO: 385335

SEQ ID NO: 517909 - RNA, 64 nt, hsa; identical to SEQ ID NO: 385336

SEQ ID NO: 517910 - RNA, 64 nt, hsa; identical to SEQ ID NO: 385337

SEQ ID NO: 517911 - RNA, 64 nt, hsa; identical to SEQ ID NO: 385338

SEQ ID NO: 517912 - RNA, 64 nt, hsa; identical to SEQ ID NO: 385339

SEQ ID NO: 517913 - RNA, 64 nt, hsa; identical to SEQ ID NO: 385340

SEQ ID NO: 517914 - RNA, 64 nt, hsa; identical to SEQ ID NO: 385341

SEQ ID NO: 517915 - RNA, 64 nt, hsa; identical to SEQ ID NO: 385342

SEQ ID NO: 517916 - RNA, 64 nt, hsa; identical to SEQ ID NO: 385343

SEQ ID NO: 517917 - RNA, 64 nt, hsa; identical to SEQ ID NO: 385344

SEQ ID NO: 517918 - RNA, 64 nt, hsa; identical to SEQ ID NO: 385345

SEQ ID NO: 517919 - RNA, 64 nt, hsa; identical to SEQ ID NO: 385346

SEQ ID NO: 517920 - RNA, 64 nt, hsa; identical to SEQ ID NO: 385347

SEQ ID NO: 517921 - RNA, 64 nt, hsa; identical to SEQ ID NO: 385348

SEQ ID NO: 517922 - RNA, 64 nt, hsa; identical to SEQ ID NO: 385349

SEQ ID NO: 517923 - RNA, 64 nt, hsa; identical to SEQ ID NO: 385350

SEQ ID NO: 517924 - RNA, 64 nt, hsa; identical to SEQ ID NO: 385351

SEQ ID NO: 517925 - RNA, 64 nt, hsa; identical to SEQ ID NO: 385352

SEQ ID NO: 517926 - RNA, 64 nt, hsa; identical to SEQ ID NO: 385353

SEQ ID NO: 517927 - RNA, 58 nt, hsa; identical to SEQ ID NO: 385354

SEQ ID NO: 517928 - RNA, 64 nt, hsa; identical to SEQ ID NO: 385355

SEQ ID NO: 517929 - RNA, 64 nt, hsa; identical to SEQ ID NO: 385356

SEQ ID NO: 517930 - RNA, 64 nt, hsa; identical to SEQ ID NO: 385357

SEQ ID NO: 517931 - RNA, 64 nt, hsa; identical to SEQ ID NO: 385358

SEQ ID NO: 517932 - RNA, 64 nt, hsa; identical to SEQ ID NO: 385359

SEQ ID NO: 517933 - RNA, 64 nt, hsa; identical to SEQ ID NO: 385360

SEQ ID NO: 517934 - RNA, 64 nt, hsa; identical to SEQ ID NO: 385361

SEQ ID NO: 517935 - RNA, 64 nt, hsa; identical to SEQ ID NO: 385362

SEQ ID NO: 517936 - RNA, 64 nt, hsa; identical to SEQ ID NO: 385363

SEQ ID NO: 517937 - RNA, 64 nt, hsa; identical to SEQ ID NO: 385364

SEQ ID NO: 517938 - RNA, 64 nt, hsa; identical to SEQ ID NO: 385365

SEQ ID NO: 517939 - RNA, 64 nt, hsa; identical to SEQ ID NO: 385366

SEQ ID NO: 517940 - RNA, 64 nt, hsa; identical to SEQ ID NO: 385367

SEQ ID NO: 517941 - RNA, 64 nt, hsa; identical to SEQ ID NO: 385368

SEQ ID NO: 517942 - RNA, 64 nt, hsa; identical to SEQ ID NO: 385369

SEQ ID NO: 517943 - RNA, 64 nt, hsa; identical to SEQ ID NO: 385370

SEQ ID NO: 517944 - RNA, 64 nt, hsa; identical to SEQ ID NO: 385371

SEQ ID NO: 517945 - RNA, 64 nt, hsa; identical to SEQ ID NO: 385372

SEQ ID NO: 517946 - RNA, 64 nt, hsa; identical to SEQ ID NO: 385373

SEQ ID NO: 517947 - RNA, 64 nt, hsa; identical to SEQ ID NO: 385374

SEQ ID NO: 517948 - RNA, 64 nt, hsa; identical to SEQ ID NO: 385375

SEQ ID NO: 517949 - RNA, 64 nt, hsa; identical to SEQ ID NO: 385376

SEQ ID NO: 517950 - RNA, 64 nt, hsa; identical to SEQ ID NO: 385377

SEQ ID NO: 517951 - RNA, 64 nt, hsa; identical to SEQ ID NO: 385378

SEQ ID NO: 517952 - RNA, 64 nt, hsa; identical to SEQ ID NO: 385379

SEQ ID NO: 517953 - RNA, 64 nt, hsa; identical to SEQ ID NO: 385380

SEQ ID NO: 517954 - RNA, 64 nt, hsa; identical to SEQ ID NO: 385381

SEQ ID NO: 517955 - RNA, 64 nt, hsa; identical to SEQ ID NO: 385382

SEQ ID NO: 517956 - RNA, 64 nt, hsa; identical to SEQ ID NO: 385383

SEQ ID NO: 517957 - RNA, 64 nt, hsa; identical to SEQ ID NO: 385384

SEQ ID NO: 517958 - RNA, 64 nt, hsa; identical to SEQ ID NO: 385385

SEQ ID NO: 517959 - RNA, 64 nt, hsa; identical to SEQ ID NO: 385386

SEQ ID NO: 517960 - RNA, 64 nt, hsa; identical to SEQ ID NO: 385387

SEQ ID NO: 517961 - RNA, 64 nt, hsa; identical to SEQ ID NO: 385388

SEQ ID NO: 517962 - RNA, 64 nt, hsa; identical to SEQ ID NO: 385389

SEQ ID NO: 517963 - RNA, 64 nt, hsa; identical to SEQ ID NO: 385390

SEQ ID NO: 517964 - RNA, 64 nt, hsa; identical to SEQ ID NO: 385391

SEQ ID NO: 517965 - RNA, 64 nt, hsa; identical to SEQ ID NO: 133916

SEQ ID NO: 517966 - RNA, 64 nt, hsa; identical to SEQ ID NO: 133917

SEQ ID NO: 517967 - RNA, 64 nt, hsa; identical to SEQ ID NO: 133918

SEQ ID NO: 517968 - RNA, 64 nt, hsa; identical to SEQ ID NO: 133919

SEQ ID NO: 517969 - RNA, 64 nt, hsa; identical to SEQ ID NO: 133920

SEQ ID NO: 517970 - RNA, 64 nt, hsa; identical to SEQ ID NO: 133921

SEQ ID NO: 517971 - RNA, 64 nt, hsa; identical to SEQ ID NO: 133922

SEQ ID NO: 517972 - RNA, 64 nt, hsa; identical to SEQ ID NO: 133923

SEQ ID NO: 517973 - RNA, 64 nt, hsa; identical to SEQ ID NO: 133924

SEQ ID NO: 517974 - RNA, 64 nt, hsa; identical to SEQ ID NO: 133925

SEQ ID NO: 517975 - RNA, 64 nt, hsa; identical to SEQ ID NO: 133926

SEQ ID NO: 517976 - RNA, 64 nt, hsa; identical to SEQ ID NO: 133927

SEQ ID NO: 517977 - RNA, 64 nt, hsa; identical to SEQ ID NO: 133928

SEQ ID NO: 517978 - RNA, 64 nt, hsa; identical to SEQ ID NO: 133929

SEQ ID NO: 517979 - RNA, 64 nt, hsa
cugggcacaguggcucacgccuguagucccagcuacuugggaggcugaggcaggagaaucacuu

SEQ ID NO: 517980 - RNA, 64 nt, hsa
ccaggcauggugccgcauaacuauaaucccagcuacuugggaggcugaggcaggagaaucgcuu

SEQ ID NO: 517981 - RNA, 64 nt, hsa
cugagcaugguggugggcuccuguagucccagcuacuugggaggcugaggcaggagaaucgcuu

SEQ ID NO: 517982 - RNA, 64 nt, hsa
cugggugugguggcaugugccuauaaucccagcuacuugggagguugaagcagaauugcuugaa

SEQ ID NO: 517983 - RNA, 64 nt, hsa
uaaauucaugguuuuaaagcuaaacguaauuuccacuugggacuagaucacaacugaagauaac

SEQ ID NO: 517984 - RNA, 64 nt, hsa
ccaggcauaguggcacacgccuguagucccaguuacuugggaggcugaggcaggagaauugcuu

SEQ ID NO: 517985 - RNA, 64 nt, hsa
ccgggcgugguggcaccugccuguaaucccagcuacuugggaggcugaggcaggagaaucgcuu

SEQ ID NO: 517986 - RNA, 64 nt, hsa
cugggccugguggcacacgccuguagucccagcuacuugggaggcugaggcaggagaauugcuu

SEQ ID NO: 517987 - RNA, 64 nt, hsa
caaaaauuagccggguguggugguggguaccgcuacuugggaggcugaggcaggagaaucgcuu

SEQ ID NO: 517988 - RNA, 64 nt, hsa
ccgagcacgguggugcaugccuguaaucccagcuacuugggaggcugaggcacgagauuccuug

SEQ ID NO: 517989 - RNA, 64 nt, hsa
gccgggcacgguggcucacgccuguaaucccaguacuugggaggccaaggcaggcauaucaacu

SEQ ID NO: 517990 - RNA, 64 nt, hsa
ggccaagugaagacccaagucucagaaaacccagacuugggacaacugccugggaacuaggaug

SEQ ID NO: 517991 - RNA, 64 nt, hsa
uuuuauucgcacaucccaccccauccccugaacuacuugggagguggggagggguacgagucca

SEQ ID NO: 517992 - RNA, 64 nt, hsa
auggaaugccaugaaauguacuguauuguauauuacuugggaggacacuagguuuucaaagaag

SEQ ID NO: 517993 - RNA, 64 nt, hsa
ccgggcaugcuggcacgcaccaguaaucccagcuacuugggaggcugaggcaggagaaucacuu

SEQ ID NO: 517994 - RNA, 64 nt, hsa
uccuuauucauuaauuuucuugauuaauagggaaacuugggaauagcuauaaaguaaaacuugg

SEQ ID NO: 517995 - RNA, 64 nt, hsa
cuguccuggcugaacaagaagagacacaugcuccacuugggagccuuugccaccacgcaacuca

SEQ ID NO: 517996 - RNA, 64 nt, hsa
caugucuguaaucccagcuacuguaaucucagcuacuugggaggcugaggcaggagaauugccu

SEQ ID NO: 517997 - RNA, 64 nt, hsa
ccaggcaugguggcgugugccaguaaucccagcuacuugggaggcugaggcgcgagaaucgcuu

SEQ ID NO: 517998 - RNA, 64 nt, hsa
aaaaagaccauuguaguaaauaaguucaaggggaacuugggaccagaaaccacuguuauguaca

SEQ ID NO: 517999 - RNA, 64 nt, hsa
acuagaccuuucuuauccuccuccuagaguuuugacuugggacucuaguguuaagaugaugagc

SEQ ID NO: 518000 - RNA, 64 nt, hsa
cuguuggcuagcagcugucacagauaggcagggcacuugggauaugaccuuucuguccagguga

SEQ ID NO: 518001 - RNA, 64 nt, hsa
acugcccagaacccuggccauucucaaaaugagaacuugggaauguuuaagaagaaaucaaaca

SEQ ID NO: 518002 - RNA, 64 nt, hsa
ugugugucaucagcaucaccuagguuuccagcugacuugggaacugcaagucugagucuaacag

SEQ ID NO: 518003 - RNA, 64 nt, hsa
cugggugcgguggcaggugccuguaaucccagcuacuugggacacugaggcaggagaaucacuu

SEQ ID NO: 518004 - RNA, 64 nt, hsa
uuuucucacuuuaugucucucugaccuaugggcuacuugggagagcacuggacuccauucaugc

SEQ ID NO: 518005 - RNA, 64 nt, hsa
ccaggcgugguggcacgugccuguagucccagcuacuugggaggcuaagucaggagaauugcuu

SEQ ID NO: 518006 - RNA, 64 nt, hsa
cuacuugggaggcuaagucaggagaauugcuugaacuugggagauggagguugcagugagccaa

SEQ ID NO: 518007 - RNA, 64 nt, hsa
gagaaaaaucuggcauacugaauaaauaacauuaacuugggagccaagagcuggguaagccuua

SEQ ID NO: 518008 - RNA, 64 nt, hsa
gaaaggaauugaaaauuaauuuacacuaguugcuacuugggaauaaagggcuuuuugagggggg

SEQ ID NO: 518009 - RNA, 64 nt, hsa
uaucucugagacaccccgauuggcuggagaauugacuugggagagauaaggagggagggcgggu

SEQ ID NO: 518010 - RNA, 64 nt, hsa
uugcuuugagcccacaagguaauggagggcuccuacuugggacagagcccucagcagagaauua

SEQ ID NO: 518011 - RNA, 64 nt, hsa
ccaggcgugguggcacgugccuguaaucccagcuacuugggaggcugaggcgggagaaucgcuu

SEQ ID NO: 518012 - RNA, 64 nt, hsa
agccauugcgcuggcccucuucauaggcuuuuggacuugggaauagaaaagcaaccccgucucu

SEQ ID NO: 518013 - RNA, 64 nt, hsa
ugugaugaguacggaaaagucuucagagguuggaacuugggaaaaaucagugagugaauucaua

SEQ ID NO: 518014 - RNA, 64 nt, hsa
gauagcuaccuggacuuuacagagcugucagaagacuugggaagguuugccagcauuggaaaaa

SEQ ID NO: 518015 - RNA, 64 nt, hsa
uucccuauagcuucuaagcaguuucaucagcauuacuugggaaaacguguugcaagucaaccag

SEQ ID NO: 518016 - RNA, 64 nt, hsa
ccgggcaugauggugggcaccuguaaucccagcuacuugggaggcugaggcaggagaaucacuu

SEQ ID NO: 518017 - RNA, 64 nt, hsa
cuacuugggaggcugaggcacaagaaucacuugaacuugggagguggagguugcagugagccaa

SEQ ID NO: 518018 - RNA, 64 nt, hsa
ccaggugugguggugggcaccuguaaucucagcuacuugggaggcugaggcacaagaaucacuu

SEQ ID NO: 518019 - RNA, 64 nt, hsa
uagaguguuaccuccaacucauuugauuucccuuacuugggaaaaugcaguccaguguucucac

SEQ ID NO: 518020 - RNA, 64 nt, hsa
ccgggcauggugucaggcaccuguaaucccagcuacuugggaggcugaggcaggagaauugcuu

SEQ ID NO: 518021 - RNA, 64 nt, hsa
aacauggauguuaaggcuguuuugcuuggagaagacuugggacugggacagucuuuagauauua

SEQ ID NO: 518022 - RNA, 64 nt, hsa
auuucucaaagcuaaagagauauacauucuggauacuugggaggggaauaaauuaaaguuuuca

SEQ ID NO: 518023 - RNA, 64 nt, hsa
cgagagcugggagaagaggcaaagcuacagguuuacuugggagccagcugagaagagagcagac

SEQ ID NO: 518024 - RNA, 64 nt, hsa
uggggcugaugagaacaucgugaccaucagaccuacuugggagagaacgcagagcucccagccu

SEQ ID NO: 518025 - RNA, 64 nt, hsa
cuuucuggccauuuggacaaaagcaguugccccgacuugggauuuuccuguagucuucaguggu

SEQ ID NO: 518026 - RNA, 64 nt, hsa
ugaagaagaaaccaauguacuguggucucuugggacuugggacagggacucuagcagcaccucu

SEQ ID NO: 518027 - RNA, 64 nt, hsa
ugggacuuggucucuguccugccccauccucgucacuugggaccacgagcccugguucagucac

SEQ ID NO: 518028 - RNA, 64 nt, hsa
agaguccaagggagcagccacguuaggaagagagacuugggaacagcuacacagggagcuagaa

SEQ ID NO: 518029 - RNA, 64 nt, hsa
aggguggcucaacccacaaaucaacugaucuacuacuugggagacaguggaaggaaagauagag

SEQ ID NO: 518030 - RNA, 64 nt, hsa
aaauaggcagauauagcuuuuuaaaauauaaaguacuugggauuuugcauuauuuuucuuaaua

SEQ ID NO: 518031 - RNA, 64 nt, hsa
cugggugugggggcgugcgccuguagucccagcuacuugggaggcugaggcaggagaauugcuu

SEQ ID NO: 518032 - RNA, 64 nt, hsa
aguguuguauuuuucugcaaaauagugaauugguacuugggagacuucuguucuuuguugaaaa

SEQ ID NO: 518033 - RNA, 64 nt, hsa
gaugaacaaaauacuauagcaugcaugccacugcacuugggaccucaucaugucaguugaaucg

SEQ ID NO: 518034 - RNA, 64 nt, hsa
uauguagacuagcacagagugguacauccuaaaaacuugggaaacacagcaacccaugacuucc

SEQ ID NO: 518035 - RNA, 64 nt, hsa
ucagcuuaaugacccagggguguauuuuugaaggacuugggagcucucuuugaaaggcaaacaa

SEQ ID NO: 518036 - RNA, 64 nt, hsa
ugucuuucccugugugugaaaucuuaacgucucuacuugggaacgcugaucccauucauuuaga

SEQ ID NO: 518037 - RNA, 64 nt, hsa
ccgaugucccugaauaucagccuguagcuaauggacuugggauuucuggucuaagugggccucc

SEQ ID NO: 518038 - RNA, 64 nt, hsa
ucuagccacuccucccagcucuucugugcuguccacuugggaagcuaaggcucucaaaacgggc

SEQ ID NO: 518039 - RNA, 64 nt, hsa
cuacuugggaggcugaggcaggagaauugcuugaacuugggagguggaggccaagauuguacca

SEQ ID NO: 518040 - RNA, 64 nt, hsa
ccgggcgugguggugggugccuguaauccuagcuacuugggaggcugaggcaggagaauugcuu

SEQ ID NO: 518041 - RNA, 64 nt, hsa
cugggcuuaguggugcaugccuguagucucagcuacuugggaggcugaggcaggagaauugcuu

SEQ ID NO: 518042 - RNA, 64 nt, hsa
ccgggcgugguggcaggugccuguaaucccagcuacuugggaggcugaggcaggagagugcuug

SEQ ID NO: 518043 - RNA, 64 nt, hsa
gaaagagaagguuuuuaaggaggggcuucugaauacuugggagauacggaacggaccaaggacc

SEQ ID NO: 518044 - RNA, 64 nt, hsa
caaaauuaugagugagcuguuaacucuaaaauguacuugggagauaggccaagcgagaggucau

SEQ ID NO: 518045 - RNA, 64 nt, hsa
gcuggucgcaguggcuuacacuuguaacccuagaacuugggaggcugaggugggcggauuacuu

SEQ ID NO: 518046 - RNA, 64 nt, hsa
ccgggugugguagugcaugccuguagucccagcuacuugggaggcugaagugggaggauggccu

SEQ ID NO: 518047 - RNA, 64 nt, hsa; identical to SEQ ID NO: 275345

SEQ ID NO: 518048 - RNA, 64 nt, hsa; identical to SEQ ID NO: 275346

SEQ ID NO: 518049 - RNA, 64 nt, hsa; identical to SEQ ID NO: 275347

SEQ ID NO: 518050 - RNA, 64 nt, hsa; identical to SEQ ID NO: 275348

SEQ ID NO: 518051 - RNA, 64 nt, hsa; identical to SEQ ID NO: 275349

SEQ ID NO: 518052 - RNA, 64 nt, hsa; identical to SEQ ID NO: 275350

SEQ ID NO: 518053 - RNA, 64 nt, hsa; identical to SEQ ID NO: 275351

SEQ ID NO: 518054 - RNA, 64 nt, hsa; identical to SEQ ID NO: 275352

SEQ ID NO: 518055 - RNA, 64 nt, hsa; identical to SEQ ID NO: 275353

SEQ ID NO: 518056 - RNA, 64 nt, hsa; identical to SEQ ID NO: 275354

SEQ ID NO: 518057 - RNA, 64 nt, hsa; identical to SEQ ID NO: 275355

SEQ ID NO: 518058 - RNA, 64 nt, hsa; identical to SEQ ID NO: 275356

SEQ ID NO: 518059 - RNA, 64 nt, hsa; identical to SEQ ID NO: 275357

SEQ ID NO: 518060 - RNA, 64 nt, hsa; identical to SEQ ID NO: 275358

SEQ ID NO: 518061 - RNA, 64 nt, hsa; identical to SEQ ID NO: 275359

SEQ ID NO: 518062 - RNA, 64 nt, hsa; identical to SEQ ID NO: 275360

SEQ ID NO: 518063 - RNA, 64 nt, hsa; identical to SEQ ID NO: 275361

SEQ ID NO: 518064 - RNA, 64 nt, hsa; identical to SEQ ID NO: 275362

SEQ ID NO: 518065 - RNA, 64 nt, hsa; identical to SEQ ID NO: 97063

SEQ ID NO: 518066 - RNA, 64 nt, hsa; identical to SEQ ID NO: 97064

SEQ ID NO: 518067 - RNA, 64 nt, hsa; identical to SEQ ID NO: 97065

SEQ ID NO: 518068 - RNA, 64 nt, hsa; identical to SEQ ID NO: 97066

SEQ ID NO: 518069 - RNA, 64 nt, hsa; identical to SEQ ID NO: 97067

SEQ ID NO: 518070 - RNA, 64 nt, hsa; identical to SEQ ID NO: 97068

SEQ ID NO: 518071 - RNA, 64 nt, hsa; identical to SEQ ID NO: 97069

SEQ ID NO: 518072 - RNA, 64 nt, hsa; identical to SEQ ID NO: 97070

SEQ ID NO: 518073 - RNA, 64 nt, hsa; identical to SEQ ID NO: 97071

SEQ ID NO: 518074 - RNA, 64 nt, hsa; identical to SEQ ID NO: 97072

SEQ ID NO: 518075 - RNA, 64 nt, hsa; identical to SEQ ID NO: 97073

SEQ ID NO: 518076 - RNA, 64 nt, hsa; identical to SEQ ID NO: 97074

SEQ ID NO: 518077 - RNA, 64 nt, hsa; identical to SEQ ID NO: 97075

SEQ ID NO: 518078 - RNA, 64 nt, hsa; identical to SEQ ID NO: 97076

SEQ ID NO: 518079 - RNA, 64 nt, hsa; identical to SEQ ID NO: 97077

SEQ ID NO: 518080 - RNA, 64 nt, hsa; identical to SEQ ID NO: 97078

SEQ ID NO: 518081 - RNA, 64 nt, hsa; identical to SEQ ID NO: 97079

SEQ ID NO: 518082 - RNA, 64 nt, hsa; identical to SEQ ID NO: 97080

SEQ ID NO: 518083 - RNA, 64 nt, hsa; identical to SEQ ID NO: 97081

SEQ ID NO: 518084 - RNA, 64 nt, hsa; identical to SEQ ID NO: 97082

SEQ ID NO: 518085 - RNA, 64 nt, hsa; identical to SEQ ID NO: 97083

SEQ ID NO: 518086 - RNA, 64 nt, hsa; identical to SEQ ID NO: 97084

SEQ ID NO: 518087 - RNA, 64 nt, hsa; identical to SEQ ID NO: 97085

SEQ ID NO: 518088 - RNA, 64 nt, hsa; identical to SEQ ID NO: 97086

SEQ ID NO: 518089 - RNA, 64 nt, hsa; identical to SEQ ID NO: 97087

SEQ ID NO: 518090 - RNA, 64 nt, hsa
aauuucauuugaguuaaauuuacaugcucggucacucauugagaaaauuuacacagacucugaa

SEQ ID NO: 518091 - RNA, 64 nt, hsa
guggcacuuggccaggacgcuccguugaaugaagcucauugauuggccaugcuggucaugucua

SEQ ID NO: 518092 - RNA, 64 nt, hsa
cucauuugucuuccuacccuacucacauaauucacucauugacucacucauucaccagauauuu

SEQ ID NO: 518093 - RNA, 64 nt, hsa
cccagcuucuggaaauggcagaagagaggguuuucucauugaaugggggugggggcucgugugu

SEQ ID NO: 518094 - RNA, 64 nt, hsa
gcagaguggaugcaguuuguagcuuucagagugucucauugagucuagaucauugaaccaacac

SEQ ID NO: 518095 - RNA, 64 nt, hsa
uucucaucuuuucauauaccucuaacccccgguacucauugaaucauugaugagguaucucaau

SEQ ID NO: 518096 - RNA, 64 nt, hsa
gaggaauuugguauucugguggccuugcucagcucucauugagaucuuuuccuaucagaauguu

SEQ ID NO: 518097 - RNA, 64 nt, hsa
auauuugcauuugaaaggauugcuuccuguucugcucauugaucaaagguagggccaauuaagg

SEQ ID NO: 518098 - RNA, 64 nt, hsa; identical to SEQ ID NO: 124927

SEQ ID NO: 518099 - RNA, 64 nt, hsa; identical to SEQ ID NO: 124928

SEQ ID NO: 518100 - RNA, 64 nt, hsa; identical to SEQ ID NO: 124929

SEQ ID NO: 518101 - RNA, 64 nt, hsa; identical to SEQ ID NO: 124930

SEQ ID NO: 518102 - RNA, 64 nt, hsa; identical to SEQ ID NO: 124931

SEQ ID NO: 518103 - RNA, 64 nt, hsa; identical to SEQ ID NO: 124932

SEQ ID NO: 518104 - RNA, 64 nt, hsa; identical to SEQ ID NO: 124933

SEQ ID NO: 518105 - RNA, 64 nt, hsa; identical to SEQ ID NO: 124934

SEQ ID NO: 518106 - RNA, 64 nt, hsa; identical to SEQ ID NO: 124935

SEQ ID NO: 518107 - RNA, 64 nt, hsa; identical to SEQ ID NO: 124936

SEQ ID NO: 518108 - RNA, 64 nt, hsa; identical to SEQ ID NO: 124937

SEQ ID NO: 518109 - RNA, 64 nt, hsa; identical to SEQ ID NO: 124938

SEQ ID NO: 518110 - RNA, 64 nt, hsa; identical to SEQ ID NO: 124939

SEQ ID NO: 518111 - RNA, 64 nt, hsa; identical to SEQ ID NO: 124940

SEQ ID NO: 518112 - RNA, 64 nt, hsa; identical to SEQ ID NO: 124941

SEQ ID NO: 518113 - RNA, 64 nt, hsa; identical to SEQ ID NO: 124942

SEQ ID NO: 518114 - RNA, 64 nt, hsa; identical to SEQ ID NO: 124943

SEQ ID NO: 518115 - RNA, 64 nt, hsa; identical to SEQ ID NO: 124944

SEQ ID NO: 518116 - RNA, 64 nt, hsa; identical to SEQ ID NO: 124945

SEQ ID NO: 518117 - RNA, 64 nt, hsa; identical to SEQ ID NO: 124946

SEQ ID NO: 518118 - RNA, 64 nt, hsa; identical to SEQ ID NO: 124947

SEQ ID NO: 518119 - RNA, 64 nt, hsa; identical to SEQ ID NO: 124948

SEQ ID NO: 518120 - RNA, 64 nt, hsa; identical to SEQ ID NO: 124949

SEQ ID NO: 518121 - RNA, 64 nt, hsa; identical to SEQ ID NO: 124950

SEQ ID NO: 518122 - RNA, 64 nt, hsa; identical to SEQ ID NO: 124951

SEQ ID NO: 518123 - RNA, 64 nt, hsa; identical to SEQ ID NO: 124952

SEQ ID NO: 518124 - RNA, 64 nt, hsa; identical to SEQ ID NO: 124953

SEQ ID NO: 518125 - RNA, 64 nt, hsa; identical to SEQ ID NO: 124954

SEQ ID NO: 518126 - RNA, 64 nt, hsa; identical to SEQ ID NO: 124955

SEQ ID NO: 518127 - RNA, 64 nt, hsa; identical to SEQ ID NO: 124956

SEQ ID NO: 518128 - RNA, 64 nt, hsa; identical to SEQ ID NO: 124957

SEQ ID NO: 518129 - RNA, 64 nt, hsa; identical to SEQ ID NO: 124958

SEQ ID NO: 518130 - RNA, 64 nt, hsa; identical to SEQ ID NO: 124959

SEQ ID NO: 518131 - RNA, 64 nt, hsa; identical to SEQ ID NO: 124960

SEQ ID NO: 518132 - RNA, 64 nt, hsa; identical to SEQ ID NO: 124961

SEQ ID NO: 518133 - RNA, 64 nt, hsa; identical to SEQ ID NO: 124962

SEQ ID NO: 518134 - RNA, 64 nt, hsa; identical to SEQ ID NO: 124963

SEQ ID NO: 518135 - RNA, 64 nt, hsa; identical to SEQ ID NO: 124964

SEQ ID NO: 518136 - RNA, 64 nt, hsa; identical to SEQ ID NO: 124965

SEQ ID NO: 518137 - RNA, 64 nt, hsa; identical to SEQ ID NO: 124966

SEQ ID NO: 518138 - RNA, 64 nt, hsa; identical to SEQ ID NO: 124967

SEQ ID NO: 518139 - RNA, 63 nt, hsa; identical to SEQ ID NO: 124968

SEQ ID NO: 518140 - RNA, 64 nt, hsa; identical to SEQ ID NO: 124969

SEQ ID NO: 518141 - RNA, 64 nt, hsa; identical to SEQ ID NO: 124970

SEQ ID NO: 518142 - RNA, 64 nt, hsa; identical to SEQ ID NO: 124971

SEQ ID NO: 518143 - RNA, 64 nt, hsa; identical to SEQ ID NO: 124972

SEQ ID NO: 518144 - RNA, 64 nt, hsa; identical to SEQ ID NO: 124973

SEQ ID NO: 518145 - RNA, 64 nt, hsa; identical to SEQ ID NO: 124974

SEQ ID NO: 518146 - RNA, 64 nt, hsa; identical to SEQ ID NO: 124975

SEQ ID NO: 518147 - RNA, 64 nt, hsa; identical to SEQ ID NO: 124976

SEQ ID NO: 518148 - RNA, 64 nt, hsa; identical to SEQ ID NO: 124977

SEQ ID NO: 518149 - RNA, 64 nt, hsa; identical to SEQ ID NO: 124977

SEQ ID NO: 518150 - RNA, 64 nt, hsa; identical to SEQ ID NO: 124979

SEQ ID NO: 518151 - RNA, 64 nt, hsa; identical to SEQ ID NO: 124980

SEQ ID NO: 518152 - RNA, 64 nt, hsa; identical to SEQ ID NO: 124981

SEQ ID NO: 518153 - RNA, 64 nt, hsa; identical to SEQ ID NO: 124982

SEQ ID NO: 518154 - RNA, 64 nt, hsa; identical to SEQ ID NO: 124983

SEQ ID NO: 518155 - RNA, 64 nt, hsa; identical to SEQ ID NO: 124984

SEQ ID NO: 518156 - RNA, 64 nt, hsa; identical to SEQ ID NO: 124985

SEQ ID NO: 518157 - RNA, 64 nt, hsa; identical to SEQ ID NO: 124986

SEQ ID NO: 518158 - RNA, 64 nt, hsa; identical to SEQ ID NO: 124987

SEQ ID NO: 518159 - RNA, 64 nt, hsa; identical to SEQ ID NO: 124988

SEQ ID NO: 518160 - RNA, 64 nt, hsa; identical to SEQ ID NO: 124989

SEQ ID NO: 518161 - RNA, 64 nt, hsa; identical to SEQ ID NO: 124990

SEQ ID NO: 518162 - RNA, 64 nt, hsa; identical to SEQ ID NO: 124991

SEQ ID NO: 518163 - RNA, 64 nt, hsa; identical to SEQ ID NO: 124992

SEQ ID NO: 518164 - RNA, 64 nt, hsa; identical to SEQ ID NO: 124993

SEQ ID NO: 518165 - RNA, 64 nt, hsa; identical to SEQ ID NO: 124994

SEQ ID NO: 518166 - RNA, 64 nt, hsa; identical to SEQ ID NO: 124995

SEQ ID NO: 518167 - RNA, 64 nt, hsa; identical to SEQ ID NO: 124996

SEQ ID NO: 518168 - RNA, 64 nt, hsa; identical to SEQ ID NO: 124997

SEQ ID NO: 518169 - RNA, 64 nt, hsa; identical to SEQ ID NO: 124998

SEQ ID NO: 518170 - RNA, 64 nt, hsa; identical to SEQ ID NO: 124999

SEQ ID NO: 518171 - RNA, 64 nt, hsa; identical to SEQ ID NO: 125000

SEQ ID NO: 518172 - RNA, 64 nt, hsa; identical to SEQ ID NO: 125001

SEQ ID NO: 518173 - RNA, 64 nt, hsa; identical to SEQ ID NO: 125002

SEQ ID NO: 518174 - RNA, 64 nt, hsa; identical to SEQ ID NO: 376494

SEQ ID NO: 518175 - RNA, 64 nt, hsa; identical to SEQ ID NO: 376495

SEQ ID NO: 518176 - RNA, 64 nt, hsa; identical to SEQ ID NO: 376496

SEQ ID NO: 518177 - RNA, 64 nt, hsa; identical to SEQ ID NO: 376497

SEQ ID NO: 518178 - RNA, 64 nt, hsa; identical to SEQ ID NO: 376498

SEQ ID NO: 518179 - RNA, 64 nt, hsa; identical to SEQ ID NO: 376499

SEQ ID NO: 518180 - RNA, 64 nt, hsa; identical to SEQ ID NO: 56439

SEQ ID NO: 518181 - RNA, 64 nt, hsa; identical to SEQ ID NO: 56440

SEQ ID NO: 518182 - RNA, 64 nt, hsa; identical to SEQ ID NO: 56441

SEQ ID NO: 518183 - RNA, 64 nt, hsa; identical to SEQ ID NO: 56442

SEQ ID NO: 518184 - RNA, 64 nt, hsa; identical to SEQ ID NO: 56443

SEQ ID NO: 518185 - RNA, 64 nt, hsa; identical to SEQ ID NO: 56444

SEQ ID NO: 518186 - RNA, 64 nt, hsa; identical to SEQ ID NO: 56445

SEQ ID NO: 518187 - RNA, 64 nt, hsa; identical to SEQ ID NO: 56446

SEQ ID NO: 518188 - RNA, 64 nt, hsa; identical to SEQ ID NO: 56447

SEQ ID NO: 518189 - RNA, 64 nt, hsa; identical to SEQ ID NO: 56448

SEQ ID NO: 518190 - RNA, 64 nt, hsa; identical to SEQ ID NO: 56449

SEQ ID NO: 518191 - RNA, 64 nt, hsa; identical to SEQ ID NO: 56450

SEQ ID NO: 518192 - RNA, 64 nt, hsa; identical to SEQ ID NO: 56451

SEQ ID NO: 518193 - RNA, 64 nt, hsa; identical to SEQ ID NO: 56452

SEQ ID NO: 518194 - RNA, 64 nt, hsa; identical to SEQ ID NO: 56453

SEQ ID NO: 518195 - RNA, 64 nt, hsa; identical to SEQ ID NO: 56454

SEQ ID NO: 518196 - RNA, 64 nt, hsa; identical to SEQ ID NO: 56455

SEQ ID NO: 518197 - RNA, 64 nt, hsa; identical to SEQ ID NO: 56456

SEQ ID NO: 518198 - RNA, 64 nt, hsa; identical to SEQ ID NO: 56457

SEQ ID NO: 518199 - RNA, 64 nt, hsa; identical to SEQ ID NO: 56458

SEQ ID NO: 518200 - RNA, 64 nt, hsa; identical to SEQ ID NO: 56459

SEQ ID NO: 518201 - RNA, 64 nt, hsa; identical to SEQ ID NO: 56460

SEQ ID NO: 518202 - RNA, 64 nt, hsa; identical to SEQ ID NO: 56461

SEQ ID NO: 518203 - RNA, 64 nt, hsa; identical to SEQ ID NO: 56462

SEQ ID NO: 518204 - RNA, 64 nt, hsa; identical to SEQ ID NO: 56463

SEQ ID NO: 518205 - RNA, 64 nt, hsa; identical to SEQ ID NO: 56464

SEQ ID NO: 518206 - RNA, 64 nt, hsa; identical to SEQ ID NO: 56465

SEQ ID NO: 518207 - RNA, 64 nt, hsa; identical to SEQ ID NO: 56466

SEQ ID NO: 518208 - RNA, 64 nt, hsa; identical to SEQ ID NO: 56467

SEQ ID NO: 518209 - RNA, 50 nt, hsa; identical to SEQ ID NO: 56468

SEQ ID NO: 518210 - RNA, 64 nt, hsa; identical to SEQ ID NO: 56469

SEQ ID NO: 518211 - RNA, 64 nt, hsa; identical to SEQ ID NO: 56470

SEQ ID NO: 518212 - RNA, 64 nt, hsa; identical to SEQ ID NO: 56471

SEQ ID NO: 518213 - RNA, 64 nt, hsa; identical to SEQ ID NO: 56472

SEQ ID NO: 518214 - RNA, 64 nt, hsa; identical to SEQ ID NO: 56473

SEQ ID NO: 518215 - RNA, 64 nt, hsa; identical to SEQ ID NO: 56474

SEQ ID NO: 518216 - RNA, 64 nt, hsa; identical to SEQ ID NO: 56475

SEQ ID NO: 518217 - RNA, 64 nt, hsa; identical to SEQ ID NO: 56476

SEQ ID NO: 518218 - RNA, 64 nt, hsa; identical to SEQ ID NO: 56477

SEQ ID NO: 518219 - RNA, 64 nt, hsa; identical to SEQ ID NO: 56478

SEQ ID NO: 518220 - RNA, 64 nt, hsa; identical to SEQ ID NO: 56479

SEQ ID NO: 518221 - RNA, 64 nt, hsa; identical to SEQ ID NO: 56480

SEQ ID NO: 518222 - RNA, 64 nt, hsa; identical to SEQ ID NO: 56481

SEQ ID NO: 518223 - RNA, 64 nt, hsa; identical to SEQ ID NO: 56482

SEQ ID NO: 518224 - RNA, 64 nt, hsa; identical to SEQ ID NO: 56483

SEQ ID NO: 518225 - RNA, 64 nt, hsa; identical to SEQ ID NO: 56484

SEQ ID NO: 518226 - RNA, 64 nt, hsa; identical to SEQ ID NO: 56485

SEQ ID NO: 518227 - RNA, 64 nt, hsa; identical to SEQ ID NO: 56486

SEQ ID NO: 518228 - RNA, 64 nt, hsa; identical to SEQ ID NO: 56487

SEQ ID NO: 518229 - RNA, 64 nt, hsa; identical to SEQ ID NO: 56488

SEQ ID NO: 518230 - RNA, 64 nt, hsa; identical to SEQ ID NO: 56489

SEQ ID NO: 518231 - RNA, 64 nt, hsa; identical to SEQ ID NO: 56490

SEQ ID NO: 518232 - RNA, 64 nt, hsa; identical to SEQ ID NO: 56491

SEQ ID NO: 518233 - RNA, 64 nt, hsa; identical to SEQ ID NO: 56492

SEQ ID NO: 518234 - RNA, 64 nt, hsa; identical to SEQ ID NO: 56493

SEQ ID NO: 518235 - RNA, 64 nt, hsa; identical to SEQ ID NO: 56494

SEQ ID NO: 518236 - RNA, 64 nt, hsa; identical to SEQ ID NO: 56495

SEQ ID NO: 518237 - RNA, 64 nt, hsa; identical to SEQ ID NO: 56496

SEQ ID NO: 518238 - RNA, 64 nt, hsa; identical to SEQ ID NO: 56497

SEQ ID NO: 518239 - RNA, 64 nt, hsa; identical to SEQ ID NO: 56498

SEQ ID NO: 518240 - RNA, 64 nt, hsa; identical to SEQ ID NO: 56499

SEQ ID NO: 518241 - RNA, 64 nt, hsa; identical to SEQ ID NO: 56500

SEQ ID NO: 518242 - RNA, 64 nt, hsa; identical to SEQ ID NO: 56501

SEQ ID NO: 518243 - RNA, 64 nt, hsa; identical to SEQ ID NO: 56502

SEQ ID NO: 518244 - RNA, 64 nt, hsa; identical to SEQ ID NO: 56503

SEQ ID NO: 518245 - RNA, 64 nt, hsa; identical to SEQ ID NO: 56504

SEQ ID NO: 518246 - RNA, 64 nt, hsa; identical to SEQ ID NO: 56505

SEQ ID NO: 518247 - RNA, 64 nt, hsa; identical to SEQ ID NO: 56506

SEQ ID NO: 518248 - RNA, 64 nt, hsa; identical to SEQ ID NO: 56507

SEQ ID NO: 518249 - RNA, 64 nt, hsa; identical to SEQ ID NO: 56508

SEQ ID NO: 518250 - RNA, 64 nt, hsa; identical to SEQ ID NO: 56509

SEQ ID NO: 518251 - RNA, 64 nt, hsa; identical to SEQ ID NO: 56510

SEQ ID NO: 518252 - RNA, 64 nt, hsa; identical to SEQ ID NO: 56511

SEQ ID NO: 518253 - RNA, 64 nt, hsa; identical to SEQ ID NO: 56512

SEQ ID NO: 518254 - RNA, 64 nt, hsa; identical to SEQ ID NO: 56513

SEQ ID NO: 518255 - RNA, 64 nt, hsa; identical to SEQ ID NO: 56514

SEQ ID NO: 518256 - RNA, 64 nt, hsa; identical to SEQ ID NO: 56515

SEQ ID NO: 518257 - RNA, 64 nt, hsa; identical to SEQ ID NO: 56516

SEQ ID NO: 518258 - RNA, 64 nt, hsa; identical to SEQ ID NO: 56517

SEQ ID NO: 518259 - RNA, 64 nt, hsa; identical to SEQ ID NO: 56518

SEQ ID NO: 518260 - RNA, 64 nt, hsa; identical to SEQ ID NO: 56519

SEQ ID NO: 518261 - RNA, 64 nt, hsa; identical to SEQ ID NO: 56520

SEQ ID NO: 518262 - RNA, 64 nt, hsa; identical to SEQ ID NO: 56521

SEQ ID NO: 518263 - RNA, 64 nt, hsa; identical to SEQ ID NO: 56522

SEQ ID NO: 518264 - RNA, 64 nt, hsa; identical to SEQ ID NO: 56523

SEQ ID NO: 518265 - RNA, 64 nt, hsa; identical to SEQ ID NO: 56524

SEQ ID NO: 518266 - RNA, 64 nt, hsa; identical to SEQ ID NO: 56525

SEQ ID NO: 518267 - RNA, 64 nt, hsa; identical to SEQ ID NO: 56526

SEQ ID NO: 518268 - RNA, 64 nt, hsa; identical to SEQ ID NO: 56527

SEQ ID NO: 518269 - RNA, 64 nt, hsa; identical to SEQ ID NO: 56528

SEQ ID NO: 518270 - RNA, 64 nt, hsa; identical to SEQ ID NO: 56529

SEQ ID NO: 518271 - RNA, 64 nt, hsa; identical to SEQ ID NO: 56530

SEQ ID NO: 518272 - RNA, 64 nt, hsa; identical to SEQ ID NO: 56531

SEQ ID NO: 518273 - RNA, 64 nt, hsa; identical to SEQ ID NO: 56532

SEQ ID NO: 518274 - RNA, 64 nt, hsa; identical to SEQ ID NO: 56533

SEQ ID NO: 518275 - RNA, 64 nt, hsa; identical to SEQ ID NO: 56534

SEQ ID NO: 518276 - RNA, 59 nt, hsa; identical to SEQ ID NO: 56535

SEQ ID NO: 518277 - RNA, 64 nt, hsa; identical to SEQ ID NO: 56536

SEQ ID NO: 518278 - RNA, 64 nt, hsa; identical to SEQ ID NO: 56537

SEQ ID NO: 518279 - RNA, 64 nt, hsa; identical to SEQ ID NO: 56538

SEQ ID NO: 518280 - RNA, 64 nt, hsa; identical to SEQ ID NO: 56539

SEQ ID NO: 518281 - RNA, 64 nt, hsa; identical to SEQ ID NO: 56540

SEQ ID NO: 518282 - RNA, 64 nt, hsa; identical to SEQ ID NO: 56541

SEQ ID NO: 518283 - RNA, 64 nt, hsa; identical to SEQ ID NO: 56542

SEQ ID NO: 518284 - RNA, 64 nt, hsa; identical to SEQ ID NO: 56543

SEQ ID NO: 518285 - RNA, 64 nt, hsa; identical to SEQ ID NO: 56544

SEQ ID NO: 518286 - RNA, 64 nt, hsa; identical to SEQ ID NO: 56545

SEQ ID NO: 518287 - RNA, 64 nt, hsa; identical to SEQ ID NO: 56546

SEQ ID NO: 518288 - RNA, 64 nt, hsa; identical to SEQ ID NO: 56547

SEQ ID NO: 518289 - RNA, 64 nt, hsa; identical to SEQ ID NO: 56548

SEQ ID NO: 518290 - RNA, 64 nt, hsa; identical to SEQ ID NO: 56549

SEQ ID NO: 518291 - RNA, 64 nt, hsa; identical to SEQ ID NO: 56550

SEQ ID NO: 518292 - RNA, 64 nt, hsa; identical to SEQ ID NO: 56551

SEQ ID NO: 518293 - RNA, 64 nt, hsa; identical to SEQ ID NO: 56552

SEQ ID NO: 518294 - RNA, 64 nt, hsa; identical to SEQ ID NO: 56553

SEQ ID NO: 518295 - RNA, 64 nt, hsa; identical to SEQ ID NO: 56554

SEQ ID NO: 518296 - RNA, 64 nt, hsa; identical to SEQ ID NO: 56555

SEQ ID NO: 518297 - RNA, 64 nt, hsa; identical to SEQ ID NO: 56556

SEQ ID NO: 518298 - RNA, 62 nt, hsa; identical to SEQ ID NO: 56557

SEQ ID NO: 518299 - RNA, 58 nt, hsa; identical to SEQ ID NO: 56558

SEQ ID NO: 518300 - RNA, 64 nt, hsa; identical to SEQ ID NO: 56559

SEQ ID NO: 518301 - RNA, 64 nt, hsa; identical to SEQ ID NO: 56560

SEQ ID NO: 518302 - RNA, 64 nt, hsa; identical to SEQ ID NO: 56561

SEQ ID NO: 518303 - RNA, 64 nt, hsa; identical to SEQ ID NO: 56562

SEQ ID NO: 518304 - RNA, 64 nt, hsa; identical to SEQ ID NO: 56563

SEQ ID NO: 518305 - RNA, 64 nt, hsa; identical to SEQ ID NO: 56564

SEQ ID NO: 518306 - RNA, 64 nt, hsa; identical to SEQ ID NO: 56565

SEQ ID NO: 518307 - RNA, 64 nt, hsa; identical to SEQ ID NO: 56566

SEQ ID NO: 518308 - RNA, 64 nt, hsa; identical to SEQ ID NO: 56567

SEQ ID NO: 518309 - RNA, 64 nt, hsa; identical to SEQ ID NO: 56568

SEQ ID NO: 518310 - RNA, 64 nt, hsa; identical to SEQ ID NO: 56569

SEQ ID NO: 518311 - RNA, 64 nt, hsa; identical to SEQ ID NO: 56570

SEQ ID NO: 518312 - RNA, 64 nt, hsa; identical to SEQ ID NO: 56571

SEQ ID NO: 518313 - RNA, 64 nt, hsa; identical to SEQ ID NO: 56572

SEQ ID NO: 518314 - RNA, 64 nt, hsa; identical to SEQ ID NO: 56573

SEQ ID NO: 518315 - RNA, 64 nt, hsa; identical to SEQ ID NO: 56574

SEQ ID NO: 518316 - RNA, 64 nt, hsa; identical to SEQ ID NO: 56575

SEQ ID NO: 518317 - RNA, 64 nt, hsa; identical to SEQ ID NO: 56576

SEQ ID NO: 518318 - RNA, 64 nt, hsa; identical to SEQ ID NO: 56577

SEQ ID NO: 518319 - RNA, 64 nt, hsa; identical to SEQ ID NO: 56578

SEQ ID NO: 518320 - RNA, 64 nt, hsa; identical to SEQ ID NO: 56579

SEQ ID NO: 518321 - RNA, 64 nt, hsa; identical to SEQ ID NO: 56580

SEQ ID NO: 518322 - RNA, 64 nt, hsa; identical to SEQ ID NO: 56581

SEQ ID NO: 518323 - RNA, 64 nt, hsa; identical to SEQ ID NO: 56582

SEQ ID NO: 518324 - RNA, 64 nt, hsa; identical to SEQ ID NO: 156540

SEQ ID NO: 518325 - RNA, 64 nt, hsa; identical to SEQ ID NO: 156541

SEQ ID NO: 518326 - RNA, 64 nt, hsa; identical to SEQ ID NO: 156542

SEQ ID NO: 518327 - RNA, 64 nt, hsa; identical to SEQ ID NO: 156543

SEQ ID NO: 518328 - RNA, 64 nt, hsa; identical to SEQ ID NO: 156544

SEQ ID NO: 518329 - RNA, 64 nt, hsa; identical to SEQ ID NO: 156545

SEQ ID NO: 518330 - RNA, 64 nt, hsa; identical to SEQ ID NO: 156546

SEQ ID NO: 518331 - RNA, 64 nt, hsa; identical to SEQ ID NO: 156547

SEQ ID NO: 518332 - RNA, 64 nt, hsa; identical to SEQ ID NO: 156548

SEQ ID NO: 518333 - RNA, 64 nt, hsa; identical to SEQ ID NO: 156549

SEQ ID NO: 518334 - RNA, 64 nt, hsa; identical to SEQ ID NO: 156550

SEQ ID NO: 518335 - RNA, 64 nt, hsa; identical to SEQ ID NO: 156551

SEQ ID NO: 518336 - RNA, 64 nt, hsa; identical to SEQ ID NO: 156552

SEQ ID NO: 518337 - RNA, 64 nt, hsa; identical to SEQ ID NO: 156553

SEQ ID NO: 518338 - RNA, 64 nt, hsa; identical to SEQ ID NO: 156554

SEQ ID NO: 518339 - RNA, 64 nt, hsa
aauggggugggggugggagaggagguagauggggaagaaauaccccagacccaacaaaccucca

SEQ ID NO: 518340 - RNA, 64 nt, hsa
cauuuuuagcccuuugacguggcuuaugccauucaagaaauaaaaagcaagagaaucagcuuug

SEQ ID NO: 518341 - RNA, 64 nt, hsa
gaccuaaguccucgccgggccauggcucccagccaagaaauaaguacacacuaauaggcguggg

SEQ ID NO: 518342 - RNA, 64 nt, hsa
cugacagcgguagaugccugugaggagcuacuacaagaaauagacaucaccccauuucuccuug

SEQ ID NO: 518343 - RNA, 64 nt, hsa
ucgcuacucuguuucauagaaauccccauccaucaagaaauaugaaaguuaaggcuguaauaug

SEQ ID NO: 518344 - RNA, 64 nt, hsa
ucaaugaugucuuuccauauucuuaucugggcuuaagaaauacauucuguauuuuuccagauuc

SEQ ID NO: 518345 - RNA, 64 nt, hsa
uuccacuauuaugcguaaugcucagcuuuuuguaaagaaauauuuaauuguauuuuguguuuau

SEQ ID NO: 518346 - RNA, 64 nt, hsa
uuugaaugauuugcugucacagacuauuugguagaagaaauauuuuucaccugagagaggaaga

SEQ ID NO: 518347 - RNA, 64 nt, hsa
auaccauaagcauguauuaucuaagcacuugaucaagaaauauacauguuguacaagcucucaa

SEQ ID NO: 518348 - RNA, 64 nt, hsa
aggaauuauucuuuucucaccaaucaacacuuuuaagaaauauauauauauauauacacacaua

SEQ ID NO: 518349 - RNA, 64 nt, hsa
ccccagguagcagaacucacguucccacuauagcaagaaauaaaggcaaaagagaacaucuuuu

SEQ ID NO: 518350 - RNA, 64 nt, hsa
uuuucccccgaggguuuuccaugguguacuuugcaagaaauaagcacucuaauuuuuaaaguaa

SEQ ID NO: 518351 - RNA, 64 nt, hsa
uuuuaauaauuuuuuaaugagguauuuaccacugaagaaauaugauaauauaaaaccaucaaau

SEQ ID NO: 518352 - RNA, 64 nt, hsa
cacagcaagacucuaucucaaaaaaaagaaaaaaaagaaauacauagaguucagucccuagaag

SEQ ID NO: 518353 - RNA, 64 nt, hsa
acuucuacuccugcucuccuaguuccccccaaaaaagaaauacugaccagugucucuacuuuaa

SEQ ID NO: 518354 - RNA, 64 nt, hsa
uuucucuuaacuuaauuuuuccugcuguauccagaagaaauaauugugucaugauuaaugugua

SEQ ID NO: 518355 - RNA, 64 nt, hsa
aaaucuagaggaucucuccuuuuuauaacaaaucaagaaauaugaagcacuuucucuuaacuua

SEQ ID NO: 518356 - RNA, 64 nt, hsa
uaugaggguaaucgagaugaggauauuaacucaaaagaaauagggugauuuuuaaaggauuaau

SEQ ID NO: 518357 - RNA, 64 nt, hsa
caaucagaaucacagaaaaauccugccuaaggcaaagaaauauaagacaagacuaugauaucaa

SEQ ID NO: 518358 - RNA, 64 nt, hsa
agcaacauucgccauacuagcggagguaaaacaaaagaaauauugaaaacugaggcaguuaacc

SEQ ID NO: 518359 - RNA, 64 nt, hsa
auuaguaauggcggaaacugucgcugaagcacuuaagaaauaaagguacuuuacagcaacauuc

SEQ ID NO: 518360 - RNA, 64 nt, hsa
cauagaagucgugaauacuaaguaauguauacaaaagaaauaugugaugaugugucuacuuuuu

SEQ ID NO: 518361 - RNA, 64 nt, hsa
agaugcagcaagcuuauuaaguauuauuuucuaaaagaaauaggaggcauuuucaucuuuauua

SEQ ID NO: 518362 - RNA, 64 nt, hsa
gaagcugcuuuugaauuuuguuauguugaaaugcaagaaauaacaaugauggcagcaauuaagg

SEQ ID NO: 518363 - RNA, 64 nt, hsa
aaguuuaacugaaauuaauaagccaauggaaagaaagaaauauuaauaacugcugguggaaaga

SEQ ID NO: 518364 - RNA, 64 nt, hsa
gugggaacacagccaaaccauaucaccuucaaagaagaaauaagagaauuauuaguaauuugcu

SEQ ID NO: 518365 - RNA, 64 nt, hsa
gaauaauaaacauucauguacccacuaucagguuaagaaauagaacauuuauuaauauguagga

SEQ ID NO: 518366 - RNA, 64 nt, hsa
agaaauagaacauuuauuaauauguaggaauguuaagaaauaaaacauuuaauaagaucucaga

SEQ ID NO: 518367 - RNA, 64 nt, hsa
aaacucuuuuucuauaauacuaaauugugauuauaagaaauaguccaaauguuucugaagaauu

SEQ ID NO: 518368 - RNA, 64 nt, hsa
cguaccuaaugcacacuuuaucuuuuauuguacaaagaaauaguguacaaaauucuuugguuuc

SEQ ID NO: 518369 - RNA, 64 nt, hsa
ucagcuauuuuaaagaggaaauuaaauauuauaaaagaaauaguaaagauaaguuauccucacu

SEQ ID NO: 518370 - RNA, 64 nt, hsa
aguaccuacuugaaaggaucauugugcggauuaaaagaaauaauauauguaaagcacuuuaaca

SEQ ID NO: 518371 - RNA, 64 nt, hsa
uuggacuaacauucacguaucaaacuaauauaaaaagaaauaaaaccaagaggugauuuuugua

SEQ ID NO: 518372 - RNA, 64 nt, hsa
agacuuuuaacaguccuucgugaauagagcaggcaagaaauacaaaccuucauuccuugaauca

SEQ ID NO: 518373 - RNA, 64 nt, hsa
uaauugauaaagcucuguuuaauuuagaguuuugaagaaauagucucccuucaauuaagaaauu

SEQ ID NO: 518374 - RNA, 64 nt, hsa
caaauuuuuaaaggggaaguauuauuauaaaaugaagaaauauguauuucuaaaggcuauauug

SEQ ID NO: 518375 - RNA, 64 nt, hsa
uauuuaugaauuauaaauaugaauuuaauuacuaaagaaauaaaaauaaugguguaaagccaac

SEQ ID NO: 518376 - RNA, 64 nt, hsa
ggaaucugaauaagcuuccaaaauuuuuuuuuuuaagaaauaaagggagcuguguaguggguca

SEQ ID NO: 518377 - RNA, 64 nt, hsa
agcuuuguuuagucuuuauacugcaaacuauuuaaagaaauauguauucuguaaaagaaaaaaa

SEQ ID NO: 518378 - RNA, 64 nt, hsa
uauuucagcaaacuuguugaauuuauuuuuaagaaagaaauacuguauugggaaguuacuguua

SEQ ID NO: 518379 - RNA, 64 nt, hsa
cuguaccacuguuguaacaugggaagacgugaagaagaaauaaucugagcuuuaauuauuuaua

SEQ ID NO: 518380 - RNA, 64 nt, hsa
aaaaccaaaaagaugccccuuuuuuuguagggauaagaaauacauuuguuuuauacuucuaugc

SEQ ID NO: 518381 - RNA, 64 nt, hsa
gcccauuguauuaggccguucuuggauugcuauaaagaaauaccugagacuggguaauuugguu

SEQ ID NO: 518382 - RNA, 64 nt, hsa
cagacauaauaagagguguaaaaacuaucacaggaagaaauaaaaacagauuuuugaaggugag

SEQ ID NO: 518383 - RNA, 64 nt, hsa
uauuaccaaacuuauagaaauaaaaauuauuagaaagaaauacuaugaacaauugaaugccaac

SEQ ID NO: 518384 - RNA, 64 nt, hsa
cuaggaagacacagaauaccaaaucugacuccacaagaaauagauguugugaauagagcuugcu

SEQ ID NO: 518385 - RNA, 64 nt, hsa
aaacagcuggaagaagaaauugcuagauuacccaaagaaauagaucaguuggagaaaauacaaa

SEQ ID NO: 518386 - RNA, 64 nt, hsa
aguuggagaaaauacaaaacaauucaaagcucuuaagaaauaaagcuguucaacuugaaaauga

SEQ ID NO: 518387 - RNA, 64 nt, hsa
uuaaggaguuuuucccaagaagaaaaguauuuaaaagaaauaccagugagugccuuaaaguugg

SEQ ID NO: 518388 - RNA, 64 nt, hsa
gguaucacagccuaaagaaauuaucuuuuugcaaaagaaauauuaaaugauuuagcagucucca

SEQ ID NO: 518389 - RNA, 64 nt, hsa
acuguaaagucuauucuguuuaacaauaagaaauaagaaauaauuuuuuucaaauaagaaaauu

SEQ ID NO: 518390 - RNA, 64 nt, hsa
uguuguuacuguaaagucuauucuguuuaacaauaagaaauaagaaauaauuuuuuucaaauaa

SEQ ID NO: 518391 - RNA, 64 nt, hsa
aggaugagaacuucuaaaaucuaaaauccauuucaagaaauaaagacgaacacauuugcaggaa

SEQ ID NO: 518392 - RNA, 64 nt, hsa
gugaauuguggaaaaugucauguagcugacacucaagaaauagggauuccuaauaauggcaugg

SEQ ID NO: 518393 - RNA, 64 nt, hsa
guggcuuacugugucugaagauacugacaugcagaagaaauaagugcauucuucugcuuuucac

SEQ ID NO: 518394 - RNA, 64 nt, hsa
aggguugauuuuuuugcucuccauuuugacuugcaagaaauaauaccucaagauaaucugauuu

SEQ ID NO: 518395 - RNA, 64 nt, hsa
gccuugaaaaacaaagaccuaaaaagccuuuuuuaagaaauaaauuuuuuguucacaugaccaa

SEQ ID NO: 518396 - RNA, 64 nt, hsa
aauguguuugguuuuggaaauauaacuuuugucaaagaaauacucucagaagagaaauggggcu

SEQ ID NO: 518397 - RNA, 64 nt, hsa
uaauuuaagaaauagacuuacuuaagacuauuuuaagaaauagagaugucauagccugaagauu

SEQ ID NO: 518398 - RNA, 64 nt, hsa
uacuggcuuuaacaauaauuuuuguuguuaauuuaagaaauagacuuacuuaagacuauuuuaa

SEQ ID NO: 518399 - RNA, 64 nt, hsa
guugauggaaauacacuguuaucuucacuuuuauaagaaauaggaaauauuuuaauguuucuug

SEQ ID NO: 518400 - RNA, 64 nt, hsa
agugucuugaauuguaggugacuauuauauuuccaagaaauauuccuuaagauauuaacugaga

SEQ ID NO: 518401 - RNA, 64 nt, hsa
uauuuuuuaaagaugcauuuugaaauauauacagaagaaauaauaugacuucuggaacuuacuu

SEQ ID NO: 518402 - RNA, 64 nt, hsa
aauagagagauggguggcaggaauccauagauuaaagaaauaugcaauauauggacuuuauuuu

SEQ ID NO: 518403 - RNA, 60 nt, hsa
uaucagaaaaauguauauaauaggcaaggaaagaaauacaguacuguuucuggacccuua

SEQ ID NO: 518404 - RNA, 64 nt, hsa
ugaugcuguacacauauuugaagggucuuucucaaagaaauauuaagcauguuuuguugcucag

SEQ ID NO: 518405 - RNA, 64 nt, hsa
guuccuacucaguaaacaggugugaugaguuaacaagaaauaacacuguuugagaacuagcuuu

SEQ ID NO: 518406 - RNA, 64 nt, hsa
uccccagcaccagcuauugguguaccuauaauuuaagaaauagucuauguaaagucacaaauua

SEQ ID NO: 518407 - RNA, 64 nt, hsa
uuguauuuuugugcuaaugugcaaacauguacagaagaaauagaauacauguucaugcaaauau

SEQ ID NO: 518408 - RNA, 64 nt, hsa
acauugcuaaaauaaaaaauacaccuuaauuuuuaagaaauaauuuaaaugaaacaauuuccau

SEQ ID NO: 518409 - RNA, 64 nt, hsa
uuuuuuauauauugguguaaacauaauauucuucaagaaauaauguugaaagccuacucaggaa

SEQ ID NO: 518410 - RNA, 64 nt, hsa
gcagauguuuuuccuaaaaaguacuauaucauccaagaaauauuugaguaaaaucccuuguucu

SEQ ID NO: 518411 - RNA, 64 nt, hsa
uauaucaaauaaguaucacaaaucuuuuacgcagaagaaauaaaaacuacggguagaaaacaua

SEQ ID NO: 518412 - RNA, 64 nt, hsa
ugaaaaugaagagagaggguuuuaccauccugagaagaaauaaugauggaaacauguuuaaugu

SEQ ID NO: 518413 - RNA, 64 nt, hsa
gcgagacuccgucucaaaaacaaaaaaaaaagaaaagaaauauauuuuauucauucacauuagg

SEQ ID NO: 518414 - RNA, 64 nt, hsa
uauaacacugaccucuggaaaauauuuuguucacaagaaauaauaaaguauaaugauuuguugc

SEQ ID NO: 518415 - RNA, 64 nt, hsa
cuuuuguuuaaauuuaaugaaacaaaaaauuccuaagaaauaccacccuaccacuaacaaaaug

SEQ ID NO: 518416 - RNA, 64 nt, hsa
caaccaguuaaguuauaccuguugcuauuuugcaaagaaauaauuauaguuuuuauuuacccau

SEQ ID NO: 518417 - RNA, 64 nt, hsa
auuuacaaucuuaagaaauuaucaaguuggaaccaagaaauagcaaggaaauguacaauuuuau

SEQ ID NO: 518418 - RNA, 64 nt, hsa
cuuuguguuuuggcagguuuuguaacuauuuaugaagaaauauuuuagcugaguacuauauaau

SEQ ID NO: 518419 - RNA, 64 nt, hsa
caaucaaaauuauauaaagucuucuccaguaauuaagaaauacauaugcaaauucuuuugugau

SEQ ID NO: 518420 - RNA, 64 nt, hsa
aaaagcagcuuaaauuacuuuucuuuucuacauuaagaaauauauucucaacauuuucagugag

SEQ ID NO: 518421 - RNA, 64 nt, hsa
ugucaaauaagcauauuuccauuuuuauuacugaaagaaauaugggcauuuucauucuuuaaag

SEQ ID NO: 518422 - RNA, 64 nt, hsa
uuacugaaagaaauaugggcauuuucauucuuuaaagaaauaaagcacaagaauuuuaucucaa

SEQ ID NO: 518423 - RNA, 64 nt, hsa
uugaaaaauaaaauuuuaacccaaaugaauaacuaagaaauauaaaacaagcacaaaaucuuag

SEQ ID NO: 518424 - RNA, 64 nt, hsa
gaaacaaacuuuuugccaauagaccuagggaucuaagaaauagaauuagggagaguuuacacuu

SEQ ID NO: 518425 - RNA, 64 nt, hsa
uaucaaaaaccuagagaccaaucauauaucugaaaagaaauacccauuaaaaauucugccuccu

SEQ ID NO: 518426 - RNA, 64 nt, hsa
aaaaauagcucaagacacaguuaaucgagaagaaaagaaauauguacagaaccauaaagaacca

SEQ ID NO: 518427 - RNA, 64 nt, hsa
uaguugcuuacgugaagcucaagauaccuguagaaagaaauaugguauauuuguauaguuuuua

SEQ ID NO: 518428 - RNA, 64 nt, hsa
cacaugaaaauauuccuuaguagaauguauauuuaagaaauaaaacaacaaaggggaacuauau

SEQ ID NO: 518429 - RNA, 64 nt, hsa
uugcagaaaaguugauugcaaagugugguagaaaaagaaauaaugguagcaguagagaauuuau

SEQ ID NO: 518430 - RNA, 64 nt, hsa
cuaaauuuuaaaagcugaaacacaacagaauucuaagaaauauaguccaaacguugcauggauu

SEQ ID NO: 518431 - RNA, 64 nt, hsa
gacgugguuccaacauucacuccuaucucauuagaagaaauagguagcagcaucacucaccagu

SEQ ID NO: 518432 - RNA, 64 nt, hsa
aggugcgcgccaggauguggacuacugagcccugaagaaauaaguccuuccacuuugaccccau

SEQ ID NO: 518433 - RNA, 64 nt, hsa
caagagcaaacacauucaaaagcuagcagaaggcaagaaauaacuaagauccgagcagaacuga

SEQ ID NO: 518434 - RNA, 64 nt, hsa
gcauuuuugaaaguuacauauucuccacugcuuuaagaaauaauucaguucacuuucaccuugg

SEQ ID NO: 518435 - RNA, 64 nt, hsa
acuaacagagaucuugggacauuuauuuguuuuaaagaaauauuuaugguuauggaaacgcuug

SEQ ID NO: 518436 - RNA, 64 nt, hsa
aaucuguuuuccugaguauaaauaagaguauuuaaagaaauaauuuggauugcuuuuguuuuuu

SEQ ID NO: 518437 - RNA, 64 nt, hsa
ucugcuucuuaaagaaucagccgagacaccauaaaagaaauaggcuuuuugugccuuuugcugu

SEQ ID NO: 518438 - RNA, 64 nt, hsa
aaaaggcgaacucugccuuggagagguagaugauaagaaauaaaaagguguuuauaacuauuuu

SEQ ID NO: 518439 - RNA, 64 nt, hsa
gguucuugggccaugcuccguguguggauaaggaaagaaauacuguuucugggacucucccaca

SEQ ID NO: 518440 - RNA, 64 nt, hsa
uagguauuguuucccagaugaggacaaugaggcaaagaaauaucaaguaacuugccaaagguua

SEQ ID NO: 518441 - RNA, 64 nt, hsa
uuuauagagugucucagggugcagaggucagacuaagaaauauuccaaaugucuuuuagaagau

SEQ ID NO: 518442 - RNA, 64 nt, hsa
acagauggcuucacugaaguuauuccaaauauuuaagaaauaauaccaggcuuuuauaaacuuu

SEQ ID NO: 518443 - RNA, 64 nt, hsa
cuguggaacauccagaaaacuuuaacauucuucaaagaaauagaaaacacaauccuaaaauuua

SEQ ID NO: 518444 - RNA, 64 nt, hsa
aaauauuucccaguauaaugauacaucguagccuaagaaauauuuucucaauguaauucccuuc

SEQ ID NO: 518445 - RNA, 64 nt, hsa
ucagcucugggggucauuuaccaguuuguuguagaagaaauaaucagguaaguuaaaaguucau

SEQ ID NO: 518446 - RNA, 64 nt, hsa
accaacacugaaaacuuuguagugaugacuaccaaagaaauacauaguaaaacaaccuuuuauu

SEQ ID NO: 518447 - RNA, 64 nt, hsa
uugagagcucaauauuuguaucuuaucaguacagaagaaauauuucuguguaacuugaucuucu

SEQ ID NO: 518448 - RNA, 64 nt, hsa
uuuucuguaguaaaacuuuuaaauauuauuuuaaaagaaauauguauauaaauaucucuauauu

SEQ ID NO: 518449 - RNA, 64 nt, hsa
uguuuguuuuaaauguaaauugagaaucuuuuauaagaaauaaaagcauuauugggugccuuug

SEQ ID NO: 518450 - RNA, 64 nt, hsa
gugaaaaucauggaguugggauaucucucaauuaaagaaauacauugugaacuaucagcuacaa

SEQ ID NO: 518451 - RNA, 64 nt, hsa
gcguaucacauaacuuuuuugcaaaaaauauaaaaagaaauaaacuucaauguauuuuuuauua

SEQ ID NO: 518452 - RNA, 64 nt, hsa
gagauauagcccuuaaaaugcaauauuaagaacaaagaaauagaaaaugguuuagauaucuuuc

SEQ ID NO: 518453 - RNA, 64 nt, hsa
guaaguagguaauuuuauuauuuaaaguccuauuaagaaauauuugucuuaaauauauaggaca

SEQ ID NO: 518454 - RNA, 64 nt, hsa
acaguauacaugauauagcagggaauguuacuagaagaaauaucaacugaugauauccuauccu

SEQ ID NO: 518455 - RNA, 64 nt, hsa
gggcguauaauuugaggaguggaugguggaugaaaagaaauaauaaauuguaaucagcaguaaa

SEQ ID NO: 518456 - RNA, 64 nt, hsa
gggguggcuuuuauggacuuccaugagagaaggaaagaaauauuucagguaagcuucucagggc

SEQ ID NO: 518457 - RNA, 64 nt, hsa
aagcuguaugcaugggcauuaccccucagguccuaagaaauaaguccugaaugcaugucguucc

SEQ ID NO: 518458 - RNA, 64 nt, hsa
acauuaucagccagcccagccuugcccaccauuuaagaaauaucacagagccacuagaucucau

SEQ ID NO: 518459 - RNA, 64 nt, hsa
uuguucugcaguguugaaacagaauggaaaugacaagaaauaucugcaguuauccaggagaaag

SEQ ID NO: 518460 - RNA, 64 nt, hsa
uaaagggaaugauuggggggaaaaacuggugaaaaagaaauauaaaaaggacccuaaaaagaau

SEQ ID NO: 518461 - RNA, 64 nt, hsa
aaaggacccuaaaaagaauucugcaaaauaagagaagaaauaauuugugacagguaauagaaua

SEQ ID NO: 518462 - RNA, 64 nt, hsa
gccucaugucaaauauuuagauguaauuuuguguaagaaauacagacuggauguaccaccaacu

SEQ ID NO: 518463 - RNA, 64 nt, hsa
aagccaguuuaacgcauugcccaguuguuagauuaagaaauagacagcaugagagggaugaggc

SEQ ID NO: 518464 - RNA, 64 nt, hsa
augcauuuugagauggaaaacugaaauuuggaaaaagaaauacuuuacuauugaguaaacuaca

SEQ ID NO: 518465 - RNA, 64 nt, hsa
cagaucuugaagaaaaucauauaaaaagcauuugaagaaauaguacgacaacuuauuuuuaauc

SEQ ID NO: 518466 - RNA, 64 nt, hsa
gagcaauauuuuuuaauguguaccugucuuauggaagaaauaugcagguauauaagaccacgau

SEQ ID NO: 518467 - RNA, 64 nt, hsa
cggugaaauauuuauaugcauaaauggcaaaggaaagaaauaauauauauuuuuaugucauuga

SEQ ID NO: 518468 - RNA, 64 nt, hsa
auguuuccaauucagguacaaguauguuuuaaagaagaaauaaguuucccaaucagccaauuua

SEQ ID NO: 518469 - RNA, 64 nt, hsa
uuuaaacacauccuauauaucaugucaaucuggcaagaaauaugacuugcuuuuugcugagcuu

SEQ ID NO: 518470 - RNA, 64 nt, hsa
cugaugcacuauauagaacgaauuuggguuuuuaaagaaauauuaaaaguuagguacuguaagu

SEQ ID NO: 518471 - RNA, 64 nt, hsa
guccuguaucauacuuuuuucuuuaagacuuuuuaagaaauauuacuuaaacauguggcuugcu

SEQ ID NO: 518472 - RNA, 64 nt, hsa
cuguauaaagggauugguagucaaaacauguacaaagaaauaccuguaaaacuguuuugucuca

SEQ ID NO: 518473 - RNA, 64 nt, hsa
caaaucaaagauauuugguagucaaaauaaguaaaagaaauauaggaauauuccagucaaucuc

SEQ ID NO: 518474 - RNA, 64 nt, hsa
agccacacgccacagucagcgucugcugcuugugaagaaauagccuaccagguacaggauauuc

SEQ ID NO: 518475 - RNA, 64 nt, hsa
guauauuaagagaggagcucauuucagauuccuaaagaaauagacauuuuacuguuauuuugaa

SEQ ID NO: 518476 - RNA, 64 nt, hsa
guuugcuuucuccagagaaauuuuaaaauaauagaagaaauagaaauuuugaauguauaaaaga

SEQ ID NO: 518477 - RNA, 64 nt, hsa
guauucacuuuaagugauaguuuaaaaaauaaacaagaaauauugaguaucacuaugugaagaa

SEQ ID NO: 518478 - RNA, 64 nt, hsa
ucugaauauuaagugaaaagcaaguucuauuuuuaagaaauagcuuuugcugaggaguugugaa

SEQ ID NO: 518479 - RNA, 64 nt, hsa
aacucugaccaaaucuuucauacagauacagguaaagaaauauuuuucuagguugucggagcug

SEQ ID NO: 518480 - RNA, 64 nt, hsa
uagagaaaaaaaauuaaaaagaaacaaagucuccaagaaauaugggacuaugugaaaagaccaa

SEQ ID NO: 518481 - RNA, 64 nt, hsa
caagagcaaacacagucaaaaacuagcagaaggcaagaaauaacuaaaaucagcagaacucaag

SEQ ID NO: 518482 - RNA, 64 nt, hsa
cuuuguuaaaagguguaagacuggaauaaauggaaagaaauaccauauacauagauggaaaaac

SEQ ID NO: 518483 - RNA, 64 nt, hsa
auauacauccuauagaaacucacaaauaaugcauaagaaauauauauauaauauauguauguau

SEQ ID NO: 518484 - RNA, 64 nt, hsa
gggaaacauagcaagaccccaucucuuaaaaaaaaagaaauauauagacauauaucugcauuga

SEQ ID NO: 518485 - RNA, 64 nt, hsa
gacagauuuuagagcaaaaauuaguaauaaaaauaagaaauaaaauuacaggagcaauuaaggu

SEQ ID NO: 518486 - RNA, 64 nt, hsa
cuaaaaggaugucuaaauguuuguuaauaaaaauaagaaauagcuacagugacagauuuuagag

SEQ ID NO: 518487 - RNA, 64 nt, hsa
gugacuuaacuacuuuaucuccauuuuguaguugaagaaauaaguucagagagaaagauuccuu

SEQ ID NO: 518488 - RNA, 64 nt, hsa
cuugaaaaauaaaaaguaccaaaauucauucaagaagaaauagauaccagccugagcaacaugg

SEQ ID NO: 518489 - RNA, 64 nt, hsa
cacccaaguauuuuaaaguaugugucucuaaaggaagaaauacauauuuuuauuugacuauguu

SEQ ID NO: 518490 - RNA, 64 nt, hsa
guucuugguguuugugaaaauccuauaagauuuaaagaaauauauauauacuuuuuuucuuuuu

SEQ ID NO: 518491 - RNA, 64 nt, hsa
aguugacauaauacuuuguaaauugaauuuuuuaaagaaauaggcauuugauaaccagcuuggc

SEQ ID NO: 518492 - RNA, 64 nt, hsa
agagaauuggaacaaaaccuugugacuuuuagguaagaaauaggcaugaugauaagcuaugcag

SEQ ID NO: 518493 - RNA, 64 nt, hsa
uauucauugagccuaguuccuuguuauaaaauacaagaaauaagacauucaggcauuuucccuu

SEQ ID NO: 518494 - RNA, 64 nt, hsa
acuaguccuguucuaggcuuaguggaagcuaguaaagaaauauaauucauggaucaggcucaua

SEQ ID NO: 518495 - RNA, 64 nt, hsa
ugcacaaaaucaacuguauuaguccauucuugcaaagaaauaccugagacuggguaauuuauaa

SEQ ID NO: 518496 - RNA, 64 nt, hsa
ggccacauagcaagacccugucuccaaaaaaaaaaagaaauaaaagacgaagaauagggagaaa

SEQ ID NO: 518497 - RNA, 64 nt, hsa
ucuguaauaacuagaacaaauaaaguaguaaaagaagaaauaguucugugacuaggaaaaaauu

SEQ ID NO: 518498 - RNA, 64 nt, hsa
guggugauagcaaaaucaagagauggcuuacaaaaagaaauauugaauuuuuauuuuugaaguu

SEQ ID NO: 518499 - RNA, 64 nt, hsa
gaauaucagccuuuuauaauuuuaugugaagaggaagaaauauagcuuauuuuaaacuuuugac

SEQ ID NO: 518500 - RNA, 64 nt, hsa
agauuuugcuaauacuacuuuuuuugccuggcagaagaaauagacuauuuggaucacauuucuc

SEQ ID NO: 518501 - RNA, 64 nt, hsa; identical to SEQ ID NO: 58312

SEQ ID NO: 518502 - RNA, 64 nt, hsa; identical to SEQ ID NO: 58313

SEQ ID NO: 518503 - RNA, 64 nt, hsa; identical to SEQ ID NO: 58314

SEQ ID NO: 518504 - RNA, 64 nt, hsa; identical to SEQ ID NO: 58315

SEQ ID NO: 518505 - RNA, 64 nt, hsa; identical to SEQ ID NO: 58316

SEQ ID NO: 518506 - RNA, 64 nt, hsa; identical to SEQ ID NO: 58317

SEQ ID NO: 518507 - RNA, 64 nt, hsa; identical to SEQ ID NO: 58318

SEQ ID NO: 518508 - RNA, 64 nt, hsa; identical to SEQ ID NO: 58319

SEQ ID NO: 518509 - RNA, 64 nt, hsa; identical to SEQ ID NO: 58320

SEQ ID NO: 518510 - RNA, 64 nt, hsa; identical to SEQ ID NO: 58321

SEQ ID NO: 518511 - RNA, 64 nt, hsa; identical to SEQ ID NO: 58322

SEQ ID NO: 518512 - RNA, 64 nt, hsa; identical to SEQ ID NO: 58323

SEQ ID NO: 518513 - RNA, 64 nt, hsa; identical to SEQ ID NO: 58324

SEQ ID NO: 518514 - RNA, 64 nt, hsa; identical to SEQ ID NO: 58325

SEQ ID NO: 518515 - RNA, 64 nt, hsa; identical to SEQ ID NO: 58326

SEQ ID NO: 518516 - RNA, 64 nt, hsa; identical to SEQ ID NO: 58327

SEQ ID NO: 518517 - RNA, 64 nt, hsa; identical to SEQ ID NO: 58328

SEQ ID NO: 518518 - RNA, 64 nt, hsa; identical to SEQ ID NO: 58329

SEQ ID NO: 518519 - RNA, 64 nt, hsa; identical to SEQ ID NO: 58330

SEQ ID NO: 518520 - RNA, 64 nt, hsa; identical to SEQ ID NO: 58331

SEQ ID NO: 518521 - RNA, 64 nt, hsa; identical to SEQ ID NO: 58332

SEQ ID NO: 518522 - RNA, 64 nt, hsa; identical to SEQ ID NO: 58333

SEQ ID NO: 518523 - RNA, 64 nt, hsa; identical to SEQ ID NO: 58334

SEQ ID NO: 518524 - RNA, 64 nt, hsa; identical to SEQ ID NO: 58335

SEQ ID NO: 518525 - RNA, 64 nt, hsa; identical to SEQ ID NO: 58336

SEQ ID NO: 518526 - RNA, 64 nt, hsa; identical to SEQ ID NO: 58337

SEQ ID NO: 518527 - RNA, 64 nt, hsa; identical to SEQ ID NO: 58338

SEQ ID NO: 518528 - RNA, 64 nt, hsa; identical to SEQ ID NO: 58339

SEQ ID NO: 518529 - RNA, 64 nt, hsa; identical to SEQ ID NO: 58340

SEQ ID NO: 518530 - RNA, 64 nt, hsa; identical to SEQ ID NO: 58341

SEQ ID NO: 518531 - RNA, 64 nt, hsa; identical to SEQ ID NO: 58342

SEQ ID NO: 518532 - RNA, 64 nt, hsa; identical to SEQ ID NO: 58343

SEQ ID NO: 518533 - RNA, 64 nt, hsa; identical to SEQ ID NO: 58344

SEQ ID NO: 518534 - RNA, 64 nt, hsa; identical to SEQ ID NO: 58345

SEQ ID NO: 518535 - RNA, 64 nt, hsa; identical to SEQ ID NO: 58346

SEQ ID NO: 518536 - RNA, 64 nt, hsa; identical to SEQ ID NO: 58347

SEQ ID NO: 518537 - RNA, 64 nt, hsa; identical to SEQ ID NO: 58348

SEQ ID NO: 518538 - RNA, 64 nt, hsa; identical to SEQ ID NO: 58349

SEQ ID NO: 518539 - RNA, 64 nt, hsa; identical to SEQ ID NO: 58350

SEQ ID NO: 518540 - RNA, 64 nt, hsa; identical to SEQ ID NO: 58351

SEQ ID NO: 518541 - RNA, 64 nt, hsa; identical to SEQ ID NO: 58352

SEQ ID NO: 518542 - RNA, 64 nt, hsa; identical to SEQ ID NO: 58353

SEQ ID NO: 518543 - RNA, 64 nt, hsa; identical to SEQ ID NO: 58354

SEQ ID NO: 518544 - RNA, 64 nt, hsa; identical to SEQ ID NO: 58355

SEQ ID NO: 518545 - RNA, 64 nt, hsa; identical to SEQ ID NO: 58356

SEQ ID NO: 518546 - RNA, 64 nt, hsa; identical to SEQ ID NO: 58357

SEQ ID NO: 518547 - RNA, 64 nt, hsa; identical to SEQ ID NO: 58358

SEQ ID NO: 518548 - RNA, 64 nt, hsa; identical to SEQ ID NO: 58359

SEQ ID NO: 518549 - RNA, 64 nt, hsa; identical to SEQ ID NO: 58360

SEQ ID NO: 518550 - RNA, 64 nt, hsa; identical to SEQ ID NO: 58361

SEQ ID NO: 518551 - RNA, 64 nt, hsa; identical to SEQ ID NO: 58362

SEQ ID NO: 518552 - RNA, 64 nt, hsa; identical to SEQ ID NO: 58363

SEQ ID NO: 518553 - RNA, 64 nt, hsa; identical to SEQ ID NO: 58364

SEQ ID NO: 518554 - RNA, 64 nt, hsa; identical to SEQ ID NO: 58365

SEQ ID NO: 518555 - RNA, 64 nt, hsa; identical to SEQ ID NO: 58366

SEQ ID NO: 518556 - RNA, 64 nt, hsa; identical to SEQ ID NO: 58367

SEQ ID NO: 518557 - RNA, 64 nt, hsa; identical to SEQ ID NO: 58368

SEQ ID NO: 518558 - RNA, 64 nt, hsa; identical to SEQ ID NO: 58369

SEQ ID NO: 518559 - RNA, 64 nt, hsa; identical to SEQ ID NO: 58370

SEQ ID NO: 518560 - RNA, 64 nt, hsa; identical to SEQ ID NO: 58371

SEQ ID NO: 518561 - RNA, 64 nt, hsa; identical to SEQ ID NO: 58372

SEQ ID NO: 518562 - RNA, 64 nt, hsa; identical to SEQ ID NO: 58373

SEQ ID NO: 518563 - RNA, 64 nt, hsa; identical to SEQ ID NO: 58374

SEQ ID NO: 518564 - RNA, 64 nt, hsa; identical to SEQ ID NO: 58375

SEQ ID NO: 518565 - RNA, 64 nt, hsa; identical to SEQ ID NO: 58376

SEQ ID NO: 518566 - RNA, 64 nt, hsa; identical to SEQ ID NO: 58377

SEQ ID NO: 518567 - RNA, 64 nt, hsa; identical to SEQ ID NO: 58378

SEQ ID NO: 518568 - RNA, 64 nt, hsa; identical to SEQ ID NO: 58379

SEQ ID NO: 518569 - RNA, 64 nt, hsa; identical to SEQ ID NO: 58380

SEQ ID NO: 518570 - RNA, 64 nt, hsa; identical to SEQ ID NO: 58381

SEQ ID NO: 518571 - RNA, 64 nt, hsa; identical to SEQ ID NO: 58382

SEQ ID NO: 518572 - RNA, 64 nt, hsa; identical to SEQ ID NO: 58383

SEQ ID NO: 518573 - RNA, 64 nt, hsa; identical to SEQ ID NO: 58384

SEQ ID NO: 518574 - RNA, 64 nt, hsa; identical to SEQ ID NO: 58385

SEQ ID NO: 518575 - RNA, 64 nt, hsa; identical to SEQ ID NO: 58386

SEQ ID NO: 518576 - RNA, 64 nt, hsa; identical to SEQ ID NO: 58387

SEQ ID NO: 518577 - RNA, 64 nt, hsa; identical to SEQ ID NO: 58388

SEQ ID NO: 518578 - RNA, 64 nt, hsa; identical to SEQ ID NO: 58389

SEQ ID NO: 518579 - RNA, 64 nt, hsa; identical to SEQ ID NO: 58390

SEQ ID NO: 518580 - RNA, 64 nt, hsa; identical to SEQ ID NO: 58391

SEQ ID NO: 518581 - RNA, 64 nt, hsa; identical to SEQ ID NO: 58392

SEQ ID NO: 518582 - RNA, 64 nt, hsa; identical to SEQ ID NO: 58393

SEQ ID NO: 518583 - RNA, 64 nt, hsa; identical to SEQ ID NO: 58394

SEQ ID NO: 518584 - RNA, 64 nt, hsa; identical to SEQ ID NO: 58395

SEQ ID NO: 518585 - RNA, 64 nt, hsa; identical to SEQ ID NO: 58396

SEQ ID NO: 518586 - RNA, 64 nt, hsa; identical to SEQ ID NO: 58397

SEQ ID NO: 518587 - RNA, 64 nt, hsa; identical to SEQ ID NO: 58398

SEQ ID NO: 518588 - RNA, 64 nt, hsa; identical to SEQ ID NO: 58399

SEQ ID NO: 518589 - RNA, 64 nt, hsa; identical to SEQ ID NO: 58400

SEQ ID NO: 518590 - RNA, 64 nt, hsa; identical to SEQ ID NO: 58401

SEQ ID NO: 518591 - RNA, 64 nt, hsa; identical to SEQ ID NO: 58402

SEQ ID NO: 518592 - RNA, 64 nt, hsa; identical to SEQ ID NO: 58403

SEQ ID NO: 518593 - RNA, 64 nt, hsa; identical to SEQ ID NO: 58404

SEQ ID NO: 518594 - RNA, 64 nt, hsa; identical to SEQ ID NO: 58405

SEQ ID NO: 518595 - RNA, 64 nt, hsa; identical to SEQ ID NO: 58406

SEQ ID NO: 518596 - RNA, 64 nt, hsa; identical to SEQ ID NO: 58407

SEQ ID NO: 518597 - RNA, 64 nt, hsa; identical to SEQ ID NO: 58408

SEQ ID NO: 518598 - RNA, 64 nt, hsa; identical to SEQ ID NO: 58409

SEQ ID NO: 518599 - RNA, 64 nt, hsa; identical to SEQ ID NO: 58410

SEQ ID NO: 518600 - RNA, 64 nt, hsa; identical to SEQ ID NO: 58411

SEQ ID NO: 518601 - RNA, 64 nt, hsa; identical to SEQ ID NO: 58412

SEQ ID NO: 518602 - RNA, 64 nt, hsa; identical to SEQ ID NO: 58413

SEQ ID NO: 518603 - RNA, 64 nt, hsa; identical to SEQ ID NO: 58414

SEQ ID NO: 518604 - RNA, 64 nt, hsa; identical to SEQ ID NO: 58415

SEQ ID NO: 518605 - RNA, 64 nt, hsa; identical to SEQ ID NO: 58416

SEQ ID NO: 518606 - RNA, 64 nt, hsa; identical to SEQ ID NO: 58417

SEQ ID NO: 518607 - RNA, 64 nt, hsa; identical to SEQ ID NO: 58418

SEQ ID NO: 518608 - RNA, 64 nt, hsa; identical to SEQ ID NO: 58419

SEQ ID NO: 518609 - RNA, 64 nt, hsa; identical to SEQ ID NO: 58420

SEQ ID NO: 518610 - RNA, 64 nt, hsa; identical to SEQ ID NO: 58421

SEQ ID NO: 518611 - RNA, 64 nt, hsa; identical to SEQ ID NO: 58422

SEQ ID NO: 518612 - RNA, 64 nt, hsa; identical to SEQ ID NO: 58423

SEQ ID NO: 518613 - RNA, 64 nt, hsa; identical to SEQ ID NO: 58424

SEQ ID NO: 518614 - RNA, 64 nt, hsa; identical to SEQ ID NO: 58425

SEQ ID NO: 518615 - RNA, 64 nt, hsa; identical to SEQ ID NO: 58426

SEQ ID NO: 518616 - RNA, 64 nt, hsa; identical to SEQ ID NO: 58427

SEQ ID NO: 518617 - RNA, 64 nt, hsa; identical to SEQ ID NO: 58428

SEQ ID NO: 518618 - RNA, 64 nt, hsa; identical to SEQ ID NO: 58429

SEQ ID NO: 518619 - RNA, 64 nt, hsa; identical to SEQ ID NO: 58430

SEQ ID NO: 518620 - RNA, 64 nt, hsa; identical to SEQ ID NO: 58431

SEQ ID NO: 518621 - RNA, 64 nt, hsa; identical to SEQ ID NO: 58432

SEQ ID NO: 518622 - RNA, 64 nt, hsa; identical to SEQ ID NO: 58433

SEQ ID NO: 518623 - RNA, 64 nt, hsa; identical to SEQ ID NO: 58434

SEQ ID NO: 518624 - RNA, 64 nt, hsa; identical to SEQ ID NO: 58435

SEQ ID NO: 518625 - RNA, 50 nt, hsa; identical to SEQ ID NO: 58436

SEQ ID NO: 518626 - RNA, 64 nt, hsa; identical to SEQ ID NO: 58437

SEQ ID NO: 518627 - RNA, 64 nt, hsa; identical to SEQ ID NO: 58438

SEQ ID NO: 518628 - RNA, 64 nt, hsa; identical to SEQ ID NO: 58439

SEQ ID NO: 518629 - RNA, 64 nt, hsa; identical to SEQ ID NO: 58440

SEQ ID NO: 518630 - RNA, 64 nt, hsa; identical to SEQ ID NO: 58441

SEQ ID NO: 518631 - RNA, 64 nt, hsa; identical to SEQ ID NO: 58442

SEQ ID NO: 518632 - RNA, 64 nt, hsa; identical to SEQ ID NO: 58443

SEQ ID NO: 518633 - RNA, 64 nt, hsa; identical to SEQ ID NO: 58444

SEQ ID NO: 518634 - RNA, 64 nt, hsa; identical to SEQ ID NO: 58445

SEQ ID NO: 518635 - RNA, 64 nt, hsa; identical to SEQ ID NO: 58446

SEQ ID NO: 518636 - RNA, 64 nt, hsa; identical to SEQ ID NO: 58447

SEQ ID NO: 518637 - RNA, 64 nt, hsa; identical to SEQ ID NO: 58448

SEQ ID NO: 518638 - RNA, 64 nt, hsa; identical to SEQ ID NO: 58449

SEQ ID NO: 518639 - RNA, 64 nt, hsa; identical to SEQ ID NO: 58450

SEQ ID NO: 518640 - RNA, 64 nt, hsa; identical to SEQ ID NO: 58451

SEQ ID NO: 518641 - RNA, 64 nt, hsa; identical to SEQ ID NO: 58452

SEQ ID NO: 518642 - RNA, 64 nt, hsa; identical to SEQ ID NO: 58453

SEQ ID NO: 518643 - RNA, 64 nt, hsa; identical to SEQ ID NO: 58454

SEQ ID NO: 518644 - RNA, 64 nt, hsa; identical to SEQ ID NO: 58455

SEQ ID NO: 518645 - RNA, 64 nt, hsa; identical to SEQ ID NO: 58456

SEQ ID NO: 518646 - RNA, 64 nt, hsa; identical to SEQ ID NO: 58457

SEQ ID NO: 518647 - RNA, 64 nt, hsa; identical to SEQ ID NO: 58458

SEQ ID NO: 518648 - RNA, 64 nt, hsa; identical to SEQ ID NO: 58459

SEQ ID NO: 518649 - RNA, 64 nt, hsa; identical to SEQ ID NO: 58460

SEQ ID NO: 518650 - RNA, 64 nt, hsa; identical to SEQ ID NO: 58461

SEQ ID NO: 518651 - RNA, 64 nt, hsa; identical to SEQ ID NO: 58462

SEQ ID NO: 518652 - RNA, 64 nt, hsa; identical to SEQ ID NO: 58463

SEQ ID NO: 518653 - RNA, 64 nt, hsa; identical to SEQ ID NO: 58464

SEQ ID NO: 518654 - RNA, 64 nt, hsa; identical to SEQ ID NO: 58465

SEQ ID NO: 518655 - RNA, 64 nt, hsa; identical to SEQ ID NO: 58466

SEQ ID NO: 518656 - RNA, 64 nt, hsa; identical to SEQ ID NO: 58467

SEQ ID NO: 518657 - RNA, 64 nt, hsa; identical to SEQ ID NO: 235935

SEQ ID NO: 518658 - RNA, 64 nt, hsa; identical to SEQ ID NO: 235936

SEQ ID NO: 518659 - RNA, 64 nt, hsa; identical to SEQ ID NO: 235937

SEQ ID NO: 518660 - RNA, 64 nt, hsa; identical to SEQ ID NO: 235938

SEQ ID NO: 518661 - RNA, 64 nt, hsa; identical to SEQ ID NO: 235939

SEQ ID NO: 518662 - RNA, 64 nt, hsa; identical to SEQ ID NO: 235940

SEQ ID NO: 518663 - RNA, 64 nt, hsa; identical to SEQ ID NO: 235941

SEQ ID NO: 518664 - RNA, 64 nt, hsa; identical to SEQ ID NO: 235942

SEQ ID NO: 518665 - RNA, 64 nt, hsa; identical to SEQ ID NO: 235943

SEQ ID NO: 518666 - RNA, 64 nt, hsa; identical to SEQ ID NO: 235944

SEQ ID NO: 518667 - RNA, 64 nt, hsa; identical to SEQ ID NO: 235945

SEQ ID NO: 518668 - RNA, 64 nt, hsa; identical to SEQ ID NO: 235946

SEQ ID NO: 518669 - RNA, 64 nt, hsa; identical to SEQ ID NO: 235947

SEQ ID NO: 518670 - RNA, 64 nt, hsa; identical to SEQ ID NO: 235948

SEQ ID NO: 518671 - RNA, 64 nt, hsa; identical to SEQ ID NO: 235949

SEQ ID NO: 518672 - RNA, 64 nt, hsa; identical to SEQ ID NO: 235950

SEQ ID NO: 518673 - RNA, 64 nt, hsa; identical to SEQ ID NO: 235951

SEQ ID NO: 518674 - RNA, 64 nt, hsa; identical to SEQ ID NO: 235952

SEQ ID NO: 518675 - RNA, 64 nt, hsa; identical to SEQ ID NO: 235953

SEQ ID NO: 518676 - RNA, 64 nt, hsa; identical to SEQ ID NO: 235954

SEQ ID NO: 518677 - RNA, 64 nt, hsa; identical to SEQ ID NO: 235955

SEQ ID NO: 518678 - RNA, 64 nt, hsa; identical to SEQ ID NO: 235956

SEQ ID NO: 518679 - RNA, 64 nt, hsa; identical to SEQ ID NO: 235957

SEQ ID NO: 518680 - RNA, 64 nt, hsa; identical to SEQ ID NO: 235958

SEQ ID NO: 518681 - RNA, 64 nt, hsa; identical to SEQ ID NO: 235959

SEQ ID NO: 518682 - RNA, 64 nt, hsa; identical to SEQ ID NO: 235960

SEQ ID NO: 518683 - RNA, 64 nt, hsa; identical to SEQ ID NO: 235961

SEQ ID NO: 518684 - RNA, 64 nt, hsa; identical to SEQ ID NO: 235962

SEQ ID NO: 518685 - RNA, 64 nt, hsa; identical to SEQ ID NO: 235963

SEQ ID NO: 518686 - RNA, 64 nt, hsa; identical to SEQ ID NO: 235964

SEQ ID NO: 518687 - RNA, 64 nt, hsa; identical to SEQ ID NO: 235965

SEQ ID NO: 518688 - RNA, 64 nt, hsa; identical to SEQ ID NO: 235966

SEQ ID NO: 518689 - RNA, 64 nt, hsa; identical to SEQ ID NO: 235967

SEQ ID NO: 518690 - RNA, 64 nt, hsa; identical to SEQ ID NO: 235968

SEQ ID NO: 518691 - RNA, 64 nt, hsa; identical to SEQ ID NO: 235969

SEQ ID NO: 518692 - RNA, 64 nt, hsa; identical to SEQ ID NO: 235970

SEQ ID NO: 518693 - RNA, 64 nt, hsa; identical to SEQ ID NO: 235971

SEQ ID NO: 518694 - RNA, 64 nt, hsa; identical to SEQ ID NO: 235972

SEQ ID NO: 518695 - RNA, 64 nt, hsa; identical to SEQ ID NO: 235973

SEQ ID NO: 518696 - RNA, 64 nt, hsa; identical to SEQ ID NO: 235974

SEQ ID NO: 518697 - RNA, 58 nt, hsa; identical to SEQ ID NO: 235975

SEQ ID NO: 518698 - RNA, 64 nt, hsa; identical to SEQ ID NO: 235976

SEQ ID NO: 518699 - RNA, 64 nt, hsa; identical to SEQ ID NO: 235977

SEQ ID NO: 518700 - RNA, 64 nt, hsa; identical to SEQ ID NO: 235978

SEQ ID NO: 518701 - RNA, 64 nt, hsa; identical to SEQ ID NO: 235979

SEQ ID NO: 518702 - RNA, 64 nt, hsa; identical to SEQ ID NO: 235980

SEQ ID NO: 518703 - RNA, 64 nt, hsa; identical to SEQ ID NO: 235981

SEQ ID NO: 518704 - RNA, 64 nt, hsa; identical to SEQ ID NO: 235981

SEQ ID NO: 518705 - RNA, 64 nt, hsa; identical to SEQ ID NO: 235983

SEQ ID NO: 518706 - RNA, 64 nt, hsa; identical to SEQ ID NO: 235984

SEQ ID NO: 518707 - RNA, 64 nt, hsa; identical to SEQ ID NO: 235985

SEQ ID NO: 518708 - RNA, 64 nt, hsa; identical to SEQ ID NO: 235986

SEQ ID NO: 518709 - RNA, 64 nt, hsa; identical to SEQ ID NO: 235987

SEQ ID NO: 518710 - RNA, 64 nt, hsa; identical to SEQ ID NO: 235988

SEQ ID NO: 518711 - RNA, 64 nt, hsa; identical to SEQ ID NO: 235989

SEQ ID NO: 518712 - RNA, 64 nt, hsa; identical to SEQ ID NO: 235990

SEQ ID NO: 518713 - RNA, 64 nt, hsa; identical to SEQ ID NO: 235991

SEQ ID NO: 518714 - RNA, 64 nt, hsa; identical to SEQ ID NO: 235992

SEQ ID NO: 518715 - RNA, 64 nt, hsa; identical to SEQ ID NO: 385550

SEQ ID NO: 518716 - RNA, 64 nt, hsa; identical to SEQ ID NO: 385551

SEQ ID NO: 518717 - RNA, 64 nt, hsa; identical to SEQ ID NO: 385552

SEQ ID NO: 518718 - RNA, 64 nt, hsa; identical to SEQ ID NO: 385553

SEQ ID NO: 518719 - RNA, 64 nt, hsa; identical to SEQ ID NO: 385554

SEQ ID NO: 518720 - RNA, 64 nt, hsa; identical to SEQ ID NO: 385555

SEQ ID NO: 518721 - RNA, 64 nt, hsa; identical to SEQ ID NO: 385556

SEQ ID NO: 518722 - RNA, 64 nt, hsa; identical to SEQ ID NO: 385557

SEQ ID NO: 518723 - RNA, 64 nt, hsa; identical to SEQ ID NO: 385558

SEQ ID NO: 518724 - RNA, 64 nt, hsa; identical to SEQ ID NO: 385559

SEQ ID NO: 518725 - RNA, 64 nt, hsa; identical to SEQ ID NO: 385560

SEQ ID NO: 518726 - RNA, 64 nt, hsa; identical to SEQ ID NO: 385561

SEQ ID NO: 518727 - RNA, 64 nt, hsa; identical to SEQ ID NO: 385562

SEQ ID NO: 518728 - RNA, 64 nt, hsa; identical to SEQ ID NO: 385563

SEQ ID NO: 518729 - RNA, 64 nt, hsa; identical to SEQ ID NO: 385564

SEQ ID NO: 518730 - RNA, 64 nt, hsa; identical to SEQ ID NO: 385565

SEQ ID NO: 518731 - RNA, 64 nt, hsa; identical to SEQ ID NO: 385566

SEQ ID NO: 518732 - RNA, 64 nt, hsa; identical to SEQ ID NO: 385567

SEQ ID NO: 518733 - RNA, 64 nt, hsa; identical to SEQ ID NO: 385568

SEQ ID NO: 518734 - RNA, 64 nt, hsa; identical to SEQ ID NO: 385569

SEQ ID NO: 518735 - RNA, 64 nt, hsa; identical to SEQ ID NO: 385570

SEQ ID NO: 518736 - RNA, 64 nt, hsa; identical to SEQ ID NO: 385571

SEQ ID NO: 518737 - RNA, 64 nt, hsa; identical to SEQ ID NO: 385572

SEQ ID NO: 518738 - RNA, 64 nt, hsa; identical to SEQ ID NO: 385573

SEQ ID NO: 518739 - RNA, 64 nt, hsa; identical to SEQ ID NO: 385574

SEQ ID NO: 518740 - RNA, 64 nt, hsa; identical to SEQ ID NO: 385575

SEQ ID NO: 518741 - RNA, 64 nt, hsa; identical to SEQ ID NO: 385576

SEQ ID NO: 518742 - RNA, 64 nt, hsa; identical to SEQ ID NO: 385577

SEQ ID NO: 518743 - RNA, 64 nt, hsa; identical to SEQ ID NO: 385578

SEQ ID NO: 518744 - RNA, 64 nt, hsa; identical to SEQ ID NO: 385579

SEQ ID NO: 518745 - RNA, 64 nt, hsa; identical to SEQ ID NO: 385580

SEQ ID NO: 518746 - RNA, 64 nt, hsa; identical to SEQ ID NO: 385581

SEQ ID NO: 518747 - RNA, 64 nt, hsa; identical to SEQ ID NO: 385582

SEQ ID NO: 518748 - RNA, 64 nt, hsa; identical to SEQ ID NO: 385583

SEQ ID NO: 518749 - RNA, 64 nt, hsa; identical to SEQ ID NO: 385584

SEQ ID NO: 518750 - RNA, 64 nt, hsa; identical to SEQ ID NO: 385585

SEQ ID NO: 518751 - RNA, 64 nt, hsa; identical to SEQ ID NO: 385586

SEQ ID NO: 518752 - RNA, 64 nt, hsa; identical to SEQ ID NO: 385587

SEQ ID NO: 518753 - RNA, 64 nt, hsa; identical to SEQ ID NO: 385588

SEQ ID NO: 518754 - RNA, 64 nt, hsa; identical to SEQ ID NO: 220362

SEQ ID NO: 518755 - RNA, 64 nt, hsa; identical to SEQ ID NO: 220363

SEQ ID NO: 518756 - RNA, 64 nt, hsa; identical to SEQ ID NO: 220364

SEQ ID NO: 518757 - RNA, 64 nt, hsa; identical to SEQ ID NO: 220365

SEQ ID NO: 518758 - RNA, 64 nt, hsa; identical to SEQ ID NO: 220366

SEQ ID NO: 518759 - RNA, 64 nt, hsa; identical to SEQ ID NO: 220367

SEQ ID NO: 518760 - RNA, 64 nt, hsa; identical to SEQ ID NO: 220368

SEQ ID NO: 518761 - RNA, 64 nt, hsa; identical to SEQ ID NO: 220369

SEQ ID NO: 518762 - RNA, 64 nt, hsa; identical to SEQ ID NO: 220370

SEQ ID NO: 518763 - RNA, 64 nt, hsa; identical to SEQ ID NO: 220371

SEQ ID NO: 518764 - RNA, 64 nt, hsa; identical to SEQ ID NO: 220372

SEQ ID NO: 518765 - RNA, 64 nt, hsa; identical to SEQ ID NO: 220373

SEQ ID NO: 518766 - RNA, 64 nt, hsa; identical to SEQ ID NO: 220374

SEQ ID NO: 518767 - RNA, 64 nt, hsa; identical to SEQ ID NO: 220375

SEQ ID NO: 518768 - RNA, 64 nt, hsa; identical to SEQ ID NO: 220376

SEQ ID NO: 518769 - RNA, 64 nt, hsa; identical to SEQ ID NO: 220377

SEQ ID NO: 518770 - RNA, 64 nt, hsa; identical to SEQ ID NO: 220378

SEQ ID NO: 518771 - RNA, 64 nt, hsa; identical to SEQ ID NO: 220379

SEQ ID NO: 518772 - RNA, 64 nt, hsa; identical to SEQ ID NO: 220380

SEQ ID NO: 518773 - RNA, 64 nt, hsa; identical to SEQ ID NO: 220381

SEQ ID NO: 518774 - RNA, 64 nt, hsa; identical to SEQ ID NO: 220382

SEQ ID NO: 518775 - RNA, 64 nt, hsa; identical to SEQ ID NO: 220383

SEQ ID NO: 518776 - RNA, 64 nt, hsa; identical to SEQ ID NO: 220384

SEQ ID NO: 518777 - RNA, 64 nt, hsa; identical to SEQ ID NO: 220385

SEQ ID NO: 518778 - RNA, 64 nt, hsa; identical to SEQ ID NO: 220386

SEQ ID NO: 518779 - RNA, 64 nt, hsa; identical to SEQ ID NO: 220387

SEQ ID NO: 518780 - RNA, 64 nt, hsa; identical to SEQ ID NO: 220388

SEQ ID NO: 518781 - RNA, 64 nt, hsa; identical to SEQ ID NO: 220389

SEQ ID NO: 518782 - RNA, 64 nt, hsa; identical to SEQ ID NO: 220390

SEQ ID NO: 518783 - RNA, 64 nt, hsa; identical to SEQ ID NO: 220391

SEQ ID NO: 518784 - RNA, 64 nt, hsa; identical to SEQ ID NO: 220392

SEQ ID NO: 518785 - RNA, 64 nt, hsa; identical to SEQ ID NO: 220393

SEQ ID NO: 518786 - RNA, 64 nt, hsa; identical to SEQ ID NO: 220394

SEQ ID NO: 518787 - RNA, 64 nt, hsa; identical to SEQ ID NO: 220395

SEQ ID NO: 518788 - RNA, 64 nt, hsa; identical to SEQ ID NO: 220396

SEQ ID NO: 518789 - RNA, 64 nt, hsa; identical to SEQ ID NO: 220397

SEQ ID NO: 518790 - RNA, 64 nt, hsa; identical to SEQ ID NO: 220398

SEQ ID NO: 518791 - RNA, 64 nt, hsa; identical to SEQ ID NO: 220399

SEQ ID NO: 518792 - RNA, 64 nt, hsa; identical to SEQ ID NO: 220400

SEQ ID NO: 518793 - RNA, 64 nt, hsa; identical to SEQ ID NO: 220401

SEQ ID NO: 518794 - RNA, 64 nt, hsa; identical to SEQ ID NO: 220402

SEQ ID NO: 518795 - RNA, 64 nt, hsa; identical to SEQ ID NO: 220403

SEQ ID NO: 518796 - RNA, 64 nt, hsa; identical to SEQ ID NO: 220404

SEQ ID NO: 518797 - RNA, 64 nt, hsa; identical to SEQ ID NO: 220405

SEQ ID NO: 518798 - RNA, 64 nt, hsa; identical to SEQ ID NO: 220406

SEQ ID NO: 518799 - RNA, 64 nt, hsa; identical to SEQ ID NO: 220407

SEQ ID NO: 518800 - RNA, 64 nt, hsa; identical to SEQ ID NO: 220408

SEQ ID NO: 518801 - RNA, 64 nt, hsa; identical to SEQ ID NO: 220409

SEQ ID NO: 518802 - RNA, 64 nt, hsa; identical to SEQ ID NO: 220410

SEQ ID NO: 518803 - RNA, 64 nt, hsa; identical to SEQ ID NO: 220411

SEQ ID NO: 518804 - RNA, 64 nt, hsa; identical to SEQ ID NO: 220412

SEQ ID NO: 518805 - RNA, 64 nt, hsa; identical to SEQ ID NO: 220413

SEQ ID NO: 518806 - RNA, 64 nt, hsa; identical to SEQ ID NO: 220414

SEQ ID NO: 518807 - RNA, 64 nt, hsa; identical to SEQ ID NO: 220415

SEQ ID NO: 518808 - RNA, 64 nt, hsa; identical to SEQ ID NO: 220416

SEQ ID NO: 518809 - RNA, 64 nt, hsa; identical to SEQ ID NO: 220417

SEQ ID NO: 518810 - RNA, 64 nt, hsa; identical to SEQ ID NO: 220418

SEQ ID NO: 518811 - RNA, 64 nt, hsa; identical to SEQ ID NO: 220419

SEQ ID NO: 518812 - RNA, 64 nt, hsa; identical to SEQ ID NO: 220420

SEQ ID NO: 518813 - RNA, 64 nt, hsa; identical to SEQ ID NO: 220421

SEQ ID NO: 518814 - RNA, 64 nt, hsa; identical to SEQ ID NO: 220422

SEQ ID NO: 518815 - RNA, 64 nt, hsa; identical to SEQ ID NO: 76114

SEQ ID NO: 518816 - RNA, 64 nt, hsa; identical to SEQ ID NO: 76115

SEQ ID NO: 518817 - RNA, 64 nt, hsa; identical to SEQ ID NO: 76116

SEQ ID NO: 518818 - RNA, 64 nt, hsa; identical to SEQ ID NO: 76117

SEQ ID NO: 518819 - RNA, 64 nt, hsa; identical to SEQ ID NO: 76118

SEQ ID NO: 518820 - RNA, 64 nt, hsa; identical to SEQ ID NO: 76119

SEQ ID NO: 518821 - RNA, 64 nt, hsa; identical to SEQ ID NO: 76120

SEQ ID NO: 518822 - RNA, 64 nt, hsa; identical to SEQ ID NO: 76121

SEQ ID NO: 518823 - RNA, 64 nt, hsa; identical to SEQ ID NO: 76122

SEQ ID NO: 518824 - RNA, 64 nt, hsa; identical to SEQ ID NO: 76123

SEQ ID NO: 518825 - RNA, 64 nt, hsa; identical to SEQ ID NO: 76124

SEQ ID NO: 518826 - RNA, 64 nt, hsa; identical to SEQ ID NO: 76125

SEQ ID NO: 518827 - RNA, 64 nt, hsa; identical to SEQ ID NO: 76126

SEQ ID NO: 518828 - RNA, 64 nt, hsa; identical to SEQ ID NO: 76127

SEQ ID NO: 518829 - RNA, 64 nt, hsa; identical to SEQ ID NO: 76128

SEQ ID NO: 518830 - RNA, 64 nt, hsa; identical to SEQ ID NO: 76129

SEQ ID NO: 518831 - RNA, 64 nt, hsa; identical to SEQ ID NO: 76130

SEQ ID NO: 518832 - RNA, 64 nt, hsa; identical to SEQ ID NO: 76131

SEQ ID NO: 518833 - RNA, 64 nt, hsa; identical to SEQ ID NO: 76132

SEQ ID NO: 518834 - RNA, 64 nt, hsa; identical to SEQ ID NO: 76133

SEQ ID NO: 518835 - RNA, 64 nt, hsa; identical to SEQ ID NO: 76134

SEQ ID NO: 518836 - RNA, 64 nt, hsa; identical to SEQ ID NO: 76135

SEQ ID NO: 518837 - RNA, 64 nt, hsa; identical to SEQ ID NO: 76136

SEQ ID NO: 518838 - RNA, 64 nt, hsa; identical to SEQ ID NO: 76137

SEQ ID NO: 518839 - RNA, 64 nt, hsa; identical to SEQ ID NO: 76138

SEQ ID NO: 518840 - RNA, 64 nt, hsa; identical to SEQ ID NO: 76139

SEQ ID NO: 518841 - RNA, 64 nt, hsa; identical to SEQ ID NO: 76140

SEQ ID NO: 518842 - RNA, 64 nt, hsa; identical to SEQ ID NO: 76141

SEQ ID NO: 518843 - RNA, 64 nt, hsa; identical to SEQ ID NO: 76142

SEQ ID NO: 518844 - RNA, 64 nt, hsa; identical to SEQ ID NO: 76143

SEQ ID NO: 518845 - RNA, 64 nt, hsa; identical to SEQ ID NO: 76144

SEQ ID NO: 518846 - RNA, 64 nt, hsa; identical to SEQ ID NO: 76145

SEQ ID NO: 518847 - RNA, 64 nt, hsa; identical to SEQ ID NO: 76146

SEQ ID NO: 518848 - RNA, 64 nt, hsa; identical to SEQ ID NO: 76147

SEQ ID NO: 518849 - RNA, 64 nt, hsa; identical to SEQ ID NO: 76148

SEQ ID NO: 518850 - RNA, 64 nt, hsa; identical to SEQ ID NO: 76149

SEQ ID NO: 518851 - RNA, 64 nt, hsa; identical to SEQ ID NO: 76150

SEQ ID NO: 518852 - RNA, 64 nt, hsa; identical to SEQ ID NO: 76151

SEQ ID NO: 518853 - RNA, 64 nt, hsa; identical to SEQ ID NO: 76152

SEQ ID NO: 518854 - RNA, 64 nt, hsa; identical to SEQ ID NO: 76153

SEQ ID NO: 518855 - RNA, 64 nt, hsa; identical to SEQ ID NO: 76154

SEQ ID NO: 518856 - RNA, 64 nt, hsa; identical to SEQ ID NO: 126797

SEQ ID NO: 518857 - RNA, 64 nt, hsa; identical to SEQ ID NO: 126798

SEQ ID NO: 518858 - RNA, 64 nt, hsa; identical to SEQ ID NO: 126799

SEQ ID NO: 518859 - RNA, 64 nt, hsa; identical to SEQ ID NO: 126800

SEQ ID NO: 518860 - RNA, 64 nt, hsa; identical to SEQ ID NO: 126801

SEQ ID NO: 518861 - RNA, 64 nt, hsa; identical to SEQ ID NO: 126802

SEQ ID NO: 518862 - RNA, 64 nt, hsa; identical to SEQ ID NO: 126803

SEQ ID NO: 518863 - RNA, 64 nt, hsa; identical to SEQ ID NO: 126804

SEQ ID NO: 518864 - RNA, 64 nt, hsa; identical to SEQ ID NO: 126805

SEQ ID NO: 518865 - RNA, 64 nt, hsa; identical to SEQ ID NO: 126806

SEQ ID NO: 518866 - RNA, 64 nt, hsa; identical to SEQ ID NO: 126807

SEQ ID NO: 518867 - RNA, 64 nt, hsa; identical to SEQ ID NO: 126808

SEQ ID NO: 518868 - RNA, 64 nt, hsa; identical to SEQ ID NO: 126809

SEQ ID NO: 518869 - RNA, 64 nt, hsa; identical to SEQ ID NO: 209092

SEQ ID NO: 518870 - RNA, 64 nt, hsa; identical to SEQ ID NO: 209093

SEQ ID NO: 518871 - RNA, 64 nt, hsa; identical to SEQ ID NO: 209094

SEQ ID NO: 518872 - RNA, 64 nt, hsa; identical to SEQ ID NO: 209095

SEQ ID NO: 518873 - RNA, 64 nt, hsa; identical to SEQ ID NO: 209096

SEQ ID NO: 518874 - RNA, 64 nt, hsa; identical to SEQ ID NO: 209097

SEQ ID NO: 518875 - RNA, 64 nt, hsa; identical to SEQ ID NO: 209098

SEQ ID NO: 518876 - RNA, 64 nt, hsa; identical to SEQ ID NO: 209099

SEQ ID NO: 518877 - RNA, 64 nt, hsa; identical to SEQ ID NO: 209100

SEQ ID NO: 518878 - RNA, 64 nt, hsa; identical to SEQ ID NO: 209101

SEQ ID NO: 518879 - RNA, 64 nt, hsa; identical to SEQ ID NO: 209102

SEQ ID NO: 518880 - RNA, 64 nt, hsa; identical to SEQ ID NO: 209103

SEQ ID NO: 518881 - RNA, 64 nt, hsa; identical to SEQ ID NO: 209104

SEQ ID NO: 518882 - RNA, 64 nt, hsa; identical to SEQ ID NO: 209105

SEQ ID NO: 518883 - RNA, 64 nt, hsa; identical to SEQ ID NO: 209106

SEQ ID NO: 518884 - RNA, 64 nt, hsa; identical to SEQ ID NO: 209107

SEQ ID NO: 518885 - RNA, 64 nt, hsa; identical to SEQ ID NO: 209108

SEQ ID NO: 518886 - RNA, 64 nt, hsa; identical to SEQ ID NO: 209109

SEQ ID NO: 518887 - RNA, 64 nt, hsa; identical to SEQ ID NO: 209110

SEQ ID NO: 518888 - RNA, 64 nt, hsa; identical to SEQ ID NO: 209111

SEQ ID NO: 518889 - RNA, 64 nt, hsa; identical to SEQ ID NO: 209112

SEQ ID NO: 518890 - RNA, 64 nt, hsa; identical to SEQ ID NO: 209113

SEQ ID NO: 518891 - RNA, 59 nt, hsa; identical to SEQ ID NO: 209114

SEQ ID NO: 518892 - RNA, 64 nt, hsa; identical to SEQ ID NO: 209115

SEQ ID NO: 518893 - RNA, 64 nt, hsa; identical to SEQ ID NO: 209116

SEQ ID NO: 518894 - RNA, 64 nt, hsa; identical to SEQ ID NO: 209117

SEQ ID NO: 518895 - RNA, 64 nt, hsa; identical to SEQ ID NO: 209118

SEQ ID NO: 518896 - RNA, 64 nt, hsa; identical to SEQ ID NO: 209119

SEQ ID NO: 518897 - RNA, 64 nt, hsa; identical to SEQ ID NO: 209120

SEQ ID NO: 518898 - RNA, 64 nt, hsa; identical to SEQ ID NO: 209121

SEQ ID NO: 518899 - RNA, 64 nt, hsa; identical to SEQ ID NO: 209122

SEQ ID NO: 518900 - RNA, 64 nt, hsa; identical to SEQ ID NO: 209123

SEQ ID NO: 518901 - RNA, 64 nt, hsa; identical to SEQ ID NO: 209124

SEQ ID NO: 518902 - RNA, 64 nt, hsa; identical to SEQ ID NO: 209125

SEQ ID NO: 518903 - RNA, 64 nt, hsa; identical to SEQ ID NO: 209126

SEQ ID NO: 518904 - RNA, 64 nt, hsa; identical to SEQ ID NO: 209127

SEQ ID NO: 518905 - RNA, 64 nt, hsa; identical to SEQ ID NO: 209128

SEQ ID NO: 518906 - RNA, 64 nt, hsa; identical to SEQ ID NO: 209129

SEQ ID NO: 518907 - RNA, 64 nt, hsa; identical to SEQ ID NO: 209130

SEQ ID NO: 518908 - RNA, 64 nt, hsa; identical to SEQ ID NO: 209131

SEQ ID NO: 518909 - RNA, 64 nt, hsa; identical to SEQ ID NO: 209132

SEQ ID NO: 518910 - RNA, 64 nt, hsa; identical to SEQ ID NO: 209133

SEQ ID NO: 518911 - RNA, 64 nt, hsa; identical to SEQ ID NO: 209134

SEQ ID NO: 518912 - RNA, 64 nt, hsa; identical to SEQ ID NO: 209135

SEQ ID NO: 518913 - RNA, 64 nt, hsa; identical to SEQ ID NO: 209136

SEQ ID NO: 518914 - RNA, 64 nt, hsa; identical to SEQ ID NO: 209137

SEQ ID NO: 518915 - RNA, 64 nt, hsa; identical to SEQ ID NO: 209138

SEQ ID NO: 518916 - RNA, 64 nt, hsa; identical to SEQ ID NO: 209139

SEQ ID NO: 518917 - RNA, 64 nt, hsa; identical to SEQ ID NO: 209140

SEQ ID NO: 518918 - RNA, 64 nt, hsa; identical to SEQ ID NO: 209141

SEQ ID NO: 518919 - RNA, 64 nt, hsa; identical to SEQ ID NO: 209142

SEQ ID NO: 518920 - RNA, 64 nt, hsa; identical to SEQ ID NO: 209143

SEQ ID NO: 518921 - RNA, 64 nt, hsa; identical to SEQ ID NO: 209144

SEQ ID NO: 518922 - RNA, 64 nt, hsa; identical to SEQ ID NO: 209145

SEQ ID NO: 518923 - RNA, 64 nt, hsa
aacauaauauauuucuguuaaacaguucuucaccuaacagcauauugcucuuauaacugguaga

SEQ ID NO: 518924 - RNA, 64 nt, hsa
uuugaaaauuguauguuuuauuuuuuaaauuuguuaacagcauuaauuuauagaguauugaugu

SEQ ID NO: 518925 - RNA, 64 nt, hsa
aaaauaguucagcaaguagcccacaguucuggccuaacagcagacuugcuguuuucacuuggua

SEQ ID NO: 518926 - RNA, 64 nt, hsa
ucugugucucccucacugaacccugcacguugaguaacagcagcauaauuccauccuaggaaag

SEQ ID NO: 518927 - RNA, 64 nt, hsa
ccgaugaugucucuacuacuggaucuaucuguauuaacagcaauguuacucucaaugaaacugc

SEQ ID NO: 518928 - RNA, 64 nt, hsa
cuggacaguggaaaccaagagcaggaucgcaaaguaacagcaucagacucuucugcccuccucu

SEQ ID NO: 518929 - RNA, 64 nt, hsa
aagccugccuuagggcuggcaacaucuaagccucuaacagcacagggaagcaaauaucuuacca

SEQ ID NO: 518930 - RNA, 64 nt, hsa
acacauaaagucaaacaaauguuuuaaaaauucauaacagcaaccuugaaaaaauagacuuaaa

SEQ ID NO: 518931 - RNA, 64 nt, hsa
ucccuuccuucccccuccuuagugauuuuuucuuuaacagcauaaguaaagaggacuuucuggu

SEQ ID NO: 518932 - RNA, 64 nt, hsa
cucaagcaucacgccuagcaguuucugguuccuuuaacagcaaaaggaaagagagguucugauu

SEQ ID NO: 518933 - RNA, 64 nt, hsa; identical to SEQ ID NO: 506898

SEQ ID NO: 518934 - RNA, 64 nt, hsa; identical to SEQ ID NO: 506899

SEQ ID NO: 518935 - RNA, 64 nt, hsa; identical to SEQ ID NO: 506900

SEQ ID NO: 518936 - RNA, 64 nt, hsa; identical to SEQ ID NO: 506901

SEQ ID NO: 518937 - RNA, 64 nt, hsa; identical to SEQ ID NO: 506902

SEQ ID NO: 518938 - RNA, 64 nt, hsa; identical to SEQ ID NO: 506903

SEQ ID NO: 518939 - RNA, 64 nt, hsa; identical to SEQ ID NO: 506904

SEQ ID NO: 518940 - RNA, 64 nt, hsa; identical to SEQ ID NO: 506905

SEQ ID NO: 518941 - RNA, 64 nt, hsa; identical to SEQ ID NO: 506906

SEQ ID NO: 518942 - RNA, 64 nt, hsa; identical to SEQ ID NO: 506907

SEQ ID NO: 518943 - RNA, 64 nt, hsa; identical to SEQ ID NO: 506908

SEQ ID NO: 518944 - RNA, 64 nt, hsa; identical to SEQ ID NO: 506909

SEQ ID NO: 518945 - RNA, 64 nt, hsa; identical to SEQ ID NO: 506910

SEQ ID NO: 518946 - RNA, 64 nt, hsa; identical to SEQ ID NO: 506911

SEQ ID NO: 518947 - RNA, 64 nt, hsa; identical to SEQ ID NO: 129516

SEQ ID NO: 518948 - RNA, 64 nt, hsa; identical to SEQ ID NO: 129517

SEQ ID NO: 518949 - RNA, 64 nt, hsa; identical to SEQ ID NO: 129518

SEQ ID NO: 518950 - RNA, 64 nt, hsa; identical to SEQ ID NO: 129519

SEQ ID NO: 518951 - RNA, 64 nt, hsa; identical to SEQ ID NO: 129520

SEQ ID NO: 518952 - RNA, 64 nt, hsa; identical to SEQ ID NO: 129521

SEQ ID NO: 518953 - RNA, 64 nt, hsa; identical to SEQ ID NO: 129522

SEQ ID NO: 518954 - RNA, 64 nt, hsa; identical to SEQ ID NO: 129523

SEQ ID NO: 518955 - RNA, 64 nt, hsa; identical to SEQ ID NO: 129524

SEQ ID NO: 518956 - RNA, 64 nt, hsa; identical to SEQ ID NO: 129525

SEQ ID NO: 518957 - RNA, 59 nt, hsa; identical to SEQ ID NO: 129526

SEQ ID NO: 518958 - RNA, 64 nt, hsa; identical to SEQ ID NO: 129527

SEQ ID NO: 518959 - RNA, 64 nt, hsa; identical to SEQ ID NO: 129528

SEQ ID NO: 518960 - RNA, 64 nt, hsa; identical to SEQ ID NO: 129529

SEQ ID NO: 518961 - RNA, 64 nt, hsa; identical to SEQ ID NO: 129530

SEQ ID NO: 518962 - RNA, 64 nt, hsa; identical to SEQ ID NO: 129531

SEQ ID NO: 518963 - RNA, 64 nt, hsa; identical to SEQ ID NO: 129532

SEQ ID NO: 518964 - RNA, 53 nt, hsa; identical to SEQ ID NO: 129533

SEQ ID NO: 518965 - RNA, 64 nt, hsa; identical to SEQ ID NO: 129534

SEQ ID NO: 518966 - RNA, 64 nt, hsa; identical to SEQ ID NO: 129535

SEQ ID NO: 518967 - RNA, 64 nt, hsa; identical to SEQ ID NO: 129536

SEQ ID NO: 518968 - RNA, 64 nt, hsa; identical to SEQ ID NO: 129537

SEQ ID NO: 518969 - RNA, 64 nt, hsa; identical to SEQ ID NO: 129538

SEQ ID NO: 518970 - RNA, 64 nt, hsa; identical to SEQ ID NO: 129539

SEQ ID NO: 518971 - RNA, 64 nt, hsa; identical to SEQ ID NO: 129540

SEQ ID NO: 518972 - RNA, 64 nt, hsa; identical to SEQ ID NO: 129541

SEQ ID NO: 518973 - RNA, 64 nt, hsa; identical to SEQ ID NO: 129542

SEQ ID NO: 518974 - RNA, 64 nt, hsa; identical to SEQ ID NO: 129543

SEQ ID NO: 518975 - RNA, 64 nt, hsa; identical to SEQ ID NO: 129544

SEQ ID NO: 518976 - RNA, 64 nt, hsa; identical to SEQ ID NO: 129545

SEQ ID NO: 518977 - RNA, 64 nt, hsa; identical to SEQ ID NO: 129546

SEQ ID NO: 518978 - RNA, 64 nt, hsa; identical to SEQ ID NO: 129547

SEQ ID NO: 518979 - RNA, 64 nt, hsa; identical to SEQ ID NO: 129548

SEQ ID NO: 518980 - RNA, 64 nt, hsa; identical to SEQ ID NO: 129549

SEQ ID NO: 518981 - RNA, 64 nt, hsa; identical to SEQ ID NO: 129550

SEQ ID NO: 518982 - RNA, 64 nt, hsa; identical to SEQ ID NO: 129551

SEQ ID NO: 518983 - RNA, 64 nt, hsa; identical to SEQ ID NO: 129552

SEQ ID NO: 518984 - RNA, 64 nt, hsa; identical to SEQ ID NO: 129553

SEQ ID NO: 518985 - RNA, 64 nt, hsa; identical to SEQ ID NO: 129554

SEQ ID NO: 518986 - RNA, 64 nt, hsa; identical to SEQ ID NO: 129555

SEQ ID NO: 518987 - RNA, 64 nt, hsa; identical to SEQ ID NO: 129556

SEQ ID NO: 518988 - RNA, 64 nt, hsa; identical to SEQ ID NO: 129557

SEQ ID NO: 518989 - RNA, 64 nt, hsa; identical to SEQ ID NO: 173314

SEQ ID NO: 518990 - RNA, 64 nt, hsa; identical to SEQ ID NO: 173315

SEQ ID NO: 518991 - RNA, 64 nt, hsa; identical to SEQ ID NO: 173316

SEQ ID NO: 518992 - RNA, 64 nt, hsa; identical to SEQ ID NO: 173317

SEQ ID NO: 518993 - RNA, 64 nt, hsa; identical to SEQ ID NO: 173318

SEQ ID NO: 518994 - RNA, 64 nt, hsa; identical to SEQ ID NO: 173319

SEQ ID NO: 518995 - RNA, 64 nt, hsa; identical to SEQ ID NO: 173320

SEQ ID NO: 518996 - RNA, 64 nt, hsa; identical to SEQ ID NO: 173321

SEQ ID NO: 518997 - RNA, 64 nt, hsa; identical to SEQ ID NO: 173322

SEQ ID NO: 518998 - RNA, 64 nt, hsa; identical to SEQ ID NO: 173323

SEQ ID NO: 518999 - RNA, 64 nt, hsa; identical to SEQ ID NO: 173324

SEQ ID NO: 519000 - RNA, 64 nt, hsa; identical to SEQ ID NO: 173325

SEQ ID NO: 519001 - RNA, 64 nt, hsa; identical to SEQ ID NO: 173326

SEQ ID NO: 519002 - RNA, 64 nt, hsa; identical to SEQ ID NO: 173327

SEQ ID NO: 519003 - RNA, 64 nt, hsa; identical to SEQ ID NO: 173328

SEQ ID NO: 519004 - RNA, 64 nt, hsa; identical to SEQ ID NO: 76226

SEQ ID NO: 519005 - RNA, 64 nt, hsa; identical to SEQ ID NO: 76227

SEQ ID NO: 519006 - RNA, 64 nt, hsa; identical to SEQ ID NO: 76228

SEQ ID NO: 519007 - RNA, 64 nt, hsa; identical to SEQ ID NO: 76229

SEQ ID NO: 519008 - RNA, 64 nt, hsa; identical to SEQ ID NO: 76230

SEQ ID NO: 519009 - RNA, 64 nt, hsa; identical to SEQ ID NO: 76231

SEQ ID NO: 519010 - RNA, 64 nt, hsa; identical to SEQ ID NO: 76232

SEQ ID NO: 519011 - RNA, 64 nt, hsa; identical to SEQ ID NO: 76233

SEQ ID NO: 519012 - RNA, 64 nt, hsa; identical to SEQ ID NO: 76234

SEQ ID NO: 519013 - RNA, 64 nt, hsa; identical to SEQ ID NO: 76235

SEQ ID NO: 519014 - RNA, 64 nt, hsa; identical to SEQ ID NO: 76236

SEQ ID NO: 519015 - RNA, 64 nt, hsa; identical to SEQ ID NO: 76237

SEQ ID NO: 519016 - RNA, 64 nt, hsa; identical to SEQ ID NO: 76238

SEQ ID NO: 519017 - RNA, 64 nt, hsa; identical to SEQ ID NO: 76239

SEQ ID NO: 519018 - RNA, 64 nt, hsa; identical to SEQ ID NO: 76240

SEQ ID NO: 519019 - RNA, 64 nt, hsa; identical to SEQ ID NO: 76241

SEQ ID NO: 519020 - RNA, 64 nt, hsa; identical to SEQ ID NO: 76242

SEQ ID NO: 519021 - RNA, 64 nt, hsa; identical to SEQ ID NO: 76243

SEQ ID NO: 519022 - RNA, 64 nt, hsa
uccucuugccccagaaguaauucucuauaccaagauaugcuaggaguaggaugaugauucaaag

SEQ ID NO: 519023 - RNA, 64 nt, hsa
ucauuauccauggcucauuaaucucuucuagaauauaugcuaacuguugaagauauuuugggua

SEQ ID NO: 519024 - RNA, 64 nt, hsa
augaaauaaaagcaucuuagguuauaccaucuuuauaugcuauugcguuucaauauuuaagauu

SEQ ID NO: 519025 - RNA, 64 nt, hsa
agcacccucuagcuccauauucuaagaaucugaaauaugcuacuauacuaauuaauaaguaaac

SEQ ID NO: 519026 - RNA, 64 nt, hsa
ucuccacucacaugcugauauacuuucuacuacaauaugcuauagcuuuauggaacucagggug

SEQ ID NO: 519027 - RNA, 64 nt, hsa
agcuaugacagaguaggaauugagaaauuauuucauaugcuacaguauugaaauguggaugcug

SEQ ID NO: 519028 - RNA, 64 nt, hsa
ucagcuuuggaccacaauaauuucacuguagaugauaugcuaggaucaaaguuaaacagcauuc

SEQ ID NO: 519029 - RNA, 64 nt, hsa
cuuaagcagaacaagggaagauugauauuuuuggauaugcuauagcagcuuucuccuaugaaau

SEQ ID NO: 519030 - RNA, 64 nt, hsa
cuggagugaggacggugaugcccuguguguauuaauaugcuauguaaggcugggcgugguggcu

SEQ ID NO: 519031 - RNA, 64 nt, hsa
auauguguguguguauauauauauauauauauauauaugcuauauaaaguuuaaaugaaaugcu

SEQ ID NO: 519032 - RNA, 64 nt, hsa
uucagcuccuuacaaauuaccaaaagugguucuaauaugcuaguuuguuugauuuuuucuuuua

SEQ ID NO: 519033 - RNA, 64 nt, hsa
aaacauuccccuuccaaucuggugcuaguagaguauaugcuaucuaggcaccauguguguggcu

SEQ ID NO: 519034 - RNA, 64 nt, hsa
cuuccugugcccagggugucagccacaauucagcgguaccuagagucugugcgccccuuguugg

SEQ ID NO: 519035 - RNA, 64 nt, hsa
aaggagccccacuggcuguuugggaccauggagcgguaccuaaaacagauccaggaccugcccc

SEQ ID NO: 519036 - RNA, 64 nt, hsa
uucccccagaggcccuccuguccgaaaagaaaaggaccuugauucugagcccagggucggaacc

SEQ ID NO: 519037 - RNA, 64 nt, hsa
ucgcuggcagaguugggucaagugcccucuccuugaccuugagaugaaggucaagagcacaggg

SEQ ID NO: 519038 - RNA, 64 nt, hsa
auuaaaauauuaggaagaaacaaggacaaauuuagaccuugaauccgaagagauaaagcuuacu

SEQ ID NO: 519039 - RNA, 64 nt, hsa
uuaccagcaucagagagcuucccauuugcaucuagaccuugaauuuauauuuauugaucaaguu

SEQ ID NO: 519040 - RNA, 64 nt, hsa
cuuuuccuccuagugcuaucauuagucacauaaugaccuugauuuuauuuuaggagcuuauaag

SEQ ID NO: 519041 - RNA, 64 nt, hsa
aaaguuugggggggggguugugaagauuuagggggaccuugauagagaacuuuauaaacuucuu

SEQ ID NO: 519042 - RNA, 64 nt, hsa
aaauuuuauaaugcuuguucuguuaacucaccgggaccuugaggguccaaugggaccuugaggg

SEQ ID NO: 519043 - RNA, 64 nt, hsa
cuguuaacucaccgggaccuugaggguccaaugggaccuugaggguuuucucugaaauauacaa

SEQ ID NO: 519044 - RNA, 64 nt, hsa
agugucagcaucuacaguacagccaggcaggcaggaccuugaggaaucagacuaucugucugug

SEQ ID NO: 519045 - RNA, 64 nt, hsa
uaccuuggcuaccacagguucugcugaauguccugaccuugaaccggaaccugagugacagccu

SEQ ID NO: 519046 - RNA, 64 nt, hsa
uuagaugggaaagugaggggcuugagaaagugggugggaggagggaaggauuuuuuaggagccu

SEQ ID NO: 519047 - RNA, 64 nt, hsa
cacaagcccagcugaagaacagaauggagggcucugggaggaggcagcucacuggagagccuac

SEQ ID NO: 519048 - RNA, 64 nt, hsa
accuccgccuccagggcgcagccuccugaguagcugggaggacaggcauaugccaccacaucac

SEQ ID NO: 519049 - RNA, 64 nt, hsa
gcaccuaugguuccagcuacucaggaggcugaggugggaggaucgcuugugccuuggaggucaa

SEQ ID NO: 519050 - RNA, 64 nt, hsa
gugccugaagucccagauacuuggggggcugaggugggaggaucucuugagccugggaggucaa

SEQ ID NO: 519051 - RNA, 64 nt, hsa
acgccuguaauccuagcacuuugggaggccaaggugggaggauugcuugagcucaggaguuuga

SEQ ID NO: 519052 - RNA, 64 nt, hsa
ggagcccacccaggcacagccaccacuuugcaagugggaggaggggagaaggggagacaaaacc

SEQ ID NO: 519053 - RNA, 64 nt, hsa
agcaccaugccaucggcgcuccagucugucuggcugggaggaaagugcugggcaucuuacagua

SEQ ID NO: 519054 - RNA, 64 nt, hsa
gcagcaucccaccagccugcaccacaggcuccccugggaggacgagggaaacgcugaugagacg

SEQ ID NO: 519055 - RNA, 64 nt, hsa
uccagccaagcugugccccaucccccaagccuccugggaggauccagccaaaucuugcgacucc

SEQ ID NO: 519056 - RNA, 64 nt, hsa
ccaccccugccaggccccagguuaggaauaguggugggaggaaggggaaagggcugggccucac

SEQ ID NO: 519057 - RNA, 64 nt, hsa
uuugaucuucucaaacaucuaguucccugcuugaugggaggauccuaaugaaauaccugaaaca

SEQ ID NO: 519058 - RNA, 64 nt, hsa
agucuuuguggaauggauagccucccacuaggacugggaggagaauaacccaggucuuaaggac

SEQ ID NO: 519059 - RNA, 64 nt, hsa
cucuuucucucggagggugcagagcuggguuccuugggaggaaguuguaguggugaugaugaug

SEQ ID NO: 519060 - RNA, 64 nt, hsa
uuccgagcauccgccgccucuuuucugcugggucugggaggagggaggcugggaggccgcucgg

SEQ ID NO: 519061 - RNA, 64 nt, hsa
acaccuguaaccucagcacuuugggaggcagaggugggaggaucacuuagguccaggaguucga

SEQ ID NO: 519062 - RNA, 64 nt, hsa
uguaucugugucccagcuaauugggagggugaguugggaggauuguuugagccuaggagaggga

SEQ ID NO: 519063 - RNA, 64 nt, hsa
gcaucuauagucccugcuauuugagaggcugaggugggaggaucauuugagugcaggaguucaa

SEQ ID NO: 519064 - RNA, 64 nt, hsa
accccuguagucccagcuacuugggaggcugaggugggaggauugcuugaacccaagaggucga

SEQ ID NO: 519065 - RNA, 64 nt, hsa
acaccuguagucccagcuacuuaggaggcugagaugggaggauugaucgaucgcuugagccugg

SEQ ID NO: 519066 - RNA, 64 nt, hsa
acaccuauaaucccaacacuuugggaggccgaggugggaggaucacuugagcacaggaguuuga

SEQ ID NO: 519067 - RNA, 64 nt, hsa
ugagcagauugagugaugcuggggcagagaggccugggaggaaagguguucagccagucguuug

SEQ ID NO: 519068 - RNA, 64 nt, hsa
agucccccacuggggggacggugggggaagacuuugggaggauuuuacccagaauacuugccgc

SEQ ID NO: 519069 - RNA, 64 nt, hsa
gaugaggugugagacagacuugacuugcuguugcugggaggaaggggaggucaugagccaagga

SEQ ID NO: 519070 - RNA, 64 nt, hsa
aggcuagugucugcgcgucacugugguuuuagcaugggaggacuuauuugagaaauacuaccuu

SEQ ID NO: 519071 - RNA, 64 nt, hsa
agcagagguucaugggacacaguuggaaagccacugggaggaaaugccucacuacaggggggcc

SEQ ID NO: 519072 - RNA, 64 nt, hsa
aaccaauagaguugguuggguggggagucaggggugggaggagaaggaggaagaggaggaaggc

SEQ ID NO: 519073 - RNA, 64 nt, hsa
accgcaccagacccucaaaacccauccaagacugugggaggaguaaacaacccagcccaguuaa

SEQ ID NO: 519074 - RNA, 64 nt, hsa
ggucaacaggguuagcuaucacuguccaguuuggugggaggaacugaaugcauguaggcacaug

SEQ ID NO: 519075 - RNA, 64 nt, hsa
aaacagugaggucuauuggaaaguuagccuucagugggaggaguggcaaaggcacgcagggcag

SEQ ID NO: 519076 - RNA, 64 nt, hsa
gggauuucacuaagggcuggagaaggggggaauaugggaggauuaucuccuaucacagggagcg

SEQ ID NO: 519077 - RNA, 64 nt, hsa
gccaaggcucaucuugagaagcaggcggguugggugggaggaggaagaaagggaagaauuaggu

SEQ ID NO: 519078 - RNA, 64 nt, hsa
gaguuuguugccacugagaagcaggcggguugggugggaggaggaagaaagggaagaauuaggu

SEQ ID NO: 519079 - RNA, 64 nt, hsa
agugaggaaggagacagggguggaauucgucuucugggaggaagcuggagagagcacagugaaa

SEQ ID NO: 519080 - RNA, 64 nt, hsa
uugaaaaaauaacaguuuaaaaagggaaacaaugugggaggaagaaucaccguugacgcaucuu

SEQ ID NO: 519081 - RNA, 64 nt, hsa
cccucuugcugccugccugucugcugagguaaggugggaggagggcuacagcccacaucccacc

SEQ ID NO: 519082 - RNA, 64 nt, hsa
guugauuguaccuucccaagcccgcccagugggaugggaggaggaggagaaggggggccuuggg

SEQ ID NO: 519083 - RNA, 64 nt, hsa
uagaaggaaaauggaaacccccaucugaguauuuugggaggagcccccagcccucauccagcuc

SEQ ID NO: 519084 - RNA, 64 nt, hsa
ugucuucaccccaaaacuucaguugauucugaccugggaggaucuggggaccagggggucuugg

SEQ ID NO: 519085 - RNA, 64 nt, hsa
acaucgguaguccuggcuacuagagagguugaggugggaggaucacuugaaccugggagguggg

SEQ ID NO: 519086 - RNA, 64 nt, hsa
accuguaguccgagguacucaggaggcagagacgugggaggaucgcuugagccugggagauuga

SEQ ID NO: 519087 - RNA, 64 nt, hsa
gcacuagguaaagcccagugaaugucucuuggcaugggaggaguuaaagagguuggaagggaag

SEQ ID NO: 519088 - RNA, 64 nt, hsa
cacuuauuuuugaaaaugauauaauguauauauaugggaggaaaggccacauuuuguaccuguu

SEQ ID NO: 519089 - RNA, 64 nt, hsa
ugcuuuacaacuucaggcuaaagggaggggauguugggaggagaaaccaucacaagauucccuc

SEQ ID NO: 519090 - RNA, 64 nt, hsa
gcccccgcgugaaaugagaaggcaugcuuagcacugggaggaaaagcugaguuaagaaaauucu

SEQ ID NO: 519091 - RNA, 64 nt, hsa
gcucuguccuaccuccacucucugccccuaaagaugggaggagaccagcgguccaugggucugg

SEQ ID NO: 519092 - RNA, 64 nt, hsa
ggacgggcaagugagaggggagggagggaaguccugggaggauccugagcugcuguugcagucu

SEQ ID NO: 519093 - RNA, 64 nt, hsa
cugcuuugaugcauggcuauaaucccagccgaggugggaggaucacuugaguccagguucaaga

SEQ ID NO: 519094 - RNA, 64 nt, hsa
gcgccugcagucccagcuacuugggaggcugaguugggaggaucacuugagccugggagguuga

SEQ ID NO: 519095 - RNA, 64 nt, hsa
gacuugggaggagacugaggagacccugcugcuuugggaggauuucucaggcuaugccauggca

SEQ ID NO: 519096 - RNA, 64 nt, hsa
guaugauuuugaggacgacugugacagccugacuugggaggagacugaggagacccugcugcuu

SEQ ID NO: 519097 - RNA, 64 nt, hsa
gggcaugguggcccaagucugagucccaguuacuugggaggaucacuugaauguaggaucacuu

SEQ ID NO: 519098 - RNA, 64 nt, hsa
ucaugccuguaauccuagcaacucggggcugaggugggaggauugcuucagcccaggaguuuga

SEQ ID NO: 519099 - RNA, 64 nt, hsa
cuucugccuacaaaucagggguaaaaauaccuguugggaggagaaaugagaacauagaggaaag

SEQ ID NO: 519100 - RNA, 64 nt, hsa
gcacacuucugcuuuauguguguguguauggggaugggaggacuuaacggaaguugaaccaguu

SEQ ID NO: 519101 - RNA, 64 nt, hsa
caaccacuuucggagaaugagccaggucagucacugggaggaccugugaaagaaaguuggucac

SEQ ID NO: 519102 - RNA, 64 nt, hsa
augccuguaaucccagcacuuugggaggcugaagugggaggacugcuugggcccaagaauucag

SEQ ID NO: 519103 - RNA, 64 nt, hsa
gugccuguagucccagcuacuauggagguugaggugggaggaucgcuugagcccaugaggccca

SEQ ID NO: 519104 - RNA, 64 nt, hsa
acucuuguaaucccaaaacuuuaggaggccaaggugggaggaucgcuugagcccaggaguuuga

SEQ ID NO: 519105 - RNA, 64 nt, hsa
gcagaaauuggaguggauggguucugccuuaaauugggaggacuccaagccgggaaggaaaauu

SEQ ID NO: 519106 - RNA, 64 nt, hsa
uguuuuugauugaacuuguucauuuuguuuugcuugggaggaaaauaaacaauuuuacuuuuuu

SEQ ID NO: 519107 - RNA, 64 nt, hsa
ucccaaagcacaaagcaguuuuucccccuaggggugggaggaagcaaaagacucuguaccuauu

SEQ ID NO: 519108 - RNA, 64 nt, hsa
gacuugugaauuuuucuaaaggugcuauuuaacaugggaggagagcgugugcggcuccagccca

SEQ ID NO: 519109 - RNA, 64 nt, hsa
gagcaccuacuauaugcagaaggggaggccgaggugggaggaucauuggaucucaggaguucga

SEQ ID NO: 519110 - RNA, 64 nt, hsa
gugcuuguaguuccagcuacucaggaggcugaggugggaggaugacuugaacgcaggaggcuga

SEQ ID NO: 519111 - RNA, 64 nt, hsa
cuggugccagugccugugcccacucugugccugcugggaggaggcccaggcucucugguggccg

SEQ ID NO: 519112 - RNA, 64 nt, hsa
gcaccuguggucccagcuacucgggaggcuguggugggaggauugcuugaguccaggagguuga

SEQ ID NO: 519113 - RNA, 64 nt, hsa
cugucuggucaugaccccauuagguauggagagcugggaggaggcauugucacuucccaccagg

SEQ ID NO: 519114 - RNA, 64 nt, hsa
ugaggugagucauggccucuugcuggcaauggggugggaggaguacccccaaguccucucacuc

SEQ ID NO: 519115 - RNA, 64 nt, hsa
acagguccugggaaagaagugggaucuagggcccugggaggagguugagccuggggaaggaaaa

SEQ ID NO: 519116 - RNA, 64 nt, hsa
ggcugccugcugaagucugaaguggggucuggccugggaggaggucugauaagugccuucaagg

SEQ ID NO: 519117 - RNA, 64 nt, hsa
caugguggcacacaccuguagucccaggcugaggugggaggaucacuugaacccaagaggcaga

SEQ ID NO: 519118 - RNA, 64 nt, hsa
uggcacaggggucacaccuguaaucccagcacuuugggaggacaagguggguggaucacuugag

SEQ ID NO: 519119 - RNA, 64 nt, hsa
ccgccuguagucccagcuacucaggaggcuugggugggaggauugccugagaccaggagguuga

SEQ ID NO: 519120 - RNA, 64 nt, hsa
accuguggaaucccagcacuucaggaggccgaggugggaggaucacuggagcucgggaguucaa

SEQ ID NO: 519121 - RNA, 64 nt, hsa
acaccuguaguccaagcuacuugggaggcugaagugggaggaucauuugugcccagguugaggc

SEQ ID NO: 519122 - RNA, 64 nt, hsa
acaccuguaaucccugcacuuugggaggccaaggugggaggaucaguugagccccagaguucaa

SEQ ID NO: 519123 - RNA, 64 nt, hsa
caaucauuacucauaaccuuugagagauggcaaaugggaggaguguuagucuuuguuuuggaau

SEQ ID NO: 519124 - RNA, 64 nt, hsa
acugagaaacacagucauugucuuagguguucuaugggaggaagugaauagagccuuuaggaac

SEQ ID NO: 519125 - RNA, 64 nt, hsa
acacauggaaucccagcacuuugggaggccgaggugggaggaucacuugagcccaggaguucga

SEQ ID NO: 519126 - RNA, 64 nt, hsa
acaucaguagucccagcuacucugcaggcugaggugggaggauugcuugaacccaggaggucga

SEQ ID NO: 519127 - RNA, 64 nt, hsa; identical to SEQ ID NO: 302274

SEQ ID NO: 519128 - RNA, 64 nt, hsa; identical to SEQ ID NO: 302275

SEQ ID NO: 519129 - RNA, 64 nt, hsa; identical to SEQ ID NO: 302276

SEQ ID NO: 519130 - RNA, 64 nt, hsa; identical to SEQ ID NO: 302277

SEQ ID NO: 519131 - RNA, 64 nt, hsa; identical to SEQ ID NO: 302278

SEQ ID NO: 519132 - RNA, 64 nt, hsa; identical to SEQ ID NO: 302279

SEQ ID NO: 519133 - RNA, 64 nt, hsa; identical to SEQ ID NO: 302280

SEQ ID NO: 519134 - RNA, 64 nt, hsa; identical to SEQ ID NO: 302281

SEQ ID NO: 519135 - RNA, 64 nt, hsa; identical to SEQ ID NO: 302282

SEQ ID NO: 519136 - RNA, 64 nt, hsa; identical to SEQ ID NO: 302283

SEQ ID NO: 519137 - RNA, 64 nt, hsa; identical to SEQ ID NO: 302284

SEQ ID NO: 519138 - RNA, 64 nt, hsa; identical to SEQ ID NO: 302285

SEQ ID NO: 519139 - RNA, 64 nt, hsa; identical to SEQ ID NO: 302286

SEQ ID NO: 519140 - RNA, 64 nt, hsa; identical to SEQ ID NO: 302287

SEQ ID NO: 519141 - RNA, 64 nt, hsa; identical to SEQ ID NO: 302288

SEQ ID NO: 519142 - RNA, 64 nt, hsa; identical to SEQ ID NO: 302289

SEQ ID NO: 519143 - RNA, 64 nt, hsa; identical to SEQ ID NO: 302290

SEQ ID NO: 519144 - RNA, 64 nt, hsa; identical to SEQ ID NO: 302291

SEQ ID NO: 519145 - RNA, 64 nt, hsa; identical to SEQ ID NO: 302292

SEQ ID NO: 519146 - RNA, 64 nt, hsa; identical to SEQ ID NO: 302293

SEQ ID NO: 519147 - RNA, 64 nt, hsa; identical to SEQ ID NO: 302294

SEQ ID NO: 519148 - RNA, 64 nt, hsa; identical to SEQ ID NO: 302295

SEQ ID NO: 519149 - RNA, 64 nt, hsa; identical to SEQ ID NO: 302296

SEQ ID NO: 519150 - RNA, 64 nt, hsa; identical to SEQ ID NO: 302297

SEQ ID NO: 519151 - RNA, 64 nt, hsa; identical to SEQ ID NO: 302298

SEQ ID NO: 519152 - RNA, 64 nt, hsa; identical to SEQ ID NO: 302299

SEQ ID NO: 519153 - RNA, 53 nt, hsa; identical to SEQ ID NO: 244527

SEQ ID NO: 519154 - RNA, 64 nt, hsa; identical to SEQ ID NO: 244528

SEQ ID NO: 519155 - RNA, 64 nt, hsa; identical to SEQ ID NO: 244529

SEQ ID NO: 519156 - RNA, 64 nt, hsa; identical to SEQ ID NO: 244530

SEQ ID NO: 519157 - RNA, 64 nt, hsa; identical to SEQ ID NO: 244531

SEQ ID NO: 519158 - RNA, 64 nt, hsa; identical to SEQ ID NO: 244532

SEQ ID NO: 519159 - RNA, 64 nt, hsa; identical to SEQ ID NO: 244533

SEQ ID NO: 519160 - RNA, 64 nt, hsa; identical to SEQ ID NO: 244534

SEQ ID NO: 519161 - RNA, 64 nt, hsa; identical to SEQ ID NO: 244535

SEQ ID NO: 519162 - RNA, 64 nt, hsa; identical to SEQ ID NO: 244536

SEQ ID NO: 519163 - RNA, 64 nt, hsa; identical to SEQ ID NO: 244537

SEQ ID NO: 519164 - RNA, 64 nt, hsa; identical to SEQ ID NO: 244538

SEQ ID NO: 519165 - RNA, 64 nt, hsa; identical to SEQ ID NO: 244539

SEQ ID NO: 519166 - RNA, 64 nt, hsa; identical to SEQ ID NO: 244540

SEQ ID NO: 519167 - RNA, 64 nt, hsa; identical to SEQ ID NO: 244541

SEQ ID NO: 519168 - RNA, 64 nt, hsa
cgaucaaauuugagaaucacaggucuaggauacgacggggaaaacagaaaugugggguggucag

SEQ ID NO: 519169 - RNA, 64 nt, hsa
cagggccggcagggugcuucgggagcccccugcuacggggaaaggcauguguuucuugcuggug

SEQ ID NO: 519170 - RNA, 64 nt, hsa
auuuuaaucuaagugguuauaacaguggauucugacggggaagguguagcucuguucucuucgg

SEQ ID NO: 519171 - RNA, 64 nt, hsa
ucucaaaucagauuuacaaucuccauuuucauuaacggggaaacauccccgagccacugagugc

SEQ ID NO: 519172 - RNA, 64 nt, hsa
gagaaucauccagucuuacugucucaauguacauacggggaaacugaagccaggagaagaagag

SEQ ID NO: 519173 - RNA, 64 nt, hsa
uaacuuucugaaccucagagucuucaccuauaagacggggaaaauaauaccacccuuucaagau

SEQ ID NO: 519174 - RNA, 64 nt, hsa
ccaacucuggccccuuucucagugcuaucugaugacggggaaacaaaauuauucucugagaggg

SEQ ID NO: 519175 - RNA, 64 nt, hsa
guugaaggccagucuguguagaaaggcugaggcaacggggaaagaccugacagcuaguuacaua

SEQ ID NO: 519176 - RNA, 64 nt, hsa
caaagauuucaguagaauuuuaguccugaacgcuacggggaaaaugcauuuucuucagaauuau

SEQ ID NO: 519177 - RNA, 64 nt, hsa
guuuucuucagguuacuuuuuaauaaugauuaaaacggggaacuucauuaucaugagcaugguu

SEQ ID NO: 519178 - RNA, 64 nt, hsa
caggucgggcgcaggauucagccggagggaagggacggggaagccgagcuccagagcaacgacc

SEQ ID NO: 519179 - RNA, 64 nt, hsa
cuuaccuaugucccuucucaugccuuucccuccaacggggaaagccaacuccaucucuaagugc

SEQ ID NO: 519180 - RNA, 64 nt, hsa
ccaaagccuucagcgaacgugaaaugugcgcuaaacggggaaaccuguuuaauucuagauauag

SEQ ID NO: 519181 - RNA, 64 nt, hsa
uguggacccacuaugaaugugaauaacccuuccuacggggaaucuguguaugggcccaguuccc

SEQ ID NO: 519182 - RNA, 64 nt, hsa
ccacgggagaagcuggaggugcuggagaggacauacggggaaauugagggcacggugucgaggg

SEQ ID NO: 519183 - RNA, 64 nt, hsa
ccuuccggcccuuaaaacugggcugggagagaagacggggaagugugugagacaaaacaaagcc

SEQ ID NO: 519184 - RNA, 64 nt, hsa
cccauuucacgacuccucugagacuaauugggaaacggggaaauucuuggaauuuuuuuuuuaa

SEQ ID NO: 519185 - RNA, 56 nt, hsa
ucuguggagaagaugacuaacgugucacggggaagagcucccugcugugugccugc

SEQ ID NO: 519186 - RNA, 64 nt, hsa
cucccccacaaauaaugaacagcagaaagacuggacggggaaaccuaucaauccugcccccagc

SEQ ID NO: 519187 - RNA, 64 nt, hsa
uuauggcugcaauaaaaagcauacuuucagacaaacggggaauuuccuaaaauuagucuggcuc

SEQ ID NO: 519188 - RNA, 64 nt, hsa
gugacuuucuacucaccaagguugaagaaaggaaacggggaaaaucaaaagggguucaaacccc

SEQ ID NO: 519189 - RNA, 64 nt, hsa
uccccuggcccggugggaagcccagacgaggaggacggggaaccggauuacgugaauggggagg

SEQ ID NO: 519190 - RNA, 64 nt, hsa
uuaaauauuaaaaguaguucugguuuauuaaucaacggggaaaacaucuucuccaaaaaacuug

SEQ ID NO: 519191 - RNA, 64 nt, hsa
uggacagcaucuccucagauggugaauuaugugcacggggaaaccuccugaguggaaguuucau

SEQ ID NO: 519192 - RNA, 64 nt, hsa
ccggggcagucugacugucggugcccucccaggaacggggaaggccuccgucugugugaaaggg

SEQ ID NO: 519193 - RNA, 64 nt, hsa
ccuuuuauuuuuaggauauuguuuggaaaguaacacggggaaacuuuagaaaugcuguuuucuu

SEQ ID NO: 519194 - RNA, 64 nt, hsa
cuauuguuccccagauaauguucccucaaauagcacggggaagcaacugccuuucaaggguaau

SEQ ID NO: 519195 - RNA, 64 nt, hsa
aggagcagccucaagcccagagaagacugaggcuacggggaacuucccuugcugcaggcuguug

SEQ ID NO: 519196 - RNA, 64 nt, hsa
ucugaauuacuugguauuuagaacuccuagcaccacggggaagaauagagguaucaucaaacgu

SEQ ID NO: 519197 - RNA, 64 nt, hsa
gguccauaguucuucacauugugaguauaugaauacggggaaauagaacccccuccccaccacc

SEQ ID NO: 519198 - RNA, 64 nt, hsa
caguaaugaucccauuaccagauaagauugacugacggggaaaaaaaaaaaaaaagaauggggu

SEQ ID NO: 519199 - RNA, 64 nt, hsa
uuggguagagagguuaagaagaggaggaagugagacggggaagggaggagcaccuugcuucacu

SEQ ID NO: 519200 - RNA, 64 nt, hsa
cccuuguuggggcauugagaauaucaugagugccacggggaaggggaguagggaugucuuuucc

SEQ ID NO: 519201 - RNA, 64 nt, hsa
gaaauuuuaaugcaaauacauacauuccugaaagacggggaauuaaauuacuaauuuuuuuuuu

SEQ ID NO: 519202 - RNA, 64 nt, hsa
ggggggucaccccgaccccucaggcccaccugucacggggaacauggagccuugguguauuuuu

SEQ ID NO: 519203 - RNA, 64 nt, hsa
gugauggaugacaacagguuguugacauuggccaacggggaacgcauccggcuccaagcacacu

SEQ ID NO: 519204 - RNA, 64 nt, hsa
aagcagggguuugcaugugcuaccaacacaugauacggggaagacccacccagggagcgguuuc

SEQ ID NO: 519205 - RNA, 64 nt, hsa
ccagagaaggggcuucccugucccggagggagacacggggaacgggauuuuccgucucucccuc

SEQ ID NO: 519206 - RNA, 64 nt, hsa
ugaggguagcgagcaacuggcuugagcagacagaacggggaagacuccacucugucccgagggg

SEQ ID NO: 519207 - RNA, 64 nt, hsa
ugugcgcugguggucucgugagacaguuccgaggacggggaaauugcaggguggugggggcgug

SEQ ID NO: 519208 - RNA, 64 nt, hsa
aacugagcaggaagaggauggaucaacaagggucacggggaauaggggacccacggggugugac

SEQ ID NO: 519209 - RNA, 64 nt, hsa
ggauuaaaaugccuggcgugcucaccguaacaccacggggaaggcugugugccuuuucucaucc

SEQ ID NO: 519210 - RNA, 64 nt, hsa
gcacuccugugaacaguuuuucacuuuugaugaaacggggaaccaagaggaacuuacuugugua

SEQ ID NO: 519211 - RNA, 64 nt, hsa
gucacuaauagaauaucucugaagcuggauugauacggggaaaacaucuuucccuucuaguuuu

SEQ ID NO: 519212 - RNA, 64 nt, hsa
ucacauacucacacggggcaggggggagggggaaacggggaacuauagcaauauuuaaagaugc

SEQ ID NO: 519213 - RNA, 64 nt, hsa
guguacguacauggggaccugucugcauauacacacggggaaugccagaagaaggcccagucug

SEQ ID NO: 519214 - RNA, 64 nt, hsa
uaccuguauacguuagugaaagcuguuuacuguaacggggaaaaccagauucuuugcaucuggg

SEQ ID NO: 519215 - RNA, 64 nt, hsa
uucaccggaagcagaugccgccaugagcgagaugacggggaauacagcacugcuugcucaggug

SEQ ID NO: 519216 - RNA, 64 nt, hsa
cuuguaucuucaguuggagguguaguauucaaaaacggggaaugaaggcaggaaggaggcugga

SEQ ID NO: 519217 - RNA, 64 nt, hsa
gacggggauaguaagagauaagugggugggaggcacggggaagguuuuggaguagaaccagggg

SEQ ID NO: 519218 - RNA, 64 nt, hsa
uaucuuguucugugacugaagugauacacuaaucacggggaacccagaaugauucaacauuuuc

SEQ ID NO: 519219 - RNA, 64 nt, hsa
ggggagggaagcgugccuccccaccccuccccucacggggaagguuuccuuuccucgugcuugu

SEQ ID NO: 519220 - RNA, 64 nt, hsa
ugauggagcguccccaaagcucccagcccuggggacggggaaggacauggagccugagccagag

SEQ ID NO: 519221 - RNA, 64 nt, hsa
ugauguuaggacagagugagagaagucagcugucacggggaaggugagagagaggaugcuaagc

SEQ ID NO: 519222 - RNA, 64 nt, hsa
guccuccugagucccguagccucauuucuuacagacggggaaacugaggcucagagcagcaggu

SEQ ID NO: 519223 - RNA, 64 nt, hsa
auccagauccgaccacuagaucauccuuauaccgacggggaaacggaggccagagagggcgugg

SEQ ID NO: 519224 - RNA, 64 nt, hsa
uccccaagccaccaauuggauggaugaauguuugacggggaagaggaaggguaggaggaugcau

SEQ ID NO: 519225 - RNA, 64 nt, hsa
guuguuucugucugauuuuaauugcugucuaaugacggggaaagcacgaugaaaagauguacaa

SEQ ID NO: 519226 - RNA, 64 nt, hsa
accgugggucaccaaugccagaaaaccagacaucacggggaaagaauguugcuuacuuuuuacc

SEQ ID NO: 519227 - RNA, 64 nt, hsa
auaauucuagcgggggaccugggagauaauuccuacggggaauucuuaaaacugugcucaacua

SEQ ID NO: 519228 - RNA, 64 nt, hsa
cggaaugggcaacuuucgccccuguggggaggggacggggaaggaagaaagaauuuaaaggacc

SEQ ID NO: 519229 - RNA, 64 nt, hsa
ccuguccaccuaugucuuuguaucuacauucuugacggggaaggaacuuccucugggaaccuuu

SEQ ID NO: 519230 - RNA, 64 nt, hsa
gcccuccuagagccaaccucaguugaugccuucccagagucaaccuccugugacgcccucccag

SEQ ID NO: 519231 - RNA, 64 nt, hsa
gcccucccagagccaaccucgggugacacccucccagagucaaccucaugugacaccuuaccgg

SEQ ID NO: 519232 - RNA, 64 nt, hsa
cauugccauguggaaggcaagccaggcucacucacagagucaaggccugcucccuguagggucc

SEQ ID NO: 519233 - RNA, 64 nt, hsa
gcuuuugaauuaugcuuuguagaguuuugucauucagagucagccaggaccauaccgggucuug

SEQ ID NO: 519234 - RNA, 64 nt, hsa
ggcggagaggggugguccuggaggcccaaugcuucagagucaucucuguccugcccgggaugca

SEQ ID NO: 519235 - RNA, 64 nt, hsa
guguacauacuguauuucuagauucuccuuuguacagagucacuucacaagucaagcuacuguu

SEQ ID NO: 519236 - RNA, 64 nt, hsa
cuuacagcuggggaaacugaggccuggaauggcccagagucaccaaggcaaaguuggggcuggu

SEQ ID NO: 519237 - RNA, 64 nt, hsa
ccuugccgcugccuccaggaagcccaccuugagccagagucaagggcugcagcacugcccgaua

SEQ ID NO: 519238 - RNA, 64 nt, hsa
ugggagcuggaagaaggggcauuggguacccaggcagagucaggagagguggucuuugaaguaa

SEQ ID NO: 519239 - RNA, 64 nt, hsa
caggccugggucuagaauucuugcugcugcuuugcagagucaacagcccaucagcccauguuuu

SEQ ID NO: 519240 - RNA, 64 nt, hsa
gcauaaccuacucggauccccaccugacacuaaccagagucagcacaggccccgaggagcccga

SEQ ID NO: 519241 - RNA, 64 nt, hsa
cuaaaaauguaggcuuucauguugcaaagaacuccagagucaguaguuagguuugguuugguuu

SEQ ID NO: 519242 - RNA, 64 nt, hsa
cagagucaacccccaacugaggaccacuguccuacagagucaggaaauauuguagggagaaaaa

SEQ ID NO: 519243 - RNA, 64 nt, hsa
guuaugccggauguugccagaugccccuaggggacagagucaacccccaacugaggaccacugu

SEQ ID NO: 519244 - RNA, 64 nt, hsa
ucccacccccuuccaccuccaucagucaugugugcagagucagugcucgggaucccgggcccag

SEQ ID NO: 519245 - RNA, 64 nt, hsa
uacguuagguucugcggauaaaggaggaauaagacagagucaggagaacuguuccuugugguuu

SEQ ID NO: 519246 - RNA, 64 nt, hsa
aggagaacaucaucuuaauagccuuuggcucacccagagucagggagagaugaaaauaauaggu

SEQ ID NO: 519247 - RNA, 64 nt, hsa
cauucaucugaaauguguaacuuuuucaugucuucagagucacagacuugaguucauuucccag

SEQ ID NO: 519248 - RNA, 64 nt, hsa
uguuuuucuuugaaguuuuauacacuggauuuguuaggggaaugaaauuuucucaucuaaaauu

SEQ ID NO: 519249 - RNA, 64 nt, hsa
uguguauguauguguguggugugugugcuugguuuaggggaaguauguguggguacaugugagg

SEQ ID NO: 519250 - RNA, 64 nt, hsa
uuccuuccucacagucuguagccaucugauauccuaggggaaaaggaaggccagggguucacau

SEQ ID NO: 519251 - RNA, 64 nt, hsa
ccugggaucaaguaggaaaaugggcagaacugcuuaggggaaugaaauugccauuuuucgggug

SEQ ID NO: 519252 - RNA, 64 nt, hsa
ggaacuuggcacuggggacucauguuuggaaucguaggggaacaucuggcuguuaaucacuugc

SEQ ID NO: 519253 - RNA, 64 nt, hsa
agguuuccugcagcucgcuaccuaaguguuucuguaggggaaggagccaauuaagaaaaagugu

SEQ ID NO: 519254 - RNA, 64 nt, hsa
aaaaacauuggaauuuuuguuuuaguggucaguauaggggaaugaaagcgucuguuguuaccca

SEQ ID NO: 519255 - RNA, 64 nt, hsa
ugaaguaauggugaugcuuauuacaacagcuauuuaggggaauguuacguugaucucuuaaauu

SEQ ID NO: 519256 - RNA, 64 nt, hsa
ccugcaguucccaggaccccauccucucagaagguaggggaagggcgggaggauugagaaggga

SEQ ID NO: 519257 - RNA, 64 nt, hsa
gggaggauugagaagggacaagccaccuugaccguaggggaaggaggaaugugggcugggggaa

SEQ ID NO: 519258 - RNA, 64 nt, hsa
gugacuauuuacauguaaucaacaugggaacuuuuaggggaaccuaauaagaaaucccaauuuu

SEQ ID NO: 519259 - RNA, 64 nt, hsa
cccaagggcgaaagucauuggaauuuuuaaaucauaggggaaaagcaguccuguucuaaauccu

SEQ ID NO: 519260 - RNA, 64 nt, hsa; identical to SEQ ID NO: 184076

SEQ ID NO: 519261 - RNA, 64 nt, hsa; identical to SEQ ID NO: 184077

SEQ ID NO: 519262 - RNA, 64 nt, hsa; identical to SEQ ID NO: 184078

SEQ ID NO: 519263 - RNA, 64 nt, hsa; identical to SEQ ID NO: 184079

SEQ ID NO: 519264 - RNA, 64 nt, hsa; identical to SEQ ID NO: 184080

SEQ ID NO: 519265 - RNA, 64 nt, hsa; identical to SEQ ID NO: 184081

SEQ ID NO: 519266 - RNA, 64 nt, hsa; identical to SEQ ID NO: 184082

SEQ ID NO: 519267 - RNA, 64 nt, hsa; identical to SEQ ID NO: 184083

SEQ ID NO: 519268 - RNA, 64 nt, hsa; identical to SEQ ID NO: 184084

SEQ ID NO: 519269 - RNA, 64 nt, hsa; identical to SEQ ID NO: 184085

SEQ ID NO: 519270 - RNA, 64 nt, hsa; identical to SEQ ID NO: 184086

SEQ ID NO: 519271 - RNA, 64 nt, hsa; identical to SEQ ID NO: 184087

SEQ ID NO: 519272 - RNA, 64 nt, hsa; identical to SEQ ID NO: 184088

SEQ ID NO: 519273 - RNA, 64 nt, hsa; identical to SEQ ID NO: 184089

SEQ ID NO: 519274 - RNA, 64 nt, hsa; identical to SEQ ID NO: 184090

SEQ ID NO: 519275 - RNA, 64 nt, hsa; identical to SEQ ID NO: 184091

SEQ ID NO: 519276 - RNA, 64 nt, hsa
acucaucccuggucgucuaucccaguguguguuuaacauucacagcccagaaccacagaugugu

SEQ ID NO: 519277 - RNA, 64 nt, hsa
ucaacauuccaggguugguaauguuggaugaugaaacauucauuuuuaccuuguggaugcuagu

SEQ ID NO: 519278 - RNA, 64 nt, hsa
aaacauucagaaaaugaaguuuugaauuuguuggaacauucaaaggacuugagagcauuuuauu

SEQ ID NO: 519279 - RNA, 64 nt, hsa
uaccaaugcgaacagguaguucgcauuuauguaaaacauucagaaaaugaaguuuugaauuugu

SEQ ID NO: 519280 - RNA, 64 nt, hsa
agauaaauguauucaacauguaauacaguauuuuaacauucaccucuuauuuuauauugaaaug

SEQ ID NO: 519281 - RNA, 64 nt, hsa
gacuugcaucccagcuuuccaccaaccaaauucaaacauucacugcuuauuuguuacagacugu

SEQ ID NO: 519282 - RNA, 64 nt, hsa
agaaugaacacuauacuuugcuucaaaccuucagaacauucaaaccguuuauguuucucaucua

SEQ ID NO: 519283 - RNA, 64 nt, hsa
uuuaguaacaucuugcuuagucauguuguuauaaaacauucaaauucugauauacauugcuuga

SEQ ID NO: 519284 - RNA, 64 nt, hsa
auauuacaaucauuuuauauuuuuuuacaugauuaacauucacuuauggauucaugauggcugu

SEQ ID NO: 519285 - RNA, 64 nt, hsa
gaaugucugaggcuaccagguuuaucacauaaaaaacauucaguaaaauaguaaguuucucuuu

SEQ ID NO: 519286 - RNA, 64 nt, hsa
auaaauugucacacaauggaaaaucauaugccacaacauucauuguaagguuuaauaaaauuaa

SEQ ID NO: 519287 - RNA, 64 nt, hsa
uauaauauauuguuugugaauuauugagaaauguaacauucaaauuucuaaaauugucugccaa

SEQ ID NO: 519288 - RNA, 64 nt, hsa
cucaauacucaagaaucuugcaagacaguuauuaaacauucauagcuugaaauugcccauggug

SEQ ID NO: 519289 - RNA, 64 nt, hsa
ucauaggguuuggcaugcugcucgguacaugguuaacauucauaaauggugggggcccuuacug

SEQ ID NO: 519290 - RNA, 64 nt, hsa
ggcaccaauccuagacucacgugugccccagaauaacauucagacucucagcuggucuuguguu

SEQ ID NO: 519291 - RNA, 64 nt, hsa
uugcaugacuccccauacauguugcagcuuugaaaacauucaucucagaguuagguauaaagac

SEQ ID NO: 519292 - RNA, 64 nt, hsa
gaguugcccuacaaauuucauuuggcagcgccauaacauucauuuaaaaaguuuaugaaaacau

SEQ ID NO: 519293 - RNA, 64 nt, hsa
cagcgccauaacauucauuuaaaaaguuuaugaaaacauucauuugaaaguuccaugcagcuuu

SEQ ID NO: 519294 - RNA, 64 nt, hsa
auuaguuauaaauaaauaaccaaaaauguauguaaacauucaaaugauuaucugaacaaaugag

SEQ ID NO: 519295 - RNA, 64 nt, hsa
uugaguuauaugauguuuauuugaaugacuguugaacauucaaauuuguauuauuuggagauga

SEQ ID NO: 519296 - RNA, 64 nt, hsa
ucggagugggcaccucuguguuucucuagggaguaacauucaacauuuaauugaaucguguguc

SEQ ID NO: 519297 - RNA, 64 nt, hsa
gaaaauucuuuaucauguuugccuucccuggggaaacauucaggcaguaaaaugacauccacgu

SEQ ID NO: 519298 - RNA, 58 nt, hsa; identical to SEQ ID NO: 345086

SEQ ID NO: 519299 - RNA, 64 nt, hsa
caaacacauucuccuuugaauuguuaaaauucagaacauucaaaauaacuguuuugcuacaacc

SEQ ID NO: 519300 - RNA, 64 nt, hsa
aauuagaagguggaggagucauuucaugauuaagaacauucaacauguauuguucauuaagcua

SEQ ID NO: 519301 - RNA, 64 nt, hsa
aacuauagcaugcuuugaagagucucgggcaagaaacauucaugcaugaguauauguucuugga

SEQ ID NO: 519302 - RNA, 64 nt, hsa
auaacuuaauuucuuuuccugaaauucacuguaaaacauucagggguccuaccauuucuguuca

SEQ ID NO: 519303 - RNA, 64 nt, hsa
uaguuucuuucauuugggggcuauguguuucaauaacauucacuuggaaucagcugaaagcugu

SEQ ID NO: 519304 - RNA, 64 nt, hsa
cuccaguauuaaugaaauagguuccagugaugaaaacauucaagcagaacuagguagaaacaga

SEQ ID NO: 519305 - RNA, 64 nt, hsa
uguaagaaaaaucugcuagaggaaaacuuugaggaacauucaaugucaccugaaagagaaaugg

SEQ ID NO: 519306 - RNA, 64 nt, hsa
uuuuacuucaguuaacaaaagaaaacauuuaauaaacauucaauaaugauuacaguuuucauuu

SEQ ID NO: 519307 - RNA, 64 nt, hsa
cccacaggaagacccuuaaaaugaagaaccuccuaacauucaauuuuagguccuacuacauugu

SEQ ID NO: 519308 - RNA, 64 nt, hsa
uaagggguaucucugcuacaggaaugggagugagaacauucacuuuuugaaggacaaguauaug

SEQ ID NO: 519309 - RNA, 64 nt, hsa
cccaucucaaaccuacacuuuggacacuuguuuaaacauucacaucugaauuucucuguggcaa

SEQ ID NO: 519310 - RNA, 64 nt, hsa; identical to SEQ ID NO: 389302

SEQ ID NO: 519311 - RNA, 64 nt, hsa; identical to SEQ ID NO: 389303

SEQ ID NO: 519312 - RNA, 64 nt, hsa; identical to SEQ ID NO: 389304

SEQ ID NO: 519313 - RNA, 64 nt, hsa; identical to SEQ ID NO: 389305

SEQ ID NO: 519314 - RNA, 64 nt, hsa; identical to SEQ ID NO: 389306

SEQ ID NO: 519315 - RNA, 64 nt, hsa; identical to SEQ ID NO: 389307

SEQ ID NO: 519316 - RNA, 64 nt, hsa; identical to SEQ ID NO: 389308

SEQ ID NO: 519317 - RNA, 64 nt, hsa; identical to SEQ ID NO: 389309

SEQ ID NO: 519318 - RNA, 64 nt, hsa; identical to SEQ ID NO: 389310

SEQ ID NO: 519319 - RNA, 64 nt, hsa; identical to SEQ ID NO: 389311

SEQ ID NO: 519320 - RNA, 64 nt, hsa; identical to SEQ ID NO: 389312

SEQ ID NO: 519321 - RNA, 64 nt, hsa; identical to SEQ ID NO: 389313

SEQ ID NO: 519322 - RNA, 64 nt, hsa; identical to SEQ ID NO: 389314

SEQ ID NO: 519323 - RNA, 64 nt, hsa; identical to SEQ ID NO: 389315

SEQ ID NO: 519324 - RNA, 64 nt, hsa; identical to SEQ ID NO: 389316

SEQ ID NO: 519325 - RNA, 64 nt, hsa; identical to SEQ ID NO: 389317

SEQ ID NO: 519326 - RNA, 64 nt, hsa; identical to SEQ ID NO: 389318

SEQ ID NO: 519327 - RNA, 64 nt, hsa; identical to SEQ ID NO: 389319

SEQ ID NO: 519328 - RNA, 64 nt, hsa; identical to SEQ ID NO: 389320

SEQ ID NO: 519329 - RNA, 64 nt, hsa; identical to SEQ ID NO: 389321

SEQ ID NO: 519330 - RNA, 64 nt, hsa; identical to SEQ ID NO: 119725

SEQ ID NO: 519331 - RNA, 64 nt, hsa; identical to SEQ ID NO: 119726

SEQ ID NO: 519332 - RNA, 64 nt, hsa; identical to SEQ ID NO: 119727

SEQ ID NO: 519333 - RNA, 64 nt, hsa; identical to SEQ ID NO: 119728

SEQ ID NO: 519334 - RNA, 64 nt, hsa; identical to SEQ ID NO: 119729

SEQ ID NO: 519335 - RNA, 64 nt, hsa; identical to SEQ ID NO: 119730

SEQ ID NO: 519336 - RNA, 64 nt, hsa; identical to SEQ ID NO: 119731

SEQ ID NO: 519337 - RNA, 64 nt, hsa; identical to SEQ ID NO: 119732

SEQ ID NO: 519338 - RNA, 64 nt, hsa; identical to SEQ ID NO: 119733

SEQ ID NO: 519339 - RNA, 64 nt, hsa; identical to SEQ ID NO: 119734

SEQ ID NO: 519340 - RNA, 64 nt, hsa; identical to SEQ ID NO: 119735

SEQ ID NO: 519341 - RNA, 64 nt, hsa; identical to SEQ ID NO: 119736

SEQ ID NO: 519342 - RNA, 64 nt, hsa; identical to SEQ ID NO: 119737

SEQ ID NO: 519343 - RNA, 64 nt, hsa; identical to SEQ ID NO: 119738

SEQ ID NO: 519344 - RNA, 64 nt, hsa; identical to SEQ ID NO: 119739

SEQ ID NO: 519345 - RNA, 64 nt, hsa; identical to SEQ ID NO: 119740

SEQ ID NO: 519346 - RNA, 62 nt, hsa; identical to SEQ ID NO: 119741

SEQ ID NO: 519347 - RNA, 64 nt, hsa; identical to SEQ ID NO: 119742

SEQ ID NO: 519348 - RNA, 64 nt, hsa; identical to SEQ ID NO: 119743

SEQ ID NO: 519349 - RNA, 64 nt, hsa; identical to SEQ ID NO: 119744

SEQ ID NO: 519350 - RNA, 64 nt, hsa; identical to SEQ ID NO: 119745

SEQ ID NO: 519351 - RNA, 64 nt, hsa; identical to SEQ ID NO: 119746

SEQ ID NO: 519352 - RNA, 64 nt, hsa; identical to SEQ ID NO: 119747

SEQ ID NO: 519353 - RNA, 64 nt, hsa; identical to SEQ ID NO: 119748

SEQ ID NO: 519354 - RNA, 64 nt, hsa; identical to SEQ ID NO: 119749

SEQ ID NO: 519355 - RNA, 64 nt, hsa; identical to SEQ ID NO: 119750

SEQ ID NO: 519356 - RNA, 64 nt, hsa; identical to SEQ ID NO: 119751

SEQ ID NO: 519357 - RNA, 64 nt, hsa; identical to SEQ ID NO: 119752

SEQ ID NO: 519358 - RNA, 64 nt, hsa; identical to SEQ ID NO: 119753

SEQ ID NO: 519359 - RNA, 64 nt, hsa; identical to SEQ ID NO: 119754

SEQ ID NO: 519360 - RNA, 64 nt, hsa; identical to SEQ ID NO: 119755

SEQ ID NO: 519361 - RNA, 64 nt, hsa; identical to SEQ ID NO: 119756

SEQ ID NO: 519362 - RNA, 64 nt, hsa; identical to SEQ ID NO: 119757

SEQ ID NO: 519363 - RNA, 64 nt, hsa; identical to SEQ ID NO: 119758

SEQ ID NO: 519364 - RNA, 64 nt, hsa; identical to SEQ ID NO: 119759

SEQ ID NO: 519365 - RNA, 64 nt, hsa; identical to SEQ ID NO: 119760

SEQ ID NO: 519366 - RNA, 64 nt, hsa; identical to SEQ ID NO: 119761

SEQ ID NO: 519367 - RNA, 64 nt, hsa; identical to SEQ ID NO: 119762

SEQ ID NO: 519368 - RNA, 64 nt, hsa; identical to SEQ ID NO: 119763

SEQ ID NO: 519369 - RNA, 64 nt, hsa; identical to SEQ ID NO: 119764

SEQ ID NO: 519370 - RNA, 64 nt, hsa; identical to SEQ ID NO: 119765

SEQ ID NO: 519371 - RNA, 64 nt, hsa; identical to SEQ ID NO: 119766

SEQ ID NO: 519372 - RNA, 64 nt, hsa; identical to SEQ ID NO: 119767

SEQ ID NO: 519373 - RNA, 64 nt, hsa; identical to SEQ ID NO: 119768

SEQ ID NO: 519374 - RNA, 64 nt, hsa; identical to SEQ ID NO: 119769

SEQ ID NO: 519375 - RNA, 64 nt, hsa; identical to SEQ ID NO: 119770

SEQ ID NO: 519376 - RNA, 64 nt, hsa; identical to SEQ ID NO: 119771

SEQ ID NO: 519377 - RNA, 64 nt, hsa; identical to SEQ ID NO: 119772

SEQ ID NO: 519378 - RNA, 64 nt, hsa; identical to SEQ ID NO: 119773

SEQ ID NO: 519379 - RNA, 64 nt, hsa; identical to SEQ ID NO: 119774

SEQ ID NO: 519380 - RNA, 64 nt, hsa; identical to SEQ ID NO: 119775

SEQ ID NO: 519381 - RNA, 64 nt, hsa; identical to SEQ ID NO: 119776

SEQ ID NO: 519382 - RNA, 64 nt, hsa; identical to SEQ ID NO: 119777

SEQ ID NO: 519383 - RNA, 64 nt, hsa; identical to SEQ ID NO: 119778

SEQ ID NO: 519384 - RNA, 64 nt, hsa; identical to SEQ ID NO: 119779

SEQ ID NO: 519385 - RNA, 64 nt, hsa; identical to SEQ ID NO: 119780

SEQ ID NO: 519386 - RNA, 64 nt, hsa; identical to SEQ ID NO: 119781

SEQ ID NO: 519387 - RNA, 64 nt, hsa; identical to SEQ ID NO: 119782

SEQ ID NO: 519388 - RNA, 64 nt, hsa; identical to SEQ ID NO: 119783

SEQ ID NO: 519389 - RNA, 64 nt, hsa; identical to SEQ ID NO: 119784

SEQ ID NO: 519390 - RNA, 64 nt, hsa; identical to SEQ ID NO: 119785

SEQ ID NO: 519391 - RNA, 64 nt, hsa; identical to SEQ ID NO: 119786

SEQ ID NO: 519392 - RNA, 64 nt, hsa; identical to SEQ ID NO: 119787

SEQ ID NO: 519393 - RNA, 64 nt, hsa; identical to SEQ ID NO: 119788

SEQ ID NO: 519394 - RNA, 64 nt, hsa; identical to SEQ ID NO: 119789

SEQ ID NO: 519395 - RNA, 64 nt, hsa; identical to SEQ ID NO: 119790

SEQ ID NO: 519396 - RNA, 64 nt, hsa; identical to SEQ ID NO: 119791

SEQ ID NO: 519397 - RNA, 64 nt, hsa; identical to SEQ ID NO: 119792

SEQ ID NO: 519398 - RNA, 64 nt, hsa; identical to SEQ ID NO: 119793

SEQ ID NO: 519399 - RNA, 64 nt, hsa; identical to SEQ ID NO: 119794

SEQ ID NO: 519400 - RNA, 64 nt, hsa; identical to SEQ ID NO: 119795

SEQ ID NO: 519401 - RNA, 64 nt, hsa; identical to SEQ ID NO: 119796

SEQ ID NO: 519402 - RNA, 64 nt, hsa; identical to SEQ ID NO: 119795

SEQ ID NO: 519403 - RNA, 64 nt, hsa; identical to SEQ ID NO: 119798

SEQ ID NO: 519404 - RNA, 64 nt, hsa; identical to SEQ ID NO: 119799

SEQ ID NO: 519405 - RNA, 64 nt, hsa; identical to SEQ ID NO: 119800

SEQ ID NO: 519406 - RNA, 64 nt, hsa; identical to SEQ ID NO: 119801

SEQ ID NO: 519407 - RNA, 64 nt, hsa; identical to SEQ ID NO: 119802

SEQ ID NO: 519408 - RNA, 64 nt, hsa; identical to SEQ ID NO: 119803

SEQ ID NO: 519409 - RNA, 64 nt, hsa; identical to SEQ ID NO: 119804

SEQ ID NO: 519410 - RNA, 64 nt, hsa; identical to SEQ ID NO: 119805

SEQ ID NO: 519411 - RNA, 64 nt, hsa; identical to SEQ ID NO: 119806

SEQ ID NO: 519412 - RNA, 64 nt, hsa; identical to SEQ ID NO: 119807

SEQ ID NO: 519413 - RNA, 64 nt, hsa; identical to SEQ ID NO: 119808

SEQ ID NO: 519414 - RNA, 64 nt, hsa; identical to SEQ ID NO: 119809

SEQ ID NO: 519415 - RNA, 64 nt, hsa; identical to SEQ ID NO: 119810

SEQ ID NO: 519416 - RNA, 64 nt, hsa; identical to SEQ ID NO: 119811

SEQ ID NO: 519417 - RNA, 64 nt, hsa; identical to SEQ ID NO: 119812

SEQ ID NO: 519418 - RNA, 64 nt, hsa; identical to SEQ ID NO: 119813

SEQ ID NO: 519419 - RNA, 64 nt, hsa; identical to SEQ ID NO: 119814

SEQ ID NO: 519420 - RNA, 64 nt, hsa; identical to SEQ ID NO: 119815

SEQ ID NO: 519421 - RNA, 64 nt, hsa; identical to SEQ ID NO: 119816

SEQ ID NO: 519422 - RNA, 64 nt, hsa; identical to SEQ ID NO: 119817

SEQ ID NO: 519423 - RNA, 64 nt, hsa; identical to SEQ ID NO: 119818

SEQ ID NO: 519424 - RNA, 64 nt, hsa; identical to SEQ ID NO: 119819

SEQ ID NO: 519425 - RNA, 64 nt, hsa; identical to SEQ ID NO: 119820

SEQ ID NO: 519426 - RNA, 64 nt, hsa; identical to SEQ ID NO: 119821

SEQ ID NO: 519427 - RNA, 64 nt, hsa; identical to SEQ ID NO: 119822

SEQ ID NO: 519428 - RNA, 64 nt, hsa; identical to SEQ ID NO: 119823

SEQ ID NO: 519429 - RNA, 64 nt, hsa; identical to SEQ ID NO: 119824

SEQ ID NO: 519430 - RNA, 64 nt, hsa; identical to SEQ ID NO: 119825

SEQ ID NO: 519431 - RNA, 64 nt, hsa; identical to SEQ ID NO: 119826

SEQ ID NO: 519432 - RNA, 64 nt, hsa; identical to SEQ ID NO: 119827

SEQ ID NO: 519433 - RNA, 64 nt, hsa; identical to SEQ ID NO: 119828

SEQ ID NO: 519434 - RNA, 64 nt, hsa; identical to SEQ ID NO: 119829

SEQ ID NO: 519435 - RNA, 64 nt, hsa; identical to SEQ ID NO: 119830

SEQ ID NO: 519436 - RNA, 64 nt, hsa; identical to SEQ ID NO: 119831

SEQ ID NO: 519437 - RNA, 64 nt, hsa; identical to SEQ ID NO: 119832

SEQ ID NO: 519438 - RNA, 64 nt, hsa; identical to SEQ ID NO: 119833

SEQ ID NO: 519439 - RNA, 64 nt, hsa; identical to SEQ ID NO: 119834

SEQ ID NO: 519440 - RNA, 64 nt, hsa; identical to SEQ ID NO: 119835

SEQ ID NO: 519441 - RNA, 64 nt, hsa; identical to SEQ ID NO: 119836

SEQ ID NO: 519442 - RNA, 64 nt, hsa; identical to SEQ ID NO: 119837

SEQ ID NO: 519443 - RNA, 64 nt, hsa; identical to SEQ ID NO: 119838

SEQ ID NO: 519444 - RNA, 64 nt, hsa; identical to SEQ ID NO: 119839

SEQ ID NO: 519445 - RNA, 64 nt, hsa; identical to SEQ ID NO: 361150

SEQ ID NO: 519446 - RNA, 64 nt, hsa; identical to SEQ ID NO: 361151

SEQ ID NO: 519447 - RNA, 64 nt, hsa; identical to SEQ ID NO: 361152

SEQ ID NO: 519448 - RNA, 64 nt, hsa; identical to SEQ ID NO: 361153

SEQ ID NO: 519449 - RNA, 64 nt, hsa; identical to SEQ ID NO: 361154

SEQ ID NO: 519450 - RNA, 64 nt, hsa; identical to SEQ ID NO: 361155

SEQ ID NO: 519451 - RNA, 64 nt, hsa; identical to SEQ ID NO: 361156

SEQ ID NO: 519452 - RNA, 64 nt, hsa; identical to SEQ ID NO: 361157

SEQ ID NO: 519453 - RNA, 64 nt, hsa; identical to SEQ ID NO: 361158

SEQ ID NO: 519454 - RNA, 64 nt, hsa; identical to SEQ ID NO: 361159

SEQ ID NO: 519455 - RNA, 64 nt, hsa; identical to SEQ ID NO: 361160

SEQ ID NO: 519456 - RNA, 64 nt, hsa; identical to SEQ ID NO: 361161

SEQ ID NO: 519457 - RNA, 64 nt, hsa; identical to SEQ ID NO: 361162

SEQ ID NO: 519458 - RNA, 64 nt, hsa; identical to SEQ ID NO: 361163

SEQ ID NO: 519459 - RNA, 64 nt, hsa; identical to SEQ ID NO: 361164

SEQ ID NO: 519460 - RNA, 64 nt, hsa; identical to SEQ ID NO: 361165

SEQ ID NO: 519461 - RNA, 64 nt, hsa; identical to SEQ ID NO: 361166

SEQ ID NO: 519462 - RNA, 64 nt, hsa; identical to SEQ ID NO: 361167

SEQ ID NO: 519463 - RNA, 64 nt, hsa; identical to SEQ ID NO: 361168

SEQ ID NO: 519464 - RNA, 64 nt, hsa; identical to SEQ ID NO: 361169

SEQ ID NO: 519465 - RNA, 64 nt, hsa; identical to SEQ ID NO: 361170

SEQ ID NO: 519466 - RNA, 64 nt, hsa; identical to SEQ ID NO: 361171

SEQ ID NO: 519467 - RNA, 64 nt, hsa; identical to SEQ ID NO: 433911

SEQ ID NO: 519468 - RNA, 64 nt, hsa; identical to SEQ ID NO: 433912

SEQ ID NO: 519469 - RNA, 64 nt, hsa; identical to SEQ ID NO: 433913

SEQ ID NO: 519470 - RNA, 64 nt, hsa; identical to SEQ ID NO: 433914

SEQ ID NO: 519471 - RNA, 64 nt, hsa; identical to SEQ ID NO: 433915

SEQ ID NO: 519472 - RNA, 64 nt, hsa; identical to SEQ ID NO: 433916

SEQ ID NO: 519473 - RNA, 64 nt, hsa; identical to SEQ ID NO: 433917

SEQ ID NO: 519474 - RNA, 64 nt, hsa; identical to SEQ ID NO: 433918

SEQ ID NO: 519475 - RNA, 64 nt, hsa; identical to SEQ ID NO: 433919

SEQ ID NO: 519476 - RNA, 64 nt, hsa; identical to SEQ ID NO: 433920

SEQ ID NO: 519477 - RNA, 64 nt, hsa; identical to SEQ ID NO: 433921

SEQ ID NO: 519478 - RNA, 64 nt, hsa; identical to SEQ ID NO: 433922

SEQ ID NO: 519479 - RNA, 64 nt, hsa; identical to SEQ ID NO: 433923

SEQ ID NO: 519480 - RNA, 61 nt, hsa; identical to SEQ ID NO: 433924

SEQ ID NO: 519481 - RNA, 64 nt, hsa; identical to SEQ ID NO: 433925

SEQ ID NO: 519482 - RNA, 60 nt, hsa; identical to SEQ ID NO: 433926

SEQ ID NO: 519483 - RNA, 64 nt, hsa; identical to SEQ ID NO: 433927

SEQ ID NO: 519484 - RNA, 64 nt, hsa; identical to SEQ ID NO: 433928

SEQ ID NO: 519485 - RNA, 64 nt, hsa; identical to SEQ ID NO: 433929

SEQ ID NO: 519486 - RNA, 64 nt, hsa; identical to SEQ ID NO: 433930

SEQ ID NO: 519487 - RNA, 64 nt, hsa; identical to SEQ ID NO: 433931

SEQ ID NO: 519488 - RNA, 64 nt, hsa; identical to SEQ ID NO: 433932

SEQ ID NO: 519489 - RNA, 64 nt, hsa; identical to SEQ ID NO: 433933

SEQ ID NO: 519490 - RNA, 64 nt, hsa; identical to SEQ ID NO: 433934

SEQ ID NO: 519491 - RNA, 64 nt, hsa; identical to SEQ ID NO: 433935

SEQ ID NO: 519492 - RNA, 64 nt, hsa; identical to SEQ ID NO: 433936

SEQ ID NO: 519493 - RNA, 64 nt, hsa; identical to SEQ ID NO: 433937

SEQ ID NO: 519494 - RNA, 64 nt, hsa; identical to SEQ ID NO: 433938

SEQ ID NO: 519495 - RNA, 64 nt, hsa; identical to SEQ ID NO: 433939

SEQ ID NO: 519496 - RNA, 64 nt, hsa; identical to SEQ ID NO: 433940

SEQ ID NO: 519497 - RNA, 64 nt, hsa; identical to SEQ ID NO: 433941

SEQ ID NO: 519498 - RNA, 64 nt, hsa; identical to SEQ ID NO: 433942

SEQ ID NO: 519499 - RNA, 64 nt, hsa; identical to SEQ ID NO: 215540

SEQ ID NO: 519500 - RNA, 64 nt, hsa; identical to SEQ ID NO: 215541

SEQ ID NO: 519501 - RNA, 64 nt, hsa; identical to SEQ ID NO: 215542

SEQ ID NO: 519502 - RNA, 64 nt, hsa; identical to SEQ ID NO: 215543

SEQ ID NO: 519503 - RNA, 64 nt, hsa; identical to SEQ ID NO: 215544

SEQ ID NO: 519504 - RNA, 64 nt, hsa; identical to SEQ ID NO: 215545

SEQ ID NO: 519505 - RNA, 64 nt, hsa; identical to SEQ ID NO: 215546

SEQ ID NO: 519506 - RNA, 64 nt, hsa; identical to SEQ ID NO: 215547

SEQ ID NO: 519507 - RNA, 64 nt, hsa; identical to SEQ ID NO: 215548

SEQ ID NO: 519508 - RNA, 64 nt, hsa; identical to SEQ ID NO: 215549

SEQ ID NO: 519509 - RNA, 64 nt, hsa; identical to SEQ ID NO: 215550

SEQ ID NO: 519510 - RNA, 64 nt, hsa; identical to SEQ ID NO: 215551

SEQ ID NO: 519511 - RNA, 64 nt, hsa; identical to SEQ ID NO: 215552

SEQ ID NO: 519512 - RNA, 64 nt, hsa; identical to SEQ ID NO: 215553

SEQ ID NO: 519513 - RNA, 64 nt, hsa; identical to SEQ ID NO: 215554

SEQ ID NO: 519514 - RNA, 64 nt, hsa; identical to SEQ ID NO: 215555

SEQ ID NO: 519515 - RNA, 64 nt, hsa; identical to SEQ ID NO: 215556

SEQ ID NO: 519516 - RNA, 64 nt, hsa; identical to SEQ ID NO: 215557

SEQ ID NO: 519517 - RNA, 64 nt, hsa; identical to SEQ ID NO: 215558

SEQ ID NO: 519518 - RNA, 64 nt, hsa; identical to SEQ ID NO: 215559

SEQ ID NO: 519519 - RNA, 64 nt, hsa; identical to SEQ ID NO: 215560

SEQ ID NO: 519520 - RNA, 64 nt, hsa; identical to SEQ ID NO: 215561

SEQ ID NO: 519521 - RNA, 64 nt, hsa; identical to SEQ ID NO: 215562

SEQ ID NO: 519522 - RNA, 64 nt, hsa; identical to SEQ ID NO: 215563

SEQ ID NO: 519523 - RNA, 64 nt, hsa; identical to SEQ ID NO: 215564

SEQ ID NO: 519524 - RNA, 64 nt, hsa; identical to SEQ ID NO: 215565

SEQ ID NO: 519525 - RNA, 64 nt, hsa; identical to SEQ ID NO: 215566

SEQ ID NO: 519526 - RNA, 64 nt, hsa; identical to SEQ ID NO: 215567

SEQ ID NO: 519527 - RNA, 64 nt, hsa; identical to SEQ ID NO: 215568

SEQ ID NO: 519528 - RNA, 64 nt, hsa
gugaugcaacauuauguggcugaaaaagaauauaaaaagcuagacucuacccucuaaggguuua

SEQ ID NO: 519529 - RNA, 64 nt, hsa
uaaaauauuguggcaucaacuacuuuuaaaguagaaaagcuauccauuuuauacaaucacugau

SEQ ID NO: 519530 - RNA, 64 nt, hsa
guaucuaacuccagucuuacagauaacuaaggcaaaaagcuaaauaaacaauauguaaccucua

SEQ ID NO: 519531 - RNA, 64 nt, hsa
uucccuuuaugauaguuucuuaauuuuuucuaucaaaagcuaaauauggcacacuuguucuuua

SEQ ID NO: 519532 - RNA, 64 nt, hsa
gugugagugucuuaaagcauaaccacaaacugcaaaaagcuagguaagcuauuuuguugcagcu

SEQ ID NO: 519533 - RNA, 64 nt, hsa
caggagaaagaagguaaaaaaugauuuuuuuaagaaaagcuauuuuauugcagcucuuucccaa

SEQ ID NO: 519534 - RNA, 64 nt, hsa
ucauuuuauaagcauaucauuuaaaaagcuucuaaaaagcuauuucgccaggcacgguggcuca

SEQ ID NO: 519535 - RNA, 64 nt, hsa
caucucaaaaauaaauaaauauauauaaaaaauaaaaagcuauuucuaguuuauuucacuauaa

SEQ ID NO: 519536 - RNA, 64 nt, hsa
cuaguuuauuucacuauaaaguuuugcuuuauuaaaaagcuaauaaacagcuauuaaucacagu

SEQ ID NO: 519537 - RNA, 64 nt, hsa
agaucagaaauucaaaaacucagaauaaaaaugaaaaagcuacaagcauauaugagaagagaac

SEQ ID NO: 519538 - RNA, 64 nt, hsa
aaguacauuaaggcacguagaagguaggaguaagaaaagcuaagagaagcaaaacaaacaaagc

SEQ ID NO: 519539 - RNA, 64 nt, hsa
ucugaacuauaagcccauuuauacuguuccauacaaaagcuauuuuucaaaaauuaauuugaac

SEQ ID NO: 519540 - RNA, 64 nt, hsa
gggacagcguaucuguaccagugcucuaaauaacaaaagcuagggugacaaguacauguuccuu

SEQ ID NO: 519541 - RNA, 64 nt, hsa
uagagaccuuuaagcaaacuacuacagccaacucaaaagcuaaaacugaacaaauuugauguua

SEQ ID NO: 519542 - RNA, 64 nt, hsa
ugauacguaaauuauagaaaaagaaaagaaacacaaaagcuauagauauacagauaucagcuua

SEQ ID NO: 519543 - RNA, 64 nt, hsa
uaaaauauaagaucugagauugaauauuuucauuaaaagcuacaguuuugugaaucuuugugcu

SEQ ID NO: 519544 - RNA, 64 nt, hsa
acaaaguuccaaaaugccaaauucuuauuuuuuaaaaagcuaguucuauaaaauacugguauua

SEQ ID NO: 519545 - RNA, 64 nt, hsa
ggcaggcacguugacuguuuuacugacaucacucaaaagcuaaagcaauaacauucuccugcgu

SEQ ID NO: 519546 - RNA, 64 nt, hsa
gaggcugauuuuucuuuuuuuuaaguucuauuuuaaaagcuaucaaacagcgacauagccauac

SEQ ID NO: 519547 - RNA, 64 nt, hsa
guuuuugguuuuuaagcuaacuacaaaucuaguaaaaagcuaucugaaauucacaaauaucaug

SEQ ID NO: 519548 - RNA, 64 nt, hsa
augccaugugaagaaguuguggaaauguagaauaaaaagcuaaagcugccaaauuucuguugaa

SEQ ID NO: 519549 - RNA, 64 nt, hsa
caaaaagcaaccuuuucauuuucacuaagaguuuaaaagcuauuguauuauuaaaaagucuuua

SEQ ID NO: 519550 - RNA, 64 nt, hsa
uuuacaaugcuuguuucaaagaaccaacagaaaaaaaagcuaagaaaacugagaacuaacauua

SEQ ID NO: 519551 - RNA, 64 nt, hsa
gagcccuuagaacguggguauuuuuuuucuugagaaaagcuaaugcaccuacagauggccccca

SEQ ID NO: 519552 - RNA, 64 nt, hsa
cuucuguguaugaagcaaaugucgauguuuugaaaaaagcuaggagaugacuuugaaugaaugc

SEQ ID NO: 519553 - RNA, 64 nt, hsa
ccuagagcucaagaaagcugguccaggagguugaaaaagcuauuuuguuguuaaauuauuuucu

SEQ ID NO: 519554 - RNA, 64 nt, hsa
uuuauccauaugccuuugcaauaacuagauugugaaaagcuaacaaguguuguaacaauaaucc

SEQ ID NO: 519555 - RNA, 64 nt, hsa
uccauuaaauaugggagggggacucaaauuucagaaaagcuaccaagucuugagugcuuuguag

SEQ ID NO: 519556 - RNA, 64 nt, hsa
ccacccccaggcaaggcugacuucucugaaucagaaaagcuauuaaaguuuguguguugugucc

SEQ ID NO: 519557 - RNA, 64 nt, hsa
ugagccugcaucuucuugcaucuaaugaaaaacaaaaagcuaacaucuuuacguacuguaacug

SEQ ID NO: 519558 - RNA, 64 nt, hsa
gcuacaaaagggcagccuagagggcagaacagagaaaagcuagacaaaaugauaagaucagcca

SEQ ID NO: 519559 - RNA, 64 nt, hsa
agaaaucugacgucaaugcaauuauccauuauuuaaaagcuauaaaaauagaacaggcaucauu

SEQ ID NO: 519560 - RNA, 64 nt, hsa
uguuuaauaaaacaaaaagagaaauccuuaaucuaaaagcuaaauuauuuuugaauggaaauac

SEQ ID NO: 519561 - RNA, 64 nt, hsa
acgugcauuuuugguacuuuuuuuuuuguuuucuaaaagcuacauaaaggccuuauuugacauu

SEQ ID NO: 519562 - RNA, 64 nt, hsa
aauaagcaugugccagugugaaagcuggaaggaaaaaagcuauucucuaacaggagaacauaaa

SEQ ID NO: 519563 - RNA, 64 nt, hsa
auuaaaugugcacaucuuauucacccaagggaauaaaagcuacuucguaauguuguuacuaaau

SEQ ID NO: 519564 - RNA, 62 nt, hsa
uggauguacuaccuuuucaaaaauaaaacauuuaaaaagcuauuuuguuuuacuguuauagu

SEQ ID NO: 519565 - RNA, 64 nt, hsa
ucagccuuucuucuuuucaucucagucauaacccaaaagcuacgggagaaaaagcagaagugua

SEQ ID NO: 519566 - RNA, 64 nt, hsa; identical to SEQ ID NO: 84813

SEQ ID NO: 519567 - RNA, 64 nt, hsa; identical to SEQ ID NO: 84814

SEQ ID NO: 519568 - RNA, 64 nt, hsa; identical to SEQ ID NO: 84815

SEQ ID NO: 519569 - RNA, 64 nt, hsa; identical to SEQ ID NO: 84816

SEQ ID NO: 519570 - RNA, 64 nt, hsa; identical to SEQ ID NO: 84817

SEQ ID NO: 519571 - RNA, 64 nt, hsa; identical to SEQ ID NO: 84818

SEQ ID NO: 519572 - RNA, 64 nt, hsa; identical to SEQ ID NO: 84819

SEQ ID NO: 519573 - RNA, 64 nt, hsa; identical to SEQ ID NO: 84820

SEQ ID NO: 519574 - RNA, 64 nt, hsa; identical to SEQ ID NO: 84821

SEQ ID NO: 519575 - RNA, 64 nt, hsa; identical to SEQ ID NO: 84822

SEQ ID NO: 519576 - RNA, 64 nt, hsa; identical to SEQ ID NO: 84823

SEQ ID NO: 519577 - RNA, 64 nt, hsa; identical to SEQ ID NO: 84824

SEQ ID NO: 519578 - RNA, 64 nt, hsa; identical to SEQ ID NO: 84825

SEQ ID NO: 519579 - RNA, 64 nt, hsa; identical to SEQ ID NO: 84826

SEQ ID NO: 519580 - RNA, 64 nt, hsa; identical to SEQ ID NO: 84827

SEQ ID NO: 519581 - RNA, 64 nt, hsa; identical to SEQ ID NO: 84828

SEQ ID NO: 519582 - RNA, 64 nt, hsa; identical to SEQ ID NO: 84829

SEQ ID NO: 519583 - RNA, 64 nt, hsa; identical to SEQ ID NO: 84830

SEQ ID NO: 519584 - RNA, 64 nt, hsa; identical to SEQ ID NO: 84831

SEQ ID NO: 519585 - RNA, 64 nt, hsa; identical to SEQ ID NO: 84832

SEQ ID NO: 519586 - RNA, 64 nt, hsa; identical to SEQ ID NO: 84833

SEQ ID NO: 519587 - RNA, 64 nt, hsa; identical to SEQ ID NO: 84834

SEQ ID NO: 519588 - RNA, 64 nt, hsa; identical to SEQ ID NO: 84835

SEQ ID NO: 519589 - RNA, 64 nt, hsa; identical to SEQ ID NO: 84836

SEQ ID NO: 519590 - RNA, 64 nt, hsa; identical to SEQ ID NO: 84837

SEQ ID NO: 519591 - RNA, 64 nt, hsa; identical to SEQ ID NO: 84838

SEQ ID NO: 519592 - RNA, 64 nt, hsa; identical to SEQ ID NO: 84839

SEQ ID NO: 519593 - RNA, 64 nt, hsa; identical to SEQ ID NO: 84840

SEQ ID NO: 519594 - RNA, 64 nt, hsa; identical to SEQ ID NO: 84841

SEQ ID NO: 519595 - RNA, 64 nt, hsa; identical to SEQ ID NO: 84842

SEQ ID NO: 519596 - RNA, 64 nt, hsa; identical to SEQ ID NO: 84843

SEQ ID NO: 519597 - RNA, 64 nt, hsa; identical to SEQ ID NO: 84844

SEQ ID NO: 519598 - RNA, 64 nt, hsa; identical to SEQ ID NO: 84845

SEQ ID NO: 519599 - RNA, 64 nt, hsa; identical to SEQ ID NO: 84846

SEQ ID NO: 519600 - RNA, 64 nt, hsa; identical to SEQ ID NO: 84847

SEQ ID NO: 519601 - RNA, 64 nt, hsa; identical to SEQ ID NO: 84848

SEQ ID NO: 519602 - RNA, 64 nt, hsa; identical to SEQ ID NO: 84849

SEQ ID NO: 519603 - RNA, 64 nt, hsa; identical to SEQ ID NO: 84850

SEQ ID NO: 519604 - RNA, 64 nt, hsa; identical to SEQ ID NO: 84851

SEQ ID NO: 519605 - RNA, 64 nt, hsa; identical to SEQ ID NO: 84852

SEQ ID NO: 519606 - RNA, 64 nt, hsa; identical to SEQ ID NO: 84853

SEQ ID NO: 519607 - RNA, 64 nt, hsa; identical to SEQ ID NO: 84854

SEQ ID NO: 519608 - RNA, 64 nt, hsa; identical to SEQ ID NO: 84855

SEQ ID NO: 519609 - RNA, 64 nt, hsa; identical to SEQ ID NO: 84856

SEQ ID NO: 519610 - RNA, 64 nt, hsa; identical to SEQ ID NO: 84857

SEQ ID NO: 519611 - RNA, 64 nt, hsa; identical to SEQ ID NO: 84858

SEQ ID NO: 519612 - RNA, 64 nt, hsa; identical to SEQ ID NO: 84859

SEQ ID NO: 519613 - RNA, 64 nt, hsa; identical to SEQ ID NO: 84860

SEQ ID NO: 519614 - RNA, 64 nt, hsa; identical to SEQ ID NO: 266331

SEQ ID NO: 519615 - RNA, 64 nt, hsa; identical to SEQ ID NO: 266332

SEQ ID NO: 519616 - RNA, 64 nt, hsa; identical to SEQ ID NO: 266333

SEQ ID NO: 519617 - RNA, 64 nt, hsa; identical to SEQ ID NO: 266334

SEQ ID NO: 519618 - RNA, 64 nt, hsa; identical to SEQ ID NO: 266335

SEQ ID NO: 519619 - RNA, 64 nt, hsa; identical to SEQ ID NO: 266336

SEQ ID NO: 519620 - RNA, 64 nt, hsa; identical to SEQ ID NO: 266337

SEQ ID NO: 519621 - RNA, 64 nt, hsa; identical to SEQ ID NO: 266338

SEQ ID NO: 519622 - RNA, 64 nt, hsa; identical to SEQ ID NO: 266339

SEQ ID NO: 519623 - RNA, 64 nt, hsa; identical to SEQ ID NO: 266340

SEQ ID NO: 519624 - RNA, 64 nt, hsa; identical to SEQ ID NO: 266341

SEQ ID NO: 519625 - RNA, 64 nt, hsa; identical to SEQ ID NO: 266342

SEQ ID NO: 519626 - RNA, 64 nt, hsa; identical to SEQ ID NO: 266343

SEQ ID NO: 519627 - RNA, 64 nt, hsa; identical to SEQ ID NO: 266344

SEQ ID NO: 519628 - RNA, 64 nt, hsa; identical to SEQ ID NO: 266345

SEQ ID NO: 519629 - RNA, 64 nt, hsa; identical to SEQ ID NO: 266346

SEQ ID NO: 519630 - RNA, 64 nt, hsa; identical to SEQ ID NO: 266347

SEQ ID NO: 519631 - RNA, 64 nt, hsa; identical to SEQ ID NO: 266348

SEQ ID NO: 519632 - RNA, 64 nt, hsa; identical to SEQ ID NO: 266349

SEQ ID NO: 519633 - RNA, 64 nt, hsa; identical to SEQ ID NO: 266350

SEQ ID NO: 519634 - RNA, 64 nt, hsa; identical to SEQ ID NO: 266351

SEQ ID NO: 519635 - RNA, 64 nt, hsa; identical to SEQ ID NO: 266352

SEQ ID NO: 519636 - RNA, 64 nt, hsa; identical to SEQ ID NO: 266353

SEQ ID NO: 519637 - RNA, 64 nt, hsa; identical to SEQ ID NO: 266354

SEQ ID NO: 519638 - RNA, 64 nt, hsa; identical to SEQ ID NO: 266355

SEQ ID NO: 519639 - RNA, 64 nt, hsa; identical to SEQ ID NO: 266356

SEQ ID NO: 519640 - RNA, 64 nt, hsa; identical to SEQ ID NO: 266357

SEQ ID NO: 519641 - RNA, 64 nt, hsa; identical to SEQ ID NO: 266358

SEQ ID NO: 519642 - RNA, 64 nt, hsa; identical to SEQ ID NO: 266359

SEQ ID NO: 519643 - RNA, 64 nt, hsa; identical to SEQ ID NO: 266360

SEQ ID NO: 519644 - RNA, 64 nt, hsa; identical to SEQ ID NO: 266361

SEQ ID NO: 519645 - RNA, 64 nt, hsa; identical to SEQ ID NO: 266362

SEQ ID NO: 519646 - RNA, 64 nt, hsa; identical to SEQ ID NO: 266363

SEQ ID NO: 519647 - RNA, 64 nt, hsa; identical to SEQ ID NO: 266364

SEQ ID NO: 519648 - RNA, 64 nt, hsa; identical to SEQ ID NO: 266365

SEQ ID NO: 519649 - RNA, 64 nt, hsa; identical to SEQ ID NO: 266366

SEQ ID NO: 519650 - RNA, 64 nt, hsa; identical to SEQ ID NO: 266367

SEQ ID NO: 519651 - RNA, 64 nt, hsa; identical to SEQ ID NO: 84890

SEQ ID NO: 519652 - RNA, 64 nt, hsa; identical to SEQ ID NO: 84891

SEQ ID NO: 519653 - RNA, 64 nt, hsa; identical to SEQ ID NO: 84892

SEQ ID NO: 519654 - RNA, 64 nt, hsa; identical to SEQ ID NO: 84893

SEQ ID NO: 519655 - RNA, 64 nt, hsa; identical to SEQ ID NO: 84894

SEQ ID NO: 519656 - RNA, 64 nt, hsa; identical to SEQ ID NO: 84895

SEQ ID NO: 519657 - RNA, 64 nt, hsa; identical to SEQ ID NO: 84896

SEQ ID NO: 519658 - RNA, 64 nt, hsa; identical to SEQ ID NO: 84897

SEQ ID NO: 519659 - RNA, 64 nt, hsa; identical to SEQ ID NO: 84898

SEQ ID NO: 519660 - RNA, 64 nt, hsa; identical to SEQ ID NO: 84899

SEQ ID NO: 519661 - RNA, 64 nt, hsa; identical to SEQ ID NO: 84900

SEQ ID NO: 519662 - RNA, 64 nt, hsa; identical to SEQ ID NO: 84901

SEQ ID NO: 519663 - RNA, 64 nt, hsa; identical to SEQ ID NO: 84902

SEQ ID NO: 519664 - RNA, 64 nt, hsa; identical to SEQ ID NO: 84903

SEQ ID NO: 519665 - RNA, 64 nt, hsa; identical to SEQ ID NO: 84904

SEQ ID NO: 519666 - RNA, 64 nt, hsa; identical to SEQ ID NO: 84905

SEQ ID NO: 519667 - RNA, 52 nt, hsa; identical to SEQ ID NO: 84906

SEQ ID NO: 519668 - RNA, 64 nt, hsa; identical to SEQ ID NO: 84907

SEQ ID NO: 519669 - RNA, 64 nt, hsa; identical to SEQ ID NO: 84908

SEQ ID NO: 519670 - RNA, 64 nt, hsa; identical to SEQ ID NO: 84909

SEQ ID NO: 519671 - RNA, 64 nt, hsa; identical to SEQ ID NO: 84910

SEQ ID NO: 519672 - RNA, 64 nt, hsa; identical to SEQ ID NO: 84911

SEQ ID NO: 519673 - RNA, 64 nt, hsa; identical to SEQ ID NO: 84912

SEQ ID NO: 519674 - RNA, 64 nt, hsa; identical to SEQ ID NO: 84913

SEQ ID NO: 519675 - RNA, 64 nt, hsa; identical to SEQ ID NO: 84914

SEQ ID NO: 519676 - RNA, 64 nt, hsa; identical to SEQ ID NO: 84915

SEQ ID NO: 519677 - RNA, 64 nt, hsa; identical to SEQ ID NO: 84916

SEQ ID NO: 519678 - RNA, 64 nt, hsa; identical to SEQ ID NO: 84917

SEQ ID NO: 519679 - RNA, 64 nt, hsa; identical to SEQ ID NO: 84918

SEQ ID NO: 519680 - RNA, 64 nt, hsa; identical to SEQ ID NO: 84919

SEQ ID NO: 519681 - RNA, 64 nt, hsa; identical to SEQ ID NO: 84920

SEQ ID NO: 519682 - RNA, 64 nt, hsa; identical to SEQ ID NO: 84921

SEQ ID NO: 519683 - RNA, 64 nt, hsa; identical to SEQ ID NO: 84922

SEQ ID NO: 519684 - RNA, 64 nt, hsa; identical to SEQ ID NO: 84923

SEQ ID NO: 519685 - RNA, 64 nt, hsa; identical to SEQ ID NO: 84924

SEQ ID NO: 519686 - RNA, 64 nt, hsa; identical to SEQ ID NO: 84925

SEQ ID NO: 519687 - RNA, 64 nt, hsa; identical to SEQ ID NO: 84926

SEQ ID NO: 519688 - RNA, 64 nt, hsa; identical to SEQ ID NO: 84927

SEQ ID NO: 519689 - RNA, 64 nt, hsa; identical to SEQ ID NO: 84928

SEQ ID NO: 519690 - RNA, 64 nt, hsa; identical to SEQ ID NO: 84929

SEQ ID NO: 519691 - RNA, 64 nt, hsa; identical to SEQ ID NO: 84930

SEQ ID NO: 519692 - RNA, 64 nt, hsa; identical to SEQ ID NO: 84931

SEQ ID NO: 519693 - RNA, 64 nt, hsa; identical to SEQ ID NO: 84932

SEQ ID NO: 519694 - RNA, 64 nt, hsa; identical to SEQ ID NO: 84933

SEQ ID NO: 519695 - RNA, 64 nt, hsa; identical to SEQ ID NO: 84934

SEQ ID NO: 519696 - RNA, 64 nt, hsa; identical to SEQ ID NO: 84935

SEQ ID NO: 519697 - RNA, 64 nt, hsa; identical to SEQ ID NO: 84936

SEQ ID NO: 519698 - RNA, 64 nt, hsa; identical to SEQ ID NO: 84937

SEQ ID NO: 519699 - RNA, 64 nt, hsa; identical to SEQ ID NO: 84938

SEQ ID NO: 519700 - RNA, 64 nt, hsa; identical to SEQ ID NO: 84939

SEQ ID NO: 519701 - RNA, 64 nt, hsa; identical to SEQ ID NO: 84940

SEQ ID NO: 519702 - RNA, 64 nt, hsa; identical to SEQ ID NO: 84941

SEQ ID NO: 519703 - RNA, 64 nt, hsa; identical to SEQ ID NO: 84942

SEQ ID NO: 519704 - RNA, 64 nt, hsa; identical to SEQ ID NO: 84943

SEQ ID NO: 519705 - RNA, 64 nt, hsa; identical to SEQ ID NO: 84944

SEQ ID NO: 519706 - RNA, 64 nt, hsa; identical to SEQ ID NO: 84945

SEQ ID NO: 519707 - RNA, 64 nt, hsa; identical to SEQ ID NO: 84946

SEQ ID NO: 519708 - RNA, 64 nt, hsa; identical to SEQ ID NO: 84947

SEQ ID NO: 519709 - RNA, 64 nt, hsa; identical to SEQ ID NO: 84948

SEQ ID NO: 519710 - RNA, 64 nt, hsa; identical to SEQ ID NO: 84949

SEQ ID NO: 519711 - RNA, 64 nt, hsa; identical to SEQ ID NO: 84950

SEQ ID NO: 519712 - RNA, 64 nt, hsa; identical to SEQ ID NO: 84951

SEQ ID NO: 519713 - RNA, 64 nt, hsa; identical to SEQ ID NO: 84952

SEQ ID NO: 519714 - RNA, 64 nt, hsa; identical to SEQ ID NO: 84953

SEQ ID NO: 519715 - RNA, 64 nt, hsa; identical to SEQ ID NO: 84954

SEQ ID NO: 519716 - RNA, 64 nt, hsa; identical to SEQ ID NO: 84955

SEQ ID NO: 519717 - RNA, 64 nt, hsa; identical to SEQ ID NO: 84956

SEQ ID NO: 519718 - RNA, 64 nt, hsa; identical to SEQ ID NO: 84957

SEQ ID NO: 519719 - RNA, 64 nt, hsa; identical to SEQ ID NO: 84958

SEQ ID NO: 519720 - RNA, 64 nt, hsa; identical to SEQ ID NO: 84959

SEQ ID NO: 519721 - RNA, 64 nt, hsa; identical to SEQ ID NO: 84960

SEQ ID NO: 519722 - RNA, 64 nt, hsa; identical to SEQ ID NO: 84961

SEQ ID NO: 519723 - RNA, 64 nt, hsa; identical to SEQ ID NO: 84962

SEQ ID NO: 519724 - RNA, 64 nt, hsa; identical to SEQ ID NO: 84963

SEQ ID NO: 519725 - RNA, 64 nt, hsa; identical to SEQ ID NO: 84964

SEQ ID NO: 519726 - RNA, 64 nt, hsa; identical to SEQ ID NO: 84965

SEQ ID NO: 519727 - RNA, 64 nt, hsa; identical to SEQ ID NO: 84966

SEQ ID NO: 519728 - RNA, 64 nt, hsa; identical to SEQ ID NO: 84967

SEQ ID NO: 519729 - RNA, 64 nt, hsa; identical to SEQ ID NO: 84968

SEQ ID NO: 519730 - RNA, 64 nt, hsa; identical to SEQ ID NO: 84969

SEQ ID NO: 519731 - RNA, 64 nt, hsa; identical to SEQ ID NO: 84970

SEQ ID NO: 519732 - RNA, 64 nt, hsa; identical to SEQ ID NO: 84971

SEQ ID NO: 519733 - RNA, 64 nt, hsa; identical to SEQ ID NO: 84972

SEQ ID NO: 519734 - RNA, 58 nt, hsa; identical to SEQ ID NO: 84973

SEQ ID NO: 519735 - RNA, 64 nt, hsa; identical to SEQ ID NO: 84974

SEQ ID NO: 519736 - RNA, 64 nt, hsa; identical to SEQ ID NO: 84975

SEQ ID NO: 519737 - RNA, 64 nt, hsa; identical to SEQ ID NO: 84976

SEQ ID NO: 519738 - RNA, 64 nt, hsa; identical to SEQ ID NO: 84977

SEQ ID NO: 519739 - RNA, 64 nt, hsa; identical to SEQ ID NO: 84978

SEQ ID NO: 519740 - RNA, 64 nt, hsa; identical to SEQ ID NO: 84979

SEQ ID NO: 519741 - RNA, 64 nt, hsa; identical to SEQ ID NO: 84980

SEQ ID NO: 519742 - RNA, 64 nt, hsa; identical to SEQ ID NO: 84981

SEQ ID NO: 519743 - RNA, 64 nt, hsa; identical to SEQ ID NO: 84982

SEQ ID NO: 519744 - RNA, 64 nt, hsa; identical to SEQ ID NO: 84983

SEQ ID NO: 519745 - RNA, 64 nt, hsa; identical to SEQ ID NO: 84984

SEQ ID NO: 519746 - RNA, 64 nt, hsa; identical to SEQ ID NO: 84985

SEQ ID NO: 519747 - RNA, 64 nt, hsa; identical to SEQ ID NO: 84986

SEQ ID NO: 519748 - RNA, 64 nt, hsa; identical to SEQ ID NO: 84987

SEQ ID NO: 519749 - RNA, 64 nt, hsa; identical to SEQ ID NO: 84988

SEQ ID NO: 519750 - RNA, 64 nt, hsa; identical to SEQ ID NO: 84989

SEQ ID NO: 519751 - RNA, 64 nt, hsa; identical to SEQ ID NO: 84990

SEQ ID NO: 519752 - RNA, 64 nt, hsa; identical to SEQ ID NO: 84991

SEQ ID NO: 519753 - RNA, 64 nt, hsa; identical to SEQ ID NO: 84992

SEQ ID NO: 519754 - RNA, 64 nt, hsa; identical to SEQ ID NO: 84993

SEQ ID NO: 519755 - RNA, 64 nt, hsa; identical to SEQ ID NO: 84994

SEQ ID NO: 519756 - RNA, 64 nt, hsa; identical to SEQ ID NO: 84995

SEQ ID NO: 519757 - RNA, 64 nt, hsa; identical to SEQ ID NO: 84996

SEQ ID NO: 519758 - RNA, 64 nt, hsa; identical to SEQ ID NO: 84997

SEQ ID NO: 519759 - RNA, 64 nt, hsa; identical to SEQ ID NO: 84998

SEQ ID NO: 519760 - RNA, 64 nt, hsa; identical to SEQ ID NO: 84999

SEQ ID NO: 519761 - RNA, 64 nt, hsa; identical to SEQ ID NO: 85000

SEQ ID NO: 519762 - RNA, 64 nt, hsa; identical to SEQ ID NO: 85001

SEQ ID NO: 519763 - RNA, 64 nt, hsa; identical to SEQ ID NO: 85002

SEQ ID NO: 519764 - RNA, 64 nt, hsa; identical to SEQ ID NO: 85003

SEQ ID NO: 519765 - RNA, 64 nt, hsa; identical to SEQ ID NO: 349054

SEQ ID NO: 519766 - RNA, 64 nt, hsa; identical to SEQ ID NO: 349055

SEQ ID NO: 519767 - RNA, 64 nt, hsa; identical to SEQ ID NO: 349056

SEQ ID NO: 519768 - RNA, 64 nt, hsa; identical to SEQ ID NO: 349057

SEQ ID NO: 519769 - RNA, 64 nt, hsa; identical to SEQ ID NO: 349058

SEQ ID NO: 519770 - RNA, 64 nt, hsa; identical to SEQ ID NO: 349059

SEQ ID NO: 519771 - RNA, 64 nt, hsa; identical to SEQ ID NO: 349060

SEQ ID NO: 519772 - RNA, 64 nt, hsa; identical to SEQ ID NO: 349061

SEQ ID NO: 519773 - RNA, 64 nt, hsa; identical to SEQ ID NO: 349062

SEQ ID NO: 519774 - RNA, 64 nt, hsa; identical to SEQ ID NO: 349063

SEQ ID NO: 519775 - RNA, 64 nt, hsa; identical to SEQ ID NO: 349064

SEQ ID NO: 519776 - RNA, 64 nt, hsa; identical to SEQ ID NO: 349065

SEQ ID NO: 519777 - RNA, 64 nt, hsa; identical to SEQ ID NO: 349066

SEQ ID NO: 519778 - RNA, 64 nt, hsa; identical to SEQ ID NO: 349067

SEQ ID NO: 519779 - RNA, 64 nt, hsa; identical to SEQ ID NO: 349068

SEQ ID NO: 519780 - RNA, 64 nt, hsa; identical to SEQ ID NO: 349069

SEQ ID NO: 519781 - RNA, 64 nt, hsa; identical to SEQ ID NO: 212919

SEQ ID NO: 519782 - RNA, 64 nt, hsa; identical to SEQ ID NO: 212920

SEQ ID NO: 519783 - RNA, 64 nt, hsa; identical to SEQ ID NO: 212921

SEQ ID NO: 519784 - RNA, 64 nt, hsa; identical to SEQ ID NO: 212922

SEQ ID NO: 519785 - RNA, 64 nt, hsa; identical to SEQ ID NO: 212923

SEQ ID NO: 519786 - RNA, 64 nt, hsa; identical to SEQ ID NO: 212924

SEQ ID NO: 519787 - RNA, 64 nt, hsa; identical to SEQ ID NO: 212925

SEQ ID NO: 519788 - RNA, 64 nt, hsa; identical to SEQ ID NO: 212926

SEQ ID NO: 519789 - RNA, 64 nt, hsa; identical to SEQ ID NO: 212927

SEQ ID NO: 519790 - RNA, 64 nt, hsa; identical to SEQ ID NO: 212928

SEQ ID NO: 519791 - RNA, 64 nt, hsa; identical to SEQ ID NO: 93597

SEQ ID NO: 519792 - RNA, 64 nt, hsa; identical to SEQ ID NO: 93598

SEQ ID NO: 519793 - RNA, 64 nt, hsa; identical to SEQ ID NO: 93599

SEQ ID NO: 519794 - RNA, 64 nt, hsa; identical to SEQ ID NO: 93600

SEQ ID NO: 519795 - RNA, 64 nt, hsa; identical to SEQ ID NO: 93601

SEQ ID NO: 519796 - RNA, 64 nt, hsa; identical to SEQ ID NO: 93602

SEQ ID NO: 519797 - RNA, 64 nt, hsa; identical to SEQ ID NO: 93603

SEQ ID NO: 519798 - RNA, 64 nt, hsa; identical to SEQ ID NO: 93604

SEQ ID NO: 519799 - RNA, 64 nt, hsa; identical to SEQ ID NO: 93605

SEQ ID NO: 519800 - RNA, 64 nt, hsa; identical to SEQ ID NO: 93606

SEQ ID NO: 519801 - RNA, 64 nt, hsa; identical to SEQ ID NO: 93607

SEQ ID NO: 519802 - RNA, 64 nt, hsa; identical to SEQ ID NO: 93608

SEQ ID NO: 519803 - RNA, 64 nt, hsa; identical to SEQ ID NO: 93609

SEQ ID NO: 519804 - RNA, 64 nt, hsa; identical to SEQ ID NO: 93610

SEQ ID NO: 519805 - RNA, 64 nt, hsa; identical to SEQ ID NO: 93611

SEQ ID NO: 519806 - RNA, 64 nt, hsa; identical to SEQ ID NO: 93612

SEQ ID NO: 519807 - RNA, 64 nt, hsa; identical to SEQ ID NO: 93613

SEQ ID NO: 519808 - RNA, 64 nt, hsa; identical to SEQ ID NO: 93614

SEQ ID NO: 519809 - RNA, 64 nt, hsa; identical to SEQ ID NO: 93615

SEQ ID NO: 519810 - RNA, 64 nt, hsa; identical to SEQ ID NO: 93616

SEQ ID NO: 519811 - RNA, 64 nt, hsa; identical to SEQ ID NO: 93617

SEQ ID NO: 519812 - RNA, 64 nt, hsa; identical to SEQ ID NO: 93618

SEQ ID NO: 519813 - RNA, 64 nt, hsa; identical to SEQ ID NO: 93619

SEQ ID NO: 519814 - RNA, 64 nt, hsa; identical to SEQ ID NO: 93620

SEQ ID NO: 519815 - RNA, 64 nt, hsa; identical to SEQ ID NO: 93621

SEQ ID NO: 519816 - RNA, 64 nt, hsa; identical to SEQ ID NO: 93622

SEQ ID NO: 519817 - RNA, 64 nt, hsa
ugucaggcagacguuuauacaacaccacggugcuuuuauacauugugcuuauuuuaauaaaacu

SEQ ID NO: 519818 - RNA, 64 nt, hsa
uaaagaaaauagauuugcauuugucaggcagacguuuauacaacaccacggugcuuuuauacau

SEQ ID NO: 519819 - RNA, 64 nt, hsa
uuaauaucaacuguuugguaagaguacaguuguuuuuauacacucuaagaaauguguuuauaau

SEQ ID NO: 519820 - RNA, 64 nt, hsa
gaauuuuccaaaaaucuaaggaguaaacagcuuauuuauacauuuugaggagaaaacaaagugu

SEQ ID NO: 519821 - RNA, 64 nt, hsa
aaaucucccaaaagagauaaccaguaucugaagguuuauacaauauuuacacaguggcuacaau

SEQ ID NO: 519822 - RNA, 64 nt, hsa
uuucuauuucaaguaaagcuuugaguuacuuguuuuuauacauauucaucauguacccuuuauu

SEQ ID NO: 519823 - RNA, 64 nt, hsa
uuaauuugaaaaccuugcuguuacaaauuggaccuuuauacauuuucugaaaacaaugaaaaga

SEQ ID NO: 519824 - RNA, 64 nt, hsa
guuuaugauauuguuuuucuaaaaacaaaugcuguuuauacauaugagauagcuauuuugauag

SEQ ID NO: 519825 - RNA, 64 nt, hsa
aaacuauuccaggacuaauucuuaaucggcauuauuuauacaagaggucaaguaacauuuacua

SEQ ID NO: 519826 - RNA, 64 nt, hsa
uacauuggucaccuaaauacucauauucucgaguuuuauacaguuguaucacaucgaaaagugu

SEQ ID NO: 519827 - RNA, 64 nt, hsa
cuauugauguuuccagaaaauauaaaugcaugauuuuauacauagucacaaaaauggugguuug

SEQ ID NO: 519828 - RNA, 64 nt, hsa
uuuauacauaucagaaaaguagaauuauaucuaauuuauacaaaauaauuuaacuaauuuaaac

SEQ ID NO: 519829 - RNA, 64 nt, hsa
uuuccuauuuuaaaaccaugcagcuucaucaauuuuuauacauaucagaaaaguagaauuauau

SEQ ID NO: 519830 - RNA, 64 nt, hsa
ugucuagacagcacgcaguucagaaagaaaugucuuuauacaaaagacaugauagagaaaagau

SEQ ID NO: 519831 - RNA, 64 nt, hsa
ugauuaauaaaaguucauuuuuuaaauuuguauuuuuauacaaccuccaaaaaaaaaaacaacu

SEQ ID NO: 519832 - RNA, 64 nt, hsa
gaaggaggacugagguucagcaguuaacugaccuuuuauacaaguuagcacaugaaggauagau

SEQ ID NO: 519833 - RNA, 64 nt, hsa
cucucucucucuuuuuuuuuuuuacuuuacauauuuuauacaaugucauucauaacuauggcuu

SEQ ID NO: 519834 - RNA, 64 nt, hsa
guugguacaauuaugaggguaguacugggugcuuuuuauacaacuuuccaucccccacacaguu

SEQ ID NO: 519835 - RNA, 64 nt, hsa
augugcauuuuaaaucuccaagaagcaccucuauuuuauacaucauuucccuaauuuauuuuaa

SEQ ID NO: 519836 - RNA, 64 nt, hsa
cauccucccaauuuguucuguauuuagguaguuauuuauacaagagucuuuaagucauucuaaa

SEQ ID NO: 519837 - RNA, 64 nt, hsa
guacugaaaaaugcuuuuuaguacuuuuucauauuuuauacauuuauuuuccgaauguaucauu

SEQ ID NO: 519838 - RNA, 64 nt, hsa
agaaauuuaaauucuuucuucucuauuguauuauuuuauacaauuugcuauuucuauuuccuuc

SEQ ID NO: 519839 - RNA, 64 nt, hsa
uguuuauguuuaaauacuaggguuuguucuauauuuuauacaugcauuuuggaugauuaaagaa

SEQ ID NO: 519840 - RNA, 64 nt, hsa
ugauuaaggcuuucuuugguagguaaaucuagaguuuauacaguguacauguacauaguaaagu

SEQ ID NO: 519841 - RNA, 64 nt, hsa
aaaacugaugaggcaugcagcuuucagcacaucuuuuauacaugaagaaauuaauuuuguguug

SEQ ID NO: 519842 - RNA, 64 nt, hsa
aauaccuuggggcagggacauguuuuguuuauaauuuauacaucuauuaaguucuggauauuua

SEQ ID NO: 519843 - RNA, 64 nt, hsa
uaaaaauaaaugcaaugauugaugcaugcaauuuuuuauacaaauaauuuauuucuaauaauaa

SEQ ID NO: 519844 - RNA, 64 nt, hsa
aaaguaucaauaaacggggagugaagaaacccguuuuauacaauaaaaccaaugagugucaagc

SEQ ID NO: 519845 - RNA, 64 nt, hsa
uugcugaaguauuuaaaucuuauccuuguaucuuuuuauacauauuugaaaauaagcuuauaug

SEQ ID NO: 519846 - RNA, 64 nt, hsa
aaaaagguaguuuuaauaaacaagacacaacguuuuuauacaacauacuuuaaaauauuaagga

SEQ ID NO: 519847 - RNA, 64 nt, hsa
caagcaguuguuucccauucccaacaaacuguacuuuauacaauucuggaugcuaaaacuuaga

SEQ ID NO: 519848 - RNA, 64 nt, hsa
agaacaaagauuggaaaaagcuggccgagaaccauuuauacauagaggaagggcuuauggacug

SEQ ID NO: 519849 - RNA, 64 nt, hsa
cauuuuauacaaacuuuuauagacaaauuguguuuuuauacagagucaugcauauuuucucaua

SEQ ID NO: 519850 - RNA, 64 nt, hsa
acucucugggugacaugauaccuauucgaaacauuuuauacaaacuuuuauagacaaauugugu

SEQ ID NO: 519851 - RNA, 64 nt, hsa
ggauaaucuuauuuaucuaaacuaaagcuuccuguuuauacacacuccuguuauucugggauaa

SEQ ID NO: 519852 - RNA, 64 nt, hsa
caagacuuugggccucuugacagaauuaaccacuuuuauacaucugaguucucuugguaaguuc

SEQ ID NO: 519853 - RNA, 64 nt, hsa
guuaaaacaaaggaacuaacuuacuguccaccaguuuauacagaacucacaguaccuaugacuu

SEQ ID NO: 519854 - RNA, 64 nt, hsa
uguuuaagcuacuaacgauaaaagguaauaacauuuuauacaauuuccauauagucuauucauu

SEQ ID NO: 519855 - RNA, 64 nt, hsa
uuggauuugcauuuuaaccugcauuucgaagauuuuuauacauguuuucuauuuccgacaaugc

SEQ ID NO: 519856 - RNA, 64 nt, hsa
gcuauugaaauaguucuguaaggaagugguguucuuuauacaucaauuauuacaaaaagcagug

SEQ ID NO: 519857 - RNA, 64 nt, hsa
gugugccagcuuacaauguggaaaugaaagcuaauuuauacacagcaggcauaugaaacuccac

SEQ ID NO: 519858 - RNA, 64 nt, hsa
uuagauccucuaguuugaucucuuaaucaggauuuuuauacagcugccaggcuccccuaauuca

SEQ ID NO: 519859 - RNA, 64 nt, hsa
guagguuguauacuuacauuuuuucuuuccuuaauuuauacaugauccuuuuuccuuaauuuau

SEQ ID NO: 519860 - RNA, 64 nt, hsa
uuuccuuaauuuauacaugauccuuuuuccuuaauuuauacaugauccaggcacauuugaaauu

SEQ ID NO: 519861 - RNA, 64 nt, hsa
guuggggauaggaaguauaucuggcagauugauauuuauacacuuuuuuauaaagcagauuuua

SEQ ID NO: 519862 - RNA, 64 nt, hsa
ucaauagaagauggacaaauuccagaaaucauauuuuauacauaauuuagcauuauaauacauc

SEQ ID NO: 519863 - RNA, 64 nt, hsa
aucgcuuuuguggaagugcauauaaaauagaguauuuauacaauauauguuacuagaaauaaaa

SEQ ID NO: 519864 - RNA, 64 nt, hsa
guuaguaauaaaugccuauaauaacauauuuauuuuuauacauuuauuucuaaugaaaaaaacu

SEQ ID NO: 519865 - RNA, 64 nt, hsa
gcacuguuuauggcugcuaugguuucagagaauguuuauacauuauuucuaccgagaauuaaaa

SEQ ID NO: 519866 - RNA, 64 nt, hsa
auaaaauaagcuuggccuagcauggcaaaucagauuuauacaggagucugcauuugcacuuuuu

SEQ ID NO: 519867 - RNA, 64 nt, hsa
ccccuuuuuauauaauaauuauauaacuuaugcauuuauacacuacgaguugaucucggccagc

SEQ ID NO: 519868 - RNA, 64 nt, hsa; identical to SEQ ID NO: 131192

SEQ ID NO: 519869 - RNA, 64 nt, hsa; identical to SEQ ID NO: 131193

SEQ ID NO: 519870 - RNA, 64 nt, hsa; identical to SEQ ID NO: 131194

SEQ ID NO: 519871 - RNA, 64 nt, hsa; identical to SEQ ID NO: 131195

SEQ ID NO: 519872 - RNA, 64 nt, hsa; identical to SEQ ID NO: 131196

SEQ ID NO: 519873 - RNA, 64 nt, hsa; identical to SEQ ID NO: 131197

SEQ ID NO: 519874 - RNA, 64 nt, hsa; identical to SEQ ID NO: 131198

SEQ ID NO: 519875 - RNA, 64 nt, hsa; identical to SEQ ID NO: 131199

SEQ ID NO: 519876 - RNA, 64 nt, hsa; identical to SEQ ID NO: 131200

SEQ ID NO: 519877 - RNA, 64 nt, hsa; identical to SEQ ID NO: 131201

SEQ ID NO: 519878 - RNA, 64 nt, hsa; identical to SEQ ID NO: 131202

SEQ ID NO: 519879 - RNA, 64 nt, hsa; identical to SEQ ID NO: 131203

SEQ ID NO: 519880 - RNA, 64 nt, hsa; identical to SEQ ID NO: 131204

SEQ ID NO: 519881 - RNA, 64 nt, hsa; identical to SEQ ID NO: 131205

SEQ ID NO: 519882 - RNA, 64 nt, hsa; identical to SEQ ID NO: 131206

SEQ ID NO: 519883 - RNA, 64 nt, hsa; identical to SEQ ID NO: 131207

SEQ ID NO: 519884 - RNA, 64 nt, hsa
augcugaaugggugaauaguugaaugauaggugcucaauaaaugaaugaauggccuucccuucu

SEQ ID NO: 519885 - RNA, 64 nt, hsa
gagccucgcccagugccuggcacauaguaggcacucaauaaaugcugaaugggugaauaguuga

SEQ ID NO: 519886 - RNA, 64 nt, hsa
uuauuuuccaaagaguaauagacaugcaaaaguuucaauaaaaacugggccauuaacaaauaaa

SEQ ID NO: 519887 - RNA, 64 nt, hsa
cuaacugaggcauuucaguaacuuugcuuucaaaucaauaaagucaaauguauggaaacauuuu

SEQ ID NO: 519888 - RNA, 64 nt, hsa
acagauugcuaguauagucaacaguauuuggcuaucaauaaagaaucucuuuaagaucucaccc

SEQ ID NO: 519889 - RNA, 64 nt, hsa
acuguccaaaugaauuuuguuguuaauugagaagucaauaaaauggauuaaacugacagaaaaa

SEQ ID NO: 519890 - RNA, 64 nt, hsa
ucuuguaaccagauacauaaagagcucuuacaacucaauaaaaggcaaguaauuuaaaaauagg

SEQ ID NO: 519891 - RNA, 64 nt, hsa
uguaacaaaauaucacaugcauaaauauuauguaucaauaaaauuuuuuaaugggcaaaggauu

SEQ ID NO: 519892 - RNA, 64 nt, hsa
uguuagaauuuuuugguuguuaaaauaaacgcauucaauaaauaugacuuuguuugucaguuau

SEQ ID NO: 519893 - RNA, 64 nt, hsa
aaaucuuaaagacacaaugcacacuuaaaaugacucaauaaaaugacuugcuacguuccguuau

SEQ ID NO: 519894 - RNA, 64 nt, hsa
uuuacauacguuuguguggugacauuuuagaaugucaauaaauuugcuuuuugagauguugaga

SEQ ID NO: 519895 - RNA, 64 nt, hsa
auuuguuacuguauccucauuuguaaucuaguugucaauaaauggcccggacaugucuugcuaa

SEQ ID NO: 519896 - RNA, 64 nt, hsa
guguucuccaaacaugauggaacgaaauuagaaaucaauaaaauuugggaaauucacaaauaug

SEQ ID NO: 519897 - RNA, 64 nt, hsa
ugcacuccagcuugagcaacacagugauacugucucaauaaauaaauaaauagaagaaaucaug

SEQ ID NO: 519898 - RNA, 64 nt, hsa
uuauuccaaacauuaaauuuuaacagucuaucaaucaauaaauguugaacauuuuuuuucuauu

SEQ ID NO: 519899 - RNA, 64 nt, hsa
cugagcugcuaaaugaauaucccugcucugcuggucaauaaaacgcuuccuaauagcagcuugg

SEQ ID NO: 519900 - RNA, 64 nt, hsa
auuuuauauaauuugguuugugaaauuaaagacaucaauaaaaaugauuccugaaaguaguaau

SEQ ID NO: 519901 - RNA, 64 nt, hsa
aagugggugaauuauaugguaugugaauuauaucucaauaaaguuguuaguaaauaaauggggc

SEQ ID NO: 519902 - RNA, 64 nt, hsa
cuaauagcucugcuaguaauugauuuauuuuucuucaauaaaguugcauaaaccaaugaguuag

SEQ ID NO: 519903 - RNA, 64 nt, hsa
agcagaacagaaaaugugauguauuuuaugcaugucaauaaaggaaugaccuguucuuguucua

SEQ ID NO: 519904 - RNA, 64 nt, hsa
aauauacauucugcuuugaauuaauuuuuucaaaucaauaaauuauguagacauuuaaaaucaa

SEQ ID NO: 519905 - RNA, 64 nt, hsa
auugacuuguccaaauuucaaaagugccuacccuucaauaaaacuuuuuuauucugaucuccau

SEQ ID NO: 519906 - RNA, 64 nt, hsa
uucuuaaugugccuaaguuaauuucuguaucaauucaauaaauggaauugacugaacuucccaa

SEQ ID NO: 519907 - RNA, 64 nt, hsa
acuuuccaacuauuauauaauacauuucgaucuuucaauaaagauacgcauucacgcuguaagu

SEQ ID NO: 519908 - RNA, 64 nt, hsa
aauccuaggaaagggcucagccugugauaggcauucaauaaauacuccaaugcugucauuccuu

SEQ ID NO: 519909 - RNA, 64 nt, hsa
cugugauuuggggccguuuguacucugcauguauucaauaaauucaauucagcaauaguuauca

SEQ ID NO: 519910 - RNA, 64 nt, hsa
caauuugacuauuauaggccagcuuuccauuuagucaauaaaagcguacauuuuuaguuacuua

SEQ ID NO: 519911 - RNA, 64 nt, hsa
ugacuauauguaaugcagugcuaucccaauauuuucaauaaaggacuuuaugcauucagugauu

SEQ ID NO: 519912 - RNA, 64 nt, hsa
gcaccuagugcagugcugggcacagaguaggugcucaauaaagacuuguugaaugaacagccug

SEQ ID NO: 519913 - RNA, 64 nt, hsa
uacacggcuuugggguacaagcugugaucacugaucaauaaauuaucucuagauugguccuugu

SEQ ID NO: 519914 - RNA, 64 nt, hsa
uuggcuacuuguauucuuuaugcuguuguuuauuucaauaaaaaauucacaccuaaauguauac

SEQ ID NO: 519915 - RNA, 64 nt, hsa
gcuucuggcgaacugauuuuauuuuuaauuuuuuucaauaaagauauucuuagauacugaaaga

SEQ ID NO: 519916 - RNA, 64 nt, hsa
cacaguucguuuaguuacuguacacucuguuuguucaauaaacugcauaucaacuucccacaaa

SEQ ID NO: 519917 - RNA, 64 nt, hsa
ugacuggaauacaccuuuggaacggaauucuuuaucaauaaaguuucacaauccgucccucuuc

SEQ ID NO: 519918 - RNA, 64 nt, hsa
agugcugcugcucccgcccgaggcucaugacaacucaauaaagcacugcuuuuauuuuuugcag

SEQ ID NO: 519919 - RNA, 64 nt, hsa
gucuucaauuugagaaaggugagaaauaauguuuucaauaaaugagauucauaccauuguugac

SEQ ID NO: 519920 - RNA, 64 nt, hsa
aguaaaugcugaaauaaaaugauuaaugcauuuaucaauaaaagccuuugaaaauacuuuggau

SEQ ID NO: 519921 - RNA, 64 nt, hsa
aauagucuugcagaaaaugaaugaauaccuuuguucaauaaaggaaauaugcacugcucacuuu

SEQ ID NO: 519922 - RNA, 64 nt, hsa
gggaaagauaggacuaaaguugugccaaacuauaucaauaaauuccauguuuagcagaaauagg

SEQ ID NO: 519923 - RNA, 64 nt, hsa
uauuaggauaccacuuuucauugcaaaguuugugucaauaaagucauuaauuuuaaacauauau

SEQ ID NO: 519924 - RNA, 64 nt, hsa
uacuccagccugggugacagagugagacuccaucucaauaaaauuaauaauaauaaaaccuucc

SEQ ID NO: 519925 - RNA, 64 nt, hsa
uagaguaaaaaucagugaaauugaaaagagaaaaucaauaaaacccaaaacuguucuuugaaaa

SEQ ID NO: 519926 - RNA, 64 nt, hsa
ccugaauauguacuuuuaacacaagagagacuauucaauaaaaacucacugggucuuucauguc

SEQ ID NO: 519927 - RNA, 64 nt, hsa
uucuuuuuuauauuguccuccaccuccaucauuuucaauaaaagauagggcuuuugcucccuug

SEQ ID NO: 519928 - RNA, 64 nt, hsa
auuucucuugaaaauaauuuccucaaagcccaagucaauaaauguuaucagccagucuuccaaa

SEQ ID NO: 519929 - RNA, 64 nt, hsa
uaaauauauauaauuuuuauuugucaaauauaccucaauaaagauggaaaaaaaucgaaauuca

SEQ ID NO: 519930 - RNA, 64 nt, hsa
uacuuacuacucagcaauaaaaaugaaguaacuuucaauaaaugcaauauuauuggcagacauu

SEQ ID NO: 519931 - RNA, 64 nt, hsa
auauauauaaaauuuauuguaugaaaauuaagccucaauaaacgugauuauaaaaaacaagucu

SEQ ID NO: 519932 - RNA, 64 nt, hsa
uaaaaugcugaagugccuggucuacaguaagugcucaauaaauguuaacuauugugauugcugc

SEQ ID NO: 519933 - RNA, 64 nt, hsa
ugugaacuugccuagaacucugccuucuccguugucaauaaagccucccccucaugaccuaaac

SEQ ID NO: 519934 - RNA, 64 nt, hsa
gugcuguaaaguguuuuauuguaaauugcucaucucaauaaaauuuacuucagguuuguggacu

SEQ ID NO: 519935 - RNA, 64 nt, hsa
ugucuaggaauacagaagcuccuugacuuacaucucaauaaacccaucguaaguccaaaauauu

SEQ ID NO: 519936 - RNA, 64 nt, hsa
uuuuucccccucucuuuaaaacaucacugaaauuucaauaaauuuuuauugaaaugucuuuggg

SEQ ID NO: 519937 - RNA, 64 nt, hsa
uuaaaaacuuuauagggacuugcauuaucgguucucaauaaauuacugagcagcuuuguuuggg

SEQ ID NO: 519938 - RNA, 64 nt, hsa
gaaccuuauguguauuuuauuuuguuuucaaccaucaauaaaguuuucucuagaauauuguuuu

SEQ ID NO: 519939 - RNA, 64 nt, hsa
ugaguucuguuucacaaguuuugggccaccuauuucaauaaaaaauaaaauauaaauuaaaaaa

SEQ ID NO: 519940 - RNA, 64 nt, hsa
uuugugcaauaaguggaagggaugucauccuucuucaauaaaugcugaaugacauucaagcuga

SEQ ID NO: 519941 - RNA, 64 nt, hsa
agaccacugagaaaaucuuuauuuacaauaaauuucaauaaaauuugcauaaauauauucccaa

SEQ ID NO: 519942 - RNA, 64 nt, hsa
uggucacucacuguguuugguuacugucaagaaaucaauaaauguguuuaacaaguuacccagu

SEQ ID NO: 519943 - RNA, 64 nt, hsa
aggucauacauuguguuugguuauuguuaccagcucaauaaauguguuuaacgaguuaauuuca

SEQ ID NO: 519944 - RNA, 64 nt, hsa
acuacagaauuuagucaacauuuuauauaauguuucaauaaauguuucuuucaauaaagauacu

SEQ ID NO: 519945 - RNA, 64 nt, hsa
aacauuuuauauaauguuucaauaaauguuucuuucaauaaagauacuaugugcccuucauagu

SEQ ID NO: 519946 - RNA, 64 nt, hsa
ccaauauccuugaugaacauugaugugaaaauccucaauaaaauacuggcaaaccgaauccagc

SEQ ID NO: 519947 - RNA, 64 nt, hsa
cccugggaugcaaggcugguucaacauacgcaaaucaauaaauguaauccagcauauaaacaga

SEQ ID NO: 519948 - RNA, 64 nt, hsa
gccagcacccaaauaagccuggcaugcaguggccucaauaaaaugugacuguauugagucauuu

SEQ ID NO: 519949 - RNA, 64 nt, hsa
ggauuugacagcauauccaaauaugucagcaauuucaauaaacaugacuguacucaacaaacca

SEQ ID NO: 519950 - RNA, 64 nt, hsa
gaucagcagaaauaggguuuucucaucuucaccaucaauaaacauuuauugcguaccuccuaua

SEQ ID NO: 519951 - RNA, 64 nt, hsa
aagucagaacuagaauuguucauucuuucauucaucaauaaauguauuuugagugccuaagagu

SEQ ID NO: 519952 - RNA, 64 nt, hsa
caugugcuagauuggaguggggaagugugucaaaucaauaaaugaauaaauucaauaaaugccu

SEQ ID NO: 519953 - RNA, 64 nt, hsa
uggggaagugugucaaaucaauaaaugaauaaauucaauaaaugccuauaaccagcucugguuu

SEQ ID NO: 519954 - RNA, 64 nt, hsa
uggccuuucacuucugccuucuguugagaauuaucaccaugacaccugccauaccguauagaga

SEQ ID NO: 519955 - RNA, 64 nt, hsa
acagaguagagaacaacuggcagcuuugaaaaaacaccaugaagaagaaaucguucaucauaag

SEQ ID NO: 519956 - RNA, 64 nt, hsa
aaagaaaugaucucugcuucauuugugccucccucaccaugaccccacucuuaccauaguggcu

SEQ ID NO: 519957 - RNA, 64 nt, hsa
ccagauuguuucugguucccugccacuauaaaaacaccaugagagcauacucauacauguuccc

SEQ ID NO: 519958 - RNA, 64 nt, hsa
agggcacagauuccccagaaaguuaacacaaucccaccaugagggauggguaaauucucagauu

SEQ ID NO: 519959 - RNA, 64 nt, hsa
uuggaaggauagacugcccccuaccucccaccaccaccaugaaguuuggugacuugaggcugga

SEQ ID NO: 519960 - RNA, 64 nt, hsa
ugcaguaucaagcuaacaaggugacccacacacucaccaugaggcaaaggcaagacuuuucaau

SEQ ID NO: 519961 - RNA, 64 nt, hsa
uuuuggacaaaauagagaggagcaagauaguuuccaccaugaggugcaaaacgagacagaagag

SEQ ID NO: 519962 - RNA, 64 nt, hsa
auaaauggacaaaugaguaaaugagaaagucucacaccaugaaagaugcuaguccaaugagcug

SEQ ID NO: 519963 - RNA, 64 nt, hsa
cauuuuguuguucaggucaacagcaaaaugccugcaccaugacuguggcuuuuaaaauaaagaa

SEQ ID NO: 519964 - RNA, 64 nt, hsa
ucacccgaggggaauggcagucggaggcgcaggacaccaugaagacagggucaucgaccaacaa

SEQ ID NO: 519965 - RNA, 64 nt, hsa
cccucuagguccugugccucaucacugcuccugucaccaugauucuguccagccagcaggaugc

SEQ ID NO: 519966 - RNA, 64 nt, hsa
uagagauuucucacaaguuauuucauucauaauccaccaugaacagugacuagcuucgugcagu

SEQ ID NO: 519967 - RNA, 64 nt, hsa
gaauuucuuggccuacuaggacaguucugugcuucaccaugagguuugccuuuguggaaaacug

SEQ ID NO: 519968 - RNA, 64 nt, hsa
agucaccaugaggucacugggguggccccuaacccaccaugacugguguccuucuaaggagaug

SEQ ID NO: 519969 - RNA, 64 nt, hsa
uguuuggaaacacagucguugcagauuaauuagucaccaugaggucacugggguggccccuaac

SEQ ID NO: 519970 - RNA, 64 nt, hsa
ccuauggauccgugaccaaugugagggucaacagcaccaugacaacccugcaggugcucacccu

SEQ ID NO: 519971 - RNA, 64 nt, hsa
gagugccugugugucuaccucucugaagccugagcaccaugauucccacagccagcucuuggcu

SEQ ID NO: 519972 - RNA, 64 nt, hsa
cagagcagguuccuccacugccccaccccuuagacaccaugaccccaucagguuaauccccugu

SEQ ID NO: 519973 - RNA, 64 nt, hsa
uccuugcaugccuccucagcucaccuucucucuucaccaugagacuggcuuuccacaaacucuc

SEQ ID NO: 519974 - RNA, 64 nt, hsa
aaggcugacaguucuguuggcagccaagaacccacaccaugaagacagggagugaggggccuuu

SEQ ID NO: 519975 - RNA, 64 nt, hsa
gccugccccuuggcuucucagggcuuugcucugacaccaugacagcugcccggggcugagggca

SEQ ID NO: 519976 - RNA, 64 nt, hsa
uauugcagguuuuccuuuggaauauggauaaauacaccaugauacggaaacuagaaggacauca

SEQ ID NO: 519977 - RNA, 64 nt, hsa
uaaauacaccaugauacggaaacuagaaggacaucaccaugaugugguagcuugugacuuuucu

SEQ ID NO: 519978 - RNA, 64 nt, hsa; identical to SEQ ID NO: 159774

SEQ ID NO: 519979 - RNA, 64 nt, hsa; identical to SEQ ID NO: 159775

SEQ ID NO: 519980 - RNA, 64 nt, hsa; identical to SEQ ID NO: 159776

SEQ ID NO: 519981 - RNA, 64 nt, hsa; identical to SEQ ID NO: 159777

SEQ ID NO: 519982 - RNA, 64 nt, hsa; identical to SEQ ID NO: 159778

SEQ ID NO: 519983 - RNA, 64 nt, hsa; identical to SEQ ID NO: 159779

SEQ ID NO: 519984 - RNA, 64 nt, hsa; identical to SEQ ID NO: 159780

SEQ ID NO: 519985 - RNA, 64 nt, hsa; identical to SEQ ID NO: 159781

SEQ ID NO: 519986 - RNA, 64 nt, hsa; identical to SEQ ID NO: 159782

SEQ ID NO: 519987 - RNA, 64 nt, hsa; identical to SEQ ID NO: 159783

SEQ ID NO: 519988 - RNA, 64 nt, hsa; identical to SEQ ID NO: 159784

SEQ ID NO: 519989 - RNA, 64 nt, hsa; identical to SEQ ID NO: 159785

SEQ ID NO: 519990 - RNA, 64 nt, hsa; identical to SEQ ID NO: 159786

SEQ ID NO: 519991 - RNA, 64 nt, hsa; identical to SEQ ID NO: 159787

SEQ ID NO: 519992 - RNA, 64 nt, hsa; identical to SEQ ID NO: 159788

SEQ ID NO: 519993 - RNA, 64 nt, hsa; identical to SEQ ID NO: 159789

SEQ ID NO: 519994 - RNA, 64 nt, hsa; identical to SEQ ID NO: 159790

SEQ ID NO: 519995 - RNA, 64 nt, hsa; identical to SEQ ID NO: 159791

SEQ ID NO: 519996 - RNA, 64 nt, hsa; identical to SEQ ID NO: 159792

SEQ ID NO: 519997 - RNA, 64 nt, hsa; identical to SEQ ID NO: 159793

SEQ ID NO: 519998 - RNA, 64 nt, hsa; identical to SEQ ID NO: 159794

SEQ ID NO: 519999 - RNA, 64 nt, hsa; identical to SEQ ID NO: 159795

SEQ ID NO: 520000 - RNA, 64 nt, hsa; identical to SEQ ID NO: 159796

SEQ ID NO: 520001 - RNA, 64 nt, hsa; identical to SEQ ID NO: 159797

SEQ ID NO: 520002 - RNA, 64 nt, hsa; identical to SEQ ID NO: 159798

SEQ ID NO: 520003 - RNA, 64 nt, hsa; identical to SEQ ID NO: 159799

SEQ ID NO: 520004 - RNA, 64 nt, hsa; identical to SEQ ID NO: 159800

SEQ ID NO: 520005 - RNA, 64 nt, hsa; identical to SEQ ID NO: 159801

SEQ ID NO: 520006 - RNA, 64 nt, hsa; identical to SEQ ID NO: 159802

SEQ ID NO: 520007 - RNA, 64 nt, hsa; identical to SEQ ID NO: 159803

SEQ ID NO: 520008 - RNA, 64 nt, hsa; identical to SEQ ID NO: 159804

SEQ ID NO: 520009 - RNA, 64 nt, hsa; identical to SEQ ID NO: 159805

SEQ ID NO: 520010 - RNA, 64 nt, hsa; identical to SEQ ID NO: 159806

SEQ ID NO: 520011 - RNA, 64 nt, hsa; identical to SEQ ID NO: 159807

SEQ ID NO: 520012 - RNA, 64 nt, hsa; identical to SEQ ID NO: 159808

SEQ ID NO: 520013 - RNA, 64 nt, hsa; identical to SEQ ID NO: 159809

SEQ ID NO: 520014 - RNA, 64 nt, hsa; identical to SEQ ID NO: 159810

SEQ ID NO: 520015 - RNA, 64 nt, hsa; identical to SEQ ID NO: 159811

SEQ ID NO: 520016 - RNA, 64 nt, hsa; identical to SEQ ID NO: 159812

SEQ ID NO: 520017 - RNA, 64 nt, hsa; identical to SEQ ID NO: 124017

SEQ ID NO: 520018 - RNA, 64 nt, hsa; identical to SEQ ID NO: 124018

SEQ ID NO: 520019 - RNA, 64 nt, hsa; identical to SEQ ID NO: 124019

SEQ ID NO: 520020 - RNA, 64 nt, hsa; identical to SEQ ID NO: 124020

SEQ ID NO: 520021 - RNA, 64 nt, hsa; identical to SEQ ID NO: 124021

SEQ ID NO: 520022 - RNA, 64 nt, hsa; identical to SEQ ID NO: 124022

SEQ ID NO: 520023 - RNA, 64 nt, hsa; identical to SEQ ID NO: 124023

SEQ ID NO: 520024 - RNA, 64 nt, hsa; identical to SEQ ID NO: 124024

SEQ ID NO: 520025 - RNA, 64 nt, hsa; identical to SEQ ID NO: 124025

SEQ ID NO: 520026 - RNA, 64 nt, hsa; identical to SEQ ID NO: 124026

SEQ ID NO: 520027 - RNA, 64 nt, hsa; identical to SEQ ID NO: 124027

SEQ ID NO: 520028 - RNA, 64 nt, hsa; identical to SEQ ID NO: 124028

SEQ ID NO: 520029 - RNA, 64 nt, hsa; identical to SEQ ID NO: 70765

SEQ ID NO: 520030 - RNA, 64 nt, hsa; identical to SEQ ID NO: 70766

SEQ ID NO: 520031 - RNA, 64 nt, hsa; identical to SEQ ID NO: 70767

SEQ ID NO: 520032 - RNA, 64 nt, hsa; identical to SEQ ID NO: 70768

SEQ ID NO: 520033 - RNA, 64 nt, hsa; identical to SEQ ID NO: 70769

SEQ ID NO: 520034 - RNA, 64 nt, hsa; identical to SEQ ID NO: 70770

SEQ ID NO: 520035 - RNA, 64 nt, hsa; identical to SEQ ID NO: 70771

SEQ ID NO: 520036 - RNA, 64 nt, hsa; identical to SEQ ID NO: 70772

SEQ ID NO: 520037 - RNA, 64 nt, hsa; identical to SEQ ID NO: 70773

SEQ ID NO: 520038 - RNA, 64 nt, hsa; identical to SEQ ID NO: 70774

SEQ ID NO: 520039 - RNA, 64 nt, hsa; identical to SEQ ID NO: 70775

SEQ ID NO: 520040 - RNA, 64 nt, hsa; identical to SEQ ID NO: 70776

SEQ ID NO: 520041 - RNA, 64 nt, hsa; identical to SEQ ID NO: 70777

SEQ ID NO: 520042 - RNA, 64 nt, hsa; identical to SEQ ID NO: 70778

SEQ ID NO: 520043 - RNA, 64 nt, hsa; identical to SEQ ID NO: 70779

SEQ ID NO: 520044 - RNA, 64 nt, hsa; identical to SEQ ID NO: 70780

SEQ ID NO: 520045 - RNA, 64 nt, hsa; identical to SEQ ID NO: 70781

SEQ ID NO: 520046 - RNA, 64 nt, hsa; identical to SEQ ID NO: 70782

SEQ ID NO: 520047 - RNA, 64 nt, hsa; identical to SEQ ID NO: 70783

SEQ ID NO: 520048 - RNA, 64 nt, hsa; identical to SEQ ID NO: 70784

SEQ ID NO: 520049 - RNA, 64 nt, hsa; identical to SEQ ID NO: 70785

SEQ ID NO: 520050 - RNA, 64 nt, hsa; identical to SEQ ID NO: 70786

SEQ ID NO: 520051 - RNA, 64 nt, hsa; identical to SEQ ID NO: 70787

SEQ ID NO: 520052 - RNA, 64 nt, hsa; identical to SEQ ID NO: 70788

SEQ ID NO: 520053 - RNA, 64 nt, hsa; identical to SEQ ID NO: 70789

SEQ ID NO: 520054 - RNA, 64 nt, hsa; identical to SEQ ID NO: 70790

SEQ ID NO: 520055 - RNA, 64 nt, hsa; identical to SEQ ID NO: 70791

SEQ ID NO: 520056 - RNA, 64 nt, hsa; identical to SEQ ID NO: 70792

SEQ ID NO: 520057 - RNA, 64 nt, hsa; identical to SEQ ID NO: 70793

SEQ ID NO: 520058 - RNA, 64 nt, hsa; identical to SEQ ID NO: 70794

SEQ ID NO: 520059 - RNA, 64 nt, hsa; identical to SEQ ID NO: 70795

SEQ ID NO: 520060 - RNA, 64 nt, hsa; identical to SEQ ID NO: 70796

SEQ ID NO: 520061 - RNA, 64 nt, hsa; identical to SEQ ID NO: 70797

SEQ ID NO: 520062 - RNA, 64 nt, hsa; identical to SEQ ID NO: 70798

SEQ ID NO: 520063 - RNA, 64 nt, hsa; identical to SEQ ID NO: 70799

SEQ ID NO: 520064 - RNA, 64 nt, hsa; identical to SEQ ID NO: 70800

SEQ ID NO: 520065 - RNA, 64 nt, hsa; identical to SEQ ID NO: 70801

SEQ ID NO: 520066 - RNA, 64 nt, hsa; identical to SEQ ID NO: 70802

SEQ ID NO: 520067 - RNA, 64 nt, hsa; identical to SEQ ID NO: 70803

SEQ ID NO: 520068 - RNA, 64 nt, hsa; identical to SEQ ID NO: 70804

SEQ ID NO: 520069 - RNA, 64 nt, hsa; identical to SEQ ID NO: 70805

SEQ ID NO: 520070 - RNA, 64 nt, hsa; identical to SEQ ID NO: 70806

SEQ ID NO: 520071 - RNA, 64 nt, hsa; identical to SEQ ID NO: 70807

SEQ ID NO: 520072 - RNA, 64 nt, hsa; identical to SEQ ID NO: 70808

SEQ ID NO: 520073 - RNA, 64 nt, hsa; identical to SEQ ID NO: 70809

SEQ ID NO: 520074 - RNA, 64 nt, hsa; identical to SEQ ID NO: 70810

SEQ ID NO: 520075 - RNA, 64 nt, hsa; identical to SEQ ID NO: 70811

SEQ ID NO: 520076 - RNA, 64 nt, hsa; identical to SEQ ID NO: 70812

SEQ ID NO: 520077 - RNA, 64 nt, hsa; identical to SEQ ID NO: 70813

SEQ ID NO: 520078 - RNA, 64 nt, hsa; identical to SEQ ID NO: 70814

SEQ ID NO: 520079 - RNA, 64 nt, hsa; identical to SEQ ID NO: 70814

SEQ ID NO: 520080 - RNA, 64 nt, hsa; identical to SEQ ID NO: 70816

SEQ ID NO: 520081 - RNA, 64 nt, hsa; identical to SEQ ID NO: 70817

SEQ ID NO: 520082 - RNA, 64 nt, hsa; identical to SEQ ID NO: 70818

SEQ ID NO: 520083 - RNA, 64 nt, hsa; identical to SEQ ID NO: 70819

SEQ ID NO: 520084 - RNA, 64 nt, hsa; identical to SEQ ID NO: 70820

SEQ ID NO: 520085 - RNA, 64 nt, hsa; identical to SEQ ID NO: 70821

SEQ ID NO: 520086 - RNA, 64 nt, hsa; identical to SEQ ID NO: 70822

SEQ ID NO: 520087 - RNA, 64 nt, hsa; identical to SEQ ID NO: 70823

SEQ ID NO: 520088 - RNA, 64 nt, hsa; identical to SEQ ID NO: 70824

SEQ ID NO: 520089 - RNA, 64 nt, hsa; identical to SEQ ID NO: 70825

SEQ ID NO: 520090 - RNA, 64 nt, hsa; identical to SEQ ID NO: 70826

SEQ ID NO: 520091 - RNA, 64 nt, hsa; identical to SEQ ID NO: 70827

SEQ ID NO: 520092 - RNA, 64 nt, hsa; identical to SEQ ID NO: 70828

SEQ ID NO: 520093 - RNA, 64 nt, hsa; identical to SEQ ID NO: 70829

SEQ ID NO: 520094 - RNA, 64 nt, hsa
auaaauauuuugauuugguuuuacuuuaauuucucauucauaauuucgcaacuguccuuuuggg

SEQ ID NO: 520095 - RNA, 64 nt, hsa
ggcaacuucucuuuaccucaguauaguuaaaaaccauucauauuuuaagugauucauguauacc

SEQ ID NO: 520096 - RNA, 64 nt, hsa
caauacucaagaaucuugcaagacaguuauuaaacauucauagcuugaaauugcccaugguggg

SEQ ID NO: 520097 - RNA, 64 nt, hsa
auaggguuuggcaugcugcucgguacaugguuaacauucauaaauggugggggcccuuacugug

SEQ ID NO: 520098 - RNA, 64 nt, hsa
guugauuccuaagcagaaaauuucggaagaagugcauucauacaaagugagaguaggaagacuc

SEQ ID NO: 520099 - RNA, 64 nt, hsa
ccagucagagagcacaucuaguucaacaucagagcauucauaccaaagagaacucaugaaugua

SEQ ID NO: 520100 - RNA, 64 nt, hsa
gcauguagcucagugguuuccaaauuuggcugcacauucauaccaaucaccaggggauuuuuuu

SEQ ID NO: 520101 - RNA, 64 nt, hsa
ugaaaucuuuguucaucuccacuuugugcuaacccauucauaguuggcaguuaaacacauacuc

SEQ ID NO: 520102 - RNA, 64 nt, hsa
ucgcccccaaaaauacugaagacuaauccauugacauucauaaugggacagcuaaguaccaaau

SEQ ID NO: 520103 - RNA, 64 nt, hsa
aaauuuaacauuccauguaacuuuucugacuuaucauucauaaguugcaaauauuacuauuuuc

SEQ ID NO: 520104 - RNA, 64 nt, hsa
aagaggugacccuguguuuuuugugauauugaggcauucauacagagcugcaguuagacggggu

SEQ ID NO: 520105 - RNA, 64 nt, hsa
ggggagucagcagcacccauuuguacauauaggucauucauacaucacauuuuaaauuggggac

SEQ ID NO: 520106 - RNA, 64 nt, hsa
uguauauauauguauguauauacacacguacauacauucauauauauacauauauacauaaugu

SEQ ID NO: 520107 - RNA, 64 nt, hsa
guucaagaaguauucguacucuagccuuuuuaaucauucauagauagaagucuuuguacccacu

SEQ ID NO: 520108 - RNA, 64 nt, hsa
agaagucuuuguacccacuccuuauguuucuuuucauucauaaacagguguauaaggaacaaug

SEQ ID NO: 520109 - RNA, 64 nt, hsa
guuuaaaggugugauuuguacuccuuguuugucccauucauauaugaaaauagacuuuuaaaac

SEQ ID NO: 520110 - RNA, 64 nt, hsa
ugggugaucauaguuucgagguagaguuuaugaucauucauagcuuugucuagaaggaguaaaa

SEQ ID NO: 520111 - RNA, 64 nt, hsa
caguauuagcaauacuggaauauaggcacauuaccauucauaguaagaauucugguguuuacac

SEQ ID NO: 520112 - RNA, 64 nt, hsa
auaaauauuaggcauaaauuaaaauguaaaacuccauucauaguggauuaaugcauuuugcugc

SEQ ID NO: 520113 - RNA, 64 nt, hsa; identical to SEQ ID NO: 100778

SEQ ID NO: 520114 - RNA, 64 nt, hsa; identical to SEQ ID NO: 100779

SEQ ID NO: 520115 - RNA, 64 nt, hsa; identical to SEQ ID NO: 100780

SEQ ID NO: 520116 - RNA, 64 nt, hsa; identical to SEQ ID NO: 100781

SEQ ID NO: 520117 - RNA, 64 nt, hsa; identical to SEQ ID NO: 100782

SEQ ID NO: 520118 - RNA, 64 nt, hsa; identical to SEQ ID NO: 100783

SEQ ID NO: 520119 - RNA, 64 nt, hsa; identical to SEQ ID NO: 100784

SEQ ID NO: 520120 - RNA, 64 nt, hsa; identical to SEQ ID NO: 100785

SEQ ID NO: 520121 - RNA, 64 nt, hsa; identical to SEQ ID NO: 100786

SEQ ID NO: 520122 - RNA, 64 nt, hsa; identical to SEQ ID NO: 100787

SEQ ID NO: 520123 - RNA, 64 nt, hsa; identical to SEQ ID NO: 100788

SEQ ID NO: 520124 - RNA, 64 nt, hsa; identical to SEQ ID NO: 100789

SEQ ID NO: 520125 - RNA, 64 nt, hsa; identical to SEQ ID NO: 100790

SEQ ID NO: 520126 - RNA, 64 nt, hsa
gaaaggacagcagucaccuccgacaaugcuccguucuauggaauauugauuaacugcauuuugg

SEQ ID NO: 520127 - RNA, 64 nt, hsa
gcauaacuaaacuugucaauuuagaguuuauuuuucuauggauacuauuaaaugucucaaauug

SEQ ID NO: 520128 - RNA, 64 nt, hsa
caagcucucauuauggacugaaacuggagaaaauucuauggaacuauuaucagcucacacaugu

SEQ ID NO: 520129 - RNA, 64 nt, hsa
cuaagaagcucccaugugacaccaaaguugcuggucuauggacaacaguuugaggagcaagguc

SEQ ID NO: 520130 - RNA, 64 nt, hsa
aaaucauggcaauaauagaagauuaugaaggauuucuauggaggacauaaaugcugcaucuuuc

SEQ ID NO: 520131 - RNA, 64 nt, hsa
uuaucauuaaaauuaucauuaaaauugccuuauuucuauggacucagaggaaugauguuuuagu

SEQ ID NO: 520132 - RNA, 64 nt, hsa
cuaucuaacuggcauuuguguuucuugcgaguauuuugaagaaacaggccguugaccccaucuu

SEQ ID NO: 520133 - RNA, 64 nt, hsa
augaaguacaucagccugucuuagccugagcugcuuugaagaccauggggucuuguguuuccaa

SEQ ID NO: 520134 - RNA, 64 nt, hsa
caacagucuauagaguauuagaagauuuuuacauuuugaagaaggggagcaaaucuaaaaaaaa

SEQ ID NO: 520135 - RNA, 64 nt, hsa
agccuuaagaaaaaagaaaaugagcaagcaaauauuugaagaaauguauaaaaccauagauuuc

SEQ ID NO: 520136 - RNA, 64 nt, hsa
cucagacuugguuuugccaaaacucuugguaauuuuugaagauagacugucuuaucaccaagga

SEQ ID NO: 520137 - RNA, 64 nt, hsa
cuucuuuucaucuguaccacacccuggugaaaccuuugaagacauaaaaaaaaccugucugaga

SEQ ID NO: 520138 - RNA, 64 nt, hsa
uguucccuguuaccuuuuuggagaauucauaacauuugaagaucaaaaaauugaaugauaaaua

SEQ ID NO: 520139 - RNA, 64 nt, hsa
gaauugcacuuuuuaauaaauauucuuaacaauuuuugaagaaggauauuuuaucucauuugag

SEQ ID NO: 520140 - RNA, 64 nt, hsa
caggauaugugauacugugugguugguguggaguuuugaagaaggggcuguguuugggccacgu

SEQ ID NO: 520141 - RNA, 64 nt, hsa
uugcaaaauacuuguaucugacacuuaggucuuguuugaagaauuuccuuucuggaagguuuua

SEQ ID NO: 520142 - RNA, 64 nt, hsa
gaagaugguuccauggaagaaaaaggccaaggaguuugaagauuuuucuucuagacaucucaaa

SEQ ID NO: 520143 - RNA, 64 nt, hsa
gugcuuuuuuaacacuuauauauauaauggucuauuugaagagcucacuucaaccuaacagcua

SEQ ID NO: 520144 - RNA, 64 nt, hsa
ugcuguaucguucagucucuuguggcaauagcacuuugaagaaaauagagaauuuaauauaugg

SEQ ID NO: 520145 - RNA, 64 nt, hsa
auuaauuuuggcuggaccaauauaaaaaauuguauuugaagaauugauacuuuaacuuggaccu

SEQ ID NO: 520146 - RNA, 64 nt, hsa
gcaugggggccucagggcagccugccuggaguacuuugaagaugucaucccauugucuucugac

SEQ ID NO: 520147 - RNA, 64 nt, hsa
uuuuggaaaaaaaaagauuuaaaauaauuccugguuugaagaaauaacaaauuaaaagcuauau

SEQ ID NO: 520148 - RNA, 64 nt, hsa
auaaacgguuaacaauauuagguggacauauuuguuugaagagauaggugaaagauaguugaaa

SEQ ID NO: 520149 - RNA, 64 nt, hsa
ugauacuuuuucauucacauucaagaauuaauuuuuugaagauuuaaguuacauaauggaauua

SEQ ID NO: 520150 - RNA, 64 nt, hsa
guuucaauauagaaggaauuagcuauuaaagguauuugaagaaacuauagguauaguggugaau

SEQ ID NO: 520151 - RNA, 64 nt, hsa
aagaguaauuuuucuagauuagaccagucagguuuuugaagacauauagguaacuuccacagaa

SEQ ID NO: 520152 - RNA, 64 nt, hsa
uucugguaaugaucugucucaggguauguguauuuuugaagaguguuauguccuuaguuuuaau

SEQ ID NO: 520153 - RNA, 64 nt, hsa
ggaacgcuuuccuagugcaauuuuaggaguaaaguuugaagagauaaaaauagccaaagauagg

SEQ ID NO: 520154 - RNA, 64 nt, hsa
cacagaacaauguauuagaauuuccagcuguggguuugaagacuuagggggacauccagaacgu

SEQ ID NO: 520155 - RNA, 64 nt, hsa
aaauuucuuauuugaaaaguugaaauuuaugagcuuugaagauugcuaaauuaaauaauuuaua

SEQ ID NO: 520156 - RNA, 64 nt, hsa
gugcuauuugucaguagccauuuuuuugcagugauuugaagaccaaaguuguuuuacagcugug

SEQ ID NO: 520157 - RNA, 64 nt, hsa
auuuucagugacuaauagggauaauccagguaacuuugaagagaugagcagugagugaccaggc

SEQ ID NO: 520158 - RNA, 64 nt, hsa
uuuaccuaaaauggugauuuccagccuuuacugcuuugaagaaacagaauuuguaaagguaugc

SEQ ID NO: 520159 - RNA, 64 nt, hsa
aaaugagccguaagucugcagaauucccuucuacuuugaagagaaggggauaggaauguauauu

SEQ ID NO: 520160 - RNA, 64 nt, hsa
caaaaauugugcuauauaucauugguaaaggaaauuugaagagaugacagugccuaaaaguaca

SEQ ID NO: 520161 - RNA, 64 nt, hsa
uuucagcuaugcaauaugacaaaacauggggaauuuugaagauugucauuuuuucauucgaguc

SEQ ID NO: 520162 - RNA, 64 nt, hsa
aggacagaauuaaccaaggauucuuaauuguuaauuugaagaacacauuaaccagaaagcuuaa

SEQ ID NO: 520163 - RNA, 64 nt, hsa
auagaucuagauauuagcuagugaaaugcuaaauuuugaagaguuuuguguccguaguucugua

SEQ ID NO: 520164 - RNA, 64 nt, hsa
cccucuguauggguuagauuuuccaaaaucauaauuugaagaaggccagcauuuaugguagaau

SEQ ID NO: 520165 - RNA, 64 nt, hsa
uuccaguaguuagcuuucuuccuggauuccucacuuugaagagugugaggaaaaccuauguuug

SEQ ID NO: 520166 - RNA, 64 nt, hsa
caccuugucaagggcucuguuuacaucuauacauuuugaagaugaaauuuuuagccuuaaaguu

SEQ ID NO: 520167 - RNA, 64 nt, hsa
uaggaaacauugacccagaaccugacuuaaugguuuugaagauuuacuaugcaauaggguaacu

SEQ ID NO: 520168 - RNA, 64 nt, hsa
uaaguuuuauaggaauuugcuuccuaagucuacuuuugaagaggaaaacaggaacguaccauau

SEQ ID NO: 520169 - RNA, 64 nt, hsa
ugggaagaaaaagauuaagaaaaagcaagauaauuuugaagaaggacgagaggaagaggcauga

SEQ ID NO: 520170 - RNA, 64 nt, hsa
cacaugaguuaagauugugacugaucaugauuuauuugaagauggagcacugcugauuuaugaa

SEQ ID NO: 520171 - RNA, 64 nt, hsa
ucagacauaaugauuuauuugaaggcuuguuuuauuugaagaaaagcauauugccaaaaauucu

SEQ ID NO: 520172 - RNA, 64 nt, hsa
agaaauuuuguuucauauuaggaauaaaguuuauuuugaagaaagauauuguuucuuuagucuc

SEQ ID NO: 520173 - RNA, 64 nt, hsa
gggucuggagcugcuacagcauggccaggccugguuugaagaccaucugagggaggcacagcga

SEQ ID NO: 520174 - RNA, 64 nt, hsa
gaucuucagccacaugcuguccuugaagcagcuauuugaagauguguuuucugaggaaaacagg

SEQ ID NO: 520175 - RNA, 64 nt, hsa
aaccauuagcaugcuaguuguccuaauggaaauuuuugaagaguuuuucaauauauacccuacc

SEQ ID NO: 520176 - RNA, 64 nt, hsa
auucauuauagcagaacuuuaaauuucccagcuuuuugaagauuuaagcuacacuauuaguacu

SEQ ID NO: 520177 - RNA, 64 nt, hsa
ccaugccagagaauaaacucuuucaagcaucaucuuugaagagucguguggugugaauugguuu

SEQ ID NO: 520178 - RNA, 64 nt, hsa
uaaaacuuucacaugcaaccaauguauaucugaguuugaagauguuuauauaggguauuuuuuc

SEQ ID NO: 520179 - RNA, 64 nt, hsa
aggaugacuggauacuuuuugaaaucugacuuucuuugaagauguauguuaagcaaaaacaugu

SEQ ID NO: 520180 - RNA, 64 nt, hsa
uaaucccacuuuacaaagaauauaaaagcuauauuuugaagacuugaguuauuucagaaaaaac

SEQ ID NO: 520181 - RNA, 64 nt, hsa
gagccuccccuaggagcacgucuugcuacccucuuuugaagauguucucuagccuuccaccagc

SEQ ID NO: 520182 - RNA, 64 nt, hsa
agcaugagaauggacuaauacacuccucaaauguuuugaagauuguugcaccuuggaacuacca

SEQ ID NO: 520183 - RNA, 64 nt, hsa
agaaagacaaucucggcaugcauuauuucuuuguuuugaagauucacucauguugcaugcaucu

SEQ ID NO: 520184 - RNA, 64 nt, hsa
acauaagugggaaccaaagaaaaaaugugacaaguuugaagacacagaaagagucaucugaugu

SEQ ID NO: 520185 - RNA, 64 nt, hsa
cucaauuuuccuuugagggaacccucccccacccuuugaagaguucaaguucuguacagguuuu

SEQ ID NO: 520186 - RNA, 64 nt, hsa
uggaaugaagugugaucagccacuuguggaauucuuugaagagcucagaggcuuccaagugauc

SEQ ID NO: 520187 - RNA, 64 nt, hsa
ucagaggcuuccaagugaucugcuccugaacaaguuugaagaccuauuguuucauagacccaag

SEQ ID NO: 520188 - RNA, 64 nt, hsa
uguguuugcuuacucuugaucaagugugagacaguuugaagacugugcuaccauacaaagugaa

SEQ ID NO: 520189 - RNA, 64 nt, hsa
uaagaaguauuaauuuuuuaaaagacaaaucaacuuugaagacacaaaaguuaauuggaagaaa

SEQ ID NO: 520190 - RNA, 64 nt, hsa
ugauaaaacaaaaacaaaaguauguuuuaaaugcuuugaagacugauacacucaaccaucuaua

SEQ ID NO: 520191 - RNA, 64 nt, hsa
ucuuuuguuuuuuuauauccaagaaaaugauaacuuugaagaugcccaguucacucuaguuuca

SEQ ID NO: 520192 - RNA, 64 nt, hsa
ccaaauuguuuuguggaaauagauguguuugcaauuugaagauaucuuucuguccagaaggcaa

SEQ ID NO: 520193 - RNA, 64 nt, hsa
aguuacaucuuaauuccauccaaagaagauacaguuugaagacagaaguguacucucuacaaug

SEQ ID NO: 520194 - RNA, 64 nt, hsa
aaucguuuaaauucucuuuccuaauuuucuuucuuuugaagauagauucuuucaacaaguaauu

SEQ ID NO: 520195 - RNA, 64 nt, hsa
aauuuggaaugaaguaagguucuguuaaaauauauuugaagacccuuuaaagcagugaaucuga

SEQ ID NO: 520196 - RNA, 64 nt, hsa
ggccuugccagccucugcugcuccugcuccuggguuugaagaugcaggccgaucgccagcuccg

SEQ ID NO: 520197 - RNA, 64 nt, hsa
uucuucagcuguggguccuaaaggccuuugauccuuugaagaagaaagacaugguauuuguuca

SEQ ID NO: 520198 - RNA, 64 nt, hsa
acuguuuugauuuuuggauuuucuuaauucaacauuugaagaugugccuuuuggguaauguuaa

SEQ ID NO: 520199 - RNA, 64 nt, hsa
cuuccugaccacucuuauaaaaagcucacaaaccuuugaagaaacuggaguaggcuguuauuuc

SEQ ID NO: 520200 - RNA, 64 nt, hsa
gaaagucuagaaugggucccuggugccuuuuuacuuugaagaaaucaguuucugccucuuuuug

SEQ ID NO: 520201 - RNA, 64 nt, hsa
gcaaccuggcuaagauagaggggcucugggagacuuugaagaccaguccuguuugcagggaagc

SEQ ID NO: 520202 - RNA, 64 nt, hsa
uguuggguguuaugaauucuuugaagaaauauauuuugaagaggugugggaggaaggaauacau

SEQ ID NO: 520203 - RNA, 64 nt, hsa
cuguggaucucuacuuguuggguguuaugaauucuuugaagaaauauauuuugaagaggugugg

SEQ ID NO: 520204 - RNA, 64 nt, hsa
ccuguuuaaauggccccuguuugaacucucaagcuuugaagaccuaccuguucuuccagaagag

SEQ ID NO: 520205 - RNA, 61 nt, hsa
aaagcaacaauaugguauaacaacaagugaauuugaagacucauuuaaaauauuguguuau

SEQ ID NO: 520206 - RNA, 64 nt, hsa
acucauuuaaaauauuguguuauuuauaaagucauuugaagaauauucagcacaaaauuaaauu

SEQ ID NO: 520207 - RNA, 64 nt, hsa
aguacauauuuugaagaauuucuauaguacauauuuugaagaauuuuuauaucaaauauaccgu

SEQ ID NO: 520208 - RNA, 64 nt, hsa
uuagauucacaaacuuuguauuuuuaguacauauuuugaagaauuucuauaguacauauuuuga

SEQ ID NO: 520209 - RNA, 64 nt, hsa
auacauacacucacucugucugguauaggcuaauuuugaagaacucccauaaguuucugcugcu

SEQ ID NO: 520210 - RNA, 64 nt, hsa
gucagucuuugaaaaaagaacguauuuuuugugcuuugaagaucucugaagaauuucuuuuaua

SEQ ID NO: 520211 - RNA, 64 nt, hsa
auccauauaacaauucaguaacaaagguuuaaaguuugaagauuauuuuuuaaaaagguaaaug

SEQ ID NO: 520212 - RNA, 64 nt, hsa
uacugcccacuugucaaguucagcccaccaucuguuugaagauuauaugaaguuuaaauucuag

SEQ ID NO: 520213 - RNA, 64 nt, hsa
guucuucauucugacuguugaggggagguuuuccuuugaagaguuuucaucccagacucagcug

SEQ ID NO: 520214 - RNA, 64 nt, hsa
accaggaaguugaguuuucaagaugccuuguugcuuugaagaagggagugaugucaauucucuu

SEQ ID NO: 520215 - RNA, 64 nt, hsa
cucuagagaaaaccaauauaugguggugcugggcuuugaagauagcauaucagacgccuugguu

SEQ ID NO: 520216 - RNA, 64 nt, hsa
uagucuccauaacccccaaaguacugcuuauuuguuugaagaauccagccaucguagugcuuua

SEQ ID NO: 520217 - RNA, 64 nt, hsa
uuucaagauaaguguaauuuuguuacaaguuuauuuugaagagacaaaucuccugugaucuaug

SEQ ID NO: 520218 - RNA, 64 nt, hsa
aauguggaaaaaguaagaggacuacucagcacuguuugaagauugccucuucuacagcuucuga

SEQ ID NO: 520219 - RNA, 64 nt, hsa
uaauuccuuacuuuggcuauggguggagggugaguuugaagagguucugauuuucuuguaaccu

SEQ ID NO: 520220 - RNA, 64 nt, hsa
ugguuuucuuagcuuuugaauuugaagaaguacuuuugaagacucccauuuuaagaaccgugca

SEQ ID NO: 520221 - RNA, 64 nt, hsa
aacuguucccucuuugguuuucuuagcuuuugaauuugaagaaguacuuuugaagacucccauu

SEQ ID NO: 520222 - RNA, 64 nt, hsa
cuccaucaucuuccgcgcaggugccaacccagccuuugaagaggcuguggggucugugaucacc

SEQ ID NO: 520223 - RNA, 64 nt, hsa
ggacaucuuaggcuggccagacuucagcuguuccuuugaagaaaaagacacagacaaagugaca

SEQ ID NO: 520224 - RNA, 64 nt, hsa
ucagcggaugggcggaauggucucuuuucggacuuuugaagauuuugucagguaagacauugug

SEQ ID NO: 520225 - RNA, 64 nt, hsa
ugggguaucucccuggggugauucucccauugauuuugaagauucugcacacguuccuugucca

SEQ ID NO: 520226 - RNA, 64 nt, hsa
cuggcugaagauuauacuuucaauucagagcgaguuugaagaugacacuuugaggcaucguguc

SEQ ID NO: 520227 - RNA, 64 nt, hsa
agauuucagccccauccccaaugaagagcuugaguuugaagauuauacuuuuuuugagacaggg

SEQ ID NO: 520228 - RNA, 64 nt, hsa
auauaacaguuugauuucugucauacccauuguauuugaagauauauggauacagauuauauau

SEQ ID NO: 520229 - RNA, 64 nt, hsa
ucuguuugguuagagaauaaaauugguaauugcauuugaagaauguguuaaugucauaauaaag

SEQ ID NO: 520230 - RNA, 64 nt, hsa
gccaauaugcaacugaucccgcuuuuauuaauuuuuugaagaaguacacagaauuuuuacagaa

SEQ ID NO: 520231 - RNA, 64 nt, hsa
uggcaaaagagaaucaccauuaaagauugacccauuugaagaucugucauuuaaucugcuugcu

SEQ ID NO: 520232 - RNA, 64 nt, hsa
gcuucccaaacggguucuagacuuggguguuugauuugaagaguuacgcauuuauuucacuauu

SEQ ID NO: 520233 - RNA, 64 nt, hsa
cuuuuuaaaaagggagugacuuucaugaagucaguuugaagaaggagguugggagcauguuggu

SEQ ID NO: 520234 - RNA, 64 nt, hsa
uuuucaagggauaaggccuucuguacuuugcuuauuugaagaaucagugguaggagcagugaag

SEQ ID NO: 520235 - RNA, 64 nt, hsa
accucugaccuucucaucaagagagcuggggugcuuugaagauaaucccuaccccucuccccca

SEQ ID NO: 520236 - RNA, 64 nt, hsa
aaggucacagugauguggagucgccgcacccaucuuugaagauagccagugucccuggaugagg

SEQ ID NO: 520237 - RNA, 64 nt, hsa
auuccccccgccaccuguacucacccucacgcucuuugaagaaaaaaaaaaaaaucaccuugug

SEQ ID NO: 520238 - RNA, 64 nt, hsa
cuguccauacuuaaagaccaaaucauuuguuugcuuugaagaaaaagcaaaaacaagaacaaaa

SEQ ID NO: 520239 - RNA, 64 nt, hsa
aaaaaaaaaaaaaagaaggcaauggcuuugugcuuuugaagauggauugaagagaacguccacc

SEQ ID NO: 520240 - RNA, 64 nt, hsa
gccauguuuggggcuuuauuuuauaaguuagaacuuugaagaggaaauggugcuauauguuuau

SEQ ID NO: 520241 - RNA, 64 nt, hsa
acaucucuauaugaagauaccuguguccaaaauuuuugaagauauauauuguauguguuuauuc

SEQ ID NO: 520242 - RNA, 64 nt, hsa; identical to SEQ ID NO: 315524

SEQ ID NO: 520243 - RNA, 64 nt, hsa; identical to SEQ ID NO: 315525

SEQ ID NO: 520244 - RNA, 64 nt, hsa; identical to SEQ ID NO: 315526

SEQ ID NO: 520245 - RNA, 64 nt, hsa; identical to SEQ ID NO: 315527

SEQ ID NO: 520246 - RNA, 64 nt, hsa; identical to SEQ ID NO: 315528

SEQ ID NO: 520247 - RNA, 64 nt, hsa; identical to SEQ ID NO: 315529

SEQ ID NO: 520248 - RNA, 64 nt, hsa; identical to SEQ ID NO: 315530

SEQ ID NO: 520249 - RNA, 64 nt, hsa; identical to SEQ ID NO: 315531

SEQ ID NO: 520250 - RNA, 64 nt, hsa; identical to SEQ ID NO: 315532

SEQ ID NO: 520251 - RNA, 64 nt, hsa; identical to SEQ ID NO: 315533

SEQ ID NO: 520252 - RNA, 64 nt, hsa; identical to SEQ ID NO: 315534

SEQ ID NO: 520253 - RNA, 64 nt, hsa; identical to SEQ ID NO: 315535

SEQ ID NO: 520254 - RNA, 64 nt, hsa; identical to SEQ ID NO: 315536

SEQ ID NO: 520255 - RNA, 64 nt, hsa; identical to SEQ ID NO: 315537

SEQ ID NO: 520256 - RNA, 64 nt, hsa; identical to SEQ ID NO: 315538

SEQ ID NO: 520257 - RNA, 64 nt, hsa; identical to SEQ ID NO: 315539

SEQ ID NO: 520258 - RNA, 64 nt, hsa
ugaguuauuauaaaaauugguuaauuguauaggaagaugacaguauuuuuuucaaguuaucaua

SEQ ID NO: 520259 - RNA, 64 nt, hsa
aguauuuuuuucaaguuaucauaaaaaguaauucagaugacauuugagaaguaggggaaaggga

SEQ ID NO: 520260 - RNA, 64 nt, hsa
uggcugggacaguuacugguucauaugcaaguaaagaugacaauuuacucaacaaauauuuauc

SEQ ID NO: 520261 - RNA, 64 nt, hsa
cacuacucacaccgugguccugggccagggccugagaugacaguggggagcaccauccucauua

SEQ ID NO: 520262 - RNA, 64 nt, hsa
gauaggagagaaauaaaagauuugauauuuuuugagaugacacucaagcaucaggcugagauuu

SEQ ID NO: 520263 - RNA, 64 nt, hsa
uuugcauuuugccaucugaaguucauuaaucuuuagaugacaaaaaagcaaaaaguucccagaa

SEQ ID NO: 520264 - RNA, 64 nt, hsa
aaagcucuagggguuucagaaagcuuugaugaacagaugacaaacaucugaaacccccuccgca

SEQ ID NO: 520265 - RNA, 64 nt, hsa
acucuucacuuccucagccuacaaauagcucauuagaugacauucacgcaugcuggguauaggc

SEQ ID NO: 520266 - RNA, 64 nt, hsa
auaaggaaacguaauuaugauugauuuuuuccaaagaugacaagcuguguugaaauacauuuuu

SEQ ID NO: 520267 - RNA, 64 nt, hsa
uagaggggcauucacaaggcacaccagugcaagcagaugacaaaaaggugcagaaggcaaucuu

SEQ ID NO: 520268 - RNA, 64 nt, hsa
cuauuuaaaggcacuauuauaaauuuauccuauaagaugacaauguuuacucaaagucuaacau

SEQ ID NO: 520269 - RNA, 64 nt, hsa
cgucugucccaaacucccccagcccugagcugggagaugacagggggaaagaggcccucucaag

SEQ ID NO: 520270 - RNA, 64 nt, hsa
gcuccuccccggagucccccagcacagucccaggagaugacaggaaggaagcaccagggcaagg

SEQ ID NO: 520271 - RNA, 64 nt, hsa
ggauguggguaaacuaagguaaaggggaugauauuccacaaacuaauuaugcacacagaaaauc

SEQ ID NO: 520272 - RNA, 64 nt, hsa
ucucuuuucuuacucuggcaaaccugugagugauuccacaaagauacaguauuacuuagcuauc

SEQ ID NO: 520273 - RNA, 64 nt, hsa
gucaguaagugaaacauuuuuuugugguggcuuauccacaaacaguuuaguuguagaauaaaac

SEQ ID NO: 520274 - RNA, 64 nt, hsa
uucccaguaaaugaggcaagcaauucuaagaucuuccacaaaacaucuagccaacuaaaaugga

SEQ ID NO: 520275 - RNA, 64 nt, hsa
ucuuuggacuacguucuuggcuccagaccuggaauccacaaaagccaaaccagcucauuucaac

SEQ ID NO: 520276 - RNA, 64 nt, hsa
cugcauuccaaacagcauccuaccuggguuuuuauccacaaagguagcggccacaugguuuuua

SEQ ID NO: 520277 - RNA, 64 nt, hsa
cuagcuaacuccaagagaucguuagcagcaucaguccacaaacacuuaguggcccacaauauau

SEQ ID NO: 520278 - RNA, 64 nt, hsa
uugaaaccuuuuaaggaugccaagaaugcauuauuccacaaaaaaacagcagaccaacauauag

SEQ ID NO: 520279 - RNA, 64 nt, hsa
acaaauguaaagaauguggcaaaccuuuggaugauccacaaaccuuaaugaacaugagaaaauu

SEQ ID NO: 520280 - RNA, 64 nt, hsa
caaaugugaagaauauggcaaagccugugaaugguccacaaaccugaaugagcagaagaaaauu

SEQ ID NO: 520281 - RNA, 64 nt, hsa
caaaugugaaaaacguggcagagccuucagaccauccacaaaccuuuaugaaaauucauauuug

SEQ ID NO: 520282 - RNA, 64 nt, hsa
uaugaaaauucauauuugagaguagaagauucauuccacaaacuuacauugagaagauaugaaa

SEQ ID NO: 520283 - RNA, 64 nt, hsa
uuuaaaguguaaaaucauuuuuuaaaaucuugaauccacaaauaaaguucuauucugauuuuaa

SEQ ID NO: 520284 - RNA, 64 nt, hsa
uaguuagaagaauuccuucuucaaacauuaaagauccacaaagcaguauuucuaaauaugccuu

SEQ ID NO: 520285 - RNA, 64 nt, hsa
acuacaaauucuugugaguccuaauuccuccuuauccacaaaacagucaauguucccguggagu

SEQ ID NO: 520286 - RNA, 64 nt, hsa
uagucauuuggucaaaccaaugacaaaaccgccuuccacaaaaguugaaauaagaaacaagagu

SEQ ID NO: 520287 - RNA, 64 nt, hsa
gauucuacauauucuuuaaauuucaucucaggccucccucaaccccaccacuucuuuuauaacu

SEQ ID NO: 520288 - RNA, 64 nt, hsa
caguuccuucagcuuccauuucgccccucauuuaucccucaacccccagcccacagguguuuau

SEQ ID NO: 520289 - RNA, 64 nt, hsa
uugcugcucccucaaccuuccugcugucuuccccucccucaaccccaauaggaggaucccagga

SEQ ID NO: 520290 - RNA, 64 nt, hsa
uaaaguuaaucucuuggucuggccaaguugcugcucccucaaccuuccugcugucuuccccucc

SEQ ID NO: 520291 - RNA, 64 nt, hsa
agacagagugggggucuccaucuguuuucucuucucccucaaauacaggcuguuuucaucgugu

SEQ ID NO: 520292 - RNA, 64 nt, hsa
acuaauauuauauguuacaauaagccuccauuagucccucaaaacgaugauauaaauaagucug

SEQ ID NO: 520293 - RNA, 64 nt, hsa
cacuuugccuacuguuagguuccugggguacgggucccucaaacacaagucuugaaucaguccu

SEQ ID NO: 520294 - RNA, 64 nt, hsa
gcaagugauuggguaacccggccccucuggcccuucccucaagcccagugaggaggugggugga

SEQ ID NO: 520295 - RNA, 64 nt, hsa
cgucacuuuauuucauucgggccccaccugcagcucccucaaagaggcaguugcccagccucuu

SEQ ID NO: 520296 - RNA, 64 nt, hsa
ugagagcaaacuggcuugaauuggugacauuuagucccucaagccaccagaugugacaguguug

SEQ ID NO: 520297 - RNA, 64 nt, hsa; identical to SEQ ID NO: 64767

SEQ ID NO: 520298 - RNA, 64 nt, hsa; identical to SEQ ID NO: 64768

SEQ ID NO: 520299 - RNA, 64 nt, hsa; identical to SEQ ID NO: 64769

SEQ ID NO: 520300 - RNA, 64 nt, hsa; identical to SEQ ID NO: 64770

SEQ ID NO: 520301 - RNA, 64 nt, hsa; identical to SEQ ID NO: 64771

SEQ ID NO: 520302 - RNA, 64 nt, hsa; identical to SEQ ID NO: 64772

SEQ ID NO: 520303 - RNA, 64 nt, hsa; identical to SEQ ID NO: 64773

SEQ ID NO: 520304 - RNA, 64 nt, hsa; identical to SEQ ID NO: 64774

SEQ ID NO: 520305 - RNA, 64 nt, hsa; identical to SEQ ID NO: 64775

SEQ ID NO: 520306 - RNA, 64 nt, hsa; identical to SEQ ID NO: 64776

SEQ ID NO: 520307 - RNA, 64 nt, hsa; identical to SEQ ID NO: 64777

SEQ ID NO: 520308 - RNA, 64 nt, hsa; identical to SEQ ID NO: 64778

SEQ ID NO: 520309 - RNA, 64 nt, hsa; identical to SEQ ID NO: 64779

SEQ ID NO: 520310 - RNA, 64 nt, hsa; identical to SEQ ID NO: 64780

SEQ ID NO: 520311 - RNA, 64 nt, hsa; identical to SEQ ID NO: 64781

SEQ ID NO: 520312 - RNA, 64 nt, hsa; identical to SEQ ID NO: 64782

SEQ ID NO: 520313 - RNA, 64 nt, hsa; identical to SEQ ID NO: 64783

SEQ ID NO: 520314 - RNA, 64 nt, hsa; identical to SEQ ID NO: 64784

SEQ ID NO: 520315 - RNA, 64 nt, hsa; identical to SEQ ID NO: 64785

SEQ ID NO: 520316 - RNA, 64 nt, hsa; identical to SEQ ID NO: 64786

SEQ ID NO: 520317 - RNA, 64 nt, hsa; identical to SEQ ID NO: 64787

SEQ ID NO: 520318 - RNA, 64 nt, hsa; identical to SEQ ID NO: 64788

SEQ ID NO: 520319 - RNA, 64 nt, hsa; identical to SEQ ID NO: 64789

SEQ ID NO: 520320 - RNA, 64 nt, hsa; identical to SEQ ID NO: 64790

SEQ ID NO: 520321 - RNA, 64 nt, hsa; identical to SEQ ID NO: 64791

SEQ ID NO: 520322 - RNA, 64 nt, hsa; identical to SEQ ID NO: 64792

SEQ ID NO: 520323 - RNA, 64 nt, hsa; identical to SEQ ID NO: 64793

SEQ ID NO: 520324 - RNA, 64 nt, hsa; identical to SEQ ID NO: 64794

SEQ ID NO: 520325 - RNA, 64 nt, hsa; identical to SEQ ID NO: 64795

SEQ ID NO: 520326 - RNA, 64 nt, hsa; identical to SEQ ID NO: 64796

SEQ ID NO: 520327 - RNA, 64 nt, hsa; identical to SEQ ID NO: 64797

SEQ ID NO: 520328 - RNA, 64 nt, hsa; identical to SEQ ID NO: 64798

SEQ ID NO: 520329 - RNA, 64 nt, hsa; identical to SEQ ID NO: 64799

SEQ ID NO: 520330 - RNA, 64 nt, hsa; identical to SEQ ID NO: 64800

SEQ ID NO: 520331 - RNA, 64 nt, hsa; identical to SEQ ID NO: 64801

SEQ ID NO: 520332 - RNA, 64 nt, hsa; identical to SEQ ID NO: 64802

SEQ ID NO: 520333 - RNA, 64 nt, hsa; identical to SEQ ID NO: 64803

SEQ ID NO: 520334 - RNA, 64 nt, hsa; identical to SEQ ID NO: 412069

SEQ ID NO: 520335 - RNA, 64 nt, hsa; identical to SEQ ID NO: 412070

SEQ ID NO: 520336 - RNA, 64 nt, hsa
gccagugcagucugauuucuuuugcuuuugucaguaauggaaucuuuuguuuuuaaaauguaca

SEQ ID NO: 520337 - RNA, 64 nt, hsa
augguagacaguucaugcaguauaugaauugccauaauggaaauaaucugauuuuauuuuuaca

SEQ ID NO: 520338 - RNA, 64 nt, hsa
uuacaaauuacuagugcuauuuucauuauuauuguaauggaaaaaucuguggacuagaauaaaa

SEQ ID NO: 520339 - RNA, 64 nt, hsa
ucacagaaaaauaggcacuuugggccaaaagcucuaauggaacauuuuuaguggugauuugggg

SEQ ID NO: 520340 - RNA, 64 nt, hsa
uuuuaucuaauuauuuugguuguuaauauggugauaauggaaagucaaguuaaauuuuaaauau

SEQ ID NO: 520341 - RNA, 64 nt, hsa
ccuuuagauaaucaguaugaaaaguucccauuuauaauggaaaugaaaauucuuaacuaaacua

SEQ ID NO: 520342 - RNA, 64 nt, hsa
aaucauagcuuacagaugguauaacuguauuauauaauggaauuuucuuuaggugugggaaaac

SEQ ID NO: 520343 - RNA, 64 nt, hsa
uuacauauugcuuaucacuuuuucuccauuuuaauaauggaaugaacuaaaauaaacaagaaca

SEQ ID NO: 520344 - RNA, 64 nt, hsa
uauaucgaccagaauguugugauuuaaagagaacuaauggaaguggauugaauacagcagucuc

SEQ ID NO: 520345 - RNA, 64 nt, hsa
uuucugaccuuguaccucucuuugaugguaaccauaauggaagagauucuggcuagugucuauc

SEQ ID NO: 520346 - RNA, 64 nt, hsa
augggaggaaagggacuauaaaaguguacaauguuaauggaaugauacgguaccugaaagccuu

SEQ ID NO: 520347 - RNA, 64 nt, hsa
ucuuuguuuagcaaacucacuggaaaugaacacuuaauggaauuuuuaagucuguucuguuagg

SEQ ID NO: 520348 - RNA, 64 nt, hsa
cgcaguaauguucugcacaacaguauuguaauuguaauggaaucauaaccugcuaacuaguuug

SEQ ID NO: 520349 - RNA, 64 nt, hsa
ccacccaaugaaugaugaugguauaguaugugcauaauggaaaguuaccuuacugaaaaaaaaa

SEQ ID NO: 520350 - RNA, 64 nt, hsa
acaacuauuuuuuuaauauuagccuucuagucuguaauggaaauuguauauuuugauagaaguu

SEQ ID NO: 520351 - RNA, 64 nt, hsa
aaauuaauaggggaaauggcacuuaauagagguuuaauggaaugaaguacuuucaacccauuga

SEQ ID NO: 520352 - RNA, 64 nt, hsa
gucucccugagccuguaguuggaagugacgacuguaauggaaugaugucuuguauagaaaugcc

SEQ ID NO: 520353 - RNA, 64 nt, hsa
agcaagggcuccagcauccagccuguguguucuguaauggaacugacccccuccccugaaaacg

SEQ ID NO: 520354 - RNA, 64 nt, hsa
gugaggaguggauaaggggugguccucaccuuccuaauggaagcugggccuagggaggcccauc

SEQ ID NO: 520355 - RNA, 64 nt, hsa
cuucagcauguaucuguagaaauaacuuuuuaguuaauggaagaauucaccaauuuuaaaguuu

SEQ ID NO: 520356 - RNA, 64 nt, hsa
aaugucaguuacauucagcagaaaaagugacauuuaauggaaagcaaaacaaaucagguccuga

SEQ ID NO: 520357 - RNA, 64 nt, hsa
auguaguuggguggauuuugggguggccauauaguaauggaaagcugcaauaauuaguuuuaau

SEQ ID NO: 520358 - RNA, 64 nt, hsa
ucuuaguuaauaauacaguaggccuuuuguuuauuaauggaagaguacuccccacaccuaagac

SEQ ID NO: 520359 - RNA, 64 nt, hsa
aaaauuagaugcagagaauucagagauuucuucuuaauggaaguaauaagcuguaagaauugag

SEQ ID NO: 520360 - RNA, 56 nt, hsa
gcaauucuaggggcuuauagcuccaauaauggaauggugagugauuagagaaaccc

SEQ ID NO: 520361 - RNA, 64 nt, hsa
cccugacuguaaguggugggagagggagggggguuaauggaacugggucugggauuauuuuaaa

SEQ ID NO: 520362 - RNA, 64 nt, hsa
caggcccgagcuggcagaagagacuuagagaugcuaauggaauuuaaacugaaaaaaggagccc

SEQ ID NO: 520363 - RNA, 64 nt, hsa
agugcuguuugagggauuuuauuaaaucuuuuuuuaauggaaugugguacaaauuguucauguu

SEQ ID NO: 520364 - RNA, 64 nt, hsa
caucuggguuggucuguggauuuuuaauauuuuuuaauggaacaugaaaaccuccacagcaaca

SEQ ID NO: 520365 - RNA, 64 nt, hsa
uuuccaggucauuuuuuuuugugguaagaauaacuaauggaaaauaaugaaacacccugggguu

SEQ ID NO: 520366 - RNA, 64 nt, hsa
acaacuuuguuccuuccuccuagaacuuacauuuuaauggaaauagacaaaacacaucuucuua

SEQ ID NO: 520367 - RNA, 64 nt, hsa
uaaaaauuaguugaaaaaaaaaauauuguuuccuuaauggaauucucacuucauuugaauauaa

SEQ ID NO: 520368 - RNA, 64 nt, hsa
aguuuuuuuuuguuuuaaggcaaacuuaaaauuuuaauggaaacauuucauaugaagccaaguc

SEQ ID NO: 520369 - RNA, 64 nt, hsa
auguggcuaggcgaggagcuggaguggcuguucuuaauggaaaacuguuuguaugugguggcuu

SEQ ID NO: 520370 - RNA, 64 nt, hsa
uaauaacgcaugggaauucuguacguuaucacuguaauggaauauccaauuuacagauaguaug

SEQ ID NO: 520371 - RNA, 64 nt, hsa
auguaagacucgggauuaguacacacuuguugauuaauggaaauguuuacagauccccaagccu

SEQ ID NO: 520372 - RNA, 64 nt, hsa
gucugcuuucauuccgugugcuuccugucacagguaauggaaaacauaaguagaauaggugacc

SEQ ID NO: 520373 - RNA, 64 nt, hsa
ugaacuguacuuaaauugcagagaaaccuguaaguaauggaagguaaagaaaaauuacagaaug

SEQ ID NO: 520374 - RNA, 64 nt, hsa
ugaaguugauauagucucauuuuuaauuguccuguaauggaacaguagcaaauucacuaaacuu

SEQ ID NO: 520375 - RNA, 64 nt, hsa
cuaccuacuuuuaagucuaauuuuacagauagaauaauggaaauugaaaauuuaacccuuuauu

SEQ ID NO: 520376 - RNA, 64 nt, hsa
aaucagaaguugcaaaagaugguauagccgaauauaauggaaauaggaaaaauuagucgaaaau

SEQ ID NO: 520377 - RNA, 64 nt, hsa
aaaagaucaauuuggcacuuuuuuucauuuuuuuuaauggaaauaagauuuggucucucauuuu

SEQ ID NO: 520378 - RNA, 64 nt, hsa
acuucauacauuuauauauguaaauauggcuuauuaauggaauguuaaauaaaauguauacuuc

SEQ ID NO: 520379 - RNA, 64 nt, hsa
cauuuaucggcauuguccaaaauauuuuauucuuuaauggaaaaagccauuaauauucaaauga

SEQ ID NO: 520380 - RNA, 64 nt, hsa
ggcggccauggauuugcccuugauucuauuuugcuaauggaagauagaaaggagagaagguuuu

SEQ ID NO: 520381 - RNA, 64 nt, hsa
acucuuacugagauacccucucaccccaaauguguaauggaaaauuuuuaauuaagaaaaacuu

SEQ ID NO: 520382 - RNA, 64 nt, hsa
guauaauuuauagaauuucagugcaguucauucuuaauggaaaaucugaaaccuaaauugcaga

SEQ ID NO: 520383 - RNA, 60 nt, hsa
gaauaaaaguuacuacgugaaaaaucccaguaauggaaugaagguaauauugauaagcua

SEQ ID NO: 520384 - RNA, 64 nt, hsa
agacuugaauauuuggcugauauuuucuggaaauuaauggaaugagccucucaccucaagggaa

SEQ ID NO: 520385 - RNA, 64 nt, hsa
gcacucaguucuuggcugccguccuguggcagcuuaauggaacaaaaauuacagacuuugguga

SEQ ID NO: 520386 - RNA, 64 nt, hsa
aaugauuacuuagaucaauuauuuagcaguggacuaauggaagcuacagagcagggaagggaag

SEQ ID NO: 520387 - RNA, 64 nt, hsa
uauaauuugauauucauagaguugugccuaccuuuaauggaaaaauacaugucagauacuuaga

SEQ ID NO: 520388 - RNA, 64 nt, hsa
gacauauuaauaaacaauaaagacuuuaccugucuaauggaaaaccuggagaagucgucaggaa

SEQ ID NO: 520389 - RNA, 64 nt, hsa
uaccuuucuguucaucaccacacagcagaauuucuaauggaaguuuguugugaauguaaaggag

SEQ ID NO: 520390 - RNA, 64 nt, hsa
uguguguaguucuuucaaguuguaggaaacauuuuaauggaauuuaaacucaaaaacuugaaua

SEQ ID NO: 520391 - RNA, 64 nt, hsa
uauuugguuuaaaaaaauuauugcaaucucaaguuaauggaauauuuuuaaaucccacauucag

SEQ ID NO: 520392 - RNA, 64 nt, hsa
uuuagcaaauauauuuuuauauguguauggcauauaauggaaauaauucuuugagcaacagaag

SEQ ID NO: 520393 - RNA, 64 nt, hsa
aaaauaagggauagcuuugcaaccacuauuguuuuaauggaaagcaaaaaacccccccaaacuu

SEQ ID NO: 520394 - RNA, 64 nt, hsa
ggcuuuucaguucuguggcuguuuagacuguccguaauggaaugguaaaacuccaugaauuugc

SEQ ID NO: 520395 - RNA, 64 nt, hsa
aucauuaguaaaugagucuguaguuacuaaacccuaauggaauaauuauuaaugaaagauuuuu

SEQ ID NO: 520396 - RNA, 64 nt, hsa
auugauaugauuauucuuugcuagccucucuuacuaauggaauuauauacuggccaguaaaaug

SEQ ID NO: 520397 - RNA, 64 nt, hsa
uuuggauuacugcugucugagcacuagaaauuucuaauggaaagaggccucugaauggcuaagg

SEQ ID NO: 520398 - RNA, 64 nt, hsa
aaguuaguuugcuuuaagcagguaacuuuuuuuguaauggaagaaaugcacuacaaaguuaaga

SEQ ID NO: 520399 - RNA, 64 nt, hsa
aacaagcagauuuuaaauuuugaaguaaucaaaauaauggaaagugucuguuuugugguguaua

SEQ ID NO: 520400 - RNA, 64 nt, hsa
agguacaggcgggaaacugaauaauaagaagucauaauggaaucaaggugaagcuuuuuauaaa

SEQ ID NO: 520401 - RNA, 64 nt, hsa
ggcagagaaaucuaagcugugucugcccaaugaauaauggaaaaugccaugaauuaccuggaug

SEQ ID NO: 520402 - RNA, 64 nt, hsa
uacauuuucccaguaauuuguggaggacuuugaauaauggaaucuauauuggaaucuguaucag

SEQ ID NO: 520403 - RNA, 64 nt, hsa
uccuagcaagacuuuacaagauaggaucaaauucuaauggaauugagccgguuucuuauccuaa

SEQ ID NO: 520404 - RNA, 64 nt, hsa
aggucauccauauucuuacaggccuuccagucaauaauggaagagcucacucuauacaaaacca

SEQ ID NO: 520405 - RNA, 64 nt, hsa
aagaaauagucucccuucaauuaagaaauuuucauaauggaaugauuuaaauugaagugacaaa

SEQ ID NO: 520406 - RNA, 64 nt, hsa
uaguuagcugucuguugucuguagcccagcuugauaauggaacuauacagcgaagagacaaucu

SEQ ID NO: 520407 - RNA, 64 nt, hsa
uuguggguaaaauguuagaacuguaacuguaauguaauggaaauuaacuagugcugugauuuuc

SEQ ID NO: 520408 - RNA, 64 nt, hsa
ccuccucccaagcacuucaaaggaacuggaaugauaauggaaacugucaagagggggcaaguca

SEQ ID NO: 520409 - RNA, 64 nt, hsa
ugcacuucacuuccacuucagaccaacuucauacuaauggaacauuuuggcaaauguauauuca

SEQ ID NO: 520410 - RNA, 64 nt, hsa
uugugaacaauuuagaucuuuaagaacuuauuaauaauggaauacuauuucuaauuuuucucuu

SEQ ID NO: 520411 - RNA, 64 nt, hsa
ucuuacacuguugcugaaggucacucuguacacguaauggaaacugauuuugccaagcucuuac

SEQ ID NO: 520412 - RNA, 64 nt, hsa
guuuagaaccuaaguauuagagaggaaggcuauuuaauggaaguuaguguaagcugauaaaaac

SEQ ID NO: 520413 - RNA, 64 nt, hsa
uaaugaaaggaccaccaaaauaauaaaaggcagcuaauggaaaggagagacaaaagcaugguua

SEQ ID NO: 520414 - RNA, 64 nt, hsa
acgaucuccuggucugauuccuuugggucucuaauaauggaaacugcaaggaucagcauaaagu

SEQ ID NO: 520415 - RNA, 64 nt, hsa
uuucagaccaugaaugaauguuuccauuuuuuucuaauggaaugugagaguuuacuuuuauuuu

SEQ ID NO: 520416 - RNA, 64 nt, hsa
aaaauaaauacgccauuggcaauacuucauaauguaauggaauuguuuggggaacacuuacugu

SEQ ID NO: 520417 - RNA, 64 nt, hsa
caaauguaugacuauuuagaguguuuauaagagauaauggaacugaacuuucacucaauuaauu

SEQ ID NO: 520418 - RNA, 64 nt, hsa
cuuuuaacuuagagauuaggcugaaaaaaauaaguaauggaauucaccuuugcaucuuuugugu

SEQ ID NO: 520419 - RNA, 64 nt, hsa
uguaugugauuuaaaauggaaauagauguguguuuaauggaauugaagucugaaaaggaaguag

SEQ ID NO: 520420 - RNA, 64 nt, hsa
aaaaaaaaaaaaagacaaagccucuuaauaaauuuaauggaacuauacauagaacagcagcucu

SEQ ID NO: 520421 - RNA, 64 nt, hsa
cgcugaagucagucuuucuucagcuucccuuucauaauggaaaugaacuuauuaucuugagagc

SEQ ID NO: 520422 - RNA, 64 nt, hsa
uagcgagauccugucuaaaaaaauaaaaaauaaauaauggaacacagcaaguccuaggaaguag

SEQ ID NO: 520423 - RNA, 64 nt, hsa
uucaagaauuaauuuuuugaagauuuaaguuacauaauggaauuaggcauguggaacaccaaac

SEQ ID NO: 520424 - RNA, 64 nt, hsa
cugaaacaaaccuagcauuuuuaaaaaauaagauuaauggaagacuuuaagguauuuuaaaauu

SEQ ID NO: 520425 - RNA, 64 nt, hsa
uauuaucuuacacuuauucaagcuugucugugauuaauggaauuggugucagaugcuggaauuu

SEQ ID NO: 520426 - RNA, 64 nt, hsa
aaaauaaaaggaaaacauguuucuucaaauugcauaauggaacaaauggcaaugugaguagguu

SEQ ID NO: 520427 - RNA, 64 nt, hsa
ggcaggcaggcacucaagaaaugaauuaacuacauaauggaaaaguaugguuuaauguguccaa

SEQ ID NO: 520428 - RNA, 64 nt, hsa
uauuaauaucaaauucacuuaugaauaaacuugauaauggaaacggacaaaaaaaaucaagugc

SEQ ID NO: 520429 - RNA, 64 nt, hsa
aagaggaaggcuucugucuccugcuugucccugguaauggaaugucucgguguaaaaagcugac

SEQ ID NO: 520430 - RNA, 64 nt, hsa
ucuuucuucaugaucagacauaaacuuagcaucuuaauggaagaaaaaugaggggaacuucaau

SEQ ID NO: 520431 - RNA, 64 nt, hsa
aagcuauuuggaagcuucaaaagguuucuauauguaauggaacaaaaggggaauucucuuuucc

SEQ ID NO: 520432 - RNA, 64 nt, hsa
aguaguuuucuauguuuuaaugacagaacuuggcuaauggaauucacagagguguugcagcgua

SEQ ID NO: 520433 - RNA, 61 nt, hsa
uuuuuacaggaaccugguaaucaaaccauucuaauggaaaagguauaauuuugcagcugua

SEQ ID NO: 520434 - RNA, 64 nt, hsa
ugaaaaauccgugaguauuccaaaauauauuuaauaauggaauaucugcauuaauauaccaucc

SEQ ID NO: 520435 - RNA, 64 nt, hsa
gcuccuucaucguaaauuuagaagaccaaguagauaauggaaccaaaguuguuacuuuuuucua

SEQ ID NO: 520436 - RNA, 64 nt, hsa
cuaaaacacaaauacaacugccaguauguauuuuuaauggaacccuauuuuauaaugguacguu

SEQ ID NO: 520437 - RNA, 64 nt, hsa
uuugaaugagggauaaauagaaagcagaaugaauuaauggaaaagaacucggcuguuaggccau

SEQ ID NO: 520438 - RNA, 64 nt, hsa
aaacuuuugccuguaagaauuugcacaugaauguuaauggaaaacacaaaacuuaagauggccc

SEQ ID NO: 520439 - RNA, 64 nt, hsa
gacaggaaaauucuccuugauaacauaggacaauuaauggaaaaaaaaauucucauuauuugca

SEQ ID NO: 520440 - RNA, 64 nt, hsa
cauaggaaguauggcaugaacaucuuuaggagacuaauggaaauauuauugguguuuacccagu

SEQ ID NO: 520441 - RNA, 64 nt, hsa
ucaucuuaaaaugcuacccuucagccuuacccuuuaauggaaaaaugaaaggaagugacaauac

SEQ ID NO: 520442 - RNA, 64 nt, hsa
guauacacaagaaaugucauauuuuugaguuuuguaauggaagaaccaggcacagaaacagaca

SEQ ID NO: 520443 - RNA, 64 nt, hsa
agagaaucuaauuguugcccggggggaaugaaaauaauggaauuuagagaacucuuucaucccu

SEQ ID NO: 520444 - RNA, 64 nt, hsa
guacagaaugcuauuucacuugagcaagaugauguaauggaaaggguguuggcauuggugucug

SEQ ID NO: 520445 - RNA, 64 nt, hsa
gcguccccggccacgucugugcucuguccuuguguaauggaaugcaaaaaagccaagcccuccg

SEQ ID NO: 520446 - RNA, 64 nt, hsa
ccagucugucuguuguacugguaauuuaacucuguaauggaauaguuugcugccaacuauuuau

SEQ ID NO: 520447 - RNA, 64 nt, hsa
ccucuuccaacccuccauuagcucaauuuugagauaauggaaaauugacuggaaauucaaaacu

SEQ ID NO: 520448 - RNA, 64 nt, hsa
uucaguauuuugagaauugccauauuaauuuuuauaauggaaaacuuaauaaauugcuacuguu

SEQ ID NO: 520449 - RNA, 64 nt, hsa
aaauuuuuaggaccaauacaaaauaacaaaaauguaauggaaucagacugaauuaaaguaaggc

SEQ ID NO: 520450 - RNA, 64 nt, hsa
gcugauuucgagaacuuucaaaaucucacauagcuaauggaaguugcuuucugcuuucuuauga

SEQ ID NO: 520451 - RNA, 64 nt, hsa
uuccaauggaaauauuauauaccacauuuuuuguuaauggaaauaaaugucuucauucccaugu

SEQ ID NO: 520452 - RNA, 64 nt, hsa
auuuuuucaaguuguaaauaauuuauuuaauauuuaauggaaguguauuuauuuuacagcucau

SEQ ID NO: 520453 - RNA, 64 nt, hsa
cuaauugaauauaucuaugagggcauguauuaguuaauggaaaaaaaaauacaacacuaacaau

SEQ ID NO: 520454 - RNA, 64 nt, hsa
uauuucuucauuguaccuuaguccaggaagaaauuaauggaauauggugugcuaauuaucacua

SEQ ID NO: 520455 - RNA, 64 nt, hsa
gaaggcuguguuuauucuuuuccugugccccucauaauggaagaaaguaaacugcuuaucccga

SEQ ID NO: 520456 - RNA, 64 nt, hsa
gagcauccugguauaauuacccccauugugcucuuaauggaaauuucaaaggacgggaguauuc

SEQ ID NO: 520457 - RNA, 64 nt, hsa
accaguguagugcaggaaacagcccugucucaacuaauggaaauauauuugcauguaacccaaa

SEQ ID NO: 520458 - RNA, 64 nt, hsa
ccuagguaagaguaaaugagaaauauuacggcaauaauggaacugcuucacuguuucuugguga

SEQ ID NO: 520459 - RNA, 64 nt, hsa
uucauucuauucuuuuucucucaagaguuccauuuaauggaaauaaaacgguauaauuaauaau

SEQ ID NO: 520460 - RNA, 64 nt, hsa
gggaauauugaaagguuuuaaaauggcauacagauaauggaaaauaagcuuuauguuucaagaa

SEQ ID NO: 520461 - RNA, 64 nt, hsa
uuaccuuuuaaaguuuaguauauagagacaauuuuaauggaaauaacuacuguagacuauugaa

SEQ ID NO: 520462 - RNA, 64 nt, hsa
uagacaauguauguacaauccaaauagaggagcuuaauggaauccuuuuaggagacugguuggu

SEQ ID NO: 520463 - RNA, 64 nt, hsa
uucauuaagggcuaauagauuuccauuuuucaauuaauggaaagggaaugcuacuauaccuacu

SEQ ID NO: 520464 - RNA, 64 nt, hsa
aaaaaauuauguucaaauuuguacauuaaugaaauaauggaacuugugguuagagggaaagaac

SEQ ID NO: 520465 - RNA, 64 nt, hsa
gauuucaaaaucuaccagcagacaagaauauagauaauggaaaacagaauacuguccuuuuuuu

SEQ ID NO: 520466 - RNA, 64 nt, hsa
uuuuacuacugagggaaauagccaaaaaggcaaauaauggaaaaauaguaaacauuaaguaaau

SEQ ID NO: 520467 - RNA, 64 nt, hsa
uugauacuauaauagaaugagacauaaaaugaauuaauggaaacauauccacacuguacuguga

SEQ ID NO: 520468 - RNA, 64 nt, hsa
uucuguacugcuuaugguuguaggauucagggguuaauggaaucacagaaaugauauucugcaa

SEQ ID NO: 520469 - RNA, 64 nt, hsa
ugaccauuuuucuguugcauuagaccuuuacagguaauggaacaugagcuucacccauauuaaa

SEQ ID NO: 520470 - RNA, 64 nt, hsa
cuuaaacauaaaugucaauauauauuuaaaauaauaauggaaacauaggaaaucagcuauuuaa

SEQ ID NO: 520471 - RNA, 64 nt, hsa
auguuuuaaugaaauucuuaaauuaacaucuuuuuaauggaacauuuaagugaauauaugaaua

SEQ ID NO: 520472 - RNA, 64 nt, hsa
uuaacuugguugcuaauuacaagaaugaaaauuauaauggaaaaggacaaaauaauauaccagc

SEQ ID NO: 520473 - RNA, 64 nt, hsa
cagccacugacugcuuggguugggcugugaaugauaauggaauggcuggagucugcuguuguca

SEQ ID NO: 520474 - RNA, 64 nt, hsa
ccugggaacagggaggaugggauuaguggaagcuuaauggaaaaggaaaguuaugauccuccaa

SEQ ID NO: 520475 - RNA, 64 nt, hsa
uuuuuuaacagcaauggaggaaguuaacaauuuuuaauggaaagagcauguuagagcaaacaaa

SEQ ID NO: 520476 - RNA, 64 nt, hsa
agacuaacuugaaaagaaaaccacagcaggaugcuaauggaauuacugccuuacuguacauaca

SEQ ID NO: 520477 - RNA, 59 nt, hsa
uuacacacuccuuucacugauagcuugacuaauggaaugauugguuaaaaugugauuuu

SEQ ID NO: 520478 - RNA, 64 nt, hsa
uuugcaaugacacaugaauuuaauuuuauaaauauaauggaaaacagauuuuucaucauaucau

SEQ ID NO: 520479 - RNA, 64 nt, hsa
uguauuugauugauucgagucuucaaauauuguuuaauggaaugaugagccugcauaaagugaa

SEQ ID NO: 520480 - RNA, 64 nt, hsa
caaauggcuuagacuaaaugagcagggauguagguaauggaaagccuucucaggucauucacgg

SEQ ID NO: 520481 - RNA, 64 nt, hsa
gaaucauuuugugaaugucccccucaaaaaaagcuaauggaauauuuggcauaaagggcauuug

SEQ ID NO: 520482 - RNA, 64 nt, hsa
cuguuuuuuuugguuguccuuguuguuauauuuuuaauggaaaucuguuacucaggcugguagc

SEQ ID NO: 520483 - RNA, 64 nt, hsa
aucauaguuguauauauuuuuaaaguagaauaaauaauggaaagcaacuugauauacaaguuua

SEQ ID NO: 520484 - RNA, 64 nt, hsa
uuguuguuuuuacuuuuuuuuuuuuuggcuuuuguaauggaauccauguucacauccugugaac

SEQ ID NO: 520485 - RNA, 64 nt, hsa
gacuuccaacuagacaaagaaaaaauuguuguuuuaauggaauguaaaccugaaauuggugugu

SEQ ID NO: 520486 - RNA, 64 nt, hsa
cacauccauucuugcuguuuaaauuuucaauaguuaauggaaaguugucuuugaccuugaauuu

SEQ ID NO: 520487 - RNA, 64 nt, hsa
auuaaaacagugaagacuucucuauaauuucaauuaauggaaguuguagaucaaugaauaagac

SEQ ID NO: 520488 - RNA, 64 nt, hsa
cuuguacaguauugccaugaaccauauaucgaccuaauggaaaugggaagagcaacaguaacuc

SEQ ID NO: 520489 - RNA, 64 nt, hsa
uagaguaugauuuuaacaaugauguaacacuagguaauggaaaacucauguaagauguugcuag

SEQ ID NO: 520490 - RNA, 64 nt, hsa
aaggcauggcaccuauaccuugauuaauuuccauuaauggaaaugguucguccugagucaucua

SEQ ID NO: 520491 - RNA, 64 nt, hsa
gauauugccaacuuaaucagauaaacagauuauguaauggaagaaaaaugcggaugccuacagu

SEQ ID NO: 520492 - RNA, 64 nt, hsa
ugggagucugucuaaugaaguccugggacuauuguaauggaauaugauuugaguucacugugcu

SEQ ID NO: 520493 - RNA, 64 nt, hsa
cuaccguggagaggauuuugacacauucaguaacuaauggaacacaccgucaacaugaauucgc

SEQ ID NO: 520494 - RNA, 64 nt, hsa
cauauauucaacaugaauuuuaucauucuccuccuaauggaaugucuuccuuauagaaauguuc

SEQ ID NO: 520495 - RNA, 64 nt, hsa
gaaacuuuaaaauuuauuuugguuuaucccaaaauaauggaaaauguccaguuguguuuuguaa

SEQ ID NO: 520496 - RNA, 58 nt, hsa
uugucaaggucuauaauuagaauacaacuaauggaaacaucuauaaagaagaauacau

SEQ ID NO: 520497 - RNA, 55 nt, hsa
auaccaauaagucagccugaugcucuaauggaaaaauggcccucuucaagccugg

SEQ ID NO: 520498 - RNA, 64 nt, hsa
guuggaauggcuauccuacuaugcuguucuuugguaauggaauaaauugacccaaggaccgaau

SEQ ID NO: 520499 - RNA, 64 nt, hsa
uuugagaucuuuguuuauguuuauuagaagaggguaauggaaacugaucauggaaacauuuaaa

SEQ ID NO: 520500 - RNA, 64 nt, hsa
ggugaaaaaguuagauauucuagacuuguuuuaguaauggaaacucuuaccuccacauauuauc

SEQ ID NO: 520501 - RNA, 64 nt, hsa
guuaauaguuuuaagugaauuuuugaccuuaucuuaauggaaaacgguuaacuccaaacacaaa

SEQ ID NO: 520502 - RNA, 64 nt, hsa
ucaguauuuguguuuuuacauuuuaugguuaauuuaauggaagaugaaagggcauugcaaaguu

SEQ ID NO: 520503 - RNA, 64 nt, hsa
uaauggauaucuguauucaauauuugacaaaaucuaauggaaaccauccauuuacucaugauaa

SEQ ID NO: 520504 - RNA, 64 nt, hsa
uacaguaaaucucccaggccuucagauuucuacauaauggaagaauauguuuuuaacccugaga

SEQ ID NO: 520505 - RNA, 64 nt, hsa
caugcaauugcauaauuguucugaggguuauggauaauggaauauguguuuguacauuccuguu

SEQ ID NO: 520506 - RNA, 64 nt, hsa
caauaacuaucaaauuggcuaucagaauucacuguaauggaauuuugccucuaauaacauaaag

SEQ ID NO: 520507 - RNA, 64 nt, hsa
uugaaucaaacugaaaaaguauuuccuuauagcuuaauggaaaggcuacuaggaaaaaccagaa

SEQ ID NO: 520508 - RNA, 64 nt, hsa
acccaauaugaaacaucuucucccaacacugcuuuaauggaaguucuaggaaccaauuuagcuc

SEQ ID NO: 520509 - RNA, 64 nt, hsa
cucuugcuguucugaggccuuaaaaccaaaaaaauaauggaaugauugcaucacugcgaggaag

SEQ ID NO: 520510 - RNA, 64 nt, hsa
cagaacuuuauagaguugccuaccaggguuacuguaauggaauuuaugaucuuaagaaauuacu

SEQ ID NO: 520511 - RNA, 64 nt, hsa
ugcccucaucagcugagggcagggaauggaacuuuaauggaagaaccacuuuuaucuauucuuu

SEQ ID NO: 520512 - RNA, 64 nt, hsa
uguccauauauguuaauuuucauuguagcaaagcuaauggaaauaaagcuaaugcucuaguuga

SEQ ID NO: 520513 - RNA, 64 nt, hsa
aaucaugguuaguaaacacuaauguauaacauguuaauggaaaaaaauggauuuagaauaauaa

SEQ ID NO: 520514 - RNA, 64 nt, hsa
uuuuaaguuauuaguuuuuaaaaucaguacuuuuuaauggaaacaacuugaccaaaaauuuguc

SEQ ID NO: 520515 - RNA, 64 nt, hsa
accaaagcugaaauuuaaugagaauuucuacaauuaauggaauuccuuuccugcuauaaaggag

SEQ ID NO: 520516 - RNA, 64 nt, hsa
auuggacuuaaaaucuaauucaaacuaauagaauuaauggaauauguaaauagaaacguguaua

SEQ ID NO: 520517 - RNA, 64 nt, hsa
ccugagucaagaguugaggagacauuacaauguguaauggaaaccaaggaaagugaaacuuugg

SEQ ID NO: 520518 - RNA, 64 nt, hsa
guaagaauugcaucuuuacauaaugaucaagguauaauggaaaaauauaccuauucuugaagua

SEQ ID NO: 520519 - RNA, 64 nt, hsa
auugguaucuugcacccgugggagucgggacauauaauggaaaggcccucgggaaguuccgcgu

SEQ ID NO: 520520 - RNA, 64 nt, hsa
uugucuuggaaauuuguuguaaaagccauauuucuaauggaaaaucagguguuuacaggaaaga

SEQ ID NO: 520521 - RNA, 64 nt, hsa
uucuuuguguaugcauguuugaauuaaaagaaaguaauggaagaauugaucgaugaauuaagug

SEQ ID NO: 520522 - RNA, 64 nt, hsa
acuugaaacauuuuauguauuaguuuugaaauaauaauggaaaguggcuaugcaguuugaauau

SEQ ID NO: 520523 - RNA, 64 nt, hsa
auguacacuggauauguuguuaaacacgugucuauaauggaaacauuuacaauaaauauucugc

SEQ ID NO: 520524 - RNA, 64 nt, hsa
auucuacaguuaaccauuagcaugcuaguuguccuaauggaaauuuuugaagaguuuuucaaua

SEQ ID NO: 520525 - RNA, 64 nt, hsa
uguuuggaguggagaagggcagcaccucuguguuuaauggaaauagcccauagucuccuggauu

SEQ ID NO: 520526 - RNA, 64 nt, hsa
uuaaacuuuggccugaacaguuuuuucuuuuucuuaauggaagaagauauuuaauaucuuaaaa

SEQ ID NO: 520527 - RNA, 64 nt, hsa
guuccccuggaaaagcugcuguauuuuuaauuuuuaauggaauguagcuuuuaaaauccuguca

SEQ ID NO: 520528 - RNA, 64 nt, hsa
gauauacucuuuuaaguuuagccccaauauaggguaauggaaauuuccugcccucuggguuccc

SEQ ID NO: 520529 - RNA, 64 nt, hsa
ucagcacaaguugggggaggcaggcaauggaauauaauggaauauucuugagacugaucacaaa

SEQ ID NO: 520530 - RNA, 64 nt, hsa
ugccuaacuuauuggagcacaucaguuucuuggguaauggaaaacauuaccuagaguugccagu

SEQ ID NO: 520531 - RNA, 64 nt, hsa
uugcauuuuagugguuagggagaggauauaagauuaauggaauguauauuuuuauauaagacgu

SEQ ID NO: 520532 - RNA, 64 nt, hsa
uuaauaacagcuccuuuauuauaaucaaagcucauaauggaaaaaaagacugaugaagaaauuu

SEQ ID NO: 520533 - RNA, 64 nt, hsa
cauuuuccucucccgaaggagaucucuuucucuuuaauggaaucuacaacuguuuuaaaacuuu

SEQ ID NO: 520534 - RNA, 64 nt, hsa
uggaguuaguauuugugaguagaaagacuuuagguaauggaaauauaaauaagaaagaauguuu

SEQ ID NO: 520535 - RNA, 64 nt, hsa
agucagccauucuccaaggaucucgauuuccuuuuaauggaaaauaacauuaaacaccaaauau

SEQ ID NO: 520536 - RNA, 64 nt, hsa
uguuauuuauuuguuuggcucauucuuuauauaguaauggaaacauaagucuaggaguuagaaa

SEQ ID NO: 520537 - RNA, 64 nt, hsa
uaaaaaagaaaacauaugaugcuucauuucuacuuaauggaacuuguguucugagggucauuau

SEQ ID NO: 520538 - RNA, 64 nt, hsa
cuuuguacuuuuccaagcucaggucuuuauuuuguaauggaauuaccuugcuccuacuucuuuu

SEQ ID NO: 520539 - RNA, 64 nt, hsa
ccaaacauucuccaguaagcagguacuacauuuauaauggaaggaauuuuuuaaaaaauuuuaa

SEQ ID NO: 520540 - RNA, 64 nt, hsa
uccaguguguaauccgcuccauguguauuuugcuuaauggaaugcuuuauuuaagcacuuaggc

SEQ ID NO: 520541 - RNA, 64 nt, hsa
caacuccaaaucaauucuaaaaacuucaagcacuuaauggaaagguaaauggucagauaaaaau

SEQ ID NO: 520542 - RNA, 64 nt, hsa
cauucaacacaaaauaaacuagaaggccagaggauaauggaauaaaagaucauugcaauuacuu

SEQ ID NO: 520543 - RNA, 64 nt, hsa
uagaauaccuaugguuagggcuucugaacuaaaauaauggaaaauuuuaacaauuuguauagug

SEQ ID NO: 520544 - RNA, 64 nt, hsa
gagacauaugugugcguguggaugucuacaugguuaauggaaagcacugugcucugaaguggau

SEQ ID NO: 520545 - RNA, 64 nt, hsa
gcuuaguuguuuuugagauuuuuuagucaacacauaauggaaacuucuuucuucuaaaaguugc

SEQ ID NO: 520546 - RNA, 64 nt, hsa
uuauaauaaagagcaauuuguaacugaguggcacuaauggaagaaagugcugcucaaaggaagu

SEQ ID NO: 520547 - RNA, 64 nt, hsa
caagugaguugaauaguugcuuaauuuugauuuuuaauggaaaguuguauccauuaaccugggc

SEQ ID NO: 520548 - RNA, 64 nt, hsa
uaagaaugcaucuuuauaaaugggugcuaauugauaauggaaauaauuuaguaauggacuauac

SEQ ID NO: 520549 - RNA, 64 nt, hsa
uguuuccaaguugcaucaaagaugaauugguaaauaauggaaaugaguagugauaugaaaaugg

SEQ ID NO: 520550 - RNA, 64 nt, hsa
guaauaucuucucuggaggccuguugggugaauuuaauggaaucaaguuaaguaggugccagaa

SEQ ID NO: 520551 - RNA, 64 nt, hsa
gucucugauuugcaaaugcacauuugucacugaauaauggaauuauguauaacaagccaaacau

SEQ ID NO: 520552 - RNA, 64 nt, hsa
uaauauuaaaagucacaauguucuuuauauacaauaauggaaaaaaaaaaaagaggaaaacccu

SEQ ID NO: 520553 - RNA, 64 nt, hsa
cauuagcauuaacaggugauaguugccauggauauaauggaauuauggcuggacuuucuuuuga

SEQ ID NO: 520554 - RNA, 64 nt, hsa
aguggaacaaaauguuauauagauaauauuuuucuaauggaaauaaaauaggcagauuuccuuu

SEQ ID NO: 520555 - RNA, 64 nt, hsa
uauuaugacaaaugaaagagaaaauauauauuuuuaauggaaaguuuguagcauuuuucuaaua

SEQ ID NO: 520556 - RNA, 64 nt, hsa
ucuagguugaccuuguguuuuagaaauuugcacuuaauggaauuugcauuucagagauguguua

SEQ ID NO: 520557 - RNA, 64 nt, hsa
uagcguuagaggaaacacauagagcuggaacuguuaauggaaagcagucacagcugaguuuucg

SEQ ID NO: 520558 - RNA, 64 nt, hsa
uacuauaccaguaagugccacuucugugucuuucuaauggaaaugaguagaauugcugaaaguc

SEQ ID NO: 520559 - RNA, 64 nt, hsa
uuccgucauuuaauguuuucaacuguaauugucuuaauggaaauguuaaaauucauaucugauu

SEQ ID NO: 520560 - RNA, 64 nt, hsa
ugaguugggaaaagagguggcauuucugaucggauaauggaauacucucauuuauuuuaugaca

SEQ ID NO: 520561 - RNA, 64 nt, hsa
ucuuuuaagaugcugucuuacauuaaugagcaucuaauggaaagaagguaugaguugcacugag

SEQ ID NO: 520562 - RNA, 64 nt, hsa
acagaauugcauuuuugcuuuuaaagaggucuuauaauggaacuaggaaucaccguuuugagag

SEQ ID NO: 520563 - RNA, 64 nt, hsa
acaccuauaaaaacccaaauuuuuggaacaaagauaauggaaccuccauuuucaaacugaagca

SEQ ID NO: 520564 - RNA, 64 nt, hsa
aauguuagcuaugaaauuuuaguauugaauuuuauaauggaacagaacauugguagguaacaag

SEQ ID NO: 520565 - RNA, 64 nt, hsa
ugaugcuugucugguaauaaucacuucuguguuauaauggaagguuuuuugugauguaugaaac

SEQ ID NO: 520566 - RNA, 64 nt, hsa
cuuagguuggaccuggaauaucccuuauugccuauaauggaauaugugacacugugggugaaau

SEQ ID NO: 520567 - RNA, 64 nt, hsa
aagucgacauauuuauagugcuuagagaccaaacuaauggaaggcagacuauuuacagcuuagu

SEQ ID NO: 520568 - RNA, 64 nt, hsa
ugguaugugauauaaaucguguguuucauaugcauaauggaauuuaacguaauugugaauagga

SEQ ID NO: 520569 - RNA, 64 nt, hsa
gcuuuuuugcaaaugcauucacuuugacaccauauaauggaacagaagcucugguauguuacug

SEQ ID NO: 520570 - RNA, 64 nt, hsa
ugagccuacaguaagacacuucuaucagcaguguuaauggaagaaauuccuaccaaugggcaau

SEQ ID NO: 520571 - RNA, 64 nt, hsa
uuaauacugggcccugaaaugacacccaauuuguuaauggaauuaugaagaacagcaauauaau

SEQ ID NO: 520572 - RNA, 64 nt, hsa
uuuauuuuuuaagaaacugcuaauacuuucucccuaauggaagcccugaucccccagagagcua

SEQ ID NO: 520573 - RNA, 64 nt, hsa
aguagcuagaaauaauuauguggaaaaaaaugaauaauggaaaauagugagucucaaauuguuc

SEQ ID NO: 520574 - RNA, 64 nt, hsa
gaacgacuuuucuguaaucuguuuaucucccacuuaauggaaaggcaaagggguaccccaaauc

SEQ ID NO: 520575 - RNA, 64 nt, hsa
ugauccacuaacuuuuuuuuucuuggcccaugauuaauggaauguauguaacuagguaggguuc

SEQ ID NO: 520576 - RNA, 64 nt, hsa
aaauauuaauuuuaauauuauaacaaccugaaaauaauggaaaagagguuuuugaauuuuuuuu

SEQ ID NO: 520577 - RNA, 64 nt, hsa
cgacgcuuccagacaaggcggaaaaggccuuuuguaauggaaaucucgcgaggguuaaucuucu

SEQ ID NO: 520578 - RNA, 64 nt, hsa
auagaguuaguuuugcagcacaaugguguugcuuuaauggaaaaaaaaaacaguaaaagugaaa

SEQ ID NO: 520579 - RNA, 64 nt, hsa
cugauuuuaucaugaaaacugucaugugucaugcuaauggaaaaugucuuauuuguaaauaagu

SEQ ID NO: 520580 - RNA, 64 nt, hsa
uugagauuugauccccaguguuggagguggggccuaauggaaggucaugggggugggucccuca

SEQ ID NO: 520581 - RNA, 64 nt, hsa
uggauagugucuugcacccaaacaagaaaguccauaauggaaugaucuucccucagcuuccuau

SEQ ID NO: 520582 - RNA, 64 nt, hsa
aacaauauaaugacuauaaaaugacacauggaacuaauggaauacauuuaugauuuuccauaau

SEQ ID NO: 520583 - RNA, 64 nt, hsa
augaaccauauucucauugugagaauuuuaauacuaauggaauguuucaaagguuuuauucaaa

SEQ ID NO: 520584 - RNA, 64 nt, hsa
caggugacaggauuuccuuccuguauuauacauauaauggaauguuccguuacaugugcguacc

SEQ ID NO: 520585 - RNA, 64 nt, hsa
uugaguuaaaauauuucgauuuuuuuuuuuuuuuuaauggaaaguccugcauaacaacacuggg

SEQ ID NO: 520586 - RNA, 64 nt, hsa
ucuauuuucuuaaaaaauguaaacuguggacacuuaauggaaccaagcuaaccaaaguaucucc

SEQ ID NO: 520587 - RNA, 64 nt, hsa
augucuggaggggcaguguacaggugcucuauuuuaauggaaaacacuccccucucccucuuuc

SEQ ID NO: 520588 - RNA, 64 nt, hsa
agccaaauacaugcauagaaaagggucuuccuauuaauggaagaagguaauuuuuaggaugugu

SEQ ID NO: 520589 - RNA, 64 nt, hsa
ggcacauuuugcagccuuuuugcuugauugcauguaauggaaaugcccuauauuuuccugcaaa

SEQ ID NO: 520590 - RNA, 64 nt, hsa
aguuagucccuucucucuuccuugcuuucucuucuaauggaauaugcguaguucccuggggccu

SEQ ID NO: 520591 - RNA, 64 nt, hsa
augcagaaucuacccaauaccacacugcccccauuaauggaauuaaauugggaaaaacaauauu

SEQ ID NO: 520592 - RNA, 64 nt, hsa
uauuaggcaagucaguugaaaaugcucgugcugcuaauggaauuagagugcguucauuuuacag

SEQ ID NO: 520593 - RNA, 64 nt, hsa
uguuuuuguugugugugcagggagggcaguuuucuaauggaaugguuugggaauauccauguac

SEQ ID NO: 520594 - RNA, 64 nt, hsa
ugguggagauacugagcaugucuuauugagucccuaauggaaauggugaucaacaaaagguuau

SEQ ID NO: 520595 - RNA, 64 nt, hsa
caaaggcauuugaaauaggauuuuacuuaaacaauaauggaacacaggaguauuuaaagugaag

SEQ ID NO: 520596 - RNA, 64 nt, hsa
cagguuguuguacacuuacaguacgugucaaccauaauggaacauccacaaaugcaucaauuau

SEQ ID NO: 520597 - RNA, 64 nt, hsa
cucaaauggaacaggauuuuuugaugcuuugcucuaauggaacuguuuaaaaaauuuuuuuuuc

SEQ ID NO: 520598 - RNA, 64 nt, hsa
auauucuaaccuguucuaaccucuaagcauuuucuaauggaacaaaauagaugagguggaugaa

SEQ ID NO: 520599 - RNA, 64 nt, hsa
ugcuguguugaacucuucacucugcugaagcuccuaauggaaaaagcuuucuucugacugugac

SEQ ID NO: 520600 - RNA, 64 nt, hsa
cuuuccauuaaaauauucugaaacaauauaguaauaauggaauugugaucuucaguugcaccuc

SEQ ID NO: 520601 - RNA, 64 nt, hsa
gaguuuuuuccaagcaaccucacugaaaccuauauaauggaauacauuuuucuuugaaaggguc

SEQ ID NO: 520602 - RNA, 64 nt, hsa
cacaauauggaaauuacugaaauaagacgguguauaauggaauuaacacccaaaauaaguagaa

SEQ ID NO: 520603 - RNA, 64 nt, hsa
acucuguaaaaagcaaaaucucucuguccuaaacuaauggaagcgauucucccaugcucaugug

SEQ ID NO: 520604 - RNA, 64 nt, hsa
cuacauuucuggcugaucccaaucagauucccgcuaauggaagaaguuuagaaucuuucaggug

SEQ ID NO: 520605 - RNA, 64 nt, hsa
uccucauuuuuacugaacauuguuaguuuugggguaauggaaacccacuuuuucauuguaauga

SEQ ID NO: 520606 - RNA, 64 nt, hsa
acuaccuuccugggccucagcuuucucgucuguauaauggaagcaagacuuccaaccucacgga

SEQ ID NO: 520607 - RNA, 64 nt, hsa
uacggcccagggggaagaugccaagggcaccccuuaauggaaacacgagaucaguagugcuauc

SEQ ID NO: 520608 - RNA, 64 nt, hsa
guuaagucagggaagagcagugcuguccaugauguaauggaagcuaccaggggaggcagugucu

SEQ ID NO: 520609 - RNA, 64 nt, hsa
aauaaaaugcuuuacuuuuuucaccaaaagcuuauaauggaacuaagguguacaugugcaugug

SEQ ID NO: 520610 - RNA, 64 nt, hsa
auuggauauuguguuuuaaccaaauuuuaaagauuaauggaaucaugaaagggaaaaaaauuga

SEQ ID NO: 520611 - RNA, 64 nt, hsa
uuccaagaacaagaacccuaguauuucuugaaguuaauggaaacuuuucuuuggcuuuuccagu

SEQ ID NO: 520612 - RNA, 64 nt, hsa
ccgaucuuaagguguguuuucuagaaaaguucccuaauggaauucaugaguuugggggucucag

SEQ ID NO: 520613 - RNA, 64 nt, hsa
uaaccuauuuuuguucugguuugguucgguuaucuaauggaaagguaacuggcaaugcacuuga

SEQ ID NO: 520614 - RNA, 64 nt, hsa
gcuuagugucguacuuuacacaucauagguguucuaauggaagcaaggacuggagaagcaaaga

SEQ ID NO: 520615 - RNA, 64 nt, hsa
cuggcauuccucucuuuaaaauuucuaccgaacuuaauggaauggaaaaagcaaacucauccac

SEQ ID NO: 520616 - RNA, 64 nt, hsa
uuagguaauauaacugauaauauacugaaacauauaauggaagaugcagaugauaaaacuaauu

SEQ ID NO: 520617 - RNA, 64 nt, hsa
gauauugacaaauggagacuccuaccucaauaguuaauggaauaauaagaggcuacuguugugu

SEQ ID NO: 520618 - RNA, 64 nt, hsa
uucacauacuguuacugaagaaagcaccaagucuuaauggaacaaagaccauagaaugaauuau

SEQ ID NO: 520619 - RNA, 64 nt, hsa
uuauagaacuauauaauaauauggacuugcuguguaauggaauuaaagugcuuuugcacaauaa

SEQ ID NO: 520620 - RNA, 64 nt, hsa
uagcaauaggaauuuguacuauuuaagcaaucuuuaauggaaaauauguguguaagaauggaug

SEQ ID NO: 520621 - RNA, 64 nt, hsa
uuccaguucuuuuuucagcuucuuuauuuccuccuaauggaaacauuaucuuuaaaaguugcau

SEQ ID NO: 520622 - RNA, 64 nt, hsa
ugcauuccuuccuucgggaauuguauucaaaauguaauggaaaguaauuguugaccuccugcuu

SEQ ID NO: 520623 - RNA, 64 nt, hsa
gcgcauauauauauauguauaaaaaauaauaaaauaauggaagaugaugguguucucuaguaag

SEQ ID NO: 520624 - RNA, 64 nt, hsa
uuuuuuauuuugcagugugcugcaggaaagaauuuaauggaagugaugccaaauauuucuguau

SEQ ID NO: 520625 - RNA, 64 nt, hsa
cagaaacccuucagugcuacauuuuguggcuuuuuaauggaaaccaagccaauguuauagacgu

SEQ ID NO: 520626 - RNA, 64 nt, hsa
caggcccuacccugcaaugggauucgcuuucauuuaauggaaacuucugggacugaugcccaac

SEQ ID NO: 520627 - RNA, 64 nt, hsa
ucagaaauaaguuacaaaucuuuguagaugaaaauaauggaaggaauguggagcaauaaaugua

SEQ ID NO: 520628 - RNA, 64 nt, hsa
uguacacuagcauaauauuuguggcauauccguguaauggaagauuaugcaggcauuaaaauau

SEQ ID NO: 520629 - RNA, 64 nt, hsa
ucuagagucgggcaguccaauaacuuuuuugcaauaauggaaacguucuaugugcaguccaaua

SEQ ID NO: 520630 - RNA, 64 nt, hsa
auaccagcagcuggugagauuugacuuuuuuuuuuaauggaaacuguaggugcuguucucaggu

SEQ ID NO: 520631 - RNA, 64 nt, hsa
gaucuaguguaaugaaauaaaaugugaucuaguguaauggaagaccuuugagaaccugggugua

SEQ ID NO: 520632 - RNA, 64 nt, hsa
uacauaauuccauuaagugguugaaggaagcaaauaauggaauugucaauuggucaucuggcug

SEQ ID NO: 520633 - RNA, 64 nt, hsa
acuuggauauuuuaugauuuuacuugaaugugccuaauggaaccauuugaugugagaaacaauu

SEQ ID NO: 520634 - RNA, 64 nt, hsa
ccagccccuaugaguaggguguuuguggacuaccuaauggaauauuuuugaggccuggaugaac

SEQ ID NO: 520635 - RNA, 64 nt, hsa
aacuguuuuauagucauugauuuggugagaacaguaauggaaaaugguguugaaggacuucuca

SEQ ID NO: 520636 - RNA, 64 nt, hsa
uaccaaaaacuagacauuauuuuguauggaauauuaauggaaacaugcuguacuaaaauaugca

SEQ ID NO: 520637 - RNA, 64 nt, hsa
gcuggcucucgagucucuucugauaugcuguauuuaauggaaaaccuggacaccaaggaaacag

SEQ ID NO: 520638 - RNA, 64 nt, hsa
aaacuuuccaaauaaaaaaaaaaaaagcagcaaguaauggaauugcacauauuaguaacccagu

SEQ ID NO: 520639 - RNA, 64 nt, hsa
auaaaagguagagaaacuuguaguguucuccacauaauggaaaauguacaaaugccuaguugug

SEQ ID NO: 520640 - RNA, 64 nt, hsa
aagcgggcuugcugcuucacccuuggggaugaaauaauggaagcugguuaaaguggaugagguu

SEQ ID NO: 520641 - RNA, 64 nt, hsa
cugaauuuuuaaauguucacucuggcuuaccuguuaauggaagaauuugcauaauaucuacuua

SEQ ID NO: 520642 - RNA, 64 nt, hsa
ccagaagucccuuuccuguucugucucuucauuguaauggaaguuucaguugggcaugagccug

SEQ ID NO: 520643 - RNA, 64 nt, hsa
gucauuauagaugaguuuugccaguucaagaauuuaauggaaucagauauuguaagcauucuug

SEQ ID NO: 520644 - RNA, 64 nt, hsa
gauagcuuuuuguucuaucuuguacagaaaacaguaauggaaucacucauguucagaaccuugu

SEQ ID NO: 520645 - RNA, 58 nt, hsa
uugcucuuucugcagcauagcuugucaauaauggaaacaccaaaaacuguauuauuug

SEQ ID NO: 520646 - RNA, 64 nt, hsa
aaggaaauuaauauuaguaaaauaaacaccucuuuaauggaagcugcaaccuucuagugaucca

SEQ ID NO: 520647 - RNA, 64 nt, hsa
cccauaaaaauuuaaaaagaaauggaauggcaaauaauggaacauaaacuuuaaacaguuagcu

SEQ ID NO: 520648 - RNA, 64 nt, hsa
ccaucaaugagguaucuucuuuaguggugguauguaauggaacuuagccauuuuucaaagcaau

SEQ ID NO: 520649 - RNA, 64 nt, hsa
ucuugaauacucugcccucuagagccuucagccuuaauggaagguuggauccaaggagggugua

SEQ ID NO: 520650 - RNA, 64 nt, hsa
cucuuauuugaauugauuuuuucaucuaauguaauaauggaagccaaaguauucauauuucuua

SEQ ID NO: 520651 - RNA, 64 nt, hsa
cuuuguaaauagcaguucacauuuuuccacaguauaauggaaaauaauggguaggggugcauug

SEQ ID NO: 520652 - RNA, 64 nt, hsa
aaaaucacuuaauuaguaccauuaagugagagaguaauggaaaacuguuauccaucaaaaguga

SEQ ID NO: 520653 - RNA, 64 nt, hsa
gcaggucugaauaagaccuagcuuuguuuuuuucuaauggaaugaaccauuuuccucuucugaa

SEQ ID NO: 520654 - RNA, 64 nt, hsa
gagcauuuugugagaaaaaugaauauaucauaucuaauggaaaagauuggaugaauguucucaa

SEQ ID NO: 520655 - RNA, 64 nt, hsa
uuuuuuaagaucugauaugcuaucauugccuuaauaauggaacaaaauagaagcauaucuaaca

SEQ ID NO: 520656 - RNA, 64 nt, hsa
gauauaaauaacucccacaugcuuaguguuccaauaauggaacacuaggcauaaacagguuuua

SEQ ID NO: 520657 - RNA, 64 nt, hsa
agguuuaaauuuuuagaucucuggaacacauucuuaauggaacaucacaaaagaucaauuccaa

SEQ ID NO: 520658 - RNA, 64 nt, hsa
ucaaaguuaagggauuugcugaagacuguaaaguuaauggaagaauugagacaaaaauccagug

SEQ ID NO: 520659 - RNA, 64 nt, hsa
gggguaauagaagaaaaaguaaauugggaggacuuaauggaaggucuuuuaaaaaguuaacuug

SEQ ID NO: 520660 - RNA, 64 nt, hsa
cuuaagugauuacacuuuugcucaaauugaagcuuaauggaauuauaauucucaggauaguauu

SEQ ID NO: 520661 - RNA, 64 nt, hsa
aguaaaaaguauuacgaugaaauuguuaggguauuaauggaacaaacccaguuucacucucuug

SEQ ID NO: 520662 - RNA, 64 nt, hsa
gagauggucuugguuuuucacuuaacaaauuuuuuaauggaaucuuuguuuuuguucuccaucu

SEQ ID NO: 520663 - RNA, 64 nt, hsa
aaaaaggugguguuuucauuuuuguauaauacuuuaauggaaugcuuuuuaaaaaaauauaaaa

SEQ ID NO: 520664 - RNA, 64 nt, hsa
uuguuucaucuucacguauggaugcuagugccuuuaauggaagguaaagaauguuuugcuaguu

SEQ ID NO: 520665 - RNA, 64 nt, hsa
aggccucccaggauggcgagcuccaguaagaugauaauggaaagcagcagcuuguugguuguca

SEQ ID NO: 520666 - RNA, 64 nt, hsa
agaguccagaggggaggugagguuaaaaccugaguaauggaaaagcuuuuagaguagaaacaca

SEQ ID NO: 520667 - RNA, 64 nt, hsa
uguuuuauuaaaaguaguuuuaaauuaauggauuuaauggaauuguaauuuuaaacauuuaauu

SEQ ID NO: 520668 - RNA, 64 nt, hsa
cucaaccacuuugccacuccuaugguuuagggauuaauggaaccaaauccauuaacauucuaac

SEQ ID NO: 520669 - RNA, 64 nt, hsa
uguauuguacuagauugccaaauucauaaaauguuaauggaagcuuuuugaugugauuauaaug

SEQ ID NO: 520670 - RNA, 64 nt, hsa
agcauuucugaaguuauuccuacuuggauauaguuaauggaauuggcuuaauuugaugacauaa

SEQ ID NO: 520671 - RNA, 64 nt, hsa
uuaaaccuaugauggaauucuaaugucauuauuuuaauggaaucaaucgaaauaugcucuauag

SEQ ID NO: 520672 - RNA, 64 nt, hsa
uuuuuguuuaccauaaauuguuccagauuuauauuaauggaaggaagugugcauuuauuagcua

SEQ ID NO: 520673 - RNA, 64 nt, hsa
uaaucgcacauuuaaaacauaacuguagccucacuaauggaaaaguaguaugaugaacaaucau

SEQ ID NO: 520674 - RNA, 64 nt, hsa
cuuauggaaaagaggugagccuuugugaagaacauaauggaaaagugcauguacgggaaauaac

SEQ ID NO: 520675 - RNA, 64 nt, hsa
gauaaaugaacacaccacucugaggcuaauuaccuaauggaauacaagagcaauggucacccgu

SEQ ID NO: 520676 - RNA, 64 nt, hsa
gacaagaugaauuugagaagccaaauggaauuuuuaauggaaaccauuuaucagauuaaucucu

SEQ ID NO: 520677 - RNA, 64 nt, hsa
uccaucaguggucaccuugagggauuagacauucuaauggaauguccuggcuccacccuccagc

SEQ ID NO: 520678 - RNA, 64 nt, hsa
acaccacuggucuguaguaccagaauuguuuuguuaauggaaaguuuaaguaaauuauauugua

SEQ ID NO: 520679 - RNA, 64 nt, hsa
gaaaaaccuuauuuucuucgguuuuugaaaaacauaauggaaauaaaacaggauauugacauaa

SEQ ID NO: 520680 - RNA, 64 nt, hsa
aucuuccauuguguuuuucuuuauggacaggagcuaauggaagugacagucauguucaaaggaa

SEQ ID NO: 520681 - RNA, 64 nt, hsa
aaacugggaugaagaugugcaaagucacagaauguaauggaaguccugaugguuacagaguaag

SEQ ID NO: 520682 - RNA, 64 nt, hsa
accaaagaugguguacucuaauuuuuuaaaacaguaauggaacacaauuuuuuucauucuuccu

SEQ ID NO: 520683 - RNA, 64 nt, hsa
aaagggaagguaaauggcauaaauauggucgcacuaauggaagacaaauggcaaaucuugaaau

SEQ ID NO: 520684 - RNA, 64 nt, hsa
ggagggacugauuuuuauaggaaaggaggaaaaauaauggaaacacaucucauuauuuuauugu

SEQ ID NO: 520685 - RNA, 64 nt, hsa
agggggcuggcaucauguauuuaggggcaaguaauaauggaaugcuacuaagauacuccauauu

SEQ ID NO: 520686 - RNA, 64 nt, hsa
caaguuuacacugcuuaaaguacauuaugcuuuuuaauggaacuaaaugaucaaaaaaagaaug

SEQ ID NO: 520687 - RNA, 64 nt, hsa
gagagccagagagaggagugaggguggcucaaccuaauggaauuuuuaaauuguauacaauacu

SEQ ID NO: 520688 - RNA, 64 nt, hsa
ucauuggugauguuuggaaaauagaagacaucucuaauggaaucaugggggaaacggguuggaa

SEQ ID NO: 520689 - RNA, 64 nt, hsa
cuaacccuuuaacaaauguguacauguuuacaaguaauggaaaugcgucuauaauacuccugcc

SEQ ID NO: 520690 - RNA, 64 nt, hsa
aggcugggcugcucagucccuucaugggucuugcuaauggaaaguagcauauaugugcuuuaaa

SEQ ID NO: 520691 - RNA, 64 nt, hsa
aucauuuugacagcaucuuccucccuccuuuaauuaauggaaucuucugaauuuucccugaaug

SEQ ID NO: 520692 - RNA, 64 nt, hsa
aguugugacuuaggcaggagucgaccuccucaaguaauggaacgauuucaaaggcaggcugccc

SEQ ID NO: 520693 - RNA, 64 nt, hsa
uuuugaugcuaugugacuugccuuuaauauuacauaauggaauggcuguucacuugauuaguug

SEQ ID NO: 520694 - RNA, 64 nt, hsa
acuaugugauuuuuuaaauguccccuuuaguauuuaauggaaaauugguuccugcaaaagacaa

SEQ ID NO: 520695 - RNA, 64 nt, hsa
ugggccuuuccauuaggguuuugcuuaugugaaguaauggaauuauguugguuauuuucuuuau

SEQ ID NO: 520696 - RNA, 64 nt, hsa
uuauacuuccccaaaaaacaagcuuuacuggaauuaauggaaaauauuaugucaaucuuaggaa

SEQ ID NO: 520697 - RNA, 64 nt, hsa
agugucgcuuaugaaaguacgauguacaguaacuuaauggaagugcugacucuagcaucagccu

SEQ ID NO: 520698 - RNA, 64 nt, hsa
gaaacauaauuuuuuuuuucucacugaagcucaauaauggaacucuuuuuuuuuuuuuuuuuaa

SEQ ID NO: 520699 - RNA, 64 nt, hsa
ggcgcuuaucagcauuguuucuuuggagucuguguaauggaauguauuuuucaaauacugauau

SEQ ID NO: 520700 - RNA, 64 nt, hsa
aaguugccaucugguuugccuuccagcacuaaaguaauggaacuuugaugaugccuuugcuggg

SEQ ID NO: 520701 - RNA, 64 nt, hsa
auuucuucuuuucacuuuaccagaaaguguucuuuaauggaaagaaaaacaacuuucuguucuc

SEQ ID NO: 520702 - RNA, 64 nt, hsa
ucauuugauggggucacuuguuagcugucacuaauaauggaauuaaugggaaacacuugauaaa

SEQ ID NO: 520703 - RNA, 62 nt, hsa
cccacccccauccuauuccugaauaaaaccaggauaauggaagaguugucuuuucugacagu

SEQ ID NO: 520704 - RNA, 64 nt, hsa
uagaaauggcauuucuccuaauuaauuuuccacuuaauggaagauuaucaauuguccuauuuua

SEQ ID NO: 520705 - RNA, 64 nt, hsa
aaguacgugccugaaacugaaaccaugugcacuuuaauggaagguaagcugaacuucuuucuuu

SEQ ID NO: 520706 - RNA, 64 nt, hsa
aaacucuaaagcuuuaauauauucgguuuguauguaauggaagcacggggcuagaguuuccaca

SEQ ID NO: 520707 - RNA, 64 nt, hsa
cucuagcauucucuuuaaauacugacgcaauccuuaauggaaaagagauuucaugaagcaaauu

SEQ ID NO: 520708 - RNA, 64 nt, hsa
gcucugaacuuggagcuacuucacacucuacucuuaauggaaacuugaacuaaugauagauagu

SEQ ID NO: 520709 - RNA, 64 nt, hsa
cauauauuuucuuucauauuuguaaaauuauauuuaauggaauucuuuucuuugauuaucaagg

SEQ ID NO: 520710 - RNA, 64 nt, hsa
guacauccuggucacuucugacuucuguuuuuacuaauggaagcuuugcaaauugaauucucag

SEQ ID NO: 520711 - RNA, 64 nt, hsa
aacugcuaaauucuauguuaaauacugugcagaauaauggaaacauuacaguucauaauaggua

SEQ ID NO: 520712 - RNA, 64 nt, hsa
uuuauuuagaaucgugaauugacauaaucuuggguaauggaacggagaucugcaacauaucuuu

SEQ ID NO: 520713 - RNA, 64 nt, hsa
auauuguuuucguagauuuuuauacuugaucaauuaauggaaucagauuuuuagauaaguguaa

SEQ ID NO: 520714 - RNA, 64 nt, hsa
caaguccuuauuauagacuauuugaagcacaaccuaauggaaaauuguagagaccuugcuuuaa

SEQ ID NO: 520715 - RNA, 64 nt, hsa
guguuccugagugguccugaaucauauaaguugguaauggaagcuguaaugaccaaguccccua

SEQ ID NO: 520716 - RNA, 64 nt, hsa
uuuaugaauguaacugugcacaggaaaugacugguaauggaaaaaauguuguaauaaaauaauc

SEQ ID NO: 520717 - RNA, 64 nt, hsa
ucuucuaaaagggccgugacucaaggaaaguuuuuaauggaaaguugagccagaacuaaaccag

SEQ ID NO: 520718 - RNA, 64 nt, hsa
gagcaggcuggagaggagauggcuaauagcuguuuaauggaaaccugcugggcuggagggaguu

SEQ ID NO: 520719 - RNA, 64 nt, hsa
acgugguuuacguaacuuuaaacuguaacagccuuaauggaagaccaaaugguuuuuuauaugu

SEQ ID NO: 520720 - RNA, 64 nt, hsa
aauaugauacaaguggcaucaggaaaugaggaaauaauggaacuauuuuuuuuaaguggaggua

SEQ ID NO: 520721 - RNA, 64 nt, hsa
uaaacuaagcaagguccuggguuguuugaguggauaauggaaacugaaaggugacgugcaaaac

SEQ ID NO: 520722 - RNA, 64 nt, hsa
uugauucauccuugaaaucaguauaaugugcuauuaauggaaccaauaguaauucgaggacuag

SEQ ID NO: 520723 - RNA, 64 nt, hsa
agcccccgcgcccccgcccuccgccgcugguuuguaauggaaccuuuucugugccccuaucuuc

SEQ ID NO: 520724 - RNA, 64 nt, hsa
guccccggcagccagugcucucuguauagggccauaauggaauucugaagaaaucuuggggagg

SEQ ID NO: 520725 - RNA, 64 nt, hsa
uccggugcugacucggccuuaaacguuugugccauaauggaaaauaucuaucuaucuguucuca

SEQ ID NO: 520726 - RNA, 64 nt, hsa
uagaggauuagaaaaaucaccauuuucuagaccuuaauggaauaauggguccagaaaacaugau

SEQ ID NO: 520727 - RNA, 64 nt, hsa
ccacauuagaaagcauucaaugucaguccuguuuuaauggaauaucugacuauucaaugguaaa

SEQ ID NO: 520728 - RNA, 64 nt, hsa
uuaaaugcuagguuuguagaggcuuacuuaaccuuaauggaaacgcuggaaaucugcaggggga

SEQ ID NO: 520729 - RNA, 64 nt, hsa
accacaccugacccauaggucuucaauaaauauuuaauggaagguuccacaagucacccuguga

SEQ ID NO: 520730 - RNA, 64 nt, hsa
ucuauaaauacaaacaaauagaauguuuauagaauaauggaacauaauaacauuauucaaaauu

SEQ ID NO: 520731 - RNA, 64 nt, hsa
agaggaaaauuggcaccucaucuuuuaaaggcaguaauggaauugauuuucaguaacugaauuu

SEQ ID NO: 520732 - RNA, 64 nt, hsa
uuuaauaggggaagguaguuuauggaaauauuuuuaauggaauaguuuucccuuaauauguauc

SEQ ID NO: 520733 - RNA, 64 nt, hsa
acacacagaugugggcuuugauuuccaaguaauauaauggaagagaaaucucauacucccccac

SEQ ID NO: 520734 - RNA, 64 nt, hsa
ccaaauucuuuauucuuccuugagcuaagcagaauaauggaauauaauaugucuucauaauaua

SEQ ID NO: 520735 - RNA, 63 nt, hsa
aacuguagguuauuuaaaauaaauuccuacaacuuaauggaaacuuaagugucugccucuuug

SEQ ID NO: 520736 - RNA, 64 nt, hsa
guuccaugauuuugcuuaaauuaauacuuuuaaguaauggaacuuuuuucaaaggcaaauuuaa

SEQ ID NO: 520737 - RNA, 64 nt, hsa
gcaaaacuuucuuuuuuaaaaauuuucauuuauuuaauggaaacuugcccauuuucacaugucu

SEQ ID NO: 520738 - RNA, 64 nt, hsa
uauuuuuuauauauuuuguuauuuauucuuuuaauaauggaauuuuuuuaaaaaguauuuugua

SEQ ID NO: 520739 - RNA, 64 nt, hsa
gaauauguaucauggaagaauagagguuauucuguaauggaaaaguguugccugccaccacccu

SEQ ID NO: 520740 - RNA, 64 nt, hsa
aguggauuuuggauuccaaacauuuucgacaguguaauggaaauuuuucuguaauuuucuuacc

SEQ ID NO: 520741 - RNA, 64 nt, hsa
aacauacaguaaugcacaguccuuaauuuguguauaauggaaaguuauuuacaauauaacacug

SEQ ID NO: 520742 - RNA, 64 nt, hsa
uaaugugacuuaggugcugucaacauuagcaagauaauggaaaucacgacgccagugggugcuu

SEQ ID NO: 520743 - RNA, 64 nt, hsa
aaauuuuauugucuguuuuuggugacucugacauuaauggaagagaauauuuuccauuagauuu

SEQ ID NO: 520744 - RNA, 64 nt, hsa
uguuuaacaaguauagccuugauuucaguagauguaauggaagccaaauuaaauugauacagaa

SEQ ID NO: 520745 - RNA, 64 nt, hsa
aauccacccaaaucuauuguugucuuaaaauuguuaauggaaguauugacccucuaugauaugu

SEQ ID NO: 520746 - RNA, 64 nt, hsa
cauccaucauuuaacuguaugccuuuccauauguuaauggaaagcuuuucuuaggccuaggguc

SEQ ID NO: 520747 - RNA, 64 nt, hsa
aaaugaauucaccccucccaccucuuucuucaauuaauggaaaacuguuaagggaagcugauac

SEQ ID NO: 520748 - RNA, 64 nt, hsa
ugaauuagccugaccacagguggucacuguaggcuaauggaaaauacccaagggagggcaaagc

SEQ ID NO: 520749 - RNA, 64 nt, hsa
uuugaaugcuguuuugugaaagaaacugugaauguaauggaaacguaggagcaucuggugacag

SEQ ID NO: 520750 - RNA, 64 nt, hsa
uaagcaaaaggauguuauuucauuaaauuugguuuaauggaaagaauaaaaguaaaugaaaaac

SEQ ID NO: 520751 - RNA, 64 nt, hsa
aaacuucuuuuuacucuaaucauuuuuaaaauacuaauggaagaacuuucuagcacuuuaccac

SEQ ID NO: 520752 - RNA, 64 nt, hsa
auugggggaaaacaacaaaugucuugaagcauauuaauggaauuaguuucuaauguggcaaacu

SEQ ID NO: 520753 - RNA, 64 nt, hsa
uuguucaacugcgaaauagaguguuugcuuuugauaauggaaaauuguauucguuuuaaaauuc

SEQ ID NO: 520754 - RNA, 64 nt, hsa
uaaauugacaacucuguaggauuuacuagcaagcuaauggaaacaugauuuucggggaagaaaa

SEQ ID NO: 520755 - RNA, 64 nt, hsa
ucucaauuugaguaaucugaucguucuuucuagcuaauggaaaaugauuuuacuuagcaauguu

SEQ ID NO: 520756 - RNA, 64 nt, hsa
agugagaggcagcccccuagaaacucuucaggcguaauggaaaaucagcucaaaugagaucagg

SEQ ID NO: 520757 - RNA, 64 nt, hsa
cagauuccacaguggcaagaaacaucauucuacauaauggaaaacauuuacaucaaaucccacu

SEQ ID NO: 520758 - RNA, 64 nt, hsa
auugcuuaaaauaaugguacuauguaaaauuguauaauggaauacaauaaaagguaaaacuuau

SEQ ID NO: 520759 - RNA, 64 nt, hsa
caagucuauuaugacaaaccaggaacuaauucuauaauggaaaacuauccauucugaauaauag

SEQ ID NO: 520760 - RNA, 64 nt, hsa
aguucuagaagauauaggaucuucuauaguagguuaauggaaaauacaaaaacaaacaaacaua

SEQ ID NO: 520761 - RNA, 64 nt, hsa
cuacaaaugcauuucuaaagccauuguaguccuguaauggaagcaucuagcaugucgucaaagc

SEQ ID NO: 520762 - RNA, 64 nt, hsa
uaugauaggucaggggcuagguguugaacuuaguuaauggaagacugagagcagaacagguuug

SEQ ID NO: 520763 - RNA, 64 nt, hsa
ugcguguguguagacacacacgcauacacacauauaauggaagcaauaagccauucuaagagcu

SEQ ID NO: 520764 - RNA, 64 nt, hsa
auuuuucaagcagauugcacauuuuuugcagcuuuaauggaauauugggugaauuagaggggua

SEQ ID NO: 520765 - RNA, 64 nt, hsa
ggaaauuguauaguuucauugauuuaaucauaaauaauggaaauggucuccaagaaguuuuauu

SEQ ID NO: 520766 - RNA, 64 nt, hsa
cagaauuuggaaccaugcugcuacccaagaaaucuaauggaaugaauuaguucuguagaugaca

SEQ ID NO: 520767 - RNA, 64 nt, hsa
uuuucaaagauugauuugguguggauugcaauuguaauggaaggcauaacuugggaucccgggc

SEQ ID NO: 520768 - RNA, 64 nt, hsa
uuaaguuaaauguuaauacuuuauuguuuugauguaauggaacuuaaggauaaaagaccauaau

SEQ ID NO: 520769 - RNA, 64 nt, hsa
uggaagaauaaaauucaagaaugugauguuuuaguaauggaaaagccaagagcgucagguggca

SEQ ID NO: 520770 - RNA, 64 nt, hsa
agccagugcagucugauuucuuuugcuuuugucaguaauggaaucuuuuguuuuuaaaauguac

SEQ ID NO: 520771 - RNA, 64 nt, hsa
guuacaaauuacuagugcuauuuucauuauuauuguaauggaaaaaucuguggacuagaauaaa

SEQ ID NO: 520772 - RNA, 64 nt, hsa
uuuauguagauaaaauuugccuccugguaacccuguaauggauggggcccagaaaugaaauauu

SEQ ID NO: 520773 - RNA, 64 nt, hsa
cuccugugcuagaugguagccagagaauuuuauaguaauggagguuagcccuuaaucucuucau

SEQ ID NO: 520774 - RNA, 64 nt, hsa
ugugaugagaaauugcagcaccucuaucucgcagguaauggaguaguuuguuauugguagucua

SEQ ID NO: 520775 - RNA, 64 nt, hsa
ccgcaguaauguucugcacaacaguauuguaauuguaauggaaucauaaccugcuaacuaguuu

SEQ ID NO: 520776 - RNA, 64 nt, hsa
uacaacuauuuuuuuaauauuagccuucuagucuguaauggaaauuguauauuuugauagaagu

SEQ ID NO: 520777 - RNA, 64 nt, hsa
ucacagccccagaggauuccauauaaaagacauuguaauggaguggauugaacucacagaugga

SEQ ID NO: 520778 - RNA, 64 nt, hsa
gaguuggauggagauaaacagcucccaucccuggguaauggaugguaagaugauggagauuccu

SEQ ID NO: 520779 - RNA, 64 nt, hsa
cgucucccugagccuguaguuggaagugacgacuguaauggaaugaugucuuguauagaaaugc

SEQ ID NO: 520780 - RNA, 64 nt, hsa
aagcaagggcuccagcauccagccuguguguucuguaauggaacugacccccuccccugaaaac

SEQ ID NO: 520781 - RNA, 64 nt, hsa
gaguggcacagccuggcaccaggagcagguccuuguaauggaguuaguguccagucagcugagc

SEQ ID NO: 520782 - RNA, 64 nt, hsa
aauguaguuggguggauuuugggguggccauauaguaauggaaagcugcaauaauuaguuuuaa

SEQ ID NO: 520783 - RNA, 64 nt, hsa
guaauaacgcaugggaauucuguacguuaucacuguaauggaauauccaauuuacagauaguau

SEQ ID NO: 520784 - RNA, 64 nt, hsa
ggucugcuuucauuccgugugcuuccugucacagguaauggaaaacauaaguagaauaggugac

SEQ ID NO: 520785 - RNA, 64 nt, hsa
gugaacuguacuuaaauugcagagaaaccuguaaguaauggaagguaaagaaaaauuacagaau

SEQ ID NO: 520786 - RNA, 64 nt, hsa
gugaaguugauauagucucauuuuuaauuguccuguaauggaacaguagcaaauucacuaaacu

SEQ ID NO: 520787 - RNA, 64 nt, hsa
agaaaagcugugaaggaaggaaauuuacgugauuguaauggaggcuagggguggauugggaggu

SEQ ID NO: 520788 - RNA, 64 nt, hsa
gaggagagcugugcuuucuaccccaaaguuguugguaauggagccggucugcccuuccuacaaa

SEQ ID NO: 520789 - RNA, 64 nt, hsa
uacucuuacugagauacccucucaccccaaauguguaauggaaaauuuuuaauuaagaaaaacu

SEQ ID NO: 520790 - RNA, 59 nt, hsa
gaauaaaaguuacuacgugaaaaaucccaguaauggaaugaagguaauauugauaagcu

SEQ ID NO: 520791 - RNA, 64 nt, hsa
agagggaccagcuggggggcaggggggagaggggguaauggaggccaagccugcagcuuucugg

SEQ ID NO: 520792 - RNA, 64 nt, hsa
uuaagguaaaacagcuuuuuacucuguuauugugguaauggacagaauauuacauacaaaaaua

SEQ ID NO: 520793 - RNA, 64 nt, hsa
cacagaauacacuuagauugauaggaaagaacucguaauggaguuugaguaaagaaaaugacug

SEQ ID NO: 520794 - RNA, 64 nt, hsa
aggcuuuucaguucuguggcuguuuagacuguccguaauggaaugguaaaacuccaugaauuug

SEQ ID NO: 520795 - RNA, 64 nt, hsa
caaaugacuacaauccauagugaaacuguaaacaguaauggacgccaaauuauagguagcugau

SEQ ID NO: 520796 - RNA, 64 nt, hsa
caaguuaguuugcuuuaagcagguaacuuuuuuuguaauggaagaaaugcacuacaaaguuaag

SEQ ID NO: 520797 - RNA, 64 nt, hsa
uaauaugaauauaaaucuuguaacuuuuaaaauuguaauggaggcuguaaucauuuuauaaucu

SEQ ID NO: 520798 - RNA, 64 nt, hsa
uaggaucuuauguaaacaguuuuuguuucugauaguaauggacuuuauucuaacuugagaucag

SEQ ID NO: 520799 - RNA, 64 nt, hsa
cugguuuuuuuuucuugauuugcccauauaauugguaauggauaacuuaauaaauuugugugau

SEQ ID NO: 520800 - RNA, 64 nt, hsa
gaaauuucugucugguucuugguguuugacuguuguaauggaguaaagaagagggccagcuuaa

SEQ ID NO: 520801 - RNA, 64 nt, hsa
auuguggguaaaauguuagaacuguaacuguaauguaauggaaauuaacuagugcugugauuuu

SEQ ID NO: 520802 - RNA, 64 nt, hsa
gauucaauuauaauuguaauggauuuuugacuuuguaauggauucuuuucaucaaaaagccuua

SEQ ID NO: 520803 - RNA, 64 nt, hsa
aaagcuaaauuuuguuacugauucaauuauaauuguaauggauuuuugacuuuguaauggauuc

SEQ ID NO: 520804 - RNA, 64 nt, hsa
uaaucaagugucugcugccauuaacagaacagaaguaauggauaacagaauggaaauaagagau

SEQ ID NO: 520805 - RNA, 64 nt, hsa
aaucuggaaacagaggaaccggugaagugaagauguaauggagauuuagcuaaugauguacuuc

SEQ ID NO: 520806 - RNA, 64 nt, hsa
agaaacaacgucucuagcaauaguaccaaaguaaguaauggagucuuuuuuuuggcaggucugc

SEQ ID NO: 520807 - RNA, 64 nt, hsa
uucuuacacuguugcugaaggucacucuguacacguaauggaaacugauuuugccaagcucuua

SEQ ID NO: 520808 - RNA, 64 nt, hsa
uuguuugcuauucugugugucagaaccaacgaguguaauggagagggcaggucaucucuuauug

SEQ ID NO: 520809 - RNA, 64 nt, hsa
ggucucacaaaaagcaauccauccuguaguauagguaauggaguugggggaagcagcuuccauu

SEQ ID NO: 520810 - RNA, 64 nt, hsa
uaaaauaaauacgccauuggcaauacuucauaauguaauggaauuguuuggggaacacuuacug

SEQ ID NO: 520811 - RNA, 64 nt, hsa
gcuuuuaacuuagagauuaggcugaaaaaaauaaguaauggaauucaccuuugcaucuuuugug

SEQ ID NO: 520812 - RNA, 64 nt, hsa
aaagaaaauguaaaagugcuaacaaggcugccaaguaauggagaaguaugguuagucuucauau

SEQ ID NO: 520813 - RNA, 64 nt, hsa
ucgucuguggaacaucacaaguaucgaaaauacaguaauggauguuuccuuucuaauccacauu

SEQ ID NO: 520814 - RNA, 64 nt, hsa
ucaaccuacuuuguaaccaaagaagcaaagcuguguaauggaguuugguuuuuuuuuguuguuu

SEQ ID NO: 520815 - RNA, 64 nt, hsa
guugccccucaccucagagcucccccaaaggccaguaauggauccccggccucagucccuacuc

SEQ ID NO: 520816 - RNA, 64 nt, hsa
aaccaucagcugccucucgaauggaagaacagugguaauggauuaacauccuauuuuguuguac

SEQ ID NO: 520817 - RNA, 64 nt, hsa
uaagaggaaggcuucugucuccugcuugucccugguaauggaaugucucgguguaaaaagcuga

SEQ ID NO: 520818 - RNA, 64 nt, hsa
cucagggucccuuccuccaagauggccauguaggguaauggagaugaccaguccacacugauaa

SEQ ID NO: 520819 - RNA, 64 nt, hsa
caagcuauuuggaagcuucaaaagguuucuauauguaauggaacaaaaggggaauucucuuuuc

SEQ ID NO: 520820 - RNA, 64 nt, hsa
gccuaacacccugccgguuuucaugcccgcugcaguaauggacguuugugugaagaaaugaacu

SEQ ID NO: 520821 - RNA, 64 nt, hsa
aauuuaaaccuuguuuguaacugaaaggucgauuguaauggauugccguuuguaccuguaucag

SEQ ID NO: 520822 - RNA, 64 nt, hsa
augcucucuugcauauuuauauaaucucugacuuguaauggacccugacuggaaugugaucccu

SEQ ID NO: 520823 - RNA, 64 nt, hsa
ucugaagcuguagcuuaguggaaauuuuagcaagguaauggauuuugcuuuaaaaugucugccu

SEQ ID NO: 520824 - RNA, 64 nt, hsa
uguauacacaagaaaugucauauuuuugaguuuuguaauggaagaaccaggcacagaaacagac

SEQ ID NO: 520825 - RNA, 64 nt, hsa
uuugccacaucccuggacucaguugcuuauuuguguaauggaugugguccucuaaagccccuca

SEQ ID NO: 520826 - RNA, 64 nt, hsa
uguacagaaugcuauuucacuugagcaagaugauguaauggaaaggguguuggcauuggugucu

SEQ ID NO: 520827 - RNA, 64 nt, hsa
agcguccccggccacgucugugcucuguccuuguguaauggaaugcaaaaaagccaagcccucc

SEQ ID NO: 520828 - RNA, 64 nt, hsa
uccagucugucuguuguacugguaauuuaacucuguaauggaauaguuugcugccaacuauuua

SEQ ID NO: 520829 - RNA, 64 nt, hsa
uaaauuuuuaggaccaauacaaaauaacaaaaauguaauggaaucagacugaauuaaaguaagg

SEQ ID NO: 520830 - RNA, 63 nt, hsa
cauggugggggauucacugauucaguuugcaaaguaauggagaagcuguagaacaauguggaa

SEQ ID NO: 520831 - RNA, 64 nt, hsa
acugguaguguucugauuugugagucgacacucaguaauggaugucuuaaucguguagaccuga

SEQ ID NO: 520832 - RNA, 64 nt, hsa
gaaauguucauaccugagcaaagucuacacaggaguaauggacuguuuaacaaguuucccaaaa

SEQ ID NO: 520833 - RNA, 64 nt, hsa
cuuagccaauuuauaagggacuuuuauuuguaaaguaauggaucuggcuugaaaaauacgguag

SEQ ID NO: 520834 - RNA, 64 nt, hsa
gaauuaaucucuuuucagauucucugcaaugacuguaauggacgauccacuguucaguuucaua

SEQ ID NO: 520835 - RNA, 64 nt, hsa
uaaauauguguuuuauagaauaucucacacauuuguaauggauaacgugcauuaaaauggaguu

SEQ ID NO: 520836 - RNA, 64 nt, hsa
augaccauuuuucuguugcauuagaccuuuacagguaauggaacaugagcuucacccauauuaa

SEQ ID NO: 520837 - RNA, 64 nt, hsa
ugcuuuaugaaaauaauagugucuucuauggcauguaauggauaccuaauaccgaugaguuaaa

SEQ ID NO: 520838 - RNA, 64 nt, hsa
guaauaguauuacagaaaaaugagcgauuaaauaguaauggauacaauuaaggagcaacuauuu

SEQ ID NO: 520839 - RNA, 64 nt, hsa
aagugaguacucaacauuugguauauuguuuugaguaauggauguuuguuuuuuguguaauuug

SEQ ID NO: 520840 - RNA, 64 nt, hsa
uaucccugccugugacuuucaagcuacucacccuguaauggaucuuaaagcauuccccaaagau

SEQ ID NO: 520841 - RNA, 64 nt, hsa
acaaauggcuuagacuaaaugagcagggauguagguaauggaaagccuucucaggucauucacg

SEQ ID NO: 520842 - RNA, 64 nt, hsa
guuguuguuuuuacuuuuuuuuuuuuuggcuuuuguaauggaauccauguucacauccugugaa

SEQ ID NO: 520843 - RNA, 64 nt, hsa
uuagaguaugauuuuaacaaugauguaacacuagguaauggaaaacucauguaagauguugcua

SEQ ID NO: 520844 - RNA, 64 nt, hsa
agauauugccaacuuaaucagauaaacagauuauguaauggaagaaaaaugcggaugccuacag

SEQ ID NO: 520845 - RNA, 64 nt, hsa
cugggagucugucuaaugaaguccugggacuauuguaauggaauaugauuugaguucacugugc

SEQ ID NO: 520846 - RNA, 64 nt, hsa
cgaagaauacauccuugagagagauguaauaaauguaauggaugugaaaaaaacuguaauaauu

SEQ ID NO: 520847 - RNA, 64 nt, hsa
uggcugaaauuugagguccuggcugagccaaggaguaauggaccagaucuaccucaguauucaa

SEQ ID NO: 520848 - RNA, 64 nt, hsa
ugcuuuagaggcuaaguugcuuugagcccacaagguaauggagggcuccuacuugggacagagc

SEQ ID NO: 520849 - RNA, 64 nt, hsa
uguuggaauggcuauccuacuaugcuguucuuugguaauggaauaaauugacccaaggaccgaa

SEQ ID NO: 520850 - RNA, 64 nt, hsa
cuuugagaucuuuguuuauguuuauuagaagaggguaauggaaacugaucauggaaacauuuaa

SEQ ID NO: 520851 - RNA, 64 nt, hsa
uggugaaaaaguuagauauucuagacuuguuuuaguaauggaaacucuuaccuccacauauuau

SEQ ID NO: 520852 - RNA, 64 nt, hsa
acaauaacuaucaaauuggcuaucagaauucacuguaauggaauuuugccucuaauaacauaaa

SEQ ID NO: 520853 - RNA, 64 nt, hsa
ugucaguuacacaagcucuagucucaaaaugaaaguaauggagaaagacacugaaauuuagaaa

SEQ ID NO: 520854 - RNA, 64 nt, hsa
ugaggaauugaaaauuaugcuaaagccugaaaauguaauggaugaauuuuuaaaauuguuuaua

SEQ ID NO: 520855 - RNA, 64 nt, hsa
ccagaacuuuauagaguugccuaccaggguuacuguaauggaauuuaugaucuuaagaaauuac

SEQ ID NO: 520856 - RNA, 64 nt, hsa
cacugggucuguccccaccccaauucccuuacaaguaauggagccggggauggaaauaaaugac

SEQ ID NO: 520857 - RNA, 64 nt, hsa
uuuuguuaaaaucuacuccuagaucaagaccuauguaauggacaagcagcaggccaucaggaac

SEQ ID NO: 520858 - RNA, 64 nt, hsa
aaaucauuaaugccaacuugcucugauaugugaaguaauggacaagagugggaaaaaagagauc

SEQ ID NO: 520859 - RNA, 64 nt, hsa
gccugagucaagaguugaggagacauuacaauguguaauggaaaccaaggaaagugaaacuuug

SEQ ID NO: 520860 - RNA, 64 nt, hsa
guguaaacaggauuauuauuaguguuuuaugcauguaauggacuaugcacacuuuuaauuuugu

SEQ ID NO: 520861 - RNA, 64 nt, hsa
aauuauguuguauuuagucaguaugucuuuuuguguaauggacugggccaaucaaaugugauaa

SEQ ID NO: 520862 - RNA, 64 nt, hsa
gagcaaaccccugugguccggcagugcuaccaugguaauggacagaguuaucaaggcacauucu

SEQ ID NO: 520863 - RNA, 64 nt, hsa
gagccaaggccuugggagcagcagugcuaccacgguaauggacagaguuaucgaggcacauacu

SEQ ID NO: 520864 - RNA, 64 nt, hsa
uuagcagcacguguucccgacauaacauuguacuguaauggagugagcguagcagcucagcucu

SEQ ID NO: 520865 - RNA, 64 nt, hsa
uuucuuuguguaugcauguuugaauuaaaagaaaguaauggaagaauugaucgaugaauuaagu

SEQ ID NO: 520866 - RNA, 64 nt, hsa
ugccuguauuaauuuuaguuuugagucaggauuuguaauggagugggaaauguguuucucugga

SEQ ID NO: 520867 - RNA, 64 nt, hsa
ggauauacucuuuuaaguuuagccccaauauaggguaauggaaauuuccugcccucuggguucc

SEQ ID NO: 520868 - RNA, 64 nt, hsa
gugccuaacuuauuggagcacaucaguuucuuggguaauggaaaacauuaccuagaguugccag

SEQ ID NO: 520869 - RNA, 64 nt, hsa
auggaguuaguauuugugaguagaaagacuuuagguaauggaaauauaaauaagaaagaauguu

SEQ ID NO: 520870 - RNA, 64 nt, hsa
uuguuauuuauuuguuuggcucauucuuuauauaguaauggaaacauaagucuaggaguuagaa

SEQ ID NO: 520871 - RNA, 64 nt, hsa
ccuuuguacuuuuccaagcucaggucuuuauuuuguaauggaauuaccuugcuccuacuucuuu

SEQ ID NO: 520872 - RNA, 64 nt, hsa
aaaaaaaaauuacaaauggggcaaacagucuaguguaauggaucaaauuaagauucucugccca

SEQ ID NO: 520873 - RNA, 64 nt, hsa
aaggaagaacaaucacaaauaaagugagaguaauguaauggagcucuuuucacuaggguauaag

SEQ ID NO: 520874 - RNA, 64 nt, hsa
uguaaauggagaaacaaucauaucuuucuaagcgguaauggaggaagacuagugcuuugugcau

SEQ ID NO: 520875 - RNA, 64 nt, hsa
gcccugugucuaccaggagcuucuuuuuccaaauguaauggauuauguggaauuguagugccau

SEQ ID NO: 520876 - RNA, 64 nt, hsa
gaagugaaggcuuuagaugugggaccccccuaauguaauggauuucucaauacuguaugaauaa

SEQ ID NO: 520877 - RNA, 64 nt, hsa
gcccuagauccgaauaagauccgaauaagaauauguaauggaccaggcgcagugccucacgccu

SEQ ID NO: 520878 - RNA, 64 nt, hsa
auuuguagcaguaauaacugcaggucacuuguauguaauggaugugagguagccgaaguuuggu

SEQ ID NO: 520879 - RNA, 64 nt, hsa
cccauauugauaugcuggcaauauaggaugguauguaauggacagaacugaugcagaugguuga

SEQ ID NO: 520880 - RNA, 64 nt, hsa
aauuuuucucuguuacaucaguaauauuguuaaaguaauggauagaaccauaacuuacacauga

SEQ ID NO: 520881 - RNA, 64 nt, hsa
uaaaugggugcuaauugauaauggaaauaauuuaguaauggacuauacaggauguuaauaauga

SEQ ID NO: 520882 - RNA, 64 nt, hsa
ucauagcucacuagggagaaggaugcacaaauaaguaauggaugagcaaacagaauuaccugag

SEQ ID NO: 520883 - RNA, 64 nt, hsa
uggaaguacauaaaguaauaacuguuagaauuagguaauggauaugaaagagaaaaugcuuucu

SEQ ID NO: 520884 - RNA, 64 nt, hsa
caggaugagaaucuaagauauauuauuaauaaauguaauggauuuuuuuuuuguauacguguuu

SEQ ID NO: 520885 - RNA, 64 nt, hsa
aaaccugagggcaaaaaggaauggauaaaguaguguaauggauugacaaucaggaagaacagaa

SEQ ID NO: 520886 - RNA, 64 nt, hsa
gacacguuugauaguuaacauuucuuugugaaagguaauggacucacaaggggaagaaacaugc

SEQ ID NO: 520887 - RNA, 64 nt, hsa
ccgacgcuuccagacaaggcggaaaaggccuuuuguaauggaaaucucgcgaggguuaaucuuc

SEQ ID NO: 520888 - RNA, 64 nt, hsa
agagaagguacucaaaaaauccuuaaugaauaaaguaauggaucguacccaaacauguauuuua

SEQ ID NO: 520889 - RNA, 64 nt, hsa
ugaaaaugcuugguuauguaaagugauuggaaauguaauggauaauuggguaauaaaaugacag

SEQ ID NO: 520890 - RNA, 64 nt, hsa
guguaucuguacucucugcagaugguccaaaauuguaauggagucuguauuagaagaaaauaag

SEQ ID NO: 520891 - RNA, 64 nt, hsa
uggcacauuuugcagccuuuuugcuugauugcauguaauggaaaugcccuauauuuuccugcaa

SEQ ID NO: 520892 - RNA, 64 nt, hsa
cacuuuccaauguacucaagaaaauugaacaaauguaauggaucaauuuaaaauauuuuauuuc

SEQ ID NO: 520893 - RNA, 64 nt, hsa
uuucaaagugcccagacuguguacaaagacacauguaauggagauuguacagguuguuuuuuug

SEQ ID NO: 520894 - RNA, 64 nt, hsa
gcuauuuauaggggaaaacaagaggccaaauauaguaauggaggugccaaauaauuaugugcac

SEQ ID NO: 520895 - RNA, 64 nt, hsa
aaauuacuuacagguuauucaauauaaaauuuuuguaauggauaaucuuauuuaucuaaacuaa

SEQ ID NO: 520896 - RNA, 64 nt, hsa
auccucauuuuuacugaacauuguuaguuuugggguaauggaaacccacuuuuucauuguaaug

SEQ ID NO: 520897 - RNA, 64 nt, hsa
gguuaagucagggaagagcagugcuguccaugauguaauggaagcuaccaggggaggcaguguc

SEQ ID NO: 520898 - RNA, 64 nt, hsa
uuuauagaacuauauaauaauauggacuugcuguguaauggaauuaaagugcuuuugcacaaua

SEQ ID NO: 520899 - RNA, 64 nt, hsa
uuguuuuuuuaagcuucccuugagagaauaaaugguaauggagagaacuauuuaacaagguccu

SEQ ID NO: 520900 - RNA, 51 nt, hsa
cagacaaagcggagcucuagaguaauggagagugauggaaacaaaguguac

SEQ ID NO: 520901 - RNA, 64 nt, hsa
uugcauuccuuccuucgggaauuguauucaaaauguaauggaaaguaauuguugaccuccugcu

SEQ ID NO: 520902 - RNA, 64 nt, hsa
auguacacuagcauaauauuuguggcauauccguguaauggaagauuaugcaggcauuaaaaua

SEQ ID NO: 520903 - RNA, 64 nt, hsa
guaguggauucccaaauuucaaagcucuuuuaauguaauggacaaaaauaagauaugagaauau

SEQ ID NO: 520904 - RNA, 64 nt, hsa
ugaucuaguguaaugaaauaaaaugugaucuaguguaauggaagaccuuugagaaccugggugu

SEQ ID NO: 520905 - RNA, 64 nt, hsa
aaacuguuuuauagucauugauuuggugagaacaguaauggaaaaugguguugaaggacuucuc

SEQ ID NO: 520906 - RNA, 64 nt, hsa
acagaaugaguaugcaaguuuuauuuaucaaaauguaauggauuuuuaaaggcugagaaauuuu

SEQ ID NO: 520907 - RNA, 64 nt, hsa
uggcaauauggguggggggaauuguguguugugaguaauggacagauauggggcuuuuuagcca

SEQ ID NO: 520908 - RNA, 64 nt, hsa
ggcaccucaacugaggaggggaagaaaguucuacguaauggagggaagaauuucccagccaucu

SEQ ID NO: 520909 - RNA, 64 nt, hsa
caaacuuuccaaauaaaaaaaaaaaaagcagcaaguaauggaauugcacauauuaguaacccag

SEQ ID NO: 520910 - RNA, 64 nt, hsa
cuucggguugcaaccuugucucuugcaguuuaagguaauggauauuguagcccauuugaauuuu

SEQ ID NO: 520911 - RNA, 64 nt, hsa
cggacacaccuggagcagccucugagucuuacccguaauggagccggccaacccuguguguuau

SEQ ID NO: 520912 - RNA, 64 nt, hsa
accagaagucccuuuccuguucugucucuucauuguaauggaaguuucaguugggcaugagccu

SEQ ID NO: 520913 - RNA, 64 nt, hsa
ggauagcuuuuuguucuaucuuguacagaaaacaguaauggaaucacucauguucagaaccuug

SEQ ID NO: 520914 - RNA, 64 nt, hsa
uccaucaaugagguaucuucuuuaguggugguauguaauggaacuuagccauuuuucaaagcaa

SEQ ID NO: 520915 - RNA, 64 nt, hsa
ucagccuuaauggaagguuggauccaaggaggguguaauggagcaucaagccacucggcggcag

SEQ ID NO: 520916 - RNA, 64 nt, hsa
caaaaucacuuaauuaguaccauuaagugagagaguaauggaaaacuguuauccaucaaaagug

SEQ ID NO: 520917 - RNA, 64 nt, hsa
uagaguccagaggggaggugagguuaaaaccugaguaauggaaaagcuuuuagaguagaaacac

SEQ ID NO: 520918 - RNA, 64 nt, hsa
agcaggaguaaaggaagaaagugacccuagggaaguaauggauuuuuuuuuacucaucuuugaa

SEQ ID NO: 520919 - RNA, 64 nt, hsa
ugauuuuaaaguggugcauuugauuccagccuugguaauggagaguuugcaaacacacagcggc

SEQ ID NO: 520920 - RNA, 64 nt, hsa
agagcuaccacccaauggagauacuaaauccaugguaauggaccaucgagggcaaccuccagag

SEQ ID NO: 520921 - RNA, 64 nt, hsa
gcaaguagccugucuuccuuuaaguaaguagccuguaauggauguacuacuuugccacuggaau

SEQ ID NO: 520922 - RNA, 64 nt, hsa
aaaacugggaugaagaugugcaaagucacagaauguaauggaaguccugaugguuacagaguaa

SEQ ID NO: 520923 - RNA, 64 nt, hsa
gaccaaagaugguguacucuaauuuuuuaaaacaguaauggaacacaauuuuuuucauucuucc

SEQ ID NO: 520924 - RNA, 64 nt, hsa
aucuuugaaaucuuuuucaaaggacuguaguuuuguaauggacuuuucaagccuuccuuccauu

SEQ ID NO: 520925 - RNA, 64 nt, hsa
ucuaacccuuuaacaaauguguacauguuuacaaguaauggaaaugcgucuauaauacuccugc

SEQ ID NO: 520926 - RNA, 64 nt, hsa
gacaagucuguuauuaggaauaauccuuagccauguaauggagaaaggagcagucagcauucuu

SEQ ID NO: 520927 - RNA, 64 nt, hsa
aauauuaagcaauuucuaguuauuauucuagccaguaauggacuucagaaucuuuuauuacaca

SEQ ID NO: 520928 - RNA, 64 nt, hsa
ccuaucccauacauuugacacaaaagaaguguugguaauggauaaauaacauaucccgggcaga

SEQ ID NO: 520929 - RNA, 64 nt, hsa
aaagaaccuccuuggaaaaauuaauugcuuuuucguaauggauucucuaugcuaaugcucucuc

SEQ ID NO: 520930 - RNA, 64 nt, hsa
gaguugugacuuaggcaggagucgaccuccucaaguaauggaacgauuucaaaggcaggcugcc

SEQ ID NO: 520931 - RNA, 64 nt, hsa
agauuaggccaguucagguguauuuuguaucuuaguaauggaucauaucguaaaaauagagaua

SEQ ID NO: 520932 - RNA, 64 nt, hsa
guccuuugguugcuccuccuugguuugauuuuguguaauggauggaaaacgcagcauacuuggc

SEQ ID NO: 520933 - RNA, 64 nt, hsa
augggccuuuccauuaggguuuugcuuaugugaaguaauggaauuauguugguuauuuucuuua

SEQ ID NO: 520934 - RNA, 64 nt, hsa
cggcgcuuaucagcauuguuucuuuggagucuguguaauggaauguauuuuucaaauacugaua

SEQ ID NO: 520935 - RNA, 64 nt, hsa
caaguugccaucugguuugccuuccagcacuaaaguaauggaacuuugaugaugccuuugcugg

SEQ ID NO: 520936 - RNA, 64 nt, hsa
auagaucacaaagcucaaggaauuuaauauucuuguaauggacuagauaauucaaacugauuag

SEQ ID NO: 520937 - RNA, 64 nt, hsa
ccuguauuuuaaaaagaaauacaaaguuguaaaaguaauggauuucuuuggaugcugaaugcag

SEQ ID NO: 520938 - RNA, 64 nt, hsa
aaaacucuaaagcuuuaauauauucgguuuguauguaauggaagcacggggcuagaguuuccac

SEQ ID NO: 520939 - RNA, 64 nt, hsa
augucaccuuucauuuuauaguguucaucauugaguaauggauuaagugaaaauccaggaguau

SEQ ID NO: 520940 - RNA, 64 nt, hsa
ugucuauugaacacuuaaaauuaauuagaaugugguaauggacauauuacugagccucuccauu

SEQ ID NO: 520941 - RNA, 64 nt, hsa
auuuauuuagaaucgugaauugacauaaucuuggguaauggaacggagaucugcaacauaucuu

SEQ ID NO: 520942 - RNA, 64 nt, hsa
uuauaaugcuauuuguacauuaccaugauuuauuguaauggaguagaguaugugauaguaucug

SEQ ID NO: 520943 - RNA, 64 nt, hsa
gguguuccugagugguccugaaucauauaaguugguaauggaagcuguaaugaccaaguccccu

SEQ ID NO: 520944 - RNA, 64 nt, hsa
uuuuaugaauguaacugugcacaggaaaugacugguaauggaaaaaauguuguaauaaaauaau

SEQ ID NO: 520945 - RNA, 64 nt, hsa
cucagaauuacucaaaucaauuuauuuuuaguugguaauggauauaauauuucuuaaaacaaaa

SEQ ID NO: 520946 - RNA, 64 nt, hsa
aaaguuuccucauaaaacucaguacuaucuauugguaauggaugcauauauguauguacauguu

SEQ ID NO: 520947 - RNA, 64 nt, hsa
ugcauugaaaacaaccuaaauauucaucagugggguaauggaugaauaaaauaugauauauuca

SEQ ID NO: 520948 - RNA, 64 nt, hsa
ucaucgcuggugcuccgacaaaaaaaaugcugcuguaauggaccaagagccugcagggaacaga

SEQ ID NO: 520949 - RNA, 64 nt, hsa
cggguucaagcaauuaacugccucagcuucccuaguaauggauuacaggcgcccgccaccacgc

SEQ ID NO: 520950 - RNA, 64 nt, hsa
uuuaagaacuaaaauauauuuuauuuuaaauaaaguaauggaccuuuaaucuuacacagcuaaa

SEQ ID NO: 520951 - RNA, 64 nt, hsa
cagcccccgcgcccccgcccuccgccgcugguuuguaauggaaccuuuucugugccccuaucuu

SEQ ID NO: 520952 - RNA, 64 nt, hsa
gagaggaaaauuggcaccucaucuuuuaaaggcaguaauggaauugauuuucaguaacugaauu

SEQ ID NO: 520953 - RNA, 64 nt, hsa
guaagauuaaguuaggcagucuucuaccaaauguguaauggagauugccucaaaauugugucca

SEQ ID NO: 520954 - RNA, 64 nt, hsa
uguuccaugauuuugcuuaaauuaauacuuuuaaguaauggaacuuuuuucaaaggcaaauuua

SEQ ID NO: 520955 - RNA, 64 nt, hsa
uuugccuuucaaccuuguuuuacaguucugcaguguaauggaggacgggcaacgugcaugugca

SEQ ID NO: 520956 - RNA, 64 nt, hsa
ggaauauguaucauggaagaauagagguuauucuguaauggaaaaguguugccugccaccaccc

SEQ ID NO: 520957 - RNA, 64 nt, hsa
uaguggauuuuggauuccaaacauuuucgacaguguaauggaaauuuuucuguaauuuucuuac

SEQ ID NO: 520958 - RNA, 64 nt, hsa
auguuuaacaaguauagccuugauuucaguagauguaauggaagccaaauuaaauugauacaga

SEQ ID NO: 520959 - RNA, 64 nt, hsa
auaccaaacccaguguuaggagaaaggacacagcguaauggagaaaggggaaguaguagaauuc

SEQ ID NO: 520960 - RNA, 64 nt, hsa
ugguuccuucugccugacccugggagacauaucaguaauggauguacaaaagcaggucuguuuu

SEQ ID NO: 520961 - RNA, 64 nt, hsa
cuuugaaugcuguuuugugaaagaaacugugaauguaauggaaacguaggagcaucuggugaca

SEQ ID NO: 520962 - RNA, 64 nt, hsa
uaaaauuuaaaaaauuaacagccaagucacaaagguaauggauugcacauagacuaaggaauaa

SEQ ID NO: 520963 - RNA, 64 nt, hsa
ugcuguuggaaaaugagagcgaucacauggagcaguaauggagcaaagaccagccaucccaguu

SEQ ID NO: 520964 - RNA, 64 nt, hsa
cagugagaggcagcccccuagaaacucuucaggcguaauggaaaaucagcucaaaugagaucag

SEQ ID NO: 520965 - RNA, 64 nt, hsa
gcuacaaaugcauuucuaaagccauuguaguccuguaauggaagcaucuagcaugucgucaaag

SEQ ID NO: 520966 - RNA, 64 nt, hsa
caugguaauuuguggauuuuuuuuucauacucaaguaauggaggcuagaaaugaagagaaccuu

SEQ ID NO: 520967 - RNA, 64 nt, hsa
aagugagauguuaagcccacuuuguucuuuuaauguaauggagcuuauggguagaagaccaugu

SEQ ID NO: 520968 - RNA, 64 nt, hsa
agucuaguccguccuggcacagaagaggagucaaguaauggaggucccagcccuggggguuuaa

SEQ ID NO: 520969 - RNA, 64 nt, hsa
guuuucaaagauugauuugguguggauugcaauuguaauggaaggcauaacuugggaucccggg

SEQ ID NO: 520970 - RNA, 64 nt, hsa
gcuucaaaauuaggaaauacuacaggacaccccuguaauggauugguggcaacuggguggcacu

SEQ ID NO: 520971 - RNA, 64 nt, hsa
auaugaauuuaaaccuaguaccauccaaaaccauguaauggauuuuaagaaucuguuaggccuu

SEQ ID NO: 520972 - RNA, 64 nt, hsa
cuuaaguuaaauguuaauacuuuauuguuuugauguaauggaacuuaaggauaaaagaccauaa

SEQ ID NO: 520973 - RNA, 64 nt, hsa
uuggaagaauaaaauucaagaaugugauguuuuaguaauggaaaagccaagagcgucagguggc

SEQ ID NO: 520974 - RNA, 64 nt, hsa
gaggaucacuggagcccaggaguuugaggcugcagcgagcuaugaucgcgccacuacacuccag

SEQ ID NO: 520975 - RNA, 64 nt, hsa
gaagaucacgugagcccaggaguuugaggcugcagcgagcuaugaucacaucacuguacuccag

SEQ ID NO: 520976 - RNA, 64 nt, hsa
ugccucagccucccaaaguguggggauuacaggugcgagcuacugcucccagcaagagccaaga

SEQ ID NO: 520977 - RNA, 64 nt, hsa
cuucauauacuucuauuagcagugaugauggaaggcgagcuaagaggagacuuagauccagugg

SEQ ID NO: 520978 - RNA, 50 nt, hsa
gccugaggaaccggcggugagcgagcuagagucggucaaggagaauaacu

SEQ ID NO: 520979 - RNA, 64 nt, hsa
uucaccugaggacagaugaugcagcuguuguguggcgagcuauuuggaaagacgucuguguuuu

SEQ ID NO: 520980 - RNA, 64 nt, hsa
cuagcagagcuuuuguuaaugccccagcugcuuggcgagcuaacagcugaccuuucgggaagcc

SEQ ID NO: 520981 - RNA, 64 nt, hsa
guucccugguugaguagguuuggcagacacuaaagcgagcuacacgaucaucuuugcuacaggc

SEQ ID NO: 520982 - RNA, 64 nt, hsa
cugaggacagagcugguggggcgcgggggggcuggcgagcuacuguaaacuuuaaagaauuccu

SEQ ID NO: 520983 - RNA, 64 nt, hsa
gagcuccaccaacucucggccugccaguucucaagcgagcuaaucuugucauuaaucgauagaa

SEQ ID NO: 520984 - RNA, 64 nt, hsa
aggguguuuauguaaaacuaaaugagugcaggcagcgagcuacacuuuuuuuuuuccuaaaugg

SEQ ID NO: 520985 - RNA, 64 nt, hsa
ggcagccgaaugaaaaaaaaauuuaaaaaaaugugcgagcuaauauggcaaaacaacuggaagg

SEQ ID NO: 520986 - RNA, 64 nt, hsa
gauugguucacccuugcucugaguuggccccaaagcgagcuaugcugaacucuucuccaucucc

SEQ ID NO: 520987 - RNA, 64 nt, hsa
ucugccucccaacuccucaaggucaccuauagaagcgagcuaccaaaagacgucuccuaagcau

SEQ ID NO: 520988 - RNA, 64 nt, hsa
caaagguggcuaaggcagaggcugagggggcugggcgagcuaccaagcugaagguauccaaauu

SEQ ID NO: 520989 - RNA, 64 nt, hsa
ggcccuucaggucaccaaacauccaccuggagcggcgagcuagaggccuguuggcuugugaaau

SEQ ID NO: 520990 - RNA, 64 nt, hsa
guggcguguagggaacacugcccuggcucagcgugcgagcuaagguggugauguaugcgauggg

SEQ ID NO: 520991 - RNA, 64 nt, hsa
gcuuucuccagacuuuuguauguuguuauuaaaagcgagcuauugcauuucauucugccucagu

SEQ ID NO: 520992 - RNA, 64 nt, hsa
uuuucuuucagggagacuucauguguucauuuauuuccaccacagcagauuuuaagaaauuaua

SEQ ID NO: 520993 - RNA, 64 nt, hsa
ucucauuccugcuucccucucacccuauugccaguuccaccaacuagagugaaagacuuccuag

SEQ ID NO: 520994 - RNA, 64 nt, hsa
aaauugucucguuuauuuuaaauagaaucuaugcuuccaccaauaaaccaucgggagcuaagaa

SEQ ID NO: 520995 - RNA, 64 nt, hsa
aggaaaguaguuauuccuagcuccauuucuuauuuuccaccaaauuuaauugaagggcauuaau

SEQ ID NO: 520996 - RNA, 64 nt, hsa
gcucuggaguuacagaucuggguucaaggccaaauuccaccacuuacuagguuuguaauauugg

SEQ ID NO: 520997 - RNA, 64 nt, hsa
uccacaucccucugccccucccagaccucuguccuuccaccaaucgccucccgcagccccgagc

SEQ ID NO: 520998 - RNA, 64 nt, hsa
uuccuggauuuucuuucuauguagaacuguucauuuccaccaaggguaucugcugccucugaaa

SEQ ID NO: 520999 - RNA, 64 nt, hsa
ucacaaauauaguugaacaagauuucccuaaaaauuccaccaggauuaaucucuaaaauucuag

SEQ ID NO: 521000 - RNA, 57 nt, hsa
agccucucaggaagcauugaugaaucauuccaccaagaaaacaaacaagcaccuacc

SEQ ID NO: 521001 - RNA, 64 nt, hsa
uaucggccgugauacauuuuuuaauucauuuguuuuccaccauuauauuuuuauacuuuucagu

SEQ ID NO: 521002 - RNA, 64 nt, hsa
aaaaaaacaggaaaaaaagaaccauacaaaauuuuuccaccacacauacccucuaagccagcaa

SEQ ID NO: 521003 - RNA, 64 nt, hsa
ucacaccuuuuaggcaccuacugugugcauagcauuccaccaggacucaucucccuuccuucuc

SEQ ID NO: 521004 - RNA, 64 nt, hsa
cccuuccccuucccaaaacagaguucauaugcacuuccaccaaaguaaugccaaugaaagugcu

SEQ ID NO: 521005 - RNA, 64 nt, hsa
ccaucuucuguagccccuccgcucuacucauuccuuccaccaucugcagagauuugaaguuugg

SEQ ID NO: 521006 - RNA, 64 nt, hsa; identical to SEQ ID NO: 23340

SEQ ID NO: 521007 - RNA, 64 nt, hsa; identical to SEQ ID NO: 23341

SEQ ID NO: 521008 - RNA, 64 nt, hsa; identical to SEQ ID NO: 23342

SEQ ID NO: 521009 - RNA, 64 nt, hsa; identical to SEQ ID NO: 23343

SEQ ID NO: 521010 - RNA, 64 nt, hsa; identical to SEQ ID NO: 23344

SEQ ID NO: 521011 - RNA, 64 nt, hsa; identical to SEQ ID NO: 23345

SEQ ID NO: 521012 - RNA, 64 nt, hsa; identical to SEQ ID NO: 23346

SEQ ID NO: 521013 - RNA, 64 nt, hsa; identical to SEQ ID NO: 23347

SEQ ID NO: 521014 - RNA, 64 nt, hsa; identical to SEQ ID NO: 23348

SEQ ID NO: 521015 - RNA, 64 nt, hsa; identical to SEQ ID NO: 23349

SEQ ID NO: 521016 - RNA, 64 nt, hsa; identical to SEQ ID NO: 23350

SEQ ID NO: 521017 - RNA, 64 nt, hsa; identical to SEQ ID NO: 23351

SEQ ID NO: 521018 - RNA, 64 nt, hsa; identical to SEQ ID NO: 23352

SEQ ID NO: 521019 - RNA, 64 nt, hsa; identical to SEQ ID NO: 23353

SEQ ID NO: 521020 - RNA, 64 nt, hsa; identical to SEQ ID NO: 23354

SEQ ID NO: 521021 - RNA, 64 nt, hsa; identical to SEQ ID NO: 23355

SEQ ID NO: 521022 - RNA, 64 nt, hsa; identical to SEQ ID NO: 23356

SEQ ID NO: 521023 - RNA, 64 nt, hsa; identical to SEQ ID NO: 23357

SEQ ID NO: 521024 - RNA, 64 nt, hsa; identical to SEQ ID NO: 23358

SEQ ID NO: 521025 - RNA, 64 nt, hsa; identical to SEQ ID NO: 23359

SEQ ID NO: 521026 - RNA, 64 nt, hsa; identical to SEQ ID NO: 23360

SEQ ID NO: 521027 - RNA, 64 nt, hsa; identical to SEQ ID NO: 23361

SEQ ID NO: 521028 - RNA, 64 nt, hsa; identical to SEQ ID NO: 23362

SEQ ID NO: 521029 - RNA, 64 nt, hsa; identical to SEQ ID NO: 23363

SEQ ID NO: 521030 - RNA, 64 nt, hsa; identical to SEQ ID NO: 23364

SEQ ID NO: 521031 - RNA, 64 nt, hsa; identical to SEQ ID NO: 23365

SEQ ID NO: 521032 - RNA, 64 nt, hsa; identical to SEQ ID NO: 23366

SEQ ID NO: 521033 - RNA, 64 nt, hsa; identical to SEQ ID NO: 23367

SEQ ID NO: 521034 - RNA, 64 nt, hsa; identical to SEQ ID NO: 23368

SEQ ID NO: 521035 - RNA, 64 nt, hsa; identical to SEQ ID NO: 23369

SEQ ID NO: 521036 - RNA, 64 nt, hsa; identical to SEQ ID NO: 23370

SEQ ID NO: 521037 - RNA, 64 nt, hsa; identical to SEQ ID NO: 23371

SEQ ID NO: 521038 - RNA, 64 nt, hsa; identical to SEQ ID NO: 23372

SEQ ID NO: 521039 - RNA, 64 nt, hsa; identical to SEQ ID NO: 23373

SEQ ID NO: 521040 - RNA, 64 nt, hsa; identical to SEQ ID NO: 23374

SEQ ID NO: 521041 - RNA, 64 nt, hsa; identical to SEQ ID NO: 23375

SEQ ID NO: 521042 - RNA, 64 nt, hsa; identical to SEQ ID NO: 23376

SEQ ID NO: 521043 - RNA, 64 nt, hsa; identical to SEQ ID NO: 23377

SEQ ID NO: 521044 - RNA, 64 nt, hsa; identical to SEQ ID NO: 23378

SEQ ID NO: 521045 - RNA, 64 nt, hsa; identical to SEQ ID NO: 23379

SEQ ID NO: 521046 - RNA, 64 nt, hsa; identical to SEQ ID NO: 23380

SEQ ID NO: 521047 - RNA, 64 nt, hsa; identical to SEQ ID NO: 23381

SEQ ID NO: 521048 - RNA, 64 nt, hsa; identical to SEQ ID NO: 23382

SEQ ID NO: 521049 - RNA, 64 nt, hsa; identical to SEQ ID NO: 23383

SEQ ID NO: 521050 - RNA, 64 nt, hsa; identical to SEQ ID NO: 23384

SEQ ID NO: 521051 - RNA, 64 nt, hsa; identical to SEQ ID NO: 23385

SEQ ID NO: 521052 - RNA, 64 nt, hsa; identical to SEQ ID NO: 23386

SEQ ID NO: 521053 - RNA, 64 nt, hsa; identical to SEQ ID NO: 23387

SEQ ID NO: 521054 - RNA, 64 nt, hsa; identical to SEQ ID NO: 23388

SEQ ID NO: 521055 - RNA, 64 nt, hsa; identical to SEQ ID NO: 23389

SEQ ID NO: 521056 - RNA, 64 nt, hsa; identical to SEQ ID NO: 23390

SEQ ID NO: 521057 - RNA, 64 nt, hsa; identical to SEQ ID NO: 23391

SEQ ID NO: 521058 - RNA, 64 nt, hsa; identical to SEQ ID NO: 23392

SEQ ID NO: 521059 - RNA, 64 nt, hsa; identical to SEQ ID NO: 23393

SEQ ID NO: 521060 - RNA, 64 nt, hsa; identical to SEQ ID NO: 23394

SEQ ID NO: 521061 - RNA, 64 nt, hsa; identical to SEQ ID NO: 23395

SEQ ID NO: 521062 - RNA, 64 nt, hsa; identical to SEQ ID NO: 23396

SEQ ID NO: 521063 - RNA, 64 nt, hsa; identical to SEQ ID NO: 23397

SEQ ID NO: 521064 - RNA, 64 nt, hsa; identical to SEQ ID NO: 23398

SEQ ID NO: 521065 - RNA, 64 nt, hsa; identical to SEQ ID NO: 23399

SEQ ID NO: 521066 - RNA, 64 nt, hsa; identical to SEQ ID NO: 23400

SEQ ID NO: 521067 - RNA, 64 nt, hsa; identical to SEQ ID NO: 23401

SEQ ID NO: 521068 - RNA, 64 nt, hsa; identical to SEQ ID NO: 23402

SEQ ID NO: 521069 - RNA, 64 nt, hsa; identical to SEQ ID NO: 23403

SEQ ID NO: 521070 - RNA, 64 nt, hsa; identical to SEQ ID NO: 23404

SEQ ID NO: 521071 - RNA, 64 nt, hsa; identical to SEQ ID NO: 23405

SEQ ID NO: 521072 - RNA, 64 nt, hsa; identical to SEQ ID NO: 23406

SEQ ID NO: 521073 - RNA, 64 nt, hsa; identical to SEQ ID NO: 23407

SEQ ID NO: 521074 - RNA, 64 nt, hsa; identical to SEQ ID NO: 23408

SEQ ID NO: 521075 - RNA, 64 nt, hsa; identical to SEQ ID NO: 23409

SEQ ID NO: 521076 - RNA, 64 nt, hsa; identical to SEQ ID NO: 23410

SEQ ID NO: 521077 - RNA, 64 nt, hsa; identical to SEQ ID NO: 23411

SEQ ID NO: 521078 - RNA, 64 nt, hsa; identical to SEQ ID NO: 23412

SEQ ID NO: 521079 - RNA, 64 nt, hsa; identical to SEQ ID NO: 23413

SEQ ID NO: 521080 - RNA, 64 nt, hsa; identical to SEQ ID NO: 23414

SEQ ID NO: 521081 - RNA, 64 nt, hsa; identical to SEQ ID NO: 23415

SEQ ID NO: 521082 - RNA, 64 nt, hsa; identical to SEQ ID NO: 23416

SEQ ID NO: 521083 - RNA, 64 nt, hsa; identical to SEQ ID NO: 23417

SEQ ID NO: 521084 - RNA, 64 nt, hsa; identical to SEQ ID NO: 23418

SEQ ID NO: 521085 - RNA, 64 nt, hsa; identical to SEQ ID NO: 23419

SEQ ID NO: 521086 - RNA, 64 nt, hsa; identical to SEQ ID NO: 23420

SEQ ID NO: 521087 - RNA, 64 nt, hsa; identical to SEQ ID NO: 23421

SEQ ID NO: 521088 - RNA, 64 nt, hsa; identical to SEQ ID NO: 23422

SEQ ID NO: 521089 - RNA, 64 nt, hsa; identical to SEQ ID NO: 23423

SEQ ID NO: 521090 - RNA, 64 nt, hsa; identical to SEQ ID NO: 23424

SEQ ID NO: 521091 - RNA, 64 nt, hsa; identical to SEQ ID NO: 23425

SEQ ID NO: 521092 - RNA, 64 nt, hsa; identical to SEQ ID NO: 23426

SEQ ID NO: 521093 - RNA, 64 nt, hsa; identical to SEQ ID NO: 23427

SEQ ID NO: 521094 - RNA, 64 nt, hsa; identical to SEQ ID NO: 23428

SEQ ID NO: 521095 - RNA, 64 nt, hsa; identical to SEQ ID NO: 23429

SEQ ID NO: 521096 - RNA, 64 nt, hsa; identical to SEQ ID NO: 23430

SEQ ID NO: 521097 - RNA, 64 nt, hsa; identical to SEQ ID NO: 23431

SEQ ID NO: 521098 - RNA, 64 nt, hsa; identical to SEQ ID NO: 23432

SEQ ID NO: 521099 - RNA, 64 nt, hsa; identical to SEQ ID NO: 23433

SEQ ID NO: 521100 - RNA, 64 nt, hsa; identical to SEQ ID NO: 23434

SEQ ID NO: 521101 - RNA, 64 nt, hsa; identical to SEQ ID NO: 23435

SEQ ID NO: 521102 - RNA, 64 nt, hsa; identical to SEQ ID NO: 23436

SEQ ID NO: 521103 - RNA, 64 nt, hsa; identical to SEQ ID NO: 23437

SEQ ID NO: 521104 - RNA, 64 nt, hsa; identical to SEQ ID NO: 23438

SEQ ID NO: 521105 - RNA, 64 nt, hsa; identical to SEQ ID NO: 23439

SEQ ID NO: 521106 - RNA, 64 nt, hsa; identical to SEQ ID NO: 23440

SEQ ID NO: 521107 - RNA, 64 nt, hsa; identical to SEQ ID NO: 23441

SEQ ID NO: 521108 - RNA, 64 nt, hsa; identical to SEQ ID NO: 23442

SEQ ID NO: 521109 - RNA, 64 nt, hsa; identical to SEQ ID NO: 23443

SEQ ID NO: 521110 - RNA, 64 nt, hsa; identical to SEQ ID NO: 23444

SEQ ID NO: 521111 - RNA, 64 nt, hsa; identical to SEQ ID NO: 23445

SEQ ID NO: 521112 - RNA, 64 nt, hsa; identical to SEQ ID NO: 23446

SEQ ID NO: 521113 - RNA, 64 nt, hsa; identical to SEQ ID NO: 23447

SEQ ID NO: 521114 - RNA, 64 nt, hsa; identical to SEQ ID NO: 23448

SEQ ID NO: 521115 - RNA, 64 nt, hsa; identical to SEQ ID NO: 23449

SEQ ID NO: 521116 - RNA, 64 nt, hsa; identical to SEQ ID NO: 23450

SEQ ID NO: 521117 - RNA, 64 nt, hsa; identical to SEQ ID NO: 23451

SEQ ID NO: 521118 - RNA, 64 nt, hsa; identical to SEQ ID NO: 23452

SEQ ID NO: 521119 - RNA, 64 nt, hsa; identical to SEQ ID NO: 111122

SEQ ID NO: 521120 - RNA, 64 nt, hsa; identical to SEQ ID NO: 111123

SEQ ID NO: 521121 - RNA, 64 nt, hsa; identical to SEQ ID NO: 111124

SEQ ID NO: 521122 - RNA, 64 nt, hsa; identical to SEQ ID NO: 111125

SEQ ID NO: 521123 - RNA, 64 nt, hsa; identical to SEQ ID NO: 111126

SEQ ID NO: 521124 - RNA, 64 nt, hsa; identical to SEQ ID NO: 111127

SEQ ID NO: 521125 - RNA, 64 nt, hsa; identical to SEQ ID NO: 111128

SEQ ID NO: 521126 - RNA, 64 nt, hsa; identical to SEQ ID NO: 111129

SEQ ID NO: 521127 - RNA, 64 nt, hsa; identical to SEQ ID NO: 111130

SEQ ID NO: 521128 - RNA, 64 nt, hsa; identical to SEQ ID NO: 111131

SEQ ID NO: 521129 - RNA, 64 nt, hsa; identical to SEQ ID NO: 111132

SEQ ID NO: 521130 - RNA, 64 nt, hsa; identical to SEQ ID NO: 111133

SEQ ID NO: 521131 - RNA, 64 nt, hsa; identical to SEQ ID NO: 111134

SEQ ID NO: 521132 - RNA, 64 nt, hsa; identical to SEQ ID NO: 111135

SEQ ID NO: 521133 - RNA, 64 nt, hsa; identical to SEQ ID NO: 111136

SEQ ID NO: 521134 - RNA, 64 nt, hsa; identical to SEQ ID NO: 111137

SEQ ID NO: 521135 - RNA, 64 nt, hsa; identical to SEQ ID NO: 111138

SEQ ID NO: 521136 - RNA, 64 nt, hsa; identical to SEQ ID NO: 111139

SEQ ID NO: 521137 - RNA, 64 nt, hsa; identical to SEQ ID NO: 111140

SEQ ID NO: 521138 - RNA, 64 nt, hsa; identical to SEQ ID NO: 111141

SEQ ID NO: 521139 - RNA, 64 nt, hsa; identical to SEQ ID NO: 111142

SEQ ID NO: 521140 - RNA, 64 nt, hsa; identical to SEQ ID NO: 111143

SEQ ID NO: 521141 - RNA, 64 nt, hsa; identical to SEQ ID NO: 111144

SEQ ID NO: 521142 - RNA, 64 nt, hsa; identical to SEQ ID NO: 111145

SEQ ID NO: 521143 - RNA, 64 nt, hsa; identical to SEQ ID NO: 111146

SEQ ID NO: 521144 - RNA, 64 nt, hsa; identical to SEQ ID NO: 111147

SEQ ID NO: 521145 - RNA, 64 nt, hsa; identical to SEQ ID NO: 111148

SEQ ID NO: 521146 - RNA, 64 nt, hsa; identical to SEQ ID NO: 111149

SEQ ID NO: 521147 - RNA, 64 nt, hsa; identical to SEQ ID NO: 111150

SEQ ID NO: 521148 - RNA, 64 nt, hsa; identical to SEQ ID NO: 111151

SEQ ID NO: 521149 - RNA, 64 nt, hsa; identical to SEQ ID NO: 111152

SEQ ID NO: 521150 - RNA, 64 nt, hsa; identical to SEQ ID NO: 111153

SEQ ID NO: 521151 - RNA, 64 nt, hsa; identical to SEQ ID NO: 111154

SEQ ID NO: 521152 - RNA, 64 nt, hsa; identical to SEQ ID NO: 111155

SEQ ID NO: 521153 - RNA, 64 nt, hsa; identical to SEQ ID NO: 111156

SEQ ID NO: 521154 - RNA, 64 nt, hsa; identical to SEQ ID NO: 111157

SEQ ID NO: 521155 - RNA, 64 nt, hsa; identical to SEQ ID NO: 111158

SEQ ID NO: 521156 - RNA, 64 nt, hsa; identical to SEQ ID NO: 111159

SEQ ID NO: 521157 - RNA, 64 nt, hsa; identical to SEQ ID NO: 111160

SEQ ID NO: 521158 - RNA, 64 nt, hsa; identical to SEQ ID NO: 111161

SEQ ID NO: 521159 - RNA, 64 nt, hsa; identical to SEQ ID NO: 111162

SEQ ID NO: 521160 - RNA, 64 nt, hsa; identical to SEQ ID NO: 111163

SEQ ID NO: 521161 - RNA, 64 nt, hsa; identical to SEQ ID NO: 111164

SEQ ID NO: 521162 - RNA, 64 nt, hsa; identical to SEQ ID NO: 111165

SEQ ID NO: 521163 - RNA, 64 nt, hsa; identical to SEQ ID NO: 111166

SEQ ID NO: 521164 - RNA, 64 nt, hsa; identical to SEQ ID NO: 111167

SEQ ID NO: 521165 - RNA, 64 nt, hsa; identical to SEQ ID NO: 111168

SEQ ID NO: 521166 - RNA, 64 nt, hsa; identical to SEQ ID NO: 111169

SEQ ID NO: 521167 - RNA, 64 nt, hsa; identical to SEQ ID NO: 111170

SEQ ID NO: 521168 - RNA, 64 nt, hsa; identical to SEQ ID NO: 111171

SEQ ID NO: 521169 - RNA, 64 nt, hsa; identical to SEQ ID NO: 111172

SEQ ID NO: 521170 - RNA, 64 nt, hsa; identical to SEQ ID NO: 111173

SEQ ID NO: 521171 - RNA, 64 nt, hsa; identical to SEQ ID NO: 111174

SEQ ID NO: 521172 - RNA, 64 nt, hsa; identical to SEQ ID NO: 111175

SEQ ID NO: 521173 - RNA, 64 nt, hsa; identical to SEQ ID NO: 111176

SEQ ID NO: 521174 - RNA, 64 nt, hsa; identical to SEQ ID NO: 111177

SEQ ID NO: 521175 - RNA, 64 nt, hsa; identical to SEQ ID NO: 111178

SEQ ID NO: 521176 - RNA, 64 nt, hsa; identical to SEQ ID NO: 111179

SEQ ID NO: 521177 - RNA, 64 nt, hsa; identical to SEQ ID NO: 111180

SEQ ID NO: 521178 - RNA, 64 nt, hsa; identical to SEQ ID NO: 111181

SEQ ID NO: 521179 - RNA, 64 nt, hsa; identical to SEQ ID NO: 111182

SEQ ID NO: 521180 - RNA, 64 nt, hsa; identical to SEQ ID NO: 111183

SEQ ID NO: 521181 - RNA, 64 nt, hsa; identical to SEQ ID NO: 111184

SEQ ID NO: 521182 - RNA, 64 nt, hsa; identical to SEQ ID NO: 111185

SEQ ID NO: 521183 - RNA, 64 nt, hsa; identical to SEQ ID NO: 111186

SEQ ID NO: 521184 - RNA, 64 nt, hsa; identical to SEQ ID NO: 111187

SEQ ID NO: 521185 - RNA, 64 nt, hsa; identical to SEQ ID NO: 111188

SEQ ID NO: 521186 - RNA, 64 nt, hsa; identical to SEQ ID NO: 111189

SEQ ID NO: 521187 - RNA, 64 nt, hsa; identical to SEQ ID NO: 111190

SEQ ID NO: 521188 - RNA, 64 nt, hsa; identical to SEQ ID NO: 111191

SEQ ID NO: 521189 - RNA, 64 nt, hsa; identical to SEQ ID NO: 111192

SEQ ID NO: 521190 - RNA, 64 nt, hsa; identical to SEQ ID NO: 111193

SEQ ID NO: 521191 - RNA, 64 nt, hsa; identical to SEQ ID NO: 111194

SEQ ID NO: 521192 - RNA, 64 nt, hsa; identical to SEQ ID NO: 111195

SEQ ID NO: 521193 - RNA, 64 nt, hsa; identical to SEQ ID NO: 111196

SEQ ID NO: 521194 - RNA, 64 nt, hsa; identical to SEQ ID NO: 111197

SEQ ID NO: 521195 - RNA, 64 nt, hsa; identical to SEQ ID NO: 111198

SEQ ID NO: 521196 - RNA, 64 nt, hsa; identical to SEQ ID NO: 111199

SEQ ID NO: 521197 - RNA, 64 nt, hsa; identical to SEQ ID NO: 111200

SEQ ID NO: 521198 - RNA, 64 nt, hsa; identical to SEQ ID NO: 111201

SEQ ID NO: 521199 - RNA, 64 nt, hsa; identical to SEQ ID NO: 111202

SEQ ID NO: 521200 - RNA, 64 nt, hsa; identical to SEQ ID NO: 111203

SEQ ID NO: 521201 - RNA, 64 nt, hsa; identical to SEQ ID NO: 111204

SEQ ID NO: 521202 - RNA, 64 nt, hsa; identical to SEQ ID NO: 111205

SEQ ID NO: 521203 - RNA, 64 nt, hsa; identical to SEQ ID NO: 111206

SEQ ID NO: 521204 - RNA, 64 nt, hsa; identical to SEQ ID NO: 111207

SEQ ID NO: 521205 - RNA, 64 nt, hsa; identical to SEQ ID NO: 111208

SEQ ID NO: 521206 - RNA, 64 nt, hsa; identical to SEQ ID NO: 111209

SEQ ID NO: 521207 - RNA, 64 nt, hsa; identical to SEQ ID NO: 111210

SEQ ID NO: 521208 - RNA, 64 nt, hsa; identical to SEQ ID NO: 111211

SEQ ID NO: 521209 - RNA, 64 nt, hsa; identical to SEQ ID NO: 111212

SEQ ID NO: 521210 - RNA, 64 nt, hsa; identical to SEQ ID NO: 111213

SEQ ID NO: 521211 - RNA, 64 nt, hsa; identical to SEQ ID NO: 111214

SEQ ID NO: 521212 - RNA, 64 nt, hsa; identical to SEQ ID NO: 111215

SEQ ID NO: 521213 - RNA, 64 nt, hsa; identical to SEQ ID NO: 111216

SEQ ID NO: 521214 - RNA, 64 nt, hsa; identical to SEQ ID NO: 111217

SEQ ID NO: 521215 - RNA, 64 nt, hsa; identical to SEQ ID NO: 111218

SEQ ID NO: 521216 - RNA, 64 nt, hsa; identical to SEQ ID NO: 111219

SEQ ID NO: 521217 - RNA, 64 nt, hsa; identical to SEQ ID NO: 111220

SEQ ID NO: 521218 - RNA, 64 nt, hsa; identical to SEQ ID NO: 111221

SEQ ID NO: 521219 - RNA, 64 nt, hsa; identical to SEQ ID NO: 111222

SEQ ID NO: 521220 - RNA, 64 nt, hsa; identical to SEQ ID NO: 111223

SEQ ID NO: 521221 - RNA, 64 nt, hsa; identical to SEQ ID NO: 111224

SEQ ID NO: 521222 - RNA, 64 nt, hsa; identical to SEQ ID NO: 111225

SEQ ID NO: 521223 - RNA, 64 nt, hsa; identical to SEQ ID NO: 111226

SEQ ID NO: 521224 - RNA, 64 nt, hsa; identical to SEQ ID NO: 111227

SEQ ID NO: 521225 - RNA, 64 nt, hsa; identical to SEQ ID NO: 111228

SEQ ID NO: 521226 - RNA, 64 nt, hsa; identical to SEQ ID NO: 111229

SEQ ID NO: 521227 - RNA, 64 nt, hsa; identical to SEQ ID NO: 111230

SEQ ID NO: 521228 - RNA, 64 nt, hsa; identical to SEQ ID NO: 111231

SEQ ID NO: 521229 - RNA, 64 nt, hsa; identical to SEQ ID NO: 111232

SEQ ID NO: 521230 - RNA, 64 nt, hsa; identical to SEQ ID NO: 111233

SEQ ID NO: 521231 - RNA, 64 nt, hsa; identical to SEQ ID NO: 111234

SEQ ID NO: 521232 - RNA, 64 nt, hsa; identical to SEQ ID NO: 111235

SEQ ID NO: 521233 - RNA, 64 nt, hsa; identical to SEQ ID NO: 111236

SEQ ID NO: 521234 - RNA, 64 nt, hsa; identical to SEQ ID NO: 111237

SEQ ID NO: 521235 - RNA, 64 nt, hsa; identical to SEQ ID NO: 111238

SEQ ID NO: 521236 - RNA, 64 nt, hsa; identical to SEQ ID NO: 111239

SEQ ID NO: 521237 - RNA, 64 nt, hsa; identical to SEQ ID NO: 111240

SEQ ID NO: 521238 - RNA, 64 nt, hsa; identical to SEQ ID NO: 111241

SEQ ID NO: 521239 - RNA, 64 nt, hsa; identical to SEQ ID NO: 111242

SEQ ID NO: 521240 - RNA, 64 nt, hsa; identical to SEQ ID NO: 111243

SEQ ID NO: 521241 - RNA, 64 nt, hsa; identical to SEQ ID NO: 111244

SEQ ID NO: 521242 - RNA, 64 nt, hsa; identical to SEQ ID NO: 111245

SEQ ID NO: 521243 - RNA, 64 nt, hsa; identical to SEQ ID NO: 111246

SEQ ID NO: 521244 - RNA, 64 nt, hsa; identical to SEQ ID NO: 111247

SEQ ID NO: 521245 - RNA, 64 nt, hsa; identical to SEQ ID NO: 111248

SEQ ID NO: 521246 - RNA, 64 nt, hsa; identical to SEQ ID NO: 111249

SEQ ID NO: 521247 - RNA, 64 nt, hsa; identical to SEQ ID NO: 111250

SEQ ID NO: 521248 - RNA, 64 nt, hsa; identical to SEQ ID NO: 111251

SEQ ID NO: 521249 - RNA, 64 nt, hsa; identical to SEQ ID NO: 111252

SEQ ID NO: 521250 - RNA, 64 nt, hsa; identical to SEQ ID NO: 111253

SEQ ID NO: 521251 - RNA, 64 nt, hsa; identical to SEQ ID NO: 111254

SEQ ID NO: 521252 - RNA, 64 nt, hsa; identical to SEQ ID NO: 111255

SEQ ID NO: 521253 - RNA, 64 nt, hsa; identical to SEQ ID NO: 111256

SEQ ID NO: 521254 - RNA, 64 nt, hsa; identical to SEQ ID NO: 111257

SEQ ID NO: 521255 - RNA, 64 nt, hsa; identical to SEQ ID NO: 111258

SEQ ID NO: 521256 - RNA, 64 nt, hsa; identical to SEQ ID NO: 111259

SEQ ID NO: 521257 - RNA, 64 nt, hsa; identical to SEQ ID NO: 111260

SEQ ID NO: 521258 - RNA, 64 nt, hsa; identical to SEQ ID NO: 111261

SEQ ID NO: 521259 - RNA, 64 nt, hsa; identical to SEQ ID NO: 111262

SEQ ID NO: 521260 - RNA, 64 nt, hsa; identical to SEQ ID NO: 111263

SEQ ID NO: 521261 - RNA, 64 nt, hsa; identical to SEQ ID NO: 111264

SEQ ID NO: 521262 - RNA, 64 nt, hsa; identical to SEQ ID NO: 111265

SEQ ID NO: 521263 - RNA, 64 nt, hsa; identical to SEQ ID NO: 111266

SEQ ID NO: 521264 - RNA, 64 nt, hsa; identical to SEQ ID NO: 111267

SEQ ID NO: 521265 - RNA, 64 nt, hsa; identical to SEQ ID NO: 111268

SEQ ID NO: 521266 - RNA, 64 nt, hsa; identical to SEQ ID NO: 111269

SEQ ID NO: 521267 - RNA, 64 nt, hsa; identical to SEQ ID NO: 111270

SEQ ID NO: 521268 - RNA, 64 nt, hsa; identical to SEQ ID NO: 111271

SEQ ID NO: 521269 - RNA, 64 nt, hsa; identical to SEQ ID NO: 111272

SEQ ID NO: 521270 - RNA, 64 nt, hsa; identical to SEQ ID NO: 111273

SEQ ID NO: 521271 - RNA, 64 nt, hsa; identical to SEQ ID NO: 111274

SEQ ID NO: 521272 - RNA, 64 nt, hsa; identical to SEQ ID NO: 111275

SEQ ID NO: 521273 - RNA, 64 nt, hsa; identical to SEQ ID NO: 111276

SEQ ID NO: 521274 - RNA, 64 nt, hsa; identical to SEQ ID NO: 111277

SEQ ID NO: 521275 - RNA, 64 nt, hsa; identical to SEQ ID NO: 111278

SEQ ID NO: 521276 - RNA, 64 nt, hsa; identical to SEQ ID NO: 111279

SEQ ID NO: 521277 - RNA, 64 nt, hsa; identical to SEQ ID NO: 111280

SEQ ID NO: 521278 - RNA, 64 nt, hsa; identical to SEQ ID NO: 111281

SEQ ID NO: 521279 - RNA, 64 nt, hsa; identical to SEQ ID NO: 111282

SEQ ID NO: 521280 - RNA, 64 nt, hsa; identical to SEQ ID NO: 111283

SEQ ID NO: 521281 - RNA, 64 nt, hsa; identical to SEQ ID NO: 111284

SEQ ID NO: 521282 - RNA, 64 nt, hsa; identical to SEQ ID NO: 111285

SEQ ID NO: 521283 - RNA, 64 nt, hsa; identical to SEQ ID NO: 111286

SEQ ID NO: 521284 - RNA, 64 nt, hsa; identical to SEQ ID NO: 111287

SEQ ID NO: 521285 - RNA, 64 nt, hsa; identical to SEQ ID NO: 111288

SEQ ID NO: 521286 - RNA, 64 nt, hsa; identical to SEQ ID NO: 111289

SEQ ID NO: 521287 - RNA, 64 nt, hsa; identical to SEQ ID NO: 111290

SEQ ID NO: 521288 - RNA, 64 nt, hsa; identical to SEQ ID NO: 111291

SEQ ID NO: 521289 - RNA, 64 nt, hsa; identical to SEQ ID NO: 111292

SEQ ID NO: 521290 - RNA, 64 nt, hsa; identical to SEQ ID NO: 111293

SEQ ID NO: 521291 - RNA, 64 nt, hsa; identical to SEQ ID NO: 111294

SEQ ID NO: 521292 - RNA, 64 nt, hsa; identical to SEQ ID NO: 111295

SEQ ID NO: 521293 - RNA, 64 nt, hsa; identical to SEQ ID NO: 111296

SEQ ID NO: 521294 - RNA, 64 nt, hsa; identical to SEQ ID NO: 111297

SEQ ID NO: 521295 - RNA, 64 nt, hsa; identical to SEQ ID NO: 111298

SEQ ID NO: 521296 - RNA, 64 nt, hsa; identical to SEQ ID NO: 111299

SEQ ID NO: 521297 - RNA, 64 nt, hsa; identical to SEQ ID NO: 111300

SEQ ID NO: 521298 - RNA, 64 nt, hsa; identical to SEQ ID NO: 111301

SEQ ID NO: 521299 - RNA, 64 nt, hsa; identical to SEQ ID NO: 111302

SEQ ID NO: 521300 - RNA, 64 nt, hsa; identical to SEQ ID NO: 111303

SEQ ID NO: 521301 - RNA, 64 nt, hsa; identical to SEQ ID NO: 111304

SEQ ID NO: 521302 - RNA, 64 nt, hsa; identical to SEQ ID NO: 365461

SEQ ID NO: 521303 - RNA, 64 nt, hsa; identical to SEQ ID NO: 365462

SEQ ID NO: 521304 - RNA, 64 nt, hsa; identical to SEQ ID NO: 365463

SEQ ID NO: 521305 - RNA, 64 nt, hsa; identical to SEQ ID NO: 365464

SEQ ID NO: 521306 - RNA, 64 nt, hsa; identical to SEQ ID NO: 365465

SEQ ID NO: 521307 - RNA, 64 nt, hsa; identical to SEQ ID NO: 365466

SEQ ID NO: 521308 - RNA, 64 nt, hsa; identical to SEQ ID NO: 365467

SEQ ID NO: 521309 - RNA, 64 nt, hsa; identical to SEQ ID NO: 365468

SEQ ID NO: 521310 - RNA, 64 nt, hsa; identical to SEQ ID NO: 365469

SEQ ID NO: 521311 - RNA, 64 nt, hsa; identical to SEQ ID NO: 365470

SEQ ID NO: 521312 - RNA, 64 nt, hsa; identical to SEQ ID NO: 365471

SEQ ID NO: 521313 - RNA, 64 nt, hsa; identical to SEQ ID NO: 365472

SEQ ID NO: 521314 - RNA, 64 nt, hsa; identical to SEQ ID NO: 365473

SEQ ID NO: 521315 - RNA, 64 nt, hsa; identical to SEQ ID NO: 365474

SEQ ID NO: 521316 - RNA, 64 nt, hsa; identical to SEQ ID NO: 365475

SEQ ID NO: 521317 - RNA, 64 nt, hsa; identical to SEQ ID NO: 365476

SEQ ID NO: 521318 - RNA, 64 nt, hsa; identical to SEQ ID NO: 365477

SEQ ID NO: 521319 - RNA, 64 nt, hsa; identical to SEQ ID NO: 365478

SEQ ID NO: 521320 - RNA, 64 nt, hsa; identical to SEQ ID NO: 365479

SEQ ID NO: 521321 - RNA, 62 nt, hsa; identical to SEQ ID NO: 365480

SEQ ID NO: 521322 - RNA, 64 nt, hsa; identical to SEQ ID NO: 365481

SEQ ID NO: 521323 - RNA, 64 nt, hsa; identical to SEQ ID NO: 365482

SEQ ID NO: 521324 - RNA, 64 nt, hsa; identical to SEQ ID NO: 365483

SEQ ID NO: 521325 - RNA, 64 nt, hsa; identical to SEQ ID NO: 365484

SEQ ID NO: 521326 - RNA, 64 nt, hsa; identical to SEQ ID NO: 365485

SEQ ID NO: 521327 - RNA, 64 nt, hsa; identical to SEQ ID NO: 365486

SEQ ID NO: 521328 - RNA, 64 nt, hsa; identical to SEQ ID NO: 365487

SEQ ID NO: 521329 - RNA, 64 nt, hsa; identical to SEQ ID NO: 365488

SEQ ID NO: 521330 - RNA, 64 nt, hsa; identical to SEQ ID NO: 365489

SEQ ID NO: 521331 - RNA, 64 nt, hsa; identical to SEQ ID NO: 365490

SEQ ID NO: 521332 - RNA, 64 nt, hsa; identical to SEQ ID NO: 365491

SEQ ID NO: 521333 - RNA, 64 nt, hsa; identical to SEQ ID NO: 365492

SEQ ID NO: 521334 - RNA, 64 nt, hsa; identical to SEQ ID NO: 365493

SEQ ID NO: 521335 - RNA, 64 nt, hsa; identical to SEQ ID NO: 365494

SEQ ID NO: 521336 - RNA, 64 nt, hsa; identical to SEQ ID NO: 365495

SEQ ID NO: 521337 - RNA, 64 nt, hsa; identical to SEQ ID NO: 365496

SEQ ID NO: 521338 - RNA, 64 nt, hsa; identical to SEQ ID NO: 365497

SEQ ID NO: 521339 - RNA, 64 nt, hsa; identical to SEQ ID NO: 365498

SEQ ID NO: 521340 - RNA, 64 nt, hsa; identical to SEQ ID NO: 365499

SEQ ID NO: 521341 - RNA, 64 nt, hsa; identical to SEQ ID NO: 365500

SEQ ID NO: 521342 - RNA, 64 nt, hsa; identical to SEQ ID NO: 365501

SEQ ID NO: 521343 - RNA, 64 nt, hsa; identical to SEQ ID NO: 365502

SEQ ID NO: 521344 - RNA, 64 nt, hsa; identical to SEQ ID NO: 365503

SEQ ID NO: 521345 - RNA, 64 nt, hsa; identical to SEQ ID NO: 365504

SEQ ID NO: 521346 - RNA, 56 nt, hsa; identical to SEQ ID NO: 365505

SEQ ID NO: 521347 - RNA, 64 nt, hsa; identical to SEQ ID NO: 365506

SEQ ID NO: 521348 - RNA, 64 nt, hsa; identical to SEQ ID NO: 365507

SEQ ID NO: 521349 - RNA, 64 nt, hsa; identical to SEQ ID NO: 365508

SEQ ID NO: 521350 - RNA, 64 nt, hsa; identical to SEQ ID NO: 365509

SEQ ID NO: 521351 - RNA, 64 nt, hsa; identical to SEQ ID NO: 365510

SEQ ID NO: 521352 - RNA, 64 nt, hsa; identical to SEQ ID NO: 365511

SEQ ID NO: 521353 - RNA, 64 nt, hsa; identical to SEQ ID NO: 365512

SEQ ID NO: 521354 - RNA, 64 nt, hsa; identical to SEQ ID NO: 365513

SEQ ID NO: 521355 - RNA, 64 nt, hsa; identical to SEQ ID NO: 365514

SEQ ID NO: 521356 - RNA, 64 nt, hsa; identical to SEQ ID NO: 365515

SEQ ID NO: 521357 - RNA, 64 nt, hsa; identical to SEQ ID NO: 365516

SEQ ID NO: 521358 - RNA, 64 nt, hsa; identical to SEQ ID NO: 365517

SEQ ID NO: 521359 - RNA, 64 nt, hsa; identical to SEQ ID NO: 365518

SEQ ID NO: 521360 - RNA, 64 nt, hsa; identical to SEQ ID NO: 365519

SEQ ID NO: 521361 - RNA, 64 nt, hsa; identical to SEQ ID NO: 365520

SEQ ID NO: 521362 - RNA, 64 nt, hsa; identical to SEQ ID NO: 365521

SEQ ID NO: 521363 - RNA, 64 nt, hsa; identical to SEQ ID NO: 365522

SEQ ID NO: 521364 - RNA, 64 nt, hsa; identical to SEQ ID NO: 365523

SEQ ID NO: 521365 - RNA, 64 nt, hsa; identical to SEQ ID NO: 365524

SEQ ID NO: 521366 - RNA, 64 nt, hsa; identical to SEQ ID NO: 365525

SEQ ID NO: 521367 - RNA, 64 nt, hsa; identical to SEQ ID NO: 219898

SEQ ID NO: 521368 - RNA, 64 nt, hsa; identical to SEQ ID NO: 219899

SEQ ID NO: 521369 - RNA, 64 nt, hsa; identical to SEQ ID NO: 219900

SEQ ID NO: 521370 - RNA, 64 nt, hsa; identical to SEQ ID NO: 219901

SEQ ID NO: 521371 - RNA, 64 nt, hsa; identical to SEQ ID NO: 219902

SEQ ID NO: 521372 - RNA, 64 nt, hsa; identical to SEQ ID NO: 219903

SEQ ID NO: 521373 - RNA, 64 nt, hsa
uauuaccaauguggguguaaauuuuuaaaaaaugauuauugauagaaguuuggcaggaaaauuc

SEQ ID NO: 521374 - RNA, 64 nt, hsa
uggucaaaagucaaaauaguauuagaauauugaaauuauugauagcuuucauaaucucagcuuu

SEQ ID NO: 521375 - RNA, 64 nt, hsa
uuuugcuuguggaucuccacuugucccacugcugauuauugagaaaaauauccuuucuccacgg

SEQ ID NO: 521376 - RNA, 64 nt, hsa
aaccacuagacuaccagggaugagccuucuuuuuauuauugaguugggugagcuauuuguauau

SEQ ID NO: 521377 - RNA, 64 nt, hsa
guaggacagcuaagaaauuaauauuaauaucaaaauuauugauaaucuuaaauuauugauuauu

SEQ ID NO: 521378 - RNA, 64 nt, hsa
uuaauauuaauaucaaaauuauugauaaucuuaaauuauugauuauuccuuaacgcacuccauu

SEQ ID NO: 521379 - RNA, 64 nt, hsa
auguagaaugauuuuguuaagaguaauguaaacuauuauugaguagaggccuaaagaggacugu

SEQ ID NO: 521380 - RNA, 64 nt, hsa
auugcacugaauuuaaaucugaaagucagaggugauuauugauaguacuuuuguauuuugauau

SEQ ID NO: 521381 - RNA, 64 nt, hsa
uauccuacuacuuuuaaucugauuuuucuucaggauuauugaguagguugugaauuuucuuucu

SEQ ID NO: 521382 - RNA, 64 nt, hsa
auuucuuaaaugaagagacuuucauucuuuaaauauuauugacuuacaguuuaaaaauaaauaa

SEQ ID NO: 521383 - RNA, 64 nt, hsa
auauauauauacauauauauauaucaaguuuuaaauuauugauaguucaucuggauuaccaaaa

SEQ ID NO: 521384 - RNA, 64 nt, hsa
aaauacuugaaugagcuuguauuauaacauuaauauuauugagaguaucugcuuuccaggcuga

SEQ ID NO: 521385 - RNA, 64 nt, hsa
uuuauguauacuagccuggccuuucuccaagcaaauuauugaacuauuagaauauguuaguuau

SEQ ID NO: 521386 - RNA, 64 nt, hsa
acuaaucaaaguugugugaugauuuccgggaauuauuauugaaagccuaugaauuuaaaaccag

SEQ ID NO: 521387 - RNA, 64 nt, hsa
acuaucuuuccaaacuuuguuagauuuuaaauguauuauugaccugagaccuuaaugacaaauc

SEQ ID NO: 521388 - RNA, 64 nt, hsa
auucuggugcugaugaauagguugccuucagaguauuauugacagacagcuuguggaacuaauu

SEQ ID NO: 521389 - RNA, 64 nt, hsa
augucgaugaccuuuuuuucuuuagaguaacagcauuauugagauauaauuuacauaccauaag

SEQ ID NO: 521390 - RNA, 64 nt, hsa
aauuuguccuagauaaggauaaaguagcuaauccauuauugaucacaguaugaaguaaaacuau

SEQ ID NO: 521391 - RNA, 64 nt, hsa
uuucuauugccauuuuuuauuugugcaugaauugauuauugagaaaauguagcaguuugcauau

SEQ ID NO: 521392 - RNA, 64 nt, hsa
gcuuauggacugagaaagggagaacaugguagggauuauugaaucauuucaaauuuauaccagc

SEQ ID NO: 521393 - RNA, 64 nt, hsa
gcagaauguauaucaucccaucugaaaaacacuaauuauugacaugugcaucuguacaauaaac

SEQ ID NO: 521394 - RNA, 64 nt, hsa
uuaaauaaucaaauauaucuacuacauuguuuauauuauugaauaaaguauauuuuccaaaugu

SEQ ID NO: 521395 - RNA, 64 nt, hsa
gaucaggaauacucuuccaggaguacaaaauuacauuauugauaguuaagcucuuaauugugua

SEQ ID NO: 521396 - RNA, 64 nt, hsa
cuuccaacuaaaauuacaauauuuuuagguuaaaauuauugagauauaaagcagccauugggaa

SEQ ID NO: 521397 - RNA, 64 nt, hsa
auuuaucaaaacucauuuucuuguuaaagagugaauuauugaauaguaauuaaacuuuaacuga

SEQ ID NO: 521398 - RNA, 64 nt, hsa
uuuugacagcauuugugacugucauugccacuaaauuauugagcuagaagaugcugcagggaaa

SEQ ID NO: 521399 - RNA, 64 nt, hsa
uguuguugcaguuguuuugaaacaaaauuauccuauuauugaccauugcuagagacccacaucc

SEQ ID NO: 521400 - RNA, 64 nt, hsa
caucuagcugcaaagaaggcuagggaaugucuuuauuauugauugucaugugccuugauaagca

SEQ ID NO: 521401 - RNA, 64 nt, hsa
cugcagaagugcagggcaccaguaaacaccauguauuauugaagaugaaucuguuuguauguau

SEQ ID NO: 521402 - RNA, 64 nt, hsa
gagaaugauaagaugagggaaggaaaaggcauucauuauugacuuacaugucaguaaggucugc

SEQ ID NO: 521403 - RNA, 64 nt, hsa
ggaaugaaaucauuuauaaagaacaacuguuucuauuauugaaaauuguauguaaaacuauuua

SEQ ID NO: 521404 - RNA, 64 nt, hsa
acuauuuaaaauagaauagaaggauacacacccaauuauugauagcauugucucuggagauuga

SEQ ID NO: 521405 - RNA, 64 nt, hsa
cugacuacauuucuagagucagagcuugaucaccacaacucaauuauuucggcaucuuuucacc

SEQ ID NO: 521406 - RNA, 64 nt, hsa
uugguuccacucagcaucaagaagacagggacaaacaacucaagugucuuaacagcugcuggag

SEQ ID NO: 521407 - RNA, 64 nt, hsa
uauauucacuuucauuuuugacaggauucccuccacaacucaguuucauauauuauuccguauu

SEQ ID NO: 521408 - RNA, 64 nt, hsa
uuauuggaggauuuggucagaaugcaguuguuguacaacucauaaauacuaacugcugauuuug

SEQ ID NO: 521409 - RNA, 64 nt, hsa
gauucuaguggcaguauucuuguaaccuguuagacguggauauaccucuucaggauggccuccu

SEQ ID NO: 521410 - RNA, 64 nt, hsa
uuguacuucacugaauugugaugguuagaaacuucguggauaguuuguggaaaucauccaauua

SEQ ID NO: 521411 - RNA, 64 nt, hsa
gccaggcuggggccaugggcugcugccagaggaccguggauaccucaguguccacacacccacc

SEQ ID NO: 521412 - RNA, 64 nt, hsa
ucaguauccgaagcggguggauuccaggacgcuccguggauaauaaacuuugacgacgcugaga

SEQ ID NO: 521413 - RNA, 64 nt, hsa
caagucaucauaaacuagguauugcauugcuauccguggauacagacgcuuagcucuuaaaaga

SEQ ID NO: 521414 - RNA, 64 nt, hsa
uaagggagcuacgcugugguuuauucuuaaguuacguggauaaacuaaccucuaacagaaauau

SEQ ID NO: 521415 - RNA, 64 nt, hsa
cagaguaagccgguaaauguuugugaaaucaaugcguggauaaaggaacacaugccauccaagu

SEQ ID NO: 521416 - RNA, 64 nt, hsa
gggugccuugcccuggucuaauccaggacauagccguggauacguccaaaaauccccagaaccu

SEQ ID NO: 521417 - RNA, 64 nt, hsa
aauucagcaaggcuuucauauccuugcugugggucguggauaaggagcuuauucagguuuccug

SEQ ID NO: 521418 - RNA, 64 nt, hsa
uuucuuauuguuaccacauguucaccuuuaucagcguggauacugucagcaugaguacauauuu

SEQ ID NO: 521419 - RNA, 59 nt, hsa
gcauccuaacaaaccguuaggaacagccccguggauacugaaguuuuuuuuaugguagu

SEQ ID NO: 521420 - RNA, 64 nt, hsa
gcgggugagguuccgacacugaucccagagaugccguggauacgccagggucccagggggaauc

SEQ ID NO: 521421 - RNA, 64 nt, hsa
gcugcccagaaugcacagcgaugguaagagacaccguggauauucuucaucagaagcuuuaauc

SEQ ID NO: 521422 - RNA, 64 nt, hsa
cuccagagaccuaauggccucaacaccuucugaacguggauagugccagaacacuuaggagggu

SEQ ID NO: 521423 - RNA, 64 nt, hsa
uaaauuguuuuucauaauaguggugauauguuugcguggauacgucuguacuauuucaucuggu

SEQ ID NO: 521424 - RNA, 64 nt, hsa
ugcugagaugccuuucaaugcaaucgucugggcucguggauaugucccucaggugcggugacag

SEQ ID NO: 521425 - RNA, 64 nt, hsa
guuaaauguaaugggaagguggcagacuuaagaacguggauaugaagugccuagaaccaccaca

SEQ ID NO: 521426 - RNA, 64 nt, hsa
guuguuagguuuuuguguaagauucuugcuguagcguggauagcugugauuggugagucaaccg

SEQ ID NO: 521427 - RNA, 64 nt, hsa
gucacuaagcucaagugcuuggaugaaaggacagcguggauaaaaagguuuuuaaaacauggau

SEQ ID NO: 521428 - RNA, 64 nt, hsa
gcucgcucucuccugcaaugauugaugaucacuccguggauagagaggcacacugucagaggug

SEQ ID NO: 521429 - RNA, 64 nt, hsa
cugaauuccaagcuccacuggcauuucagucugacguggauaaagaagaagauaagaaagaggu

SEQ ID NO: 521430 - RNA, 64 nt, hsa
ugacauaugggaagacaacagauucagaaauuuacguggauaggacuuuagacaccacccagcc

SEQ ID NO: 521431 - RNA, 64 nt, hsa
uuuccugcugugaaaacucaucuuucauuuuugccguggauaggcgcuuuuauuaauuguuguc

SEQ ID NO: 521432 - RNA, 64 nt, hsa
cuccucaucaguguguaaauaauuugcacugaaacguggauacagagccacgaguuuggauguu

SEQ ID NO: 521433 - RNA, 64 nt, hsa
auuaacaaugagaaagagagaaguguaucuguuacguggauauaugggccagccuggauauaca

SEQ ID NO: 521434 - RNA, 64 nt, hsa
gaaaugugcacacuaauauuuaguuuugcuuucucguggauaauauuaagcacuuacucugcag

SEQ ID NO: 521435 - RNA, 64 nt, hsa
gguguugagccuggacugugggaggaaagagcugcguggauagauucaaacuuccugugguagu

SEQ ID NO: 521436 - RNA, 64 nt, hsa
agguaacggaaaccucaaucacagaaaguaaagccguggauacggugggacuaauguauuggua

SEQ ID NO: 521437 - RNA, 64 nt, hsa
ggcuguguuccucgggcucuucuggaccuugcaccguggauaccaggccaugugccaugguauu

SEQ ID NO: 521438 - RNA, 64 nt, hsa
ccccugcagguucugacaggaacagcauggauuccguggauagcuguugcagucucaagaagac

SEQ ID NO: 521439 - RNA, 64 nt, hsa
uuaaagcagucuugcaggucgcuccuuucccagccguggauaaaaacugaagcuaggaaucuaa

SEQ ID NO: 521440 - RNA, 64 nt, hsa
cacacuuugaagaauacagaccccaguaucuagucguggauauaauuaaaacgcugaagaccau

SEQ ID NO: 521441 - RNA, 64 nt, hsa
ccagauuuaucaaauggucaugcccacugggagccguggauaugcguggggacauccuggguca

SEQ ID NO: 521442 - RNA, 64 nt, hsa; identical to SEQ ID NO: 168425

SEQ ID NO: 521443 - RNA, 64 nt, hsa; identical to SEQ ID NO: 168426

SEQ ID NO: 521444 - RNA, 64 nt, hsa; identical to SEQ ID NO: 168427

SEQ ID NO: 521445 - RNA, 64 nt, hsa; identical to SEQ ID NO: 168428

SEQ ID NO: 521446 - RNA, 64 nt, hsa; identical to SEQ ID NO: 168429

SEQ ID NO: 521447 - RNA, 64 nt, hsa; identical to SEQ ID NO: 168430

SEQ ID NO: 521448 - RNA, 64 nt, hsa; identical to SEQ ID NO: 168431

SEQ ID NO: 521449 - RNA, 64 nt, hsa; identical to SEQ ID NO: 168432

SEQ ID NO: 521450 - RNA, 64 nt, hsa; identical to SEQ ID NO: 168433

SEQ ID NO: 521451 - RNA, 64 nt, hsa; identical to SEQ ID NO: 168434

SEQ ID NO: 521452 - RNA, 64 nt, hsa; identical to SEQ ID NO: 168435

SEQ ID NO: 521453 - RNA, 64 nt, hsa; identical to SEQ ID NO: 168436

SEQ ID NO: 521454 - RNA, 64 nt, hsa; identical to SEQ ID NO: 168437

SEQ ID NO: 521455 - RNA, 64 nt, hsa; identical to SEQ ID NO: 168438

SEQ ID NO: 521456 - RNA, 64 nt, hsa; identical to SEQ ID NO: 168439

SEQ ID NO: 521457 - RNA, 64 nt, hsa; identical to SEQ ID NO: 168440

SEQ ID NO: 521458 - RNA, 64 nt, hsa; identical to SEQ ID NO: 168441

SEQ ID NO: 521459 - RNA, 64 nt, hsa; identical to SEQ ID NO: 168442

SEQ ID NO: 521460 - RNA, 64 nt, hsa; identical to SEQ ID NO: 168443

SEQ ID NO: 521461 - RNA, 64 nt, hsa; identical to SEQ ID NO: 168444

SEQ ID NO: 521462 - RNA, 64 nt, hsa; identical to SEQ ID NO: 168445

SEQ ID NO: 521463 - RNA, 64 nt, hsa; identical to SEQ ID NO: 168446

SEQ ID NO: 521464 - RNA, 64 nt, hsa; identical to SEQ ID NO: 327018

SEQ ID NO: 521465 - RNA, 64 nt, hsa; identical to SEQ ID NO: 327019

SEQ ID NO: 521466 - RNA, 64 nt, hsa; identical to SEQ ID NO: 327020

SEQ ID NO: 521467 - RNA, 64 nt, hsa; identical to SEQ ID NO: 327021

SEQ ID NO: 521468 - RNA, 64 nt, hsa; identical to SEQ ID NO: 327022

SEQ ID NO: 521469 - RNA, 64 nt, hsa; identical to SEQ ID NO: 327023

SEQ ID NO: 521470 - RNA, 64 nt, hsa; identical to SEQ ID NO: 327024

SEQ ID NO: 521471 - RNA, 64 nt, hsa; identical to SEQ ID NO: 327025

SEQ ID NO: 521472 - RNA, 64 nt, hsa; identical to SEQ ID NO: 327026

SEQ ID NO: 521473 - RNA, 64 nt, hsa; identical to SEQ ID NO: 327027

SEQ ID NO: 521474 - RNA, 64 nt, hsa; identical to SEQ ID NO: 327028

SEQ ID NO: 521475 - RNA, 64 nt, hsa; identical to SEQ ID NO: 327029

SEQ ID NO: 521476 - RNA, 64 nt, hsa; identical to SEQ ID NO: 327030

SEQ ID NO: 521477 - RNA, 64 nt, hsa; identical to SEQ ID NO: 327031

SEQ ID NO: 521478 - RNA, 64 nt, hsa; identical to SEQ ID NO: 327032

SEQ ID NO: 521479 - RNA, 64 nt, hsa; identical to SEQ ID NO: 327033

SEQ ID NO: 521480 - RNA, 64 nt, hsa; identical to SEQ ID NO: 327034

SEQ ID NO: 521481 - RNA, 64 nt, hsa; identical to SEQ ID NO: 327035

SEQ ID NO: 521482 - RNA, 64 nt, hsa; identical to SEQ ID NO: 168425

SEQ ID NO: 521483 - RNA, 64 nt, hsa; identical to SEQ ID NO: 168426

SEQ ID NO: 521484 - RNA, 64 nt, hsa; identical to SEQ ID NO: 168427

SEQ ID NO: 521485 - RNA, 64 nt, hsa; identical to SEQ ID NO: 168428

SEQ ID NO: 521486 - RNA, 64 nt, hsa; identical to SEQ ID NO: 168429

SEQ ID NO: 521487 - RNA, 64 nt, hsa; identical to SEQ ID NO: 168430

SEQ ID NO: 521488 - RNA, 64 nt, hsa; identical to SEQ ID NO: 168431

SEQ ID NO: 521489 - RNA, 64 nt, hsa; identical to SEQ ID NO: 168432

SEQ ID NO: 521490 - RNA, 64 nt, hsa; identical to SEQ ID NO: 168433

SEQ ID NO: 521491 - RNA, 64 nt, hsa; identical to SEQ ID NO: 168434

SEQ ID NO: 521492 - RNA, 64 nt, hsa; identical to SEQ ID NO: 168435

SEQ ID NO: 521493 - RNA, 64 nt, hsa; identical to SEQ ID NO: 168436

SEQ ID NO: 521494 - RNA, 64 nt, hsa; identical to SEQ ID NO: 168437

SEQ ID NO: 521495 - RNA, 64 nt, hsa; identical to SEQ ID NO: 168438

SEQ ID NO: 521496 - RNA, 64 nt, hsa; identical to SEQ ID NO: 168439

SEQ ID NO: 521497 - RNA, 64 nt, hsa; identical to SEQ ID NO: 168440

SEQ ID NO: 521498 - RNA, 64 nt, hsa; identical to SEQ ID NO: 168441

SEQ ID NO: 521499 - RNA, 64 nt, hsa; identical to SEQ ID NO: 168442

SEQ ID NO: 521500 - RNA, 64 nt, hsa; identical to SEQ ID NO: 168443

SEQ ID NO: 521501 - RNA, 64 nt, hsa; identical to SEQ ID NO: 168444

SEQ ID NO: 521502 - RNA, 64 nt, hsa; identical to SEQ ID NO: 168445

SEQ ID NO: 521503 - RNA, 64 nt, hsa; identical to SEQ ID NO: 168446

SEQ ID NO: 521504 - RNA, 64 nt, hsa; identical to SEQ ID NO: 327018

SEQ ID NO: 521505 - RNA, 64 nt, hsa; identical to SEQ ID NO: 327019

SEQ ID NO: 521506 - RNA, 64 nt, hsa; identical to SEQ ID NO: 327020

SEQ ID NO: 521507 - RNA, 64 nt, hsa; identical to SEQ ID NO: 327021

SEQ ID NO: 521508 - RNA, 64 nt, hsa; identical to SEQ ID NO: 327022

SEQ ID NO: 521509 - RNA, 64 nt, hsa; identical to SEQ ID NO: 327023

SEQ ID NO: 521510 - RNA, 64 nt, hsa; identical to SEQ ID NO: 327024

SEQ ID NO: 521511 - RNA, 64 nt, hsa; identical to SEQ ID NO: 327025

SEQ ID NO: 521512 - RNA, 64 nt, hsa; identical to SEQ ID NO: 327026

SEQ ID NO: 521513 - RNA, 64 nt, hsa; identical to SEQ ID NO: 327027

SEQ ID NO: 521514 - RNA, 64 nt, hsa; identical to SEQ ID NO: 327028

SEQ ID NO: 521515 - RNA, 64 nt, hsa; identical to SEQ ID NO: 327029

SEQ ID NO: 521516 - RNA, 64 nt, hsa; identical to SEQ ID NO: 327030

SEQ ID NO: 521517 - RNA, 64 nt, hsa; identical to SEQ ID NO: 327031

SEQ ID NO: 521518 - RNA, 64 nt, hsa; identical to SEQ ID NO: 327032

SEQ ID NO: 521519 - RNA, 64 nt, hsa; identical to SEQ ID NO: 327033

SEQ ID NO: 521520 - RNA, 64 nt, hsa; identical to SEQ ID NO: 327034

SEQ ID NO: 521521 - RNA, 64 nt, hsa; identical to SEQ ID NO: 327035

SEQ ID NO: 521522 - RNA, 64 nt, hsa; identical to SEQ ID NO: 485099

SEQ ID NO: 521523 - RNA, 64 nt, hsa; identical to SEQ ID NO: 485100

SEQ ID NO: 521524 - RNA, 64 nt, hsa; identical to SEQ ID NO: 485101

SEQ ID NO: 521525 - RNA, 64 nt, hsa; identical to SEQ ID NO: 485102

SEQ ID NO: 521526 - RNA, 64 nt, hsa; identical to SEQ ID NO: 485103

SEQ ID NO: 521527 - RNA, 64 nt, hsa; identical to SEQ ID NO: 485104

SEQ ID NO: 521528 - RNA, 64 nt, hsa; identical to SEQ ID NO: 485105

SEQ ID NO: 521529 - RNA, 64 nt, hsa; identical to SEQ ID NO: 485106

SEQ ID NO: 521530 - RNA, 64 nt, hsa; identical to SEQ ID NO: 485107

SEQ ID NO: 521531 - RNA, 64 nt, hsa; identical to SEQ ID NO: 485108

SEQ ID NO: 521532 - RNA, 64 nt, hsa; identical to SEQ ID NO: 485109

SEQ ID NO: 521533 - RNA, 64 nt, hsa; identical to SEQ ID NO: 485110

SEQ ID NO: 521534 - RNA, 64 nt, hsa; identical to SEQ ID NO: 485111

SEQ ID NO: 521535 - RNA, 64 nt, hsa; identical to SEQ ID NO: 485112

SEQ ID NO: 521536 - RNA, 64 nt, hsa; identical to SEQ ID NO: 485113

SEQ ID NO: 521537 - RNA, 64 nt, hsa; identical to SEQ ID NO: 485114

SEQ ID NO: 521538 - RNA, 64 nt, hsa; identical to SEQ ID NO: 485115

SEQ ID NO: 521539 - RNA, 64 nt, hsa; identical to SEQ ID NO: 485116

SEQ ID NO: 521540 - RNA, 64 nt, hsa; identical to SEQ ID NO: 485117

SEQ ID NO: 521541 - RNA, 64 nt, hsa; identical to SEQ ID NO: 485118

SEQ ID NO: 521542 - RNA, 64 nt, hsa; identical to SEQ ID NO: 245406

SEQ ID NO: 521543 - RNA, 64 nt, hsa; identical to SEQ ID NO: 245407

SEQ ID NO: 521544 - RNA, 64 nt, hsa; identical to SEQ ID NO: 245408

SEQ ID NO: 521545 - RNA, 64 nt, hsa; identical to SEQ ID NO: 245409

SEQ ID NO: 521546 - RNA, 64 nt, hsa; identical to SEQ ID NO: 245410

SEQ ID NO: 521547 - RNA, 64 nt, hsa; identical to SEQ ID NO: 245411

SEQ ID NO: 521548 - RNA, 64 nt, hsa; identical to SEQ ID NO: 425218

SEQ ID NO: 521549 - RNA, 64 nt, hsa; identical to SEQ ID NO: 425219

SEQ ID NO: 521550 - RNA, 64 nt, hsa; identical to SEQ ID NO: 425220

SEQ ID NO: 521551 - RNA, 64 nt, hsa; identical to SEQ ID NO: 425221

SEQ ID NO: 521552 - RNA, 64 nt, hsa; identical to SEQ ID NO: 425222

SEQ ID NO: 521553 - RNA, 64 nt, hsa; identical to SEQ ID NO: 425223

SEQ ID NO: 521554 - RNA, 64 nt, hsa; identical to SEQ ID NO: 425224

SEQ ID NO: 521555 - RNA, 64 nt, hsa; identical to SEQ ID NO: 425225

SEQ ID NO: 521556 - RNA, 64 nt, hsa; identical to SEQ ID NO: 425226

SEQ ID NO: 521557 - RNA, 64 nt, hsa; identical to SEQ ID NO: 425227

SEQ ID NO: 521558 - RNA, 64 nt, hsa; identical to SEQ ID NO: 425228

SEQ ID NO: 521559 - RNA, 64 nt, hsa; identical to SEQ ID NO: 425229

SEQ ID NO: 521560 - RNA, 64 nt, hsa
acuguugcugaaauguggcuuuggcauuguuggauuucauaaaaaauuucuggcaggaagucuu

SEQ ID NO: 521561 - RNA, 64 nt, hsa
uaaaaaauaaaaguaucuccuagucccuuaauuuuuucauaaauauuucuggcuuuugaguagu

SEQ ID NO: 521562 - RNA, 64 nt, hsa
uaugauuauauuuccuauauaacuaaaaauuuuguuucauaaauuuuaaaauaauuauuuuuga

SEQ ID NO: 521563 - RNA, 64 nt, hsa
auauaaaacuagaaagggacuuuuuuuccuuucuuuucauaaugaagcagaucaacuuaaagga

SEQ ID NO: 521564 - RNA, 64 nt, hsa
auugaugugcugugauaugagggaaucugaaauguuucauaaaaauaaagcuuaaaaauugucu

SEQ ID NO: 521565 - RNA, 64 nt, hsa
gauacucugauccuuacagaauccaagaggaagcuuucauaaaaacaauucagcaaauauuucc

SEQ ID NO: 521566 - RNA, 64 nt, hsa
cuggaaguauuuaauaaguugcaaaugcaguuccuuucauaauaucucagcaccagaaacaaaa

SEQ ID NO: 521567 - RNA, 64 nt, hsa
caaaauaucacugacucaucccuacccauauucuuuucauaaaacccacucaccagguacaaua

SEQ ID NO: 521568 - RNA, 64 nt, hsa
uuuugaagaaauagucucccuucaauuaagaaauuuucauaauggaaugauuuaaauugaagug

SEQ ID NO: 521569 - RNA, 64 nt, hsa
uaaaauauauuuuucucauaccuguuuucuucauuuucauaaugaagcacuuugcuauguagcu

SEQ ID NO: 521570 - RNA, 64 nt, hsa
uacucuuuguauacaaguguuuauuaguauugcuuuucauaauucugucucacugaaaaccuua

SEQ ID NO: 521571 - RNA, 64 nt, hsa
gauugggaauauguaaacucaacuggagauuuuuuuucauaaaaauuuauauaguuccagcccu

SEQ ID NO: 521572 - RNA, 64 nt, hsa
gagaauaaauaacuguuuuguguugguuggugguuuucauaaucuuauuucuguacuggaacua

SEQ ID NO: 521573 - RNA, 64 nt, hsa
auuauucugcaauauuguaauucauaguuugacuuuucauaagcaaauaaaucccuaggaugua

SEQ ID NO: 521574 - RNA, 64 nt, hsa
cugcuuucuuaugacuguuuuuauaaauaaacuguuucauaaauaauguauacuggaaaauugu

SEQ ID NO: 521575 - RNA, 64 nt, hsa
ccaaaaucuccaaaccucugaaaacugaaauauuuuucauaaauuaggcguaaauucuaugccc

SEQ ID NO: 521576 - RNA, 64 nt, hsa
ggcuuuuucugcaaugagcagcagcugacugaauuuucauaagaaacuuggacugcaggacuua

SEQ ID NO: 521577 - RNA, 64 nt, hsa
aggacuuaaucuguagucuuuagacaacaguugcuuucauaaagacuaguucuuaucaaccuug

SEQ ID NO: 521578 - RNA, 64 nt, hsa
gugaaaauacagaagggguguuugaguauucagauuucauaaaacacuuccuuggaauauagcu

SEQ ID NO: 521579 - RNA, 64 nt, hsa
ugcuuuugaccaucaccucccaguagcaauuugcuuucauaauccauuuagcaauccaggccuc

SEQ ID NO: 521580 - RNA, 64 nt, hsa
uuuaucugguagaacaauauguguucuacauuuuuuucauaauuauauauuguguauguuaaaa

SEQ ID NO: 521581 - RNA, 64 nt, hsa
caguuucuaauuuuuaaaacugaugugguuugcauuucauaaaaggcaaaguuuacagaaccau

SEQ ID NO: 521582 - RNA, 64 nt, hsa
ccauacauuuuuagagucagagauaacuuugaaauuucauaaguuugauauucaguggauacaa

SEQ ID NO: 521583 - RNA, 64 nt, hsa
gauuaauugaagaaauaaaauauuucggauaagguuucauaauuuacaaaugggaauuucauuu

SEQ ID NO: 521584 - RNA, 64 nt, hsa
ugucccugauuuuauuuucuuuuagggaaaauuguuucauaaaugugacacugauaaagccuuu

SEQ ID NO: 521585 - RNA, 64 nt, hsa
uuagcacuguuaaagcacgaauugguaacaguuguuucauaaaugagcacuguugugauaacac

SEQ ID NO: 521586 - RNA, 64 nt, hsa
aaguccuguucuucuuuagauaaacaagagacauuuucauaauugcuuucuagcaaucagcuuu

SEQ ID NO: 521587 - RNA, 64 nt, hsa
acaaauaauuucccuuggguuggaggggaagugauuucauaaauuaauuagaaagccaucuuua

SEQ ID NO: 521588 - RNA, 64 nt, hsa
auuggaaaucaguuccugacauaguaaaguuugcuuucauaacugcagcaaaaaaggucaacuu

SEQ ID NO: 521589 - RNA, 64 nt, hsa
auaacaugauaguuuccuaaccuuuucauaaccuuuucauaacaugauaguuuccauaacagag

SEQ ID NO: 521590 - RNA, 64 nt, hsa
auuagcuuuucauaacaugauaguuuccuaaccuuuucauaaccuuuucauaacaugauaguuu

SEQ ID NO: 521591 - RNA, 64 nt, hsa
aguucaguuguuuuuaaaagauucaauauuagcuuuucauaacaugauaguuuccuaaccuuuu

SEQ ID NO: 521592 - RNA, 64 nt, hsa
uaaauauuguacuacugugcuuaucuuguaaagauuucauaaaaugauaguauugguuauuuua

SEQ ID NO: 521593 - RNA, 64 nt, hsa
auaaauaguauuuuacaucuuauuuuugccuuuauuucauaaguaauuuaaaaaucacuggauu

SEQ ID NO: 521594 - RNA, 64 nt, hsa
uuuugcacaacuguaacccuguuguuacuuuauauuucauaaucaggcaaaaauacuuacaguu

SEQ ID NO: 521595 - RNA, 64 nt, hsa
uaauucuucuaaauuaccacuugccauuaagcuauuucauaauaaauucuguacaguuuccccc

SEQ ID NO: 521596 - RNA, 64 nt, hsa
gaacaaauaaaacuaggaaccugcuauacauguguuucauaaccugccuccuuugcuuggcccu

SEQ ID NO: 521597 - RNA, 64 nt, hsa
aaaagaacuuaucuugcagcauuuuaucaacaaauuucauaauuguggacaauuggaggcauuu

SEQ ID NO: 521598 - RNA, 64 nt, hsa
uaaaaagagaaaaagagaaacuuguccauuuagcuuucauaagaaaucccauggcaaaggguaa

SEQ ID NO: 521599 - RNA, 64 nt, hsa
aacauagcuuuaguuuuugcuguuguaaaaguguuuucauaaguucacucaagaaaaaugcagc

SEQ ID NO: 521600 - RNA, 64 nt, hsa
caugcaccaccuguuugcuugcuuucaaugaaccuuucauaaauucgcagucucagcuuauggu

SEQ ID NO: 521601 - RNA, 64 nt, hsa
acucacucauucaguuacuccuaagacuuuucaguuucauaaggaagaguguugccugaggccc

SEQ ID NO: 521602 - RNA, 64 nt, hsa
uuuguucuggcagugagucaaguguccagcauuuuuucauaaguguuuuuuaaaauuguucucc

SEQ ID NO: 521603 - RNA, 64 nt, hsa
guauggaucguaaaauuuuaagcacuaaaaauuuuuucauaaccuuucauaauaaaguuuaaua

SEQ ID NO: 521604 - RNA, 64 nt, hsa
uaaaauuuuaagcacuaaaaauuuuuucauaaccuuucauaauaaaguuuaauaauagguuuau

SEQ ID NO: 521605 - RNA, 64 nt, hsa
uugccagaggcagaaauggucuggguauaagcuauuucauaaaagcagcuuuaaauugucagua

SEQ ID NO: 521606 - RNA, 64 nt, hsa
ugucuuaauuucuaacauuaucuuugcuuuuauguuucauaaaaauuugucauuauuuaugcug

SEQ ID NO: 521607 - RNA, 64 nt, hsa
uccugggaacccuaguuccacaggauaauagguuuuucauaaagaaacguaggguguguaugug

SEQ ID NO: 521608 - RNA, 64 nt, hsa
guuuugugccugcuuuuugcugugguccuguuuuuuucauaacaauauacugguauagcuucca

SEQ ID NO: 521609 - RNA, 64 nt, hsa
ucuaguaccucaaugcgauucugagauauuugaauuucauaaaauuguaacugaaauuuaaaau

SEQ ID NO: 521610 - RNA, 64 nt, hsa
aaauaauugcuuguuuucuagccuggcaagauauuuucauaaaagagggauaacaaugcugauu

SEQ ID NO: 521611 - RNA, 64 nt, hsa
uaaagagcauuuaacaugccuuuuaguuuucuuauuucauaaucuacuuuucuaucauuaauca

SEQ ID NO: 521612 - RNA, 64 nt, hsa
guugaucuggaugaguuauacaugauauuugacuuuucauaaguaguggaagguuucacuaagu

SEQ ID NO: 521613 - RNA, 64 nt, hsa
guugaucuagaugaguuauaaaugguauuugacuuuucauaaguaguggaagguuucacuaagu

SEQ ID NO: 521614 - RNA, 64 nt, hsa
uauaugcacaaaacuacuuuucuaaaaucuaaaauuucauaauucugaaacaacuugccccaag

SEQ ID NO: 521615 - RNA, 64 nt, hsa
ggauuguguaucugugcuucuaauauuaguuggcuuucauaaaucauguuguuguguguauaug

SEQ ID NO: 521616 - RNA, 64 nt, hsa
ucauucuaaauauagaaguguugcauguauaggauuucauaaaggcuaauugcauaagaaagag

SEQ ID NO: 521617 - RNA, 64 nt, hsa
aaaggcugauggguggauuagcuaccccagcuccuuucauaagacacaaagacgugcacaggag

SEQ ID NO: 521618 - RNA, 64 nt, hsa
uucacucauuaccuagaguaaacuuauugcauauuuucauaaucagucaaaauaauaaaacuaa

SEQ ID NO: 521619 - RNA, 64 nt, hsa
guaagaacauacauuuugaaauuaugaacauuuuuuucauaaaaauuaaaugcuuuaagaaaug

SEQ ID NO: 521620 - RNA, 64 nt, hsa
cagaaguacgugaguuguuccucaggaauagauuuuucauaaagcagaauugauccuguggcug

SEQ ID NO: 521621 - RNA, 64 nt, hsa
cuauaaaguuuuauaaagaaaaggaauauuuuguuuucauaaagaggaaaauccauucuuagaa

SEQ ID NO: 521622 - RNA, 64 nt, hsa
aagauuaaaauaaagcuaccauuuuacauuucuauuucauaaugaaaaacuaugucaguauuuu

SEQ ID NO: 521623 - RNA, 64 nt, hsa
ugaaaguuagagaacauuauguuuguaucauuucuuucauaaaaccucaagagcauuuuuaagc

SEQ ID NO: 521624 - RNA, 64 nt, hsa
gccagagaaaaugaauugcaaucaucaaaugguguuucauaacuugguaguaguaacuuaccuu

SEQ ID NO: 521625 - RNA, 64 nt, hsa
uuauagcguaacagacuacacaaugcacugauguuuucauaauguuuaagggacccacugcaag

SEQ ID NO: 521626 - RNA, 64 nt, hsa
acuggcuucauucugaauuugugcuaaaauaaucuuucauaaagagaccucaguuuauagcgua

SEQ ID NO: 521627 - RNA, 64 nt, hsa
augccuaguuguguugcccaucaauuuuguauauuuucauaauuuuaauuguugaaaauugcau

SEQ ID NO: 521628 - RNA, 64 nt, hsa
uuaauucugaauuucauguaaugacaacauauucuuucauaaaacuauggccuguuuaagaugg

SEQ ID NO: 521629 - RNA, 64 nt, hsa
uugcaauuagguuuuugacuguuaaaauggauauuuucauaaaaaugguguucugaauuuugcu

SEQ ID NO: 521630 - RNA, 64 nt, hsa
ucaaguauguucaguauaaaauaaguuaaucccauuucauaauguaaaucauauuuuuguuauu

SEQ ID NO: 521631 - RNA, 64 nt, hsa
auccuccaugggcuaaauccagauguccaccuguuuucauaaauaacguuuuauuggagcauag

SEQ ID NO: 521632 - RNA, 64 nt, hsa
uauuuuuuaaauguauucauuccuacaaauuaacuuucauaaauuuuauggcaugucuucuauu

SEQ ID NO: 521633 - RNA, 64 nt, hsa
uuaauccauauguggacuagugaugaauagauauuuucauaagaguuuaaaugcugauauuugg

SEQ ID NO: 521634 - RNA, 64 nt, hsa
uuuuuucugccauuucccaaauaauaacuccagauuucauaauuccaguuuuuacauuccguua

SEQ ID NO: 521635 - RNA, 64 nt, hsa
gauuugggaaauauucuuuacuacaaaggacuuauuucauaauuacaaauuuuccuucauauuu

SEQ ID NO: 521636 - RNA, 64 nt, hsa
cuuaccaggaauauuuucuaagugccauagucuuuuucauaauacguaugaguuuuaccuuuuc

SEQ ID NO: 521637 - RNA, 64 nt, hsa
caucccaagguuuuuuucucauuuaacauauuuguuucauaauucagcaaguacagaugcaagc

SEQ ID NO: 521638 - RNA, 64 nt, hsa
aauacauuuccuggguaacuuaggaaauuaaguuuuucauaaggcaacagaugguuaaacugau

SEQ ID NO: 521639 - RNA, 64 nt, hsa
uuuuauguaaccuguuacaaaauagacuugacuuuuucauaauggacuuuuguauuauacaagg

SEQ ID NO: 521640 - RNA, 64 nt, hsa
agggagguguuacuuucauuguauauaggucuuauuucauaaacagauauccuguaucaaauaa

SEQ ID NO: 521641 - RNA, 64 nt, hsa
acuucuauuaaguuauugaugcaauuugauauuuuuucauaaucuauauuuaaacaaaauuaca

SEQ ID NO: 521642 - RNA, 64 nt, hsa
cccauuguagcauauguuugauuuuuuuuuauuauuucauaagaaaacuacguuaauuuuaccu

SEQ ID NO: 521643 - RNA, 64 nt, hsa
gaggugaugauaguuggccucuggucuacaaagauuucauaacuccuuggaaagcuucuuauaa

SEQ ID NO: 521644 - RNA, 64 nt, hsa
gauuggcuggcuauaaccaccccaguuaaaccauuuucauaauuaguagugccagcaauagugg

SEQ ID NO: 521645 - RNA, 64 nt, hsa
uuucccaugcuguggaaaguuuauugagaacuuguuucauaaauggauaucccuacuaugacug

SEQ ID NO: 521646 - RNA, 64 nt, hsa
cuuuuauaauucccauccuaaaaauucuuaauauuuucauaaaauuuguauuuuuaaaugaaaa

SEQ ID NO: 521647 - RNA, 64 nt, hsa
cuuuccugacauuguuuucagaauaaagaauauuuuucauaauauuuuaagauacauacuaucu

SEQ ID NO: 521648 - RNA, 64 nt, hsa
uuuuuaaccagccuaauaaauaagucuuacuacuuuucauaauauuucauaauaguuaaaagua

SEQ ID NO: 521649 - RNA, 64 nt, hsa
gccuaauaaauaagucuuacuacuuuucauaauauuucauaauaguuaaaaguagguguuuuuu

SEQ ID NO: 521650 - RNA, 64 nt, hsa
uuccuuuuauucuaacgggaauauuucauguaaauuucauaaauucuuuggacaaaaguagguu

SEQ ID NO: 521651 - RNA, 64 nt, hsa
acccccauacagacauuugacagcgucuuguccuuuucauaauaaucaugaauacuuuuccagg

SEQ ID NO: 521652 - RNA, 64 nt, hsa
gaauuuuaauuuuacucuuuuauacaugugauaauuucauaaagugagggaucccaaaaaaaga

SEQ ID NO: 521653 - RNA, 64 nt, hsa
gccacagaguauuguuuaaaacugcccuauguaguuucauaauuugguaacauguaccuucaug

SEQ ID NO: 521654 - RNA, 64 nt, hsa
cagugcggucuauguggagaugcugcagauccugcugccgcacuucagcgacgugaggaccuca

SEQ ID NO: 521655 - RNA, 64 nt, hsa
ccacauccuggccagcugcuggcagaacuccuggcugccgcacgggaacucauggguguguuac

SEQ ID NO: 521656 - RNA, 64 nt, hsa; identical to SEQ ID NO: 434045

SEQ ID NO: 521657 - RNA, 64 nt, hsa; identical to SEQ ID NO: 434046

SEQ ID NO: 521658 - RNA, 64 nt, hsa
ggaacuguacaaauauuuauaccaaaaauauagauaagaaaagguggggcuauacuagcaacaa

SEQ ID NO: 521659 - RNA, 64 nt, hsa
aauggugccaaguaaugugaaugcuaauacugcuuaagaaaauuaaguuacuuuugcaaaacag

SEQ ID NO: 521660 - RNA, 64 nt, hsa
acagauauguccaaggaaguugagcuauagggaguaagaaaaagcaucaugauaacgucuaguc

SEQ ID NO: 521661 - RNA, 64 nt, hsa
auggcauuuagccaaaggccuuuucagccaggaguaagaaaagaugguuagugauauuuggaaa

SEQ ID NO: 521662 - RNA, 64 nt, hsa
cuuuugauuugucauauuccuggucauaaaacauuaagaaaauuauggcuguugcugucauuac

SEQ ID NO: 521663 - RNA, 64 nt, hsa
uuaagacaguucagugcauauauaguagaagccuuaagaaaaaagaaaaugagcaagcaaauau

SEQ ID NO: 521664 - RNA, 64 nt, hsa
agauagaauuuuuuacuguuuuuuacuguuuucuuaagaaaacaguuaaaucauuaugcauuca

SEQ ID NO: 521665 - RNA, 64 nt, hsa
cuagugggcaaaugucauuguuaccucuguguguuaagaaaauaaaaauauuuucuaaaggucu

SEQ ID NO: 521666 - RNA, 64 nt, hsa
acaucuucaacaugucacacuggcuaucaaagaauaagaaaauuauugaguaugaguguguuuu

SEQ ID NO: 521667 - RNA, 64 nt, hsa
uucaaauagagcuguucaacaucacugaaaccuuuaagaaaagcccugagaucaguuauuccua

SEQ ID NO: 521668 - RNA, 64 nt, hsa
uuguuuuauauuguuugauacucaguaccuguuuuaagaaaaaacaacaaggaaguaaaaccaa

SEQ ID NO: 521669 - RNA, 64 nt, hsa
uggcucacguauuuaagagccugaauauuccagguaagaaaauauaaaaugagguuuauuuuau

SEQ ID NO: 521670 - RNA, 64 nt, hsa
uaaaaugaauuucuauaugaauauggaucugccauaagaaaaucuaguucaacucuaauuuuau

SEQ ID NO: 521671 - RNA, 64 nt, hsa
aaaucuucccaaauguuguggaaaacuggaauauuaagaaaaugagaaauuauauuuauuagaa

SEQ ID NO: 521672 - RNA, 64 nt, hsa
cugcguuaauuauugaggaaaaaaaaagaugggguaagaaaacuacccaugcaugauguagaga

SEQ ID NO: 521673 - RNA, 64 nt, hsa
gcaaaaaaggcuucaucccauccuugccaaaaaauaagaaaacugucuuggagaaugggucaga

SEQ ID NO: 521674 - RNA, 64 nt, hsa
uuuugggaauuuuacagagucaaaguaggcagaauaagaaaauaguucuucaggagggccgacc

SEQ ID NO: 521675 - RNA, 64 nt, hsa
agaugagagcuuuaugaguucacggaauuuauuuuaagaaaaaaaaauauacauaugagaagaa

SEQ ID NO: 521676 - RNA, 64 nt, hsa
aaauuaagaaaaaauaaaacuaccuacgaaauacuaagaaaaauuuguauacuaauauuaagaa

SEQ ID NO: 521677 - RNA, 64 nt, hsa
aaugugugggucuuguuuggauccugacucaaauuaagaaaaaauaaaacuaccuacgaaauac

SEQ ID NO: 521678 - RNA, 64 nt, hsa
gggcaugugcaaagcaagcaaggaacauuugggguaagaaaacaaacaugaggcaaaagaaaaa

SEQ ID NO: 521679 - RNA, 64 nt, hsa
acaaacaugaggcaaaagaaaaaauacauguuuuuaagaaaacauugagcagagaacugcagcc

SEQ ID NO: 521680 - RNA, 64 nt, hsa
agucuccuacauagcaguguuauuuauguacagauaagaaaaccauaugucagccaaagauuuu

SEQ ID NO: 521681 - RNA, 64 nt, hsa
uaauaauagcccugagauguuucuaacauuuaaauaagaaaaaaaucaaaucgaagucagccug

SEQ ID NO: 521682 - RNA, 64 nt, hsa
aaguauuuuuauuaccaauaaauuuaaaauuuuuuaagaaaaauauuuuuauccuagggccaag

SEQ ID NO: 521683 - RNA, 64 nt, hsa
ugaaauguaaaauuuuuaugaucugauucaguuuuaagaaaacaugaaugaacuagaagauauu

SEQ ID NO: 521684 - RNA, 64 nt, hsa
cuguuuaguuuggguucauuucuauaacauuuuguaagaaaauaaaaguuugagcaccugauua

SEQ ID NO: 521685 - RNA, 64 nt, hsa
aacuacaaccugcaauuuaagauuacuauuacuuuaagaaaaucaauuucauaguauugguuuu

SEQ ID NO: 521686 - RNA, 64 nt, hsa
acugcuuuuccagacacaaggcugcuaaaccaauuaagaaaauaauuaauuucuuucaagcaac

SEQ ID NO: 521687 - RNA, 64 nt, hsa
gaccagcuuaacuuauaaugaaugggcauuguguuaagaaaagaacauuuccagucauucagcu

SEQ ID NO: 521688 - RNA, 64 nt, hsa
aaaauaaaaaggacuacuuaaacauuugucauauuaagaaaaaaaguuuaucuagcacuuguga

SEQ ID NO: 521689 - RNA, 64 nt, hsa
ugaacuuauucuuaagaaauuguacuuuuuauuguaagaaaaauaaaaaggacuacuuaaacau

SEQ ID NO: 521690 - RNA, 64 nt, hsa
agcccggcggucccuguuuugcuuuauugcuguuuaagaaaaauggagguaguuccaaaaaagu

SEQ ID NO: 521691 - RNA, 64 nt, hsa
ggcuggguuuucugaagucugaggaacaaugccuuaagaaaaaacaaacagcaggaaucggugg

SEQ ID NO: 521692 - RNA, 64 nt, hsa
aucauuaacucuccuaaaauguguuucauucuaguaagaaaaccucaaaggauauuguaggaua

SEQ ID NO: 521693 - RNA, 64 nt, hsa
agcaucugcucauuauguuuggaauugcuuucuauaagaaaauugcccacuacuacuaacuuga

SEQ ID NO: 521694 - RNA, 64 nt, hsa
ucuuuauucaagauaccugaacuggggugcuuuuuaagaaaaauuugggaaauauauauguuuc

SEQ ID NO: 521695 - RNA, 64 nt, hsa
ucugaugcacaguaaaauccgagaaacacugguuuaagaaaaaccuuguaaugaucgaauaccc

SEQ ID NO: 521696 - RNA, 64 nt, hsa
uaacaauaagaaauaagaaauaauuuuuuucaaauaagaaaauuguguacucuagaaauggaga

SEQ ID NO: 521697 - RNA, 64 nt, hsa
gucagagaugguauuaccuuuuaaaaaaugcuaauaagaaaauuggaagauucuuuuaaaaauu

SEQ ID NO: 521698 - RNA, 64 nt, hsa
uaagagaauauuuuaaguauugcaucuguauaaguaagaaaauauuuugucuaaaaugccucag

SEQ ID NO: 521699 - RNA, 64 nt, hsa
cagcagcucccccucccccacugccauaaaacauuaagaaaaucauauugcuucuucuccuaug

SEQ ID NO: 521700 - RNA, 64 nt, hsa
auggauagauuuuuggaacgaaaaaggguaaguauaagaaaauauugcaaacacauuaaaacag

SEQ ID NO: 521701 - RNA, 64 nt, hsa
augguuggucucuaauauauuuggaacugauucauaagaaaaguuauuaaaauuaucuuugaaa

SEQ ID NO: 521702 - RNA, 64 nt, hsa
cugugaagugacaugucagaacaguccagacugguaagaaaauuaauggcuucacuugaauuua

SEQ ID NO: 521703 - RNA, 64 nt, hsa
ggaaaugauuuugguguuuuggguuaauugcuucuaagaaaaguuucauaguggacuguuuaga

SEQ ID NO: 521704 - RNA, 64 nt, hsa
auuuaauccauucuuaauauuuuaaaacuuuuguuaagaaaaacugccaguuugugcuuuugaa

SEQ ID NO: 521705 - RNA, 64 nt, hsa
gguauagagaucugauaacuugaauucagaauauuaagaaaaugaaguaacugauuuucuaaaa

SEQ ID NO: 521706 - RNA, 64 nt, hsa
auaagaaacuuauuucucauaucaacuuagucaauaagaaaauauauucuuucaaaggaacauu

SEQ ID NO: 521707 - RNA, 64 nt, hsa
caggccucuccauuugcucuucagaugccacuucuaagaaaagccuaaucacaguuuuuccugg

SEQ ID NO: 521708 - RNA, 64 nt, hsa
uuuuacaaguggcuuuacauuuccuaaaaugccauaagaaaaugcaauaucuggguacuguaug

SEQ ID NO: 521709 - RNA, 64 nt, hsa
uuccucuguaaagaucagaugguaaucuuucaaauaagaaaaaaauaaagacguauguuugacc

SEQ ID NO: 521710 - RNA, 64 nt, hsa
ugcucauuuuuauuguuuuuacagccaguuauaguaagaaaaagguuuuuccccuugugcugcu

SEQ ID NO: 521711 - RNA, 64 nt, hsa
uuuggugcugaauauguccuuguaggcucuguuuuaagaaaacaauaugugggaaaugauuuaa

SEQ ID NO: 521712 - RNA, 64 nt, hsa
uacaaaacaaauaggcuuuuccauaaguggccuuuaagaaaacauggaagacaauucauguuug

SEQ ID NO: 521713 - RNA, 64 nt, hsa
uuuuaaauuuagauuauguauuccuuuugaaacauaagaaaaacauuuaaaccuaugcugaaaa

SEQ ID NO: 521714 - RNA, 64 nt, hsa
caacuccaauaugcuaaaaguuaaauaugguauuuaagaaaauagucauguaugcaauugagaa

SEQ ID NO: 521715 - RNA, 51 nt, hsa
agcaacaacagcagaguugauuaagaaaaaugaagaaaaaacgcaaaaaga

SEQ ID NO: 521716 - RNA, 64 nt, hsa
gcaauuaaaguuuuucuuccaugaguugaguccuuaagaaaaugauuccaguuacucauuuugc

SEQ ID NO: 521717 - RNA, 56 nt, hsa
gccacagcacaaaguuuuaaugucuuuaagaaaaagaaaucaaucugcagaaaugu

SEQ ID NO: 521718 - RNA, 64 nt, hsa
uuuaaauauuacaccuucagaaccauaacaugcuuaagaaaacuuucccaaaauguugaccuag

SEQ ID NO: 521719 - RNA, 64 nt, hsa
guaucagguucugggaggcaacagcauuaagugauaagaaaaggagacauucuggcaaagccaa

SEQ ID NO: 521720 - RNA, 64 nt, hsa
gacuuuaauauugauuauauuuuuaacaggaauuuaagaaaauauuacuggaauuaaaaauaua

SEQ ID NO: 521721 - RNA, 64 nt, hsa
uuggauuucuccaaaucugggagaauuuucaaaauaagaaaauaaccuuuauaugauauacuau

SEQ ID NO: 521722 - RNA, 64 nt, hsa
auuauggaaauguugucuuuuauacuuaguuauauaagaaaaaagggaguuaugcaauuaauau

SEQ ID NO: 521723 - RNA, 64 nt, hsa
guuuuauuuuuuucccuuuagcauugcaugugaauaagaaaauaauguuuaaagaaaaaaaaaa

SEQ ID NO: 521724 - RNA, 64 nt, hsa
uguuucuuucugguuaaaaaaaggaaaaaccaucuaagaaaauauauauguauguaugugugua

SEQ ID NO: 521725 - RNA, 64 nt, hsa
aagcuuuuaaccuaucuuaacaacuuacugaacauaagaaaauuuacacuagagagaaagccua

SEQ ID NO: 521726 - RNA, 64 nt, hsa
aagcuuuucaccgauacucaauccuuaguacacauaagaaaauucauacuggggagaaacccca

SEQ ID NO: 521727 - RNA, 64 nt, hsa
aagcuuuuaaccaguccucacaccuuaugagacauaagaaaauucauaguaaagagaaacccua

SEQ ID NO: 521728 - RNA, 64 nt, hsa
guuguuuuaacuaguucucgaacuuuacuaugcauaagaaaauucaaacuggagagaaacucua

SEQ ID NO: 521729 - RNA, 64 nt, hsa
ugaaacugucauaauggugaauguucaaucuguguaagaaaacaaacuaaauguaguugucaca

SEQ ID NO: 521730 - RNA, 64 nt, hsa
gugugauggcaaggugcuuguuaugucuagaaaguaagaaaacaauaugaggagacauucuguc

SEQ ID NO: 521731 - RNA, 64 nt, hsa
aaguuuauucaaugcuaauuugaaagaaaauugauaagaaaacuuugagggcccaaguccacaa

SEQ ID NO: 521732 - RNA, 64 nt, hsa
uuucauuguaaaaugaacaaauacauaaauauuuuaagaaaaauuuaaguuuauucagauaagu

SEQ ID NO: 521733 - RNA, 64 nt, hsa
cacaucuaagaaaauuuacuguaacuucuuaaucuaagaaaauuauguauuuuugucauaugua

SEQ ID NO: 521734 - RNA, 64 nt, hsa
uugucuuacauaaucacaauaauauauccacaucuaagaaaauuuacuguaacuucuuaaucua

SEQ ID NO: 521735 - RNA, 64 nt, hsa
aaaacauaaaaacaucacacuaaucuuggaggaauaagaaaaauuguacauccauuaaauguac

SEQ ID NO: 521736 - RNA, 64 nt, hsa
uuuaaccauuaacuugucaaauuacaaucacaguuaagaaaaugauguaaaauucuguuuugug

SEQ ID NO: 521737 - RNA, 64 nt, hsa
uguagcugcugcgccacccaccaucaaaggaauauaagaaaaguaaugaagaaucacgauuuca

SEQ ID NO: 521738 - RNA, 64 nt, hsa
gugguuuuauuacaaaugcaaauuucuauaaauuuaagaaaacaaguauauaauuuacuuugua

SEQ ID NO: 521739 - RNA, 64 nt, hsa
ugguucaguuuaacugaagaauauccugagauuguaagaaaagcauuuuuuaaaagguaucacu

SEQ ID NO: 521740 - RNA, 64 nt, hsa
ugaaccgccaugccuggcccuugauuuuucuuuuuaagaaaaaaauaucuaggaguuucuuaga

SEQ ID NO: 521741 - RNA, 64 nt, hsa
caaauuaaauccuugcaggaagagaaauuaacacuaagaaaaagucaucaauauuuuucaacuu

SEQ ID NO: 521742 - RNA, 64 nt, hsa
gaucuuuuguacuucucauaaccuaaugucagacuaagaaaaauaaaauaucugagaguaaaua

SEQ ID NO: 521743 - RNA, 64 nt, hsa
ccauuaagacaaaagcaauguguucaugaagacuuaagaaaaaugucacuacugcaacauuagg

SEQ ID NO: 521744 - RNA, 64 nt, hsa
gauuacuuuuccuguugauuguucaaauauaauuuaagaaaauuccacuuaauaggcuuaccua

SEQ ID NO: 521745 - RNA, 64 nt, hsa
uguguucaagcuccugugggcaacucaauuguuuuaagaaaacucuauuucuguucauauuaau

SEQ ID NO: 521746 - RNA, 64 nt, hsa
ccuucucuuuauuggugguccuaagugggucacuuaagaaaaaaaaguguaacaaauucucgcu

SEQ ID NO: 521747 - RNA, 64 nt, hsa
acagagguguugaguugcaggauaucuagcaauuuaagaaaauguggaaaaaauauuuuuauug

SEQ ID NO: 521748 - RNA, 64 nt, hsa
aagaugagccugaaucaucucauguaccugacaguaagaaaauacucuggcuggucucaguggc

SEQ ID NO: 521749 - RNA, 64 nt, hsa
aguauacacuggcacauaauuuuuuaaaaaguuuuaagaaaagauucauuuggaauuuuauuca

SEQ ID NO: 521750 - RNA, 64 nt, hsa
cacuagaagaaaucagcaggucuaaucccaccaguaagaaaacuaccacuucuugauuuuuaca

SEQ ID NO: 521751 - RNA, 64 nt, hsa
gugccucugcaagauacuaacacaaagcucauguuaagaaaacaguugaggacucagaagucag

SEQ ID NO: 521752 - RNA, 64 nt, hsa
uuaaacauuucuuguaaaaagcugagacaguuuguaagaaaagaauccuuaaaaucuagauuua

SEQ ID NO: 521753 - RNA, 64 nt, hsa
cacugucgucgucuccccacuuucccucuuccuuuaagaaaacuuacuaaaaaauguuucauug

SEQ ID NO: 521754 - RNA, 64 nt, hsa
cguuuucagaccuaaaggaaauguuuggucauguuaagaaaacaaauuauucauucauaugaug

SEQ ID NO: 521755 - RNA, 64 nt, hsa
uuuucuguuacaacuuacaggaacauuuguacuuuaagaaaaauuuaagugacaaauguuagaa

SEQ ID NO: 521756 - RNA, 64 nt, hsa
ugugacuuacuaauggcugcaaugccaaugauuguaagaaaacaaacaaauuuaucaugaaauu

SEQ ID NO: 521757 - RNA, 64 nt, hsa
uuccagcacuuuaauggccaauuaacugagaauguaagaaaauugaugcuguacaaggcaaaua

SEQ ID NO: 521758 - RNA, 64 nt, hsa
guucugauuucuuuuuaacaaauguuaucaugauuaagaaaauuuccagcacuuuaauggccaa

SEQ ID NO: 521759 - RNA, 64 nt, hsa
gaaauuuuuaauugaguguaaacacaccuaacuuuaagaaaaagaaccgcuuguaugauuuuca

SEQ ID NO: 521760 - RNA, 64 nt, hsa
aauuauacaaucaaacuagaucugaagcauaauuuaagaaaaacaucaacauuuuuugugcuuu

SEQ ID NO: 521761 - RNA, 64 nt, hsa
ugguugccauuuguguucuuuugcagaacucugauaagaaaaguguucaauuuguauuuaagca

SEQ ID NO: 521762 - RNA, 64 nt, hsa
aaucauuugguuuuugaguuguuuuuucuuaauguaagaaaaauuguauuuuuuuuacaaguau

SEQ ID NO: 521763 - RNA, 64 nt, hsa
aguuuuaacuuucugaagaauaucugucaaaauuuaagaaaacaaauguauaaaauuccauuuu

SEQ ID NO: 521764 - RNA, 64 nt, hsa
caacucucauuuaauauucaugcuuuugugccuuuaagaaaauauuuuuugucauuuuuugugu

SEQ ID NO: 521765 - RNA, 64 nt, hsa
ccaguauuuuacuucaaaagccaaaaagaggcaauaagaaaagacacuuugugguggccuuuau

SEQ ID NO: 521766 - RNA, 64 nt, hsa
gucaguuuugaaccaagaauuggugauuuguuuauaagaaaaaaacuggcuucauuucugugaa

SEQ ID NO: 521767 - RNA, 64 nt, hsa
uuaauuccuugcugguaaucuaauagaaucagauuaagaaaauuaacacaauuuuaccauuuga

SEQ ID NO: 521768 - RNA, 64 nt, hsa
cucaauaauaauaauaauaauaaugaugauacucuaagaaaaaaaucucaacauacuucauuua

SEQ ID NO: 521769 - RNA, 64 nt, hsa
guggaagagagaugagaaaauugagagcuauuauuaagaaaaacaguugagagaggaagaauuu

SEQ ID NO: 521770 - RNA, 64 nt, hsa
auuaugaacuuuuauuuacaugacucuaagacuauaagaaaaucugauggcagugacaaagugc

SEQ ID NO: 521771 - RNA, 64 nt, hsa
uguaauuuuugccuuuguuuaagccuggaacuuguaagaaaaugaaaauuuaauuuuuuuuucu

SEQ ID NO: 521772 - RNA, 64 nt, hsa
guguuaaagauagaauuuguuuuaggacaaauuuuaagaaaaugugggaauaccaaauguccuu

SEQ ID NO: 521773 - RNA, 64 nt, hsa
uuuaagaaaaugugggaauaccaaauguccuuuauaagaaaaauaaauuuuauuuuaagggaca

SEQ ID NO: 521774 - RNA, 64 nt, hsa
uuagacuuuuauaggcuugaaaucauccaucacauaagaaaauagaaaucauauuaaaagugaa

SEQ ID NO: 521775 - RNA, 64 nt, hsa
ccaagcagaugauugauaaaaccugggaguaagguaagaaaaauggaacaaauuuuuaucuaaa

SEQ ID NO: 521776 - RNA, 64 nt, hsa
aaauauaguucugauuggguauuaauuacuugauuaagaaaaaauuaacauuauagauacucug

SEQ ID NO: 521777 - RNA, 64 nt, hsa
uuuauuaccacaaaacagcaaaaucuucaaugucuaagaaaacuagcuuaaaauguuuaaauau

SEQ ID NO: 521778 - RNA, 64 nt, hsa
gacaugaugucaagaaguaucugcuugaccuuucuaagaaaaagggauucuuaucuuacucuga

SEQ ID NO: 521779 - RNA, 64 nt, hsa
agguccuguguuaaacuguuuagugcucuguuuuuaagaaaacaaauguugaaccucacacuuu

SEQ ID NO: 521780 - RNA, 64 nt, hsa
ggcuccaggggagggagcuggggaggccaggguauaagaaaagcaucagaacucucagcuuggc

SEQ ID NO: 521781 - RNA, 64 nt, hsa
accucccuuuugacagagauuagaaguacuucuuuaagaaaaaaauaaauuugagaaauuguau

SEQ ID NO: 521782 - RNA, 64 nt, hsa
caucuuugauuuuucauucaaguaaauauagccauaagaaaauaucugcuauacaggaaaacca

SEQ ID NO: 521783 - RNA, 64 nt, hsa
cuucgagcacuuuucuaacuaaugagcucugugguaagaaaaaaugaacucuuucaauugagau

SEQ ID NO: 521784 - RNA, 64 nt, hsa
gagaaggugagauaagcccugagucucagcuaccuaagaaaaaccuggaugucacuggccacug

SEQ ID NO: 521785 - RNA, 64 nt, hsa
gccaaagggaaauaucauuuauuuuuuacauuauuaagaaaaaaagauuuauuuauuuaagaca

SEQ ID NO: 521786 - RNA, 64 nt, hsa
agugauguaccaugaaacaaagcugcaggcuguuuaagaaaaaauaacacacauauaaacauca

SEQ ID NO: 521787 - RNA, 64 nt, hsa
gaaaucuuacaaguaugaauaaugugccaaagccuaagaaaacccucaauucuuaauagauaua

SEQ ID NO: 521788 - RNA, 64 nt, hsa
caguuguuaaaauuuuguugaacaucagggaguuuaagaaaacccugcaaguauaaugaauuug

SEQ ID NO: 521789 - RNA, 64 nt, hsa
gguucuugguuuuaauggauaggcugaauuggauuaagaaaaguugaaugccaccuaugguaau

SEQ ID NO: 521790 - RNA, 64 nt, hsa
uaucaacuccaugccaucucccaaaauaauugucuaagaaaacuugaaaguguaagguuuuaac

SEQ ID NO: 521791 - RNA, 64 nt, hsa
aaauauauguuagucuaaagauaaaccuuaaguguaagaaaauuauagagugaguuugugugua

SEQ ID NO: 521792 - RNA, 64 nt, hsa
aaaaacauaagugcaacuacugucaaaauaucuuuaagaaaauauaagcuuuuaaagugaagag

SEQ ID NO: 521793 - RNA, 64 nt, hsa
aagcuuuuaaacaguccucaaucuuuauuacacauaagaaaauucaugcuggagagaaacacua

SEQ ID NO: 521794 - RNA, 64 nt, hsa
uaaauccuucagcugauucucagucuaguaaacauaagaaaauucauacuggagagaaaaucua

SEQ ID NO: 521795 - RNA, 64 nt, hsa
uuuauaagaaaauggaggcaaagaacuuaaguuuuaagaaaaagcacuucaaaacagaagggca

SEQ ID NO: 521796 - RNA, 64 nt, hsa
aguagagcugcaccuaaagaggaaauuggguuuauaagaaaauggaggcaaagaacuuaaguuu

SEQ ID NO: 521797 - RNA, 64 nt, hsa
uguuaauggugggguuuucugcuuuguuuuuauuuaagaaaauaaacacgacauauuuaaagaa

SEQ ID NO: 521798 - RNA, 64 nt, hsa
uggggauuggaugaaagucaaagguugucuacuuuaagaaaauaaaauacccugaauggagccc

SEQ ID NO: 521799 - RNA, 64 nt, hsa
gacauaacuuugaauguuuuaacagcaagaauuuuaagaaaagauaaacaccauuuuauuuauu

SEQ ID NO: 521800 - RNA, 64 nt, hsa
cuaaugguauuuuaaucauuauuuuugccugucauaagaaaacucuuagcugaaauggccgaaa

SEQ ID NO: 521801 - RNA, 64 nt, hsa
acuuguuuuuuauuauuguuguuuaagcauaauuuaagaaaaaaaauuuuuaccuggugaacuu

SEQ ID NO: 521802 - RNA, 64 nt, hsa
uaucucagggcuuaugaaauguaauuaaauuuauuaagaaaauagaugaaaaauuaggguacac

SEQ ID NO: 521803 - RNA, 64 nt, hsa
caggaaccauaguugacaguuccaaucaguagcuuaagaaaaaaccguguuugucucuucugga

SEQ ID NO: 521804 - RNA, 64 nt, hsa
gucuugcucuccuagguagcccccucuucccugguaagaaaaagcaaaaggcauuucccacccu

SEQ ID NO: 521805 - RNA, 64 nt, hsa; identical to SEQ ID NO: 256603

SEQ ID NO: 521806 - RNA, 64 nt, hsa; identical to SEQ ID NO: 256604

SEQ ID NO: 521807 - RNA, 64 nt, hsa; identical to SEQ ID NO: 256605

SEQ ID NO: 521808 - RNA, 64 nt, hsa; identical to SEQ ID NO: 256606

SEQ ID NO: 521809 - RNA, 64 nt, hsa; identical to SEQ ID NO: 256607

SEQ ID NO: 521810 - RNA, 64 nt, hsa; identical to SEQ ID NO: 256608

SEQ ID NO: 521811 - RNA, 64 nt, hsa; identical to SEQ ID NO: 256609

SEQ ID NO: 521812 - RNA, 64 nt, hsa; identical to SEQ ID NO: 256610

SEQ ID NO: 521813 - RNA, 64 nt, hsa; identical to SEQ ID NO: 256611

SEQ ID NO: 521814 - RNA, 64 nt, hsa; identical to SEQ ID NO: 256612

SEQ ID NO: 521815 - RNA, 64 nt, hsa; identical to SEQ ID NO: 256613

SEQ ID NO: 521816 - RNA, 64 nt, hsa; identical to SEQ ID NO: 256614

SEQ ID NO: 521817 - RNA, 64 nt, hsa; identical to SEQ ID NO: 256615

SEQ ID NO: 521818 - RNA, 64 nt, hsa; identical to SEQ ID NO: 256616

SEQ ID NO: 521819 - RNA, 64 nt, hsa; identical to SEQ ID NO: 256617

SEQ ID NO: 521820 - RNA, 64 nt, hsa; identical to SEQ ID NO: 256618

SEQ ID NO: 521821 - RNA, 64 nt, hsa; identical to SEQ ID NO: 256619

SEQ ID NO: 521822 - RNA, 64 nt, hsa; identical to SEQ ID NO: 256620

SEQ ID NO: 521823 - RNA, 64 nt, hsa; identical to SEQ ID NO: 256621

SEQ ID NO: 521824 - RNA, 64 nt, hsa; identical to SEQ ID NO: 256622

SEQ ID NO: 521825 - RNA, 64 nt, hsa; identical to SEQ ID NO: 256623

SEQ ID NO: 521826 - RNA, 64 nt, hsa; identical to SEQ ID NO: 256624

SEQ ID NO: 521827 - RNA, 64 nt, hsa; identical to SEQ ID NO: 256625

SEQ ID NO: 521828 - RNA, 64 nt, hsa; identical to SEQ ID NO: 256626

SEQ ID NO: 521829 - RNA, 64 nt, hsa; identical to SEQ ID NO: 256627

SEQ ID NO: 521830 - RNA, 64 nt, hsa; identical to SEQ ID NO: 256628

SEQ ID NO: 521831 - RNA, 64 nt, hsa; identical to SEQ ID NO: 256629

SEQ ID NO: 521832 - RNA, 64 nt, hsa; identical to SEQ ID NO: 256630

SEQ ID NO: 521833 - RNA, 64 nt, hsa; identical to SEQ ID NO: 256631

SEQ ID NO: 521834 - RNA, 64 nt, hsa; identical to SEQ ID NO: 256632

SEQ ID NO: 521835 - RNA, 64 nt, hsa; identical to SEQ ID NO: 256633

SEQ ID NO: 521836 - RNA, 64 nt, hsa; identical to SEQ ID NO: 256634

SEQ ID NO: 521837 - RNA, 64 nt, hsa; identical to SEQ ID NO: 256635

SEQ ID NO: 521838 - RNA, 64 nt, hsa; identical to SEQ ID NO: 256636

SEQ ID NO: 521839 - RNA, 64 nt, hsa; identical to SEQ ID NO: 256637

SEQ ID NO: 521840 - RNA, 64 nt, hsa; identical to SEQ ID NO: 256638

SEQ ID NO: 521841 - RNA, 64 nt, hsa; identical to SEQ ID NO: 256639

SEQ ID NO: 521842 - RNA, 64 nt, hsa; identical to SEQ ID NO: 256640

SEQ ID NO: 521843 - RNA, 64 nt, hsa; identical to SEQ ID NO: 256641

SEQ ID NO: 521844 - RNA, 64 nt, hsa; identical to SEQ ID NO: 256642

SEQ ID NO: 521845 - RNA, 64 nt, hsa; identical to SEQ ID NO: 256643

SEQ ID NO: 521846 - RNA, 64 nt, hsa; identical to SEQ ID NO: 256644

SEQ ID NO: 521847 - RNA, 64 nt, hsa; identical to SEQ ID NO: 256645

SEQ ID NO: 521848 - RNA, 64 nt, hsa; identical to SEQ ID NO: 256646

SEQ ID NO: 521849 - RNA, 64 nt, hsa; identical to SEQ ID NO: 256647

SEQ ID NO: 521850 - RNA, 64 nt, hsa; identical to SEQ ID NO: 256648

SEQ ID NO: 521851 - RNA, 64 nt, hsa; identical to SEQ ID NO: 256649

SEQ ID NO: 521852 - RNA, 64 nt, hsa; identical to SEQ ID NO: 256650

SEQ ID NO: 521853 - RNA, 64 nt, hsa; identical to SEQ ID NO: 256651

SEQ ID NO: 521854 - RNA, 64 nt, hsa; identical to SEQ ID NO: 256652

SEQ ID NO: 521855 - RNA, 64 nt, hsa; identical to SEQ ID NO: 256653

SEQ ID NO: 521856 - RNA, 57 nt, hsa; identical to SEQ ID NO: 256654

SEQ ID NO: 521857 - RNA, 64 nt, hsa; identical to SEQ ID NO: 256655

SEQ ID NO: 521858 - RNA, 64 nt, hsa; identical to SEQ ID NO: 256656

SEQ ID NO: 521859 - RNA, 64 nt, hsa; identical to SEQ ID NO: 256657

SEQ ID NO: 521860 - RNA, 64 nt, hsa; identical to SEQ ID NO: 256658

SEQ ID NO: 521861 - RNA, 64 nt, hsa; identical to SEQ ID NO: 256659

SEQ ID NO: 521862 - RNA, 64 nt, hsa; identical to SEQ ID NO: 256660

SEQ ID NO: 521863 - RNA, 64 nt, hsa; identical to SEQ ID NO: 256661

SEQ ID NO: 521864 - RNA, 64 nt, hsa; identical to SEQ ID NO: 256662

SEQ ID NO: 521865 - RNA, 64 nt, hsa; identical to SEQ ID NO: 256663

SEQ ID NO: 521866 - RNA, 64 nt, hsa; identical to SEQ ID NO: 256664

SEQ ID NO: 521867 - RNA, 64 nt, hsa; identical to SEQ ID NO: 256665

SEQ ID NO: 521868 - RNA, 64 nt, hsa; identical to SEQ ID NO: 256666

SEQ ID NO: 521869 - RNA, 64 nt, hsa; identical to SEQ ID NO: 256667

SEQ ID NO: 521870 - RNA, 64 nt, hsa; identical to SEQ ID NO: 256668

SEQ ID NO: 521871 - RNA, 64 nt, hsa; identical to SEQ ID NO: 256669

SEQ ID NO: 521872 - RNA, 64 nt, hsa; identical to SEQ ID NO: 256670

SEQ ID NO: 521873 - RNA, 64 nt, hsa; identical to SEQ ID NO: 256671

SEQ ID NO: 521874 - RNA, 64 nt, hsa; identical to SEQ ID NO: 256672

SEQ ID NO: 521875 - RNA, 64 nt, hsa; identical to SEQ ID NO: 256673

SEQ ID NO: 521876 - RNA, 64 nt, hsa; identical to SEQ ID NO: 256674

SEQ ID NO: 521877 - RNA, 64 nt, hsa; identical to SEQ ID NO: 256675

SEQ ID NO: 521878 - RNA, 64 nt, hsa; identical to SEQ ID NO: 256676

SEQ ID NO: 521879 - RNA, 64 nt, hsa; identical to SEQ ID NO: 256677

SEQ ID NO: 521880 - RNA, 64 nt, hsa; identical to SEQ ID NO: 256678

SEQ ID NO: 521881 - RNA, 64 nt, hsa; identical to SEQ ID NO: 256679

SEQ ID NO: 521882 - RNA, 64 nt, hsa; identical to SEQ ID NO: 256680

SEQ ID NO: 521883 - RNA, 64 nt, hsa; identical to SEQ ID NO: 256681

SEQ ID NO: 521884 - RNA, 64 nt, hsa; identical to SEQ ID NO: 256682

SEQ ID NO: 521885 - RNA, 64 nt, hsa; identical to SEQ ID NO: 256683

SEQ ID NO: 521886 - RNA, 64 nt, hsa; identical to SEQ ID NO: 256684

SEQ ID NO: 521887 - RNA, 64 nt, hsa; identical to SEQ ID NO: 256685

SEQ ID NO: 521888 - RNA, 64 nt, hsa; identical to SEQ ID NO: 256686

SEQ ID NO: 521889 - RNA, 64 nt, hsa; identical to SEQ ID NO: 256687

SEQ ID NO: 521890 - RNA, 64 nt, hsa; identical to SEQ ID NO: 256688

SEQ ID NO: 521891 - RNA, 64 nt, hsa; identical to SEQ ID NO: 256689

SEQ ID NO: 521892 - RNA, 64 nt, hsa; identical to SEQ ID NO: 256690

SEQ ID NO: 521893 - RNA, 64 nt, hsa; identical to SEQ ID NO: 256691

SEQ ID NO: 521894 - RNA, 64 nt, hsa; identical to SEQ ID NO: 256692

SEQ ID NO: 521895 - RNA, 64 nt, hsa; identical to SEQ ID NO: 256693

SEQ ID NO: 521896 - RNA, 64 nt, hsa; identical to SEQ ID NO: 256694

SEQ ID NO: 521897 - RNA, 64 nt, hsa; identical to SEQ ID NO: 256695

SEQ ID NO: 521898 - RNA, 64 nt, hsa; identical to SEQ ID NO: 256696

SEQ ID NO: 521899 - RNA, 64 nt, hsa; identical to SEQ ID NO: 256697

SEQ ID NO: 521900 - RNA, 64 nt, hsa; identical to SEQ ID NO: 256698

SEQ ID NO: 521901 - RNA, 64 nt, hsa; identical to SEQ ID NO: 256699

SEQ ID NO: 521902 - RNA, 64 nt, hsa; identical to SEQ ID NO: 256700

SEQ ID NO: 521903 - RNA, 64 nt, hsa; identical to SEQ ID NO: 256701

SEQ ID NO: 521904 - RNA, 64 nt, hsa; identical to SEQ ID NO: 256702

SEQ ID NO: 521905 - RNA, 64 nt, hsa; identical to SEQ ID NO: 256703

SEQ ID NO: 521906 - RNA, 64 nt, hsa; identical to SEQ ID NO: 256704

SEQ ID NO: 521907 - RNA, 64 nt, hsa; identical to SEQ ID NO: 256705

SEQ ID NO: 521908 - RNA, 64 nt, hsa; identical to SEQ ID NO: 256706

SEQ ID NO: 521909 - RNA, 64 nt, hsa; identical to SEQ ID NO: 256707

SEQ ID NO: 521910 - RNA, 64 nt, hsa; identical to SEQ ID NO: 256708

SEQ ID NO: 521911 - RNA, 64 nt, hsa; identical to SEQ ID NO: 256709

SEQ ID NO: 521912 - RNA, 64 nt, hsa; identical to SEQ ID NO: 256710

SEQ ID NO: 521913 - RNA, 64 nt, hsa; identical to SEQ ID NO: 256711

SEQ ID NO: 521914 - RNA, 64 nt, hsa; identical to SEQ ID NO: 256712

SEQ ID NO: 521915 - RNA, 64 nt, hsa; identical to SEQ ID NO: 256713

SEQ ID NO: 521916 - RNA, 64 nt, hsa; identical to SEQ ID NO: 256714

SEQ ID NO: 521917 - RNA, 64 nt, hsa; identical to SEQ ID NO: 256715

SEQ ID NO: 521918 - RNA, 64 nt, hsa; identical to SEQ ID NO: 256716

SEQ ID NO: 521919 - RNA, 64 nt, hsa; identical to SEQ ID NO: 256717

SEQ ID NO: 521920 - RNA, 64 nt, hsa; identical to SEQ ID NO: 256718

SEQ ID NO: 521921 - RNA, 64 nt, hsa; identical to SEQ ID NO: 256719

SEQ ID NO: 521922 - RNA, 64 nt, hsa; identical to SEQ ID NO: 256720

SEQ ID NO: 521923 - RNA, 64 nt, hsa; identical to SEQ ID NO: 256720

SEQ ID NO: 521924 - RNA, 64 nt, hsa; identical to SEQ ID NO: 256719

SEQ ID NO: 521925 - RNA, 64 nt, hsa; identical to SEQ ID NO: 256723

SEQ ID NO: 521926 - RNA, 64 nt, hsa; identical to SEQ ID NO: 256724

SEQ ID NO: 521927 - RNA, 64 nt, hsa; identical to SEQ ID NO: 256725

SEQ ID NO: 521928 - RNA, 64 nt, hsa; identical to SEQ ID NO: 256726

SEQ ID NO: 521929 - RNA, 64 nt, hsa; identical to SEQ ID NO: 256727

SEQ ID NO: 521930 - RNA, 64 nt, hsa; identical to SEQ ID NO: 256728

SEQ ID NO: 521931 - RNA, 64 nt, hsa; identical to SEQ ID NO: 256729

SEQ ID NO: 521932 - RNA, 64 nt, hsa; identical to SEQ ID NO: 256730

SEQ ID NO: 521933 - RNA, 64 nt, hsa; identical to SEQ ID NO: 256731

SEQ ID NO: 521934 - RNA, 64 nt, hsa; identical to SEQ ID NO: 256732

SEQ ID NO: 521935 - RNA, 64 nt, hsa; identical to SEQ ID NO: 256733

SEQ ID NO: 521936 - RNA, 64 nt, hsa; identical to SEQ ID NO: 256734

SEQ ID NO: 521937 - RNA, 64 nt, hsa; identical to SEQ ID NO: 256735

SEQ ID NO: 521938 - RNA, 64 nt, hsa; identical to SEQ ID NO: 256736

SEQ ID NO: 521939 - RNA, 64 nt, hsa; identical to SEQ ID NO: 256737

SEQ ID NO: 521940 - RNA, 64 nt, hsa; identical to SEQ ID NO: 256738

SEQ ID NO: 521941 - RNA, 64 nt, hsa; identical to SEQ ID NO: 256739

SEQ ID NO: 521942 - RNA, 64 nt, hsa; identical to SEQ ID NO: 256740

SEQ ID NO: 521943 - RNA, 64 nt, hsa; identical to SEQ ID NO: 256741

SEQ ID NO: 521944 - RNA, 64 nt, hsa; identical to SEQ ID NO: 256742

SEQ ID NO: 521945 - RNA, 64 nt, hsa; identical to SEQ ID NO: 256743

SEQ ID NO: 521946 - RNA, 64 nt, hsa; identical to SEQ ID NO: 256744

SEQ ID NO: 521947 - RNA, 64 nt, hsa; identical to SEQ ID NO: 256745

SEQ ID NO: 521948 - RNA, 64 nt, hsa; identical to SEQ ID NO: 256746

SEQ ID NO: 521949 - RNA, 64 nt, hsa; identical to SEQ ID NO: 256747

SEQ ID NO: 521950 - RNA, 64 nt, hsa; identical to SEQ ID NO: 256748

SEQ ID NO: 521951 - RNA, 64 nt, hsa; identical to SEQ ID NO: 256749

SEQ ID NO: 521952 - RNA, 64 nt, hsa; identical to SEQ ID NO: 256750

SEQ ID NO: 521953 - RNA, 64 nt, hsa; identical to SEQ ID NO: 256751

SEQ ID NO: 521954 - RNA, 64 nt, hsa; identical to SEQ ID NO: 256752

SEQ ID NO: 521955 - RNA, 64 nt, hsa; identical to SEQ ID NO: 256753

SEQ ID NO: 521956 - RNA, 64 nt, hsa; identical to SEQ ID NO: 256754

SEQ ID NO: 521957 - RNA, 64 nt, hsa; identical to SEQ ID NO: 256755

SEQ ID NO: 521958 - RNA, 64 nt, hsa
ugugcauuacaggauauuuagcagcaacccuggcccacucuaguuaugacaaccaaaaaugucu

SEQ ID NO: 521959 - RNA, 64 nt, hsa
aagcaggggcuggugggggugccuacucccuuuuccacucuaucuuuagauuucaaaccuuagg

SEQ ID NO: 521960 - RNA, 64 nt, hsa
uguuuuacaaagucagguguuugagaguucuuuuccacucuacuacuacucauagagcuuguuu

SEQ ID NO: 521961 - RNA, 64 nt, hsa
ucuugcuuuuuuuuuuaugaucagaacaaagggcccacucuaguucucuacaugucaaucaauc

SEQ ID NO: 521962 - RNA, 64 nt, hsa
ucaacagugcuuggcccccgccagcuugucccagccacucuagcugcuggaugugauccuggga

SEQ ID NO: 521963 - RNA, 64 nt, hsa
aaauaaacugcuauccuccccuuggaaucuaccgccacucuacauccuacugcuuuggccuccc

SEQ ID NO: 521964 - RNA, 64 nt, hsa; identical to SEQ ID NO: 98311

SEQ ID NO: 521965 - RNA, 64 nt, hsa; identical to SEQ ID NO: 98312

SEQ ID NO: 521966 - RNA, 64 nt, hsa; identical to SEQ ID NO: 98313

SEQ ID NO: 521967 - RNA, 64 nt, hsa; identical to SEQ ID NO: 98314

SEQ ID NO: 521968 - RNA, 64 nt, hsa; identical to SEQ ID NO: 98315

SEQ ID NO: 521969 - RNA, 64 nt, hsa; identical to SEQ ID NO: 98316

SEQ ID NO: 521970 - RNA, 64 nt, hsa; identical to SEQ ID NO: 98317

SEQ ID NO: 521971 - RNA, 64 nt, hsa; identical to SEQ ID NO: 98318

SEQ ID NO: 521972 - RNA, 64 nt, hsa; identical to SEQ ID NO: 98319

SEQ ID NO: 521973 - RNA, 64 nt, hsa; identical to SEQ ID NO: 98320

SEQ ID NO: 521974 - RNA, 64 nt, hsa; identical to SEQ ID NO: 98321

SEQ ID NO: 521975 - RNA, 64 nt, hsa; identical to SEQ ID NO: 98322

SEQ ID NO: 521976 - RNA, 64 nt, hsa; identical to SEQ ID NO: 98323

SEQ ID NO: 521977 - RNA, 64 nt, hsa; identical to SEQ ID NO: 98324

SEQ ID NO: 521978 - RNA, 64 nt, hsa; identical to SEQ ID NO: 98325

SEQ ID NO: 521979 - RNA, 64 nt, hsa; identical to SEQ ID NO: 98326

SEQ ID NO: 521980 - RNA, 64 nt, hsa; identical to SEQ ID NO: 98327

SEQ ID NO: 521981 - RNA, 64 nt, hsa; identical to SEQ ID NO: 98328

SEQ ID NO: 521982 - RNA, 64 nt, hsa; identical to SEQ ID NO: 98329

SEQ ID NO: 521983 - RNA, 64 nt, hsa; identical to SEQ ID NO: 98330

SEQ ID NO: 521984 - RNA, 64 nt, hsa; identical to SEQ ID NO: 98331

SEQ ID NO: 521985 - RNA, 64 nt, hsa; identical to SEQ ID NO: 98332

SEQ ID NO: 521986 - RNA, 64 nt, hsa; identical to SEQ ID NO: 98333

SEQ ID NO: 521987 - RNA, 64 nt, hsa; identical to SEQ ID NO: 98334

SEQ ID NO: 521988 - RNA, 64 nt, hsa; identical to SEQ ID NO: 98335

SEQ ID NO: 521989 - RNA, 64 nt, hsa; identical to SEQ ID NO: 98336

SEQ ID NO: 521990 - RNA, 64 nt, hsa; identical to SEQ ID NO: 98337

SEQ ID NO: 521991 - RNA, 64 nt, hsa; identical to SEQ ID NO: 98338

SEQ ID NO: 521992 - RNA, 64 nt, hsa; identical to SEQ ID NO: 98339

SEQ ID NO: 521993 - RNA, 64 nt, hsa; identical to SEQ ID NO: 98340

SEQ ID NO: 521994 - RNA, 64 nt, hsa; identical to SEQ ID NO: 98341

SEQ ID NO: 521995 - RNA, 64 nt, hsa; identical to SEQ ID NO: 98342

SEQ ID NO: 521996 - RNA, 64 nt, hsa; identical to SEQ ID NO: 98343

SEQ ID NO: 521997 - RNA, 64 nt, hsa; identical to SEQ ID NO: 98344

SEQ ID NO: 521998 - RNA, 64 nt, hsa; identical to SEQ ID NO: 98345

SEQ ID NO: 521999 - RNA, 64 nt, hsa; identical to SEQ ID NO: 98346

SEQ ID NO: 522000 - RNA, 64 nt, hsa; identical to SEQ ID NO: 98347

SEQ ID NO: 522001 - RNA, 64 nt, hsa; identical to SEQ ID NO: 98348

SEQ ID NO: 522002 - RNA, 64 nt, hsa; identical to SEQ ID NO: 98349

SEQ ID NO: 522003 - RNA, 64 nt, hsa; identical to SEQ ID NO: 98350

SEQ ID NO: 522004 - RNA, 64 nt, hsa; identical to SEQ ID NO: 98351

SEQ ID NO: 522005 - RNA, 64 nt, hsa; identical to SEQ ID NO: 98352

SEQ ID NO: 522006 - RNA, 64 nt, hsa; identical to SEQ ID NO: 98353

SEQ ID NO: 522007 - RNA, 64 nt, hsa; identical to SEQ ID NO: 98354

SEQ ID NO: 522008 - RNA, 64 nt, hsa; identical to SEQ ID NO: 98355

SEQ ID NO: 522009 - RNA, 64 nt, hsa; identical to SEQ ID NO: 98356

SEQ ID NO: 522010 - RNA, 64 nt, hsa; identical to SEQ ID NO: 98357

SEQ ID NO: 522011 - RNA, 64 nt, hsa; identical to SEQ ID NO: 98358

SEQ ID NO: 522012 - RNA, 64 nt, hsa; identical to SEQ ID NO: 98359

SEQ ID NO: 522013 - RNA, 64 nt, hsa; identical to SEQ ID NO: 98360

SEQ ID NO: 522014 - RNA, 64 nt, hsa; identical to SEQ ID NO: 98361

SEQ ID NO: 522015 - RNA, 64 nt, hsa; identical to SEQ ID NO: 98362

SEQ ID NO: 522016 - RNA, 64 nt, hsa; identical to SEQ ID NO: 98363

SEQ ID NO: 522017 - RNA, 64 nt, hsa; identical to SEQ ID NO: 98364

SEQ ID NO: 522018 - RNA, 64 nt, hsa; identical to SEQ ID NO: 98365

SEQ ID NO: 522019 - RNA, 64 nt, hsa; identical to SEQ ID NO: 98366

SEQ ID NO: 522020 - RNA, 64 nt, hsa; identical to SEQ ID NO: 98367

SEQ ID NO: 522021 - RNA, 64 nt, hsa; identical to SEQ ID NO: 98368

SEQ ID NO: 522022 - RNA, 64 nt, hsa; identical to SEQ ID NO: 98369

SEQ ID NO: 522023 - RNA, 64 nt, hsa; identical to SEQ ID NO: 98370

SEQ ID NO: 522024 - RNA, 64 nt, hsa; identical to SEQ ID NO: 98371

SEQ ID NO: 522025 - RNA, 64 nt, hsa; identical to SEQ ID NO: 98372

SEQ ID NO: 522026 - RNA, 64 nt, hsa; identical to SEQ ID NO: 98373

SEQ ID NO: 522027 - RNA, 64 nt, hsa; identical to SEQ ID NO: 98374

SEQ ID NO: 522028 - RNA, 64 nt, hsa; identical to SEQ ID NO: 98375

SEQ ID NO: 522029 - RNA, 64 nt, hsa; identical to SEQ ID NO: 98376

SEQ ID NO: 522030 - RNA, 64 nt, hsa; identical to SEQ ID NO: 98377

SEQ ID NO: 522031 - RNA, 64 nt, hsa; identical to SEQ ID NO: 98378

SEQ ID NO: 522032 - RNA, 64 nt, hsa; identical to SEQ ID NO: 98379

SEQ ID NO: 522033 - RNA, 64 nt, hsa; identical to SEQ ID NO: 98380

SEQ ID NO: 522034 - RNA, 64 nt, hsa; identical to SEQ ID NO: 98381

SEQ ID NO: 522035 - RNA, 64 nt, hsa; identical to SEQ ID NO: 98382

SEQ ID NO: 522036 - RNA, 64 nt, hsa; identical to SEQ ID NO: 98383

SEQ ID NO: 522037 - RNA, 64 nt, hsa; identical to SEQ ID NO: 98384

SEQ ID NO: 522038 - RNA, 64 nt, hsa; identical to SEQ ID NO: 98385

SEQ ID NO: 522039 - RNA, 64 nt, hsa; identical to SEQ ID NO: 98386

SEQ ID NO: 522040 - RNA, 64 nt, hsa; identical to SEQ ID NO: 98387

SEQ ID NO: 522041 - RNA, 64 nt, hsa; identical to SEQ ID NO: 98388

SEQ ID NO: 522042 - RNA, 64 nt, hsa; identical to SEQ ID NO: 98389

SEQ ID NO: 522043 - RNA, 64 nt, hsa; identical to SEQ ID NO: 98390

SEQ ID NO: 522044 - RNA, 64 nt, hsa; identical to SEQ ID NO: 98391

SEQ ID NO: 522045 - RNA, 64 nt, hsa; identical to SEQ ID NO: 98392

SEQ ID NO: 522046 - RNA, 64 nt, hsa; identical to SEQ ID NO: 98393

SEQ ID NO: 522047 - RNA, 64 nt, hsa; identical to SEQ ID NO: 98394

SEQ ID NO: 522048 - RNA, 64 nt, hsa; identical to SEQ ID NO: 98395

SEQ ID NO: 522049 - RNA, 64 nt, hsa; identical to SEQ ID NO: 98396

SEQ ID NO: 522050 - RNA, 64 nt, hsa; identical to SEQ ID NO: 98397

SEQ ID NO: 522051 - RNA, 64 nt, hsa; identical to SEQ ID NO: 98398

SEQ ID NO: 522052 - RNA, 64 nt, hsa; identical to SEQ ID NO: 98399

SEQ ID NO: 522053 - RNA, 64 nt, hsa; identical to SEQ ID NO: 98400

SEQ ID NO: 522054 - RNA, 64 nt, hsa; identical to SEQ ID NO: 98401

SEQ ID NO: 522055 - RNA, 64 nt, hsa; identical to SEQ ID NO: 98402

SEQ ID NO: 522056 - RNA, 64 nt, hsa; identical to SEQ ID NO: 98403

SEQ ID NO: 522057 - RNA, 64 nt, hsa; identical to SEQ ID NO: 98404

SEQ ID NO: 522058 - RNA, 64 nt, hsa; identical to SEQ ID NO: 98405

SEQ ID NO: 522059 - RNA, 64 nt, hsa; identical to SEQ ID NO: 98406

SEQ ID NO: 522060 - RNA, 64 nt, hsa; identical to SEQ ID NO: 98407

SEQ ID NO: 522061 - RNA, 64 nt, hsa; identical to SEQ ID NO: 98408

SEQ ID NO: 522062 - RNA, 64 nt, hsa; identical to SEQ ID NO: 98409

SEQ ID NO: 522063 - RNA, 64 nt, hsa; identical to SEQ ID NO: 98410

SEQ ID NO: 522064 - RNA, 64 nt, hsa; identical to SEQ ID NO: 98411

SEQ ID NO: 522065 - RNA, 64 nt, hsa; identical to SEQ ID NO: 98412

SEQ ID NO: 522066 - RNA, 64 nt, hsa; identical to SEQ ID NO: 98413

SEQ ID NO: 522067 - RNA, 64 nt, hsa; identical to SEQ ID NO: 98414

SEQ ID NO: 522068 - RNA, 64 nt, hsa; identical to SEQ ID NO: 98415

SEQ ID NO: 522069 - RNA, 64 nt, hsa; identical to SEQ ID NO: 98416

SEQ ID NO: 522070 - RNA, 64 nt, hsa; identical to SEQ ID NO: 98417

SEQ ID NO: 522071 - RNA, 64 nt, hsa; identical to SEQ ID NO: 98418

SEQ ID NO: 522072 - RNA, 64 nt, hsa; identical to SEQ ID NO: 98419

SEQ ID NO: 522073 - RNA, 64 nt, hsa; identical to SEQ ID NO: 98420

SEQ ID NO: 522074 - RNA, 64 nt, hsa; identical to SEQ ID NO: 98421

SEQ ID NO: 522075 - RNA, 64 nt, hsa; identical to SEQ ID NO: 98422

SEQ ID NO: 522076 - RNA, 64 nt, hsa; identical to SEQ ID NO: 98423

SEQ ID NO: 522077 - RNA, 64 nt, hsa; identical to SEQ ID NO: 98424

SEQ ID NO: 522078 - RNA, 64 nt, hsa; identical to SEQ ID NO: 98425

SEQ ID NO: 522079 - RNA, 64 nt, hsa; identical to SEQ ID NO: 98426

SEQ ID NO: 522080 - RNA, 64 nt, hsa; identical to SEQ ID NO: 98427

SEQ ID NO: 522081 - RNA, 64 nt, hsa; identical to SEQ ID NO: 98428

SEQ ID NO: 522082 - RNA, 64 nt, hsa; identical to SEQ ID NO: 98429

SEQ ID NO: 522083 - RNA, 64 nt, hsa; identical to SEQ ID NO: 98430

SEQ ID NO: 522084 - RNA, 64 nt, hsa; identical to SEQ ID NO: 98431

SEQ ID NO: 522085 - RNA, 64 nt, hsa; identical to SEQ ID NO: 98432

SEQ ID NO: 522086 - RNA, 64 nt, hsa; identical to SEQ ID NO: 98433

SEQ ID NO: 522087 - RNA, 64 nt, hsa; identical to SEQ ID NO: 98434

SEQ ID NO: 522088 - RNA, 64 nt, hsa; identical to SEQ ID NO: 98435

SEQ ID NO: 522089 - RNA, 64 nt, hsa; identical to SEQ ID NO: 98436

SEQ ID NO: 522090 - RNA, 64 nt, hsa; identical to SEQ ID NO: 98437

SEQ ID NO: 522091 - RNA, 64 nt, hsa; identical to SEQ ID NO: 98438

SEQ ID NO: 522092 - RNA, 64 nt, hsa; identical to SEQ ID NO: 98439

SEQ ID NO: 522093 - RNA, 64 nt, hsa; identical to SEQ ID NO: 98440

SEQ ID NO: 522094 - RNA, 64 nt, hsa; identical to SEQ ID NO: 98441

SEQ ID NO: 522095 - RNA, 64 nt, hsa; identical to SEQ ID NO: 98442

SEQ ID NO: 522096 - RNA, 64 nt, hsa; identical to SEQ ID NO: 98443

SEQ ID NO: 522097 - RNA, 64 nt, hsa; identical to SEQ ID NO: 98444

SEQ ID NO: 522098 - RNA, 64 nt, hsa; identical to SEQ ID NO: 98445

SEQ ID NO: 522099 - RNA, 64 nt, hsa; identical to SEQ ID NO: 98446

SEQ ID NO: 522100 - RNA, 64 nt, hsa; identical to SEQ ID NO: 98447

SEQ ID NO: 522101 - RNA, 64 nt, hsa; identical to SEQ ID NO: 98448

SEQ ID NO: 522102 - RNA, 64 nt, hsa; identical to SEQ ID NO: 98449

SEQ ID NO: 522103 - RNA, 64 nt, hsa; identical to SEQ ID NO: 98450

SEQ ID NO: 522104 - RNA, 64 nt, hsa; identical to SEQ ID NO: 98451

SEQ ID NO: 522105 - RNA, 64 nt, hsa; identical to SEQ ID NO: 98452

SEQ ID NO: 522106 - RNA, 64 nt, hsa; identical to SEQ ID NO: 98453

SEQ ID NO: 522107 - RNA, 64 nt, hsa; identical to SEQ ID NO: 98454

SEQ ID NO: 522108 - RNA, 64 nt, hsa; identical to SEQ ID NO: 98455

SEQ ID NO: 522109 - RNA, 64 nt, hsa; identical to SEQ ID NO: 98456

SEQ ID NO: 522110 - RNA, 64 nt, hsa; identical to SEQ ID NO: 98457

SEQ ID NO: 522111 - RNA, 64 nt, hsa; identical to SEQ ID NO: 98458

SEQ ID NO: 522112 - RNA, 64 nt, hsa; identical to SEQ ID NO: 98459

SEQ ID NO: 522113 - RNA, 64 nt, hsa; identical to SEQ ID NO: 98460

SEQ ID NO: 522114 - RNA, 64 nt, hsa; identical to SEQ ID NO: 98461

SEQ ID NO: 522115 - RNA, 64 nt, hsa; identical to SEQ ID NO: 98462

SEQ ID NO: 522116 - RNA, 64 nt, hsa; identical to SEQ ID NO: 98463

SEQ ID NO: 522117 - RNA, 64 nt, hsa; identical to SEQ ID NO: 98464

SEQ ID NO: 522118 - RNA, 64 nt, hsa; identical to SEQ ID NO: 98465

SEQ ID NO: 522119 - RNA, 64 nt, hsa; identical to SEQ ID NO: 98466

SEQ ID NO: 522120 - RNA, 64 nt, hsa; identical to SEQ ID NO: 98467

SEQ ID NO: 522121 - RNA, 64 nt, hsa; identical to SEQ ID NO: 98468

SEQ ID NO: 522122 - RNA, 64 nt, hsa; identical to SEQ ID NO: 98469

SEQ ID NO: 522123 - RNA, 64 nt, hsa; identical to SEQ ID NO: 98470

SEQ ID NO: 522124 - RNA, 64 nt, hsa; identical to SEQ ID NO: 98471

SEQ ID NO: 522125 - RNA, 64 nt, hsa; identical to SEQ ID NO: 98472

SEQ ID NO: 522126 - RNA, 64 nt, hsa; identical to SEQ ID NO: 98473

SEQ ID NO: 522127 - RNA, 64 nt, hsa; identical to SEQ ID NO: 98474

SEQ ID NO: 522128 - RNA, 64 nt, hsa; identical to SEQ ID NO: 98475

SEQ ID NO: 522129 - RNA, 64 nt, hsa; identical to SEQ ID NO: 98476

SEQ ID NO: 522130 - RNA, 64 nt, hsa; identical to SEQ ID NO: 98477

SEQ ID NO: 522131 - RNA, 64 nt, hsa; identical to SEQ ID NO: 98478

SEQ ID NO: 522132 - RNA, 64 nt, hsa; identical to SEQ ID NO: 98479

SEQ ID NO: 522133 - RNA, 64 nt, hsa; identical to SEQ ID NO: 98480

SEQ ID NO: 522134 - RNA, 64 nt, hsa; identical to SEQ ID NO: 98481

SEQ ID NO: 522135 - RNA, 64 nt, hsa; identical to SEQ ID NO: 98482

SEQ ID NO: 522136 - RNA, 64 nt, hsa; identical to SEQ ID NO: 98483

SEQ ID NO: 522137 - RNA, 64 nt, hsa; identical to SEQ ID NO: 98484

SEQ ID NO: 522138 - RNA, 64 nt, hsa; identical to SEQ ID NO: 98485

SEQ ID NO: 522139 - RNA, 64 nt, hsa; identical to SEQ ID NO: 98486

SEQ ID NO: 522140 - RNA, 64 nt, hsa; identical to SEQ ID NO: 98487

SEQ ID NO: 522141 - RNA, 64 nt, hsa; identical to SEQ ID NO: 98488

SEQ ID NO: 522142 - RNA, 64 nt, hsa; identical to SEQ ID NO: 98489

SEQ ID NO: 522143 - RNA, 64 nt, hsa; identical to SEQ ID NO: 98490

SEQ ID NO: 522144 - RNA, 64 nt, hsa; identical to SEQ ID NO: 98491

SEQ ID NO: 522145 - RNA, 64 nt, hsa; identical to SEQ ID NO: 98492

SEQ ID NO: 522146 - RNA, 64 nt, hsa; identical to SEQ ID NO: 98493

SEQ ID NO: 522147 - RNA, 64 nt, hsa; identical to SEQ ID NO: 98494

SEQ ID NO: 522148 - RNA, 64 nt, hsa; identical to SEQ ID NO: 98495

SEQ ID NO: 522149 - RNA, 64 nt, hsa; identical to SEQ ID NO: 98496

SEQ ID NO: 522150 - RNA, 64 nt, hsa; identical to SEQ ID NO: 98497

SEQ ID NO: 522151 - RNA, 64 nt, hsa; identical to SEQ ID NO: 98498

SEQ ID NO: 522152 - RNA, 64 nt, hsa; identical to SEQ ID NO: 98499

SEQ ID NO: 522153 - RNA, 64 nt, hsa; identical to SEQ ID NO: 98500

SEQ ID NO: 522154 - RNA, 64 nt, hsa; identical to SEQ ID NO: 98501

SEQ ID NO: 522155 - RNA, 64 nt, hsa; identical to SEQ ID NO: 98502

SEQ ID NO: 522156 - RNA, 64 nt, hsa; identical to SEQ ID NO: 98503

SEQ ID NO: 522157 - RNA, 64 nt, hsa; identical to SEQ ID NO: 98504

SEQ ID NO: 522158 - RNA, 64 nt, hsa; identical to SEQ ID NO: 144190

SEQ ID NO: 522159 - RNA, 64 nt, hsa; identical to SEQ ID NO: 144191

SEQ ID NO: 522160 - RNA, 64 nt, hsa; identical to SEQ ID NO: 144192

SEQ ID NO: 522161 - RNA, 64 nt, hsa; identical to SEQ ID NO: 144193

SEQ ID NO: 522162 - RNA, 64 nt, hsa; identical to SEQ ID NO: 144194

SEQ ID NO: 522163 - RNA, 64 nt, hsa; identical to SEQ ID NO: 144195

SEQ ID NO: 522164 - RNA, 64 nt, hsa; identical to SEQ ID NO: 144196

SEQ ID NO: 522165 - RNA, 64 nt, hsa; identical to SEQ ID NO: 144197

SEQ ID NO: 522166 - RNA, 64 nt, hsa; identical to SEQ ID NO: 144198

SEQ ID NO: 522167 - RNA, 64 nt, hsa; identical to SEQ ID NO: 144199

SEQ ID NO: 522168 - RNA, 64 nt, hsa; identical to SEQ ID NO: 144200

SEQ ID NO: 522169 - RNA, 64 nt, hsa; identical to SEQ ID NO: 144201

SEQ ID NO: 522170 - RNA, 64 nt, hsa; identical to SEQ ID NO: 144202

SEQ ID NO: 522171 - RNA, 64 nt, hsa; identical to SEQ ID NO: 144203

SEQ ID NO: 522172 - RNA, 64 nt, hsa; identical to SEQ ID NO: 144204

SEQ ID NO: 522173 - RNA, 64 nt, hsa; identical to SEQ ID NO: 144205

SEQ ID NO: 522174 - RNA, 64 nt, hsa; identical to SEQ ID NO: 144206

SEQ ID NO: 522175 - RNA, 64 nt, hsa; identical to SEQ ID NO: 144207

SEQ ID NO: 522176 - RNA, 64 nt, hsa; identical to SEQ ID NO: 144208

SEQ ID NO: 522177 - RNA, 64 nt, hsa; identical to SEQ ID NO: 144209

SEQ ID NO: 522178 - RNA, 64 nt, hsa; identical to SEQ ID NO: 144210

SEQ ID NO: 522179 - RNA, 64 nt, hsa; identical to SEQ ID NO: 144211

SEQ ID NO: 522180 - RNA, 64 nt, hsa; identical to SEQ ID NO: 144212

SEQ ID NO: 522181 - RNA, 64 nt, hsa; identical to SEQ ID NO: 144213

SEQ ID NO: 522182 - RNA, 64 nt, hsa; identical to SEQ ID NO: 144214

SEQ ID NO: 522183 - RNA, 64 nt, hsa; identical to SEQ ID NO: 144215

SEQ ID NO: 522184 - RNA, 64 nt, hsa; identical to SEQ ID NO: 144216

SEQ ID NO: 522185 - RNA, 64 nt, hsa; identical to SEQ ID NO: 144217

SEQ ID NO: 522186 - RNA, 64 nt, hsa; identical to SEQ ID NO: 144218

SEQ ID NO: 522187 - RNA, 64 nt, hsa; identical to SEQ ID NO: 144219

SEQ ID NO: 522188 - RNA, 64 nt, hsa; identical to SEQ ID NO: 144220

SEQ ID NO: 522189 - RNA, 64 nt, hsa; identical to SEQ ID NO: 144221

SEQ ID NO: 522190 - RNA, 64 nt, hsa; identical to SEQ ID NO: 144222

SEQ ID NO: 522191 - RNA, 64 nt, hsa; identical to SEQ ID NO: 144223

SEQ ID NO: 522192 - RNA, 64 nt, hsa; identical to SEQ ID NO: 144224

SEQ ID NO: 522193 - RNA, 64 nt, hsa; identical to SEQ ID NO: 144225

SEQ ID NO: 522194 - RNA, 64 nt, hsa; identical to SEQ ID NO: 144226

SEQ ID NO: 522195 - RNA, 64 nt, hsa; identical to SEQ ID NO: 144227

SEQ ID NO: 522196 - RNA, 64 nt, hsa; identical to SEQ ID NO: 144228

SEQ ID NO: 522197 - RNA, 64 nt, hsa; identical to SEQ ID NO: 144229

SEQ ID NO: 522198 - RNA, 64 nt, hsa; identical to SEQ ID NO: 144230

SEQ ID NO: 522199 - RNA, 64 nt, hsa; identical to SEQ ID NO: 144231

SEQ ID NO: 522200 - RNA, 64 nt, hsa; identical to SEQ ID NO: 144232

SEQ ID NO: 522201 - RNA, 64 nt, hsa; identical to SEQ ID NO: 144233

SEQ ID NO: 522202 - RNA, 64 nt, hsa; identical to SEQ ID NO: 144234

SEQ ID NO: 522203 - RNA, 64 nt, hsa; identical to SEQ ID NO: 144235

SEQ ID NO: 522204 - RNA, 64 nt, hsa; identical to SEQ ID NO: 144236

SEQ ID NO: 522205 - RNA, 64 nt, hsa; identical to SEQ ID NO: 144237

SEQ ID NO: 522206 - RNA, 64 nt, hsa; identical to SEQ ID NO: 144238

SEQ ID NO: 522207 - RNA, 64 nt, hsa; identical to SEQ ID NO: 144239

SEQ ID NO: 522208 - RNA, 64 nt, hsa; identical to SEQ ID NO: 144240

SEQ ID NO: 522209 - RNA, 64 nt, hsa; identical to SEQ ID NO: 144241

SEQ ID NO: 522210 - RNA, 64 nt, hsa; identical to SEQ ID NO: 144242

SEQ ID NO: 522211 - RNA, 64 nt, hsa; identical to SEQ ID NO: 144243

SEQ ID NO: 522212 - RNA, 64 nt, hsa; identical to SEQ ID NO: 144244

SEQ ID NO: 522213 - RNA, 64 nt, hsa; identical to SEQ ID NO: 144245

SEQ ID NO: 522214 - RNA, 64 nt, hsa; identical to SEQ ID NO: 144246

SEQ ID NO: 522215 - RNA, 64 nt, hsa; identical to SEQ ID NO: 144247

SEQ ID NO: 522216 - RNA, 64 nt, hsa; identical to SEQ ID NO: 144248

SEQ ID NO: 522217 - RNA, 64 nt, hsa; identical to SEQ ID NO: 144249

SEQ ID NO: 522218 - RNA, 64 nt, hsa; identical to SEQ ID NO: 144250

SEQ ID NO: 522219 - RNA, 64 nt, hsa; identical to SEQ ID NO: 144251

SEQ ID NO: 522220 - RNA, 64 nt, hsa; identical to SEQ ID NO: 144252

SEQ ID NO: 522221 - RNA, 64 nt, hsa; identical to SEQ ID NO: 144253

SEQ ID NO: 522222 - RNA, 64 nt, hsa; identical to SEQ ID NO: 144254

SEQ ID NO: 522223 - RNA, 64 nt, hsa; identical to SEQ ID NO: 144255

SEQ ID NO: 522224 - RNA, 64 nt, hsa
gauuaugucucauggagaccaguaagaaaaucauuuaucugaaggugaaaugcagaguuggaua

SEQ ID NO: 522225 - RNA, 64 nt, hsa
ggaauggaguguucuaaccaauugccuuuucuuguuaucugagcucuccuauauuaucauacuc

SEQ ID NO: 522226 - RNA, 64 nt, hsa
acauugaaugaaacuauuuuaccugaacuagauuuuaucugaaaguagguagaauuuuugcuau

SEQ ID NO: 522227 - RNA, 64 nt, hsa
uugaaaugauugaccuuuaaauuuuugccaaauguuaucugaaauugucuaugaauaccaucua

SEQ ID NO: 522228 - RNA, 52 nt, hsa
aggcuauuucuggauguugagauuaucugauuucaagguacugaaggacaaa

SEQ ID NO: 522229 - RNA, 64 nt, hsa
uuuuggggaggaacuacacagucgugauuagaauuuaucugaugguuuuguauuauaacuugua

SEQ ID NO: 522230 - RNA, 57 nt, hsa
ggaagcuggaauucguaugacggagucuuaucugaacuacacuuacugaacagcuug

SEQ ID NO: 522231 - RNA, 64 nt, hsa
gaaggccuuuugaguucugcuggacaggagcacuuuaucugaagacaaacucauuuaaucaucu

SEQ ID NO: 522232 - RNA, 64 nt, hsa
ggcaccuuguuuaugaagaauaaaaaaugauuuguuaucugaagagaauaaauuuuaaauucuc

SEQ ID NO: 522233 - RNA, 64 nt, hsa
cagucuuccuguauuuuaugugcaucauagugauuuaucugagcuuagugacccccaucuugua

SEQ ID NO: 522234 - RNA, 64 nt, hsa
cucuuuauauauauuauuucugcaguuaccauccuuaucugaguuaucacaguucaugaaucua

SEQ ID NO: 522235 - RNA, 64 nt, hsa
auagauucugguguuaaaauagacuggaucuguauuaucugaggguuaguaacuaaugcuuagc

SEQ ID NO: 522236 - RNA, 64 nt, hsa
ccuucauuuggcaagggaagucuuuuuaacuaguuuaucugaugauuuucuuacaugagcuuuu

SEQ ID NO: 522237 - RNA, 64 nt, hsa
aacaagcaaucuuauuuuggaaggcguuaaaaaauuaucugacaguuacaugguaacagugaau

SEQ ID NO: 522238 - RNA, 64 nt, hsa
uuuuaaauggacaagcaauaggggguugaaguguuuaucugauuuguuuaaaauuuuguauauc

SEQ ID NO: 522239 - RNA, 64 nt, hsa
cagcuuuuucauaaggaaaauacuuuauuugcuuuuaucugagaauuucucaguaugaaaauga

SEQ ID NO: 522240 - RNA, 64 nt, hsa
ugcuggaguauuuucuaauaauccugcuugacccuuaucugaccucuuuggaaacuauaacaua

SEQ ID NO: 522241 - RNA, 64 nt, hsa
aauauuucuguggaaauaugaggaaaauccaugguuaucugagauaggagauacaaacuuugua

SEQ ID NO: 522242 - RNA, 64 nt, hsa; identical to SEQ ID NO: 264456

SEQ ID NO: 522243 - RNA, 64 nt, hsa; identical to SEQ ID NO: 264457

SEQ ID NO: 522244 - RNA, 64 nt, hsa; identical to SEQ ID NO: 264458

SEQ ID NO: 522245 - RNA, 64 nt, hsa; identical to SEQ ID NO: 264459

SEQ ID NO: 522246 - RNA, 64 nt, hsa; identical to SEQ ID NO: 264460

SEQ ID NO: 522247 - RNA, 64 nt, hsa; identical to SEQ ID NO: 264461

SEQ ID NO: 522248 - RNA, 64 nt, hsa; identical to SEQ ID NO: 264460

SEQ ID NO: 522249 - RNA, 64 nt, hsa
aaaauagaaucauuaggccaggcgugguggcucaugcuuguaaucccagcacuuugguaggcug

SEQ ID NO: 522250 - RNA, 64 nt, hsa
aaaauuacaaaaauuagccggccaugguggcaggugcuuguaaucccagcuacuugggaggcug

SEQ ID NO: 522251 - RNA, 64 nt, hsa
cuuugcuuuuggggucuaugucauugguuucugaugcuuguacaaacacgcacacacaaaugga

SEQ ID NO: 522252 - RNA, 64 nt, hsa
gcgccugcaccgccucugcguccuggguagucugugcuuguaauccagcauguuucacagagua

SEQ ID NO: 522253 - RNA, 64 nt, hsa
uuuuaucaguaauaggugucaguuuuuaaaaaauugcuuguaggcugagcgcgguggcucacgc

SEQ ID NO: 522254 - RNA, 64 nt, hsa
gacagagugagacucugucuccaaaaaaaaacuuugcuuguauauuauuuuugccuuacagugg

SEQ ID NO: 522255 - RNA, 64 nt, hsa
ucuuuugcuuaaaucaguuggaguuugugucuguugcuuguaaucaagccuuuauggcugcugg

SEQ ID NO: 522256 - RNA, 64 nt, hsa
accaagaaagcuucuucagagugaagaaucuuaaugcuuguaauuuaaacauuuguuccuggag

SEQ ID NO: 522257 - RNA, 64 nt, hsa
cccagccuaaacagggagaguccuaacaguguugugcuuguaugauucugagacuuuauuugcg

SEQ ID NO: 522258 - RNA, 64 nt, hsa
uuaauaagguagucauuccuguagagggauaagaugcuuguagaguuguggguaucauuccaaa

SEQ ID NO: 522259 - RNA, 64 nt, hsa
aguuucuuaucuuuuuugguuuauucucaggaguugcuuguacauucuugggcaauugcagaua

SEQ ID NO: 522260 - RNA, 64 nt, hsa
aaaaauacaaaaauuagcugggugcaguggcgcaugcuuguaaucccagcuacucaggaggcag

SEQ ID NO: 522261 - RNA, 64 nt, hsa
auccacuuuuuagugcaacaagagcuccauguuaugcuuguaauaaauuauuuacacgggagcu

SEQ ID NO: 522262 - RNA, 64 nt, hsa
agcuccaggcuccugccagcuggaggugaaacugugcuuguauccccagccacgaagagcugga

SEQ ID NO: 522263 - RNA, 64 nt, hsa
auugauuaaaauuuaucuuuuuuauuaucuuacaugcuuguaucuucaguuggagguguaguau

SEQ ID NO: 522264 - RNA, 64 nt, hsa
acauuuuguugugcuaugagccucuguaaucaaaugcuuguacucagaagagaguguaaaauca

SEQ ID NO: 522265 - RNA, 64 nt, hsa
aacuaccgucauucugcucauguuucuucuugaccucuugcauaaucuuuuuguuuucuagaca

SEQ ID NO: 522266 - RNA, 64 nt, hsa
aguuauaguuguggauaaaggggagaauuuauugcucuugcaaaccaauuauggaaagcaacuu

SEQ ID NO: 522267 - RNA, 64 nt, hsa
cucuggccuggcugggccacugcccucuguccaucucuugcagugguggggucggacgccgugg

SEQ ID NO: 522268 - RNA, 64 nt, hsa
guggacucugcacaguccucugcccucuguccgucucuugcagugguggggucagaugcugugg

SEQ ID NO: 522269 - RNA, 64 nt, hsa
uacuuauuaucagaauuucugaaaccuuuacaaaaauucugauuuauuccauuaauggccgguu

SEQ ID NO: 522270 - RNA, 64 nt, hsa
aaaacuuauuaaaaaauaggauuuacuuuuuucuaauucugaccuaagaaaaauaaugagaaca

SEQ ID NO: 522271 - RNA, 64 nt, hsa
caucuugcuuagucauguuguuauaaaacauucaaauucugauauacauugcuugaaaaugagu

SEQ ID NO: 522272 - RNA, 64 nt, hsa
auauaggaaauauuucugcacuugacccuauuugaauucugagcauuauuuauaaguauaaaau

SEQ ID NO: 522273 - RNA, 64 nt, hsa
augacaucauaauacuggaugaaaacuugcauagaauucugauuaaauagugggucuguuucac

SEQ ID NO: 522274 - RNA, 64 nt, hsa
uugugguaaagacuguuuguacccuucaugaaauaauucugaaguugccaucaguuuuacuaau

SEQ ID NO: 522275 - RNA, 64 nt, hsa
guagcuugagccugaaaugcaaaacccauggaggaauucugaagccauugucuccuugaguacc

SEQ ID NO: 522276 - RNA, 64 nt, hsa
aauuuaaaaaacuaucuuuuugcuuacaguuuuaaauucugaacaauucucucuuauaugugua

SEQ ID NO: 522277 - RNA, 64 nt, hsa
ggcuaccucuuaccuaacaucugaccuggcaucuaauucugauucuggcuuuaagccuucaaaa

SEQ ID NO: 522278 - RNA, 64 nt, hsa
acuaacucaaauacacauuugcuacuguuguaagaauucugauugauuugauugggaugaaugc

SEQ ID NO: 522279 - RNA, 64 nt, hsa
aaaaauuucagcucuuauuuuaauggaguguuaaaauucugauucauauagucuuaaauuauca

SEQ ID NO: 522280 - RNA, 64 nt, hsa
ccaaguaccagccguccaaacugaucacaauuaaaauucugacaguugccuuuuuuuucaucuc

SEQ ID NO: 522281 - RNA, 64 nt, hsa
ucuucaguuaguguaaacugcaaauacuacagauaauucugauaauaaaaugauaugcacgcug

SEQ ID NO: 522282 - RNA, 64 nt, hsa
aaagggaaaccuauauuuauguaacuguauacugaauucugacaaaauaaaaaaagauaccuua

SEQ ID NO: 522283 - RNA, 64 nt, hsa
cauaucuguaaucauaucuacaugcaauguuaguaauucugaaguuuuuuaaauuuauggcuau

SEQ ID NO: 522284 - RNA, 64 nt, hsa
cacuauagaugucuauacugugaaaaguguuuucaauucugaaaaaaagcauacaucaugauua

SEQ ID NO: 522285 - RNA, 64 nt, hsa
auauaguaugaaagccaggugcuagcaacagacaaauucugagcccaauaugcuuuauacugcu

SEQ ID NO: 522286 - RNA, 64 nt, hsa
aaaauaaauguugaucagcagaccacguauuuaaaauucugaaucuucugggacaggguuguaa

SEQ ID NO: 522287 - RNA, 64 nt, hsa
guguacauucugaacauuuucugaaguuucucuuaauucugauuuguguuucuguuuugacuuu

SEQ ID NO: 522288 - RNA, 64 nt, hsa
uugauaaguuaugauuuauauuucucaagguuaaaauucugaguaaaauggucuuugauuaaua

SEQ ID NO: 522289 - RNA, 64 nt, hsa
uacaggcuaaaauuaguuuuaaaauacuauauuaaauucugaaugcaauuuuuuuuuguucccu

SEQ ID NO: 522290 - RNA, 64 nt, hsa
augguucuacuuccuguaauguacaauuuuauauaauucugaaauguuuuuaauguauuugugc

SEQ ID NO: 522291 - RNA, 64 nt, hsa
guagaugaaauagugauguagcaaaaaccuaguaaauucugaaugcuuuuccacguagacuuau

SEQ ID NO: 522292 - RNA, 64 nt, hsa
guaccaugguguuccuuaaaagaagaaaauuucuaauucugaacucaauguuuugcuuuuacuc

SEQ ID NO: 522293 - RNA, 64 nt, hsa
ugagauuuuuccaacaagcaugugauuuacguggaauucugacagugcagggagccccaacccu

SEQ ID NO: 522294 - RNA, 64 nt, hsa
gcccagggggaagggagggggcaggggaggaggcaauucugaaugaaugaauggauuuuuuguu

SEQ ID NO: 522295 - RNA, 64 nt, hsa
uagcauucuccuuuugaccguccaagucauuaugaauucugacuuguuguauuaggaacauguu

SEQ ID NO: 522296 - RNA, 64 nt, hsa
augcaaaaaguaucuguuuaugguuggacuuugaaauucugaccuuugaaauaaugucaacagu

SEQ ID NO: 522297 - RNA, 64 nt, hsa
ugccuuuggaaggggcaauuagauggccagaaagaauucugacucccaugcacccuuggagacu

SEQ ID NO: 522298 - RNA, 64 nt, hsa
uaaaauacaaaauuggaucaagacauucacccuaaauucugaauuuuugucagaaaagagauuu

SEQ ID NO: 522299 - RNA, 64 nt, hsa
guaacaagauagccaaaagcauaggauuucuuaaaauucugaauucgucuuuucugagaaacau

SEQ ID NO: 522300 - RNA, 64 nt, hsa
acuucuccccacccuccagaagggguccacguugaauucugaaucaucuugaaaauaagauucc

SEQ ID NO: 522301 - RNA, 64 nt, hsa
cucuggcuaauauuuuaauaagcucacagcagauaauucugagaucaugggugagggguggugc

SEQ ID NO: 522302 - RNA, 64 nt, hsa
ucucuggcagcauaauuuugugguuaagagaaugaauucugaauguacacuuucugucucaaac

SEQ ID NO: 522303 - RNA, 64 nt, hsa
caaaugaauucaaccucagcccugaaaauaacagaauucugaaguuuccuaugacuaauucaca

SEQ ID NO: 522304 - RNA, 64 nt, hsa
gaaauuuuauaacaguuucagugaauagagaaaaaauucugaacugaucauaaugaguuaaaag

SEQ ID NO: 522305 - RNA, 64 nt, hsa
agcugauuugcuuuuuauuaaacugcaggaaauuaauucugaagaaggaaaagaaacugacaug

SEQ ID NO: 522306 - RNA, 64 nt, hsa
gcaguggaauaguaccagccuuccgcaggaaggaaauucugacauaugcggugacauggaugaa

SEQ ID NO: 522307 - RNA, 64 nt, hsa
auggucauaugauauuccuucauuuucagagaguaauucugaaauucuguuuugaacuaauucu

SEQ ID NO: 522308 - RNA, 64 nt, hsa
gaacuuacuccuucguugacugaaaggaguuuuaaauucugagcuccugagauacugacuagca

SEQ ID NO: 522309 - RNA, 64 nt, hsa
ucacucacccuccugguacauugccauuccaaggaauucugagaguaggcaaacaaauuuugcc

SEQ ID NO: 522310 - RNA, 64 nt, hsa
ccucccaauucuguguaaucaagaauaccuccuuaauucugagagcaugaauauuugaccuuaa

SEQ ID NO: 522311 - RNA, 64 nt, hsa
auaaggccuuuagaaucugacacaucuggguucaaauucugaaacugucacuuauuaccuguau

SEQ ID NO: 522312 - RNA, 64 nt, hsa
uucugcuugucuuucuugagcuuuuuggaaggauaauucugauaaggcacucaagaaacguaca

SEQ ID NO: 522313 - RNA, 64 nt, hsa
uaugcauagcaaggagaugcagagccgccaggaaaauucugaguuccagcacaauuuucuuugg

SEQ ID NO: 522314 - RNA, 64 nt, hsa
uacuguguaugcuuuugaauuuuauuuuuaggaaaauucugaagccagcuaucacagguuuguu

SEQ ID NO: 522315 - RNA, 64 nt, hsa
uaaaauuuguggugcuccuguaacaguaagaacuaauucugaaauaaaagacaucuccuaaugc

SEQ ID NO: 522316 - RNA, 64 nt, hsa
aagguuguaggaugugucacaagagacuuuugacaauucugaggaaccuuguguccaguuguua

SEQ ID NO: 522317 - RNA, 64 nt, hsa
ugaauuccuucuucacuguuguuuguauuuaugaaauucugaaauuauggggaaucagcguaau

SEQ ID NO: 522318 - RNA, 64 nt, hsa
guugaaaaucaacccaauaauucuguauuaacugaauucugaacuuuucaggagguacugugag

SEQ ID NO: 522319 - RNA, 64 nt, hsa
uaucauguugaagucaaauuuggauuuuccaccaaauucugaauuuguagacauacuuguacgc

SEQ ID NO: 522320 - RNA, 64 nt, hsa
acccaguaacucuugggauuaauuuuaugaaauaaauucugagcugcugcuuuugauauaguca

SEQ ID NO: 522321 - RNA, 64 nt, hsa
gauucuuugagcccaggaguucaaggcugcagugaauucugaucgcaccacugaacuccagccc

SEQ ID NO: 522322 - RNA, 64 nt, hsa
auacagauugcccuccccggcaugaagaagucacaauucugacccgccaccucuccaggggcgg

SEQ ID NO: 522323 - RNA, 64 nt, hsa
gggucugagugggaccucaaagcauggccagugcaauucugaggcuaggggaauaggagaagcc

SEQ ID NO: 522324 - RNA, 64 nt, hsa
guagguggaguuugugauugcagugaauagaacaaauucugacuugcagaaaugcagacauaca

SEQ ID NO: 522325 - RNA, 64 nt, hsa
agauauauauaguguauuugugaaaguuugcuuaaauucugauacaugccuucuuuguaggugg

SEQ ID NO: 522326 - RNA, 64 nt, hsa
uuuuuuuuucuacugggauuguuuuaagauugucaauucugacuuuuuuauagugguuuuuaag

SEQ ID NO: 522327 - RNA, 64 nt, hsa; identical to SEQ ID NO: 38562

SEQ ID NO: 522328 - RNA, 64 nt, hsa; identical to SEQ ID NO: 38563

SEQ ID NO: 522329 - RNA, 64 nt, hsa; identical to SEQ ID NO: 38564

SEQ ID NO: 522330 - RNA, 64 nt, hsa; identical to SEQ ID NO: 38565

SEQ ID NO: 522331 - RNA, 64 nt, hsa; identical to SEQ ID NO: 38566

SEQ ID NO: 522332 - RNA, 64 nt, hsa; identical to SEQ ID NO: 38567

SEQ ID NO: 522333 - RNA, 64 nt, hsa; identical to SEQ ID NO: 38568

SEQ ID NO: 522334 - RNA, 64 nt, hsa; identical to SEQ ID NO: 38569

SEQ ID NO: 522335 - RNA, 64 nt, hsa; identical to SEQ ID NO: 38570

SEQ ID NO: 522336 - RNA, 64 nt, hsa; identical to SEQ ID NO: 38571

SEQ ID NO: 522337 - RNA, 64 nt, hsa; identical to SEQ ID NO: 38572

SEQ ID NO: 522338 - RNA, 64 nt, hsa; identical to SEQ ID NO: 38573

SEQ ID NO: 522339 - RNA, 64 nt, hsa; identical to SEQ ID NO: 38574

SEQ ID NO: 522340 - RNA, 64 nt, hsa; identical to SEQ ID NO: 38575

SEQ ID NO: 522341 - RNA, 64 nt, hsa; identical to SEQ ID NO: 38576

SEQ ID NO: 522342 - RNA, 64 nt, hsa; identical to SEQ ID NO: 38577

SEQ ID NO: 522343 - RNA, 64 nt, hsa; identical to SEQ ID NO: 38578

SEQ ID NO: 522344 - RNA, 64 nt, hsa; identical to SEQ ID NO: 38579

SEQ ID NO: 522345 - RNA, 64 nt, hsa; identical to SEQ ID NO: 38580

SEQ ID NO: 522346 - RNA, 64 nt, hsa; identical to SEQ ID NO: 38581

SEQ ID NO: 522347 - RNA, 64 nt, hsa; identical to SEQ ID NO: 38582

SEQ ID NO: 522348 - RNA, 64 nt, hsa; identical to SEQ ID NO: 38583

SEQ ID NO: 522349 - RNA, 64 nt, hsa; identical to SEQ ID NO: 38584

SEQ ID NO: 522350 - RNA, 64 nt, hsa; identical to SEQ ID NO: 38585

SEQ ID NO: 522351 - RNA, 64 nt, hsa; identical to SEQ ID NO: 38586

SEQ ID NO: 522352 - RNA, 64 nt, hsa; identical to SEQ ID NO: 38587

SEQ ID NO: 522353 - RNA, 64 nt, hsa; identical to SEQ ID NO: 38588

SEQ ID NO: 522354 - RNA, 64 nt, hsa; identical to SEQ ID NO: 38589

SEQ ID NO: 522355 - RNA, 64 nt, hsa; identical to SEQ ID NO: 38590

SEQ ID NO: 522356 - RNA, 64 nt, hsa; identical to SEQ ID NO: 38591

SEQ ID NO: 522357 - RNA, 64 nt, hsa; identical to SEQ ID NO: 38592

SEQ ID NO: 522358 - RNA, 64 nt, hsa; identical to SEQ ID NO: 38593

SEQ ID NO: 522359 - RNA, 64 nt, hsa; identical to SEQ ID NO: 154522

SEQ ID NO: 522360 - RNA, 64 nt, hsa; identical to SEQ ID NO: 154523

SEQ ID NO: 522361 - RNA, 64 nt, hsa; identical to SEQ ID NO: 154524

SEQ ID NO: 522362 - RNA, 64 nt, hsa; identical to SEQ ID NO: 154525

SEQ ID NO: 522363 - RNA, 64 nt, hsa; identical to SEQ ID NO: 154526

SEQ ID NO: 522364 - RNA, 64 nt, hsa; identical to SEQ ID NO: 154527

SEQ ID NO: 522365 - RNA, 64 nt, hsa; identical to SEQ ID NO: 154528

SEQ ID NO: 522366 - RNA, 64 nt, hsa; identical to SEQ ID NO: 154529

SEQ ID NO: 522367 - RNA, 64 nt, hsa; identical to SEQ ID NO: 154530

SEQ ID NO: 522368 - RNA, 64 nt, hsa; identical to SEQ ID NO: 154531

SEQ ID NO: 522369 - RNA, 64 nt, hsa; identical to SEQ ID NO: 154532

SEQ ID NO: 522370 - RNA, 64 nt, hsa; identical to SEQ ID NO: 154533

SEQ ID NO: 522371 - RNA, 64 nt, hsa; identical to SEQ ID NO: 154534

SEQ ID NO: 522372 - RNA, 64 nt, hsa; identical to SEQ ID NO: 154535

SEQ ID NO: 522373 - RNA, 64 nt, hsa; identical to SEQ ID NO: 154536

SEQ ID NO: 522374 - RNA, 64 nt, hsa; identical to SEQ ID NO: 154537

SEQ ID NO: 522375 - RNA, 64 nt, hsa; identical to SEQ ID NO: 154538

SEQ ID NO: 522376 - RNA, 64 nt, hsa; identical to SEQ ID NO: 154539

SEQ ID NO: 522377 - RNA, 64 nt, hsa; identical to SEQ ID NO: 154540

SEQ ID NO: 522378 - RNA, 64 nt, hsa; identical to SEQ ID NO: 154541

SEQ ID NO: 522379 - RNA, 64 nt, hsa; identical to SEQ ID NO: 154542

SEQ ID NO: 522380 - RNA, 64 nt, hsa; identical to SEQ ID NO: 154543

SEQ ID NO: 522381 - RNA, 64 nt, hsa; identical to SEQ ID NO: 154544

SEQ ID NO: 522382 - RNA, 64 nt, hsa; identical to SEQ ID NO: 154545

SEQ ID NO: 522383 - RNA, 64 nt, hsa; identical to SEQ ID NO: 154546

SEQ ID NO: 522384 - RNA, 64 nt, hsa; identical to SEQ ID NO: 154547

SEQ ID NO: 522385 - RNA, 64 nt, hsa; identical to SEQ ID NO: 154548

SEQ ID NO: 522386 - RNA, 64 nt, hsa; identical to SEQ ID NO: 154549

SEQ ID NO: 522387 - RNA, 64 nt, hsa; identical to SEQ ID NO: 154550

SEQ ID NO: 522388 - RNA, 64 nt, hsa; identical to SEQ ID NO: 154551

SEQ ID NO: 522389 - RNA, 64 nt, hsa
gcacuuaaaaucuaugaguuuuuacuuuuuacugggaauggaaaguguggugaagaucauucaa

SEQ ID NO: 522390 - RNA, 64 nt, hsa
ugaagcugggcagcgucugcucuguguucuguguggaauggagaaaaaaacgccugcccugcug

SEQ ID NO: 522391 - RNA, 64 nt, hsa
cccuggaaccugagucccaagaaaugguagacugggaauggaaagaaugggguaaaccacaguc

SEQ ID NO: 522392 - RNA, 63 nt, hsa
aucccuguguccugcagugaccugccugccuauggaauggagcuggguucaucucaucacauu

SEQ ID NO: 522393 - RNA, 64 nt, hsa
gagcuccgucauguagccugcugaggaauggaauggaauggagaugcccacaggagguccugau

SEQ ID NO: 522394 - RNA, 64 nt, hsa
gaacagagcuccgucauguagccugcugaggaauggaauggaauggagaugcccacaggagguc

SEQ ID NO: 522395 - RNA, 64 nt, hsa
uuacugaacagagcuccgucauguagccugcugaggaauggaauggaauggagaugcccacagg

SEQ ID NO: 522396 - RNA, 64 nt, hsa
gcacaaggguugugaaugugaaagggggaauggaggaauggaaauaaaauugggaugagcccua

SEQ ID NO: 522397 - RNA, 64 nt, hsa
ggaauguugcacaaggguugugaaugugaaagggggaauggaggaauggaaauaaaauugggau

SEQ ID NO: 522398 - RNA, 64 nt, hsa
cucagguucccaggggcccgggaguccaaauacuggaauggaggguuggaggcagccuuccuug

SEQ ID NO: 522399 - RNA, 64 nt, hsa
cuuggcagugcucucguagaccccucggugauguggaauggacaggugccucgcaagagagcaa

SEQ ID NO: 522400 - RNA, 64 nt, hsa
uuauuugauuuuauucuugcagagggaauggaaaggaauggaaagauuuguuggcguaauuuuu

SEQ ID NO: 522401 - RNA, 64 nt, hsa
agccuaacaguuauuugauuuuauucuugcagagggaauggaaaggaauggaaagauuuguugg

SEQ ID NO: 522402 - RNA, 64 nt, hsa
uuguuuuggaaugucccccacuuggagaguuugaggaauggaaaugagaaucggaggagaaaua

SEQ ID NO: 522403 - RNA, 64 nt, hsa
ggaacguaaaauccauuucagccugccgccccuuggaauggagggucuucuagggaccagaaac

SEQ ID NO: 522404 - RNA, 64 nt, hsa
gaggcugaccccucacuugacaacacacaggaauggaauggacaggcucaccuggggauuuggg

SEQ ID NO: 522405 - RNA, 64 nt, hsa
acucugaggcugaccccucacuugacaacacacaggaauggaauggacaggcucaccuggggau

SEQ ID NO: 522406 - RNA, 64 nt, hsa
uggaagagaauauuccuacuugcaguacaucaaaggaauggaugguggacccuacuauucaugu

SEQ ID NO: 522407 - RNA, 64 nt, hsa
aucaugcuugguuuucuuuuuucuuuugguccagggaauggagaaugguguuccauugccucuu

SEQ ID NO: 522408 - RNA, 64 nt, hsa
gcucaguuaguucuggaauggauucgcucuugcaggaauggaugaauucucacaagaguggguu

SEQ ID NO: 522409 - RNA, 64 nt, hsa
auuaaaggcuuucucaugaggcucaguuaguucuggaauggauucgcucuugcaggaauggaug

SEQ ID NO: 522410 - RNA, 64 nt, hsa
accuguacuuauuuuucucuucccgccucccucuggaauggauauauugguugguucauaugau

SEQ ID NO: 522411 - RNA, 64 nt, hsa
aaucuuucaagucguagcacuuuguuucagaacuggaauggagauguagcacucaugucguccc

SEQ ID NO: 522412 - RNA, 64 nt, hsa
agcuuucauuuucuguuuauucaguuuuuuauuuggaauggaugcuacucuaggccuuaaacug

SEQ ID NO: 522413 - RNA, 64 nt, hsa
ugaaauguacugaguggauuccgucuucuacucaggaauggaaugugugacacaggccugacuc

SEQ ID NO: 522414 - RNA, 64 nt, hsa
cugaagccaaagcugggcucaguggggaaggucaggaauggagaaauugccuuuucucguuagc

SEQ ID NO: 522415 - RNA, 64 nt, hsa
aguuggagaucauuauucuaagugaaauaacucaggaauggagaaccaaauauuguacauccuc

SEQ ID NO: 522416 - RNA, 64 nt, hsa
cuguggagaugagaaggugguggacacucgugauggaauggaaaucguccuaccgugcagccac

SEQ ID NO: 522417 - RNA, 64 nt, hsa
ucggagcgggggugaggggggcagugugcucgugggaauggaaaggacagcaagcacaggugag

SEQ ID NO: 522418 - RNA, 64 nt, hsa
ugaguugggggaccuggcaauagagcugcuugguuggaggaagugaagcuggcuuaguaccagc

SEQ ID NO: 522419 - RNA, 64 nt, hsa
acuguuuggacccaggccucaucaucagggguccuggaggaagccuccaaguagaggggagacc

SEQ ID NO: 522420 - RNA, 64 nt, hsa
gauuucugcaagucgacuaucaugaugacuucgcuggaggaaaggugauacguacauacgcauu

SEQ ID NO: 522421 - RNA, 64 nt, hsa
uccugccagcccuacggaaguuccuuuuaugcauuggaggaaaaacauguuggcuuuucucuug

SEQ ID NO: 522422 - RNA, 64 nt, hsa
uuaggccagcccuacagaagugcuguuuacucauuggaggaacaguaccuuggcuuggcucuug

SEQ ID NO: 522423 - RNA, 64 nt, hsa
ugaggagagguagccaugcugacucaugaacagguggaggaaagggguugcaggugaccagcau

SEQ ID NO: 522424 - RNA, 64 nt, hsa
cuggaggaacagguucuuagaagaugauucaccuuggaggaagcuggggaaagugguuagggag

SEQ ID NO: 522425 - RNA, 64 nt, hsa
agcuagccccuggggcugaguacuccugcagggcuggaggaacagguucuuagaagaugauuca

SEQ ID NO: 522426 - RNA, 64 nt, hsa
uccuaauuuuuaacacuaaaauucaaggaagcaguggaggaaagaaugcauuacuaccacagau

SEQ ID NO: 522427 - RNA, 64 nt, hsa
uauguguucccaaguggugaggugagauuguggcuggaggaagaaaaaggauggcaugaaagaa

SEQ ID NO: 522428 - RNA, 64 nt, hsa
cuguccuuuguuauuauccugcauuuuacgucuuuggaggaacagcucccuaguggcuuccucc

SEQ ID NO: 522429 - RNA, 64 nt, hsa
uaaggagggacaagaaucaauggauaagcguggguggaggaagauccaaacagaaaagugcaaa

SEQ ID NO: 522430 - RNA, 64 nt, hsa
caaaguuauuccccaucuuccaaggguugaauucuggaggaagaagacacauuccuaguucccc

SEQ ID NO: 522431 - RNA, 64 nt, hsa
gguccuuguugauguuucuucuccuagccacacuuggaggaaaguugcagguggguugggcagg

SEQ ID NO: 522432 - RNA, 64 nt, hsa
cugcugccaggauggagcagaggagcgccacacauggaggaaagccccuguaacguuaccuacc

SEQ ID NO: 522433 - RNA, 64 nt, hsa
ggaggaauggaaauaaaauugggaugagcccuaauggaggaagucgggcaaauugaaaguauaa

SEQ ID NO: 522434 - RNA, 64 nt, hsa
uguugcacaaggguugugaaugugaaagggggaauggaggaauggaaauaaaauugggaugagc

SEQ ID NO: 522435 - RNA, 64 nt, hsa
uccaguucacauuuauuugguagcccaccuggguuggaggaagggcacgguggagagaaaguga

SEQ ID NO: 522436 - RNA, 64 nt, hsa
caacuuuaaaacugcucauuucaugaagcaagaauggaggaauccuugacucuuacacacugga

SEQ ID NO: 522437 - RNA, 64 nt, hsa
cucaguaugaagagcggaugaggauacagaaggcuggaggaaacgucagguaaccaagggacug

SEQ ID NO: 522438 - RNA, 64 nt, hsa
cucggguuucauauuuugcuguuuuugauggacauggaggaauucgagccucaaaauuugcugc

SEQ ID NO: 522439 - RNA, 64 nt, hsa
aacacucagacaucuaguaccagggauuauuaauuggaggaagauuuaugguuaugggucuggc

SEQ ID NO: 522440 - RNA, 64 nt, hsa
cauuaagacgcaacucauuuuauaucaacacgcuuggaggaaagggacucagggaagggagcag

SEQ ID NO: 522441 - RNA, 64 nt, hsa
gggggcaguggcagcccuggggcccuuucccuucuggaggaagcacaagccucagggaagggga

SEQ ID NO: 522442 - RNA, 64 nt, hsa
cugacgcucuguguauugcucuuugaaucgaguuuggaggaagaguugaguuguaugaguggcg

SEQ ID NO: 522443 - RNA, 64 nt, hsa
uggaggaaugucaucuuccuaaaugaaguuuauuuggaggaacacagucaucuccuuggugaaa

SEQ ID NO: 522444 - RNA, 64 nt, hsa
gagaagaaagugcauuuauugucuuuccaccuauuggaggaaugucaucuuccuaaaugaaguu

SEQ ID NO: 522445 - RNA, 64 nt, hsa
cacugucauuccaaagguacaguguaacucuggauggaggaauaacuuaccuaucacuacaaca

SEQ ID NO: 522446 - RNA, 63 nt, hsa
ugucacaaagugucagaugagaauuuuaggggcuggaggaagauguaaaagaugaaaauguuu

SEQ ID NO: 522447 - RNA, 64 nt, hsa
aaaagaaauuccuauuugaaaugaauuccucauuuggaggaaaaaaagcaugcauucuagcaca

SEQ ID NO: 522448 - RNA, 64 nt, hsa
ugcugcaaguuagugaaacagcugucuccguaaauggaggaaauguggggaagccuuggaaugc

SEQ ID NO: 522449 - RNA, 64 nt, hsa
caaccuauuuaacuuuuuguggaggaauuuuacauggaggaagugagcacaugucaugcuagcc

SEQ ID NO: 522450 - RNA, 64 nt, hsa
ucucucauuccagcccaaccuauuuaacuuuuuguggaggaauuuuacauggaggaagugagca

SEQ ID NO: 522451 - RNA, 64 nt, hsa
aagcugccuggaugagcgcccaugcagcaaggcuuggaggaagcgucagugcccuggagauccc

SEQ ID NO: 522452 - RNA, 64 nt, hsa
gcucuccccacugucagcaacagcacuuccuucguggaggaaguggacucgaauccuggaggag

SEQ ID NO: 522453 - RNA, 64 nt, hsa
gcuggcugcugcugccucgcgcgcugggguuccauggaggaacugggccugccgccccggccuc

SEQ ID NO: 522454 - RNA, 64 nt, hsa
cggccucaccugcugcccgcaugcuggggucccauggaggaaccaggccuggcgccccggccuc

SEQ ID NO: 522455 - RNA, 64 nt, hsa
uggggaggaagccccaucucugcuguucccugcguggaggaagcccacccagcaagcucucucc

SEQ ID NO: 522456 - RNA, 64 nt, hsa
ucagguacugagcaaggccccagauccuucucucuggaggaagagggaagcccagggguccugu

SEQ ID NO: 522457 - RNA, 64 nt, hsa
acagcggaacaaugacugccccgauaggugaggcuggaggaagaaucaguccuguccuuggcaa

SEQ ID NO: 522458 - RNA, 64 nt, hsa
gcuguauuuaauggcauaggcugacuuuugcagauggaggaauuucuugauuaauguugaaaaa

SEQ ID NO: 522459 - RNA, 64 nt, hsa
ggagagcugagauuggagggaauuguguuguuccuggaggaagcccaggcaucauuaaacaagc

SEQ ID NO: 522460 - RNA, 64 nt, hsa
ggagacugguugcaaggugugaccgcaggaauccuggaggaacagagaguaaagcuucuaggca

SEQ ID NO: 522461 - RNA, 64 nt, hsa
ugcaggucagcaguaagguuucaagguacaguuauggaggaaagaagaaaaugacacauugaua

SEQ ID NO: 522462 - RNA, 64 nt, hsa
cucaugagaccggcucacuaucacaggaacagcauggaggaaaccgcccccaugauccaguuac

SEQ ID NO: 522463 - RNA, 64 nt, hsa
accuccauacacugaggcagaaacuugugucaguuggaggaaaauagacuugaguagucuuugg

SEQ ID NO: 522464 - RNA, 64 nt, hsa
gggaggagaaaugagaacauagaggaaagccucuuggaggaaaggugcuuggaccaagucucag

SEQ ID NO: 522465 - RNA, 64 nt, hsa
uugaacuucuccaugaccugaagcguuccuucccuggaggaacucugguugcagggcuaaacuu

SEQ ID NO: 522466 - RNA, 64 nt, hsa
uggcagaaacgugaugugucccacaaacugcugguggaggaagaagauguucgucagccaauuc

SEQ ID NO: 522467 - RNA, 64 nt, hsa
cugcccucccucccacaaacaaaugaauccagcguggaggaaggcgcgccgccccgagcuggag

SEQ ID NO: 522468 - RNA, 64 nt, hsa
gaggccuaaaaaggaagugaguuuauacugcaguuggaggaacugccugcagccuugaggaaaa

SEQ ID NO: 522469 - RNA, 64 nt, hsa
gguaggaagaacaaacccuugucccuuugccauguggaggaaagugccugccucugguccgagc

SEQ ID NO: 522470 - RNA, 64 nt, hsa
ccuccuccagggcccucugcagaccaggcugagauggaggaaccugcuaaaaucgauggagaug

SEQ ID NO: 522471 - RNA, 64 nt, hsa
ccugcugcagcugcaggcauucugaggggcaacguggaggaagggccagggaugcaugggauuu

SEQ ID NO: 522472 - RNA, 64 nt, hsa
cccaaaggaguggacauuuccuaacaauucuguauggaggaaggugggguaauugcauucgucu

SEQ ID NO: 522473 - RNA, 64 nt, hsa
ggaaacuggauugccaaggcauggcagacugagcuggaggaagaugucagaaauguuugcccug

SEQ ID NO: 522474 - RNA, 64 nt, hsa
uggaaugaaauuccuccuuccccccaucucugaguggaggaagcccaccaaucugcccuuugca

SEQ ID NO: 522475 - RNA, 64 nt, hsa
gccauagggucugcagccugcuggggcuaagcgguggaggaaggcucugucacuccaggcauau

SEQ ID NO: 522476 - RNA, 64 nt, hsa
cuucacaaggcucagugacaaaccugaagaagauuggaggaaccuugaagagugagaaacaccu

SEQ ID NO: 522477 - RNA, 64 nt, hsa
cucuuguccaaauaguggauugggcagacuggccuggaggaaaugcuagaacagagggaaagga

SEQ ID NO: 522478 - RNA, 64 nt, hsa
auccugccccuuccuucuugccuguagcuccugcuggaggaagaggauuccagccuguuggccc

SEQ ID NO: 522479 - RNA, 64 nt, hsa
ggaugaucaugacaaacaaucacugcgcaaaauguggaggaaaauucauuaccauaaucacaac

SEQ ID NO: 522480 - RNA, 64 nt, hsa
uuauuccaagaaucuacaaugacauugaaguuguuggaggaauguacuguauuuaaaaaaaccu

SEQ ID NO: 522481 - RNA, 64 nt, hsa
uuguuacaugaaagguugaaauauugagugguugaaagugaacugcuguuugccugauugguaa

SEQ ID NO: 522482 - RNA, 64 nt, hsa
ccagacuuaauugguauuuguucuugcauuggccaaagugaaaauuuuuuuuuuucuuuugaaa

SEQ ID NO: 522483 - RNA, 64 nt, hsa
aacuguuggcaggcaguaucgauuuuaugaagagaaagugaaguuugaaaacuuuucaaacuuu

SEQ ID NO: 522484 - RNA, 64 nt, hsa
caauccaauuuuucagauuugauaaugcuuuuccaaagugaaaauaagauacacaauaaucauu

SEQ ID NO: 522485 - RNA, 64 nt, hsa
aaauacuucuaauuuuuuucccuaaacauuuuuaaaagugaaauaugggaagagcuuuacagac

SEQ ID NO: 522486 - RNA, 64 nt, hsa
ccuagaguuuuaauuaccuuuauaauguuucuuaaaagugaaacuuagauacaauugugauugg

SEQ ID NO: 522487 - RNA, 64 nt, hsa
gcuauuugccuaguaggauuuaaaaaauauuuucaaagugaagcugagagagaaucuuggaaac

SEQ ID NO: 522488 - RNA, 64 nt, hsa
gauguucugcaggcccagcaaacucaucauguccaaagugaaacuuuuucucuuuccugucucc

SEQ ID NO: 522489 - RNA, 64 nt, hsa
aauguagaagaaagcaaaaaauaaaauaaguccuaaagugaagaagccaucaauuuuaacauuu

SEQ ID NO: 522490 - RNA, 64 nt, hsa
uuauagaaauuacuggagccaugucuacaaaagcaaagugaagugaugagcugaaaagugauca

SEQ ID NO: 522491 - RNA, 64 nt, hsa
caauaccaagcuucugauuccuccucacauaugaaaagugaaaguugugaguuguuuuccucuu

SEQ ID NO: 522492 - RNA, 64 nt, hsa
uuuuucagaagcgacauuucauauauaggugccaaaagugaaucggggugcggagagugggaac

SEQ ID NO: 522493 - RNA, 64 nt, hsa
cucucguguucuuuuccagaagaaaauccucagcaaagugaagaauugcuugaaguaagcaacu

SEQ ID NO: 522494 - RNA, 64 nt, hsa
cugaguaaggacauuucugacugaagaagcucuaaaagugaagagaccucguuuugauguaucg

SEQ ID NO: 522495 - RNA, 64 nt, hsa
acuccuuaugugaggaaaugcuacuaauaucugaaaagugaaagauuucuauguauuaacucuu

SEQ ID NO: 522496 - RNA, 64 nt, hsa
guuauuguuuucugucauuugccuacuggggaagaaagugaaggaggggaaacuguuuaauauc

SEQ ID NO: 522497 - RNA, 64 nt, hsa
uccaauuccuccucuucuucagaaucaucuucagaaagugaacuugaacaugagagaagcagaa

SEQ ID NO: 522498 - RNA, 64 nt, hsa
gucaaaggaaaaucuuaaaagagaacacaccaaaaaagugaaagagaaauugaaagggaaaaaa

SEQ ID NO: 522499 - RNA, 64 nt, hsa
cugacugagagaaagauggucgucuccagcagagaaagugaacagcauuuguuggaaggugaug

SEQ ID NO: 522500 - RNA, 64 nt, hsa
cccuggggggaaauaucauucuuacuaugguuagaaagugaauuagaaauuucagcucaguuuc

SEQ ID NO: 522501 - RNA, 64 nt, hsa
uuaauuuuauguccuuuuuuuccuaaagugaauuaaagugaaucauggaagcagcauuacuuua

SEQ ID NO: 522502 - RNA, 64 nt, hsa
ggaauuuuuguuaauuuuauguccuuuuuuuccuaaagugaauuaaagugaaucauggaagcag

SEQ ID NO: 522503 - RNA, 64 nt, hsa
ccuggcaacuuggauacuuggaaccuuguauuuaaaagugaauuuaaccacaacugagaccuaa

SEQ ID NO: 522504 - RNA, 64 nt, hsa
agauaauuugggaccuaugucuacuuuucaaggcaaagugaagaugacaguccuugcucucagg

SEQ ID NO: 522505 - RNA, 64 nt, hsa
cauuaugauugaaaaacauaaaaacuaacauaggaaagugaaugaucaguuacuuaugauauau

SEQ ID NO: 522506 - RNA, 64 nt, hsa
uuaugauauauuuuguuuccucuugugguuuaauaaagugaagugugugugugugugugugugu

SEQ ID NO: 522507 - RNA, 64 nt, hsa
cuucuuguguuaaacuaaaaauuuacaagagaagaaagugaaagcaaaugggguuucacaaaua

SEQ ID NO: 522508 - RNA, 64 nt, hsa
acuuuccucacaccuggaagaaacaaaguaggaaaaagugaacaggggaugucaaaucgauucu

SEQ ID NO: 522509 - RNA, 64 nt, hsa
ucaaauauuguuuaauggaaugaugagccugcauaaagugaagcugcaauguaacauagguauc

SEQ ID NO: 522510 - RNA, 64 nt, hsa
uccucuggucauuucagacucucaucucucuauuaaagugaauauucuguagaucagaugaauu

SEQ ID NO: 522511 - RNA, 64 nt, hsa
aggaccagcgacaagacucaugagaggacuggcuaaagugaagugugcacagugugaaguuuaa

SEQ ID NO: 522512 - RNA, 64 nt, hsa
uguaaaaggggaaauuaguauaugauguaggcuaaaagugaaaucauaguaacauauguuuuag

SEQ ID NO: 522513 - RNA, 64 nt, hsa
uugucaagagaucuuucagaaaauauaagccuuuaaagugaagaagaggagccaguugugcugg

SEQ ID NO: 522514 - RNA, 64 nt, hsa
uaagagaaaaccauuuuuaaucuuaguuaaaauuaaagugaauuaguaguauaucauuuuacua

SEQ ID NO: 522515 - RNA, 64 nt, hsa
aagaaaaaacagaagacaaauacugcuaauaccaaaagugaaagaggccaucauagcugauccu

SEQ ID NO: 522516 - RNA, 64 nt, hsa
acacugaggagaaaauugucaauuuaagaaaucuaaagugaaaauuuugcuuagaaauaaaaua

SEQ ID NO: 522517 - RNA, 64 nt, hsa
cgcaaggcugggguagcccccuccaguacaccccaaagugaaagggauaagagugcagccccag

SEQ ID NO: 522518 - RNA, 64 nt, hsa
ucuacgccaaaacagacgggaaagggaacaaaauaaagugaaauccaauacacgccugugugag

SEQ ID NO: 522519 - RNA, 64 nt, hsa
aaaugcuuuccuaaaaugauaguggauaauagacaaagugaaaacauuuaaaaaggaagagaaa

SEQ ID NO: 522520 - RNA, 64 nt, hsa
uugaauauacauauauauauauauguauauuuaaaaagugaauauaauuugaggcacagaagaa

SEQ ID NO: 522521 - RNA, 64 nt, hsa
aagaaagagaaaaaagauaaaguagaaaaagaaaaaagugaaaaggaaacaacuagcaaaaaga

SEQ ID NO: 522522 - RNA, 64 nt, hsa
accaguuucaaaaccuucaagugauauguggaaaaaagugaaugagaccucugauaggggguuu

SEQ ID NO: 522523 - RNA, 64 nt, hsa
guaagagaauuuauuuacuaaaugcacuauguauaaagugaaagauaguuuacuuaucugacuu

SEQ ID NO: 522524 - RNA, 64 nt, hsa
aauacaggggucaaaaccagacuaacaguuuuagaaagugaaaaaaguuaaaaaagaaaugggg

SEQ ID NO: 522525 - RNA, 64 nt, hsa
auugaaaggaaguuaucuugguaaauugagacucaaagugaaauacaaaaaugaaaauauuuau

SEQ ID NO: 522526 - RNA, 64 nt, hsa
ugugacccuaaugaaagaauguauaugauccuggaaagugaacugggugaccuaggaccucuga

SEQ ID NO: 522527 - RNA, 64 nt, hsa
aggacuacauuaacucuuauuguuguguuucugaaaagugaaauuuaaaaagcagccugaaaaa

SEQ ID NO: 522528 - RNA, 64 nt, hsa
gcagggcccaauccuuccagacccaccagcuggaaaagugaaggaagcauguccacugacaaac

SEQ ID NO: 522529 - RNA, 64 nt, hsa
ggagcaaguggccaaacaucagaaucgauuaaaaaaagugaagaaaagaagcgaauaaguaugc

SEQ ID NO: 522530 - RNA, 64 nt, hsa
uaguuacccagcuguuuaauauuccagucuucccaaagugaaaagauuuguauacaaauguuuu

SEQ ID NO: 522531 - RNA, 64 nt, hsa
aauaagugugacaacuuaaaacuuguuucuauuuaaagugaaauguaucuuucaacuguuuagu

SEQ ID NO: 522532 - RNA, 64 nt, hsa
auaauucacuaauguuuuauauucauauauuaggaaagugaacuuagcaagcuuuuuggaauuu

SEQ ID NO: 522533 - RNA, 64 nt, hsa
ucagcagacuucuuucagcagcucguguuuuucuaaagugaaaggcaugguuuguccugcuuag

SEQ ID NO: 522534 - RNA, 64 nt, hsa
aaccacagucgggaaacaagcauagaaauggaagaaagugaacuugaugcucaguauuugcaga

SEQ ID NO: 522535 - RNA, 64 nt, hsa
cuggccagugauccucaugaggcuuuaauauguaaaagugaaagaguucacuccaaaucaguag

SEQ ID NO: 522536 - RNA, 64 nt, hsa
ggugaaaaggggacaguuuuuacccuaaagugcaaaagugaaacauacaaaauaagacuaauuu

SEQ ID NO: 522537 - RNA, 64 nt, hsa
gaggaaaauguauuuaaaagaaauacgagaaaagaaagugaaaguuuuacaaguuagagggaug

SEQ ID NO: 522538 - RNA, 64 nt, hsa
guauuucagagagacauaaguuacuagaaagugaaaagugaauaaauaagucacagagaaugua

SEQ ID NO: 522539 - RNA, 64 nt, hsa
gcuuucuguauuucagagagacauaaguuacuagaaagugaaaagugaauaaauaagucacaga

SEQ ID NO: 522540 - RNA, 64 nt, hsa
auuuugguuuugccuauaccauccugauuuuugaaaagugaauuauaaacacaaaauuguuagu

SEQ ID NO: 522541 - RNA, 64 nt, hsa
guguucuacugaguaagaugacuuguugacugugaaagugaauuuucuugcugugucgaacaau

SEQ ID NO: 522542 - RNA, 64 nt, hsa
aauagcuauuuugcuuaaauuucuacaguauguaaaagugaaaaaaugaugaagacgggugcac

SEQ ID NO: 522543 - RNA, 64 nt, hsa
aggacugguuuuguuuuuauauauauaaaaaaaaaaagugaaaacaccaaugugugaaaugccu

SEQ ID NO: 522544 - RNA, 64 nt, hsa
gaggaacuccugccacgccacugugucaugaaggaaagugaaagggaacgaggaaguaggaaug

SEQ ID NO: 522545 - RNA, 64 nt, hsa
cacgccaaccccagaaaauaccccacaugccagaaaagugaaguccuagguguuuccaucuaug

SEQ ID NO: 522546 - RNA, 64 nt, hsa
aguggggaagaaaccuccccaggaaauuggaauuaaagugaaaaaucauucuggagguggcaug

SEQ ID NO: 522547 - RNA, 64 nt, hsa
ugaagcagaugaguuuguagcagggccacaaaacaaagugaaacguccaggggaacccaacagu

SEQ ID NO: 522548 - RNA, 64 nt, hsa
cgcuggaauuggcuugugggucacuuguugugcaaaagugaauuaauuucaaauaggaaucaua

SEQ ID NO: 522549 - RNA, 64 nt, hsa
cauuguuuguggaggauuacauuuaaaaaagcaaaaagugaaaaaaaaaagcucuggacaccuu

SEQ ID NO: 522550 - RNA, 64 nt, hsa
guuuaaucaguuaacggaaauuucuuggcuuaugaaagugaaaaguccagugguauuggcauug

SEQ ID NO: 522551 - RNA, 64 nt, hsa
uuguuuguguggugccaggaaauugauuuuggaaaaagugaaauaacauuaaaggugaauguga

SEQ ID NO: 522552 - RNA, 64 nt, hsa; identical to SEQ ID NO: 159163

SEQ ID NO: 522553 - RNA, 64 nt, hsa; identical to SEQ ID NO: 159164

SEQ ID NO: 522554 - RNA, 64 nt, hsa; identical to SEQ ID NO: 159165

SEQ ID NO: 522555 - RNA, 64 nt, hsa; identical to SEQ ID NO: 159166

SEQ ID NO: 522556 - RNA, 64 nt, hsa; identical to SEQ ID NO: 159167

SEQ ID NO: 522557 - RNA, 64 nt, hsa; identical to SEQ ID NO: 159168

SEQ ID NO: 522558 - RNA, 64 nt, hsa; identical to SEQ ID NO: 159169

SEQ ID NO: 522559 - RNA, 64 nt, hsa; identical to SEQ ID NO: 159170

SEQ ID NO: 522560 - RNA, 64 nt, hsa; identical to SEQ ID NO: 159171

SEQ ID NO: 522561 - RNA, 64 nt, hsa; identical to SEQ ID NO: 159172

SEQ ID NO: 522562 - RNA, 64 nt, hsa; identical to SEQ ID NO: 159173

SEQ ID NO: 522563 - RNA, 64 nt, hsa; identical to SEQ ID NO: 159174

SEQ ID NO: 522564 - RNA, 64 nt, hsa; identical to SEQ ID NO: 159175

SEQ ID NO: 522565 - RNA, 64 nt, hsa; identical to SEQ ID NO: 159176

SEQ ID NO: 522566 - RNA, 64 nt, hsa; identical to SEQ ID NO: 159177

SEQ ID NO: 522567 - RNA, 64 nt, hsa; identical to SEQ ID NO: 159178

SEQ ID NO: 522568 - RNA, 64 nt, hsa; identical to SEQ ID NO: 159179

SEQ ID NO: 522569 - RNA, 64 nt, hsa; identical to SEQ ID NO: 159180

SEQ ID NO: 522570 - RNA, 64 nt, hsa; identical to SEQ ID NO: 159181

SEQ ID NO: 522571 - RNA, 64 nt, hsa; identical to SEQ ID NO: 159182

SEQ ID NO: 522572 - RNA, 64 nt, hsa; identical to SEQ ID NO: 159183

SEQ ID NO: 522573 - RNA, 64 nt, hsa; identical to SEQ ID NO: 159184

SEQ ID NO: 522574 - RNA, 64 nt, hsa; identical to SEQ ID NO: 159185

SEQ ID NO: 522575 - RNA, 64 nt, hsa; identical to SEQ ID NO: 159186

SEQ ID NO: 522576 - RNA, 64 nt, hsa; identical to SEQ ID NO: 159187

SEQ ID NO: 522577 - RNA, 64 nt, hsa; identical to SEQ ID NO: 159188

SEQ ID NO: 522578 - RNA, 64 nt, hsa; identical to SEQ ID NO: 159189

SEQ ID NO: 522579 - RNA, 64 nt, hsa; identical to SEQ ID NO: 159190

SEQ ID NO: 522580 - RNA, 64 nt, hsa; identical to SEQ ID NO: 159191

SEQ ID NO: 522581 - RNA, 64 nt, hsa; identical to SEQ ID NO: 159192

SEQ ID NO: 522582 - RNA, 64 nt, hsa; identical to SEQ ID NO: 159193

SEQ ID NO: 522583 - RNA, 64 nt, hsa; identical to SEQ ID NO: 159194

SEQ ID NO: 522584 - RNA, 64 nt, hsa; identical to SEQ ID NO: 159195

SEQ ID NO: 522585 - RNA, 64 nt, hsa; identical to SEQ ID NO: 159196

SEQ ID NO: 522586 - RNA, 64 nt, hsa; identical to SEQ ID NO: 159197

SEQ ID NO: 522587 - RNA, 64 nt, hsa; identical to SEQ ID NO: 159198

SEQ ID NO: 522588 - RNA, 64 nt, hsa; identical to SEQ ID NO: 159199

SEQ ID NO: 522589 - RNA, 64 nt, hsa; identical to SEQ ID NO: 159200

SEQ ID NO: 522590 - RNA, 64 nt, hsa; identical to SEQ ID NO: 159201

SEQ ID NO: 522591 - RNA, 64 nt, hsa
uggaacuuggcacuggggacucauguuuggaaucguaggggaacaucuggcuguuaaucacuug

SEQ ID NO: 522592 - RNA, 64 nt, hsa
cagguuuccugcagcucgcuaccuaaguguuucuguaggggaaggagccaauuaagaaaaagug

SEQ ID NO: 522593 - RNA, 64 nt, hsa
accggaggagcaauuggggauccaggugucagagguaggggaaccaggggcaagcuggggcuga

SEQ ID NO: 522594 - RNA, 64 nt, hsa
ccgcgcaggccuccggggggccggggcuuaccauguaggggaggggagaucuauccacauaccu

SEQ ID NO: 522595 - RNA, 64 nt, hsa
uccugcaguucccaggaccccauccucucagaagguaggggaagggcgggaggauugagaaggg

SEQ ID NO: 522596 - RNA, 64 nt, hsa
cgggaggauugagaagggacaagccaccuugaccguaggggaaggaggaaugugggcuggggga

SEQ ID NO: 522597 - RNA, 64 nt, hsa
cagacuguugggccaacaggagaagcuccccagaguaggggagaagguugggguguagggccuu

SEQ ID NO: 522598 - RNA, 64 nt, hsa
ccuugggugggcaccacccuggcaguuccagccuguaggggagugaagggacauggcugagcug

SEQ ID NO: 522599 - RNA, 64 nt, hsa
gaggcuauacgugacaaaugaccaaaagcccaagguaggggaguuuccucugcucacaguucuu

SEQ ID NO: 522600 - RNA, 64 nt, hsa
cgccugccagggggugacuggcacagagcgggccguaggggacccccucacacaccaccgagau

SEQ ID NO: 522601 - RNA, 64 nt, hsa
gaaauaaugggauuagaaacaaacaaaacucuuaaguccuaaaaguucucaauguagaggcaua

SEQ ID NO: 522602 - RNA, 64 nt, hsa
aggccggaugaaacuucucaguccagcaguuuccaguccuaacaaaugcucccaccugaauuug

SEQ ID NO: 522603 - RNA, 64 nt, hsa
ccugguuagggcugaggaccccaagauaggcugaaguccuaacuugaagcaccucagaauguga

SEQ ID NO: 522604 - RNA, 64 nt, hsa
ggauguccauguccucacaggccugcucauuuucaguccuaaucguagaaucugaaauaaacag

SEQ ID NO: 522605 - RNA, 64 nt, hsa
cccacccauccaguucuccucagcaaagcaaauuccuuaacaccuuugguggagaauuucuuac

SEQ ID NO: 522606 - RNA, 64 nt, hsa
ggcuaagggggugugugcccaccuccucccugacccuuaacacuccuguccugcccagaccaac

SEQ ID NO: 522607 - RNA, 64 nt, hsa
aggacuuagccucaguugacgauaguaacaauggccuuaacaucuaccuuaacagcuaccuauu

SEQ ID NO: 522608 - RNA, 64 nt, hsa
caguugacgauaguaacaauggccuuaacaucuaccuuaacagcuaccuauuacagccguauuc

SEQ ID NO: 522609 - RNA, 64 nt, hsa; identical to SEQ ID NO: 44019

SEQ ID NO: 522610 - RNA, 64 nt, hsa; identical to SEQ ID NO: 44020

SEQ ID NO: 522611 - RNA, 64 nt, hsa; identical to SEQ ID NO: 44021

SEQ ID NO: 522612 - RNA, 64 nt, hsa; identical to SEQ ID NO: 44022

SEQ ID NO: 522613 - RNA, 64 nt, hsa; identical to SEQ ID NO: 44023

SEQ ID NO: 522614 - RNA, 64 nt, hsa; identical to SEQ ID NO: 44024

SEQ ID NO: 522615 - RNA, 64 nt, hsa; identical to SEQ ID NO: 44025

SEQ ID NO: 522616 - RNA, 64 nt, hsa; identical to SEQ ID NO: 44026

SEQ ID NO: 522617 - RNA, 64 nt, hsa; identical to SEQ ID NO: 44027

SEQ ID NO: 522618 - RNA, 64 nt, hsa; identical to SEQ ID NO: 44028

SEQ ID NO: 522619 - RNA, 64 nt, hsa; identical to SEQ ID NO: 44029

SEQ ID NO: 522620 - RNA, 64 nt, hsa; identical to SEQ ID NO: 44030

SEQ ID NO: 522621 - RNA, 64 nt, hsa; identical to SEQ ID NO: 44031

SEQ ID NO: 522622 - RNA, 64 nt, hsa; identical to SEQ ID NO: 44032

SEQ ID NO: 522623 - RNA, 64 nt, hsa; identical to SEQ ID NO: 44033

SEQ ID NO: 522624 - RNA, 64 nt, hsa; identical to SEQ ID NO: 44028

SEQ ID NO: 522625 - RNA, 64 nt, hsa; identical to SEQ ID NO: 44035

SEQ ID NO: 522626 - RNA, 64 nt, hsa; identical to SEQ ID NO: 44036

SEQ ID NO: 522627 - RNA, 64 nt, hsa; identical to SEQ ID NO: 44037

SEQ ID NO: 522628 - RNA, 64 nt, hsa; identical to SEQ ID NO: 44038

SEQ ID NO: 522629 - RNA, 64 nt, hsa; identical to SEQ ID NO: 44039

SEQ ID NO: 522630 - RNA, 64 nt, hsa; identical to SEQ ID NO: 44040

SEQ ID NO: 522631 - RNA, 64 nt, hsa; identical to SEQ ID NO: 44041

SEQ ID NO: 522632 - RNA, 64 nt, hsa; identical to SEQ ID NO: 44042

SEQ ID NO: 522633 - RNA, 64 nt, hsa; identical to SEQ ID NO: 44043

SEQ ID NO: 522634 - RNA, 64 nt, hsa; identical to SEQ ID NO: 44044

SEQ ID NO: 522635 - RNA, 64 nt, hsa; identical to SEQ ID NO: 44045

SEQ ID NO: 522636 - RNA, 64 nt, hsa; identical to SEQ ID NO: 44046

SEQ ID NO: 522637 - RNA, 51 nt, hsa; identical to SEQ ID NO: 44047

SEQ ID NO: 522638 - RNA, 64 nt, hsa; identical to SEQ ID NO: 44048

SEQ ID NO: 522639 - RNA, 64 nt, hsa; identical to SEQ ID NO: 44049

SEQ ID NO: 522640 - RNA, 64 nt, hsa; identical to SEQ ID NO: 44050

SEQ ID NO: 522641 - RNA, 64 nt, hsa; identical to SEQ ID NO: 44051

SEQ ID NO: 522642 - RNA, 64 nt, hsa; identical to SEQ ID NO: 44052

SEQ ID NO: 522643 - RNA, 64 nt, hsa; identical to SEQ ID NO: 44053

SEQ ID NO: 522644 - RNA, 64 nt, hsa; identical to SEQ ID NO: 44054

SEQ ID NO: 522645 - RNA, 64 nt, hsa; identical to SEQ ID NO: 44055

SEQ ID NO: 522646 - RNA, 64 nt, hsa
uggaacaucuccuauguaccaggcacugugcuaagugcuggaauacauuaucucauugaauuau

SEQ ID NO: 522647 - RNA, 64 nt, hsa
ggcuggaggaguaaguggcuuugcaauaaaaugggugcuggagucuaaaaugauacccugggug

SEQ ID NO: 522648 - RNA, 64 nt, hsa
uguaggcuuggagguaaagaacugaagauaacuggugcuggauagaggagccuuauuuuuuauu

SEQ ID NO: 522649 - RNA, 64 nt, hsa
uuuaccuuuuuccccccuuuuuuuuaaauggagugugcuggaugucucuauaauuuuauucaga

SEQ ID NO: 522650 - RNA, 64 nt, hsa
ccuuggcuguuggcagugagugagccuggcucuugugcuggauggagcccaggcgggagcggug

SEQ ID NO: 522651 - RNA, 64 nt, hsa
agaaagcaggggcuacaagagggaauccccgaaggugcuggaggugggagcaggagauugagaa

SEQ ID NO: 522652 - RNA, 64 nt, hsa
gggccuggagccaagggaugagguuguccaggcugugcuggacagcaccaccuucuucccugaa

SEQ ID NO: 522653 - RNA, 64 nt, hsa
ccugcaggagcuggagccggucaucucccgcgcggugcuggacaacccgcaccgugagucuggc

SEQ ID NO: 522654 - RNA, 64 nt, hsa
aucauggaaccagucagcccucuguggagucauugugcuggaccucugaaaagaucugcagggg

SEQ ID NO: 522655 - RNA, 64 nt, hsa
cucucugcucugacccuucucaggcccgccugaugugcuggaccaucccccugcugccacggcc

SEQ ID NO: 522656 - RNA, 64 nt, hsa
cuggggagacgaugcuguugcuuugcagaucacagugcuggaagcaggaacccaggguaagugc

SEQ ID NO: 522657 - RNA, 64 nt, hsa
ccagaccaaagagaagaugguuaccauggugucagugcuggaggaucugauuggcaagcuuacc

SEQ ID NO: 522658 - RNA, 64 nt, hsa
gugcgccaccuuacuuuggaagucucuggcuugugugcuggaugaggcugccagaacuuguugg

SEQ ID NO: 522659 - RNA, 64 nt, hsa
ucuguggaguccucagucacucugcuguuggagagugcuggaggaaaugcacuuuuacugugcu

SEQ ID NO: 522660 - RNA, 64 nt, hsa
gcuggggagaaugaagagcuaaaauagauccuaggugcuggaugcuuugucauccaugcgugca

SEQ ID NO: 522661 - RNA, 64 nt, hsa
cuccauucuagaugcuucccuuguauccagugaugugcuggagcuggcuuugccaagcuuguga

SEQ ID NO: 522662 - RNA, 64 nt, hsa
gcucccaaugggagcccacggaacuaaguagggucccaagaaaaaaaacgggagcuauuucaca

SEQ ID NO: 522663 - RNA, 64 nt, hsa
cugggguuccugguggauuucuuacuaccuaacgcccaagaaaaccaacuaaggacucucaaac

SEQ ID NO: 522664 - RNA, 64 nt, hsa
cagcccuccucucccaagaaauccaggcuccucucccaagaaauccaggugcuuuccagacucc

SEQ ID NO: 522665 - RNA, 64 nt, hsa
gaagaacugauuggggcuuccacagcccuccucucccaagaaauccaggcuccucucccaagaa

SEQ ID NO: 522666 - RNA, 64 nt, hsa
aggguccuacagacaagguggcaucucaaccucacccaagaaacccccgggacuuuaccccagc

SEQ ID NO: 522667 - RNA, 64 nt, hsa
gccgcucagaggcuucagccugacuuccagcggucccaagaacaccuacuaauuccucugcacu

SEQ ID NO: 522668 - RNA, 64 nt, hsa
cagucauuucagaggcagcagaugcccagggagacccaagaaagagucagguuagggagcagug

SEQ ID NO: 522669 - RNA, 64 nt, hsa
auccaaauacucuuacuuuaaaaaauuuccuuuccccaagaaucuccuugggacuuugacuuau

SEQ ID NO: 522670 - RNA, 64 nt, hsa
cgacgaaagcgacggaccaaaagaaauuuccugccccaagaagcaugggauccaggaaggggcg

SEQ ID NO: 522671 - RNA, 64 nt, hsa
auguuccuaaguaagucaggucccuaagccccgucccaagaagugacacaaguggccaacaucc

SEQ ID NO: 522672 - RNA, 64 nt, hsa
ggauguuagcauucauuagaguaugaggaugagucccaagaagguucuuuggaaggaggacgaa

SEQ ID NO: 522673 - RNA, 64 nt, hsa
uuaagugggcuuccauuccauggauuuaaucagucccaagaagaucaaacucagcaguacuugg

SEQ ID NO: 522674 - RNA, 64 nt, hsa
ucccccuuccucccauacugcuuuuaaacagaugcccaagaaggcaagcaggaaugccucuugu

SEQ ID NO: 522675 - RNA, 64 nt, hsa
auaugguauguaugcuaaauuauaugaaccuuuccccaagaagggcccuagaaauugauguggc

SEQ ID NO: 522676 - RNA, 64 nt, hsa
guguuaaccacguguauaacagcucugcuggacacccaagaaagccaugggaacgccaacugga

SEQ ID NO: 522677 - RNA, 64 nt, hsa
uaaaagugaaauuaaccuccugccaauuuuacaacccaagaauuuuuuuuuaagggccuuggag

SEQ ID NO: 522678 - RNA, 64 nt, hsa
guuaauacuaucauaguaauauuauuauugucaucccaagaaaaaauauauuaaaaagauauuu

SEQ ID NO: 522679 - RNA, 64 nt, hsa
auuaauacuaucauguuaauacuauuauugucaucccaagaaaaaagauauuuuaaaaauuuau

SEQ ID NO: 522680 - RNA, 64 nt, hsa
cucccugguucaagugauucuccugccucauccucccaagaagcugagauuacagaugaccacc

SEQ ID NO: 522681 - RNA, 64 nt, hsa
auaccuagagacgcugcuggggaaggucagcacacccaagaacuuugggagugugugucuguuu

SEQ ID NO: 522682 - RNA, 64 nt, hsa
cuccugagugaucccauuucuuaaucaguguagccccaagaaggcuggggcuauuuaccagggu

SEQ ID NO: 522683 - RNA, 64 nt, hsa
ggcaaugaguguguuggcuugugaucugggaacucccaagaacagcaggcccaccuaccuucaa

SEQ ID NO: 522684 - RNA, 64 nt, hsa
gugggcaccggaaaggaggggacuucuccugcaccccaagaagugguggggagauugcugcccc

SEQ ID NO: 522685 - RNA, 64 nt, hsa
agccaagcccccagccccgaucugcagauccugccccaagaagcugggguggugggggcaguaa

SEQ ID NO: 522686 - RNA, 64 nt, hsa
uguaucuccuuaguuaacaacccaguuccaggaucgagccuaaagcgggagccaggccugagug

SEQ ID NO: 522687 - RNA, 64 nt, hsa
uuaaaaagacgcagggcaccugugagcgcaggagcgagccuaaggccacccagcggcagcgccc

SEQ ID NO: 522688 - RNA, 64 nt, hsa
uggaggacguagaauuucacuggaucagcaaugacgagccuacacaguacuggagaacuuggca

SEQ ID NO: 522689 - RNA, 64 nt, hsa
uuuaauguuguccaggaaacccuggcuugcuugccgagccuaaugaaagggaaagucagcuuuc

SEQ ID NO: 522690 - RNA, 64 nt, hsa
cucuuccaaagacuccccccagguacagugccuucgagccuacaagccccgagagaaugaugaa

SEQ ID NO: 522691 - RNA, 64 nt, hsa
uacagaccucccccggacagcccacucucuaucacgagccuaacccgcgggaggcggaagagac

SEQ ID NO: 522692 - RNA, 64 nt, hsa
ggugccuggagcagagggacccacaagugccucccgagccuagauccuggcucggaccacugca

SEQ ID NO: 522693 - RNA, 64 nt, hsa
cagucagcaugucauccacaaguauuuccugccccgagccuaugcugucgccaucccacuggcu

SEQ ID NO: 522694 - RNA, 64 nt, hsa
gucaucacucaauauugcgaagcacaugccccaucgagccuacugggcagagcagcagagcagg

SEQ ID NO: 522695 - RNA, 64 nt, hsa
gaaugaagaggugcgccguuucucagauuuuuugcgagccuaaaacacuugccaaguaauccug

SEQ ID NO: 522696 - RNA, 64 nt, hsa
cguguccuaccuccgucuucgccaaggccccgcccgagccuaguuguucucccccugaaugugu

SEQ ID NO: 522697 - RNA, 64 nt, hsa
ucaacuugcugauauuuuaguaguuaacagcuuccgagccuaucaugcaauuuggagucuguca

SEQ ID NO: 522698 - RNA, 64 nt, hsa
ggcccaccugccucugucucacugaacuagaagccgagccuagaaacuaacacagccaucaagg

SEQ ID NO: 522699 - RNA, 64 nt, hsa
cuuagcugguggccagccugacuggcuuccugggcgagccuaguagcuccugcaggcaggggca

SEQ ID NO: 522700 - RNA, 64 nt, hsa
cuucaucauaguaugaaguguugaaaauuaauaacgagccuaguuuaggaaaaagcugcuuaaa

SEQ ID NO: 522701 - RNA, 64 nt, hsa
cauauacauaaugagauauuuugggaauaggacccgagccuaaacacaaaauucauugaugugu

SEQ ID NO: 522702 - RNA, 64 nt, hsa
agacuccuccaaaucuuaaaaugaagcaggaaaacgagccuaagaggacuuucauaccgacaac

SEQ ID NO: 522703 - RNA, 64 nt, hsa
ggcauguuugucgucguccuacaaaugaggaaaccgagccuauggcgugcccuggucuguugag

SEQ ID NO: 522704 - RNA, 64 nt, hsa
gccccuucucgccgagccguggggcgcgggcggccgagccuauacauaguguacaggagacauc

SEQ ID NO: 522705 - RNA, 64 nt, hsa
agguugugguggggcaagaucgcaccauugcacccgagccuaggcaacaagagugaaauuccgu

SEQ ID NO: 522706 - RNA, 64 nt, hsa
ucaagaagugccaguugaucaaugaauaaauaaacgagccuauuucucuuugcacauccugcuu

SEQ ID NO: 522707 - RNA, 64 nt, hsa
ggccucucacccccaaggcugucucuggcccugccgagccuaugggagucccgggacagagugc

SEQ ID NO: 522708 - RNA, 64 nt, hsa
gccagcuguggcagcgcauuaguuuuggcgcaagcgagccuaugcugcagggucacuuuuggcu

SEQ ID NO: 522709 - RNA, 64 nt, hsa
uuccucaugggcgaucacuccgcaucuauagggucgagccuaggggagcuugagggagggcugg

SEQ ID NO: 522710 - RNA, 64 nt, hsa
auucugccugaaaacaauguauuaccccagggcccaacaguaaaagauuguggacuuuuugggu

SEQ ID NO: 522711 - RNA, 64 nt, hsa
uuuagccacagaaucaguaagaacagaugauaugcaacaguaccaauuacgguucaaaaauguc

SEQ ID NO: 522712 - RNA, 64 nt, hsa
ggccuaccuuuuuaaaggacaaauauaaaaauagcaacaguaucuuugcuaaucuuacuaauag

SEQ ID NO: 522713 - RNA, 64 nt, hsa
auauuccaguauuuguguguuugauuuuuuuugacaacaguacauauaucuauuucucuaggga

SEQ ID NO: 522714 - RNA, 64 nt, hsa
ccguuuacacguggcuucccucggaagcccuccucaacaguagcuggugugaaagacuaaauca

SEQ ID NO: 522715 - RNA, 64 nt, hsa
ugccaauuuaacagucucaucaggugauucuuuucaacaguaauguuugagaauuacuggguua

SEQ ID NO: 522716 - RNA, 64 nt, hsa
gaaaugaaagaacuuguucacagguucugcguuacaacaguaacacaucuuuaauccgccuaau

SEQ ID NO: 522717 - RNA, 64 nt, hsa
gguaaccauuaagaaauguuuuuauuuucucuaucaacaguaguuuugaaacuagaagucaaaa

SEQ ID NO: 522718 - RNA, 64 nt, hsa
uuaggagggagcuuuuugaaggaagacuuauuaacaacaguaauucagcaaaugacguugauuu

SEQ ID NO: 522719 - RNA, 64 nt, hsa
caaaucauucacaaacagaauaaaacagagccaacaacaguauuuuaagggucacuugccuccu

SEQ ID NO: 522720 - RNA, 64 nt, hsa
cuguuaaggaggucucagguuuugaaauauaacucaacaguauauuaaccauugacaagaaugg

SEQ ID NO: 522721 - RNA, 64 nt, hsa
cuuaaggcauuuucaugcucauaaaucugauaggcaacaguagcuccuacugaaauuucuuagg

SEQ ID NO: 522722 - RNA, 64 nt, hsa
cuguugaugguuuuugcaagagaauucagcagcucaacaguaaugaaagugaagaacagagucc

SEQ ID NO: 522723 - RNA, 64 nt, hsa
aagacgcuugacuuauuaaggacuuuaaccuacucaacaguauuucauauccauugugguuagu

SEQ ID NO: 522724 - RNA, 64 nt, hsa
aguugucugaaaagccagcucuugaaccucuucacaacaguaucaacacuggcuucucccgguu

SEQ ID NO: 522725 - RNA, 64 nt, hsa
aagacuguaagccugugugugccacuguuugcuucaacaguauauccuaauaagccucaccuau

SEQ ID NO: 522726 - RNA, 64 nt, hsa; identical to SEQ ID NO: 152997

SEQ ID NO: 522727 - RNA, 64 nt, hsa; identical to SEQ ID NO: 152998

SEQ ID NO: 522728 - RNA, 64 nt, hsa; identical to SEQ ID NO: 152999

SEQ ID NO: 522729 - RNA, 64 nt, hsa; identical to SEQ ID NO: 153000

SEQ ID NO: 522730 - RNA, 64 nt, hsa; identical to SEQ ID NO: 153001

SEQ ID NO: 522731 - RNA, 64 nt, hsa; identical to SEQ ID NO: 153002

SEQ ID NO: 522732 - RNA, 64 nt, hsa; identical to SEQ ID NO: 153003

SEQ ID NO: 522733 - RNA, 64 nt, hsa; identical to SEQ ID NO: 153004

SEQ ID NO: 522734 - RNA, 64 nt, hsa; identical to SEQ ID NO: 153005

SEQ ID NO: 522735 - RNA, 64 nt, hsa; identical to SEQ ID NO: 153006

SEQ ID NO: 522736 - RNA, 64 nt, hsa; identical to SEQ ID NO: 153007

SEQ ID NO: 522737 - RNA, 58 nt, hsa
ugguuagcugacagucagcuguggggaacacagcuacaacccuacccuggcagggacc

SEQ ID NO: 522738 - RNA, 58 nt, hsa
cccaacccugcccugccccaccccaccucacagcuacucaguggggcuggcaucaagg

SEQ ID NO: 522739 - RNA, 58 nt, hsa
uuugccuaaggucacagcuaauaaguggcacagcuaauauucccaguaaagauaccau

SEQ ID NO: 522740 - RNA, 58 nt, hsa
cagauaagugaaguaauuugccuaaggucacagcuaauaaguggcacagcuaauauuc

SEQ ID NO: 522741 - RNA, 58 nt, hsa
cggcccacagcuagguggggucacggcccacagcuagguggggacugucugcuggcuc

SEQ ID NO: 522742 - RNA, 58 nt, hsa
uucaucagcacagcauggggucacggcccacagcuagguggggucacggcccacagcu

SEQ ID NO: 522743 - RNA, 58 nt, hsa
agggccauucaaauuguugguguugcaucacagcuaccuuaacuguuuuuaacaugga

SEQ ID NO: 522744 - RNA, 58 nt, hsa
ucaccccccccacccccgccuugccacacacagcuaauauucuaaugguaaauuucuc

SEQ ID NO: 522745 - RNA, 58 nt, hsa
gagagguuaagugucuugcccgaggucacacagcuaucugcaugucccacaacucccc

SEQ ID NO: 522746 - RNA, 58 nt, hsa
aaaaguuaaccaagccuaugcuuguagucacagcuacucgggaggccgaggugggagg

SEQ ID NO: 522747 - RNA, 58 nt, hsa
gggguggcauucacuuagggucugacuucacagcuaugacaaaaccgaaaaagcaaaa

SEQ ID NO: 522748 - RNA, 58 nt, hsa
uccacagaaugucaggaccaaauaacuucacagcuacucugcaaagggcaaauuauaa

SEQ ID NO: 522749 - RNA, 58 nt, hsa
gagggaacucugccaccugcgugcaacccacagcuaaaguaaauucaaugacacuacu

SEQ ID NO: 522750 - RNA, 58 nt, hsa
cuacaagagggaaagaaggcaaaaacggcacagcuaucuccaaacacaucugaguuca

SEQ ID NO: 522751 - RNA, 58 nt, hsa
ggacaugcugaagccaaagccaauaacacacagcuaacacacagcucccauaaccgcu

SEQ ID NO: 522752 - RNA, 58 nt, hsa
caaugccauccucaaacacugcaggcaucacagcuaacaauugugaagucgucuuaac

SEQ ID NO: 522753 - RNA, 64 nt, hsa; identical to SEQ ID NO: 111815

SEQ ID NO: 522754 - RNA, 64 nt, hsa; identical to SEQ ID NO: 111816

SEQ ID NO: 522755 - RNA, 64 nt, hsa; identical to SEQ ID NO: 111817

SEQ ID NO: 522756 - RNA, 64 nt, hsa; identical to SEQ ID NO: 111818

SEQ ID NO: 522757 - RNA, 64 nt, hsa; identical to SEQ ID NO: 111819

SEQ ID NO: 522758 - RNA, 64 nt, hsa; identical to SEQ ID NO: 111820

SEQ ID NO: 522759 - RNA, 64 nt, hsa; identical to SEQ ID NO: 111821

SEQ ID NO: 522760 - RNA, 64 nt, hsa; identical to SEQ ID NO: 111822

SEQ ID NO: 522761 - RNA, 64 nt, hsa; identical to SEQ ID NO: 111823

SEQ ID NO: 522762 - RNA, 64 nt, hsa; identical to SEQ ID NO: 111824

SEQ ID NO: 522763 - RNA, 64 nt, hsa; identical to SEQ ID NO: 111825

SEQ ID NO: 522764 - RNA, 64 nt, hsa; identical to SEQ ID NO: 111826

SEQ ID NO: 522765 - RNA, 64 nt, hsa; identical to SEQ ID NO: 111827

SEQ ID NO: 522766 - RNA, 64 nt, hsa; identical to SEQ ID NO: 111828

SEQ ID NO: 522767 - RNA, 64 nt, hsa; identical to SEQ ID NO: 111829

SEQ ID NO: 522768 - RNA, 64 nt, hsa; identical to SEQ ID NO: 373477

SEQ ID NO: 522769 - RNA, 64 nt, hsa; identical to SEQ ID NO: 373478

SEQ ID NO: 522770 - RNA, 64 nt, hsa; identical to SEQ ID NO: 373479

SEQ ID NO: 522771 - RNA, 64 nt, hsa; identical to SEQ ID NO: 373480

SEQ ID NO: 522772 - RNA, 64 nt, hsa; identical to SEQ ID NO: 373481

SEQ ID NO: 522773 - RNA, 64 nt, hsa; identical to SEQ ID NO: 373482

SEQ ID NO: 522774 - RNA, 64 nt, hsa; identical to SEQ ID NO: 373483

SEQ ID NO: 522775 - RNA, 64 nt, hsa; identical to SEQ ID NO: 373484

SEQ ID NO: 522776 - RNA, 64 nt, hsa; identical to SEQ ID NO: 373485

SEQ ID NO: 522777 - RNA, 64 nt, hsa; identical to SEQ ID NO: 373486

SEQ ID NO: 522778 - RNA, 64 nt, hsa; identical to SEQ ID NO: 373487

SEQ ID NO: 522779 - RNA, 64 nt, hsa; identical to SEQ ID NO: 373488

SEQ ID NO: 522780 - RNA, 64 nt, hsa; identical to SEQ ID NO: 373489

SEQ ID NO: 522781 - RNA, 64 nt, hsa; identical to SEQ ID NO: 373490

SEQ ID NO: 522782 - RNA, 64 nt, hsa; identical to SEQ ID NO: 373491

SEQ ID NO: 522783 - RNA, 64 nt, hsa; identical to SEQ ID NO: 373492

SEQ ID NO: 522784 - RNA, 64 nt, hsa; identical to SEQ ID NO: 373493

SEQ ID NO: 522785 - RNA, 64 nt, hsa; identical to SEQ ID NO: 373494

SEQ ID NO: 522786 - RNA, 64 nt, hsa; identical to SEQ ID NO: 373495

SEQ ID NO: 522787 - RNA, 64 nt, hsa; identical to SEQ ID NO: 373496

SEQ ID NO: 522788 - RNA, 64 nt, hsa; identical to SEQ ID NO: 373497

SEQ ID NO: 522789 - RNA, 64 nt, hsa; identical to SEQ ID NO: 373498

SEQ ID NO: 522790 - RNA, 64 nt, hsa; identical to SEQ ID NO: 373499

SEQ ID NO: 522791 - RNA, 64 nt, hsa; identical to SEQ ID NO: 373500

SEQ ID NO: 522792 - RNA, 64 nt, hsa; identical to SEQ ID NO: 373501

SEQ ID NO: 522793 - RNA, 64 nt, hsa; identical to SEQ ID NO: 373502

SEQ ID NO: 522794 - RNA, 64 nt, hsa; identical to SEQ ID NO: 373503

SEQ ID NO: 522795 - RNA, 64 nt, hsa; identical to SEQ ID NO: 373504

SEQ ID NO: 522796 - RNA, 64 nt, hsa; identical to SEQ ID NO: 373505

SEQ ID NO: 522797 - RNA, 64 nt, hsa; identical to SEQ ID NO: 373506

SEQ ID NO: 522798 - RNA, 64 nt, hsa; identical to SEQ ID NO: 373507

SEQ ID NO: 522799 - RNA, 64 nt, hsa; identical to SEQ ID NO: 373508

SEQ ID NO: 522800 - RNA, 64 nt, hsa; identical to SEQ ID NO: 373509

SEQ ID NO: 522801 - RNA, 64 nt, hsa; identical to SEQ ID NO: 373510

SEQ ID NO: 522802 - RNA, 64 nt, hsa; identical to SEQ ID NO: 373511

SEQ ID NO: 522803 - RNA, 64 nt, hsa; identical to SEQ ID NO: 373512

SEQ ID NO: 522804 - RNA, 64 nt, hsa; identical to SEQ ID NO: 373513

SEQ ID NO: 522805 - RNA, 64 nt, hsa; identical to SEQ ID NO: 373514

SEQ ID NO: 522806 - RNA, 64 nt, hsa; identical to SEQ ID NO: 373515

SEQ ID NO: 522807 - RNA, 64 nt, hsa; identical to SEQ ID NO: 373516

SEQ ID NO: 522808 - RNA, 64 nt, hsa; identical to SEQ ID NO: 373517

SEQ ID NO: 522809 - RNA, 64 nt, hsa; identical to SEQ ID NO: 373518

SEQ ID NO: 522810 - RNA, 64 nt, hsa; identical to SEQ ID NO: 373519

SEQ ID NO: 522811 - RNA, 64 nt, hsa; identical to SEQ ID NO: 373520

SEQ ID NO: 522812 - RNA, 64 nt, hsa; identical to SEQ ID NO: 373521

SEQ ID NO: 522813 - RNA, 64 nt, hsa; identical to SEQ ID NO: 373522

SEQ ID NO: 522814 - RNA, 64 nt, hsa; identical to SEQ ID NO: 373523

SEQ ID NO: 522815 - RNA, 64 nt, hsa; identical to SEQ ID NO: 373524

SEQ ID NO: 522816 - RNA, 64 nt, hsa; identical to SEQ ID NO: 373525

SEQ ID NO: 522817 - RNA, 64 nt, hsa; identical to SEQ ID NO: 373526

SEQ ID NO: 522818 - RNA, 64 nt, hsa; identical to SEQ ID NO: 373527

SEQ ID NO: 522819 - RNA, 64 nt, hsa; identical to SEQ ID NO: 373528

SEQ ID NO: 522820 - RNA, 64 nt, hsa; identical to SEQ ID NO: 373529

SEQ ID NO: 522821 - RNA, 64 nt, hsa; identical to SEQ ID NO: 373530

SEQ ID NO: 522822 - RNA, 64 nt, hsa; identical to SEQ ID NO: 373531

SEQ ID NO: 522823 - RNA, 64 nt, hsa; identical to SEQ ID NO: 373532

SEQ ID NO: 522824 - RNA, 64 nt, hsa; identical to SEQ ID NO: 373533

SEQ ID NO: 522825 - RNA, 64 nt, hsa; identical to SEQ ID NO: 373534

SEQ ID NO: 522826 - RNA, 64 nt, hsa; identical to SEQ ID NO: 373535

SEQ ID NO: 522827 - RNA, 64 nt, hsa; identical to SEQ ID NO: 373536

SEQ ID NO: 522828 - RNA, 64 nt, hsa; identical to SEQ ID NO: 373537

SEQ ID NO: 522829 - RNA, 64 nt, hsa; identical to SEQ ID NO: 373538

SEQ ID NO: 522830 - RNA, 64 nt, hsa; identical to SEQ ID NO: 373539

SEQ ID NO: 522831 - RNA, 64 nt, hsa; identical to SEQ ID NO: 373540

SEQ ID NO: 522832 - RNA, 64 nt, hsa; identical to SEQ ID NO: 373541

SEQ ID NO: 522833 - RNA, 64 nt, hsa; identical to SEQ ID NO: 373542

SEQ ID NO: 522834 - RNA, 64 nt, hsa; identical to SEQ ID NO: 373543

SEQ ID NO: 522835 - RNA, 64 nt, hsa; identical to SEQ ID NO: 373544

SEQ ID NO: 522836 - RNA, 64 nt, hsa; identical to SEQ ID NO: 373545

SEQ ID NO: 522837 - RNA, 64 nt, hsa; identical to SEQ ID NO: 373546

SEQ ID NO: 522838 - RNA, 64 nt, hsa; identical to SEQ ID NO: 373547

SEQ ID NO: 522839 - RNA, 64 nt, hsa; identical to SEQ ID NO: 373548

SEQ ID NO: 522840 - RNA, 64 nt, hsa; identical to SEQ ID NO: 373549

SEQ ID NO: 522841 - RNA, 64 nt, hsa; identical to SEQ ID NO: 373550

SEQ ID NO: 522842 - RNA, 64 nt, hsa; identical to SEQ ID NO: 373551

SEQ ID NO: 522843 - RNA, 64 nt, hsa; identical to SEQ ID NO: 373552

SEQ ID NO: 522844 - RNA, 64 nt, hsa; identical to SEQ ID NO: 373553

SEQ ID NO: 522845 - RNA, 64 nt, hsa; identical to SEQ ID NO: 373554

SEQ ID NO: 522846 - RNA, 64 nt, hsa; identical to SEQ ID NO: 373555

SEQ ID NO: 522847 - RNA, 64 nt, hsa; identical to SEQ ID NO: 373556

SEQ ID NO: 522848 - RNA, 64 nt, hsa; identical to SEQ ID NO: 373557

SEQ ID NO: 522849 - RNA, 64 nt, hsa; identical to SEQ ID NO: 373558

SEQ ID NO: 522850 - RNA, 64 nt, hsa; identical to SEQ ID NO: 373559

SEQ ID NO: 522851 - RNA, 64 nt, hsa; identical to SEQ ID NO: 373560

SEQ ID NO: 522852 - RNA, 64 nt, hsa; identical to SEQ ID NO: 373561

SEQ ID NO: 522853 - RNA, 64 nt, hsa; identical to SEQ ID NO: 373562

SEQ ID NO: 522854 - RNA, 64 nt, hsa; identical to SEQ ID NO: 373563

SEQ ID NO: 522855 - RNA, 64 nt, hsa; identical to SEQ ID NO: 373564

SEQ ID NO: 522856 - RNA, 64 nt, hsa; identical to SEQ ID NO: 373565

SEQ ID NO: 522857 - RNA, 64 nt, hsa; identical to SEQ ID NO: 373566

SEQ ID NO: 522858 - RNA, 64 nt, hsa; identical to SEQ ID NO: 373567

SEQ ID NO: 522859 - RNA, 64 nt, hsa; identical to SEQ ID NO: 373568

SEQ ID NO: 522860 - RNA, 64 nt, hsa; identical to SEQ ID NO: 373569

SEQ ID NO: 522861 - RNA, 64 nt, hsa; identical to SEQ ID NO: 373570

SEQ ID NO: 522862 - RNA, 64 nt, hsa; identical to SEQ ID NO: 373571

SEQ ID NO: 522863 - RNA, 64 nt, hsa; identical to SEQ ID NO: 373572

SEQ ID NO: 522864 - RNA, 64 nt, hsa; identical to SEQ ID NO: 373573

SEQ ID NO: 522865 - RNA, 64 nt, hsa; identical to SEQ ID NO: 373574

SEQ ID NO: 522866 - RNA, 64 nt, hsa; identical to SEQ ID NO: 373575

SEQ ID NO: 522867 - RNA, 64 nt, hsa; identical to SEQ ID NO: 373576

SEQ ID NO: 522868 - RNA, 64 nt, hsa; identical to SEQ ID NO: 373577

SEQ ID NO: 522869 - RNA, 64 nt, hsa; identical to SEQ ID NO: 373578

SEQ ID NO: 522870 - RNA, 64 nt, hsa; identical to SEQ ID NO: 373579

SEQ ID NO: 522871 - RNA, 64 nt, hsa; identical to SEQ ID NO: 373580

SEQ ID NO: 522872 - RNA, 64 nt, hsa; identical to SEQ ID NO: 373581

SEQ ID NO: 522873 - RNA, 64 nt, hsa; identical to SEQ ID NO: 373582

SEQ ID NO: 522874 - RNA, 64 nt, hsa; identical to SEQ ID NO: 373583

SEQ ID NO: 522875 - RNA, 64 nt, hsa; identical to SEQ ID NO: 373584

SEQ ID NO: 522876 - RNA, 64 nt, hsa; identical to SEQ ID NO: 373585

SEQ ID NO: 522877 - RNA, 64 nt, hsa; identical to SEQ ID NO: 373586

SEQ ID NO: 522878 - RNA, 64 nt, hsa; identical to SEQ ID NO: 373587

SEQ ID NO: 522879 - RNA, 64 nt, hsa; identical to SEQ ID NO: 373588

SEQ ID NO: 522880 - RNA, 64 nt, hsa; identical to SEQ ID NO: 373589

SEQ ID NO: 522881 - RNA, 64 nt, hsa; identical to SEQ ID NO: 373590

SEQ ID NO: 522882 - RNA, 64 nt, hsa; identical to SEQ ID NO: 373591

SEQ ID NO: 522883 - RNA, 64 nt, hsa; identical to SEQ ID NO: 373592

SEQ ID NO: 522884 - RNA, 64 nt, hsa; identical to SEQ ID NO: 373593

SEQ ID NO: 522885 - RNA, 64 nt, hsa; identical to SEQ ID NO: 373594

SEQ ID NO: 522886 - RNA, 64 nt, hsa; identical to SEQ ID NO: 373595

SEQ ID NO: 522887 - RNA, 64 nt, hsa; identical to SEQ ID NO: 373596

SEQ ID NO: 522888 - RNA, 64 nt, hsa; identical to SEQ ID NO: 373597

SEQ ID NO: 522889 - RNA, 64 nt, hsa; identical to SEQ ID NO: 373598

SEQ ID NO: 522890 - RNA, 64 nt, hsa; identical to SEQ ID NO: 373599

SEQ ID NO: 522891 - RNA, 64 nt, hsa; identical to SEQ ID NO: 373600

SEQ ID NO: 522892 - RNA, 64 nt, hsa; identical to SEQ ID NO: 373601

SEQ ID NO: 522893 - RNA, 64 nt, hsa; identical to SEQ ID NO: 373602

SEQ ID NO: 522894 - RNA, 64 nt, hsa; identical to SEQ ID NO: 373603

SEQ ID NO: 522895 - RNA, 64 nt, hsa; identical to SEQ ID NO: 373604

SEQ ID NO: 522896 - RNA, 64 nt, hsa; identical to SEQ ID NO: 373605

SEQ ID NO: 522897 - RNA, 64 nt, hsa; identical to SEQ ID NO: 373606

SEQ ID NO: 522898 - RNA, 64 nt, hsa; identical to SEQ ID NO: 373607

SEQ ID NO: 522899 - RNA, 64 nt, hsa; identical to SEQ ID NO: 373608

SEQ ID NO: 522900 - RNA, 64 nt, hsa; identical to SEQ ID NO: 373609

SEQ ID NO: 522901 - RNA, 64 nt, hsa; identical to SEQ ID NO: 373610

SEQ ID NO: 522902 - RNA, 64 nt, hsa; identical to SEQ ID NO: 373611

SEQ ID NO: 522903 - RNA, 64 nt, hsa; identical to SEQ ID NO: 373612

SEQ ID NO: 522904 - RNA, 64 nt, hsa; identical to SEQ ID NO: 373613

SEQ ID NO: 522905 - RNA, 64 nt, hsa; identical to SEQ ID NO: 373614

SEQ ID NO: 522906 - RNA, 64 nt, hsa; identical to SEQ ID NO: 373615

SEQ ID NO: 522907 - RNA, 64 nt, hsa; identical to SEQ ID NO: 373616

SEQ ID NO: 522908 - RNA, 64 nt, hsa; identical to SEQ ID NO: 373617

SEQ ID NO: 522909 - RNA, 64 nt, hsa; identical to SEQ ID NO: 373618

SEQ ID NO: 522910 - RNA, 64 nt, hsa; identical to SEQ ID NO: 373619

SEQ ID NO: 522911 - RNA, 64 nt, hsa; identical to SEQ ID NO: 373620

SEQ ID NO: 522912 - RNA, 64 nt, hsa; identical to SEQ ID NO: 373621

SEQ ID NO: 522913 - RNA, 64 nt, hsa; identical to SEQ ID NO: 373622

SEQ ID NO: 522914 - RNA, 64 nt, hsa; identical to SEQ ID NO: 373623

SEQ ID NO: 522915 - RNA, 64 nt, hsa; identical to SEQ ID NO: 373624

SEQ ID NO: 522916 - RNA, 64 nt, hsa; identical to SEQ ID NO: 373625

SEQ ID NO: 522917 - RNA, 64 nt, hsa; identical to SEQ ID NO: 373626

SEQ ID NO: 522918 - RNA, 64 nt, hsa; identical to SEQ ID NO: 373627

SEQ ID NO: 522919 - RNA, 64 nt, hsa; identical to SEQ ID NO: 373628

SEQ ID NO: 522920 - RNA, 64 nt, hsa; identical to SEQ ID NO: 373629

SEQ ID NO: 522921 - RNA, 64 nt, hsa; identical to SEQ ID NO: 373630

SEQ ID NO: 522922 - RNA, 64 nt, hsa; identical to SEQ ID NO: 373631

SEQ ID NO: 522923 - RNA, 64 nt, hsa; identical to SEQ ID NO: 373632

SEQ ID NO: 522924 - RNA, 64 nt, hsa; identical to SEQ ID NO: 373633

SEQ ID NO: 522925 - RNA, 64 nt, hsa; identical to SEQ ID NO: 373634

SEQ ID NO: 522926 - RNA, 64 nt, hsa; identical to SEQ ID NO: 373635

SEQ ID NO: 522927 - RNA, 64 nt, hsa; identical to SEQ ID NO: 373636

SEQ ID NO: 522928 - RNA, 64 nt, hsa; identical to SEQ ID NO: 373637

SEQ ID NO: 522929 - RNA, 64 nt, hsa; identical to SEQ ID NO: 373638

SEQ ID NO: 522930 - RNA, 64 nt, hsa; identical to SEQ ID NO: 373639

SEQ ID NO: 522931 - RNA, 64 nt, hsa; identical to SEQ ID NO: 373640

SEQ ID NO: 522932 - RNA, 64 nt, hsa; identical to SEQ ID NO: 373641

SEQ ID NO: 522933 - RNA, 64 nt, hsa; identical to SEQ ID NO: 373642

SEQ ID NO: 522934 - RNA, 64 nt, hsa; identical to SEQ ID NO: 373643

SEQ ID NO: 522935 - RNA, 64 nt, hsa; identical to SEQ ID NO: 373644

SEQ ID NO: 522936 - RNA, 64 nt, hsa; identical to SEQ ID NO: 373645

SEQ ID NO: 522937 - RNA, 64 nt, hsa; identical to SEQ ID NO: 373646

SEQ ID NO: 522938 - RNA, 64 nt, hsa; identical to SEQ ID NO: 373647

SEQ ID NO: 522939 - RNA, 64 nt, hsa; identical to SEQ ID NO: 373648

SEQ ID NO: 522940 - RNA, 64 nt, hsa; identical to SEQ ID NO: 373649

SEQ ID NO: 522941 - RNA, 64 nt, hsa; identical to SEQ ID NO: 373650

SEQ ID NO: 522942 - RNA, 64 nt, hsa; identical to SEQ ID NO: 373651

SEQ ID NO: 522943 - RNA, 64 nt, hsa; identical to SEQ ID NO: 373652

SEQ ID NO: 522944 - RNA, 64 nt, hsa; identical to SEQ ID NO: 373653

SEQ ID NO: 522945 - RNA, 64 nt, hsa; identical to SEQ ID NO: 373654

SEQ ID NO: 522946 - RNA, 64 nt, hsa; identical to SEQ ID NO: 373655

SEQ ID NO: 522947 - RNA, 64 nt, hsa; identical to SEQ ID NO: 373656

SEQ ID NO: 522948 - RNA, 64 nt, hsa; identical to SEQ ID NO: 373657

SEQ ID NO: 522949 - RNA, 64 nt, hsa; identical to SEQ ID NO: 373658

SEQ ID NO: 522950 - RNA, 64 nt, hsa; identical to SEQ ID NO: 373659

SEQ ID NO: 522951 - RNA, 64 nt, hsa; identical to SEQ ID NO: 373660

SEQ ID NO: 522952 - RNA, 64 nt, hsa; identical to SEQ ID NO: 373661

SEQ ID NO: 522953 - RNA, 63 nt, hsa
gaauuaaagcagagagaagccauucgugaugcuuagaaccaaggauggucauguacacaaaga

SEQ ID NO: 522954 - RNA, 63 nt, hsa
gcagacauguuuacuaaugaucauagccaggauuagaaccacuuucaaacauuggggccuucu

SEQ ID NO: 522955 - RNA, 63 nt, hsa
guggcuacuguauugacauucugggucuaggacuagaaccaguggucuguaacaaaaguacuu

SEQ ID NO: 522956 - RNA, 63 nt, hsa
uauuuaaauacuggggaaauugcuucacugucuuagaaccaagcaagauucaccuguguuuug

SEQ ID NO: 522957 - RNA, 63 nt, hsa
uugaauuuccaaaauagucaguaaaggaucuaauagaaccagaauuauuugggugaauucugc

SEQ ID NO: 522958 - RNA, 63 nt, hsa
gguauuuugguguucacuuacgaagcauacaacuagaaccauauccaagcagacucuggguug

SEQ ID NO: 522959 - RNA, 63 nt, hsa
caccuguccuuuccauagcccuuuuuggaccuuuagaaccacagaugauaggaccagcccaau

SEQ ID NO: 522960 - RNA, 63 nt, hsa
cuuuucaguuacagaguccaguggaccauuuuguagaaccaugcagcucccugcggaaggugg

SEQ ID NO: 522961 - RNA, 64 nt, hsa; identical to SEQ ID NO: 348295

SEQ ID NO: 522962 - RNA, 64 nt, hsa; identical to SEQ ID NO: 348296

SEQ ID NO: 522963 - RNA, 64 nt, hsa; identical to SEQ ID NO: 348297

SEQ ID NO: 522964 - RNA, 64 nt, hsa; identical to SEQ ID NO: 348298

SEQ ID NO: 522965 - RNA, 64 nt, hsa; identical to SEQ ID NO: 348299

SEQ ID NO: 522966 - RNA, 64 nt, hsa; identical to SEQ ID NO: 348300

SEQ ID NO: 522967 - RNA, 64 nt, hsa; identical to SEQ ID NO: 348301

SEQ ID NO: 522968 - RNA, 64 nt, hsa; identical to SEQ ID NO: 348302

SEQ ID NO: 522969 - RNA, 64 nt, hsa; identical to SEQ ID NO: 348303

SEQ ID NO: 522970 - RNA, 64 nt, hsa; identical to SEQ ID NO: 348304

SEQ ID NO: 522971 - RNA, 64 nt, hsa; identical to SEQ ID NO: 348305

SEQ ID NO: 522972 - RNA, 64 nt, hsa; identical to SEQ ID NO: 348306

SEQ ID NO: 522973 - RNA, 64 nt, hsa; identical to SEQ ID NO: 348307

SEQ ID NO: 522974 - RNA, 64 nt, hsa; identical to SEQ ID NO: 348308

SEQ ID NO: 522975 - RNA, 64 nt, hsa; identical to SEQ ID NO: 348309

SEQ ID NO: 522976 - RNA, 64 nt, hsa; identical to SEQ ID NO: 348310

SEQ ID NO: 522977 - RNA, 64 nt, hsa; identical to SEQ ID NO: 348311

SEQ ID NO: 522978 - RNA, 64 nt, hsa; identical to SEQ ID NO: 348312

SEQ ID NO: 522979 - RNA, 64 nt, hsa; identical to SEQ ID NO: 348313

SEQ ID NO: 522980 - RNA, 64 nt, hsa; identical to SEQ ID NO: 348314

SEQ ID NO: 522981 - RNA, 64 nt, hsa; identical to SEQ ID NO: 348315

SEQ ID NO: 522982 - RNA, 64 nt, hsa; identical to SEQ ID NO: 348316

SEQ ID NO: 522983 - RNA, 64 nt, hsa; identical to SEQ ID NO: 348317

SEQ ID NO: 522984 - RNA, 64 nt, hsa; identical to SEQ ID NO: 348318

SEQ ID NO: 522985 - RNA, 64 nt, hsa; identical to SEQ ID NO: 348319

SEQ ID NO: 522986 - RNA, 64 nt, hsa; identical to SEQ ID NO: 348320

SEQ ID NO: 522987 - RNA, 64 nt, hsa; identical to SEQ ID NO: 348321

SEQ ID NO: 522988 - RNA, 64 nt, hsa; identical to SEQ ID NO: 348322

SEQ ID NO: 522989 - RNA, 64 nt, hsa; identical to SEQ ID NO: 348323

SEQ ID NO: 522990 - RNA, 64 nt, hsa; identical to SEQ ID NO: 348324

SEQ ID NO: 522991 - RNA, 64 nt, hsa; identical to SEQ ID NO: 348325

SEQ ID NO: 522992 - RNA, 64 nt, hsa; identical to SEQ ID NO: 348326

SEQ ID NO: 522993 - RNA, 64 nt, hsa; identical to SEQ ID NO: 348327

SEQ ID NO: 522994 - RNA, 64 nt, hsa; identical to SEQ ID NO: 348328

SEQ ID NO: 522995 - RNA, 50 nt, hsa; identical to SEQ ID NO: 348329

SEQ ID NO: 522996 - RNA, 64 nt, hsa; identical to SEQ ID NO: 348330

SEQ ID NO: 522997 - RNA, 64 nt, hsa; identical to SEQ ID NO: 348331

SEQ ID NO: 522998 - RNA, 64 nt, hsa; identical to SEQ ID NO: 348332

SEQ ID NO: 522999 - RNA, 64 nt, hsa; identical to SEQ ID NO: 348333

SEQ ID NO: 523000 - RNA, 64 nt, hsa; identical to SEQ ID NO: 348334

SEQ ID NO: 523001 - RNA, 64 nt, hsa; identical to SEQ ID NO: 348335

SEQ ID NO: 523002 - RNA, 64 nt, hsa
cacagcuauucauaaccuauauucuagaguagacaaucuggacuauguaauaaauagucugcug

SEQ ID NO: 523003 - RNA, 64 nt, hsa
gucaaguaugaauaaagguguggcagaauauaauaaucuggacuauuuucuauaggauaauugc

SEQ ID NO: 523004 - RNA, 64 nt, hsa
gggcauuauuaauaauuaucuuguaaugaacuuaaaucuggacuguuccaggcaaaccagacuu

SEQ ID NO: 523005 - RNA, 64 nt, hsa
ugcuguacaaaggcaacagcaacuuaaaaaagaaaaucuggacaauagauguggacuccaaggg

SEQ ID NO: 523006 - RNA, 64 nt, hsa
gguuauucccugcaccucgaggccgcugcgggccaaucuggagugaaacacggggaccugaagg

SEQ ID NO: 523007 - RNA, 64 nt, hsa
ugcucuggugugggaaugcaggccuaaugacagaaaucuggagaagccagaaauacagauuugu

SEQ ID NO: 523008 - RNA, 64 nt, hsa
uauuauaaaggagaaagaagauacaagguggggaaaucuggaaaaagauuucagacauuaggcu

SEQ ID NO: 523009 - RNA, 64 nt, hsa
auuauuuugagaggugggugauaugugagagagaaaucuggaaccuucuucuggguagauacag

SEQ ID NO: 523010 - RNA, 64 nt, hsa
uuuuuauuauuuaugccacgucaguggggcaagaaaucuggagugagugaagaaagcuaaguug

SEQ ID NO: 523011 - RNA, 64 nt, hsa
uggaaucaggaagaaaagcuauguucauacucuaaaucuggauauuaaaauuggaagagacuuc

SEQ ID NO: 523012 - RNA, 64 nt, hsa
auguuuauaucugcaaaaaaccuaauagcuaauuaaucuggaauaugcaacauuguccuuaauu

SEQ ID NO: 523013 - RNA, 64 nt, hsa
uaguuaugugaagucaccaagguucuugaccgugaaucuggagccguuugaguucacaagaguc

SEQ ID NO: 523014 - RNA, 64 nt, hsa
gcaaaagcuaagccuggauugcagggcaggaaaaaaucuggaauuaacuuuagccaguggaauu

SEQ ID NO: 523015 - RNA, 64 nt, hsa
gcaaaaggucagccuugggguuggccguuccucuaaucuggacuugcuugcaaaggugccaggc

SEQ ID NO: 523016 - RNA, 64 nt, hsa
cuagaagcuggaggacuagaaccuggagggcuggaaucuggagagcuagaaccuggagggcuag

SEQ ID NO: 523017 - RNA, 64 nt, hsa
cuagaaccuggagggcuagaaccuggagggcuagaaucuggagagcuagaaccuggagggcuag

SEQ ID NO: 523018 - RNA, 64 nt, hsa
cuagaaucuggagagcuagaaccuggagggcuagaaucuggagagcuagaaccuggagggcuag

SEQ ID NO: 523019 - RNA, 64 nt, hsa
uagaaccuagaagggcuagaaccuggagggcuggaaucuggagagcuagaaccuggagggcuag

SEQ ID NO: 523020 - RNA, 64 nt, hsa; identical to SEQ ID NO: 523019

SEQ ID NO: 523021 - RNA, 63 nt, hsa
gaauuuugauugccuuuaaaguuacuauucuguaucauugauucaucaagaaaaccuagaucu

SEQ ID NO: 523022 - RNA, 63 nt, hsa
gaaaaccuagaucugcacucaccucacuguucaaucauugagugguaaaggacagaaguauuu

SEQ ID NO: 523023 - RNA, 63 nt, hsa
auuucuaugauccuuuuuugucauuuuaugaauaucauugauuuuauaauuggugcuauuuga

SEQ ID NO: 523024 - RNA, 63 nt, hsa
acccuggugguauuuuauuuuggcuucauuucaaucauugaaguauauucuuauuggaaaugu

SEQ ID NO: 523025 - RNA, 63 nt, hsa
uugcuaaaauaccccucacagcuagucauccauaucauugaagcgcucaugauuugauagauu

SEQ ID NO: 523026 - RNA, 63 nt, hsa
uauucugccaaaccaaucauguuauuguuuuuaaucauugaaucauuggaucuuuaaauagga

SEQ ID NO: 523027 - RNA, 63 nt, hsa
uuuguagcuuucagagugucucauugagucuagaucauugaaccaacacuuaaccaaaugucc

SEQ ID NO: 523028 - RNA, 63 nt, hsa
uuucauauaccucuaacccccgguacucauugaaucauugaugagguaucucaauugagauuu

SEQ ID NO: 523029 - RNA, 63 nt, hsa
cauugggauggaaggaucauugauugggugaagaucauugauuaggugaaggauuauuucuau

SEQ ID NO: 523030 - RNA, 63 nt, hsa
gugcuuucuuggaaagaucauugggauggaaggaucauugauugggugaagaucauugauuag

SEQ ID NO: 523031 - RNA, 64 nt, hsa; identical to SEQ ID NO: 285262

SEQ ID NO: 523032 - RNA, 64 nt, hsa; identical to SEQ ID NO: 285263

SEQ ID NO: 523033 - RNA, 64 nt, hsa; identical to SEQ ID NO: 285264

SEQ ID NO: 523034 - RNA, 64 nt, hsa; identical to SEQ ID NO: 285265

SEQ ID NO: 523035 - RNA, 64 nt, hsa; identical to SEQ ID NO: 285266

SEQ ID NO: 523036 - RNA, 64 nt, hsa; identical to SEQ ID NO: 285267

SEQ ID NO: 523037 - RNA, 64 nt, hsa; identical to SEQ ID NO: 285268

SEQ ID NO: 523038 - RNA, 64 nt, hsa; identical to SEQ ID NO: 285269

SEQ ID NO: 523039 - RNA, 64 nt, hsa; identical to SEQ ID NO: 285270

SEQ ID NO: 523040 - RNA, 64 nt, hsa; identical to SEQ ID NO: 285271

SEQ ID NO: 523041 - RNA, 64 nt, hsa; identical to SEQ ID NO: 285272

SEQ ID NO: 523042 - RNA, 64 nt, hsa; identical to SEQ ID NO: 285273

SEQ ID NO: 523043 - RNA, 64 nt, hsa; identical to SEQ ID NO: 285274

SEQ ID NO: 523044 - RNA, 64 nt, hsa; identical to SEQ ID NO: 285275

SEQ ID NO: 523045 - RNA, 64 nt, hsa; identical to SEQ ID NO: 285276

SEQ ID NO: 523046 - RNA, 64 nt, hsa; identical to SEQ ID NO: 285277

SEQ ID NO: 523047 - RNA, 64 nt, hsa; identical to SEQ ID NO: 285278

SEQ ID NO: 523048 - RNA, 64 nt, hsa; identical to SEQ ID NO: 285279

SEQ ID NO: 523049 - RNA, 64 nt, hsa; identical to SEQ ID NO: 285280

SEQ ID NO: 523050 - RNA, 64 nt, hsa; identical to SEQ ID NO: 285281

SEQ ID NO: 523051 - RNA, 64 nt, hsa; identical to SEQ ID NO: 285282

SEQ ID NO: 523052 - RNA, 64 nt, hsa; identical to SEQ ID NO: 285283

SEQ ID NO: 523053 - RNA, 64 nt, hsa; identical to SEQ ID NO: 285284

SEQ ID NO: 523054 - RNA, 64 nt, hsa; identical to SEQ ID NO: 285285

SEQ ID NO: 523055 - RNA, 64 nt, hsa; identical to SEQ ID NO: 285286

SEQ ID NO: 523056 - RNA, 64 nt, hsa; identical to SEQ ID NO: 285287

SEQ ID NO: 523057 - RNA, 64 nt, hsa; identical to SEQ ID NO: 285288

SEQ ID NO: 523058 - RNA, 64 nt, hsa; identical to SEQ ID NO: 285289

SEQ ID NO: 523059 - RNA, 64 nt, hsa; identical to SEQ ID NO: 285290

SEQ ID NO: 523060 - RNA, 61 nt, hsa; identical to SEQ ID NO: 285291

SEQ ID NO: 523061 - RNA, 64 nt, hsa; identical to SEQ ID NO: 285292

SEQ ID NO: 523062 - RNA, 64 nt, hsa; identical to SEQ ID NO: 285293

SEQ ID NO: 523063 - RNA, 64 nt, hsa; identical to SEQ ID NO: 285294

SEQ ID NO: 523064 - RNA, 64 nt, hsa; identical to SEQ ID NO: 285295

SEQ ID NO: 523065 - RNA, 64 nt, hsa; identical to SEQ ID NO: 285296

SEQ ID NO: 523066 - RNA, 64 nt, hsa; identical to SEQ ID NO: 285297

SEQ ID NO: 523067 - RNA, 64 nt, hsa; identical to SEQ ID NO: 285298

SEQ ID NO: 523068 - RNA, 64 nt, hsa; identical to SEQ ID NO: 285299

SEQ ID NO: 523069 - RNA, 64 nt, hsa; identical to SEQ ID NO: 285300

SEQ ID NO: 523070 - RNA, 64 nt, hsa
cauuuugaaggcugucuacacuuaagaagucuuagcugucuaauuuuuagagaauaagauuguu

SEQ ID NO: 523071 - RNA, 64 nt, hsa
uuuuuaccaagcauuuucagccuccauuuugaaggcugucuacacuuaagaagucuuagcuguc

SEQ ID NO: 523072 - RNA, 64 nt, hsa; identical to SEQ ID NO: 109963

SEQ ID NO: 523073 - RNA, 64 nt, hsa; identical to SEQ ID NO: 109964

SEQ ID NO: 523074 - RNA, 64 nt, hsa; identical to SEQ ID NO: 109965

SEQ ID NO: 523075 - RNA, 64 nt, hsa; identical to SEQ ID NO: 109966

SEQ ID NO: 523076 - RNA, 64 nt, hsa; identical to SEQ ID NO: 109967

SEQ ID NO: 523077 - RNA, 64 nt, hsa; identical to SEQ ID NO: 109968

SEQ ID NO: 523078 - RNA, 64 nt, hsa; identical to SEQ ID NO: 109969

SEQ ID NO: 523079 - RNA, 64 nt, hsa; identical to SEQ ID NO: 109970

SEQ ID NO: 523080 - RNA, 64 nt, hsa; identical to SEQ ID NO: 109971

SEQ ID NO: 523081 - RNA, 64 nt, hsa; identical to SEQ ID NO: 109972

SEQ ID NO: 523082 - RNA, 64 nt, hsa; identical to SEQ ID NO: 109973

SEQ ID NO: 523083 - RNA, 64 nt, hsa; identical to SEQ ID NO: 109974

SEQ ID NO: 523084 - RNA, 64 nt, hsa; identical to SEQ ID NO: 109975

SEQ ID NO: 523085 - RNA, 64 nt, hsa; identical to SEQ ID NO: 109976

SEQ ID NO: 523086 - RNA, 64 nt, hsa; identical to SEQ ID NO: 109977

SEQ ID NO: 523087 - RNA, 64 nt, hsa; identical to SEQ ID NO: 109978

SEQ ID NO: 523088 - RNA, 64 nt, hsa; identical to SEQ ID NO: 109979

SEQ ID NO: 523089 - RNA, 64 nt, hsa; identical to SEQ ID NO: 109980

SEQ ID NO: 523090 - RNA, 64 nt, hsa; identical to SEQ ID NO: 109981

SEQ ID NO: 523091 - RNA, 64 nt, hsa; identical to SEQ ID NO: 109982

SEQ ID NO: 523092 - RNA, 64 nt, hsa; identical to SEQ ID NO: 109983

SEQ ID NO: 523093 - RNA, 64 nt, hsa; identical to SEQ ID NO: 109984

SEQ ID NO: 523094 - RNA, 64 nt, hsa; identical to SEQ ID NO: 109985

SEQ ID NO: 523095 - RNA, 64 nt, hsa; identical to SEQ ID NO: 109986

SEQ ID NO: 523096 - RNA, 64 nt, hsa; identical to SEQ ID NO: 109987

SEQ ID NO: 523097 - RNA, 64 nt, hsa; identical to SEQ ID NO: 109988

SEQ ID NO: 523098 - RNA, 64 nt, hsa; identical to SEQ ID NO: 109989

SEQ ID NO: 523099 - RNA, 64 nt, hsa; identical to SEQ ID NO: 109990

SEQ ID NO: 523100 - RNA, 64 nt, hsa; identical to SEQ ID NO: 109991

SEQ ID NO: 523101 - RNA, 52 nt, hsa; identical to SEQ ID NO: 109992

SEQ ID NO: 523102 - RNA, 64 nt, hsa; identical to SEQ ID NO: 109993

SEQ ID NO: 523103 - RNA, 64 nt, hsa; identical to SEQ ID NO: 109994

SEQ ID NO: 523104 - RNA, 64 nt, hsa; identical to SEQ ID NO: 109995

SEQ ID NO: 523105 - RNA, 64 nt, hsa; identical to SEQ ID NO: 109996

SEQ ID NO: 523106 - RNA, 64 nt, hsa; identical to SEQ ID NO: 109997

SEQ ID NO: 523107 - RNA, 64 nt, hsa; identical to SEQ ID NO: 109998

SEQ ID NO: 523108 - RNA, 64 nt, hsa; identical to SEQ ID NO: 109999

SEQ ID NO: 523109 - RNA, 64 nt, hsa; identical to SEQ ID NO: 110000

SEQ ID NO: 523110 - RNA, 63 nt, hsa
gucagaguuacucaucccuuuucaaagaauuguggguggaaguuuguaaaggccauucauuug

SEQ ID NO: 523111 - RNA, 63 nt, hsa
gggaaacuugggaauagcuauaaaguaaaacuuggguggaaccuggggcccuggcaucacaca

SEQ ID NO: 523112 - RNA, 63 nt, hsa
uuucacuagauuuggaaagaagaaagaggauaaggguggaaaggcugagcagaaagguacucu

SEQ ID NO: 523113 - RNA, 63 nt, hsa
uccacugguuccagcugacaguggccguccuacggguggaagcacugaccguauccagaaguu

SEQ ID NO: 523114 - RNA, 63 nt, hsa
gaauaugaauauuguggagucuguccagauaccggguggaagacugguuuugaucaguuuaag

SEQ ID NO: 523115 - RNA, 63 nt, hsa
uuuggacaauaaagaaucuaaaauggguggggaggguggaagaaaugguggacuguaucucuc

SEQ ID NO: 523116 - RNA, 63 nt, hsa
gggugcuugggugaucucugcuucauuagucauggguggaagaaaaaccacaccccccgcacc

SEQ ID NO: 523117 - RNA, 63 nt, hsa
aaauuggggguuuaaacauuaaguaggagcuugggguggaagagggacagccggcugggccac

SEQ ID NO: 523118 - RNA, 63 nt, hsa
aacccagagccacccgcuaugagcacaggccggggguggaaggcccaguagagcugcccuucc

SEQ ID NO: 523119 - RNA, 63 nt, hsa
gggaauucauaugaucugccagagccucuccagggguggaauacauguccuggacuaagccaa

SEQ ID NO: 523120 - RNA, 63 nt, hsa
uguccccauucucauggcccuuuggucacugccggguggaauagcacuggcuucagcaggcgu

SEQ ID NO: 523121 - RNA, 63 nt, hsa
agaaggugggcuagggccuccugcaggguugugggguggaacagggucuccucuccccagcca

SEQ ID NO: 523122 - RNA, 63 nt, hsa
cugcaugucgggcuuaaggucaccagccgggcaggguggaaggagcuugccucuuugagaaac

SEQ ID NO: 523123 - RNA, 63 nt, hsa
gggcaauugucagucuuuuuagagaaggggccaggguggaacaaucccagugaguaaauuauu

SEQ ID NO: 523124 - RNA, 63 nt, hsa
cugggaccgcgguggguggaaucccaaggcuggggguggaaggagcagggcucuggagggauu

SEQ ID NO: 523125 - RNA, 63 nt, hsa
caggaggucuucagaguuuccugggaccgcgguggguggaaucccaaggcuggggguggaagg

SEQ ID NO: 523126 - RNA, 64 nt, hsa
ccuauuucucaauagucuuuaaacccuaaaucugagucaguaauucucuuacauccuucccaaa

SEQ ID NO: 523127 - RNA, 64 nt, hsa
ccuauuucucaauagucuuuaagcccuaaaucugagucaguaauucucuaaaaauccuucccaa

SEQ ID NO: 523128 - RNA, 64 nt, hsa; identical to SEQ ID NO: 114632

SEQ ID NO: 523129 - RNA, 64 nt, hsa; identical to SEQ ID NO: 114633

SEQ ID NO: 523130 - RNA, 64 nt, hsa; identical to SEQ ID NO: 114632

SEQ ID NO: 523131 - RNA, 64 nt, hsa; identical to SEQ ID NO: 114633

SEQ ID NO: 523132 - RNA, 64 nt, hsa; identical to SEQ ID NO: 114636

SEQ ID NO: 523133 - RNA, 64 nt, hsa; identical to SEQ ID NO: 114637

SEQ ID NO: 523134 - RNA, 64 nt, hsa; identical to SEQ ID NO: 114638

SEQ ID NO: 523135 - RNA, 64 nt, hsa; identical to SEQ ID NO: 114639

SEQ ID NO: 523136 - RNA, 64 nt, hsa; identical to SEQ ID NO: 114640

SEQ ID NO: 523137 - RNA, 64 nt, hsa; identical to SEQ ID NO: 114641

SEQ ID NO: 523138 - RNA, 64 nt, hsa; identical to SEQ ID NO: 114642

SEQ ID NO: 523139 - RNA, 64 nt, hsa; identical to SEQ ID NO: 114643

SEQ ID NO: 523140 - RNA, 64 nt, hsa; identical to SEQ ID NO: 114644

SEQ ID NO: 523141 - RNA, 64 nt, hsa; identical to SEQ ID NO: 114645

SEQ ID NO: 523142 - RNA, 64 nt, hsa; identical to SEQ ID NO: 114646

SEQ ID NO: 523143 - RNA, 64 nt, hsa; identical to SEQ ID NO: 114647

SEQ ID NO: 523144 - RNA, 64 nt, hsa; identical to SEQ ID NO: 114648

SEQ ID NO: 523145 - RNA, 64 nt, hsa; identical to SEQ ID NO: 114649

SEQ ID NO: 523146 - RNA, 64 nt, hsa; identical to SEQ ID NO: 114650

SEQ ID NO: 523147 - RNA, 64 nt, hsa; identical to SEQ ID NO: 114651

SEQ ID NO: 523148 - RNA, 64 nt, hsa; identical to SEQ ID NO: 114652

SEQ ID NO: 523149 - RNA, 64 nt, hsa; identical to SEQ ID NO: 114653

SEQ ID NO: 523150 - RNA, 64 nt, hsa; identical to SEQ ID NO: 114654

SEQ ID NO: 523151 - RNA, 64 nt, hsa; identical to SEQ ID NO: 114655

SEQ ID NO: 523152 - RNA, 64 nt, hsa; identical to SEQ ID NO: 114656

SEQ ID NO: 523153 - RNA, 64 nt, hsa; identical to SEQ ID NO: 114657

SEQ ID NO: 523154 - RNA, 64 nt, hsa; identical to SEQ ID NO: 114658

SEQ ID NO: 523155 - RNA, 64 nt, hsa; identical to SEQ ID NO: 114659

SEQ ID NO: 523156 - RNA, 64 nt, hsa; identical to SEQ ID NO: 114660

SEQ ID NO: 523157 - RNA, 64 nt, hsa; identical to SEQ ID NO: 114661

SEQ ID NO: 523158 - RNA, 64 nt, hsa; identical to SEQ ID NO: 114662

SEQ ID NO: 523159 - RNA, 64 nt, hsa; identical to SEQ ID NO: 114663

SEQ ID NO: 523160 - RNA, 64 nt, hsa; identical to SEQ ID NO: 114664

SEQ ID NO: 523161 - RNA, 64 nt, hsa; identical to SEQ ID NO: 114665

SEQ ID NO: 523162 - RNA, 64 nt, hsa; identical to SEQ ID NO: 114666

SEQ ID NO: 523163 - RNA, 64 nt, hsa; identical to SEQ ID NO: 114667

SEQ ID NO: 523164 - RNA, 64 nt, hsa; identical to SEQ ID NO: 114668

SEQ ID NO: 523165 - RNA, 64 nt, hsa; identical to SEQ ID NO: 114669

SEQ ID NO: 523166 - RNA, 64 nt, hsa; identical to SEQ ID NO: 114670

SEQ ID NO: 523167 - RNA, 64 nt, hsa; identical to SEQ ID NO: 114671

SEQ ID NO: 523168 - RNA, 64 nt, hsa; identical to SEQ ID NO: 114672

SEQ ID NO: 523169 - RNA, 64 nt, hsa; identical to SEQ ID NO: 114673

SEQ ID NO: 523170 - RNA, 64 nt, hsa; identical to SEQ ID NO: 114674

SEQ ID NO: 523171 - RNA, 64 nt, hsa; identical to SEQ ID NO: 114675

SEQ ID NO: 523172 - RNA, 64 nt, hsa; identical to SEQ ID NO: 114676

SEQ ID NO: 523173 - RNA, 64 nt, hsa; identical to SEQ ID NO: 114677

SEQ ID NO: 523174 - RNA, 64 nt, hsa; identical to SEQ ID NO: 114678

SEQ ID NO: 523175 - RNA, 64 nt, hsa; identical to SEQ ID NO: 114679

SEQ ID NO: 523176 - RNA, 64 nt, hsa; identical to SEQ ID NO: 114680

SEQ ID NO: 523177 - RNA, 64 nt, hsa; identical to SEQ ID NO: 114681

SEQ ID NO: 523178 - RNA, 64 nt, hsa; identical to SEQ ID NO: 114682

SEQ ID NO: 523179 - RNA, 64 nt, hsa; identical to SEQ ID NO: 114683

SEQ ID NO: 523180 - RNA, 64 nt, hsa; identical to SEQ ID NO: 114684

SEQ ID NO: 523181 - RNA, 64 nt, hsa; identical to SEQ ID NO: 114685

SEQ ID NO: 523182 - RNA, 64 nt, hsa; identical to SEQ ID NO: 114686

SEQ ID NO: 523183 - RNA, 64 nt, hsa; identical to SEQ ID NO: 114687

SEQ ID NO: 523184 - RNA, 64 nt, hsa; identical to SEQ ID NO: 114688

SEQ ID NO: 523185 - RNA, 64 nt, hsa; identical to SEQ ID NO: 114689

SEQ ID NO: 523186 - RNA, 64 nt, hsa; identical to SEQ ID NO: 114690

SEQ ID NO: 523187 - RNA, 64 nt, hsa; identical to SEQ ID NO: 114691

SEQ ID NO: 523188 - RNA, 64 nt, hsa; identical to SEQ ID NO: 196427

SEQ ID NO: 523189 - RNA, 64 nt, hsa; identical to SEQ ID NO: 196428

SEQ ID NO: 523190 - RNA, 64 nt, hsa; identical to SEQ ID NO: 196429

SEQ ID NO: 523191 - RNA, 64 nt, hsa; identical to SEQ ID NO: 196430

SEQ ID NO: 523192 - RNA, 64 nt, hsa; identical to SEQ ID NO: 196431

SEQ ID NO: 523193 - RNA, 64 nt, hsa; identical to SEQ ID NO: 196432

SEQ ID NO: 523194 - RNA, 64 nt, hsa; identical to SEQ ID NO: 196433

SEQ ID NO: 523195 - RNA, 64 nt, hsa; identical to SEQ ID NO: 196434

SEQ ID NO: 523196 - RNA, 64 nt, hsa; identical to SEQ ID NO: 196435

SEQ ID NO: 523197 - RNA, 64 nt, hsa; identical to SEQ ID NO: 196436

SEQ ID NO: 523198 - RNA, 64 nt, hsa; identical to SEQ ID NO: 196437

SEQ ID NO: 523199 - RNA, 64 nt, hsa; identical to SEQ ID NO: 196438

SEQ ID NO: 523200 - RNA, 64 nt, hsa; identical to SEQ ID NO: 196439

SEQ ID NO: 523201 - RNA, 64 nt, hsa; identical to SEQ ID NO: 196440

SEQ ID NO: 523202 - RNA, 64 nt, hsa; identical to SEQ ID NO: 196441

SEQ ID NO: 523203 - RNA, 57 nt, hsa; identical to SEQ ID NO: 196442

SEQ ID NO: 523204 - RNA, 64 nt, hsa; identical to SEQ ID NO: 196443

SEQ ID NO: 523205 - RNA, 64 nt, hsa; identical to SEQ ID NO: 196444

SEQ ID NO: 523206 - RNA, 64 nt, hsa; identical to SEQ ID NO: 196445

SEQ ID NO: 523207 - RNA, 64 nt, hsa; identical to SEQ ID NO: 196446

SEQ ID NO: 523208 - RNA, 64 nt, hsa; identical to SEQ ID NO: 196447

SEQ ID NO: 523209 - RNA, 64 nt, hsa
ccagagccuuguggcuuguacaguuuugaaacucccguucuauuuuaugaugguugauaauagu

SEQ ID NO: 523210 - RNA, 64 nt, hsa
gcuguggcccugagacugcaucggaggcggcgccccguucuagggccguggccuuugccgagac

SEQ ID NO: 523211 - RNA, 64 nt, hsa
gccugccccgccacgcuccugggccaacucugcaccguucuaggugccgauggcugccuccggc

SEQ ID NO: 523212 - RNA, 64 nt, hsa
cuggcccuguuaagacggcuuaaccacugagaucccguucuauugauuuaauaaagucaaacua

SEQ ID NO: 523213 - RNA, 64 nt, hsa
uuuggacuuucaucauaagaagugucuggaauacccguucuauguaauaucaacagaaccuugu

SEQ ID NO: 523214 - RNA, 64 nt, hsa
uuuuauaacuugcauuacauguuguaagcaugguccguucuauaccuuuuucuggucauaauga

SEQ ID NO: 523215 - RNA, 64 nt, hsa
ccucuugguuuugauacuuuaaaaucuguggcacccguucuacaugaauuaucaauauuuggua

SEQ ID NO: 523216 - RNA, 64 nt, hsa
gacaauuccuuugcauaucugaacuuggcagguaccguucuaaaucugaaacagggugauagcu

SEQ ID NO: 523217 - RNA, 64 nt, hsa
agugauuccugaggaaguauuccagaugcacaagccguucuaccagucccucuuugccuuggcc

SEQ ID NO: 523218 - RNA, 64 nt, hsa
gggccaagggcacagguuacggggguucuugcugccguucuaauauuuuuuuaagcauagacag

SEQ ID NO: 523219 - RNA, 64 nt, hsa
ucugugugacaguuaacugccauuaauuaauuagccguucuaaaaguuuauuuacaauaucaaa

SEQ ID NO: 523220 - RNA, 64 nt, hsa
ggcuugcacucaggagagaaccacccccaagucuccguucuacugccgugaacucauguguugc

SEQ ID NO: 523221 - RNA, 64 nt, hsa
uagucauacuuuauauucaauugauauauaauaaccguucuaaccucuuccaggaaaauauuuu

SEQ ID NO: 523222 - RNA, 64 nt, hsa
caguuucaaaauuugauucaguuuauguuuuauuccguucuaaaauauuggagaugaggaaaau

SEQ ID NO: 523223 - RNA, 64 nt, hsa
gaaagaaaggacagcagucaccuccgacaaugcuccguucuauggaauauugauuaacugcauu

SEQ ID NO: 523224 - RNA, 64 nt, hsa
acugccuccccagucaccaagggccccagcuggcccguucuacucaccuaagugccgccugacc

SEQ ID NO: 523225 - RNA, 64 nt, hsa
gacugaguagaugaauuauugaaugugagauaauccguucuagagaauaacuaugaaagcuugc

SEQ ID NO: 523226 - RNA, 64 nt, hsa
auacuugugaaaucgugcaugaggccccagggcaccguucuagaacaacgucacuucacacagg

SEQ ID NO: 523227 - RNA, 64 nt, hsa
ccaugccaaacgcauucacucggggcaguauuaaccguucuagaaagccacuguuuuauagcaa

SEQ ID NO: 523228 - RNA, 64 nt, hsa
ccaguggaagaccccagcccccagggagaggaacccguucuauccccagccaugauaauaaagc

SEQ ID NO: 523229 - RNA, 64 nt, hsa
aggacuuaccauccacaaugcaccacggaagaggccguucuaugaaaaacugacacagacugua

SEQ ID NO: 523230 - RNA, 64 nt, hsa
aaaagcaauucugacuguccaggagcuaaucugaccguucuauuguguggaugaccacauaaga

SEQ ID NO: 523231 - RNA, 64 nt, hsa
agcauuuuuuccuguuaacuuuauauuacaaaauccguucuaccauaacaauacagaggaacua

SEQ ID NO: 523232 - RNA, 64 nt, hsa
auuuucuacccacuucuuaauauugacagcuuccccguucuauuuaauguccaaaaauguuucc

SEQ ID NO: 523233 - RNA, 64 nt, hsa
guaagagucuuguuuuuuauucagauugggaaauccguucuauuuugugaauuugggacauaau

SEQ ID NO: 523234 - RNA, 64 nt, hsa
caguugcuuccucccaugagccaagguggugucagagggcaacuggaugacucgcaguaccaca

SEQ ID NO: 523235 - RNA, 64 nt, hsa
ggaaggaagacaaagaagguaggaacggaauuuugagggcaaagaaaccuguguuuccauggaa

SEQ ID NO: 523236 - RNA, 64 nt, hsa
cugguuuuuuagggagaugguauccccuggaguagagggcaagaggagagagcgccuccagucu

SEQ ID NO: 523237 - RNA, 64 nt, hsa
ccuuggguaagucgcgccugacccaggcugcuaagagggcaaggagaaggaaguacccugggga

SEQ ID NO: 523238 - RNA, 64 nt, hsa
gcgccggcucauguucccuuuaguuuauuuuugugagggcaaaggggaggaaaugggguucugu

SEQ ID NO: 523239 - RNA, 64 nt, hsa
ccuggagaccccuuuuuugcccccagguuccccagagggcaacgccaucaguagcaguguggug

SEQ ID NO: 523240 - RNA, 64 nt, hsa
caagccuccauuuuccccaagcaggauuacuccagagggcaaaacacagcccaauaguaucaca

SEQ ID NO: 523241 - RNA, 64 nt, hsa
uugacccuuucuugggaaggugacagagagguaggagggcaaacaucuugugugccccguccca

SEQ ID NO: 523242 - RNA, 64 nt, hsa; identical to SEQ ID NO: 88257

SEQ ID NO: 523243 - RNA, 64 nt, hsa; identical to SEQ ID NO: 88258

SEQ ID NO: 523244 - RNA, 64 nt, hsa; identical to SEQ ID NO: 88259

SEQ ID NO: 523245 - RNA, 64 nt, hsa; identical to SEQ ID NO: 88260

SEQ ID NO: 523246 - RNA, 64 nt, hsa; identical to SEQ ID NO: 88261

SEQ ID NO: 523247 - RNA, 64 nt, hsa; identical to SEQ ID NO: 88262

SEQ ID NO: 523248 - RNA, 64 nt, hsa; identical to SEQ ID NO: 88263

SEQ ID NO: 523249 - RNA, 64 nt, hsa; identical to SEQ ID NO: 88264

SEQ ID NO: 523250 - RNA, 64 nt, hsa; identical to SEQ ID NO: 88265

SEQ ID NO: 523251 - RNA, 64 nt, hsa; identical to SEQ ID NO: 88266

SEQ ID NO: 523252 - RNA, 64 nt, hsa; identical to SEQ ID NO: 88267

SEQ ID NO: 523253 - RNA, 64 nt, hsa; identical to SEQ ID NO: 88268

SEQ ID NO: 523254 - RNA, 64 nt, hsa; identical to SEQ ID NO: 88269

SEQ ID NO: 523255 - RNA, 64 nt, hsa; identical to SEQ ID NO: 88270

SEQ ID NO: 523256 - RNA, 64 nt, hsa; identical to SEQ ID NO: 88271

SEQ ID NO: 523257 - RNA, 64 nt, hsa; identical to SEQ ID NO: 88269

SEQ ID NO: 523258 - RNA, 64 nt, hsa; identical to SEQ ID NO: 88273

SEQ ID NO: 523259 - RNA, 64 nt, hsa; identical to SEQ ID NO: 88274

SEQ ID NO: 523260 - RNA, 64 nt, hsa; identical to SEQ ID NO: 88275

SEQ ID NO: 523261 - RNA, 64 nt, hsa; identical to SEQ ID NO: 88276

SEQ ID NO: 523262 - RNA, 64 nt, hsa; identical to SEQ ID NO: 88277

SEQ ID NO: 523263 - RNA, 64 nt, hsa; identical to SEQ ID NO: 88278

SEQ ID NO: 523264 - RNA, 64 nt, hsa; identical to SEQ ID NO: 88279

SEQ ID NO: 523265 - RNA, 64 nt, hsa; identical to SEQ ID NO: 88280

SEQ ID NO: 523266 - RNA, 64 nt, hsa; identical to SEQ ID NO: 88281

SEQ ID NO: 523267 - RNA, 64 nt, hsa; identical to SEQ ID NO: 88282

SEQ ID NO: 523268 - RNA, 64 nt, hsa; identical to SEQ ID NO: 88283

SEQ ID NO: 523269 - RNA, 64 nt, hsa; identical to SEQ ID NO: 88284

SEQ ID NO: 523270 - RNA, 64 nt, hsa; identical to SEQ ID NO: 88285

SEQ ID NO: 523271 - RNA, 64 nt, hsa; identical to SEQ ID NO: 88286

SEQ ID NO: 523272 - RNA, 64 nt, hsa; identical to SEQ ID NO: 88287

SEQ ID NO: 523273 - RNA, 64 nt, hsa; identical to SEQ ID NO: 88288

SEQ ID NO: 523274 - RNA, 64 nt, hsa; identical to SEQ ID NO: 88289

SEQ ID NO: 523275 - RNA, 64 nt, hsa; identical to SEQ ID NO: 88290

SEQ ID NO: 523276 - RNA, 64 nt, hsa; identical to SEQ ID NO: 88291

SEQ ID NO: 523277 - RNA, 64 nt, hsa; identical to SEQ ID NO: 88292

SEQ ID NO: 523278 - RNA, 64 nt, hsa; identical to SEQ ID NO: 88293

SEQ ID NO: 523279 - RNA, 64 nt, hsa; identical to SEQ ID NO: 88294

SEQ ID NO: 523280 - RNA, 64 nt, hsa; identical to SEQ ID NO: 88295

SEQ ID NO: 523281 - RNA, 64 nt, hsa; identical to SEQ ID NO: 88296

SEQ ID NO: 523282 - RNA, 64 nt, hsa; identical to SEQ ID NO: 88297

SEQ ID NO: 523283 - RNA, 64 nt, hsa; identical to SEQ ID NO: 88298

SEQ ID NO: 523284 - RNA, 64 nt, hsa; identical to SEQ ID NO: 88299

SEQ ID NO: 523285 - RNA, 64 nt, hsa; identical to SEQ ID NO: 88300

SEQ ID NO: 523286 - RNA, 64 nt, hsa; identical to SEQ ID NO: 88298

SEQ ID NO: 523287 - RNA, 64 nt, hsa; identical to SEQ ID NO: 88302

SEQ ID NO: 523288 - RNA, 64 nt, hsa; identical to SEQ ID NO: 88300

SEQ ID NO: 523289 - RNA, 64 nt, hsa; identical to SEQ ID NO: 88304

SEQ ID NO: 523290 - RNA, 64 nt, hsa; identical to SEQ ID NO: 88305

SEQ ID NO: 523291 - RNA, 64 nt, hsa; identical to SEQ ID NO: 88306

SEQ ID NO: 523292 - RNA, 64 nt, hsa; identical to SEQ ID NO: 88307

SEQ ID NO: 523293 - RNA, 64 nt, hsa; identical to SEQ ID NO: 88299

SEQ ID NO: 523294 - RNA, 64 nt, hsa; identical to SEQ ID NO: 88309

SEQ ID NO: 523295 - RNA, 64 nt, hsa; identical to SEQ ID NO: 88310

SEQ ID NO: 523296 - RNA, 64 nt, hsa; identical to SEQ ID NO: 88311

SEQ ID NO: 523297 - RNA, 64 nt, hsa; identical to SEQ ID NO: 88312

SEQ ID NO: 523298 - RNA, 64 nt, hsa; identical to SEQ ID NO: 88313

SEQ ID NO: 523299 - RNA, 64 nt, hsa; identical to SEQ ID NO: 88314

SEQ ID NO: 523300 - RNA, 64 nt, hsa; identical to SEQ ID NO: 88315

SEQ ID NO: 523301 - RNA, 64 nt, hsa; identical to SEQ ID NO: 88316

SEQ ID NO: 523302 - RNA, 64 nt, hsa; identical to SEQ ID NO: 88317

SEQ ID NO: 523303 - RNA, 64 nt, hsa; identical to SEQ ID NO: 88318

SEQ ID NO: 523304 - RNA, 64 nt, hsa; identical to SEQ ID NO: 88319

SEQ ID NO: 523305 - RNA, 64 nt, hsa; identical to SEQ ID NO: 88320

SEQ ID NO: 523306 - RNA, 64 nt, hsa; identical to SEQ ID NO: 88321

SEQ ID NO: 523307 - RNA, 64 nt, hsa; identical to SEQ ID NO: 88322

SEQ ID NO: 523308 - RNA, 64 nt, hsa; identical to SEQ ID NO: 88323

SEQ ID NO: 523309 - RNA, 64 nt, hsa; identical to SEQ ID NO: 88324

SEQ ID NO: 523310 - RNA, 64 nt, hsa; identical to SEQ ID NO: 88325

SEQ ID NO: 523311 - RNA, 64 nt, hsa; identical to SEQ ID NO: 88326

SEQ ID NO: 523312 - RNA, 64 nt, hsa; identical to SEQ ID NO: 88327

SEQ ID NO: 523313 - RNA, 64 nt, hsa; identical to SEQ ID NO: 88328

SEQ ID NO: 523314 - RNA, 64 nt, hsa; identical to SEQ ID NO: 88329

SEQ ID NO: 523315 - RNA, 64 nt, hsa; identical to SEQ ID NO: 88330

SEQ ID NO: 523316 - RNA, 64 nt, hsa; identical to SEQ ID NO: 476781

SEQ ID NO: 523317 - RNA, 64 nt, hsa; identical to SEQ ID NO: 476782

SEQ ID NO: 523318 - RNA, 64 nt, hsa; identical to SEQ ID NO: 24182

SEQ ID NO: 523319 - RNA, 64 nt, hsa; identical to SEQ ID NO: 24183

SEQ ID NO: 523320 - RNA, 64 nt, hsa; identical to SEQ ID NO: 24184

SEQ ID NO: 523321 - RNA, 64 nt, hsa; identical to SEQ ID NO: 24185

SEQ ID NO: 523322 - RNA, 64 nt, hsa; identical to SEQ ID NO: 24186

SEQ ID NO: 523323 - RNA, 64 nt, hsa; identical to SEQ ID NO: 24187

SEQ ID NO: 523324 - RNA, 64 nt, hsa; identical to SEQ ID NO: 24188

SEQ ID NO: 523325 - RNA, 64 nt, hsa; identical to SEQ ID NO: 24189

SEQ ID NO: 523326 - RNA, 64 nt, hsa; identical to SEQ ID NO: 24190

SEQ ID NO: 523327 - RNA, 64 nt, hsa; identical to SEQ ID NO: 24191

SEQ ID NO: 523328 - RNA, 64 nt, hsa; identical to SEQ ID NO: 24192

SEQ ID NO: 523329 - RNA, 64 nt, hsa; identical to SEQ ID NO: 24193

SEQ ID NO: 523330 - RNA, 64 nt, hsa; identical to SEQ ID NO: 24194

SEQ ID NO: 523331 - RNA, 64 nt, hsa; identical to SEQ ID NO: 24195

SEQ ID NO: 523332 - RNA, 64 nt, hsa; identical to SEQ ID NO: 24196

SEQ ID NO: 523333 - RNA, 64 nt, hsa; identical to SEQ ID NO: 24197

SEQ ID NO: 523334 - RNA, 64 nt, hsa; identical to SEQ ID NO: 24198

SEQ ID NO: 523335 - RNA, 64 nt, hsa; identical to SEQ ID NO: 24199

SEQ ID NO: 523336 - RNA, 64 nt, hsa; identical to SEQ ID NO: 24200

SEQ ID NO: 523337 - RNA, 64 nt, hsa; identical to SEQ ID NO: 24201

SEQ ID NO: 523338 - RNA, 64 nt, hsa; identical to SEQ ID NO: 24202

SEQ ID NO: 523339 - RNA, 64 nt, hsa; identical to SEQ ID NO: 24203

SEQ ID NO: 523340 - RNA, 64 nt, hsa; identical to SEQ ID NO: 24204

SEQ ID NO: 523341 - RNA, 64 nt, hsa; identical to SEQ ID NO: 24205

SEQ ID NO: 523342 - RNA, 64 nt, hsa; identical to SEQ ID NO: 24206

SEQ ID NO: 523343 - RNA, 64 nt, hsa; identical to SEQ ID NO: 24207

SEQ ID NO: 523344 - RNA, 64 nt, hsa; identical to SEQ ID NO: 24208

SEQ ID NO: 523345 - RNA, 64 nt, hsa; identical to SEQ ID NO: 24209

SEQ ID NO: 523346 - RNA, 64 nt, hsa; identical to SEQ ID NO: 24210

SEQ ID NO: 523347 - RNA, 64 nt, hsa; identical to SEQ ID NO: 24211

SEQ ID NO: 523348 - RNA, 64 nt, hsa; identical to SEQ ID NO: 24212

SEQ ID NO: 523349 - RNA, 64 nt, hsa; identical to SEQ ID NO: 24213

SEQ ID NO: 523350 - RNA, 64 nt, hsa; identical to SEQ ID NO: 24214

SEQ ID NO: 523351 - RNA, 64 nt, hsa; identical to SEQ ID NO: 24215

SEQ ID NO: 523352 - RNA, 64 nt, hsa; identical to SEQ ID NO: 24216

SEQ ID NO: 523353 - RNA, 64 nt, hsa; identical to SEQ ID NO: 24217

SEQ ID NO: 523354 - RNA, 64 nt, hsa; identical to SEQ ID NO: 24218

SEQ ID NO: 523355 - RNA, 64 nt, hsa; identical to SEQ ID NO: 24219

SEQ ID NO: 523356 - RNA, 64 nt, hsa; identical to SEQ ID NO: 24220

SEQ ID NO: 523357 - RNA, 64 nt, hsa; identical to SEQ ID NO: 24221

SEQ ID NO: 523358 - RNA, 64 nt, hsa; identical to SEQ ID NO: 24222

SEQ ID NO: 523359 - RNA, 64 nt, hsa; identical to SEQ ID NO: 24223

SEQ ID NO: 523360 - RNA, 64 nt, hsa; identical to SEQ ID NO: 24224

SEQ ID NO: 523361 - RNA, 64 nt, hsa; identical to SEQ ID NO: 24225

SEQ ID NO: 523362 - RNA, 64 nt, hsa; identical to SEQ ID NO: 24226

SEQ ID NO: 523363 - RNA, 64 nt, hsa; identical to SEQ ID NO: 24227

SEQ ID NO: 523364 - RNA, 64 nt, hsa; identical to SEQ ID NO: 24228

SEQ ID NO: 523365 - RNA, 64 nt, hsa; identical to SEQ ID NO: 24229

SEQ ID NO: 523366 - RNA, 64 nt, hsa; identical to SEQ ID NO: 24230

SEQ ID NO: 523367 - RNA, 64 nt, hsa; identical to SEQ ID NO: 24231

SEQ ID NO: 523368 - RNA, 64 nt, hsa; identical to SEQ ID NO: 24232

SEQ ID NO: 523369 - RNA, 64 nt, hsa; identical to SEQ ID NO: 24233

SEQ ID NO: 523370 - RNA, 64 nt, hsa; identical to SEQ ID NO: 24234

SEQ ID NO: 523371 - RNA, 64 nt, hsa; identical to SEQ ID NO: 24235

SEQ ID NO: 523372 - RNA, 64 nt, hsa; identical to SEQ ID NO: 24236

SEQ ID NO: 523373 - RNA, 64 nt, hsa; identical to SEQ ID NO: 24237

SEQ ID NO: 523374 - RNA, 64 nt, hsa; identical to SEQ ID NO: 24238

SEQ ID NO: 523375 - RNA, 64 nt, hsa; identical to SEQ ID NO: 24239

SEQ ID NO: 523376 - RNA, 64 nt, hsa; identical to SEQ ID NO: 24240

SEQ ID NO: 523377 - RNA, 64 nt, hsa; identical to SEQ ID NO: 24241

SEQ ID NO: 523378 - RNA, 64 nt, hsa; identical to SEQ ID NO: 24242

SEQ ID NO: 523379 - RNA, 64 nt, hsa; identical to SEQ ID NO: 24243

SEQ ID NO: 523380 - RNA, 64 nt, hsa; identical to SEQ ID NO: 24244

SEQ ID NO: 523381 - RNA, 64 nt, hsa; identical to SEQ ID NO: 24245

SEQ ID NO: 523382 - RNA, 64 nt, hsa; identical to SEQ ID NO: 24246

SEQ ID NO: 523383 - RNA, 64 nt, hsa; identical to SEQ ID NO: 24247

SEQ ID NO: 523384 - RNA, 64 nt, hsa; identical to SEQ ID NO: 24248

SEQ ID NO: 523385 - RNA, 64 nt, hsa; identical to SEQ ID NO: 24249

SEQ ID NO: 523386 - RNA, 64 nt, hsa; identical to SEQ ID NO: 24250

SEQ ID NO: 523387 - RNA, 64 nt, hsa; identical to SEQ ID NO: 24247

SEQ ID NO: 523388 - RNA, 64 nt, hsa; identical to SEQ ID NO: 24252

SEQ ID NO: 523389 - RNA, 64 nt, hsa; identical to SEQ ID NO: 24253

SEQ ID NO: 523390 - RNA, 64 nt, hsa; identical to SEQ ID NO: 24254

SEQ ID NO: 523391 - RNA, 64 nt, hsa; identical to SEQ ID NO: 24255

SEQ ID NO: 523392 - RNA, 64 nt, hsa; identical to SEQ ID NO: 24256

SEQ ID NO: 523393 - RNA, 64 nt, hsa; identical to SEQ ID NO: 24257

SEQ ID NO: 523394 - RNA, 64 nt, hsa; identical to SEQ ID NO: 24258

SEQ ID NO: 523395 - RNA, 64 nt, hsa; identical to SEQ ID NO: 24259

SEQ ID NO: 523396 - RNA, 64 nt, hsa; identical to SEQ ID NO: 24260

SEQ ID NO: 523397 - RNA, 64 nt, hsa; identical to SEQ ID NO: 24261

SEQ ID NO: 523398 - RNA, 64 nt, hsa; identical to SEQ ID NO: 24262

SEQ ID NO: 523399 - RNA, 64 nt, hsa; identical to SEQ ID NO: 24263

SEQ ID NO: 523400 - RNA, 64 nt, hsa; identical to SEQ ID NO: 24264

SEQ ID NO: 523401 - RNA, 64 nt, hsa; identical to SEQ ID NO: 24265

SEQ ID NO: 523402 - RNA, 64 nt, hsa; identical to SEQ ID NO: 24266

SEQ ID NO: 523403 - RNA, 64 nt, hsa; identical to SEQ ID NO: 24267

SEQ ID NO: 523404 - RNA, 64 nt, hsa; identical to SEQ ID NO: 24268

SEQ ID NO: 523405 - RNA, 64 nt, hsa; identical to SEQ ID NO: 24269

SEQ ID NO: 523406 - RNA, 64 nt, hsa; identical to SEQ ID NO: 24270

SEQ ID NO: 523407 - RNA, 64 nt, hsa; identical to SEQ ID NO: 24271

SEQ ID NO: 523408 - RNA, 64 nt, hsa; identical to SEQ ID NO: 24272

SEQ ID NO: 523409 - RNA, 64 nt, hsa; identical to SEQ ID NO: 24273

SEQ ID NO: 523410 - RNA, 64 nt, hsa; identical to SEQ ID NO: 24274

SEQ ID NO: 523411 - RNA, 64 nt, hsa; identical to SEQ ID NO: 24275

SEQ ID NO: 523412 - RNA, 64 nt, hsa; identical to SEQ ID NO: 24276

SEQ ID NO: 523413 - RNA, 64 nt, hsa; identical to SEQ ID NO: 24277

SEQ ID NO: 523414 - RNA, 64 nt, hsa; identical to SEQ ID NO: 24278

SEQ ID NO: 523415 - RNA, 64 nt, hsa; identical to SEQ ID NO: 24279

SEQ ID NO: 523416 - RNA, 64 nt, hsa; identical to SEQ ID NO: 24280

SEQ ID NO: 523417 - RNA, 64 nt, hsa; identical to SEQ ID NO: 24281

SEQ ID NO: 523418 - RNA, 64 nt, hsa; identical to SEQ ID NO: 24282

SEQ ID NO: 523419 - RNA, 64 nt, hsa; identical to SEQ ID NO: 24283

SEQ ID NO: 523420 - RNA, 64 nt, hsa; identical to SEQ ID NO: 24284

SEQ ID NO: 523421 - RNA, 64 nt, hsa; identical to SEQ ID NO: 24285

SEQ ID NO: 523422 - RNA, 64 nt, hsa; identical to SEQ ID NO: 24286

SEQ ID NO: 523423 - RNA, 64 nt, hsa; identical to SEQ ID NO: 24287

SEQ ID NO: 523424 - RNA, 64 nt, hsa; identical to SEQ ID NO: 24288

SEQ ID NO: 523425 - RNA, 64 nt, hsa; identical to SEQ ID NO: 24289

SEQ ID NO: 523426 - RNA, 64 nt, hsa; identical to SEQ ID NO: 24290

SEQ ID NO: 523427 - RNA, 64 nt, hsa; identical to SEQ ID NO: 24291

SEQ ID NO: 523428 - RNA, 64 nt, hsa; identical to SEQ ID NO: 24292

SEQ ID NO: 523429 - RNA, 64 nt, hsa; identical to SEQ ID NO: 24293

SEQ ID NO: 523430 - RNA, 64 nt, hsa; identical to SEQ ID NO: 24294

SEQ ID NO: 523431 - RNA, 64 nt, hsa; identical to SEQ ID NO: 24295

SEQ ID NO: 523432 - RNA, 64 nt, hsa; identical to SEQ ID NO: 24296

SEQ ID NO: 523433 - RNA, 64 nt, hsa; identical to SEQ ID NO: 24297

SEQ ID NO: 523434 - RNA, 64 nt, hsa; identical to SEQ ID NO: 24298

SEQ ID NO: 523435 - RNA, 64 nt, hsa; identical to SEQ ID NO: 24299

SEQ ID NO: 523436 - RNA, 64 nt, hsa; identical to SEQ ID NO: 24300

SEQ ID NO: 523437 - RNA, 64 nt, hsa; identical to SEQ ID NO: 24301

SEQ ID NO: 523438 - RNA, 64 nt, hsa; identical to SEQ ID NO: 24302

SEQ ID NO: 523439 - RNA, 64 nt, hsa; identical to SEQ ID NO: 24303

SEQ ID NO: 523440 - RNA, 64 nt, hsa; identical to SEQ ID NO: 24304

SEQ ID NO: 523441 - RNA, 64 nt, hsa; identical to SEQ ID NO: 24305

SEQ ID NO: 523442 - RNA, 64 nt, hsa; identical to SEQ ID NO: 24306

SEQ ID NO: 523443 - RNA, 64 nt, hsa; identical to SEQ ID NO: 24307

SEQ ID NO: 523444 - RNA, 64 nt, hsa; identical to SEQ ID NO: 24308

SEQ ID NO: 523445 - RNA, 64 nt, hsa; identical to SEQ ID NO: 24309

SEQ ID NO: 523446 - RNA, 64 nt, hsa; identical to SEQ ID NO: 24310

SEQ ID NO: 523447 - RNA, 64 nt, hsa; identical to SEQ ID NO: 24311

SEQ ID NO: 523448 - RNA, 64 nt, hsa; identical to SEQ ID NO: 24312

SEQ ID NO: 523449 - RNA, 64 nt, hsa; identical to SEQ ID NO: 24313

SEQ ID NO: 523450 - RNA, 64 nt, hsa; identical to SEQ ID NO: 24314

SEQ ID NO: 523451 - RNA, 64 nt, hsa; identical to SEQ ID NO: 24315

SEQ ID NO: 523452 - RNA, 64 nt, hsa; identical to SEQ ID NO: 24316

SEQ ID NO: 523453 - RNA, 64 nt, hsa; identical to SEQ ID NO: 24317

SEQ ID NO: 523454 - RNA, 64 nt, hsa; identical to SEQ ID NO: 24318

SEQ ID NO: 523455 - RNA, 64 nt, hsa; identical to SEQ ID NO: 24319

SEQ ID NO: 523456 - RNA, 64 nt, hsa; identical to SEQ ID NO: 24320

SEQ ID NO: 523457 - RNA, 64 nt, hsa; identical to SEQ ID NO: 24321

SEQ ID NO: 523458 - RNA, 64 nt, hsa; identical to SEQ ID NO: 24322

SEQ ID NO: 523459 - RNA, 64 nt, hsa; identical to SEQ ID NO: 24323

SEQ ID NO: 523460 - RNA, 64 nt, hsa; identical to SEQ ID NO: 24324

SEQ ID NO: 523461 - RNA, 64 nt, hsa; identical to SEQ ID NO: 24325

SEQ ID NO: 523462 - RNA, 64 nt, hsa; identical to SEQ ID NO: 24326

SEQ ID NO: 523463 - RNA, 64 nt, hsa; identical to SEQ ID NO: 24327

SEQ ID NO: 523464 - RNA, 64 nt, hsa
gacucuuucaugagcgccaaucucugccaggggcuccggcuaccagugcuuccccuucugugcu

SEQ ID NO: 523465 - RNA, 64 nt, hsa
augccugagcagcgccucggagcccggcccgcccuccggcuacaauccccgcagagucuccggu

SEQ ID NO: 523466 - RNA, 64 nt, hsa
ggagcugagaagucugggagugaggagaucccaguccggcuaagcuugguggagcauuuuccca

SEQ ID NO: 523467 - RNA, 64 nt, hsa
cgaguagcugggacuacaggcacccgccaccacauccggcuaauuuuuuguauuuuuaguagag

SEQ ID NO: 523468 - RNA, 64 nt, hsa
gucucuaggccuuacuuugugauuauacguuaucuccggcuagaaaaaaauaaugguaguaaag

SEQ ID NO: 523469 - RNA, 64 nt, hsa
uuggaaccuagagcuggagugaggaguagaggucuccggcuauuccagaaagaaaagugagcca

SEQ ID NO: 523470 - RNA, 64 nt, hsa
aaauuagcuggucgcgguggcuucugccugugauuccggcuacuugggaggcugaggugggagg

SEQ ID NO: 523471 - RNA, 64 nt, hsa
ucccucccagcuccaccccgcaagcaccauccccuccggcuaagcaggcgcaagggaggcccag

SEQ ID NO: 523472 - RNA, 64 nt, hsa
ugaguagcugggauuacgggcgcgugccaccauguccggcuaauuuuuguauuuuuaguagaga

SEQ ID NO: 523473 - RNA, 64 nt, hsa
aguguuaaagauuaggauugaagucacugaccauuccggcuaugcuucuucauaccauucuccu

SEQ ID NO: 523474 - RNA, 64 nt, hsa
aguagggaagagauucucaaaugagaaaaagggcuccggcuauaugggcaacaaagagggaaga

SEQ ID NO: 523475 - RNA, 64 nt, hsa
ugaguagcugggacuacaugcgcacaccaccacguccggcuaauuuuuguauuuuuaguagaga

SEQ ID NO: 523476 - RNA, 64 nt, hsa
guaacugugucaggauugaggaugaacucagguuuccggcuacugacagugguagaguccuagg

SEQ ID NO: 523477 - RNA, 64 nt, hsa
cgagaggcugauccaagaacggcuuggcagccaguccggcuaaguggagcucagagcggauggg

SEQ ID NO: 523478 - RNA, 64 nt, hsa
gaaguaaagaagcugaugcgcaaguacaccgugcuccggcuaaugauucgacagaggcuggagg

SEQ ID NO: 523479 - RNA, 64 nt, hsa
aggaaaucuuuguacugucuuggaagccuccacauccggcuauggcccugcaagcugcuuuauc

SEQ ID NO: 523480 - RNA, 60 nt, hsa
ggcuucuggaaaucuguggccacucgagugcccaaggagcccccugagauucgaauccuc

SEQ ID NO: 523481 - RNA, 60 nt, hsa
gccuuuagccuggaccaaagggaagugaggcccaaggagcuuacccaagcuguggcagcc

SEQ ID NO: 523482 - RNA, 60 nt, hsa
cacaggucccgagccaacggggcuuucauacccaaggaucuguuuccuugcugaaaauga

SEQ ID NO: 523483 - RNA, 60 nt, hsa
gccaaccuccucagggcgcccuggcuucuccccaaggagaugaggagcggugaugccagc

SEQ ID NO: 523484 - RNA, 60 nt, hsa
uccuucagggaaggaaccacagagucccuucccaaggaauguaggucguuucuguguucu

SEQ ID NO: 523485 - RNA, 60 nt, hsa
ucuuucaauguuauuuucucccauccuuggcccaaggaacuaugcuaagugaaacguggg

SEQ ID NO: 523486 - RNA, 60 nt, hsa
uuagcuucaauccuggcagcaccugguagacccaaggacuuggguggaucaggacaccug

SEQ ID NO: 523487 - RNA, 60 nt, hsa
aagagaagcuuccggcaacccugcaacccacccaaggaggcuacuggaucggggauuccc

SEQ ID NO: 523488 - RNA, 60 nt, hsa
acugaaaccauuucuaaccacaacccuuggcccaaggacuugguacaggaagggagaagg

SEQ ID NO: 523489 - RNA, 60 nt, hsa
cagguggccuggccacucuggagaaagaaacccaaggaaagugagcacccaacuggaugc

SEQ ID NO: 523490 - RNA, 60 nt, hsa
caaacugaggaagcuacaacacagugaagacccaaggaaggccuaugaaaagguccugau

SEQ ID NO: 523491 - RNA, 60 nt, hsa
augcaggcaccagagcagggacugagaaaccccaaggaugggucaucuaagugcugucca

SEQ ID NO: 523492 - RNA, 60 nt, hsa
uuugggggguccugcuacacuccaccgauccccaaggaaguauaauaaacgauacccagc

SEQ ID NO: 523493 - RNA, 60 nt, hsa
caaaguauagaaacauguucauugcacacacccaaggagaagagcucaagcgcuuggaag

SEQ ID NO: 523494 - RNA, 60 nt, hsa
gcccaguguggaugucucuuacagagggggcccaaggaaucaccaccccgcuucagugua

SEQ ID NO: 523495 - RNA, 60 nt, hsa
acuuagaagacauuuuuguacaugcucuuccccaaggauuguacguauuauacaaauaga

SEQ ID NO: 523496 - RNA, 60 nt, hsa
ugcuccaggcaucacugauucccucucccacccaaggagaacguuugguacaaucgacau

SEQ ID NO: 523497 - RNA, 60 nt, hsa
ccacuggcacuugccugcugcuuggagugccccaaggagguggcuguuaaccacccgccc

SEQ ID NO: 523498 - RNA, 60 nt, hsa
uguggucauguuuacauugugacauccagccccaaggauggcugggaguugcucaggcau

SEQ ID NO: 523499 - RNA, 60 nt, hsa
ucucuaucccaucccuuccuguuacugcggcccaaggacaggaaacaacuuuuccaaaau

SEQ ID NO: 523500 - RNA, 60 nt, hsa
ugcacugccccccacauucucccagccccccccaaggacccccucuccuugacccccagu

SEQ ID NO: 523501 - RNA, 60 nt, hsa
ggggacccuccagaagcccagccggcuucccccaaggacucccccuucgcugggagugga

SEQ ID NO: 523502 - RNA, 60 nt, hsa
cuucacacaagaaccaccucucccgcaguucccaaggacuugucauuucauguucuuauu

SEQ ID NO: 523503 - RNA, 60 nt, hsa
uuuagaccuguuuuguaaauaaagcuguuucccaaggaaagagaugaauauuuaacacuc

SEQ ID NO: 523504 - RNA, 60 nt, hsa
cauccauucccaucuuucgggcuccuuaggcccaaggauggcaugugacuggucccugca

SEQ ID NO: 523505 - RNA, 60 nt, hsa
ccauuuuccucuuaagguuuccucuacaaccccaaggacuuucaugauuauccucaggga

SEQ ID NO: 523506 - RNA, 60 nt, hsa
uggggguggugcugacucagccgccuauuccccaaggagcuucagggcaguccuucuggc

SEQ ID NO: 523507 - RNA, 60 nt, hsa
gggauaucaacuuggaggagaacaccuagacccaaggacuuuuuucugcccaaggaacac

SEQ ID NO: 523508 - RNA, 60 nt, hsa
agaacaccuagacccaaggacuuuuuucugcccaaggaacacaguuuccuucagcuccca

SEQ ID NO: 523509 - RNA, 60 nt, hsa
cauuccccuuuucccuccugugcucugucccccaaggagucauggaacucaggguacugg

SEQ ID NO: 523510 - RNA, 60 nt, hsa
cugucuacuggcugcaugugcugugaauaucccaaggaacuggcuguggaaugcguguuu

SEQ ID NO: 523511 - RNA, 60 nt, hsa
uguaggaauuauguuucgcagaaaaguguccccaaggaagugccaccagguacuaagucc

SEQ ID NO: 523512 - RNA, 60 nt, hsa
cggaaauucuccaggcaaaugaccuccucacccaaggaguucugcuguacaaacagguga

SEQ ID NO: 523513 - RNA, 60 nt, hsa
cacuucugggaaauugaagugucuucuguucccaaggaagcuccuuccuguuuguuuugu

SEQ ID NO: 523514 - RNA, 60 nt, hsa
agaguggggagaggcacuuaaucuguaacccccaaggaggaaauaacuaagagauucuuc

SEQ ID NO: 523515 - RNA, 60 nt, hsa
ggcacggggccuccgagcuccagcuccguucccaaggauacucgugaagaccccaucugu

SEQ ID NO: 523516 - RNA, 60 nt, hsa
uacccccaucuuucucccucggggagacgacccaaggaauuucagaguauuuuguuuggc

SEQ ID NO: 523517 - RNA, 64 nt, hsa
ggucuaucuuuuaaagccugaucuggugugaauaaucaacuaggaaaucuaaacuuggauaaca

SEQ ID NO: 523518 - RNA, 64 nt, hsa
uacacaguauggcaaauggauaaaauauuguggcaucaacuacuuuuaaaguagaaaagcuauc

SEQ ID NO: 523519 - RNA, 64 nt, hsa
ucuauguaguuaauuaaaguuaaaguuucugcagaucaacuacucaaacuacuaaauacauuua

SEQ ID NO: 523520 - RNA, 64 nt, hsa
cucaucgugaucuuggaaaucaauaaagucaaauaucaacuaaagacuuacauuaucuuucuca

SEQ ID NO: 523521 - RNA, 64 nt, hsa
cucacccaagguguuagguuucacauauauauucaucaacuauuuuagaagauuuaauucuauc

SEQ ID NO: 523522 - RNA, 64 nt, hsa
ugcuuaaaaaagcauugaguuaauuuuuuuaaauaucaacuaaaauaucauaguucugugguag

SEQ ID NO: 523523 - RNA, 64 nt, hsa
gaauuggaaauaaguauaaggaaacuaaauuugaaucaacuauuaauuuuauaacuuaaagaaa

SEQ ID NO: 523524 - RNA, 64 nt, hsa
auaagugucagacuauuaggaauugagaagggggaucaacuaaauaaacgaagagagucuuucu

SEQ ID NO: 523525 - RNA, 64 nt, hsa
ucaucaucuuacucaucuuaagcccgagccauggaucaacuaggagcccauauaaaugaggcuc

SEQ ID NO: 523526 - RNA, 64 nt, hsa
aguuuugccaacaauuccccuuaaaaggaaacagaucaacuacaccgcaucccaacaacccagg

SEQ ID NO: 523527 - RNA, 64 nt, hsa
ucacuugaauauuuaugauucuuaauagauuauuaucaacuagagauauuuauaaaugaaguau

SEQ ID NO: 523528 - RNA, 64 nt, hsa
uccaccuaagaucuugccccuguuaaguggugaaaucaacuagaggugguuccuacaaguuguu

SEQ ID NO: 523529 - RNA, 64 nt, hsa
agcaaaguuauggucgauuucuauucuugaaagaaucaacuacagugaauccuuugcauuugaa

SEQ ID NO: 523530 - RNA, 64 nt, hsa
uuguauggcauaggacuggcauuauauagcagaaaucaacuacuguacaauuucuugggguuaa

SEQ ID NO: 523531 - RNA, 64 nt, hsa
gaauauagagggcuuaugauucagauuguuaucuaucaacuauaagcccacuguuaauauucua

SEQ ID NO: 523532 - RNA, 64 nt, hsa
gauguauuacaugacuguuucuuuuguaaagagaaucaacuagguauuuaagacugauaauuuu

SEQ ID NO: 523533 - RNA, 64 nt, hsa
ugcacagguucuugaaaacguuauuuauaaugaaaucaacuaaaacuauuuuugcuauaaguuc

SEQ ID NO: 523534 - RNA, 64 nt, hsa
uuaacauauuguaaauguucuuuuuuccauguaaaucaacuaucuuuguuaucacuaagugaua

SEQ ID NO: 523535 - RNA, 64 nt, hsa
guauucauuauccuaacaccaucuguaguguuaaaucaacuaaauuauuucagcaauaggagac

SEQ ID NO: 523536 - RNA, 64 nt, hsa
uauaaaaugauuuguaaugucucuaauuagaugaaucaacuagaaacaaacucaguggucaaaa

SEQ ID NO: 523537 - RNA, 64 nt, hsa
aguaauugugcaguaaaguaaagcccugugguguaucaacuacuaguuaagagucucaguugau

SEQ ID NO: 523538 - RNA, 64 nt, hsa
uuuaaauuuuacuagcaaaagucuuaggugaacaaucaacuaguauuuguugagcuccuauuug

SEQ ID NO: 523539 - RNA, 64 nt, hsa
uucucagugaaauuuuugggcaucaugaagaacgaucaacuaucuucuaauuugaaucuauagu

SEQ ID NO: 523540 - RNA, 64 nt, hsa
gcaagaaguucuauuuaauggagaugucauguauaucaacuauucugguuuagauaacuuagau

SEQ ID NO: 523541 - RNA, 64 nt, hsa
cuuuggcaccccagaauuuguggcuccugaagugaucaacuaugagcccaucggcuacgccaca

SEQ ID NO: 523542 - RNA, 64 nt, hsa
ccacaacguucaagauagagagacacagcaagccaucaacuaugguuaauuuugaaaaauggaa

SEQ ID NO: 523543 - RNA, 64 nt, hsa
uuauuuuguauuuuaaauacauaaauaggauugaaucaacuagaaaugaaucuauauguucugu

SEQ ID NO: 523544 - RNA, 64 nt, hsa
uguuuuccuuccuuucuuuccaguccaggagaucaucaacuaagagccaggcaccccuuuuaag

SEQ ID NO: 523545 - RNA, 64 nt, hsa
caaccuaucuguucugucucccaauguaccacuuaucaacuaaucccucuccucucugauuccu

SEQ ID NO: 523546 - RNA, 64 nt, hsa
auauauaacaaauaauauauuaaaaaacccauccaucaacuaaaacauuauauguauacaucag

SEQ ID NO: 523547 - RNA, 64 nt, hsa
uaauuaccccauuauuaaauucaaguccuugaaaaucaacuagagauuauaaagucucuaaaga

SEQ ID NO: 523548 - RNA, 64 nt, hsa
cuguuuaguuuacauuguaacauucuauuguaaaaucaacuaaaauucagacuuuuagcaggac

SEQ ID NO: 523549 - RNA, 64 nt, hsa
caugccucaugauccuuuugauccuaugacugacaucaacuaaaauuuaaaagaagaggaagac

SEQ ID NO: 523550 - RNA, 64 nt, hsa
ugaauaaaugaugcaaguugucaauggaugagugaucaacuaauagcucugcuaguaauugauu

SEQ ID NO: 523551 - RNA, 64 nt, hsa
aagguauuuaauauucuuuuuuaugacaacuuagaucaacuauuuuuagcuugguaaauuuuuc

SEQ ID NO: 523552 - RNA, 64 nt, hsa
ccaugcuauuuguucuucaagaacuuucucugccaucaacuacuauucaaaaccucaaauccac

SEQ ID NO: 523553 - RNA, 64 nt, hsa
ugagcagauaacccugcuuauuuggugugguuaaaucaacuagcuucugcuaauagccccaauu

SEQ ID NO: 523554 - RNA, 64 nt, hsa
gaaaacguucagacccauccuguuaguaugucaaaucaacuaagacuggcaggguauuaacucc

SEQ ID NO: 523555 - RNA, 64 nt, hsa
caggaugcaaaaacguuauugggggguuguaaauaucaacuauucaacaguuuaggaugcaauu

SEQ ID NO: 523556 - RNA, 64 nt, hsa
aauaguacugaaaugauucucuauguuguaaaugaucaacuacaauauucaggaagcacauuua

SEQ ID NO: 523557 - RNA, 64 nt, hsa
uauaaagcuuuaaguugucaacuuuguucuaaauaucaacuagcgcaagugaauacugaagauu

SEQ ID NO: 523558 - RNA, 64 nt, hsa
uugaaaaugcuauuggaggagucacacuaauacuaucaacuaucagucuucccacagcuucaau

SEQ ID NO: 523559 - RNA, 64 nt, hsa
ggauauuucagcuguuguuuccaaauggcaaaucaucaacuaaaagcacuuguuucaaguuuug

SEQ ID NO: 523560 - RNA, 64 nt, hsa
auaacucugaucuuuuacauaaagcagaagaggaaucaacuaguuaauugcaagguuucuacuc

SEQ ID NO: 523561 - RNA, 64 nt, hsa
gccacugcucagugcacuucucccuuccaacugcaucaacuaacucucggggguguucugcuca

SEQ ID NO: 523562 - RNA, 64 nt, hsa
gugcagauaggugauguugggauggaaaaugcuaaucaacuacccuuucuuuuaucaaguaauu

SEQ ID NO: 523563 - RNA, 64 nt, hsa
ucuauuuuauaauuauauuugacauuuuguucacaucaacuaauguucaccuguagaagagaac

SEQ ID NO: 523564 - RNA, 64 nt, hsa
cuuuuuuggcauguccuuaaaaagaggauuugaaaucaacuauaugcuaccaagaacuuuagga

SEQ ID NO: 523565 - RNA, 64 nt, hsa
ucaguagaguccacuucugcccuggagaccacaaaucaacuagcuccauuuacagccauuucua

SEQ ID NO: 523566 - RNA, 53 nt, hsa
ucccacagccaacagauugaaggaucaacuauuugccugaacagaaucauccu

SEQ ID NO: 523567 - RNA, 64 nt, hsa
agggcuuucauugucugacucauaaugguucaggaucaacuaucaucaaacggaaggauuaacu

SEQ ID NO: 523568 - RNA, 64 nt, hsa
gaaauguucuuaagaugaauacaccugccuuuggaucaacuauuuaaacauuguaugcauuuug

SEQ ID NO: 523569 - RNA, 64 nt, hsa
uauaagagauacucaauaaauaaauauuugucaaaucaacuaauugauuccuugugaccuaauu

SEQ ID NO: 523570 - RNA, 64 nt, hsa
uauuaaaaucuguugaaauaacucuuaggaaauuaucaacuaauuuuuucagaucaguaucuuc

SEQ ID NO: 523571 - RNA, 64 nt, hsa
ucuggaugauauggaaaacacugccauauuuuaaaucaacuacuccacguguuuuuccauccaa

SEQ ID NO: 523572 - RNA, 64 nt, hsa
uucuugcauucuggguuuggcuuuuuucugugucaucaacuaugguuauccucuaaauaggcau

SEQ ID NO: 523573 - RNA, 64 nt, hsa
acaguccaugaucugaccaacuaagcuuuuaaaaaucaacuauuaccacccagaaaacaguccu

SEQ ID NO: 523574 - RNA, 64 nt, hsa
ucuuuuuaugaggcaauuggaaauuugaacacugaucaacuauaggaugauuggaauuauuaau

SEQ ID NO: 523575 - RNA, 64 nt, hsa
caguauggugguccuggaaaggacauuuuugaagaucaacuauaucuuccugugcauuccgaug

SEQ ID NO: 523576 - RNA, 64 nt, hsa
uuguauaaaacuguaacauuacuguacagaguacaucaacuauuuucagcccaaaaaggugcca

SEQ ID NO: 523577 - RNA, 64 nt, hsa
ucagagagagacugaggguugacaaauaaacuguaucaacuaaacuuugauauaaaccagaaug

SEQ ID NO: 523578 - RNA, 64 nt, hsa
uaaaaccacagauugcaaagcauagcauuuuagcaucaacuacaaucaaaagagcgauuugcug

SEQ ID NO: 523579 - RNA, 64 nt, hsa
uaucuguacauaauugcuuugucuugauguuucuaucaacuauaucaugacuaucuauugguuc

SEQ ID NO: 523580 - RNA, 64 nt, hsa
caauuuuuuuuuuuucucagacagacauaguaguaucaacuagcauuggaaaauacauaucacu

SEQ ID NO: 523581 - RNA, 64 nt, hsa
ucguaaguuuggaugaaagugcaagauguggaacaucaacuaccuauuuuccuuggguuuuucc

SEQ ID NO: 523582 - RNA, 64 nt, hsa
ggucaauggaccuuucuuugcacugugugacuuaaucaacuauaaaagcuuacaauuagucuuc

SEQ ID NO: 523583 - RNA, 64 nt, hsa
acuucaguugagagugacuuuuuaauacaacaagaucaacuagaagaauucaacugucucaaga

SEQ ID NO: 523584 - RNA, 64 nt, hsa
cuccuggaaacagacagggagaaguugagcagguaucaacuaggggaggagagagggucuccag

SEQ ID NO: 523585 - RNA, 64 nt, hsa
uuuaacaucauuuuuucaacuuuuaagauauaauaucaacuauucuaaauacagguaaugguau

SEQ ID NO: 523586 - RNA, 64 nt, hsa
uuuggaacauaagucacuaugcagacuaauaaacaucaacuagagagaacucccaacugcuguu

SEQ ID NO: 523587 - RNA, 64 nt, hsa
caaaccuauguucguaaugagagauuuuauaaggaucaacuaagaaauggaaggcaggugaaga

SEQ ID NO: 523588 - RNA, 64 nt, hsa
aauaucaaaaaauguuucuaagguauuaugaugcaucaacuaguucuuccauguaaaauaauuu

SEQ ID NO: 523589 - RNA, 64 nt, hsa
guccauaggaaccacccccaugaccaccaccaacaucaacuaaagguucuuggaggguauguca

SEQ ID NO: 523590 - RNA, 64 nt, hsa
uuauauagucccguuaggguuuaaaaccauauugaucaacuagaaagaaaaauaugaaaagaga

SEQ ID NO: 523591 - RNA, 64 nt, hsa
ugaagacauguauccauaagaaggagugcucuucaucaacuaauagagcaccuaccacaguguc

SEQ ID NO: 523592 - RNA, 64 nt, hsa
cugugcuuccugaggagcaggccggauguaaguuaucaacuauaaauaaaaccaagacuuccgu

SEQ ID NO: 523593 - RNA, 64 nt, hsa
aguuuccagaaacuuugacuugaaauguuugcagaucaacuauaagcacaaagaagagauaacu

SEQ ID NO: 523594 - RNA, 64 nt, hsa
guacacaguauggucuuuggaaauauaauaaaacaucaacuaacuuggacuaauugugaggaag

SEQ ID NO: 523595 - RNA, 64 nt, hsa
ucagcgagacuaaagacaaaguucugagcuccucaucaacuacaaaauaugaaaucagcauucc

SEQ ID NO: 523596 - RNA, 64 nt, hsa
acucugagaccaugaccuuggaagauccucagagaucaacuagccaagucacucacuuaaaaug

SEQ ID NO: 523597 - RNA, 64 nt, hsa
uuuguauuuaagcaaacagugaacgacguuugcaaucaacuaaaaauucgucuaucgaauuagg

SEQ ID NO: 523598 - RNA, 64 nt, hsa
aacacaauguaaugagugaaugaauacauuucaaaucaacuauuaaaaauuuucuaaucugcau

SEQ ID NO: 523599 - RNA, 64 nt, hsa
ccuaccuuuucaguuauuuuaauuauaccaaauuaucaacuagaauagcuucauccauaugaaa

SEQ ID NO: 523600 - RNA, 64 nt, hsa
aagguggaaaauuuucuuacaguugaugcaaaguaucaacuacuuuacccuaccuucuccccuu

SEQ ID NO: 523601 - RNA, 64 nt, hsa
uguucagaauuuaguagauuguuuaaugcaggacaucaacuacauaaugaaagaugcuugaaau

SEQ ID NO: 523602 - RNA, 64 nt, hsa
uguucaaaauaaggcuuguuggaaauccuaguccaucaacuaauuucaaaaauuuauuuuugau

SEQ ID NO: 523603 - RNA, 64 nt, hsa
gugccaauaaucgucauaggcuucugcacguuggaucaacuaauguuguuuacaauauagauga

SEQ ID NO: 523604 - RNA, 64 nt, hsa
uucuccuuuguuuuuguaguuuucaccaaagaugaucaacuagaaauguuaaguggcuaugcaa

SEQ ID NO: 523605 - RNA, 64 nt, hsa
acagaagcauuucacauaaauguugguuucagucaucaacuacccaugaauuccugcccaagga

SEQ ID NO: 523606 - RNA, 64 nt, hsa
ucuuuaaaaauuaaguggaagaagaauuacuuuaaucaacuaacaagcaauaauaaaaugaaac

SEQ ID NO: 523607 - RNA, 64 nt, hsa
uauaaaggaucauuugaaacuguugauuccaaacaucaacuaauauuauauagucaucaguaga

SEQ ID NO: 523608 - RNA, 64 nt, hsa
gugaagaacucugugaaggauggaacuuucagauaucaacuauuuagaguccagagggagccau

SEQ ID NO: 523609 - RNA, 64 nt, hsa
uuacugugucucauguuuuguauauuuuuguuucaucaacuaagaugcacuguaacaucucuga

SEQ ID NO: 523610 - RNA, 64 nt, hsa
gcagccaaaacaaagaacuggguguugaguauucaucaacuaagaaccaaaauccagggcacuc

SEQ ID NO: 523611 - RNA, 64 nt, hsa
gaugccugaaaccucagauaguacugaacccuuuaucaacuauguuuuuucagucugacaacca

SEQ ID NO: 523612 - RNA, 64 nt, hsa
auguauaacauuuguacauggccuuuaaaauuguaucaacuagaaauaaaauugcaugaguauu

SEQ ID NO: 523613 - RNA, 64 nt, hsa
ucucaauucaagcuggauuagccagcucagcauaaucaacuagacagugguuuguuaaauuuag

SEQ ID NO: 523614 - RNA, 64 nt, hsa
ggaguacauuuuuaaaauuuuuuguuccauucugaucaacuaaagaaaauuaagguguccaccu

SEQ ID NO: 523615 - RNA, 64 nt, hsa
auuuucuggugccaacacucauucaucauucccgaucaacuaggaugaauuuaagacugugcua

SEQ ID NO: 523616 - RNA, 64 nt, hsa
ccaccauccuuucucuggcuucuuuuagcaaguuaucaacuaaucacuaacuccuuccuuuucc

SEQ ID NO: 523617 - RNA, 64 nt, hsa
aaaucuaauguaugaaugugacucaccaauuuuuaucaacuaauuccuuuuuuuuauuaaaggc

SEQ ID NO: 523618 - RNA, 64 nt, hsa
ucauaauuuaauuguuugaaauuacauuaaauaaaucaacuaauuaaauacuaaaguuuuguuc

SEQ ID NO: 523619 - RNA, 64 nt, hsa
cauuauauuugugcuuaaagauguuccuucauucaucaacuaggggaaguccagaugcggguua

SEQ ID NO: 523620 - RNA, 64 nt, hsa
ggcaagaccaucuccuggaaccuuacugucucagaucaacuacucuaccacucuacucuaagau

SEQ ID NO: 523621 - RNA, 64 nt, hsa
gaagucuuacagucaccuguaccaaacauuugaaaucaacuacaaguacaugggacuggugaua

SEQ ID NO: 523622 - RNA, 63 nt, hsa
gagaaacagccuguguuuuuuaugcaauaaagucaucaacuacaucaugcuuccuuuguguuc

SEQ ID NO: 523623 - RNA, 64 nt, hsa
uuuacugaaauuguaaaauauccaucuuaaagacaucaacuauucuaaaaauuguguacaggau

SEQ ID NO: 523624 - RNA, 64 nt, hsa
ucuuggagucaaugaucucuaaacaaacuggauuaucaacuauuuacaacgucuauacaguaua

SEQ ID NO: 523625 - RNA, 64 nt, hsa
aaaaaaaaaaaaacccaauuuggauaccaaauuaaucaacuaauuugagcuaucuggccuuacu

SEQ ID NO: 523626 - RNA, 64 nt, hsa
aaauuauuauaauucagccuucaaacuacuacugaucaacuaaaggaaagcuaauaagguauuu

SEQ ID NO: 523627 - RNA, 64 nt, hsa
uugaauuguuuucuuacacccuggaaaucuuucuaucaacuauaaugauaaauccauuuugaag

SEQ ID NO: 523628 - RNA, 64 nt, hsa
gacaauacuuucaguguccccuuuucuggcauaaaucaacuaugaauauguuucaagcaucaca

SEQ ID NO: 523629 - RNA, 64 nt, hsa
gaaaaucuauagacugaaugcaguuccaaacaaaaucaacuaagaauuuucuaggaucuuucaa

SEQ ID NO: 523630 - RNA, 64 nt, hsa
ggguaccaggcaccauucucaguguuucaccuggaucaacuaaugcgucccucaccucagcccu

SEQ ID NO: 523631 - RNA, 64 nt, hsa
cugcuagugacuuaguagccgucuuggugaucagaucaacuaucccagcaucacagugccugug

SEQ ID NO: 523632 - RNA, 64 nt, hsa
uggcugacaugaagcuguugugugagguucgcuuaucaacuaaugauuuagugaucaaauugug

SEQ ID NO: 523633 - RNA, 64 nt, hsa
ccauuaacagauuaaaagagacuuaaagagacauaucaacuaaauucaguauguuggcauuacu

SEQ ID NO: 523634 - RNA, 64 nt, hsa
auuuaacucaguuucuaggcaccucagaccaaucaucaacuaccauucuauuccauguuugcac

SEQ ID NO: 523635 - RNA, 64 nt, hsa
uuugaaucauggaccauaacuuuucaguuaucagaucaacuaaagaaacauuuguuguuaagcc

SEQ ID NO: 523636 - RNA, 64 nt, hsa
ucucccuucuuguacaauccagaggaauauuuuuaucaacuauuuuguaaaugcaaguuuuuua

SEQ ID NO: 523637 - RNA, 62 nt, hsa
cuggccuccccccagggauggagugucuuggggcaucaacuagaaucuuggcccucagaggg

SEQ ID NO: 523638 - RNA, 64 nt, hsa
ucgacaucucugaagacagguuauuuuauaaaagaucaacuaucauguuaagaauguacaguuu

SEQ ID NO: 523639 - RNA, 64 nt, hsa
uacucauaugaucacuuuucuuuuuagauacuacaucaacuagauucaggaguauaucauuugc

SEQ ID NO: 523640 - RNA, 64 nt, hsa
ccaagauggugagcucugauugcuucaguuggucaucaacuauuuucccuugacugcuguccug

SEQ ID NO: 523641 - RNA, 64 nt, hsa
uuuguuuuggcauuuuuuugugugaaguaaauuaaucaacuagagaggugcaaaacguucucag

SEQ ID NO: 523642 - RNA, 64 nt, hsa
uauuuuugacuaaauuauugauucgauaugaaaaaucaacuaagauuacacagcuuuguuuuuu

SEQ ID NO: 523643 - RNA, 64 nt, hsa
guguuuuaauugugaugucaaaaaguuguaucagaucaacuaaaauggagagcaagacagagaa

SEQ ID NO: 523644 - RNA, 64 nt, hsa
auuuaguggaaaguaauaauuuuuuuaauuuucuaucaacuaauaguauaguaacaacuaugau

SEQ ID NO: 523645 - RNA, 64 nt, hsa
cacuucaagaugauuuaauugagcuucuauaacuaucaacuaucaaauucuaguuucaaguauc

SEQ ID NO: 523646 - RNA, 64 nt, hsa
uaaauugcucacaguuauuacauacacaucagccaucaacuaaaguuguacuuuaaaaauuuac

SEQ ID NO: 523647 - RNA, 64 nt, hsa
ugguaugggggauuucaaacuuaaacaaaaaacuaucaacuacaaauuaguugccugacuuugg

SEQ ID NO: 523648 - RNA, 64 nt, hsa
gcaggaccuaaagggagccccaucuuuauggcugaucaacuacaacccuauaugccugaauacu

SEQ ID NO: 523649 - RNA, 64 nt, hsa; identical to SEQ ID NO: 340781

SEQ ID NO: 523650 - RNA, 64 nt, hsa; identical to SEQ ID NO: 340782

SEQ ID NO: 523651 - RNA, 64 nt, hsa; identical to SEQ ID NO: 340783

SEQ ID NO: 523652 - RNA, 64 nt, hsa; identical to SEQ ID NO: 340784

SEQ ID NO: 523653 - RNA, 64 nt, hsa; identical to SEQ ID NO: 340785

SEQ ID NO: 523654 - RNA, 64 nt, hsa; identical to SEQ ID NO: 340786

SEQ ID NO: 523655 - RNA, 64 nt, hsa; identical to SEQ ID NO: 340787

SEQ ID NO: 523656 - RNA, 64 nt, hsa; identical to SEQ ID NO: 340788

SEQ ID NO: 523657 - RNA, 64 nt, hsa; identical to SEQ ID NO: 340789

SEQ ID NO: 523658 - RNA, 64 nt, hsa; identical to SEQ ID NO: 340790

SEQ ID NO: 523659 - RNA, 64 nt, hsa; identical to SEQ ID NO: 340791

SEQ ID NO: 523660 - RNA, 64 nt, hsa; identical to SEQ ID NO: 340792

SEQ ID NO: 523661 - RNA, 64 nt, hsa; identical to SEQ ID NO: 340793

SEQ ID NO: 523662 - RNA, 64 nt, hsa; identical to SEQ ID NO: 340794

SEQ ID NO: 523663 - RNA, 64 nt, hsa; identical to SEQ ID NO: 340795

SEQ ID NO: 523664 - RNA, 64 nt, hsa; identical to SEQ ID NO: 340796

SEQ ID NO: 523665 - RNA, 64 nt, hsa; identical to SEQ ID NO: 340797

SEQ ID NO: 523666 - RNA, 64 nt, hsa; identical to SEQ ID NO: 340798

SEQ ID NO: 523667 - RNA, 64 nt, hsa; identical to SEQ ID NO: 340799

SEQ ID NO: 523668 - RNA, 64 nt, hsa; identical to SEQ ID NO: 340800

SEQ ID NO: 523669 - RNA, 64 nt, hsa; identical to SEQ ID NO: 340801

SEQ ID NO: 523670 - RNA, 64 nt, hsa; identical to SEQ ID NO: 340802

SEQ ID NO: 523671 - RNA, 64 nt, hsa; identical to SEQ ID NO: 340803

SEQ ID NO: 523672 - RNA, 64 nt, hsa; identical to SEQ ID NO: 340804

SEQ ID NO: 523673 - RNA, 64 nt, hsa; identical to SEQ ID NO: 340805

SEQ ID NO: 523674 - RNA, 64 nt, hsa; identical to SEQ ID NO: 340806

SEQ ID NO: 523675 - RNA, 64 nt, hsa; identical to SEQ ID NO: 340807

SEQ ID NO: 523676 - RNA, 64 nt, hsa; identical to SEQ ID NO: 340808

SEQ ID NO: 523677 - RNA, 64 nt, hsa; identical to SEQ ID NO: 340809

SEQ ID NO: 523678 - RNA, 64 nt, hsa; identical to SEQ ID NO: 340810

SEQ ID NO: 523679 - RNA, 64 nt, hsa; identical to SEQ ID NO: 340811

SEQ ID NO: 523680 - RNA, 64 nt, hsa; identical to SEQ ID NO: 340812

SEQ ID NO: 523681 - RNA, 64 nt, hsa; identical to SEQ ID NO: 340813

SEQ ID NO: 523682 - RNA, 64 nt, hsa; identical to SEQ ID NO: 340814

SEQ ID NO: 523683 - RNA, 64 nt, hsa; identical to SEQ ID NO: 340815

SEQ ID NO: 523684 - RNA, 64 nt, hsa; identical to SEQ ID NO: 340816

SEQ ID NO: 523685 - RNA, 64 nt, hsa; identical to SEQ ID NO: 340817

SEQ ID NO: 523686 - RNA, 64 nt, hsa; identical to SEQ ID NO: 340818

SEQ ID NO: 523687 - RNA, 64 nt, hsa; identical to SEQ ID NO: 340819

SEQ ID NO: 523688 - RNA, 64 nt, hsa; identical to SEQ ID NO: 340820

SEQ ID NO: 523689 - RNA, 64 nt, hsa; identical to SEQ ID NO: 340821

SEQ ID NO: 523690 - RNA, 64 nt, hsa; identical to SEQ ID NO: 340822

SEQ ID NO: 523691 - RNA, 64 nt, hsa; identical to SEQ ID NO: 340823

SEQ ID NO: 523692 - RNA, 64 nt, hsa; identical to SEQ ID NO: 340824

SEQ ID NO: 523693 - RNA, 64 nt, hsa; identical to SEQ ID NO: 340825

SEQ ID NO: 523694 - RNA, 64 nt, hsa; identical to SEQ ID NO: 340826

SEQ ID NO: 523695 - RNA, 64 nt, hsa; identical to SEQ ID NO: 340827

SEQ ID NO: 523696 - RNA, 64 nt, hsa; identical to SEQ ID NO: 340828

SEQ ID NO: 523697 - RNA, 64 nt, hsa; identical to SEQ ID NO: 340829

SEQ ID NO: 523698 - RNA, 64 nt, hsa; identical to SEQ ID NO: 340830

SEQ ID NO: 523699 - RNA, 64 nt, hsa; identical to SEQ ID NO: 340831

SEQ ID NO: 523700 - RNA, 64 nt, hsa; identical to SEQ ID NO: 340832

SEQ ID NO: 523701 - RNA, 64 nt, hsa; identical to SEQ ID NO: 340833

SEQ ID NO: 523702 - RNA, 64 nt, hsa; identical to SEQ ID NO: 340834

SEQ ID NO: 523703 - RNA, 64 nt, hsa; identical to SEQ ID NO: 340835

SEQ ID NO: 523704 - RNA, 64 nt, hsa; identical to SEQ ID NO: 340836

SEQ ID NO: 523705 - RNA, 64 nt, hsa; identical to SEQ ID NO: 340837

SEQ ID NO: 523706 - RNA, 64 nt, hsa; identical to SEQ ID NO: 340838

SEQ ID NO: 523707 - RNA, 64 nt, hsa; identical to SEQ ID NO: 340839

SEQ ID NO: 523708 - RNA, 64 nt, hsa; identical to SEQ ID NO: 340840

SEQ ID NO: 523709 - RNA, 64 nt, hsa; identical to SEQ ID NO: 340841

SEQ ID NO: 523710 - RNA, 64 nt, hsa; identical to SEQ ID NO: 340842

SEQ ID NO: 523711 - RNA, 64 nt, hsa; identical to SEQ ID NO: 340843

SEQ ID NO: 523712 - RNA, 64 nt, hsa; identical to SEQ ID NO: 340844

SEQ ID NO: 523713 - RNA, 64 nt, hsa; identical to SEQ ID NO: 340845

SEQ ID NO: 523714 - RNA, 64 nt, hsa; identical to SEQ ID NO: 340846

SEQ ID NO: 523715 - RNA, 64 nt, hsa; identical to SEQ ID NO: 340847

SEQ ID NO: 523716 - RNA, 64 nt, hsa; identical to SEQ ID NO: 340848

SEQ ID NO: 523717 - RNA, 64 nt, hsa; identical to SEQ ID NO: 340849

SEQ ID NO: 523718 - RNA, 64 nt, hsa; identical to SEQ ID NO: 340850

SEQ ID NO: 523719 - RNA, 64 nt, hsa; identical to SEQ ID NO: 340851

SEQ ID NO: 523720 - RNA, 64 nt, hsa; identical to SEQ ID NO: 340852

SEQ ID NO: 523721 - RNA, 64 nt, hsa; identical to SEQ ID NO: 340853

SEQ ID NO: 523722 - RNA, 64 nt, hsa; identical to SEQ ID NO: 340854

SEQ ID NO: 523723 - RNA, 64 nt, hsa; identical to SEQ ID NO: 340855

SEQ ID NO: 523724 - RNA, 64 nt, hsa; identical to SEQ ID NO: 340856

SEQ ID NO: 523725 - RNA, 64 nt, hsa; identical to SEQ ID NO: 340857

SEQ ID NO: 523726 - RNA, 64 nt, hsa; identical to SEQ ID NO: 340858

SEQ ID NO: 523727 - RNA, 64 nt, hsa; identical to SEQ ID NO: 340859

SEQ ID NO: 523728 - RNA, 64 nt, hsa; identical to SEQ ID NO: 340860

SEQ ID NO: 523729 - RNA, 64 nt, hsa; identical to SEQ ID NO: 340861

SEQ ID NO: 523730 - RNA, 64 nt, hsa; identical to SEQ ID NO: 340862

SEQ ID NO: 523731 - RNA, 64 nt, hsa; identical to SEQ ID NO: 340863

SEQ ID NO: 523732 - RNA, 64 nt, hsa; identical to SEQ ID NO: 340864

SEQ ID NO: 523733 - RNA, 64 nt, hsa; identical to SEQ ID NO: 340865

SEQ ID NO: 523734 - RNA, 64 nt, hsa; identical to SEQ ID NO: 115977

SEQ ID NO: 523735 - RNA, 64 nt, hsa; identical to SEQ ID NO: 115978

SEQ ID NO: 523736 - RNA, 64 nt, hsa; identical to SEQ ID NO: 115979

SEQ ID NO: 523737 - RNA, 64 nt, hsa; identical to SEQ ID NO: 115980

SEQ ID NO: 523738 - RNA, 64 nt, hsa; identical to SEQ ID NO: 115981

SEQ ID NO: 523739 - RNA, 64 nt, hsa; identical to SEQ ID NO: 115982

SEQ ID NO: 523740 - RNA, 64 nt, hsa; identical to SEQ ID NO: 115983

SEQ ID NO: 523741 - RNA, 64 nt, hsa; identical to SEQ ID NO: 115984

SEQ ID NO: 523742 - RNA, 64 nt, hsa; identical to SEQ ID NO: 115985

SEQ ID NO: 523743 - RNA, 64 nt, hsa; identical to SEQ ID NO: 115986

SEQ ID NO: 523744 - RNA, 64 nt, hsa; identical to SEQ ID NO: 115987

SEQ ID NO: 523745 - RNA, 64 nt, hsa; identical to SEQ ID NO: 115988

SEQ ID NO: 523746 - RNA, 64 nt, hsa; identical to SEQ ID NO: 115989

SEQ ID NO: 523747 - RNA, 64 nt, hsa; identical to SEQ ID NO: 115990

SEQ ID NO: 523748 - RNA, 64 nt, hsa; identical to SEQ ID NO: 115991

SEQ ID NO: 523749 - RNA, 64 nt, hsa; identical to SEQ ID NO: 115992

SEQ ID NO: 523750 - RNA, 64 nt, hsa; identical to SEQ ID NO: 115993

SEQ ID NO: 523751 - RNA, 64 nt, hsa; identical to SEQ ID NO: 115994

SEQ ID NO: 523752 - RNA, 64 nt, hsa; identical to SEQ ID NO: 115995

SEQ ID NO: 523753 - RNA, 64 nt, hsa; identical to SEQ ID NO: 115996

SEQ ID NO: 523754 - RNA, 64 nt, hsa; identical to SEQ ID NO: 115997

SEQ ID NO: 523755 - RNA, 64 nt, hsa; identical to SEQ ID NO: 115998

SEQ ID NO: 523756 - RNA, 64 nt, hsa; identical to SEQ ID NO: 115999

SEQ ID NO: 523757 - RNA, 64 nt, hsa; identical to SEQ ID NO: 116000

SEQ ID NO: 523758 - RNA, 64 nt, hsa; identical to SEQ ID NO: 116001

SEQ ID NO: 523759 - RNA, 64 nt, hsa; identical to SEQ ID NO: 116002

SEQ ID NO: 523760 - RNA, 64 nt, hsa; identical to SEQ ID NO: 116003

SEQ ID NO: 523761 - RNA, 64 nt, hsa; identical to SEQ ID NO: 116004

SEQ ID NO: 523762 - RNA, 64 nt, hsa; identical to SEQ ID NO: 116005

SEQ ID NO: 523763 - RNA, 64 nt, hsa; identical to SEQ ID NO: 116006

SEQ ID NO: 523764 - RNA, 64 nt, hsa; identical to SEQ ID NO: 116007

SEQ ID NO: 523765 - RNA, 64 nt, hsa; identical to SEQ ID NO: 116008

SEQ ID NO: 523766 - RNA, 64 nt, hsa; identical to SEQ ID NO: 116009

SEQ ID NO: 523767 - RNA, 64 nt, hsa; identical to SEQ ID NO: 116010

SEQ ID NO: 523768 - RNA, 64 nt, hsa; identical to SEQ ID NO: 116011

SEQ ID NO: 523769 - RNA, 64 nt, hsa; identical to SEQ ID NO: 116012

SEQ ID NO: 523770 - RNA, 64 nt, hsa; identical to SEQ ID NO: 116013

SEQ ID NO: 523771 - RNA, 64 nt, hsa; identical to SEQ ID NO: 116014

SEQ ID NO: 523772 - RNA, 64 nt, hsa; identical to SEQ ID NO: 116015

SEQ ID NO: 523773 - RNA, 64 nt, hsa; identical to SEQ ID NO: 116016

SEQ ID NO: 523774 - RNA, 64 nt, hsa; identical to SEQ ID NO: 116017

SEQ ID NO: 523775 - RNA, 64 nt, hsa; identical to SEQ ID NO: 116018

SEQ ID NO: 523776 - RNA, 64 nt, hsa; identical to SEQ ID NO: 116019

SEQ ID NO: 523777 - RNA, 64 nt, hsa; identical to SEQ ID NO: 116020

SEQ ID NO: 523778 - RNA, 64 nt, hsa; identical to SEQ ID NO: 116021

SEQ ID NO: 523779 - RNA, 64 nt, hsa; identical to SEQ ID NO: 116022

SEQ ID NO: 523780 - RNA, 64 nt, hsa; identical to SEQ ID NO: 116023

SEQ ID NO: 523781 - RNA, 64 nt, hsa; identical to SEQ ID NO: 116024

SEQ ID NO: 523782 - RNA, 64 nt, hsa; identical to SEQ ID NO: 116025

SEQ ID NO: 523783 - RNA, 64 nt, hsa; identical to SEQ ID NO: 116026

SEQ ID NO: 523784 - RNA, 64 nt, hsa; identical to SEQ ID NO: 116027

SEQ ID NO: 523785 - RNA, 64 nt, hsa; identical to SEQ ID NO: 116028

SEQ ID NO: 523786 - RNA, 64 nt, hsa; identical to SEQ ID NO: 116029

SEQ ID NO: 523787 - RNA, 64 nt, hsa; identical to SEQ ID NO: 116030

SEQ ID NO: 523788 - RNA, 64 nt, hsa; identical to SEQ ID NO: 116031

SEQ ID NO: 523789 - RNA, 64 nt, hsa; identical to SEQ ID NO: 116032

SEQ ID NO: 523790 - RNA, 64 nt, hsa; identical to SEQ ID NO: 116033

SEQ ID NO: 523791 - RNA, 64 nt, hsa; identical to SEQ ID NO: 116034

SEQ ID NO: 523792 - RNA, 64 nt, hsa; identical to SEQ ID NO: 116035

SEQ ID NO: 523793 - RNA, 64 nt, hsa; identical to SEQ ID NO: 116036

SEQ ID NO: 523794 - RNA, 64 nt, hsa; identical to SEQ ID NO: 116037

SEQ ID NO: 523795 - RNA, 64 nt, hsa; identical to SEQ ID NO: 116038

SEQ ID NO: 523796 - RNA, 64 nt, hsa; identical to SEQ ID NO: 116039

SEQ ID NO: 523797 - RNA, 64 nt, hsa; identical to SEQ ID NO: 116040

SEQ ID NO: 523798 - RNA, 64 nt, hsa; identical to SEQ ID NO: 116041

SEQ ID NO: 523799 - RNA, 64 nt, hsa; identical to SEQ ID NO: 116042

SEQ ID NO: 523800 - RNA, 64 nt, hsa; identical to SEQ ID NO: 116043

SEQ ID NO: 523801 - RNA, 64 nt, hsa; identical to SEQ ID NO: 116044

SEQ ID NO: 523802 - RNA, 64 nt, hsa; identical to SEQ ID NO: 116045

SEQ ID NO: 523803 - RNA, 64 nt, hsa; identical to SEQ ID NO: 116046

SEQ ID NO: 523804 - RNA, 64 nt, hsa; identical to SEQ ID NO: 116047

SEQ ID NO: 523805 - RNA, 64 nt, hsa; identical to SEQ ID NO: 116048

SEQ ID NO: 523806 - RNA, 64 nt, hsa; identical to SEQ ID NO: 116049

SEQ ID NO: 523807 - RNA, 64 nt, hsa; identical to SEQ ID NO: 116050

SEQ ID NO: 523808 - RNA, 64 nt, hsa; identical to SEQ ID NO: 116051

SEQ ID NO: 523809 - RNA, 64 nt, hsa; identical to SEQ ID NO: 116052

SEQ ID NO: 523810 - RNA, 64 nt, hsa; identical to SEQ ID NO: 116053

SEQ ID NO: 523811 - RNA, 64 nt, hsa; identical to SEQ ID NO: 116054

SEQ ID NO: 523812 - RNA, 64 nt, hsa; identical to SEQ ID NO: 116055

SEQ ID NO: 523813 - RNA, 64 nt, hsa; identical to SEQ ID NO: 116056

SEQ ID NO: 523814 - RNA, 64 nt, hsa; identical to SEQ ID NO: 116057

SEQ ID NO: 523815 - RNA, 64 nt, hsa; identical to SEQ ID NO: 116058

SEQ ID NO: 523816 - RNA, 64 nt, hsa; identical to SEQ ID NO: 116059

SEQ ID NO: 523817 - RNA, 64 nt, hsa; identical to SEQ ID NO: 116060

SEQ ID NO: 523818 - RNA, 64 nt, hsa; identical to SEQ ID NO: 116061

SEQ ID NO: 523819 - RNA, 64 nt, hsa; identical to SEQ ID NO: 116062

SEQ ID NO: 523820 - RNA, 64 nt, hsa; identical to SEQ ID NO: 116063

SEQ ID NO: 523821 - RNA, 64 nt, hsa; identical to SEQ ID NO: 116064

SEQ ID NO: 523822 - RNA, 64 nt, hsa; identical to SEQ ID NO: 116065

SEQ ID NO: 523823 - RNA, 64 nt, hsa; identical to SEQ ID NO: 116066

SEQ ID NO: 523824 - RNA, 64 nt, hsa; identical to SEQ ID NO: 116067

SEQ ID NO: 523825 - RNA, 64 nt, hsa; identical to SEQ ID NO: 116068

SEQ ID NO: 523826 - RNA, 64 nt, hsa; identical to SEQ ID NO: 116069

SEQ ID NO: 523827 - RNA, 64 nt, hsa; identical to SEQ ID NO: 116070

SEQ ID NO: 523828 - RNA, 64 nt, hsa; identical to SEQ ID NO: 116071

SEQ ID NO: 523829 - RNA, 64 nt, hsa; identical to SEQ ID NO: 116072

SEQ ID NO: 523830 - RNA, 64 nt, hsa; identical to SEQ ID NO: 116073

SEQ ID NO: 523831 - RNA, 64 nt, hsa; identical to SEQ ID NO: 116074

SEQ ID NO: 523832 - RNA, 64 nt, hsa; identical to SEQ ID NO: 116075

SEQ ID NO: 523833 - RNA, 64 nt, hsa; identical to SEQ ID NO: 116076

SEQ ID NO: 523834 - RNA, 64 nt, hsa; identical to SEQ ID NO: 116077

SEQ ID NO: 523835 - RNA, 64 nt, hsa; identical to SEQ ID NO: 116078

SEQ ID NO: 523836 - RNA, 64 nt, hsa; identical to SEQ ID NO: 116079

SEQ ID NO: 523837 - RNA, 64 nt, hsa; identical to SEQ ID NO: 116080

SEQ ID NO: 523838 - RNA, 64 nt, hsa; identical to SEQ ID NO: 116081

SEQ ID NO: 523839 - RNA, 64 nt, hsa; identical to SEQ ID NO: 116082

SEQ ID NO: 523840 - RNA, 64 nt, hsa; identical to SEQ ID NO: 116083

SEQ ID NO: 523841 - RNA, 64 nt, hsa; identical to SEQ ID NO: 116084

SEQ ID NO: 523842 - RNA, 64 nt, hsa; identical to SEQ ID NO: 116085

SEQ ID NO: 523843 - RNA, 64 nt, hsa; identical to SEQ ID NO: 116086

SEQ ID NO: 523844 - RNA, 64 nt, hsa; identical to SEQ ID NO: 116087

SEQ ID NO: 523845 - RNA, 64 nt, hsa; identical to SEQ ID NO: 116088

SEQ ID NO: 523846 - RNA, 64 nt, hsa; identical to SEQ ID NO: 116089

SEQ ID NO: 523847 - RNA, 64 nt, hsa; identical to SEQ ID NO: 116090

SEQ ID NO: 523848 - RNA, 64 nt, hsa; identical to SEQ ID NO: 116091

SEQ ID NO: 523849 - RNA, 64 nt, hsa; identical to SEQ ID NO: 116092

SEQ ID NO: 523850 - RNA, 64 nt, hsa; identical to SEQ ID NO: 116093

SEQ ID NO: 523851 - RNA, 64 nt, hsa; identical to SEQ ID NO: 116094

SEQ ID NO: 523852 - RNA, 64 nt, hsa; identical to SEQ ID NO: 116095

SEQ ID NO: 523853 - RNA, 64 nt, hsa; identical to SEQ ID NO: 116096

SEQ ID NO: 523854 - RNA, 64 nt, hsa; identical to SEQ ID NO: 116097

SEQ ID NO: 523855 - RNA, 64 nt, hsa; identical to SEQ ID NO: 116098

SEQ ID NO: 523856 - RNA, 64 nt, hsa; identical to SEQ ID NO: 116099

SEQ ID NO: 523857 - RNA, 64 nt, hsa; identical to SEQ ID NO: 116100

SEQ ID NO: 523858 - RNA, 64 nt, hsa; identical to SEQ ID NO: 116101

SEQ ID NO: 523859 - RNA, 64 nt, hsa; identical to SEQ ID NO: 116102

SEQ ID NO: 523860 - RNA, 64 nt, hsa; identical to SEQ ID NO: 116103

SEQ ID NO: 523861 - RNA, 64 nt, hsa; identical to SEQ ID NO: 116104

SEQ ID NO: 523862 - RNA, 64 nt, hsa; identical to SEQ ID NO: 116105

SEQ ID NO: 523863 - RNA, 64 nt, hsa; identical to SEQ ID NO: 116106

SEQ ID NO: 523864 - RNA, 64 nt, hsa; identical to SEQ ID NO: 116107

SEQ ID NO: 523865 - RNA, 64 nt, hsa; identical to SEQ ID NO: 116108

SEQ ID NO: 523866 - RNA, 64 nt, hsa; identical to SEQ ID NO: 116109

SEQ ID NO: 523867 - RNA, 64 nt, hsa; identical to SEQ ID NO: 116110

SEQ ID NO: 523868 - RNA, 64 nt, hsa; identical to SEQ ID NO: 116111

SEQ ID NO: 523869 - RNA, 64 nt, hsa; identical to SEQ ID NO: 116112

SEQ ID NO: 523870 - RNA, 64 nt, hsa; identical to SEQ ID NO: 116113

SEQ ID NO: 523871 - RNA, 64 nt, hsa; identical to SEQ ID NO: 116114

SEQ ID NO: 523872 - RNA, 64 nt, hsa; identical to SEQ ID NO: 116115

SEQ ID NO: 523873 - RNA, 64 nt, hsa; identical to SEQ ID NO: 116116

SEQ ID NO: 523874 - RNA, 64 nt, hsa; identical to SEQ ID NO: 116117

SEQ ID NO: 523875 - RNA, 64 nt, hsa; identical to SEQ ID NO: 116118

SEQ ID NO: 523876 - RNA, 64 nt, hsa; identical to SEQ ID NO: 116119

SEQ ID NO: 523877 - RNA, 64 nt, hsa; identical to SEQ ID NO: 116120

SEQ ID NO: 523878 - RNA, 64 nt, hsa; identical to SEQ ID NO: 116121

SEQ ID NO: 523879 - RNA, 64 nt, hsa; identical to SEQ ID NO: 116122

SEQ ID NO: 523880 - RNA, 64 nt, hsa; identical to SEQ ID NO: 116123

SEQ ID NO: 523881 - RNA, 64 nt, hsa; identical to SEQ ID NO: 116124

SEQ ID NO: 523882 - RNA, 64 nt, hsa; identical to SEQ ID NO: 116125

SEQ ID NO: 523883 - RNA, 64 nt, hsa; identical to SEQ ID NO: 116126

SEQ ID NO: 523884 - RNA, 64 nt, hsa; identical to SEQ ID NO: 116127

SEQ ID NO: 523885 - RNA, 64 nt, hsa; identical to SEQ ID NO: 116128

SEQ ID NO: 523886 - RNA, 64 nt, hsa; identical to SEQ ID NO: 116129

SEQ ID NO: 523887 - RNA, 64 nt, hsa; identical to SEQ ID NO: 116130

SEQ ID NO: 523888 - RNA, 64 nt, hsa; identical to SEQ ID NO: 116131

SEQ ID NO: 523889 - RNA, 64 nt, hsa; identical to SEQ ID NO: 116132

SEQ ID NO: 523890 - RNA, 64 nt, hsa; identical to SEQ ID NO: 116133

SEQ ID NO: 523891 - RNA, 64 nt, hsa; identical to SEQ ID NO: 116134

SEQ ID NO: 523892 - RNA, 64 nt, hsa; identical to SEQ ID NO: 116135

SEQ ID NO: 523893 - RNA, 64 nt, hsa; identical to SEQ ID NO: 116136

SEQ ID NO: 523894 - RNA, 64 nt, hsa; identical to SEQ ID NO: 116137

SEQ ID NO: 523895 - RNA, 64 nt, hsa; identical to SEQ ID NO: 116138

SEQ ID NO: 523896 - RNA, 64 nt, hsa; identical to SEQ ID NO: 116139

SEQ ID NO: 523897 - RNA, 64 nt, hsa; identical to SEQ ID NO: 116140

SEQ ID NO: 523898 - RNA, 64 nt, hsa; identical to SEQ ID NO: 116141

SEQ ID NO: 523899 - RNA, 64 nt, hsa; identical to SEQ ID NO: 116142

SEQ ID NO: 523900 - RNA, 64 nt, hsa; identical to SEQ ID NO: 116143

SEQ ID NO: 523901 - RNA, 64 nt, hsa; identical to SEQ ID NO: 116144

SEQ ID NO: 523902 - RNA, 64 nt, hsa; identical to SEQ ID NO: 116145

SEQ ID NO: 523903 - RNA, 64 nt, hsa; identical to SEQ ID NO: 116146

SEQ ID NO: 523904 - RNA, 64 nt, hsa; identical to SEQ ID NO: 116147

SEQ ID NO: 523905 - RNA, 64 nt, hsa; identical to SEQ ID NO: 116148

SEQ ID NO: 523906 - RNA, 64 nt, hsa; identical to SEQ ID NO: 116149

SEQ ID NO: 523907 - RNA, 64 nt, hsa; identical to SEQ ID NO: 116150

SEQ ID NO: 523908 - RNA, 64 nt, hsa; identical to SEQ ID NO: 116151

SEQ ID NO: 523909 - RNA, 64 nt, hsa; identical to SEQ ID NO: 116152

SEQ ID NO: 523910 - RNA, 64 nt, hsa; identical to SEQ ID NO: 116153

SEQ ID NO: 523911 - RNA, 64 nt, hsa; identical to SEQ ID NO: 116154

SEQ ID NO: 523912 - RNA, 64 nt, hsa; identical to SEQ ID NO: 116155

SEQ ID NO: 523913 - RNA, 64 nt, hsa; identical to SEQ ID NO: 116156

SEQ ID NO: 523914 - RNA, 64 nt, hsa; identical to SEQ ID NO: 116157

SEQ ID NO: 523915 - RNA, 64 nt, hsa; identical to SEQ ID NO: 116158

SEQ ID NO: 523916 - RNA, 64 nt, hsa; identical to SEQ ID NO: 116159

SEQ ID NO: 523917 - RNA, 64 nt, hsa; identical to SEQ ID NO: 116160

SEQ ID NO: 523918 - RNA, 64 nt, hsa; identical to SEQ ID NO: 116161

SEQ ID NO: 523919 - RNA, 64 nt, hsa; identical to SEQ ID NO: 116162

SEQ ID NO: 523920 - RNA, 64 nt, hsa; identical to SEQ ID NO: 116163

SEQ ID NO: 523921 - RNA, 64 nt, hsa; identical to SEQ ID NO: 116164

SEQ ID NO: 523922 - RNA, 64 nt, hsa; identical to SEQ ID NO: 116165

SEQ ID NO: 523923 - RNA, 64 nt, hsa; identical to SEQ ID NO: 116166

SEQ ID NO: 523924 - RNA, 64 nt, hsa; identical to SEQ ID NO: 116167

SEQ ID NO: 523925 - RNA, 64 nt, hsa; identical to SEQ ID NO: 116168

SEQ ID NO: 523926 - RNA, 64 nt, hsa; identical to SEQ ID NO: 116169

SEQ ID NO: 523927 - RNA, 64 nt, hsa; identical to SEQ ID NO: 116170

SEQ ID NO: 523928 - RNA, 64 nt, hsa; identical to SEQ ID NO: 116171

SEQ ID NO: 523929 - RNA, 64 nt, hsa; identical to SEQ ID NO: 116172

SEQ ID NO: 523930 - RNA, 64 nt, hsa; identical to SEQ ID NO: 116173

SEQ ID NO: 523931 - RNA, 64 nt, hsa; identical to SEQ ID NO: 116174

SEQ ID NO: 523932 - RNA, 64 nt, hsa; identical to SEQ ID NO: 116175

SEQ ID NO: 523933 - RNA, 64 nt, hsa; identical to SEQ ID NO: 116176

SEQ ID NO: 523934 - RNA, 64 nt, hsa; identical to SEQ ID NO: 116177

SEQ ID NO: 523935 - RNA, 64 nt, hsa; identical to SEQ ID NO: 116178

SEQ ID NO: 523936 - RNA, 64 nt, hsa; identical to SEQ ID NO: 116179

SEQ ID NO: 523937 - RNA, 64 nt, hsa; identical to SEQ ID NO: 116180

SEQ ID NO: 523938 - RNA, 64 nt, hsa; identical to SEQ ID NO: 116181

SEQ ID NO: 523939 - RNA, 64 nt, hsa; identical to SEQ ID NO: 116182

SEQ ID NO: 523940 - RNA, 64 nt, hsa; identical to SEQ ID NO: 116183

SEQ ID NO: 523941 - RNA, 64 nt, hsa; identical to SEQ ID NO: 116184

SEQ ID NO: 523942 - RNA, 64 nt, hsa; identical to SEQ ID NO: 116185

SEQ ID NO: 523943 - RNA, 64 nt, hsa; identical to SEQ ID NO: 116186

SEQ ID NO: 523944 - RNA, 64 nt, hsa; identical to SEQ ID NO: 116187

SEQ ID NO: 523945 - RNA, 64 nt, hsa; identical to SEQ ID NO: 116188

SEQ ID NO: 523946 - RNA, 64 nt, hsa; identical to SEQ ID NO: 116189

SEQ ID NO: 523947 - RNA, 64 nt, hsa; identical to SEQ ID NO: 116190

SEQ ID NO: 523948 - RNA, 64 nt, hsa; identical to SEQ ID NO: 116191

SEQ ID NO: 523949 - RNA, 64 nt, hsa; identical to SEQ ID NO: 116192

SEQ ID NO: 523950 - RNA, 64 nt, hsa; identical to SEQ ID NO: 116193

SEQ ID NO: 523951 - RNA, 64 nt, hsa; identical to SEQ ID NO: 116194

SEQ ID NO: 523952 - RNA, 64 nt, hsa; identical to SEQ ID NO: 116195

SEQ ID NO: 523953 - RNA, 64 nt, hsa; identical to SEQ ID NO: 116196

SEQ ID NO: 523954 - RNA, 64 nt, hsa; identical to SEQ ID NO: 116197

SEQ ID NO: 523955 - RNA, 64 nt, hsa; identical to SEQ ID NO: 116198

SEQ ID NO: 523956 - RNA, 64 nt, hsa; identical to SEQ ID NO: 116199

SEQ ID NO: 523957 - RNA, 64 nt, hsa; identical to SEQ ID NO: 116200

SEQ ID NO: 523958 - RNA, 64 nt, hsa; identical to SEQ ID NO: 116201

SEQ ID NO: 523959 - RNA, 64 nt, hsa; identical to SEQ ID NO: 116202

SEQ ID NO: 523960 - RNA, 64 nt, hsa; identical to SEQ ID NO: 116203

SEQ ID NO: 523961 - RNA, 64 nt, hsa; identical to SEQ ID NO: 116204

SEQ ID NO: 523962 - RNA, 64 nt, hsa; identical to SEQ ID NO: 116205

SEQ ID NO: 523963 - RNA, 64 nt, hsa; identical to SEQ ID NO: 116206

SEQ ID NO: 523964 - RNA, 64 nt, hsa; identical to SEQ ID NO: 116207

SEQ ID NO: 523965 - RNA, 64 nt, hsa; identical to SEQ ID NO: 116208

SEQ ID NO: 523966 - RNA, 64 nt, hsa; identical to SEQ ID NO: 116209

SEQ ID NO: 523967 - RNA, 64 nt, hsa; identical to SEQ ID NO: 116210

SEQ ID NO: 523968 - RNA, 64 nt, hsa; identical to SEQ ID NO: 116211

SEQ ID NO: 523969 - RNA, 64 nt, hsa; identical to SEQ ID NO: 116212

SEQ ID NO: 523970 - RNA, 64 nt, hsa; identical to SEQ ID NO: 116213

SEQ ID NO: 523971 - RNA, 64 nt, hsa; identical to SEQ ID NO: 116214

SEQ ID NO: 523972 - RNA, 64 nt, hsa; identical to SEQ ID NO: 116215

SEQ ID NO: 523973 - RNA, 64 nt, hsa; identical to SEQ ID NO: 116216

SEQ ID NO: 523974 - RNA, 64 nt, hsa; identical to SEQ ID NO: 116217

SEQ ID NO: 523975 - RNA, 64 nt, hsa; identical to SEQ ID NO: 116218

SEQ ID NO: 523976 - RNA, 64 nt, hsa; identical to SEQ ID NO: 116219

SEQ ID NO: 523977 - RNA, 64 nt, hsa; identical to SEQ ID NO: 116220

SEQ ID NO: 523978 - RNA, 64 nt, hsa; identical to SEQ ID NO: 116221

SEQ ID NO: 523979 - RNA, 64 nt, hsa; identical to SEQ ID NO: 116222

SEQ ID NO: 523980 - RNA, 64 nt, hsa; identical to SEQ ID NO: 116223

SEQ ID NO: 523981 - RNA, 64 nt, hsa; identical to SEQ ID NO: 116224

SEQ ID NO: 523982 - RNA, 64 nt, hsa; identical to SEQ ID NO: 116225

SEQ ID NO: 523983 - RNA, 64 nt, hsa; identical to SEQ ID NO: 116226

SEQ ID NO: 523984 - RNA, 64 nt, hsa; identical to SEQ ID NO: 116227

SEQ ID NO: 523985 - RNA, 64 nt, hsa; identical to SEQ ID NO: 116228

SEQ ID NO: 523986 - RNA, 64 nt, hsa; identical to SEQ ID NO: 116229

SEQ ID NO: 523987 - RNA, 64 nt, hsa; identical to SEQ ID NO: 116230

SEQ ID NO: 523988 - RNA, 64 nt, hsa; identical to SEQ ID NO: 116231

SEQ ID NO: 523989 - RNA, 64 nt, hsa; identical to SEQ ID NO: 116232

SEQ ID NO: 523990 - RNA, 64 nt, hsa; identical to SEQ ID NO: 116233

SEQ ID NO: 523991 - RNA, 64 nt, hsa; identical to SEQ ID NO: 116234

SEQ ID NO: 523992 - RNA, 64 nt, hsa; identical to SEQ ID NO: 116235

SEQ ID NO: 523993 - RNA, 64 nt, hsa; identical to SEQ ID NO: 116236

SEQ ID NO: 523994 - RNA, 64 nt, hsa; identical to SEQ ID NO: 116237

SEQ ID NO: 523995 - RNA, 64 nt, hsa; identical to SEQ ID NO: 116238

SEQ ID NO: 523996 - RNA, 64 nt, hsa; identical to SEQ ID NO: 116239

SEQ ID NO: 523997 - RNA, 64 nt, hsa; identical to SEQ ID NO: 116240

SEQ ID NO: 523998 - RNA, 64 nt, hsa; identical to SEQ ID NO: 116241

SEQ ID NO: 523999 - RNA, 64 nt, hsa; identical to SEQ ID NO: 116242

SEQ ID NO: 524000 - RNA, 64 nt, hsa; identical to SEQ ID NO: 116243

SEQ ID NO: 524001 - RNA, 64 nt, hsa; identical to SEQ ID NO: 116244

SEQ ID NO: 524002 - RNA, 64 nt, hsa; identical to SEQ ID NO: 116245

SEQ ID NO: 524003 - RNA, 64 nt, hsa; identical to SEQ ID NO: 116246

SEQ ID NO: 524004 - RNA, 64 nt, hsa; identical to SEQ ID NO: 116247

SEQ ID NO: 524005 - RNA, 64 nt, hsa; identical to SEQ ID NO: 116248

SEQ ID NO: 524006 - RNA, 64 nt, hsa; identical to SEQ ID NO: 116249

SEQ ID NO: 524007 - RNA, 64 nt, hsa; identical to SEQ ID NO: 116250

SEQ ID NO: 524008 - RNA, 64 nt, hsa; identical to SEQ ID NO: 116251

SEQ ID NO: 524009 - RNA, 64 nt, hsa; identical to SEQ ID NO: 116252

SEQ ID NO: 524010 - RNA, 64 nt, hsa; identical to SEQ ID NO: 116253

SEQ ID NO: 524011 - RNA, 64 nt, hsa; identical to SEQ ID NO: 116254

SEQ ID NO: 524012 - RNA, 64 nt, hsa; identical to SEQ ID NO: 116255

SEQ ID NO: 524013 - RNA, 64 nt, hsa; identical to SEQ ID NO: 116256

SEQ ID NO: 524014 - RNA, 64 nt, hsa; identical to SEQ ID NO: 116257

SEQ ID NO: 524015 - RNA, 64 nt, hsa; identical to SEQ ID NO: 116258

SEQ ID NO: 524016 - RNA, 64 nt, hsa; identical to SEQ ID NO: 116259

SEQ ID NO: 524017 - RNA, 64 nt, hsa; identical to SEQ ID NO: 116260

SEQ ID NO: 524018 - RNA, 64 nt, hsa; identical to SEQ ID NO: 116261

SEQ ID NO: 524019 - RNA, 64 nt, hsa; identical to SEQ ID NO: 116262

SEQ ID NO: 524020 - RNA, 64 nt, hsa; identical to SEQ ID NO: 116263

SEQ ID NO: 524021 - RNA, 64 nt, hsa; identical to SEQ ID NO: 116264

SEQ ID NO: 524022 - RNA, 64 nt, hsa; identical to SEQ ID NO: 116265

SEQ ID NO: 524023 - RNA, 64 nt, hsa; identical to SEQ ID NO: 116266

SEQ ID NO: 524024 - RNA, 64 nt, hsa; identical to SEQ ID NO: 116267

SEQ ID NO: 524025 - RNA, 64 nt, hsa; identical to SEQ ID NO: 116268

SEQ ID NO: 524026 - RNA, 64 nt, hsa; identical to SEQ ID NO: 116269

SEQ ID NO: 524027 - RNA, 64 nt, hsa; identical to SEQ ID NO: 116270

SEQ ID NO: 524028 - RNA, 64 nt, hsa; identical to SEQ ID NO: 116271

SEQ ID NO: 524029 - RNA, 64 nt, hsa; identical to SEQ ID NO: 116272

SEQ ID NO: 524030 - RNA, 64 nt, hsa; identical to SEQ ID NO: 116273

SEQ ID NO: 524031 - RNA, 64 nt, hsa; identical to SEQ ID NO: 116274

SEQ ID NO: 524032 - RNA, 64 nt, hsa; identical to SEQ ID NO: 116275

SEQ ID NO: 524033 - RNA, 64 nt, hsa; identical to SEQ ID NO: 116276

SEQ ID NO: 524034 - RNA, 64 nt, hsa; identical to SEQ ID NO: 116277

SEQ ID NO: 524035 - RNA, 64 nt, hsa; identical to SEQ ID NO: 116278

SEQ ID NO: 524036 - RNA, 64 nt, hsa; identical to SEQ ID NO: 116279

SEQ ID NO: 524037 - RNA, 64 nt, hsa; identical to SEQ ID NO: 116280

SEQ ID NO: 524038 - RNA, 64 nt, hsa; identical to SEQ ID NO: 116281

SEQ ID NO: 524039 - RNA, 64 nt, hsa; identical to SEQ ID NO: 116282

SEQ ID NO: 524040 - RNA, 64 nt, hsa; identical to SEQ ID NO: 116283

SEQ ID NO: 524041 - RNA, 64 nt, hsa; identical to SEQ ID NO: 116284

SEQ ID NO: 524042 - RNA, 64 nt, hsa; identical to SEQ ID NO: 116285

SEQ ID NO: 524043 - RNA, 64 nt, hsa; identical to SEQ ID NO: 116286

SEQ ID NO: 524044 - RNA, 64 nt, hsa; identical to SEQ ID NO: 116287

SEQ ID NO: 524045 - RNA, 64 nt, hsa; identical to SEQ ID NO: 116288

SEQ ID NO: 524046 - RNA, 64 nt, hsa; identical to SEQ ID NO: 116289

SEQ ID NO: 524047 - RNA, 64 nt, hsa; identical to SEQ ID NO: 116290

SEQ ID NO: 524048 - RNA, 64 nt, hsa; identical to SEQ ID NO: 116291

SEQ ID NO: 524049 - RNA, 64 nt, hsa; identical to SEQ ID NO: 116292

SEQ ID NO: 524050 - RNA, 64 nt, hsa; identical to SEQ ID NO: 116293

SEQ ID NO: 524051 - RNA, 64 nt, hsa; identical to SEQ ID NO: 116294

SEQ ID NO: 524052 - RNA, 64 nt, hsa; identical to SEQ ID NO: 116295

SEQ ID NO: 524053 - RNA, 64 nt, hsa; identical to SEQ ID NO: 116296

SEQ ID NO: 524054 - RNA, 64 nt, hsa; identical to SEQ ID NO: 116297

SEQ ID NO: 524055 - RNA, 64 nt, hsa; identical to SEQ ID NO: 116298

SEQ ID NO: 524056 - RNA, 64 nt, hsa; identical to SEQ ID NO: 116299

SEQ ID NO: 524057 - RNA, 64 nt, hsa; identical to SEQ ID NO: 116300

SEQ ID NO: 524058 - RNA, 64 nt, hsa; identical to SEQ ID NO: 116301

SEQ ID NO: 524059 - RNA, 64 nt, hsa; identical to SEQ ID NO: 116302

SEQ ID NO: 524060 - RNA, 64 nt, hsa; identical to SEQ ID NO: 116303

SEQ ID NO: 524061 - RNA, 64 nt, hsa; identical to SEQ ID NO: 116304

SEQ ID NO: 524062 - RNA, 64 nt, hsa; identical to SEQ ID NO: 116305

SEQ ID NO: 524063 - RNA, 64 nt, hsa; identical to SEQ ID NO: 116306

SEQ ID NO: 524064 - RNA, 64 nt, hsa; identical to SEQ ID NO: 116307

SEQ ID NO: 524065 - RNA, 64 nt, hsa; identical to SEQ ID NO: 116308

SEQ ID NO: 524066 - RNA, 64 nt, hsa; identical to SEQ ID NO: 116309

SEQ ID NO: 524067 - RNA, 64 nt, hsa; identical to SEQ ID NO: 116310

SEQ ID NO: 524068 - RNA, 64 nt, hsa; identical to SEQ ID NO: 116311

SEQ ID NO: 524069 - RNA, 64 nt, hsa; identical to SEQ ID NO: 116312

SEQ ID NO: 524070 - RNA, 64 nt, hsa; identical to SEQ ID NO: 116313

SEQ ID NO: 524071 - RNA, 64 nt, hsa; identical to SEQ ID NO: 116314

SEQ ID NO: 524072 - RNA, 64 nt, hsa; identical to SEQ ID NO: 116315

SEQ ID NO: 524073 - RNA, 64 nt, hsa; identical to SEQ ID NO: 116316

SEQ ID NO: 524074 - RNA, 64 nt, hsa; identical to SEQ ID NO: 116317

SEQ ID NO: 524075 - RNA, 64 nt, hsa; identical to SEQ ID NO: 116318

SEQ ID NO: 524076 - RNA, 64 nt, hsa; identical to SEQ ID NO: 116319

SEQ ID NO: 524077 - RNA, 64 nt, hsa; identical to SEQ ID NO: 116320

SEQ ID NO: 524078 - RNA, 64 nt, hsa; identical to SEQ ID NO: 116321

SEQ ID NO: 524079 - RNA, 64 nt, hsa; identical to SEQ ID NO: 116322

SEQ ID NO: 524080 - RNA, 64 nt, hsa; identical to SEQ ID NO: 116323

SEQ ID NO: 524081 - RNA, 64 nt, hsa; identical to SEQ ID NO: 116324

SEQ ID NO: 524082 - RNA, 64 nt, hsa; identical to SEQ ID NO: 116325

SEQ ID NO: 524083 - RNA, 64 nt, hsa; identical to SEQ ID NO: 116326

SEQ ID NO: 524084 - RNA, 64 nt, hsa; identical to SEQ ID NO: 116327

SEQ ID NO: 524085 - RNA, 64 nt, hsa; identical to SEQ ID NO: 116328

SEQ ID NO: 524086 - RNA, 64 nt, hsa; identical to SEQ ID NO: 116329

SEQ ID NO: 524087 - RNA, 64 nt, hsa; identical to SEQ ID NO: 116330

SEQ ID NO: 524088 - RNA, 64 nt, hsa; identical to SEQ ID NO: 116331

SEQ ID NO: 524089 - RNA, 64 nt, hsa; identical to SEQ ID NO: 116332

SEQ ID NO: 524090 - RNA, 64 nt, hsa; identical to SEQ ID NO: 116333

SEQ ID NO: 524091 - RNA, 64 nt, hsa; identical to SEQ ID NO: 116334

SEQ ID NO: 524092 - RNA, 64 nt, hsa; identical to SEQ ID NO: 116335

SEQ ID NO: 524093 - RNA, 64 nt, hsa; identical to SEQ ID NO: 116336

SEQ ID NO: 524094 - RNA, 64 nt, hsa; identical to SEQ ID NO: 116337

SEQ ID NO: 524095 - RNA, 64 nt, hsa; identical to SEQ ID NO: 116338

SEQ ID NO: 524096 - RNA, 64 nt, hsa; identical to SEQ ID NO: 116339

SEQ ID NO: 524097 - RNA, 64 nt, hsa; identical to SEQ ID NO: 116340

SEQ ID NO: 524098 - RNA, 64 nt, hsa; identical to SEQ ID NO: 116341

SEQ ID NO: 524099 - RNA, 64 nt, hsa; identical to SEQ ID NO: 116342

SEQ ID NO: 524100 - RNA, 64 nt, hsa; identical to SEQ ID NO: 116343

SEQ ID NO: 524101 - RNA, 64 nt, hsa; identical to SEQ ID NO: 116344

SEQ ID NO: 524102 - RNA, 64 nt, hsa; identical to SEQ ID NO: 116345

SEQ ID NO: 524103 - RNA, 64 nt, hsa; identical to SEQ ID NO: 116346

SEQ ID NO: 524104 - RNA, 64 nt, hsa; identical to SEQ ID NO: 116347

SEQ ID NO: 524105 - RNA, 64 nt, hsa; identical to SEQ ID NO: 116348

SEQ ID NO: 524106 - RNA, 64 nt, hsa; identical to SEQ ID NO: 116349

SEQ ID NO: 524107 - RNA, 64 nt, hsa; identical to SEQ ID NO: 116350

SEQ ID NO: 524108 - RNA, 64 nt, hsa; identical to SEQ ID NO: 116351

SEQ ID NO: 524109 - RNA, 64 nt, hsa; identical to SEQ ID NO: 116352

SEQ ID NO: 524110 - RNA, 64 nt, hsa; identical to SEQ ID NO: 116353

SEQ ID NO: 524111 - RNA, 64 nt, hsa; identical to SEQ ID NO: 116354

SEQ ID NO: 524112 - RNA, 64 nt, hsa; identical to SEQ ID NO: 116355

SEQ ID NO: 524113 - RNA, 64 nt, hsa; identical to SEQ ID NO: 116356

SEQ ID NO: 524114 - RNA, 64 nt, hsa; identical to SEQ ID NO: 116357

SEQ ID NO: 524115 - RNA, 64 nt, hsa; identical to SEQ ID NO: 116358

SEQ ID NO: 524116 - RNA, 64 nt, hsa; identical to SEQ ID NO: 116359

SEQ ID NO: 524117 - RNA, 64 nt, hsa; identical to SEQ ID NO: 116360

SEQ ID NO: 524118 - RNA, 64 nt, hsa; identical to SEQ ID NO: 116361

SEQ ID NO: 524119 - RNA, 64 nt, hsa; identical to SEQ ID NO: 116362

SEQ ID NO: 524120 - RNA, 64 nt, hsa; identical to SEQ ID NO: 116363

SEQ ID NO: 524121 - RNA, 64 nt, hsa; identical to SEQ ID NO: 116364

SEQ ID NO: 524122 - RNA, 64 nt, hsa; identical to SEQ ID NO: 116365

SEQ ID NO: 524123 - RNA, 64 nt, hsa; identical to SEQ ID NO: 116366

SEQ ID NO: 524124 - RNA, 64 nt, hsa; identical to SEQ ID NO: 116367

SEQ ID NO: 524125 - RNA, 64 nt, hsa; identical to SEQ ID NO: 116368

SEQ ID NO: 524126 - RNA, 64 nt, hsa; identical to SEQ ID NO: 264086

SEQ ID NO: 524127 - RNA, 64 nt, hsa; identical to SEQ ID NO: 264087

SEQ ID NO: 524128 - RNA, 64 nt, hsa; identical to SEQ ID NO: 264088

SEQ ID NO: 524129 - RNA, 64 nt, hsa; identical to SEQ ID NO: 264089

SEQ ID NO: 524130 - RNA, 64 nt, hsa; identical to SEQ ID NO: 264090

SEQ ID NO: 524131 - RNA, 64 nt, hsa; identical to SEQ ID NO: 264091

SEQ ID NO: 524132 - RNA, 64 nt, hsa; identical to SEQ ID NO: 264092

SEQ ID NO: 524133 - RNA, 64 nt, hsa; identical to SEQ ID NO: 264093

SEQ ID NO: 524134 - RNA, 64 nt, hsa; identical to SEQ ID NO: 264094

SEQ ID NO: 524135 - RNA, 64 nt, hsa; identical to SEQ ID NO: 264095

SEQ ID NO: 524136 - RNA, 64 nt, hsa
ccuuuuugcucauuucccagccuuucuugcuguuaggggcuaccaugggaccagcucuggccag

SEQ ID NO: 524137 - RNA, 64 nt, hsa
accagguggaccaggugguggccagagaggcuccaggggcuagacucccucaggaggcugaauu

SEQ ID NO: 524138 - RNA, 64 nt, hsa; identical to SEQ ID NO: 88200

SEQ ID NO: 524139 - RNA, 64 nt, hsa; identical to SEQ ID NO: 88201

SEQ ID NO: 524140 - RNA, 64 nt, hsa; identical to SEQ ID NO: 88202

SEQ ID NO: 524141 - RNA, 64 nt, hsa; identical to SEQ ID NO: 88203

SEQ ID NO: 524142 - RNA, 64 nt, hsa; identical to SEQ ID NO: 88204

SEQ ID NO: 524143 - RNA, 64 nt, hsa; identical to SEQ ID NO: 88205

SEQ ID NO: 524144 - RNA, 64 nt, hsa; identical to SEQ ID NO: 88206

SEQ ID NO: 524145 - RNA, 64 nt, hsa; identical to SEQ ID NO: 88207

SEQ ID NO: 524146 - RNA, 64 nt, hsa; identical to SEQ ID NO: 88208

SEQ ID NO: 524147 - RNA, 64 nt, hsa; identical to SEQ ID NO: 88209

SEQ ID NO: 524148 - RNA, 64 nt, hsa; identical to SEQ ID NO: 88210

SEQ ID NO: 524149 - RNA, 64 nt, hsa; identical to SEQ ID NO: 88211

SEQ ID NO: 524150 - RNA, 64 nt, hsa; identical to SEQ ID NO: 88212

SEQ ID NO: 524151 - RNA, 64 nt, hsa; identical to SEQ ID NO: 88213

SEQ ID NO: 524152 - RNA, 64 nt, hsa; identical to SEQ ID NO: 88214

SEQ ID NO: 524153 - RNA, 64 nt, hsa; identical to SEQ ID NO: 88215

SEQ ID NO: 524154 - RNA, 64 nt, hsa; identical to SEQ ID NO: 88216

SEQ ID NO: 524155 - RNA, 64 nt, hsa; identical to SEQ ID NO: 88217

SEQ ID NO: 524156 - RNA, 64 nt, hsa; identical to SEQ ID NO: 88218

SEQ ID NO: 524157 - RNA, 64 nt, hsa; identical to SEQ ID NO: 88219

SEQ ID NO: 524158 - RNA, 64 nt, hsa; identical to SEQ ID NO: 88220

SEQ ID NO: 524159 - RNA, 64 nt, hsa; identical to SEQ ID NO: 88221

SEQ ID NO: 524160 - RNA, 64 nt, hsa; identical to SEQ ID NO: 88222

SEQ ID NO: 524161 - RNA, 64 nt, hsa; identical to SEQ ID NO: 88223

SEQ ID NO: 524162 - RNA, 64 nt, hsa; identical to SEQ ID NO: 88224

SEQ ID NO: 524163 - RNA, 64 nt, hsa; identical to SEQ ID NO: 88225

SEQ ID NO: 524164 - RNA, 64 nt, hsa; identical to SEQ ID NO: 88226

SEQ ID NO: 524165 - RNA, 64 nt, hsa; identical to SEQ ID NO: 88227

SEQ ID NO: 524166 - RNA, 64 nt, hsa; identical to SEQ ID NO: 88228

SEQ ID NO: 524167 - RNA, 64 nt, hsa; identical to SEQ ID NO: 88229

SEQ ID NO: 524168 - RNA, 64 nt, hsa; identical to SEQ ID NO: 88230

SEQ ID NO: 524169 - RNA, 64 nt, hsa; identical to SEQ ID NO: 88231

SEQ ID NO: 524170 - RNA, 64 nt, hsa; identical to SEQ ID NO: 88232

SEQ ID NO: 524171 - RNA, 64 nt, hsa; identical to SEQ ID NO: 88233

SEQ ID NO: 524172 - RNA, 64 nt, hsa; identical to SEQ ID NO: 88234

SEQ ID NO: 524173 - RNA, 64 nt, hsa; identical to SEQ ID NO: 88235

SEQ ID NO: 524174 - RNA, 64 nt, hsa; identical to SEQ ID NO: 88236

SEQ ID NO: 524175 - RNA, 64 nt, hsa; identical to SEQ ID NO: 88237

SEQ ID NO: 524176 - RNA, 64 nt, hsa; identical to SEQ ID NO: 88238

SEQ ID NO: 524177 - RNA, 64 nt, hsa; identical to SEQ ID NO: 88239

SEQ ID NO: 524178 - RNA, 64 nt, hsa; identical to SEQ ID NO: 88240

SEQ ID NO: 524179 - RNA, 64 nt, hsa; identical to SEQ ID NO: 88241

SEQ ID NO: 524180 - RNA, 64 nt, hsa; identical to SEQ ID NO: 88242

SEQ ID NO: 524181 - RNA, 64 nt, hsa; identical to SEQ ID NO: 88243

SEQ ID NO: 524182 - RNA, 64 nt, hsa; identical to SEQ ID NO: 88244

SEQ ID NO: 524183 - RNA, 64 nt, hsa; identical to SEQ ID NO: 88245

SEQ ID NO: 524184 - RNA, 64 nt, hsa; identical to SEQ ID NO: 88246

SEQ ID NO: 524185 - RNA, 64 nt, hsa; identical to SEQ ID NO: 88247

SEQ ID NO: 524186 - RNA, 64 nt, hsa; identical to SEQ ID NO: 88248

SEQ ID NO: 524187 - RNA, 61 nt, hsa; identical to SEQ ID NO: 88249

SEQ ID NO: 524188 - RNA, 64 nt, hsa; identical to SEQ ID NO: 88250

SEQ ID NO: 524189 - RNA, 64 nt, hsa; identical to SEQ ID NO: 88251

SEQ ID NO: 524190 - RNA, 64 nt, hsa; identical to SEQ ID NO: 88252

SEQ ID NO: 524191 - RNA, 64 nt, hsa; identical to SEQ ID NO: 88253

SEQ ID NO: 524192 - RNA, 64 nt, hsa; identical to SEQ ID NO: 88254

SEQ ID NO: 524193 - RNA, 64 nt, hsa; identical to SEQ ID NO: 88255

SEQ ID NO: 524194 - RNA, 64 nt, hsa; identical to SEQ ID NO: 88256

SEQ ID NO: 524195 - RNA, 64 nt, hsa
cccguaucgaacuuuuguucucaguaucagcccaugguuucaggaucaaagcugucauguugga

SEQ ID NO: 524196 - RNA, 64 nt, hsa
gagagugauuuuuuaaaaauuuuuuaucuuuauaugguuucagaaguaugaaccagcuuucuuu

SEQ ID NO: 524197 - RNA, 64 nt, hsa
agcaauaaaagacaaaugcaacauuuuaaggcaaugguuucacaugguuacauaucaaaacauc

SEQ ID NO: 524198 - RNA, 64 nt, hsa
aaaggagagugauugauuuucuuccuccaauaguugguuucaaauccuuuugaacacguucgac

SEQ ID NO: 524199 - RNA, 64 nt, hsa
uuuucauuuaaauucucugauggagggacaacaaugguuucaacuguaugcccaugccugaucc

SEQ ID NO: 524200 - RNA, 64 nt, hsa
cuccacuggccucuaaaauuauauuagccaagagugguuucauuugagugccuucguguguaug

SEQ ID NO: 524201 - RNA, 64 nt, hsa
guaccccauggagcugggcuaaguaaauaggaauugguuucacgccugaggcaauuagacacuu

SEQ ID NO: 524202 - RNA, 64 nt, hsa
aaguucaugcagcuguggcagaguuacaguucugugguuucauguuaguuaccuuauaguuacu

SEQ ID NO: 524203 - RNA, 64 nt, hsa
cauuuccucaaaaguaauuuauuuuuacagcuucugguuucacaugaaauuguuugcgcuacug

SEQ ID NO: 524204 - RNA, 64 nt, hsa
ccucuucuucccaggugugccaaggaauuaaucuugguuucacuacaauuaaaauucacuccuu

SEQ ID NO: 524205 - RNA, 64 nt, hsa
aagagacugaauuucuggguccuugcagcugugaugguuucagagcucagacugaucaggcauc

SEQ ID NO: 524206 - RNA, 64 nt, hsa
uuaaaucagcuuuacaucauuuuuacauaucaagugguuucauguuaaaaaacaaacuccuagu

SEQ ID NO: 524207 - RNA, 64 nt, hsa
ccugcugcuucgugucucacucgagaguugcuucugguuucacacuuuuuaaccccucugugcu

SEQ ID NO: 524208 - RNA, 64 nt, hsa
auuuaugaucagggauuuuauaaacaugcgggccugguuucacaucggauggcaccuuuuggcu

SEQ ID NO: 524209 - RNA, 64 nt, hsa
ucgcuggcaucagugugcagcaaauuuguucuuuugguuucaucacuaacaaaagugccucauc

SEQ ID NO: 524210 - RNA, 64 nt, hsa
aucagaauuguuauuaugcagccuucauuugggcugguuucaucauuuugcacugugaaauagc

SEQ ID NO: 524211 - RNA, 64 nt, hsa
auuauuuccauucauuuagcacaaauaaaucauuugguuucacuuugcaguggaacacugaguc

SEQ ID NO: 524212 - RNA, 64 nt, hsa
aacaugagucgauaaauguuguccuacucaccggugguuucaauggcuaauuagaauguguuau

SEQ ID NO: 524213 - RNA, 64 nt, hsa
cagcgggcagauuccaggaaugaagaauuaggcuugguuucagguuacauaaauaauagagcag

SEQ ID NO: 524214 - RNA, 64 nt, hsa
agcugcuucaaaucacucuugacuacauggaccuugguuucaaagugagcugcuauauauuauu

SEQ ID NO: 524215 - RNA, 64 nt, hsa
ucuuccuuuuuuagauuuuugaaagaaaacccuuugguuucauuguguuugugguuuaggagcu

SEQ ID NO: 524216 - RNA, 61 nt, hsa
ggccuggcagccuuguauagauuuuggaaauugguuucaaaucuugcaucuuccuuuuuua

SEQ ID NO: 524217 - RNA, 64 nt, hsa
auaacucggcaucuugacgauagucccauuugggugguuucagcugcacuaucuguaugaaaug

SEQ ID NO: 524218 - RNA, 64 nt, hsa
uaccaaccaaacccuaaauugaaagacaaaacuaugguuucagucaacauauucaugaauuagg

SEQ ID NO: 524219 - RNA, 64 nt, hsa
gcuagaacuguuaguauuguugaaucaauuacuuugguuucaugaaaaaauaaacgauaaauau

SEQ ID NO: 524220 - RNA, 64 nt, hsa
ugcauuuuuauugaaaggccugcauuaaacugaaugguuucacaggcauuugcuuguccugcau

SEQ ID NO: 524221 - RNA, 64 nt, hsa
gguuugaagcuaccaccauugaacucccccauggugguuucaugaugcccccuccccaauuccu

SEQ ID NO: 524222 - RNA, 64 nt, hsa
ccuaaagguucccucuccacccguucugccucagugguuucaaaucucuccuuucagggcuuua

SEQ ID NO: 524223 - RNA, 64 nt, hsa
auacagaagugguauuuugguuuuuaaucagauuugguuucaucagaagcagcaagaauggacc

SEQ ID NO: 524224 - RNA, 64 nt, hsa
uuagacaauguuauuuauuagcccuaauuguguuugguuucagacaaaaccuuuucuccugugu

SEQ ID NO: 524225 - RNA, 64 nt, hsa; identical to SEQ ID NO: 348710

SEQ ID NO: 524226 - RNA, 64 nt, hsa; identical to SEQ ID NO: 348711

SEQ ID NO: 524227 - RNA, 64 nt, hsa; identical to SEQ ID NO: 348712

SEQ ID NO: 524228 - RNA, 64 nt, hsa; identical to SEQ ID NO: 348713

SEQ ID NO: 524229 - RNA, 64 nt, hsa; identical to SEQ ID NO: 348714

SEQ ID NO: 524230 - RNA, 64 nt, hsa; identical to SEQ ID NO: 348715

SEQ ID NO: 524231 - RNA, 64 nt, hsa; identical to SEQ ID NO: 348716

SEQ ID NO: 524232 - RNA, 64 nt, hsa; identical to SEQ ID NO: 348717

SEQ ID NO: 524233 - RNA, 64 nt, hsa; identical to SEQ ID NO: 348718

SEQ ID NO: 524234 - RNA, 64 nt, hsa; identical to SEQ ID NO: 348719

SEQ ID NO: 524235 - RNA, 64 nt, hsa; identical to SEQ ID NO: 348720

SEQ ID NO: 524236 - RNA, 64 nt, hsa; identical to SEQ ID NO: 348721

SEQ ID NO: 524237 - RNA, 64 nt, hsa; identical to SEQ ID NO: 348722

SEQ ID NO: 524238 - RNA, 64 nt, hsa; identical to SEQ ID NO: 348723

SEQ ID NO: 524239 - RNA, 64 nt, hsa; identical to SEQ ID NO: 348724

SEQ ID NO: 524240 - RNA, 64 nt, hsa; identical to SEQ ID NO: 348725

SEQ ID NO: 524241 - RNA, 64 nt, hsa; identical to SEQ ID NO: 348726

SEQ ID NO: 524242 - RNA, 64 nt, hsa; identical to SEQ ID NO: 348727

SEQ ID NO: 524243 - RNA, 64 nt, hsa; identical to SEQ ID NO: 348728

SEQ ID NO: 524244 - RNA, 64 nt, hsa; identical to SEQ ID NO: 348729

SEQ ID NO: 524245 - RNA, 64 nt, hsa; identical to SEQ ID NO: 348730

SEQ ID NO: 524246 - RNA, 64 nt, hsa; identical to SEQ ID NO: 348731

SEQ ID NO: 524247 - RNA, 64 nt, hsa
caaagaauacucaagucuuuuucuucuuauggaaucaucgaaacugcuauuuaucauaaucacc

SEQ ID NO: 524248 - RNA, 64 nt, hsa
gauuuccagaaaagccucuuaauuuuaugcuuucucaucgaaguaauguacccuuuuuuucuga

SEQ ID NO: 524249 - RNA, 64 nt, hsa
ggcaugguuugcuuaggaguucagaguuccuucaucaucgaaauagugauuaagugaucccaga

SEQ ID NO: 524250 - RNA, 64 nt, hsa
aauaguuauggaaaauucggucacguaauuacucucaucgaaggacucauuacaacaaacaggg

SEQ ID NO: 524251 - RNA, 64 nt, hsa
uuuguaacugaaacgcaccacagaagacagggagucaucgaagggcugcucggggagguggcag

SEQ ID NO: 524252 - RNA, 64 nt, hsa
aauucauaucugaaaccauuuuagaagggagaagucaucgaaguauuuucugaguguugagaag

SEQ ID NO: 524253 - RNA, 64 nt, hsa
aggugaaaugagaagcuaucaguaacagcuacucucaucgaaagcacuuuauuauuuuacggag

SEQ ID NO: 524254 - RNA, 64 nt, hsa
acuuucuguaacaauuaaccuuauacuuuguuugucaucgaauauuuguugaaugcaugucagg

SEQ ID NO: 524255 - RNA, 64 nt, hsa
caauuagcuagauaauucaagcagaaauccauuuucaucgaaauugccugugugcacauauuuu

SEQ ID NO: 524256 - RNA, 64 nt, hsa
aagaauaaaugguguuuuggaaauuuuaaaauuaucaucgaagguggugaaacuauuucaggcc

SEQ ID NO: 524257 - RNA, 64 nt, hsa
gauuacaggcguaagccacuacaccuggcccucuucaucgaauuuuauuugagaaguagagcuc

SEQ ID NO: 524258 - RNA, 64 nt, hsa
cugccaccacuuuuggauuuuaugggaggcuccuucaucgaaugcuaaaccuuugaguagaguc

SEQ ID NO: 524259 - RNA, 64 nt, hsa
cugcaaagccaaacagcugcaaaauguugaaaaaucaucgaaauguauaaaaauugcaguaucu

SEQ ID NO: 524260 - RNA, 64 nt, hsa
cuucuugcauuuuugguaucuucauaaucuuuagucaucgaaucccaguggaggggacccuuuu

SEQ ID NO: 524261 - RNA, 64 nt, hsa
gauuaauaaccugccagucccagaucacacaucaucaucgaagucuuccccaguuauaaagagg

SEQ ID NO: 524262 - RNA, 64 nt, hsa
uagauuuguaugugugaaagccuuaaaccaaagcucaucgaagaauacauccuugagagagaug

SEQ ID NO: 524263 - RNA, 64 nt, hsa
uccuauuuacugaucacaaaugagcucauuaaugucaucgaaacauuuauuguaaccuaacaga

SEQ ID NO: 524264 - RNA, 64 nt, hsa
caucauccaacauuauugagauugucguguauagucaucgaauaucagccaguuccuguaauuu

SEQ ID NO: 524265 - RNA, 64 nt, hsa
aguuaguguucuaugguuuaaauuagcauagcaaucaucgaacuuggauuucaaaugcaauaga

SEQ ID NO: 524266 - RNA, 64 nt, hsa
uggaauguucacugacgucuuuucuugguagccaucaucgaaacuaauggggggacagacuuga

SEQ ID NO: 524267 - RNA, 64 nt, hsa
uauaaauuagaauaaaauauaguugugauaauggucaucgaauggauuuguuuggaaagcuaca

SEQ ID NO: 524268 - RNA, 64 nt, hsa
uguucccuggucccccugaagccugcaaacguugucaucgaagggaaggguggggggcagcugc

SEQ ID NO: 524269 - RNA, 64 nt, hsa
aguugucuaguucuuccuucaucacacgugcuucucaucgaaacccugguuucaggauggauca

SEQ ID NO: 524270 - RNA, 64 nt, hsa
caggaacgaaauaccucccagaaacaugaagcaaucaucgaagacucacugguaauauuuuuaa

SEQ ID NO: 524271 - RNA, 64 nt, hsa
uaaauuccacugaaaauuuaacaguauccccuucucaucgaagggauuguguaucugugcuucu

SEQ ID NO: 524272 - RNA, 64 nt, hsa
acgccuuuggaggaagcacucaaccaguacucugucaucgaagagaccagcucugacacagacu

SEQ ID NO: 524273 - RNA, 64 nt, hsa
uuauuuuuauguugaaacagcaauuucccuuaauucaucgaaguaaggguguacuuccuacauc

SEQ ID NO: 524274 - RNA, 64 nt, hsa
uagacacuaugugcuuuuuuuuuuuaaccauaguucaucgaaaugcagcuuuuucugaacuuca

SEQ ID NO: 524275 - RNA, 64 nt, hsa
gggcccccauaauaaguuccuaaagcaugggaucucaucgaauaagacucaucauuuaauccuu

SEQ ID NO: 524276 - RNA, 64 nt, hsa
cuucuuuuccgagucauaccccaugaucaaaguuucaucgaaaacuacgcagggaucuuccacu

SEQ ID NO: 524277 - RNA, 64 nt, hsa
ugccagaagaacucaugguuuuaaauauagaccaucaucgaaacuccagaaauuuauccacugu

SEQ ID NO: 524278 - RNA, 64 nt, hsa
uugauauuugucuuuuuuuuaaauuuuacaguagucaucgaaaguuauguuucuuugcuuacuu

SEQ ID NO: 524279 - RNA, 64 nt, hsa
ccacacauguucacagcucacacgcccucuccauucaucgaacuucucagugucccugucccug

SEQ ID NO: 524280 - RNA, 64 nt, hsa
gauuuuucagauaucguucauauauugcuauucaucaucgaacucaugcuggagagaaaccuua

SEQ ID NO: 524281 - RNA, 64 nt, hsa
accaguuuagauuucaagaaaaaauaaauggaaaucaucgaaaauucauuucacauuaaugguc

SEQ ID NO: 524282 - RNA, 64 nt, hsa
cuggaaguccaauguggcaaggaaaaacaggucuucaucgaaucuacuaauuccacaccuuuua

SEQ ID NO: 524283 - RNA, 63 nt, hsa
acagcacagcaguacuccacauuguuuccuauuuggacauagacuucauuuccuuucaguaua

SEQ ID NO: 524284 - RNA, 63 nt, hsa
uuuuaaacuuccuaaaauuaggaauuagguaguuggacauagucugugaccuuuaugucguug

SEQ ID NO: 524285 - RNA, 63 nt, hsa
ccgguagacugaauaucugacgggauuucuauauggacauagcacagaugaaccaaaaaugua

SEQ ID NO: 524286 - RNA, 63 nt, hsa
ucuggcagugguuuugaguuacuucauggaacuuggacauacaccaccagguccuuuaugugu

SEQ ID NO: 524287 - RNA, 63 nt, hsa
cuccucuguuggacauauaagugcaucucuuguuggacauaggcaaaauaacuuggcaaacuu

SEQ ID NO: 524288 - RNA, 63 nt, hsa
cuaaacacuaaguuuaauuuucagcuccucuguuggacauauaagugcaucucuuguuggaca

SEQ ID NO: 524289 - RNA, 63 nt, hsa
auuguuuuaaagaggauauauuauuuagaaaaauggacauaugaauauuauuaaaaauugagu

SEQ ID NO: 524290 - RNA, 63 nt, hsa
uucuauuaacuaaaaugagguaagccauuauuuuggacauagaaacagaucuuuguaucuugu

SEQ ID NO: 524291 - RNA, 63 nt, hsa
cacaccaaaggaaagguaaacugaaauuucccuuggacauaugugaaaucuuuuugucuuuau

SEQ ID NO: 524292 - RNA, 63 nt, hsa
cgugcucaucagagcaugccaauccuaagccauuggacauauguagacugguuuuuguuguug

SEQ ID NO: 524293 - RNA, 63 nt, hsa; identical to SEQ ID NO: 252244

SEQ ID NO: 524294 - RNA, 63 nt, hsa; identical to SEQ ID NO: 252245

SEQ ID NO: 524295 - RNA, 63 nt, hsa; identical to SEQ ID NO: 252246

SEQ ID NO: 524296 - RNA, 63 nt, hsa; identical to SEQ ID NO: 252247

SEQ ID NO: 524297 - RNA, 63 nt, hsa; identical to SEQ ID NO: 252248

SEQ ID NO: 524298 - RNA, 63 nt, hsa; identical to SEQ ID NO: 252249

SEQ ID NO: 524299 - RNA, 63 nt, hsa; identical to SEQ ID NO: 252250

SEQ ID NO: 524300 - RNA, 63 nt, hsa; identical to SEQ ID NO: 252251

SEQ ID NO: 524301 - RNA, 63 nt, hsa; identical to SEQ ID NO: 252252

SEQ ID NO: 524302 - RNA, 63 nt, hsa; identical to SEQ ID NO: 252253

SEQ ID NO: 524303 - RNA, 63 nt, hsa; identical to SEQ ID NO: 252254

SEQ ID NO: 524304 - RNA, 63 nt, hsa; identical to SEQ ID NO: 252255

SEQ ID NO: 524305 - RNA, 63 nt, hsa; identical to SEQ ID NO: 252256

SEQ ID NO: 524306 - RNA, 63 nt, hsa; identical to SEQ ID NO: 252257

SEQ ID NO: 524307 - RNA, 63 nt, hsa; identical to SEQ ID NO: 252258

SEQ ID NO: 524308 - RNA, 63 nt, hsa; identical to SEQ ID NO: 252259

SEQ ID NO: 524309 - RNA, 63 nt, hsa; identical to SEQ ID NO: 252260

SEQ ID NO: 524310 - RNA, 63 nt, hsa; identical to SEQ ID NO: 252261

SEQ ID NO: 524311 - RNA, 63 nt, hsa; identical to SEQ ID NO: 252262

SEQ ID NO: 524312 - RNA, 63 nt, hsa; identical to SEQ ID NO: 252263

SEQ ID NO: 524313 - RNA, 63 nt, hsa; identical to SEQ ID NO: 252264

SEQ ID NO: 524314 - RNA, 65 nt, hsa; identical to SEQ ID NO: 252265

SEQ ID NO: 524315 - RNA, 65 nt, hsa; identical to SEQ ID NO: 252266

SEQ ID NO: 524316 - RNA, 65 nt, hsa; identical to SEQ ID NO: 252267

SEQ ID NO: 524317 - RNA, 65 nt, hsa; identical to SEQ ID NO: 252268

SEQ ID NO: 524318 - RNA, 65 nt, hsa; identical to SEQ ID NO: 252269

SEQ ID NO: 524319 - RNA, 65 nt, hsa; identical to SEQ ID NO: 252270

SEQ ID NO: 524320 - RNA, 65 nt, hsa; identical to SEQ ID NO: 252271

SEQ ID NO: 524321 - RNA, 65 nt, hsa; identical to SEQ ID NO: 252272

SEQ ID NO: 524322 - RNA, 65 nt, hsa; identical to SEQ ID NO: 252273

SEQ ID NO: 524323 - RNA, 65 nt, hsa; identical to SEQ ID NO: 252274

SEQ ID NO: 524324 - RNA, 65 nt, hsa; identical to SEQ ID NO: 252275

SEQ ID NO: 524325 - RNA, 65 nt, hsa; identical to SEQ ID NO: 252276

SEQ ID NO: 524326 - RNA, 65 nt, hsa; identical to SEQ ID NO: 252277

SEQ ID NO: 524327 - RNA, 65 nt, hsa; identical to SEQ ID NO: 252278

SEQ ID NO: 524328 - RNA, 65 nt, hsa; identical to SEQ ID NO: 252279

SEQ ID NO: 524329 - RNA, 65 nt, hsa; identical to SEQ ID NO: 252280

SEQ ID NO: 524330 - RNA, 65 nt, hsa; identical to SEQ ID NO: 252281

SEQ ID NO: 524331 - RNA, 65 nt, hsa; identical to SEQ ID NO: 252282

SEQ ID NO: 524332 - RNA, 65 nt, hsa; identical to SEQ ID NO: 252283

SEQ ID NO: 524333 - RNA, 65 nt, hsa; identical to SEQ ID NO: 252284

SEQ ID NO: 524334 - RNA, 65 nt, hsa; identical to SEQ ID NO: 252285

SEQ ID NO: 524335 - RNA, 65 nt, hsa; identical to SEQ ID NO: 252286

SEQ ID NO: 524336 - RNA, 65 nt, hsa; identical to SEQ ID NO: 252287

SEQ ID NO: 524337 - RNA, 65 nt, hsa; identical to SEQ ID NO: 252288

SEQ ID NO: 524338 - RNA, 65 nt, hsa; identical to SEQ ID NO: 252289

SEQ ID NO: 524339 - RNA, 65 nt, hsa; identical to SEQ ID NO: 252290

SEQ ID NO: 524340 - RNA, 65 nt, hsa; identical to SEQ ID NO: 252291

SEQ ID NO: 524341 - RNA, 65 nt, hsa; identical to SEQ ID NO: 252292

SEQ ID NO: 524342 - RNA, 65 nt, hsa; identical to SEQ ID NO: 252293

SEQ ID NO: 524343 - RNA, 65 nt, hsa; identical to SEQ ID NO: 252294

SEQ ID NO: 524344 - RNA, 65 nt, hsa; identical to SEQ ID NO: 252295

SEQ ID NO: 524345 - RNA, 65 nt, hsa; identical to SEQ ID NO: 252296

SEQ ID NO: 524346 - RNA, 65 nt, hsa; identical to SEQ ID NO: 252297

SEQ ID NO: 524347 - RNA, 65 nt, hsa; identical to SEQ ID NO: 252298

SEQ ID NO: 524348 - RNA, 60 nt, hsa; identical to SEQ ID NO: 252299

SEQ ID NO: 524349 - RNA, 60 nt, hsa; identical to SEQ ID NO: 252300

SEQ ID NO: 524350 - RNA, 60 nt, hsa; identical to SEQ ID NO: 252301

SEQ ID NO: 524351 - RNA, 60 nt, hsa; identical to SEQ ID NO: 252302

SEQ ID NO: 524352 - RNA, 60 nt, hsa; identical to SEQ ID NO: 252303

SEQ ID NO: 524353 - RNA, 60 nt, hsa; identical to SEQ ID NO: 252304

SEQ ID NO: 524354 - RNA, 60 nt, hsa; identical to SEQ ID NO: 252305

SEQ ID NO: 524355 - RNA, 60 nt, hsa; identical to SEQ ID NO: 252306

SEQ ID NO: 524356 - RNA, 60 nt, hsa; identical to SEQ ID NO: 252307

SEQ ID NO: 524357 - RNA, 60 nt, hsa; identical to SEQ ID NO: 252308

SEQ ID NO: 524358 - RNA, 60 nt, hsa; identical to SEQ ID NO: 252309

SEQ ID NO: 524359 - RNA, 60 nt, hsa; identical to SEQ ID NO: 252310

SEQ ID NO: 524360 - RNA, 60 nt, hsa; identical to SEQ ID NO: 252311

SEQ ID NO: 524361 - RNA, 60 nt, hsa; identical to SEQ ID NO: 252312

SEQ ID NO: 524362 - RNA, 60 nt, hsa; identical to SEQ ID NO: 252313

SEQ ID NO: 524363 - RNA, 60 nt, hsa; identical to SEQ ID NO: 252314

SEQ ID NO: 524364 - RNA, 60 nt, hsa; identical to SEQ ID NO: 252315

SEQ ID NO: 524365 - RNA, 60 nt, hsa; identical to SEQ ID NO: 252316

SEQ ID NO: 524366 - RNA, 60 nt, hsa; identical to SEQ ID NO: 252317

SEQ ID NO: 524367 - RNA, 60 nt, hsa; identical to SEQ ID NO: 252318

SEQ ID NO: 524368 - RNA, 60 nt, hsa; identical to SEQ ID NO: 252319

SEQ ID NO: 524369 - RNA, 60 nt, hsa; identical to SEQ ID NO: 252320

SEQ ID NO: 524370 - RNA, 60 nt, hsa; identical to SEQ ID NO: 252321

SEQ ID NO: 524371 - RNA, 60 nt, hsa; identical to SEQ ID NO: 252322

SEQ ID NO: 524372 - RNA, 60 nt, hsa; identical to SEQ ID NO: 252323

SEQ ID NO: 524373 - RNA, 60 nt, hsa; identical to SEQ ID NO: 252324

SEQ ID NO: 524374 - RNA, 60 nt, hsa; identical to SEQ ID NO: 252325

SEQ ID NO: 524375 - RNA, 60 nt, hsa; identical to SEQ ID NO: 252326

SEQ ID NO: 524376 - RNA, 60 nt, hsa; identical to SEQ ID NO: 252327

SEQ ID NO: 524377 - RNA, 60 nt, hsa; identical to SEQ ID NO: 252328

SEQ ID NO: 524378 - RNA, 60 nt, hsa; identical to SEQ ID NO: 252329

SEQ ID NO: 524379 - RNA, 60 nt, hsa; identical to SEQ ID NO: 252330

SEQ ID NO: 524380 - RNA, 60 nt, hsa; identical to SEQ ID NO: 252331

SEQ ID NO: 524381 - RNA, 60 nt, hsa; identical to SEQ ID NO: 252332

SEQ ID NO: 524382 - RNA, 60 nt, hsa; identical to SEQ ID NO: 252333

SEQ ID NO: 524383 - RNA, 60 nt, hsa; identical to SEQ ID NO: 252334

SEQ ID NO: 524384 - RNA, 60 nt, hsa; identical to SEQ ID NO: 252335

SEQ ID NO: 524385 - RNA, 60 nt, hsa; identical to SEQ ID NO: 252336

SEQ ID NO: 524386 - RNA, 60 nt, hsa; identical to SEQ ID NO: 252337

SEQ ID NO: 524387 - RNA, 60 nt, hsa; identical to SEQ ID NO: 252338

SEQ ID NO: 524388 - RNA, 60 nt, hsa; identical to SEQ ID NO: 252339

SEQ ID NO: 524389 - RNA, 60 nt, hsa; identical to SEQ ID NO: 252340

SEQ ID NO: 524390 - RNA, 60 nt, hsa; identical to SEQ ID NO: 252341

SEQ ID NO: 524391 - RNA, 60 nt, hsa; identical to SEQ ID NO: 252342

SEQ ID NO: 524392 - RNA, 60 nt, hsa; identical to SEQ ID NO: 252343

SEQ ID NO: 524393 - RNA, 60 nt, hsa; identical to SEQ ID NO: 252344

SEQ ID NO: 524394 - RNA, 60 nt, hsa; identical to SEQ ID NO: 252345

SEQ ID NO: 524395 - RNA, 60 nt, hsa; identical to SEQ ID NO: 252346

SEQ ID NO: 524396 - RNA, 60 nt, hsa; identical to SEQ ID NO: 252347

SEQ ID NO: 524397 - RNA, 60 nt, hsa; identical to SEQ ID NO: 252348

SEQ ID NO: 524398 - RNA, 60 nt, hsa; identical to SEQ ID NO: 252349

SEQ ID NO: 524399 - RNA, 60 nt, hsa; identical to SEQ ID NO: 252350

SEQ ID NO: 524400 - RNA, 60 nt, hsa; identical to SEQ ID NO: 252351

SEQ ID NO: 524401 - RNA, 60 nt, hsa; identical to SEQ ID NO: 252352

SEQ ID NO: 524402 - RNA, 60 nt, hsa; identical to SEQ ID NO: 252353

SEQ ID NO: 524403 - RNA, 60 nt, hsa; identical to SEQ ID NO: 252354

SEQ ID NO: 524404 - RNA, 60 nt, hsa; identical to SEQ ID NO: 252355

SEQ ID NO: 524405 - RNA, 60 nt, hsa; identical to SEQ ID NO: 252356

SEQ ID NO: 524406 - RNA, 60 nt, hsa; identical to SEQ ID NO: 252357

SEQ ID NO: 524407 - RNA, 60 nt, hsa; identical to SEQ ID NO: 252358

SEQ ID NO: 524408 - RNA, 60 nt, hsa; identical to SEQ ID NO: 252359

SEQ ID NO: 524409 - RNA, 60 nt, hsa; identical to SEQ ID NO: 252360

SEQ ID NO: 524410 - RNA, 60 nt, hsa; identical to SEQ ID NO: 252361

SEQ ID NO: 524411 - RNA, 60 nt, hsa; identical to SEQ ID NO: 252362

SEQ ID NO: 524412 - RNA, 60 nt, hsa; identical to SEQ ID NO: 252363

SEQ ID NO: 524413 - RNA, 60 nt, hsa; identical to SEQ ID NO: 252364

SEQ ID NO: 524414 - RNA, 60 nt, hsa; identical to SEQ ID NO: 252365

SEQ ID NO: 524415 - RNA, 60 nt, hsa; identical to SEQ ID NO: 252366

SEQ ID NO: 524416 - RNA, 60 nt, hsa; identical to SEQ ID NO: 252367

SEQ ID NO: 524417 - RNA, 60 nt, hsa; identical to SEQ ID NO: 252368

SEQ ID NO: 524418 - RNA, 60 nt, hsa; identical to SEQ ID NO: 252369

SEQ ID NO: 524419 - RNA, 60 nt, hsa; identical to SEQ ID NO: 252370

SEQ ID NO: 524420 - RNA, 60 nt, hsa; identical to SEQ ID NO: 252371

SEQ ID NO: 524421 - RNA, 60 nt, hsa; identical to SEQ ID NO: 252372

SEQ ID NO: 524422 - RNA, 60 nt, hsa; identical to SEQ ID NO: 252373

SEQ ID NO: 524423 - RNA, 60 nt, hsa; identical to SEQ ID NO: 252374

SEQ ID NO: 524424 - RNA, 60 nt, hsa; identical to SEQ ID NO: 252375

SEQ ID NO: 524425 - RNA, 60 nt, hsa; identical to SEQ ID NO: 252376

SEQ ID NO: 524426 - RNA, 60 nt, hsa; identical to SEQ ID NO: 252377

SEQ ID NO: 524427 - RNA, 60 nt, hsa; identical to SEQ ID NO: 252378

SEQ ID NO: 524428 - RNA, 60 nt, hsa; identical to SEQ ID NO: 252379

SEQ ID NO: 524429 - RNA, 60 nt, hsa; identical to SEQ ID NO: 252380

SEQ ID NO: 524430 - RNA, 60 nt, hsa; identical to SEQ ID NO: 252381

SEQ ID NO: 524431 - RNA, 60 nt, hsa; identical to SEQ ID NO: 252382

SEQ ID NO: 524432 - RNA, 60 nt, hsa; identical to SEQ ID NO: 252383

SEQ ID NO: 524433 - RNA, 60 nt, hsa; identical to SEQ ID NO: 252384

SEQ ID NO: 524434 - RNA, 60 nt, hsa; identical to SEQ ID NO: 252385

SEQ ID NO: 524435 - RNA, 60 nt, hsa; identical to SEQ ID NO: 252386

SEQ ID NO: 524436 - RNA, 60 nt, hsa; identical to SEQ ID NO: 252387

SEQ ID NO: 524437 - RNA, 60 nt, hsa; identical to SEQ ID NO: 252388

SEQ ID NO: 524438 - RNA, 60 nt, hsa; identical to SEQ ID NO: 252389

SEQ ID NO: 524439 - RNA, 60 nt, hsa; identical to SEQ ID NO: 252390

SEQ ID NO: 524440 - RNA, 60 nt, hsa; identical to SEQ ID NO: 252391

SEQ ID NO: 524441 - RNA, 60 nt, hsa; identical to SEQ ID NO: 252392

SEQ ID NO: 524442 - RNA, 60 nt, hsa; identical to SEQ ID NO: 252393

SEQ ID NO: 524443 - RNA, 60 nt, hsa; identical to SEQ ID NO: 252394

SEQ ID NO: 524444 - RNA, 60 nt, hsa; identical to SEQ ID NO: 252395

SEQ ID NO: 524445 - RNA, 60 nt, hsa; identical to SEQ ID NO: 252396

SEQ ID NO: 524446 - RNA, 60 nt, hsa; identical to SEQ ID NO: 252397

SEQ ID NO: 524447 - RNA, 60 nt, hsa; identical to SEQ ID NO: 252398

SEQ ID NO: 524448 - RNA, 60 nt, hsa; identical to SEQ ID NO: 252399

SEQ ID NO: 524449 - RNA, 60 nt, hsa; identical to SEQ ID NO: 252400

SEQ ID NO: 524450 - RNA, 60 nt, hsa; identical to SEQ ID NO: 252401

SEQ ID NO: 524451 - RNA, 60 nt, hsa; identical to SEQ ID NO: 252402

SEQ ID NO: 524452 - RNA, 60 nt, hsa; identical to SEQ ID NO: 252403

SEQ ID NO: 524453 - RNA, 60 nt, hsa; identical to SEQ ID NO: 252404

SEQ ID NO: 524454 - RNA, 60 nt, hsa; identical to SEQ ID NO: 252405

SEQ ID NO: 524455 - RNA, 60 nt, hsa; identical to SEQ ID NO: 252406

SEQ ID NO: 524456 - RNA, 60 nt, hsa; identical to SEQ ID NO: 252407

SEQ ID NO: 524457 - RNA, 60 nt, hsa; identical to SEQ ID NO: 252408

SEQ ID NO: 524458 - RNA, 60 nt, hsa; identical to SEQ ID NO: 252409

SEQ ID NO: 524459 - RNA, 60 nt, hsa; identical to SEQ ID NO: 252410

SEQ ID NO: 524460 - RNA, 60 nt, hsa; identical to SEQ ID NO: 252411

SEQ ID NO: 524461 - RNA, 60 nt, hsa; identical to SEQ ID NO: 252412

SEQ ID NO: 524462 - RNA, 60 nt, hsa; identical to SEQ ID NO: 252413

SEQ ID NO: 524463 - RNA, 60 nt, hsa; identical to SEQ ID NO: 252414

SEQ ID NO: 524464 - RNA, 60 nt, hsa; identical to SEQ ID NO: 252415

SEQ ID NO: 524465 - RNA, 60 nt, hsa; identical to SEQ ID NO: 252416

SEQ ID NO: 524466 - RNA, 60 nt, hsa; identical to SEQ ID NO: 252417

SEQ ID NO: 524467 - RNA, 60 nt, hsa; identical to SEQ ID NO: 252418

SEQ ID NO: 524468 - RNA, 60 nt, hsa; identical to SEQ ID NO: 252419

SEQ ID NO: 524469 - RNA, 60 nt, hsa; identical to SEQ ID NO: 252420

SEQ ID NO: 524470 - RNA, 60 nt, hsa; identical to SEQ ID NO: 252421

SEQ ID NO: 524471 - RNA, 60 nt, hsa; identical to SEQ ID NO: 252422

SEQ ID NO: 524472 - RNA, 60 nt, hsa; identical to SEQ ID NO: 252423

SEQ ID NO: 524473 - RNA, 60 nt, hsa; identical to SEQ ID NO: 252424

SEQ ID NO: 524474 - RNA, 60 nt, hsa; identical to SEQ ID NO: 252425

SEQ ID NO: 524475 - RNA, 60 nt, hsa; identical to SEQ ID NO: 252426

SEQ ID NO: 524476 - RNA, 60 nt, hsa; identical to SEQ ID NO: 252427

SEQ ID NO: 524477 - RNA, 60 nt, hsa; identical to SEQ ID NO: 252428

SEQ ID NO: 524478 - RNA, 60 nt, hsa; identical to SEQ ID NO: 252429

SEQ ID NO: 524479 - RNA, 60 nt, hsa; identical to SEQ ID NO: 252430

SEQ ID NO: 524480 - RNA, 60 nt, hsa; identical to SEQ ID NO: 252431

SEQ ID NO: 524481 - RNA, 60 nt, hsa; identical to SEQ ID NO: 252432

SEQ ID NO: 524482 - RNA, 60 nt, hsa; identical to SEQ ID NO: 252433

SEQ ID NO: 524483 - RNA, 60 nt, hsa; identical to SEQ ID NO: 252434

SEQ ID NO: 524484 - RNA, 60 nt, hsa; identical to SEQ ID NO: 252435

SEQ ID NO: 524485 - RNA, 60 nt, hsa; identical to SEQ ID NO: 252436

SEQ ID NO: 524486 - RNA, 60 nt, hsa; identical to SEQ ID NO: 252437

SEQ ID NO: 524487 - RNA, 60 nt, hsa; identical to SEQ ID NO: 252438

SEQ ID NO: 524488 - RNA, 60 nt, hsa; identical to SEQ ID NO: 252439

SEQ ID NO: 524489 - RNA, 60 nt, hsa; identical to SEQ ID NO: 252440

SEQ ID NO: 524490 - RNA, 60 nt, hsa; identical to SEQ ID NO: 252441

SEQ ID NO: 524491 - RNA, 60 nt, hsa; identical to SEQ ID NO: 252442

SEQ ID NO: 524492 - RNA, 60 nt, hsa; identical to SEQ ID NO: 252443

SEQ ID NO: 524493 - RNA, 60 nt, hsa; identical to SEQ ID NO: 252444

SEQ ID NO: 524494 - RNA, 60 nt, hsa; identical to SEQ ID NO: 252445

SEQ ID NO: 524495 - RNA, 60 nt, hsa; identical to SEQ ID NO: 252446

SEQ ID NO: 524496 - RNA, 60 nt, hsa; identical to SEQ ID NO: 252447

SEQ ID NO: 524497 - RNA, 60 nt, hsa; identical to SEQ ID NO: 252448

SEQ ID NO: 524498 - RNA, 60 nt, hsa; identical to SEQ ID NO: 252449

SEQ ID NO: 524499 - RNA, 60 nt, hsa; identical to SEQ ID NO: 252450

SEQ ID NO: 524500 - RNA, 60 nt, hsa; identical to SEQ ID NO: 252451

SEQ ID NO: 524501 - RNA, 60 nt, hsa; identical to SEQ ID NO: 252452

SEQ ID NO: 524502 - RNA, 60 nt, hsa; identical to SEQ ID NO: 252453

SEQ ID NO: 524503 - RNA, 60 nt, hsa; identical to SEQ ID NO: 252454

SEQ ID NO: 524504 - RNA, 60 nt, hsa; identical to SEQ ID NO: 252455

SEQ ID NO: 524505 - RNA, 60 nt, hsa; identical to SEQ ID NO: 252456

SEQ ID NO: 524506 - RNA, 60 nt, hsa; identical to SEQ ID NO: 252457

SEQ ID NO: 524507 - RNA, 60 nt, hsa; identical to SEQ ID NO: 252458

SEQ ID NO: 524508 - RNA, 60 nt, hsa; identical to SEQ ID NO: 252459

SEQ ID NO: 524509 - RNA, 52 nt, hsa; identical to SEQ ID NO: 252460

SEQ ID NO: 524510 - RNA, 60 nt, hsa; identical to SEQ ID NO: 252461

SEQ ID NO: 524511 - RNA, 60 nt, hsa; identical to SEQ ID NO: 252462

SEQ ID NO: 524512 - RNA, 60 nt, hsa; identical to SEQ ID NO: 252463

SEQ ID NO: 524513 - RNA, 60 nt, hsa; identical to SEQ ID NO: 252464

SEQ ID NO: 524514 - RNA, 60 nt, hsa; identical to SEQ ID NO: 252465

SEQ ID NO: 524515 - RNA, 60 nt, hsa; identical to SEQ ID NO: 252466

SEQ ID NO: 524516 - RNA, 60 nt, hsa; identical to SEQ ID NO: 252467

SEQ ID NO: 524517 - RNA, 60 nt, hsa; identical to SEQ ID NO: 252468

SEQ ID NO: 524518 - RNA, 60 nt, hsa; identical to SEQ ID NO: 252469

SEQ ID NO: 524519 - RNA, 60 nt, hsa; identical to SEQ ID NO: 252470

SEQ ID NO: 524520 - RNA, 60 nt, hsa; identical to SEQ ID NO: 252471

SEQ ID NO: 524521 - RNA, 60 nt, hsa; identical to SEQ ID NO: 252472

SEQ ID NO: 524522 - RNA, 60 nt, hsa; identical to SEQ ID NO: 252473

SEQ ID NO: 524523 - RNA, 60 nt, hsa; identical to SEQ ID NO: 252474

SEQ ID NO: 524524 - RNA, 60 nt, hsa; identical to SEQ ID NO: 252475

SEQ ID NO: 524525 - RNA, 60 nt, hsa; identical to SEQ ID NO: 252476

SEQ ID NO: 524526 - RNA, 60 nt, hsa; identical to SEQ ID NO: 252477

SEQ ID NO: 524527 - RNA, 60 nt, hsa; identical to SEQ ID NO: 252478

SEQ ID NO: 524528 - RNA, 60 nt, hsa; identical to SEQ ID NO: 252479

SEQ ID NO: 524529 - RNA, 60 nt, hsa; identical to SEQ ID NO: 252480

SEQ ID NO: 524530 - RNA, 60 nt, hsa; identical to SEQ ID NO: 252481

SEQ ID NO: 524531 - RNA, 60 nt, hsa; identical to SEQ ID NO: 252482

SEQ ID NO: 524532 - RNA, 60 nt, hsa; identical to SEQ ID NO: 252483

SEQ ID NO: 524533 - RNA, 60 nt, hsa; identical to SEQ ID NO: 252484

SEQ ID NO: 524534 - RNA, 60 nt, hsa; identical to SEQ ID NO: 252485

SEQ ID NO: 524535 - RNA, 60 nt, hsa; identical to SEQ ID NO: 252486

SEQ ID NO: 524536 - RNA, 60 nt, hsa; identical to SEQ ID NO: 252487

SEQ ID NO: 524537 - RNA, 60 nt, hsa; identical to SEQ ID NO: 252488

SEQ ID NO: 524538 - RNA, 60 nt, hsa; identical to SEQ ID NO: 252489

SEQ ID NO: 524539 - RNA, 60 nt, hsa; identical to SEQ ID NO: 252490

SEQ ID NO: 524540 - RNA, 60 nt, hsa; identical to SEQ ID NO: 252491

SEQ ID NO: 524541 - RNA, 60 nt, hsa; identical to SEQ ID NO: 252492

SEQ ID NO: 524542 - RNA, 60 nt, hsa; identical to SEQ ID NO: 252493

SEQ ID NO: 524543 - RNA, 60 nt, hsa; identical to SEQ ID NO: 252494

SEQ ID NO: 524544 - RNA, 60 nt, hsa; identical to SEQ ID NO: 252495

SEQ ID NO: 524545 - RNA, 60 nt, hsa; identical to SEQ ID NO: 252496

SEQ ID NO: 524546 - RNA, 60 nt, hsa; identical to SEQ ID NO: 252497

SEQ ID NO: 524547 - RNA, 60 nt, hsa; identical to SEQ ID NO: 252498

SEQ ID NO: 524548 - RNA, 60 nt, hsa; identical to SEQ ID NO: 252499

SEQ ID NO: 524549 - RNA, 60 nt, hsa; identical to SEQ ID NO: 252500

SEQ ID NO: 524550 - RNA, 60 nt, hsa; identical to SEQ ID NO: 252501

SEQ ID NO: 524551 - RNA, 60 nt, hsa; identical to SEQ ID NO: 252502

SEQ ID NO: 524552 - RNA, 60 nt, hsa; identical to SEQ ID NO: 252503

SEQ ID NO: 524553 - RNA, 60 nt, hsa; identical to SEQ ID NO: 252504

SEQ ID NO: 524554 - RNA, 60 nt, hsa; identical to SEQ ID NO: 252505

SEQ ID NO: 524555 - RNA, 60 nt, hsa; identical to SEQ ID NO: 252506

SEQ ID NO: 524556 - RNA, 60 nt, hsa; identical to SEQ ID NO: 252507

SEQ ID NO: 524557 - RNA, 60 nt, hsa; identical to SEQ ID NO: 252508

SEQ ID NO: 524558 - RNA, 60 nt, hsa; identical to SEQ ID NO: 252509

SEQ ID NO: 524559 - RNA, 60 nt, hsa; identical to SEQ ID NO: 252510

SEQ ID NO: 524560 - RNA, 60 nt, hsa; identical to SEQ ID NO: 252511

SEQ ID NO: 524561 - RNA, 60 nt, hsa; identical to SEQ ID NO: 252512

SEQ ID NO: 524562 - RNA, 60 nt, hsa; identical to SEQ ID NO: 252513

SEQ ID NO: 524563 - RNA, 60 nt, hsa; identical to SEQ ID NO: 252514

SEQ ID NO: 524564 - RNA, 60 nt, hsa; identical to SEQ ID NO: 252515

SEQ ID NO: 524565 - RNA, 60 nt, hsa; identical to SEQ ID NO: 252516

SEQ ID NO: 524566 - RNA, 60 nt, hsa; identical to SEQ ID NO: 252517

SEQ ID NO: 524567 - RNA, 60 nt, hsa; identical to SEQ ID NO: 252518

SEQ ID NO: 524568 - RNA, 60 nt, hsa; identical to SEQ ID NO: 252519

SEQ ID NO: 524569 - RNA, 60 nt, hsa; identical to SEQ ID NO: 252520

SEQ ID NO: 524570 - RNA, 60 nt, hsa; identical to SEQ ID NO: 252521

SEQ ID NO: 524571 - RNA, 60 nt, hsa; identical to SEQ ID NO: 252522

SEQ ID NO: 524572 - RNA, 60 nt, hsa; identical to SEQ ID NO: 252523

SEQ ID NO: 524573 - RNA, 60 nt, hsa; identical to SEQ ID NO: 252524

SEQ ID NO: 524574 - RNA, 60 nt, hsa; identical to SEQ ID NO: 252525

SEQ ID NO: 524575 - RNA, 60 nt, hsa; identical to SEQ ID NO: 252526

SEQ ID NO: 524576 - RNA, 60 nt, hsa; identical to SEQ ID NO: 252527

SEQ ID NO: 524577 - RNA, 60 nt, hsa; identical to SEQ ID NO: 252528

SEQ ID NO: 524578 - RNA, 60 nt, hsa; identical to SEQ ID NO: 252529

SEQ ID NO: 524579 - RNA, 60 nt, hsa; identical to SEQ ID NO: 252530

SEQ ID NO: 524580 - RNA, 60 nt, hsa; identical to SEQ ID NO: 252531

SEQ ID NO: 524581 - RNA, 60 nt, hsa; identical to SEQ ID NO: 252532

SEQ ID NO: 524582 - RNA, 60 nt, hsa; identical to SEQ ID NO: 252533

SEQ ID NO: 524583 - RNA, 60 nt, hsa; identical to SEQ ID NO: 252534

SEQ ID NO: 524584 - RNA, 60 nt, hsa; identical to SEQ ID NO: 252535

SEQ ID NO: 524585 - RNA, 60 nt, hsa; identical to SEQ ID NO: 252536

SEQ ID NO: 524586 - RNA, 60 nt, hsa; identical to SEQ ID NO: 252537

SEQ ID NO: 524587 - RNA, 60 nt, hsa; identical to SEQ ID NO: 252538

SEQ ID NO: 524588 - RNA, 60 nt, hsa; identical to SEQ ID NO: 252539

SEQ ID NO: 524589 - RNA, 60 nt, hsa; identical to SEQ ID NO: 252540

SEQ ID NO: 524590 - RNA, 60 nt, hsa; identical to SEQ ID NO: 252541

SEQ ID NO: 524591 - RNA, 60 nt, hsa; identical to SEQ ID NO: 252542

SEQ ID NO: 524592 - RNA, 60 nt, hsa; identical to SEQ ID NO: 252543

SEQ ID NO: 524593 - RNA, 60 nt, hsa; identical to SEQ ID NO: 252544

SEQ ID NO: 524594 - RNA, 60 nt, hsa; identical to SEQ ID NO: 252545

SEQ ID NO: 524595 - RNA, 60 nt, hsa; identical to SEQ ID NO: 252546

SEQ ID NO: 524596 - RNA, 60 nt, hsa; identical to SEQ ID NO: 252547

SEQ ID NO: 524597 - RNA, 60 nt, hsa; identical to SEQ ID NO: 252548

SEQ ID NO: 524598 - RNA, 60 nt, hsa; identical to SEQ ID NO: 252549

SEQ ID NO: 524599 - RNA, 60 nt, hsa; identical to SEQ ID NO: 252550

SEQ ID NO: 524600 - RNA, 60 nt, hsa; identical to SEQ ID NO: 252551

SEQ ID NO: 524601 - RNA, 60 nt, hsa; identical to SEQ ID NO: 252552

SEQ ID NO: 524602 - RNA, 60 nt, hsa; identical to SEQ ID NO: 252553

SEQ ID NO: 524603 - RNA, 60 nt, hsa; identical to SEQ ID NO: 252554

SEQ ID NO: 524604 - RNA, 60 nt, hsa; identical to SEQ ID NO: 252555

SEQ ID NO: 524605 - RNA, 60 nt, hsa; identical to SEQ ID NO: 252556

SEQ ID NO: 524606 - RNA, 51 nt, hsa; identical to SEQ ID NO: 252557

SEQ ID NO: 524607 - RNA, 60 nt, hsa; identical to SEQ ID NO: 252558

SEQ ID NO: 524608 - RNA, 60 nt, hsa; identical to SEQ ID NO: 252559

SEQ ID NO: 524609 - RNA, 60 nt, hsa; identical to SEQ ID NO: 252560

SEQ ID NO: 524610 - RNA, 60 nt, hsa; identical to SEQ ID NO: 252561

SEQ ID NO: 524611 - RNA, 60 nt, hsa; identical to SEQ ID NO: 252562

SEQ ID NO: 524612 - RNA, 60 nt, hsa; identical to SEQ ID NO: 252563

SEQ ID NO: 524613 - RNA, 60 nt, hsa; identical to SEQ ID NO: 252564

SEQ ID NO: 524614 - RNA, 60 nt, hsa; identical to SEQ ID NO: 252565

SEQ ID NO: 524615 - RNA, 60 nt, hsa; identical to SEQ ID NO: 252566

SEQ ID NO: 524616 - RNA, 60 nt, hsa; identical to SEQ ID NO: 252567

SEQ ID NO: 524617 - RNA, 60 nt, hsa; identical to SEQ ID NO: 252568

SEQ ID NO: 524618 - RNA, 60 nt, hsa; identical to SEQ ID NO: 252569

SEQ ID NO: 524619 - RNA, 60 nt, hsa; identical to SEQ ID NO: 252570

SEQ ID NO: 524620 - RNA, 60 nt, hsa; identical to SEQ ID NO: 252571

SEQ ID NO: 524621 - RNA, 60 nt, hsa; identical to SEQ ID NO: 252572

SEQ ID NO: 524622 - RNA, 60 nt, hsa; identical to SEQ ID NO: 252573

SEQ ID NO: 524623 - RNA, 60 nt, hsa; identical to SEQ ID NO: 252574

SEQ ID NO: 524624 - RNA, 60 nt, hsa; identical to SEQ ID NO: 252575

SEQ ID NO: 524625 - RNA, 60 nt, hsa; identical to SEQ ID NO: 252576

SEQ ID NO: 524626 - RNA, 60 nt, hsa; identical to SEQ ID NO: 252577

SEQ ID NO: 524627 - RNA, 60 nt, hsa; identical to SEQ ID NO: 252578

SEQ ID NO: 524628 - RNA, 60 nt, hsa; identical to SEQ ID NO: 252579

SEQ ID NO: 524629 - RNA, 60 nt, hsa; identical to SEQ ID NO: 252580

SEQ ID NO: 524630 - RNA, 60 nt, hsa; identical to SEQ ID NO: 252581

SEQ ID NO: 524631 - RNA, 60 nt, hsa; identical to SEQ ID NO: 252582

SEQ ID NO: 524632 - RNA, 60 nt, hsa; identical to SEQ ID NO: 252583

SEQ ID NO: 524633 - RNA, 60 nt, hsa; identical to SEQ ID NO: 252584

SEQ ID NO: 524634 - RNA, 60 nt, hsa; identical to SEQ ID NO: 252585

SEQ ID NO: 524635 - RNA, 60 nt, hsa; identical to SEQ ID NO: 252586

SEQ ID NO: 524636 - RNA, 60 nt, hsa; identical to SEQ ID NO: 252587

SEQ ID NO: 524637 - RNA, 60 nt, hsa; identical to SEQ ID NO: 252588

SEQ ID NO: 524638 - RNA, 60 nt, hsa; identical to SEQ ID NO: 252589

SEQ ID NO: 524639 - RNA, 60 nt, hsa; identical to SEQ ID NO: 252590

SEQ ID NO: 524640 - RNA, 60 nt, hsa; identical to SEQ ID NO: 252591

SEQ ID NO: 524641 - RNA, 60 nt, hsa; identical to SEQ ID NO: 252592

SEQ ID NO: 524642 - RNA, 60 nt, hsa; identical to SEQ ID NO: 252593

SEQ ID NO: 524643 - RNA, 60 nt, hsa; identical to SEQ ID NO: 252594

SEQ ID NO: 524644 - RNA, 60 nt, hsa; identical to SEQ ID NO: 252595

SEQ ID NO: 524645 - RNA, 60 nt, hsa; identical to SEQ ID NO: 252596

SEQ ID NO: 524646 - RNA, 64 nt, hsa
caaggaauucagcuguugaaaucauuugaacuaaucaaggaauaaauccuaauguucugggacu

SEQ ID NO: 524647 - RNA, 64 nt, hsa
aguccauccaaaggaccaaccugccuuacacaucucaaggaauucagcuguugaaaucauuuga

SEQ ID NO: 524648 - RNA, 64 nt, hsa
uggaaaauaccaaaugaacguacaguacaacauuucaaggaaaugaauauauuguuagaccagg

SEQ ID NO: 524649 - RNA, 64 nt, hsa
uuuugcuuagaauagaauggaacaaguuuaaauuucaaggaaauaugaaggcacuuccuuuuuu

SEQ ID NO: 524650 - RNA, 64 nt, hsa
cuccauaaauuacuuagucuucuauguauagcuaucaaggaaauaaaaccaauuuugccacagc

SEQ ID NO: 524651 - RNA, 64 nt, hsa
aagagcuucuuagaguaguauauuuugggggcagucaaggaauaaacuacaguguaaacauauc

SEQ ID NO: 524652 - RNA, 64 nt, hsa
ugauagucuaaaaaaugaucaaaacaaaugauuuucaaggaauauucaauauucugccuuucag

SEQ ID NO: 524653 - RNA, 64 nt, hsa
uuuaaguaccagccaaguacacacgaugauagcuucaaggaauacaacugacuuuaugauauga

SEQ ID NO: 524654 - RNA, 64 nt, hsa
ucaaggaauacaacugacuuuaugauaugaauuuucaaggaacguaucuuauauggauuuugaa

SEQ ID NO: 524655 - RNA, 64 nt, hsa
uaaaugcaauugaauucccagaaaaaugauuguuucaaggaagugacaguucuacuuuagaagu

SEQ ID NO: 524656 - RNA, 64 nt, hsa
cguaggugaaaaaagaugggccauuaaggauucuucaaggaaaacauuccucaaaaugaucuuu

SEQ ID NO: 524657 - RNA, 64 nt, hsa
agagucuuccaggugggcauuucaaccaacucagucaaggaacccaugacaaagaaagucauuu

SEQ ID NO: 524658 - RNA, 64 nt, hsa
acgugcuucaaauauccauauuaaccacuauuuuucaaggaaguauggaaaaguacacucuguc

SEQ ID NO: 524659 - RNA, 64 nt, hsa
ugguuuucacacuauuucagcagcaaaaacuuuuucaaggaaaaucuuacagaaccuuuaaaca

SEQ ID NO: 524660 - RNA, 64 nt, hsa
uuuaauaggcgagcaaauaaaauucaaaucaauuucaaggaaaaacaucuggccagggguagcu

SEQ ID NO: 524661 - RNA, 64 nt, hsa
aagggaaccccggggaaugggaggacaggauuuuucaaggaaccuuuuucaaugaaagagaagg

SEQ ID NO: 524662 - RNA, 64 nt, hsa
uuaagauuucgagcagaauuuaucuaaauguguuucaaggaaacacaaucgcugaaccaaaacg

SEQ ID NO: 524663 - RNA, 64 nt, hsa
aaagguauacaaauaaauaaggccaugucugacuucaaggaacucaguuuaauuuugauauauu

SEQ ID NO: 524664 - RNA, 64 nt, hsa
acauugugauuauugaaguucaugaaucuugcugucaaggaagaaagguaagaaagcugauagc

SEQ ID NO: 524665 - RNA, 64 nt, hsa
uuugccaaacugaauggucucuuugacagcccugucaaggaauaccaacagaauauugauucuc

SEQ ID NO: 524666 - RNA, 64 nt, hsa
gagccacucagaaaaggcccauggccauggagcuucaaggaaagaaaccccucaguuuuuuccg

SEQ ID NO: 524667 - RNA, 64 nt, hsa
aagucacuuuugaaugugaacaaaaggaagaaaaucaaggaaagaaugagucuaauaucaagcc

SEQ ID NO: 524668 - RNA, 64 nt, hsa
gugugggagaucaagaauuguuacaaaucaccccucaaggaaccagggaugaaaucaguuugga

SEQ ID NO: 524669 - RNA, 62 nt, hsa
aagacgucaucuucuucuaaaagggccgugacucaaggaaaguuuuuaauggaaaguugagc

SEQ ID NO: 524670 - RNA, 64 nt, hsa
cgagaugccacaauuccuuggaugggggagaaguucaaggaauuucugcucggccacgcggugg

SEQ ID NO: 524671 - RNA, 64 nt, hsa; identical to SEQ ID NO: 81753

SEQ ID NO: 524672 - RNA, 64 nt, hsa; identical to SEQ ID NO: 81754

SEQ ID NO: 524673 - RNA, 64 nt, hsa; identical to SEQ ID NO: 81755

SEQ ID NO: 524674 - RNA, 64 nt, hsa; identical to SEQ ID NO: 81756

SEQ ID NO: 524675 - RNA, 64 nt, hsa; identical to SEQ ID NO: 81757

SEQ ID NO: 524676 - RNA, 64 nt, hsa; identical to SEQ ID NO: 81758

SEQ ID NO: 524677 - RNA, 64 nt, hsa; identical to SEQ ID NO: 81759

SEQ ID NO: 524678 - RNA, 64 nt, hsa; identical to SEQ ID NO: 81760

SEQ ID NO: 524679 - RNA, 61 nt, hsa; identical to SEQ ID NO: 81761

SEQ ID NO: 524680 - RNA, 64 nt, hsa; identical to SEQ ID NO: 81762

SEQ ID NO: 524681 - RNA, 64 nt, hsa; identical to SEQ ID NO: 81763

SEQ ID NO: 524682 - RNA, 64 nt, hsa; identical to SEQ ID NO: 81764

SEQ ID NO: 524683 - RNA, 64 nt, hsa; identical to SEQ ID NO: 81765

SEQ ID NO: 524684 - RNA, 64 nt, hsa; identical to SEQ ID NO: 81766

SEQ ID NO: 524685 - RNA, 64 nt, hsa; identical to SEQ ID NO: 81767

SEQ ID NO: 524686 - RNA, 64 nt, hsa; identical to SEQ ID NO: 81768

SEQ ID NO: 524687 - RNA, 64 nt, hsa; identical to SEQ ID NO: 81769

SEQ ID NO: 524688 - RNA, 56 nt, hsa; identical to SEQ ID NO: 81770

SEQ ID NO: 524689 - RNA, 64 nt, hsa; identical to SEQ ID NO: 81771

SEQ ID NO: 524690 - RNA, 64 nt, hsa; identical to SEQ ID NO: 81772

SEQ ID NO: 524691 - RNA, 64 nt, hsa; identical to SEQ ID NO: 81773

SEQ ID NO: 524692 - RNA, 64 nt, hsa; identical to SEQ ID NO: 81774

SEQ ID NO: 524693 - RNA, 64 nt, hsa; identical to SEQ ID NO: 81775

SEQ ID NO: 524694 - RNA, 64 nt, hsa; identical to SEQ ID NO: 81776

SEQ ID NO: 524695 - RNA, 64 nt, hsa; identical to SEQ ID NO: 81777

SEQ ID NO: 524696 - RNA, 64 nt, hsa; identical to SEQ ID NO: 81778

SEQ ID NO: 524697 - RNA, 64 nt, hsa; identical to SEQ ID NO: 81779

SEQ ID NO: 524698 - RNA, 64 nt, hsa; identical to SEQ ID NO: 81780

SEQ ID NO: 524699 - RNA, 64 nt, hsa; identical to SEQ ID NO: 81781

SEQ ID NO: 524700 - RNA, 64 nt, hsa; identical to SEQ ID NO: 81782

SEQ ID NO: 524701 - RNA, 64 nt, hsa; identical to SEQ ID NO: 81783

SEQ ID NO: 524702 - RNA, 64 nt, hsa; identical to SEQ ID NO: 81784

SEQ ID NO: 524703 - RNA, 64 nt, hsa; identical to SEQ ID NO: 81785

SEQ ID NO: 524704 - RNA, 64 nt, hsa; identical to SEQ ID NO: 81786

SEQ ID NO: 524705 - RNA, 64 nt, hsa; identical to SEQ ID NO: 81787

SEQ ID NO: 524706 - RNA, 64 nt, hsa; identical to SEQ ID NO: 81788

SEQ ID NO: 524707 - RNA, 64 nt, hsa; identical to SEQ ID NO: 81789

SEQ ID NO: 524708 - RNA, 64 nt, hsa; identical to SEQ ID NO: 81790

SEQ ID NO: 524709 - RNA, 64 nt, hsa; identical to SEQ ID NO: 81791

SEQ ID NO: 524710 - RNA, 64 nt, hsa; identical to SEQ ID NO: 81792

SEQ ID NO: 524711 - RNA, 64 nt, hsa; identical to SEQ ID NO: 81793

SEQ ID NO: 524712 - RNA, 64 nt, hsa; identical to SEQ ID NO: 81794

SEQ ID NO: 524713 - RNA, 64 nt, hsa; identical to SEQ ID NO: 81795

SEQ ID NO: 524714 - RNA, 64 nt, hsa; identical to SEQ ID NO: 81796

SEQ ID NO: 524715 - RNA, 64 nt, hsa; identical to SEQ ID NO: 81797

SEQ ID NO: 524716 - RNA, 64 nt, hsa; identical to SEQ ID NO: 81798

SEQ ID NO: 524717 - RNA, 64 nt, hsa; identical to SEQ ID NO: 81799

SEQ ID NO: 524718 - RNA, 64 nt, hsa; identical to SEQ ID NO: 81800

SEQ ID NO: 524719 - RNA, 64 nt, hsa; identical to SEQ ID NO: 81801

SEQ ID NO: 524720 - RNA, 64 nt, hsa; identical to SEQ ID NO: 81802

SEQ ID NO: 524721 - RNA, 64 nt, hsa; identical to SEQ ID NO: 233025

SEQ ID NO: 524722 - RNA, 64 nt, hsa; identical to SEQ ID NO: 233026

SEQ ID NO: 524723 - RNA, 64 nt, hsa; identical to SEQ ID NO: 233027

SEQ ID NO: 524724 - RNA, 64 nt, hsa; identical to SEQ ID NO: 233028

SEQ ID NO: 524725 - RNA, 64 nt, hsa; identical to SEQ ID NO: 233029

SEQ ID NO: 524726 - RNA, 64 nt, hsa; identical to SEQ ID NO: 233030

SEQ ID NO: 524727 - RNA, 64 nt, hsa; identical to SEQ ID NO: 233031

SEQ ID NO: 524728 - RNA, 64 nt, hsa; identical to SEQ ID NO: 233032

SEQ ID NO: 524729 - RNA, 64 nt, hsa; identical to SEQ ID NO: 233033

SEQ ID NO: 524730 - RNA, 64 nt, hsa; identical to SEQ ID NO: 233034

SEQ ID NO: 524731 - RNA, 64 nt, hsa; identical to SEQ ID NO: 233035

SEQ ID NO: 524732 - RNA, 64 nt, hsa; identical to SEQ ID NO: 233036

SEQ ID NO: 524733 - RNA, 64 nt, hsa; identical to SEQ ID NO: 233037

SEQ ID NO: 524734 - RNA, 64 nt, hsa; identical to SEQ ID NO: 233038

SEQ ID NO: 524735 - RNA, 64 nt, hsa; identical to SEQ ID NO: 233039

SEQ ID NO: 524736 - RNA, 64 nt, hsa; identical to SEQ ID NO: 233040

SEQ ID NO: 524737 - RNA, 64 nt, hsa; identical to SEQ ID NO: 233041

SEQ ID NO: 524738 - RNA, 64 nt, hsa; identical to SEQ ID NO: 233042

SEQ ID NO: 524739 - RNA, 64 nt, hsa; identical to SEQ ID NO: 233043

SEQ ID NO: 524740 - RNA, 64 nt, hsa; identical to SEQ ID NO: 233044

SEQ ID NO: 524741 - RNA, 64 nt, hsa; identical to SEQ ID NO: 233045

SEQ ID NO: 524742 - RNA, 64 nt, hsa; identical to SEQ ID NO: 233046

SEQ ID NO: 524743 - RNA, 64 nt, hsa; identical to SEQ ID NO: 233047

SEQ ID NO: 524744 - RNA, 64 nt, hsa; identical to SEQ ID NO: 233048

SEQ ID NO: 524745 - RNA, 64 nt, hsa; identical to SEQ ID NO: 233049

SEQ ID NO: 524746 - RNA, 64 nt, hsa; identical to SEQ ID NO: 233050

SEQ ID NO: 524747 - RNA, 64 nt, hsa; identical to SEQ ID NO: 233051

SEQ ID NO: 524748 - RNA, 64 nt, hsa; identical to SEQ ID NO: 233052

SEQ ID NO: 524749 - RNA, 64 nt, hsa; identical to SEQ ID NO: 233053

SEQ ID NO: 524750 - RNA, 64 nt, hsa; identical to SEQ ID NO: 233054

SEQ ID NO: 524751 - RNA, 64 nt, hsa; identical to SEQ ID NO: 233055

SEQ ID NO: 524752 - RNA, 64 nt, hsa; identical to SEQ ID NO: 233055

SEQ ID NO: 524753 - RNA, 64 nt, hsa; identical to SEQ ID NO: 233057

SEQ ID NO: 524754 - RNA, 64 nt, hsa; identical to SEQ ID NO: 296446

SEQ ID NO: 524755 - RNA, 64 nt, hsa; identical to SEQ ID NO: 296447

SEQ ID NO: 524756 - RNA, 64 nt, hsa; identical to SEQ ID NO: 296448

SEQ ID NO: 524757 - RNA, 64 nt, hsa; identical to SEQ ID NO: 296449

SEQ ID NO: 524758 - RNA, 64 nt, hsa; identical to SEQ ID NO: 296450

SEQ ID NO: 524759 - RNA, 64 nt, hsa; identical to SEQ ID NO: 296451

SEQ ID NO: 524760 - RNA, 64 nt, hsa; identical to SEQ ID NO: 296452

SEQ ID NO: 524761 - RNA, 64 nt, hsa; identical to SEQ ID NO: 296453

SEQ ID NO: 524762 - RNA, 64 nt, hsa; identical to SEQ ID NO: 296454

SEQ ID NO: 524763 - RNA, 64 nt, hsa; identical to SEQ ID NO: 296455

SEQ ID NO: 524764 - RNA, 64 nt, hsa; identical to SEQ ID NO: 159322

SEQ ID NO: 524765 - RNA, 64 nt, hsa; identical to SEQ ID NO: 159323

SEQ ID NO: 524766 - RNA, 64 nt, hsa; identical to SEQ ID NO: 159324

SEQ ID NO: 524767 - RNA, 64 nt, hsa; identical to SEQ ID NO: 159325

SEQ ID NO: 524768 - RNA, 64 nt, hsa; identical to SEQ ID NO: 159326

SEQ ID NO: 524769 - RNA, 64 nt, hsa; identical to SEQ ID NO: 159327

SEQ ID NO: 524770 - RNA, 64 nt, hsa; identical to SEQ ID NO: 159328

SEQ ID NO: 524771 - RNA, 64 nt, hsa; identical to SEQ ID NO: 159329

SEQ ID NO: 524772 - RNA, 64 nt, hsa; identical to SEQ ID NO: 159330

SEQ ID NO: 524773 - RNA, 64 nt, hsa; identical to SEQ ID NO: 159331

SEQ ID NO: 524774 - RNA, 64 nt, hsa; identical to SEQ ID NO: 159332

SEQ ID NO: 524775 - RNA, 64 nt, hsa; identical to SEQ ID NO: 159333

SEQ ID NO: 524776 - RNA, 64 nt, hsa; identical to SEQ ID NO: 159334

SEQ ID NO: 524777 - RNA, 64 nt, hsa; identical to SEQ ID NO: 159335

SEQ ID NO: 524778 - RNA, 64 nt, hsa; identical to SEQ ID NO: 159336

SEQ ID NO: 524779 - RNA, 64 nt, hsa; identical to SEQ ID NO: 159337

SEQ ID NO: 524780 - RNA, 64 nt, hsa; identical to SEQ ID NO: 159338

SEQ ID NO: 524781 - RNA, 64 nt, hsa; identical to SEQ ID NO: 159339

SEQ ID NO: 524782 - RNA, 64 nt, hsa; identical to SEQ ID NO: 159340

SEQ ID NO: 524783 - RNA, 64 nt, hsa; identical to SEQ ID NO: 159341

SEQ ID NO: 524784 - RNA, 64 nt, hsa; identical to SEQ ID NO: 159342

SEQ ID NO: 524785 - RNA, 64 nt, hsa; identical to SEQ ID NO: 159343

SEQ ID NO: 524786 - RNA, 64 nt, hsa; identical to SEQ ID NO: 159344

SEQ ID NO: 524787 - RNA, 64 nt, hsa; identical to SEQ ID NO: 159345

SEQ ID NO: 524788 - RNA, 64 nt, hsa; identical to SEQ ID NO: 159346

SEQ ID NO: 524789 - RNA, 64 nt, hsa; identical to SEQ ID NO: 159347

SEQ ID NO: 524790 - RNA, 64 nt, hsa; identical to SEQ ID NO: 159348

SEQ ID NO: 524791 - RNA, 64 nt, hsa; identical to SEQ ID NO: 159349

SEQ ID NO: 524792 - RNA, 64 nt, hsa; identical to SEQ ID NO: 159350

SEQ ID NO: 524793 - RNA, 64 nt, hsa; identical to SEQ ID NO: 159351

SEQ ID NO: 524794 - RNA, 64 nt, hsa; identical to SEQ ID NO: 159352

SEQ ID NO: 524795 - RNA, 64 nt, hsa; identical to SEQ ID NO: 159353

SEQ ID NO: 524796 - RNA, 64 nt, hsa; identical to SEQ ID NO: 159354

SEQ ID NO: 524797 - RNA, 64 nt, hsa; identical to SEQ ID NO: 159355

SEQ ID NO: 524798 - RNA, 64 nt, hsa; identical to SEQ ID NO: 159356

SEQ ID NO: 524799 - RNA, 64 nt, hsa; identical to SEQ ID NO: 159357

SEQ ID NO: 524800 - RNA, 64 nt, hsa; identical to SEQ ID NO: 159358

SEQ ID NO: 524801 - RNA, 64 nt, hsa; identical to SEQ ID NO: 159359

SEQ ID NO: 524802 - RNA, 64 nt, hsa; identical to SEQ ID NO: 159360

SEQ ID NO: 524803 - RNA, 64 nt, hsa; identical to SEQ ID NO: 159361

SEQ ID NO: 524804 - RNA, 64 nt, hsa; identical to SEQ ID NO: 159362

SEQ ID NO: 524805 - RNA, 64 nt, hsa; identical to SEQ ID NO: 159363

SEQ ID NO: 524806 - RNA, 64 nt, hsa; identical to SEQ ID NO: 159364

SEQ ID NO: 524807 - RNA, 64 nt, hsa; identical to SEQ ID NO: 159365

SEQ ID NO: 524808 - RNA, 64 nt, hsa; identical to SEQ ID NO: 159366

SEQ ID NO: 524809 - RNA, 64 nt, hsa; identical to SEQ ID NO: 159365

SEQ ID NO: 524810 - RNA, 64 nt, hsa; identical to SEQ ID NO: 159368

SEQ ID NO: 524811 - RNA, 64 nt, hsa; identical to SEQ ID NO: 159369

SEQ ID NO: 524812 - RNA, 64 nt, hsa; identical to SEQ ID NO: 159370

SEQ ID NO: 524813 - RNA, 64 nt, hsa; identical to SEQ ID NO: 159371

SEQ ID NO: 524814 - RNA, 64 nt, hsa; identical to SEQ ID NO: 159372

SEQ ID NO: 524815 - RNA, 64 nt, hsa; identical to SEQ ID NO: 159373

SEQ ID NO: 524816 - RNA, 64 nt, hsa; identical to SEQ ID NO: 159374

SEQ ID NO: 524817 - RNA, 64 nt, hsa; identical to SEQ ID NO: 159375

SEQ ID NO: 524818 - RNA, 64 nt, hsa; identical to SEQ ID NO: 159376

SEQ ID NO: 524819 - RNA, 64 nt, hsa; identical to SEQ ID NO: 159377

SEQ ID NO: 524820 - RNA, 64 nt, hsa; identical to SEQ ID NO: 209724

SEQ ID NO: 524821 - RNA, 64 nt, hsa; identical to SEQ ID NO: 209725

SEQ ID NO: 524822 - RNA, 64 nt, hsa; identical to SEQ ID NO: 209726

SEQ ID NO: 524823 - RNA, 64 nt, hsa; identical to SEQ ID NO: 209727

SEQ ID NO: 524824 - RNA, 64 nt, hsa; identical to SEQ ID NO: 209728

SEQ ID NO: 524825 - RNA, 64 nt, hsa; identical to SEQ ID NO: 209729

SEQ ID NO: 524826 - RNA, 64 nt, hsa; identical to SEQ ID NO: 209730

SEQ ID NO: 524827 - RNA, 64 nt, hsa; identical to SEQ ID NO: 209731

SEQ ID NO: 524828 - RNA, 64 nt, hsa; identical to SEQ ID NO: 209732

SEQ ID NO: 524829 - RNA, 64 nt, hsa; identical to SEQ ID NO: 209733

SEQ ID NO: 524830 - RNA, 63 nt, hsa; identical to SEQ ID NO: 209734

SEQ ID NO: 524831 - RNA, 64 nt, hsa; identical to SEQ ID NO: 209735

SEQ ID NO: 524832 - RNA, 64 nt, hsa; identical to SEQ ID NO: 209736

SEQ ID NO: 524833 - RNA, 64 nt, hsa; identical to SEQ ID NO: 209737

SEQ ID NO: 524834 - RNA, 64 nt, hsa; identical to SEQ ID NO: 209738

SEQ ID NO: 524835 - RNA, 64 nt, hsa; identical to SEQ ID NO: 209739

SEQ ID NO: 524836 - RNA, 64 nt, hsa; identical to SEQ ID NO: 209740

SEQ ID NO: 524837 - RNA, 64 nt, hsa; identical to SEQ ID NO: 209741

SEQ ID NO: 524838 - RNA, 64 nt, hsa; identical to SEQ ID NO: 209742

SEQ ID NO: 524839 - RNA, 64 nt, hsa; identical to SEQ ID NO: 209743

SEQ ID NO: 524840 - RNA, 64 nt, hsa; identical to SEQ ID NO: 209744

SEQ ID NO: 524841 - RNA, 64 nt, hsa; identical to SEQ ID NO: 209745

SEQ ID NO: 524842 - RNA, 64 nt, hsa; identical to SEQ ID NO: 209746

SEQ ID NO: 524843 - RNA, 64 nt, hsa; identical to SEQ ID NO: 209747

SEQ ID NO: 524844 - RNA, 64 nt, hsa; identical to SEQ ID NO: 209748

SEQ ID NO: 524845 - RNA, 64 nt, hsa; identical to SEQ ID NO: 209749

SEQ ID NO: 524846 - RNA, 64 nt, hsa; identical to SEQ ID NO: 209750

SEQ ID NO: 524847 - RNA, 64 nt, hsa; identical to SEQ ID NO: 209751

SEQ ID NO: 524848 - RNA, 64 nt, hsa; identical to SEQ ID NO: 209752

SEQ ID NO: 524849 - RNA, 64 nt, hsa; identical to SEQ ID NO: 209753

SEQ ID NO: 524850 - RNA, 64 nt, hsa; identical to SEQ ID NO: 209754

SEQ ID NO: 524851 - RNA, 64 nt, hsa; identical to SEQ ID NO: 209755

SEQ ID NO: 524852 - RNA, 64 nt, hsa; identical to SEQ ID NO: 209756

SEQ ID NO: 524853 - RNA, 64 nt, hsa; identical to SEQ ID NO: 209757

SEQ ID NO: 524854 - RNA, 64 nt, hsa; identical to SEQ ID NO: 209758

SEQ ID NO: 524855 - RNA, 64 nt, hsa; identical to SEQ ID NO: 209759

SEQ ID NO: 524856 - RNA, 64 nt, hsa; identical to SEQ ID NO: 209760

SEQ ID NO: 524857 - RNA, 64 nt, hsa; identical to SEQ ID NO: 209761

SEQ ID NO: 524858 - RNA, 64 nt, hsa; identical to SEQ ID NO: 209762

SEQ ID NO: 524859 - RNA, 64 nt, hsa; identical to SEQ ID NO: 209763

SEQ ID NO: 524860 - RNA, 64 nt, hsa; identical to SEQ ID NO: 209764

SEQ ID NO: 524861 - RNA, 64 nt, hsa; identical to SEQ ID NO: 209765

SEQ ID NO: 524862 - RNA, 64 nt, hsa; identical to SEQ ID NO: 209766

SEQ ID NO: 524863 - RNA, 64 nt, hsa; identical to SEQ ID NO: 209767

SEQ ID NO: 524864 - RNA, 64 nt, hsa; identical to SEQ ID NO: 209768

SEQ ID NO: 524865 - RNA, 64 nt, hsa; identical to SEQ ID NO: 209769

SEQ ID NO: 524866 - RNA, 64 nt, hsa; identical to SEQ ID NO: 209770

SEQ ID NO: 524867 - RNA, 64 nt, hsa; identical to SEQ ID NO: 209771

SEQ ID NO: 524868 - RNA, 64 nt, hsa; identical to SEQ ID NO: 209772

SEQ ID NO: 524869 - RNA, 64 nt, hsa; identical to SEQ ID NO: 209773

SEQ ID NO: 524870 - RNA, 64 nt, hsa; identical to SEQ ID NO: 209774

SEQ ID NO: 524871 - RNA, 64 nt, hsa; identical to SEQ ID NO: 209775

SEQ ID NO: 524872 - RNA, 64 nt, hsa; identical to SEQ ID NO: 209776

SEQ ID NO: 524873 - RNA, 64 nt, hsa; identical to SEQ ID NO: 209777

SEQ ID NO: 524874 - RNA, 64 nt, hsa; identical to SEQ ID NO: 209778

SEQ ID NO: 524875 - RNA, 64 nt, hsa; identical to SEQ ID NO: 209779

SEQ ID NO: 524876 - RNA, 64 nt, hsa; identical to SEQ ID NO: 209780

SEQ ID NO: 524877 - RNA, 64 nt, hsa; identical to SEQ ID NO: 209781

SEQ ID NO: 524878 - RNA, 64 nt, hsa; identical to SEQ ID NO: 209782

SEQ ID NO: 524879 - RNA, 64 nt, hsa; identical to SEQ ID NO: 209783

SEQ ID NO: 524880 - RNA, 64 nt, hsa; identical to SEQ ID NO: 209784

SEQ ID NO: 524881 - RNA, 64 nt, hsa; identical to SEQ ID NO: 209785

SEQ ID NO: 524882 - RNA, 64 nt, hsa; identical to SEQ ID NO: 209786

SEQ ID NO: 524883 - RNA, 64 nt, hsa; identical to SEQ ID NO: 209787

SEQ ID NO: 524884 - RNA, 64 nt, hsa; identical to SEQ ID NO: 209788

SEQ ID NO: 524885 - RNA, 64 nt, hsa; identical to SEQ ID NO: 209789

SEQ ID NO: 524886 - RNA, 64 nt, hsa; identical to SEQ ID NO: 209790

SEQ ID NO: 524887 - RNA, 64 nt, hsa; identical to SEQ ID NO: 209791

SEQ ID NO: 524888 - RNA, 64 nt, hsa; identical to SEQ ID NO: 209792

SEQ ID NO: 524889 - RNA, 64 nt, hsa; identical to SEQ ID NO: 209793

SEQ ID NO: 524890 - RNA, 64 nt, hsa; identical to SEQ ID NO: 209794

SEQ ID NO: 524891 - RNA, 64 nt, hsa; identical to SEQ ID NO: 209795

SEQ ID NO: 524892 - RNA, 64 nt, hsa; identical to SEQ ID NO: 209796

SEQ ID NO: 524893 - RNA, 64 nt, hsa; identical to SEQ ID NO: 209797

SEQ ID NO: 524894 - RNA, 64 nt, hsa; identical to SEQ ID NO: 209798

SEQ ID NO: 524895 - RNA, 64 nt, hsa; identical to SEQ ID NO: 209799

SEQ ID NO: 524896 - RNA, 64 nt, hsa; identical to SEQ ID NO: 209800

SEQ ID NO: 524897 - RNA, 64 nt, hsa; identical to SEQ ID NO: 209801

SEQ ID NO: 524898 - RNA, 64 nt, hsa; identical to SEQ ID NO: 209802

SEQ ID NO: 524899 - RNA, 64 nt, hsa; identical to SEQ ID NO: 209803

SEQ ID NO: 524900 - RNA, 64 nt, hsa; identical to SEQ ID NO: 209804

SEQ ID NO: 524901 - RNA, 64 nt, hsa; identical to SEQ ID NO: 209805

SEQ ID NO: 524902 - RNA, 64 nt, hsa; identical to SEQ ID NO: 209806

SEQ ID NO: 524903 - RNA, 64 nt, hsa; identical to SEQ ID NO: 209807

SEQ ID NO: 524904 - RNA, 64 nt, hsa; identical to SEQ ID NO: 209808

SEQ ID NO: 524905 - RNA, 64 nt, hsa; identical to SEQ ID NO: 209809

SEQ ID NO: 524906 - RNA, 64 nt, hsa; identical to SEQ ID NO: 209810

SEQ ID NO: 524907 - RNA, 64 nt, hsa; identical to SEQ ID NO: 209811

SEQ ID NO: 524908 - RNA, 64 nt, hsa; identical to SEQ ID NO: 209812

SEQ ID NO: 524909 - RNA, 64 nt, hsa; identical to SEQ ID NO: 209813

SEQ ID NO: 524910 - RNA, 64 nt, hsa; identical to SEQ ID NO: 209814

SEQ ID NO: 524911 - RNA, 64 nt, hsa
gauugaggcuguugaccugggcaguagcuccucccauggccaguggucagugggagggugugcc

SEQ ID NO: 524912 - RNA, 64 nt, hsa
uggucagugggagggugugcccugcgccugucugcauggccacugggcauguguguugggagca

SEQ ID NO: 524913 - RNA, 64 nt, hsa
ccaggugcuggccagaugccuugaucacagccuccauggccaggggccugucaagccaggggcc

SEQ ID NO: 524914 - RNA, 64 nt, hsa
ggcucucaggagugugaccagaguagacuuggggcauggccauuggggucauauguuuauuuuu

SEQ ID NO: 524915 - RNA, 64 nt, hsa
cuuuccuugagcucucuggacacugcagaggacccauggccauggaacccugaagaagcauguc

SEQ ID NO: 524916 - RNA, 64 nt, hsa
uggcccuuccccgggugaggccguuuggaauuaacauggccaguguuucacacaagauuggguu

SEQ ID NO: 524917 - RNA, 64 nt, hsa
cccuauccuacuugcccauaugagcacggcuccccauggccacauacuccugcaaagcuuuuau

SEQ ID NO: 524918 - RNA, 64 nt, hsa
ugcuaaggucuuggaacuugccugccuuuccauccauggccagcagcaccugcccuaccugccc

SEQ ID NO: 524919 - RNA, 64 nt, hsa
caggucccucucauuuagccuguccugucaucaucauggccagcuggaggcaggggcuuccugg

SEQ ID NO: 524920 - RNA, 64 nt, hsa
ggccccugacucaccccggucaccucccaggguccauggccagggccucuguguuuggggggcc

SEQ ID NO: 524921 - RNA, 64 nt, hsa
uccauuccccuggacccagggacaugcagcccuacauggccacccacuguuugcagugucucug

SEQ ID NO: 524922 - RNA, 64 nt, hsa
aacuucuacaggaucagagaggaucuugcucauucauggccauauccacaugcccauggccacu

SEQ ID NO: 524923 - RNA, 64 nt, hsa
ggaucuugcucauucauggccauauccacaugcccauggccacucaguagauuguugaaaaagc

SEQ ID NO: 524924 - RNA, 64 nt, hsa
ggucauacacagggcuggaccucacgcagacuggcauggccauggguccagaggauacuacugg

SEQ ID NO: 524925 - RNA, 64 nt, hsa
uuccagaugguuccauggaguucugaucuuugggcauggccaggggaagcagaagggagacucu

SEQ ID NO: 524926 - RNA, 64 nt, hsa
ugaugcacauauuucaccacgguaucauguacuucauggccaguguuuuaucucagcagggaac

SEQ ID NO: 524927 - RNA, 64 nt, hsa
ucaaauauauccacauucuuuaucagcaagcauucauggccauucagaagaaauaaauuaggua

SEQ ID NO: 524928 - RNA, 64 nt, hsa
uggguguggcccggugguggugcacuggugacuucauggccacgccagcugcggggacgcacuu

SEQ ID NO: 524929 - RNA, 64 nt, hsa
ccucuaccuccuguccucaggccgugcggcacgacauggccagcacgcagaaggagcccucccg

SEQ ID NO: 524930 - RNA, 64 nt, hsa
cuucuccaacaggguucuuggugaugcuggcagccauggccauggcagcggguggcauccaggc

SEQ ID NO: 524931 - RNA, 64 nt, hsa
ccuucuucaacgccaucuccacucuuguggucaucauggccagcacgccgcucuucacuguggu

SEQ ID NO: 524932 - RNA, 64 nt, hsa
agcccuggagugggcagagaguauuguggggaggcauggccagugggacuaguguucccuccau

SEQ ID NO: 524933 - RNA, 64 nt, hsa
uagagcgagcccagcagcccuaaaaggcugccuucauggccaucuagccccaguucagggcagc

SEQ ID NO: 524934 - RNA, 64 nt, hsa
ucucagugacugugaaaggacauugugucugagccauggccagccgcuggcuggcccccugauc

SEQ ID NO: 524935 - RNA, 64 nt, hsa
aaaugaagacaaaauacucagaaguugcauuugccauggccacuggcuccagcugggguuuggu

SEQ ID NO: 524936 - RNA, 64 nt, hsa; identical to SEQ ID NO: 61460

SEQ ID NO: 524937 - RNA, 64 nt, hsa; identical to SEQ ID NO: 61461

SEQ ID NO: 524938 - RNA, 64 nt, hsa; identical to SEQ ID NO: 61462

SEQ ID NO: 524939 - RNA, 64 nt, hsa; identical to SEQ ID NO: 61463

SEQ ID NO: 524940 - RNA, 64 nt, hsa; identical to SEQ ID NO: 61464

SEQ ID NO: 524941 - RNA, 64 nt, hsa; identical to SEQ ID NO: 61465

SEQ ID NO: 524942 - RNA, 64 nt, hsa; identical to SEQ ID NO: 61466

SEQ ID NO: 524943 - RNA, 64 nt, hsa; identical to SEQ ID NO: 61467

SEQ ID NO: 524944 - RNA, 64 nt, hsa; identical to SEQ ID NO: 61468

SEQ ID NO: 524945 - RNA, 64 nt, hsa; identical to SEQ ID NO: 61469

SEQ ID NO: 524946 - RNA, 64 nt, hsa; identical to SEQ ID NO: 61470

SEQ ID NO: 524947 - RNA, 64 nt, hsa; identical to SEQ ID NO: 61471

SEQ ID NO: 524948 - RNA, 64 nt, hsa; identical to SEQ ID NO: 61472

SEQ ID NO: 524949 - RNA, 64 nt, hsa; identical to SEQ ID NO: 61473

SEQ ID NO: 524950 - RNA, 64 nt, hsa; identical to SEQ ID NO: 61474

SEQ ID NO: 524951 - RNA, 64 nt, hsa; identical to SEQ ID NO: 61475

SEQ ID NO: 524952 - RNA, 64 nt, hsa; identical to SEQ ID NO: 61476

SEQ ID NO: 524953 - RNA, 64 nt, hsa; identical to SEQ ID NO: 61477

SEQ ID NO: 524954 - RNA, 64 nt, hsa; identical to SEQ ID NO: 61478

SEQ ID NO: 524955 - RNA, 64 nt, hsa; identical to SEQ ID NO: 61479

SEQ ID NO: 524956 - RNA, 64 nt, hsa; identical to SEQ ID NO: 61480

SEQ ID NO: 524957 - RNA, 64 nt, hsa; identical to SEQ ID NO: 61481

SEQ ID NO: 524958 - RNA, 64 nt, hsa; identical to SEQ ID NO: 61482

SEQ ID NO: 524959 - RNA, 64 nt, hsa; identical to SEQ ID NO: 61483

SEQ ID NO: 524960 - RNA, 64 nt, hsa; identical to SEQ ID NO: 61484

SEQ ID NO: 524961 - RNA, 64 nt, hsa; identical to SEQ ID NO: 61485

SEQ ID NO: 524962 - RNA, 64 nt, hsa; identical to SEQ ID NO: 61486

SEQ ID NO: 524963 - RNA, 64 nt, hsa; identical to SEQ ID NO: 61487

SEQ ID NO: 524964 - RNA, 64 nt, hsa; identical to SEQ ID NO: 61488

SEQ ID NO: 524965 - RNA, 64 nt, hsa; identical to SEQ ID NO: 61489

SEQ ID NO: 524966 - RNA, 64 nt, hsa; identical to SEQ ID NO: 61490

SEQ ID NO: 524967 - RNA, 64 nt, hsa; identical to SEQ ID NO: 61491

SEQ ID NO: 524968 - RNA, 64 nt, hsa; identical to SEQ ID NO: 61492

SEQ ID NO: 524969 - RNA, 64 nt, hsa; identical to SEQ ID NO: 61493

SEQ ID NO: 524970 - RNA, 64 nt, hsa; identical to SEQ ID NO: 61494

SEQ ID NO: 524971 - RNA, 64 nt, hsa
agcaguccgggucuggguuugucccacaaaaucacaggagcacuguauguuccucucuuuugga

SEQ ID NO: 524972 - RNA, 64 nt, hsa
uccaaagcggccacgcccacaauccgacagcccccaggagcagguccagggaugaugcagcccc

SEQ ID NO: 524973 - RNA, 64 nt, hsa
aggcagccugagcucuuggauguggucagcucuccaggagcaaguccuguguggcaaaacugcc

SEQ ID NO: 524974 - RNA, 64 nt, hsa
uguggagauggcgcccuguccugccaaggggcgccaggagcagagccagggccuggcgagcugg

SEQ ID NO: 524975 - RNA, 64 nt, hsa
ccuaccggaguuacaaaagucacaggacguccagcaggagcagauccaggagcagcucauauga

SEQ ID NO: 524976 - RNA, 64 nt, hsa
ugauuaauauuaggacguccagcaggagcagauccaggagcagcucauaugauccccacagucg

SEQ ID NO: 524977 - RNA, 64 nt, hsa
uccacccuggggccuugccccuaguacccccuggcaggagcaacccaccccauggucgagguuc

SEQ ID NO: 524978 - RNA, 64 nt, hsa
gacugugagccacuuccacuucucgccccccaggcaggagcacccucacuccaagggcuuggcc

SEQ ID NO: 524979 - RNA, 64 nt, hsa
gaccugagggccacuguccucagaugacaccacccaggagcacccuaggugaggggugagggcc

SEQ ID NO: 524980 - RNA, 64 nt, hsa
cuccacaagacaccugugacauccuccagggccacaggagcacgugcugaccaguuuucccuuc

SEQ ID NO: 524981 - RNA, 64 nt, hsa
aguguuccuggcaugaccaggauuccugugaaagcaggagcagcagcaagccgucccgggccug

SEQ ID NO: 524982 - RNA, 64 nt, hsa
ucacauccccagcugaugcucaauaaaacucagccaggagcauauggagaugcugacagccagg

SEQ ID NO: 524983 - RNA, 64 nt, hsa
uccaugacacgaggccaguccccaggagcagccccaggagcacaaccugagauuucuaagcuug

SEQ ID NO: 524984 - RNA, 64 nt, hsa
cacaugcuuuucuccaugacacgaggccaguccccaggagcagccccaggagcacaaccugaga

SEQ ID NO: 524985 - RNA, 64 nt, hsa
uugugcccagcccugugcuaggcgcugacauuaacaggagcaaccagggcccaauuccuggccu

SEQ ID NO: 524986 - RNA, 64 nt, hsa
gccuuucccucuccugcugagaaccagaacccaccaggagcaccacagaguccuccucuuggaa

SEQ ID NO: 524987 - RNA, 64 nt, hsa
gaauuuugcaaauggccccuugccccauuuuaagcaggagcagguggcugguuugaagccccag

SEQ ID NO: 524988 - RNA, 64 nt, hsa
ccggcucccagugucugcccagcccucucccagacaggagcaggcugccaccccuucuaccuca

SEQ ID NO: 524989 - RNA, 64 nt, hsa
cuccuucccucccuccucacgucaggcuguggagcaggagcacagcaguucuggcuguugucca

SEQ ID NO: 524990 - RNA, 64 nt, hsa
caaguagagauuacacccagaacaccauuccuuccaggagcaguaggugggagguuugacccag

SEQ ID NO: 524991 - RNA, 64 nt, hsa
cagugccgugguggccaaccggacccaggccuuccaggagcaggagcaggggcaggggcagggg

SEQ ID NO: 524992 - RNA, 64 nt, hsa
cgugguggccaaccggacccaggccuuccaggagcaggagcaggggcaggggcaggggcaggga

SEQ ID NO: 524993 - RNA, 64 nt, hsa
aaaaagggaaagaaaauguuauuucucccuaagucaggagcaugcagagcuagcccaccucaug

SEQ ID NO: 524994 - RNA, 64 nt, hsa
caccuccccagagcuccccgcacugacggggcugcaggagcaggugcagugggcgcccacacug

SEQ ID NO: 524995 - RNA, 64 nt, hsa
ggaagaagugguggagccucagggccagggcaggcaggagcaggcacugaugcuagagggugau

SEQ ID NO: 524996 - RNA, 64 nt, hsa
ccugggacccugccagucucaguucaucucuuaccaggagcaaggcccucugaagcaugggccg

SEQ ID NO: 524997 - RNA, 64 nt, hsa
uggagagugagaacgacaaaggaaugaagagcuacaggagcauuuaggccauuucuaugccaag

SEQ ID NO: 524998 - RNA, 64 nt, hsa
uugaucuucuacauacaagacuucaccauaaggccaggagcaguggcucacaccuuguaauccc

SEQ ID NO: 524999 - RNA, 64 nt, hsa
ccgaaaaaggagacaguuccugugaucuccuuugcaggagcauagaauaguuuggguaccagga

SEQ ID NO: 525000 - RNA, 64 nt, hsa
cagaaggcgucugggccuaaggauccauggaagucaggagcauuaaaucccaaaccaaaucaac

SEQ ID NO: 525001 - RNA, 64 nt, hsa
agagaagacuuucagagcucacaggagcagggagcaggagcacucuaagggaauuccaagauca

SEQ ID NO: 525002 - RNA, 64 nt, hsa
agagaacacacagagagaagacuuucagagcucacaggagcagggagcaggagcacucuaaggg

SEQ ID NO: 525003 - RNA, 64 nt, hsa
aggagguucaaguauggaggguaggagugcaacccaggagcaacgcucaagguggccgagaugc

SEQ ID NO: 525004 - RNA, 64 nt, hsa
gaaggccccugauggagcuauuucuuccuaguaucaggagcaauugagaccccucaggaguuuc

SEQ ID NO: 525005 - RNA, 64 nt, hsa
cugaggagaagaucgagcgaacccagcgggacaucaggagcauccaggaggcucucgcccgcaa

SEQ ID NO: 525006 - RNA, 64 nt, hsa
ggggcagcuccgggcucaggaagccggccugcagcaggagcagaggaaggcagacacccacaag

SEQ ID NO: 525007 - RNA, 64 nt, hsa
ucuccucccugacagcuacaccuuccagcaggugcaggagcacacggaccagauuuggaaguuc

SEQ ID NO: 525008 - RNA, 64 nt, hsa
gaugcuaccucggaagcugaagcggauccuccggcaggagcacuggccgucuuuugaaaacuug

SEQ ID NO: 525009 - RNA, 64 nt, hsa
gggugccaaggggcaggggcagugggggcucgggcaggagcaccccccagacuccccgugcccg

SEQ ID NO: 525010 - RNA, 64 nt, hsa
caucuuccgcacaccccugcagcucgacccgcagcaggagcagcagcuguuccggcgccuggaa

SEQ ID NO: 525011 - RNA, 64 nt, hsa
ugugucuuuugaaauacgaagaaaaauguguguucaggagcaugacuccagugcugcgcucuug

SEQ ID NO: 525012 - RNA, 64 nt, hsa
gcuggccaacugaccaucuaccugcccguggggccaggagcacccaagaccacagaaaagagaa

SEQ ID NO: 525013 - RNA, 64 nt, hsa
acagccauuaaccauacagugugaucaacacugacaggagcacaggaaaaacaucuagcuuaug

SEQ ID NO: 525014 - RNA, 64 nt, hsa
cuguuuuuagguuuugcuauuacaaaauacuacacaggagcaucacuaugccugugugaaagua

SEQ ID NO: 525015 - RNA, 64 nt, hsa
cggccaagcuccugcccagauguugacccucacccagcgugagcugucacauaguaggagcuuc

SEQ ID NO: 525016 - RNA, 64 nt, hsa
aaaaaguucagcaaagucauacacucccuguggccagcgugaacagagccaugccccacccucc

SEQ ID NO: 525017 - RNA, 64 nt, hsa
ucugaacacagaaggugugaacugaccucuaaagcagcgugagaugggaaugaucuagaaaacu

SEQ ID NO: 525018 - RNA, 64 nt, hsa
uggcuucauucuggacuagacaggaacuuggccucagcgugagauccugccaugcaguguugcg

SEQ ID NO: 525019 - RNA, 64 nt, hsa
caucuuccaccucagcaaccaugaccugaaaccucagcgugaauuugggggauuuuucagugga

SEQ ID NO: 525020 - RNA, 64 nt, hsa
ccacccaccucgacuucccaaagugcugggauuacagcgugagcuaccuggccccuccccaaau

SEQ ID NO: 525021 - RNA, 64 nt, hsa
gcaugauaugucucuguaaagugaucagcaguugcagcgugaaaauaaauacuuuaacucaggg

SEQ ID NO: 525022 - RNA, 64 nt, hsa
gagcauagggucauggagcagcagccucgucuuacagcgugacugcaaagaaaaagacuuuugu

SEQ ID NO: 525023 - RNA, 64 nt, hsa
agcugagccccagcugugaucauccagcaugaugcagcgugaggacagcugagcagggaccggg

SEQ ID NO: 525024 - RNA, 64 nt, hsa
auaucuuucaggcauuaagggaucauugcaagagcagcgugacugacauuaugaaggccuguac

SEQ ID NO: 525025 - RNA, 64 nt, hsa
gaccacgacuccaucucuucucauuccagauuuccagcgugaagcaggcccaagcuagggaagg

SEQ ID NO: 525026 - RNA, 64 nt, hsa
gaacagaagggaaaucugcuaccuagucuauacacagcgugaaccucacagggggcuucugaua

SEQ ID NO: 525027 - RNA, 64 nt, hsa
gagaggcugaggauggcagggcuggaagggccaucagcgugacccucauuuucaagaaggggaa

SEQ ID NO: 525028 - RNA, 64 nt, hsa
cacaugcuagucugauugccucuguguccugccucagcgugacuccccacucaccuggcucucu

SEQ ID NO: 525029 - RNA, 64 nt, hsa
aaucauguuaccauuacaaaugggauauaagaggcagcgugaaagcagaugagcuguggacuag

SEQ ID NO: 525030 - RNA, 64 nt, hsa
ggcauuggggagcccagcccggcagggaagaggccagcgugaaggaccugggcucuuggccgug

SEQ ID NO: 525031 - RNA, 64 nt, hsa
uccguaaaaguggaagagaggcagaucaggaugucagcgugaugaggugugagacagacuugac

SEQ ID NO: 525032 - RNA, 64 nt, hsa
uacugagagguauugucgagcauuugacauaagacagcgugauguucuuuggugguucaagucu

SEQ ID NO: 525033 - RNA, 64 nt, hsa
ugucgaggccauuucucuuugccacugagaaaugcagcgugacugacucuguugcuaccuguca

SEQ ID NO: 525034 - RNA, 64 nt, hsa
gcaggcagaucaccugaggucgggaguucgagaccagcgugaccaacguggagaaacccccguc

SEQ ID NO: 525035 - RNA, 64 nt, hsa
gugagcuacuugagagcaggguuuaugccuucaucagcgugaccccugugccugcagccucaua

SEQ ID NO: 525036 - RNA, 64 nt, hsa
cagauccagaagaaaggccuggcguguggccaaacagcgugaaaccuuggcacaggacugagga

SEQ ID NO: 525037 - RNA, 64 nt, hsa
gaaggggcauuauuugugcacugagaacaccgcgcagcgugacugugaguugcucauaccgugc

SEQ ID NO: 525038 - RNA, 64 nt, hsa
gcccucauccugagaaggccagaauacuggagaccagcgugaacccucacccagagucagggga

SEQ ID NO: 525039 - RNA, 64 nt, hsa
ucagcucacucccugcucccaccuggaaccuugccagcgugaaggaggcuuccagguacuucac

SEQ ID NO: 525040 - RNA, 64 nt, hsa
uuuggaugggccugccuuaacauuguuugaaaugcagcgugaguagcucuuuuguuuacuguuu

SEQ ID NO: 525041 - RNA, 64 nt, hsa
uagacuguuuaugauaagcuuuuuuuuuuauuagcagcgugauuuguauaucgauggcuuaaca

SEQ ID NO: 525042 - RNA, 64 nt, hsa
acuccacgcagcuggcagagagcacagugaucaccagcgugagugguggaggaggacacuugga

SEQ ID NO: 525043 - RNA, 64 nt, hsa
ucauuauuuuuguacauuuuuguauauacugggacagcgugaaacacuggaauccuucauggac

SEQ ID NO: 525044 - RNA, 64 nt, hsa
agccacuugacuggcacacaccccuccggacauccagcgugacggagcccacacugccaccuug

SEQ ID NO: 525045 - RNA, 64 nt, hsa
gaagaucuggaaugagaacugacuugugaaaccucagcgugaagggacauaucacugaccuuca

SEQ ID NO: 525046 - RNA, 64 nt, hsa
agugcuacaaaaagaauuaguaauguggugugggcagcgugacauuuuaugucccacccaaaaa

SEQ ID NO: 525047 - RNA, 64 nt, hsa
augacaggcucaucagccugugccugacccuucucagcgugaccccagacauccugcaaccugg

SEQ ID NO: 525048 - RNA, 64 nt, hsa
aaacccccuacccccaccccagagggaccacagucagcgugaagcaguuauuuucuacgcuacc

SEQ ID NO: 525049 - RNA, 64 nt, hsa
cugagauaaucccacugcauuccagccugggcaacagcgugagacuucaucucaaaaaaaaaaa

SEQ ID NO: 525050 - RNA, 64 nt, hsa
uucgcgucuggucuuagagcauguguauucaucucagcgugaauaccucagccagucuuaugaa

SEQ ID NO: 525051 - RNA, 64 nt, hsa
ggcauguuucuguuuuggugucucacuuuccucccagcgugacuuauuuggggauuccucaggg

SEQ ID NO: 525052 - RNA, 64 nt, hsa
ccaaaaacagcaggccaucuuuuuaugcaaaagucagcgugacaauauacuucacugguguaca

SEQ ID NO: 525053 - RNA, 64 nt, hsa
gguaugggccagcaguuuccugccagauauugcccagcgugaggagcgaucucagcaggccuau

SEQ ID NO: 525054 - RNA, 64 nt, hsa
uuugcuccagguggcaguacaagcuggcggccugcagcgugagcugugggagaggggucgugcg

SEQ ID NO: 525055 - RNA, 64 nt, hsa
acccgcugccuuugcgucaccacagccuuggucacagcgugaccuuggugccuccgacggguca

SEQ ID NO: 525056 - RNA, 64 nt, hsa
aucaacacagguuuuuaggugguucccugcugcacagcgugaccucguggucgcgcagaugccg

SEQ ID NO: 525057 - RNA, 64 nt, hsa
agccccugugcgugauccuccuucccgcagccaccagcgugagcucucugaaucccgggacccc

SEQ ID NO: 525058 - RNA, 64 nt, hsa
gacacccccagagccagugccccaucuuaagcaucagcgugacgugaccucucuguuucugcuu

SEQ ID NO: 525059 - RNA, 64 nt, hsa
ugcccgggugagggcucugccuguuccucugaagcagcgugauugcuguagauagaacaacgcu

SEQ ID NO: 525060 - RNA, 64 nt, hsa
agcugucagccuucaagaugucaagucuucgagucagcgugacucauucauucuuccaacaguu

SEQ ID NO: 525061 - RNA, 64 nt, hsa
cuacccgccuuagucucccaaagugcuaggauuacagcgugaucuaccacaccuggccaauccc

SEQ ID NO: 525062 - RNA, 64 nt, hsa
uuuccuuuuuugaguccuguguggcucuuugaaucagcgugaaacugaggcuccagcucccugu

SEQ ID NO: 525063 - RNA, 64 nt, hsa
acccuggcugugccgagugcaccuagagggcacgcagcgugagggugugucuucccuggauagc

SEQ ID NO: 525064 - RNA, 64 nt, hsa
gcacagaaaucccagaccuguuguucucuccauccagcgugaccagggcccgagagaccugaug

SEQ ID NO: 525065 - RNA, 64 nt, hsa
aaugaugccagagaaggcuugggaaauuguacuucagcgugauagccugugucuucuuaauuug

SEQ ID NO: 525066 - RNA, 64 nt, hsa
aacugcucacuuccuuaaauugucuuuuuucccccagcgugaaauguauccauuuauaacugcc

SEQ ID NO: 525067 - RNA, 64 nt, hsa
guguuaauacucaugauaauuauuagggaccuggcagcgugauuggaguauggauguuuccgua

SEQ ID NO: 525068 - RNA, 64 nt, hsa
agaggcacucugcccucuucccuauaaaaucacacagcgugauuuuacaaggucccguggcacc

SEQ ID NO: 525069 - RNA, 64 nt, hsa
guggaaaugaguggagggggauugucuuucaacgcagcgugagucuaaugguugaauaaaacuu

SEQ ID NO: 525070 - RNA, 64 nt, hsa
acuugcugaucugugggcgcucccacccgugugccagcgugacggcucgggguguccgcucccc

SEQ ID NO: 525071 - RNA, 64 nt, hsa
cugaccuaaccuuccugucuccucuucgggaagccagcgugagcucagcuuggaccaagacaaa

SEQ ID NO: 525072 - RNA, 64 nt, hsa
aguaggggacuuucccacacugugccuuuacgaucagcgugacagaguagaagcuggagugccu

SEQ ID NO: 525073 - RNA, 64 nt, hsa
cuucuccacuggaguuaggagggccugugguagacagcgugaaucaugaaaauaagccuggaga

SEQ ID NO: 525074 - RNA, 64 nt, hsa
gugcaggaagcggaggcgcaggaccucaccgcgccagcgugaaguucccgggcauggucaugaa

SEQ ID NO: 525075 - RNA, 64 nt, hsa
cuagcaucuuccccucaccuuccacccaugagaacagcgugagcugguggaucaugacaaggag

SEQ ID NO: 525076 - RNA, 64 nt, hsa
uuccuuucauuuuauuaugcauuagacguugagacagcgugauacuuacaacucacuaguauag

SEQ ID NO: 525077 - RNA, 64 nt, hsa
ugccagccagaauugguggcgggacuuggggauacagcgugaagguggggaaguugcacagcag

SEQ ID NO: 525078 - RNA, 64 nt, hsa
ggugaaaaauuaguaaauagcuucacaaaagaggcagcgugauaccuuuaguguuuucuagaau

SEQ ID NO: 525079 - RNA, 64 nt, hsa
ggauguguugugccuugugucugucauguguggccagcgugauuguauagaauccagaguaugu

SEQ ID NO: 525080 - RNA, 64 nt, hsa
cauuuugcgcgcacaauaguaaccuggguaaaugcagcgugaagggauuuuagucacacguggu

SEQ ID NO: 525081 - RNA, 64 nt, hsa
auaaagugaagaggccuacucaccauuaucccugcagcgugacaccuuuugauugucacugacc

SEQ ID NO: 525082 - RNA, 64 nt, hsa
agggaaagauuuauggccucugucgagggaccugcagcgugagagccaguggcaucugcgcggc

SEQ ID NO: 525083 - RNA, 64 nt, hsa
ucugagguggacaaagagcucucgcaagaagagacagcgugaugccucccacaguccaccccag

SEQ ID NO: 525084 - RNA, 64 nt, hsa
cucagaagaaccuggaguaauugugccugaagcucagcgugaagucugaaauaugcaacagaag

SEQ ID NO: 525085 - RNA, 64 nt, hsa
auaacaguuccaggauaacacugauuccugacaacagcgugagauuucaacagaacuuguuugg

SEQ ID NO: 525086 - RNA, 64 nt, hsa
uccugaugcucgggccccaacuccugacugggugcagcgugaggcuucagccuggagcccuggu

SEQ ID NO: 525087 - RNA, 64 nt, hsa
cucagagacaccccuaaaggcucccauuaggucacagcgugacugaaagcugauuucucuguga

SEQ ID NO: 525088 - RNA, 64 nt, hsa
uucacugaaugcugcaccacaugcuacaccaguucagcgugagaauuuucuaauaaaucuuuuc

SEQ ID NO: 525089 - RNA, 64 nt, hsa
ugagaagggccagaggguccaggcaucccaaguccagcgugaagggccacagccccucuuggcu

SEQ ID NO: 525090 - RNA, 64 nt, hsa
ucccuuaagugacuccagguuuuccaccauccuucagcgugaauuaauuuuuaaucaguuugcu

SEQ ID NO: 525091 - RNA, 64 nt, hsa
cgauguucuugauuuucccagagaagcaaauaaacagcgugaacagccccaguuccuggaguuc

SEQ ID NO: 525092 - RNA, 64 nt, hsa
cccccgccuaggccucccaaagugcuggguuuaccagcgugagccaccacgcugggcuuccugc

SEQ ID NO: 525093 - RNA, 64 nt, hsa
aggcguaguuuugaaacucacaucacccacugugcagcgugaggacgggacucuggucugcugu

SEQ ID NO: 525094 - RNA, 64 nt, hsa
gaaacacagccuucugcugcagcagaggcucacccagcgugaacugcccccagggaacacuggg

SEQ ID NO: 525095 - RNA, 64 nt, hsa
cucuuuccaccaacccuccugcauccuugccuugcagcgugaccgagauaggucaucagcccag

SEQ ID NO: 525096 - RNA, 64 nt, hsa
aucucccuccaggaagcugcugccaccaccuaaccagcgugaaagccugagucccaccagaagg

SEQ ID NO: 525097 - RNA, 64 nt, hsa
cuccuucccuucaugauaagccagugccagcauccagcgugagcagacgucggggagacuggga

SEQ ID NO: 525098 - RNA, 64 nt, hsa
cauuugugugggcaaucccaacaugaaauguagacagcgugaauacggacaggaggugaugcca

SEQ ID NO: 525099 - RNA, 64 nt, hsa
ggccugugcauucuagaccagccaauuggugggacagcgugaugaccggcaggguucaacagac

SEQ ID NO: 525100 - RNA, 64 nt, hsa
uaaaagcaccagagaaaaucaaaugcuuccuacucagcgugacccaacuuuucuagugugccac

SEQ ID NO: 525101 - RNA, 64 nt, hsa
uuuugccaguugacaagauuuuuccacccucgagcagcgugagagaugccucuuuaacacuuga

SEQ ID NO: 525102 - RNA, 64 nt, hsa
gccgagaucacgccacugcacuccagccuggugacagcgugagacucuuuaaaaaaagaaauua

SEQ ID NO: 525103 - RNA, 64 nt, hsa
acuucacagucaugaaaacugagaagacugucuucagcgugaacuaaaguucacaggcagauca

SEQ ID NO: 525104 - RNA, 64 nt, hsa
accguggccuguccacgguccagguccaucucagcagcgugagggugcacucaggguguuguua

SEQ ID NO: 525105 - RNA, 64 nt, hsa
caguggauugugggaggcucuugcuuacacuaaucagcgugaccuggaccugcugggcaggauc

SEQ ID NO: 525106 - RNA, 64 nt, hsa
uucuguguugccuuuggaagcaucuuucugugcucagcgugagucugaagcaggcgccagggcc

SEQ ID NO: 525107 - RNA, 64 nt, hsa
uggcgcucgaaguugaucuccccagcgagggccccagcgugaagccagggcccgggaagcaaau

SEQ ID NO: 525108 - RNA, 64 nt, hsa
ggauuuuggcaugcguggccugucgccaccuggacagcgugaccucagggguuguccacuuuac

SEQ ID NO: 525109 - RNA, 63 nt, hsa
uuuuagggagagaacaauaccuaagauugucugagcuuccaucuuucucauauuuccuaagca

SEQ ID NO: 525110 - RNA, 63 nt, hsa
gagugaguuaguacauauuaauccugguuguugagcuuccagacuaccccguccaaaguuuga

SEQ ID NO: 525111 - RNA, 63 nt, hsa
aagaccuguggcuacugguagagaauuggaauaagcuuccaacaauggacuguagagauuaau

SEQ ID NO: 525112 - RNA, 63 nt, hsa
ugguguaaagccaacucgaggggaaucugaauaagcuuccaaaauuuuuuuuuuuaagaaaua

SEQ ID NO: 525113 - RNA, 63 nt, hsa
acacccagaagaggccuuucccaucuggagagaagcuuccagaccagcccuucacacaccaca

SEQ ID NO: 525114 - RNA, 63 nt, hsa
acagccaggagaggccuuuaccaccuggagagaagcuuccagaccagccccucacaccacagc

SEQ ID NO: 525115 - RNA, 63 nt, hsa
acagccaggagaggccguuccugccuggagagaagcuuccagaccagcccuucacaccacagc

SEQ ID NO: 525116 - RNA, 63 nt, hsa
cuguaguugguuuccuuccugugucccuuugcaagcuuccaggcgaucuaaggugucauuucu

SEQ ID NO: 525117 - RNA, 63 nt, hsa
uuacacuagcuuguguuuugugcuacguauaccagcuuccaaaauuagcaucucauugagcca

SEQ ID NO: 525118 - RNA, 63 nt, hsa
auuuuuuuuuucuuaaauaugaucaaggaaaauagcuuccagaauguggugguucugggcaac

SEQ ID NO: 525119 - RNA, 63 nt, hsa
ucccuguuucccuuguaucaagacaccuuccucagcuuccaugccuuuggaucuuccauguuc

SEQ ID NO: 525120 - RNA, 63 nt, hsa
cuccagggaauggccuccaugaggggcagggccagcuuccaucccuucuccagcccuuggggc

SEQ ID NO: 525121 - RNA, 63 nt, hsa
uucuguucagauuggcagugugcacuauuaaaaagcuuccaucucccggcugggcacgguggc

SEQ ID NO: 525122 - RNA, 63 nt, hsa
aacucugucucaaaaauaauaauaauaaaaaaaagcuuccaucucccagcccuucuugcaagc

SEQ ID NO: 525123 - RNA, 63 nt, hsa
aaaaucuuagcgguggaccugggagauuugagaagcuuccagaaacaguuuaaacaagccagc

SEQ ID NO: 525124 - RNA, 63 nt, hsa
ugccgcggccggaggaguuuuguuguugguuuuagcuuccaguggcuucuuucugcggggcau

SEQ ID NO: 525125 - RNA, 63 nt, hsa
cccgaggcgugcuuccuuccugauugucucuagagcuuccaaguccugggaaugugcggggcc

SEQ ID NO: 525126 - RNA, 63 nt, hsa
ucuggucaggaacccucagggacccaggaacucagcuuccaaacaucugcaccuugaccggac

SEQ ID NO: 525127 - RNA, 63 nt, hsa
uuggccccaggaccugaucugaguucugcuggcagcuuccagaggauugccuuuuuugaggac

SEQ ID NO: 525128 - RNA, 63 nt, hsa
aucucaggcgaugcuugugaugaagcauuuuuuagcuuccaccacuuaccaggaacugccugu

SEQ ID NO: 525129 - RNA, 63 nt, hsa
uggccgugcccgaugugcaccucccagaagugcagcuuccaaaagucccagagaugaagcucc

SEQ ID NO: 525130 - RNA, 63 nt, hsa
cgaaagugccagagaugaaagucccugagaugaagcuuccaaaggugccugagaugaaacuuc

SEQ ID NO: 525131 - RNA, 63 nt, hsa
cugaagugaagcuccccaaggcuccugaggucaagcuuccaaaagugcccgaggcagcccuuc

SEQ ID NO: 525132 - RNA, 63 nt, hsa
auguuuaugauauggugucuuuuucuugaaacaagcuuccaagggcuagaaauaaaauagcca

SEQ ID NO: 525133 - RNA, 63 nt, hsa
ugcuguuccaucccagcuugaauuggugccacaagcuuccaaguuggcauuuuuucuagaacc

SEQ ID NO: 525134 - RNA, 63 nt, hsa
auccucucccugcaguuuguccugggcacagacagcuuccaccugggcuacacggagaccggg

SEQ ID NO: 525135 - RNA, 63 nt, hsa
cgccuucuauccagccggcacccuaugcucuacagcuuccagacaucucugcccaagcuuccu

SEQ ID NO: 525136 - RNA, 63 nt, hsa
agaaugcaccagucaucagcuauucaguugguaagcuuccaggaaaaaggacaggcagaaaga

SEQ ID NO: 525137 - RNA, 63 nt, hsa
uugauacuuguuuucaaaccaguauacaagauaagcuuccaggcugcauagaaggaggagagg

SEQ ID NO: 525138 - RNA, 64 nt, hsa; identical to SEQ ID NO: 383727

SEQ ID NO: 525139 - RNA, 64 nt, hsa; identical to SEQ ID NO: 383728

SEQ ID NO: 525140 - RNA, 64 nt, hsa
aacccuaugcauggagggucaaugugggcacaugucuacacaugugggugcccauggauaguac

SEQ ID NO: 525141 - RNA, 64 nt, hsa
acaccacuggcugccagucagggccugccaggagucuacacagcucugaaccuucuuuguuaaa

SEQ ID NO: 525142 - RNA, 64 nt, hsa
aaauuauucucaucucaaugccaaaaagauaguuucuacacaucaccugcuugcugaugucuau

SEQ ID NO: 525143 - RNA, 64 nt, hsa
uuuaaacaaacacucaacguacauauguacauaaucuacacauauuuauaucacauaucuaguu

SEQ ID NO: 525144 - RNA, 64 nt, hsa
aaguuaucaagccugcauuuugcagcuauggucuucuacacacuguaaggguaguagaaggaaa

SEQ ID NO: 525145 - RNA, 64 nt, hsa
uuuuucuuggacgaauucagguagcuacacagaaucuacacagcaaaguuaaccugacacagaa

SEQ ID NO: 525146 - RNA, 64 nt, hsa
uuguuuagaacacgaauuuccauuuaccuggugggaacacgaaacaggagucucuucuguucug

SEQ ID NO: 525147 - RNA, 64 nt, hsa
uggcuccuccuugcagacaguuaucccuuguuuagaacacgaauuuccauuuaccuggugggaa

SEQ ID NO: 525148 - RNA, 64 nt, hsa; identical to SEQ ID NO: 430264

SEQ ID NO: 525149 - RNA, 64 nt, hsa; identical to SEQ ID NO: 430265

SEQ ID NO: 525150 - RNA, 55 nt, hsa; identical to SEQ ID NO: 430266

SEQ ID NO: 525151 - RNA, 64 nt, hsa; identical to SEQ ID NO: 430267

SEQ ID NO: 525152 - RNA, 64 nt, hsa; identical to SEQ ID NO: 430268

SEQ ID NO: 525153 - RNA, 64 nt, hsa; identical to SEQ ID NO: 430269

SEQ ID NO: 525154 - RNA, 64 nt, hsa; identical to SEQ ID NO: 430270

SEQ ID NO: 525155 - RNA, 64 nt, hsa; identical to SEQ ID NO: 430271

SEQ ID NO: 525156 - RNA, 64 nt, hsa; identical to SEQ ID NO: 430272

SEQ ID NO: 525157 - RNA, 64 nt, hsa; identical to SEQ ID NO: 430273

SEQ ID NO: 525158 - RNA, 64 nt, hsa; identical to SEQ ID NO: 430274

SEQ ID NO: 525159 - RNA, 64 nt, hsa; identical to SEQ ID NO: 430275

SEQ ID NO: 525160 - RNA, 64 nt, hsa; identical to SEQ ID NO: 430276

SEQ ID NO: 525161 - RNA, 64 nt, hsa; identical to SEQ ID NO: 430277

SEQ ID NO: 525162 - RNA, 64 nt, hsa; identical to SEQ ID NO: 430278

SEQ ID NO: 525163 - RNA, 64 nt, hsa; identical to SEQ ID NO: 430279

SEQ ID NO: 525164 - RNA, 64 nt, hsa; identical to SEQ ID NO: 430280

SEQ ID NO: 525165 - RNA, 64 nt, hsa; identical to SEQ ID NO: 430281

SEQ ID NO: 525166 - RNA, 64 nt, hsa; identical to SEQ ID NO: 430282

SEQ ID NO: 525167 - RNA, 64 nt, hsa; identical to SEQ ID NO: 430283

SEQ ID NO: 525168 - RNA, 64 nt, hsa; identical to SEQ ID NO: 430284

SEQ ID NO: 525169 - RNA, 64 nt, hsa; identical to SEQ ID NO: 430285

SEQ ID NO: 525170 - RNA, 64 nt, hsa; identical to SEQ ID NO: 430286

SEQ ID NO: 525171 - RNA, 64 nt, hsa; identical to SEQ ID NO: 430287

SEQ ID NO: 525172 - RNA, 64 nt, hsa; identical to SEQ ID NO: 430288

SEQ ID NO: 525173 - RNA, 64 nt, hsa; identical to SEQ ID NO: 430289

SEQ ID NO: 525174 - RNA, 64 nt, hsa; identical to SEQ ID NO: 430290

SEQ ID NO: 525175 - RNA, 64 nt, hsa; identical to SEQ ID NO: 430291

SEQ ID NO: 525176 - RNA, 64 nt, hsa; identical to SEQ ID NO: 430292

SEQ ID NO: 525177 - RNA, 64 nt, hsa; identical to SEQ ID NO: 430293

SEQ ID NO: 525178 - RNA, 64 nt, hsa; identical to SEQ ID NO: 430294

SEQ ID NO: 525179 - RNA, 64 nt, hsa; identical to SEQ ID NO: 430295

SEQ ID NO: 525180 - RNA, 64 nt, hsa; identical to SEQ ID NO: 430296

SEQ ID NO: 525181 - RNA, 64 nt, hsa; identical to SEQ ID NO: 430297

SEQ ID NO: 525182 - RNA, 64 nt, hsa; identical to SEQ ID NO: 430298

SEQ ID NO: 525183 - RNA, 64 nt, hsa; identical to SEQ ID NO: 430299

SEQ ID NO: 525184 - RNA, 64 nt, hsa; identical to SEQ ID NO: 430300

SEQ ID NO: 525185 - RNA, 64 nt, hsa; identical to SEQ ID NO: 430301

SEQ ID NO: 525186 - RNA, 64 nt, hsa; identical to SEQ ID NO: 430302

SEQ ID NO: 525187 - RNA, 64 nt, hsa; identical to SEQ ID NO: 430303

SEQ ID NO: 525188 - RNA, 64 nt, hsa; identical to SEQ ID NO: 430304

SEQ ID NO: 525189 - RNA, 64 nt, hsa; identical to SEQ ID NO: 430305

SEQ ID NO: 525190 - RNA, 64 nt, hsa; identical to SEQ ID NO: 430306

SEQ ID NO: 525191 - RNA, 64 nt, hsa; identical to SEQ ID NO: 430307

SEQ ID NO: 525192 - RNA, 64 nt, hsa; identical to SEQ ID NO: 430308

SEQ ID NO: 525193 - RNA, 64 nt, hsa; identical to SEQ ID NO: 430309

SEQ ID NO: 525194 - RNA, 64 nt, hsa; identical to SEQ ID NO: 430310

SEQ ID NO: 525195 - RNA, 64 nt, hsa; identical to SEQ ID NO: 430311

SEQ ID NO: 525196 - RNA, 64 nt, hsa; identical to SEQ ID NO: 430312

SEQ ID NO: 525197 - RNA, 64 nt, hsa; identical to SEQ ID NO: 430313

SEQ ID NO: 525198 - RNA, 64 nt, hsa; identical to SEQ ID NO: 430314

SEQ ID NO: 525199 - RNA, 64 nt, hsa; identical to SEQ ID NO: 430315

SEQ ID NO: 525200 - RNA, 64 nt, hsa; identical to SEQ ID NO: 430316

SEQ ID NO: 525201 - RNA, 64 nt, hsa; identical to SEQ ID NO: 430317

SEQ ID NO: 525202 - RNA, 64 nt, hsa; identical to SEQ ID NO: 430318

SEQ ID NO: 525203 - RNA, 64 nt, hsa; identical to SEQ ID NO: 430319

SEQ ID NO: 525204 - RNA, 64 nt, hsa; identical to SEQ ID NO: 430320

SEQ ID NO: 525205 - RNA, 64 nt, hsa; identical to SEQ ID NO: 430321

SEQ ID NO: 525206 - RNA, 64 nt, hsa; identical to SEQ ID NO: 430322

SEQ ID NO: 525207 - RNA, 64 nt, hsa; identical to SEQ ID NO: 430323

SEQ ID NO: 525208 - RNA, 64 nt, hsa; identical to SEQ ID NO: 522591

SEQ ID NO: 525209 - RNA, 64 nt, hsa; identical to SEQ ID NO: 522592

SEQ ID NO: 525210 - RNA, 64 nt, hsa; identical to SEQ ID NO: 522593

SEQ ID NO: 525211 - RNA, 64 nt, hsa; identical to SEQ ID NO: 522594

SEQ ID NO: 525212 - RNA, 64 nt, hsa; identical to SEQ ID NO: 522595

SEQ ID NO: 525213 - RNA, 64 nt, hsa; identical to SEQ ID NO: 522596

SEQ ID NO: 525214 - RNA, 64 nt, hsa; identical to SEQ ID NO: 522597

SEQ ID NO: 525215 - RNA, 64 nt, hsa; identical to SEQ ID NO: 522598

SEQ ID NO: 525216 - RNA, 64 nt, hsa; identical to SEQ ID NO: 522599

SEQ ID NO: 525217 - RNA, 64 nt, hsa; identical to SEQ ID NO: 522600

SEQ ID NO: 525218 - RNA, 64 nt, hsa; identical to SEQ ID NO: 522601

SEQ ID NO: 525219 - RNA, 64 nt, hsa; identical to SEQ ID NO: 522602

SEQ ID NO: 525220 - RNA, 64 nt, hsa; identical to SEQ ID NO: 522603

SEQ ID NO: 525221 - RNA, 64 nt, hsa; identical to SEQ ID NO: 522604

SEQ ID NO: 525222 - RNA, 64 nt, hsa
cuuuguugucccacuuugggaccggguccagucuggggucuagucucgagcaucagggucaggc

SEQ ID NO: 525223 - RNA, 64 nt, hsa
ucugaaaucauccauuuggggacaaauccacauuggggucuagaaacauccacguaucucauca

SEQ ID NO: 525224 - RNA, 64 nt, hsa
aucaugauaucaggacugguuacuugguuaaggaggggucuaggagaucugucccuuuuagaga

SEQ ID NO: 525225 - RNA, 64 nt, hsa
ggagacuagguuauucucugccauagagcuaacuggggucuauaugcugggugcugagacacug

SEQ ID NO: 525226 - RNA, 64 nt, hsa
ucaggggcuuuggaagcucuguugcagguguccgggggucuaggacuuuagggaucuggggaag

SEQ ID NO: 525227 - RNA, 64 nt, hsa
auuaugauaucaggacugguuacuugguuaaggaggggucuaggagaucugucccuuuuagaga

SEQ ID NO: 525228 - RNA, 64 nt, hsa
gcaaggaaguauuugggcacccuacccuuuaccuggggucuaaccaaaaauggaugggaugagg

SEQ ID NO: 525229 - RNA, 64 nt, hsa
ccccgauccuggccgaggugaggaacagacagggggggucuagauucugaggggguugguggau

SEQ ID NO: 525230 - RNA, 64 nt, hsa
uguugguuuauugcuggcaacgugaauucucucaggggucuaggaggggcauuuuggagacugc

SEQ ID NO: 525231 - RNA, 64 nt, hsa
gcugugcagggugagggccaugcaugcaguaugaggggucuacaccugcaaggacugagaggcu

SEQ ID NO: 525232 - RNA, 64 nt, hsa
caaccgggaugcgugggcaacuggacucugcacgggggucuacagguugagggagguuggucac

SEQ ID NO: 525233 - RNA, 64 nt, hsa
cugugggguggggaggagcagauccaaguuuugcggggucuaaagcuguguguguugaggggga

SEQ ID NO: 525234 - RNA, 64 nt, hsa
uucuaugagucugcuccauccaugugucuguuugggggucuaucucuccaucccucuguuggug

SEQ ID NO: 525235 - RNA, 64 nt, hsa
uuucacagaguaagccuguugugacuuugcuuuuggggucuaugucauugguuucugaugcuug

SEQ ID NO: 525236 - RNA, 64 nt, hsa
cugcuaacuugugugcuaugauccacuccugaugggggucuacauuaaucuuccaguacuccuu

SEQ ID NO: 525237 - RNA, 64 nt, hsa
ucuucuugaacacucaugcugaaagcccaaguagggggucuaaaauuuuuaaggacuuuccuuc

SEQ ID NO: 525238 - RNA, 64 nt, hsa
uggaagggaccaagcgaccaaggaugggccaucuggggucuaugcccacauacccacguuuguu

SEQ ID NO: 525239 - RNA, 64 nt, hsa
uagguuguccuagaaaggguguggagggaggaagggggucuaaggucuaucaagucaaucauuu

SEQ ID NO: 525240 - RNA, 64 nt, hsa
uagagacaggugucucugcccccacaccgcuacuggggucuaauggaggggcuggguucuugaa

SEQ ID NO: 525241 - RNA, 64 nt, hsa
accaaggccuagggcggguaugaaguguggggcgggggucuauacauuccugagauucugggaa

SEQ ID NO: 525242 - RNA, 64 nt, hsa
uuuccuuuuguccuuguauuaaagugguuuuaaaggggucuaaaaagauuuuggcaaaacauau

SEQ ID NO: 525243 - RNA, 64 nt, hsa
cugauuuuuuuaucuugcccaaauuccuaccuaaggggucuagggagucgcgccuuacaaauca

SEQ ID NO: 525244 - RNA, 64 nt, hsa
gcagucagcuguuugcaguuuuuagccugauuuuggggucuauagagauugcuuuauuggauac

SEQ ID NO: 525245 - RNA, 64 nt, hsa
ucauuuuucuuuuggugcagaaccguugugcaguggggucuaccaugcaauuuucuuucagcac

SEQ ID NO: 525246 - RNA, 64 nt, hsa
cccaucucuaaggacuccaagugcuagagacaagggggucuaugagcauuuacugacuuccugu

SEQ ID NO: 525247 - RNA, 64 nt, hsa
accaagugauucccauuugucuaaggauuugaagggggucuaaauuggauguaucuuacuuagu

SEQ ID NO: 525248 - RNA, 64 nt, hsa
uauuagauaauguauaacuugcacccagggaaugggggucuaugagacaaccccacuuggagaa

SEQ ID NO: 525249 - RNA, 64 nt, hsa
acuuaugcagcuuucuacagggagaguuugguuuggggucuauaucuagagggaccuucaaagu

SEQ ID NO: 525250 - RNA, 64 nt, hsa
uguguugucacuggaaguacugucaaagacuuugggggucuaacuaaaauggccaaaguuccaa

SEQ ID NO: 525251 - RNA, 64 nt, hsa
caaauuaugguaggcaacuaacgguguuuuuaagggggucuaagccugccuuuucaaugauuua

SEQ ID NO: 525252 - RNA, 64 nt, hsa
uuuuaaucccguuauggacucugucuccaggagaggggucuauccaccccugcucauuggugga

SEQ ID NO: 525253 - RNA, 64 nt, hsa
gccucuaucuuguuuuuuguuuuuucuucuggggggggucuagaacagugccuggcacauagua

SEQ ID NO: 525254 - RNA, 64 nt, hsa
uacagauccucucuuucuuucccuacgucugccuggggucuacuccauaaggguuuacaaaugg

SEQ ID NO: 525255 - RNA, 64 nt, hsa
guuaaugagucucuuggcccacuggucccacuugggggucuagaccaggauuauagaggacaca

SEQ ID NO: 525256 - RNA, 64 nt, hsa
acugcuaauacagaaacuuaauguagaccuguuuggggucuacuauuguuuuagaaugaaggaa

SEQ ID NO: 525257 - RNA, 64 nt, hsa
uuuuuuuuuuuuucuuuuuuggugugaaggugggggggucuauuagacauuuauucaagagcgu

SEQ ID NO: 525258 - RNA, 64 nt, hsa
cagaucuaggcaguuucuaaacaacacuuagacuggggucuaacguugacaaauccuucuagaa

SEQ ID NO: 525259 - RNA, 64 nt, hsa
aaggaaauguuagaaguuauuuuucccuuccagaggggucuauauguguaagcaaccaggacuu

SEQ ID NO: 525260 - RNA, 64 nt, hsa
gggaggggagcaguguugaugccaaaauacccacggggucuaccagccaugggguuugcuugcu

SEQ ID NO: 525261 - RNA, 64 nt, hsa
augcuugcugcagcaagagagacugcacaccacuggggucuaugggugcuucucagugggaagg

SEQ ID NO: 525262 - RNA, 64 nt, hsa
caccaacagcugugauuucaucccgaaguggaagggggucuaaacagaacaggcugagagaggc

SEQ ID NO: 525263 - RNA, 64 nt, hsa
agagccaccugggguacauguugaaaacuuauuuggggucuaccccaaaccuaauaacccaaau

SEQ ID NO: 525264 - RNA, 64 nt, hsa
uaaugugggaaugauuugguuuuaauuauaaacuggggucuaaauccuaaagcaaaauugaaac

SEQ ID NO: 525265 - RNA, 64 nt, hsa
uaaauguauucucacauguaaauuugaaaguucaggggucuauuaugaaaugauacacauuuuu

SEQ ID NO: 525266 - RNA, 64 nt, hsa
cucuuaacuguggggaccaaaagggagagagccuggggucuacaagaggagacacaucaucaaa

SEQ ID NO: 525267 - RNA, 64 nt, hsa
cugcugggggcucuguggcuccauuccuggcuguggggucuagucaagaggcagagggacuugg

SEQ ID NO: 525268 - RNA, 64 nt, hsa
uggugguugccauugggcagaggaguauaggacuggggucuaggauaggagcaagacuuccuug

SEQ ID NO: 525269 - RNA, 64 nt, hsa
ggacggcagauaugaaaugccuggcacagugcuuggggucuaguauguagcuuccagaacccac

SEQ ID NO: 525270 - RNA, 64 nt, hsa
guauaacuaacagcauccccaaaacaaagucuuuggggucuacacugcaaucauaugugaucug

SEQ ID NO: 525271 - RNA, 64 nt, hsa
gguaaagugcccaucuggugcucaagagagccugggggucuaacagggagcccggcugccucac

SEQ ID NO: 525272 - RNA, 64 nt, hsa
uuaugaguucaugcaaaacucuccaggccaaguaggggucuagccuuuaaugauauuagucaaa

SEQ ID NO: 525273 - RNA, 64 nt, hsa
cauccuggugggggagggcagccuucaaacguguggggucuacaguccucaggucuaggcaggg

SEQ ID NO: 525274 - RNA, 64 nt, hsa
cccuacagaguuagggaauggagcccaggcaccaggggucuaaagugugagccacugagaagag

SEQ ID NO: 525275 - RNA, 64 nt, hsa
uuuggacuauucaggugaacuauuugagggguauggggucuagaaguuaaaagauacgcauguc

SEQ ID NO: 525276 - RNA, 64 nt, hsa
gggccccagggaacuaaagggugugggucagggaggggucuagaggcuauuccuaggccucagg

SEQ ID NO: 525277 - RNA, 64 nt, hsa
ugagagaggaguagcccccuuuuucagagaguuuggggucuaccucagagcucucccugucaaa

SEQ ID NO: 525278 - RNA, 64 nt, hsa
uucuagucaugcugugcaugccgcuuacucuguuggggucuauauaaauuuguugaacucuuac

SEQ ID NO: 525279 - RNA, 64 nt, hsa
uguguugggagauggguaaagcguuucuucuaaaggggucuacccagaaagcaugauuuccugc

SEQ ID NO: 525280 - RNA, 64 nt, hsa
auagggaacaauguuuauagucguguguacagugggggucuacaacaagaaguguauauuuuca

SEQ ID NO: 525281 - RNA, 64 nt, hsa
aucugggacgugcagugauggggauuacaggggaggggucuagcuccuuuuucucucucauauu

SEQ ID NO: 525282 - RNA, 64 nt, hsa
ucccaucaccagaaacaucuuuucaggggagcggggggucuauaaaaacagcaauagaaauuaa

SEQ ID NO: 525283 - RNA, 64 nt, hsa
cuugggcuccugaugaggagaaaggggccccaccggggucuaauggugacaguccaaaccacuc

SEQ ID NO: 525284 - RNA, 64 nt, hsa
ccugaucccugugggaccuuugacagcagggaugggggucuaacagcuguagggugcugccacu

SEQ ID NO: 525285 - RNA, 64 nt, hsa
auuccucccugaugugguaaacuggcacacuccaggggucuaaaacauaaaacaguuguguuua

SEQ ID NO: 525286 - RNA, 64 nt, hsa
gccuugcgccgcauucgcacugggggacaugggaggggucuagcuggccacugcuggaggcagc

SEQ ID NO: 525287 - RNA, 64 nt, hsa
caucuacuccugaaaauaaauguggugccaugcaggggucuacgguuugugguaguaaucuaau

SEQ ID NO: 525288 - RNA, 64 nt, hsa
aggaaccucccccuaccuaggacccuuccuguggggggucuacagagucagggacagaagggaa

SEQ ID NO: 525289 - RNA, 64 nt, hsa
uccucacaugacugaagggacuagcuaucucuguggggucuauuuuauaagggcacuaacccca

SEQ ID NO: 525290 - RNA, 64 nt, hsa
uuguuagaggagcauaugauuagaauucuguuugggggucuaguugucuuggagcaaguaugua

SEQ ID NO: 525291 - RNA, 64 nt, hsa
ugaauucauuacgaagaauguucgagagaaagcaggggucuaauccaaaagaaaugucauuaac

SEQ ID NO: 525292 - RNA, 64 nt, hsa
ccuuggcacaugaggccggcucuccccacuggcuggggucuaaccuugaacccucaccacgugc

SEQ ID NO: 525293 - RNA, 64 nt, hsa
gcucaguucaccugccacguucucuccaaggaguggggucuacgugaccuuuaguccucuaccu

SEQ ID NO: 525294 - RNA, 64 nt, hsa
guacaucuggccuugaaaccaccuuuuauuacauggggucuagaacuugacccccuugagggug

SEQ ID NO: 525295 - RNA, 64 nt, hsa
aacacaccacggucugcccugcaaaaacaccaauggggucuagugcagguggacacuuugaacc

SEQ ID NO: 525296 - RNA, 64 nt, hsa
gagccugcaugugccugugggguggggaggcguaggggucuacggcugccugagaugggugugc

SEQ ID NO: 525297 - RNA, 64 nt, hsa
uacaauuaucuucucagugaaggucauuugugauggggucuaauucuuauuacuucaacaaaua

SEQ ID NO: 525298 - RNA, 64 nt, hsa
uuugguauuucggaaacuaaaguccuuaugggauggggucuagaauugauucuccuuuccugag

SEQ ID NO: 525299 - RNA, 64 nt, hsa
uuuucucauguuuacagugcacggaguguggaagggggucuaggagagggagagcuggaaaagg

SEQ ID NO: 525300 - RNA, 64 nt, hsa
gaaauuguaccuuucuaaugacaucuaugcagcaggggucuaucgccuuguggauggcaccaaa

SEQ ID NO: 525301 - RNA, 64 nt, hsa
cuuccuaauaagccugggagugcuaugggagacuggggucuauuucaccccugcagucucgacc

SEQ ID NO: 525302 - RNA, 64 nt, hsa
uuuaacagccucugaaauuuaucuuuucuucuauggggucuauaaauguaucuuauaauaaaaa

SEQ ID NO: 525303 - RNA, 64 nt, hsa
gagaaggaagugauccacagcauucaggccacuuggggucuagaccaugguggugccagccugg

SEQ ID NO: 525304 - RNA, 64 nt, hsa
cagggcuuucauuuggucauccuugcaauccauuggggucuaguuuggaaucugacaacuggaa

SEQ ID NO: 525305 - RNA, 64 nt, hsa
ccaagagguaacauuuugccccgggccaaauucaggggucuagugcccugcauuccuuugaggc

SEQ ID NO: 525306 - RNA, 64 nt, hsa
ucuggacggggcucuuuugcuucccccucaaucuggggucuagaguugugcaaggaauucagcu

SEQ ID NO: 525307 - RNA, 64 nt, hsa
uuucuucgaggaccucagcaaggucgugaguccaggggucuacaagucccgggccccccaguuc

SEQ ID NO: 525308 - RNA, 64 nt, hsa
uugcuggggccaggccccauggaggguauacugaggggucuauagguuugugauuaaaauaaua

SEQ ID NO: 525309 - RNA, 64 nt, hsa
gcccugcugacugggaaaguuucagggcacugauggggucuaccugguaagcggagggccugag

SEQ ID NO: 525310 - RNA, 64 nt, hsa
gucguuacuaugggccauauuacuaaugcccacuggggucuaugauuucucaaaauuuucauuc

SEQ ID NO: 525311 - RNA, 64 nt, hsa; identical to SEQ ID NO: 525310

SEQ ID NO: 525312 - RNA, 64 nt, hsa; identical to SEQ ID NO: 481345

SEQ ID NO: 525313 - RNA, 64 nt, hsa; identical to SEQ ID NO: 481346

SEQ ID NO: 525314 - RNA, 64 nt, hsa; identical to SEQ ID NO: 481347

SEQ ID NO: 525315 - RNA, 64 nt, hsa; identical to SEQ ID NO: 481348

SEQ ID NO: 525316 - RNA, 64 nt, hsa; identical to SEQ ID NO: 481349

SEQ ID NO: 525317 - RNA, 64 nt, hsa; identical to SEQ ID NO: 481350

SEQ ID NO: 525318 - RNA, 64 nt, hsa; identical to SEQ ID NO: 481351

SEQ ID NO: 525319 - RNA, 63 nt, hsa; identical to SEQ ID NO: 481352

SEQ ID NO: 525320 - RNA, 64 nt, hsa; identical to SEQ ID NO: 481353

SEQ ID NO: 525321 - RNA, 64 nt, hsa; identical to SEQ ID NO: 481354

SEQ ID NO: 525322 - RNA, 64 nt, hsa; identical to SEQ ID NO: 481355

SEQ ID NO: 525323 - RNA, 64 nt, hsa; identical to SEQ ID NO: 481356

SEQ ID NO: 525324 - RNA, 64 nt, hsa; identical to SEQ ID NO: 481357

SEQ ID NO: 525325 - RNA, 64 nt, hsa; identical to SEQ ID NO: 481358

SEQ ID NO: 525326 - RNA, 64 nt, hsa; identical to SEQ ID NO: 481359

SEQ ID NO: 525327 - RNA, 64 nt, hsa; identical to SEQ ID NO: 481360

SEQ ID NO: 525328 - RNA, 64 nt, hsa; identical to SEQ ID NO: 481361

SEQ ID NO: 525329 - RNA, 64 nt, hsa; identical to SEQ ID NO: 481362

SEQ ID NO: 525330 - RNA, 64 nt, hsa; identical to SEQ ID NO: 481363

SEQ ID NO: 525331 - RNA, 64 nt, hsa; identical to SEQ ID NO: 481364

SEQ ID NO: 525332 - RNA, 64 nt, hsa; identical to SEQ ID NO: 481365

SEQ ID NO: 525333 - RNA, 64 nt, hsa; identical to SEQ ID NO: 481366

SEQ ID NO: 525334 - RNA, 64 nt, hsa; identical to SEQ ID NO: 481367

SEQ ID NO: 525335 - RNA, 64 nt, hsa; identical to SEQ ID NO: 481368

SEQ ID NO: 525336 - RNA, 64 nt, hsa; identical to SEQ ID NO: 481369

SEQ ID NO: 525337 - RNA, 64 nt, hsa; identical to SEQ ID NO: 481370

SEQ ID NO: 525338 - RNA, 64 nt, hsa; identical to SEQ ID NO: 481371

SEQ ID NO: 525339 - RNA, 64 nt, hsa; identical to SEQ ID NO: 481372

SEQ ID NO: 525340 - RNA, 64 nt, hsa; identical to SEQ ID NO: 481373

SEQ ID NO: 525341 - RNA, 64 nt, hsa; identical to SEQ ID NO: 481374

SEQ ID NO: 525342 - RNA, 64 nt, hsa; identical to SEQ ID NO: 481375

SEQ ID NO: 525343 - RNA, 64 nt, hsa; identical to SEQ ID NO: 481376

SEQ ID NO: 525344 - RNA, 64 nt, hsa; identical to SEQ ID NO: 481377

SEQ ID NO: 525345 - RNA, 64 nt, hsa; identical to SEQ ID NO: 481378

SEQ ID NO: 525346 - RNA, 64 nt, hsa; identical to SEQ ID NO: 481379

SEQ ID NO: 525347 - RNA, 64 nt, hsa; identical to SEQ ID NO: 481380

SEQ ID NO: 525348 - RNA, 64 nt, hsa; identical to SEQ ID NO: 481381

SEQ ID NO: 525349 - RNA, 64 nt, hsa; identical to SEQ ID NO: 481382

SEQ ID NO: 525350 - RNA, 64 nt, hsa; identical to SEQ ID NO: 481383

SEQ ID NO: 525351 - RNA, 64 nt, hsa; identical to SEQ ID NO: 481384

SEQ ID NO: 525352 - RNA, 64 nt, hsa; identical to SEQ ID NO: 481385

SEQ ID NO: 525353 - RNA, 64 nt, hsa; identical to SEQ ID NO: 481386

SEQ ID NO: 525354 - RNA, 64 nt, hsa; identical to SEQ ID NO: 481387

SEQ ID NO: 525355 - RNA, 64 nt, hsa; identical to SEQ ID NO: 481388

SEQ ID NO: 525356 - RNA, 64 nt, hsa; identical to SEQ ID NO: 481389

SEQ ID NO: 525357 - RNA, 64 nt, hsa; identical to SEQ ID NO: 481390

SEQ ID NO: 525358 - RNA, 64 nt, hsa; identical to SEQ ID NO: 481391

SEQ ID NO: 525359 - RNA, 64 nt, hsa; identical to SEQ ID NO: 481392

SEQ ID NO: 525360 - RNA, 64 nt, hsa; identical to SEQ ID NO: 481393

SEQ ID NO: 525361 - RNA, 64 nt, hsa; identical to SEQ ID NO: 481394

SEQ ID NO: 525362 - RNA, 64 nt, hsa; identical to SEQ ID NO: 481395

SEQ ID NO: 525363 - RNA, 64 nt, hsa; identical to SEQ ID NO: 223145

SEQ ID NO: 525364 - RNA, 64 nt, hsa; identical to SEQ ID NO: 223146

SEQ ID NO: 525365 - RNA, 64 nt, hsa; identical to SEQ ID NO: 223147

SEQ ID NO: 525366 - RNA, 64 nt, hsa; identical to SEQ ID NO: 223148

SEQ ID NO: 525367 - RNA, 64 nt, hsa; identical to SEQ ID NO: 223149

SEQ ID NO: 525368 - RNA, 64 nt, hsa; identical to SEQ ID NO: 223150

SEQ ID NO: 525369 - RNA, 64 nt, hsa; identical to SEQ ID NO: 223151

SEQ ID NO: 525370 - RNA, 64 nt, hsa; identical to SEQ ID NO: 223152

SEQ ID NO: 525371 - RNA, 64 nt, hsa; identical to SEQ ID NO: 223153

SEQ ID NO: 525372 - RNA, 64 nt, hsa; identical to SEQ ID NO: 223154

SEQ ID NO: 525373 - RNA, 64 nt, hsa; identical to SEQ ID NO: 223155

SEQ ID NO: 525374 - RNA, 64 nt, hsa; identical to SEQ ID NO: 223156

SEQ ID NO: 525375 - RNA, 64 nt, hsa; identical to SEQ ID NO: 223157

SEQ ID NO: 525376 - RNA, 64 nt, hsa; identical to SEQ ID NO: 223158

SEQ ID NO: 525377 - RNA, 64 nt, hsa; identical to SEQ ID NO: 223159

SEQ ID NO: 525378 - RNA, 64 nt, hsa; identical to SEQ ID NO: 223160

SEQ ID NO: 525379 - RNA, 64 nt, hsa; identical to SEQ ID NO: 223161

SEQ ID NO: 525380 - RNA, 64 nt, hsa; identical to SEQ ID NO: 223162

SEQ ID NO: 525381 - RNA, 64 nt, hsa; identical to SEQ ID NO: 223163

SEQ ID NO: 525382 - RNA, 64 nt, hsa; identical to SEQ ID NO: 223164

SEQ ID NO: 525383 - RNA, 64 nt, hsa; identical to SEQ ID NO: 223165

SEQ ID NO: 525384 - RNA, 64 nt, hsa; identical to SEQ ID NO: 223166

SEQ ID NO: 525385 - RNA, 64 nt, hsa; identical to SEQ ID NO: 223167

SEQ ID NO: 525386 - RNA, 64 nt, hsa; identical to SEQ ID NO: 223168

SEQ ID NO: 525387 - RNA, 64 nt, hsa; identical to SEQ ID NO: 223169

SEQ ID NO: 525388 - RNA, 64 nt, hsa; identical to SEQ ID NO: 223170

SEQ ID NO: 525389 - RNA, 64 nt, hsa; identical to SEQ ID NO: 223171

SEQ ID NO: 525390 - RNA, 64 nt, hsa; identical to SEQ ID NO: 223172

SEQ ID NO: 525391 - RNA, 64 nt, hsa; identical to SEQ ID NO: 223173

SEQ ID NO: 525392 - RNA, 64 nt, hsa; identical to SEQ ID NO: 223174

SEQ ID NO: 525393 - RNA, 64 nt, hsa; identical to SEQ ID NO: 223175

SEQ ID NO: 525394 - RNA, 64 nt, hsa; identical to SEQ ID NO: 223176

SEQ ID NO: 525395 - RNA, 64 nt, hsa; identical to SEQ ID NO: 223177

SEQ ID NO: 525396 - RNA, 64 nt, hsa; identical to SEQ ID NO: 223178

SEQ ID NO: 525397 - RNA, 64 nt, hsa; identical to SEQ ID NO: 223179

SEQ ID NO: 525398 - RNA, 64 nt, hsa; identical to SEQ ID NO: 223180

SEQ ID NO: 525399 - RNA, 64 nt, hsa; identical to SEQ ID NO: 223181

SEQ ID NO: 525400 - RNA, 64 nt, hsa; identical to SEQ ID NO: 223182

SEQ ID NO: 525401 - RNA, 64 nt, hsa; identical to SEQ ID NO: 223183

SEQ ID NO: 525402 - RNA, 64 nt, hsa; identical to SEQ ID NO: 223184

SEQ ID NO: 525403 - RNA, 64 nt, hsa; identical to SEQ ID NO: 223185

SEQ ID NO: 525404 - RNA, 64 nt, hsa; identical to SEQ ID NO: 223186

SEQ ID NO: 525405 - RNA, 64 nt, hsa; identical to SEQ ID NO: 223187

SEQ ID NO: 525406 - RNA, 64 nt, hsa; identical to SEQ ID NO: 223188

SEQ ID NO: 525407 - RNA, 64 nt, hsa; identical to SEQ ID NO: 223189

SEQ ID NO: 525408 - RNA, 64 nt, hsa; identical to SEQ ID NO: 223190

SEQ ID NO: 525409 - RNA, 64 nt, hsa; identical to SEQ ID NO: 223191

SEQ ID NO: 525410 - RNA, 64 nt, hsa; identical to SEQ ID NO: 223192

SEQ ID NO: 525411 - RNA, 64 nt, hsa; identical to SEQ ID NO: 223193

SEQ ID NO: 525412 - RNA, 64 nt, hsa; identical to SEQ ID NO: 223194

SEQ ID NO: 525413 - RNA, 64 nt, hsa; identical to SEQ ID NO: 223195

SEQ ID NO: 525414 - RNA, 57 nt, hsa; identical to SEQ ID NO: 223196

SEQ ID NO: 525415 - RNA, 64 nt, hsa; identical to SEQ ID NO: 223197

SEQ ID NO: 525416 - RNA, 54 nt, hsa; identical to SEQ ID NO: 223198

SEQ ID NO: 525417 - RNA, 64 nt, hsa; identical to SEQ ID NO: 389979

SEQ ID NO: 525418 - RNA, 64 nt, hsa; identical to SEQ ID NO: 389980

SEQ ID NO: 525419 - RNA, 64 nt, hsa; identical to SEQ ID NO: 389982

SEQ ID NO: 525420 - RNA, 64 nt, hsa; identical to SEQ ID NO: 389983

SEQ ID NO: 525421 - RNA, 64 nt, hsa; identical to SEQ ID NO: 390054

SEQ ID NO: 525422 - RNA, 64 nt, hsa; identical to SEQ ID NO: 390055

SEQ ID NO: 525423 - RNA, 64 nt, hsa; identical to SEQ ID NO: 48048

SEQ ID NO: 525424 - RNA, 64 nt, hsa; identical to SEQ ID NO: 48049

SEQ ID NO: 525425 - RNA, 64 nt, hsa; identical to SEQ ID NO: 48050

SEQ ID NO: 525426 - RNA, 64 nt, hsa; identical to SEQ ID NO: 48051

SEQ ID NO: 525427 - RNA, 64 nt, hsa; identical to SEQ ID NO: 48052

SEQ ID NO: 525428 - RNA, 64 nt, hsa; identical to SEQ ID NO: 48053

SEQ ID NO: 525429 - RNA, 64 nt, hsa; identical to SEQ ID NO: 48054

SEQ ID NO: 525430 - RNA, 64 nt, hsa; identical to SEQ ID NO: 48055

SEQ ID NO: 525431 - RNA, 64 nt, hsa; identical to SEQ ID NO: 48056

SEQ ID NO: 525432 - RNA, 64 nt, hsa; identical to SEQ ID NO: 48057

SEQ ID NO: 525433 - RNA, 64 nt, hsa; identical to SEQ ID NO: 48058

SEQ ID NO: 525434 - RNA, 64 nt, hsa; identical to SEQ ID NO: 48059

SEQ ID NO: 525435 - RNA, 64 nt, hsa; identical to SEQ ID NO: 48060

SEQ ID NO: 525436 - RNA, 64 nt, hsa; identical to SEQ ID NO: 48061

SEQ ID NO: 525437 - RNA, 64 nt, hsa; identical to SEQ ID NO: 48062

SEQ ID NO: 525438 - RNA, 64 nt, hsa; identical to SEQ ID NO: 48063

SEQ ID NO: 525439 - RNA, 64 nt, hsa; identical to SEQ ID NO: 48064

SEQ ID NO: 525440 - RNA, 64 nt, hsa; identical to SEQ ID NO: 48065

SEQ ID NO: 525441 - RNA, 64 nt, hsa; identical to SEQ ID NO: 48066

SEQ ID NO: 525442 - RNA, 64 nt, hsa; identical to SEQ ID NO: 48067

SEQ ID NO: 525443 - RNA, 64 nt, hsa; identical to SEQ ID NO: 48068

SEQ ID NO: 525444 - RNA, 64 nt, hsa; identical to SEQ ID NO: 48069

SEQ ID NO: 525445 - RNA, 64 nt, hsa; identical to SEQ ID NO: 48070

SEQ ID NO: 525446 - RNA, 64 nt, hsa; identical to SEQ ID NO: 48071

SEQ ID NO: 525447 - RNA, 64 nt, hsa; identical to SEQ ID NO: 48072

SEQ ID NO: 525448 - RNA, 64 nt, hsa; identical to SEQ ID NO: 48073

SEQ ID NO: 525449 - RNA, 64 nt, hsa; identical to SEQ ID NO: 48074

SEQ ID NO: 525450 - RNA, 64 nt, hsa; identical to SEQ ID NO: 48075

SEQ ID NO: 525451 - RNA, 64 nt, hsa; identical to SEQ ID NO: 48076

SEQ ID NO: 525452 - RNA, 64 nt, hsa; identical to SEQ ID NO: 48077

SEQ ID NO: 525453 - RNA, 64 nt, hsa; identical to SEQ ID NO: 48078

SEQ ID NO: 525454 - RNA, 64 nt, hsa; identical to SEQ ID NO: 48079

SEQ ID NO: 525455 - RNA, 64 nt, hsa; identical to SEQ ID NO: 48080

SEQ ID NO: 525456 - RNA, 64 nt, hsa; identical to SEQ ID NO: 48081

SEQ ID NO: 525457 - RNA, 64 nt, hsa; identical to SEQ ID NO: 48082

SEQ ID NO: 525458 - RNA, 64 nt, hsa; identical to SEQ ID NO: 48083

SEQ ID NO: 525459 - RNA, 64 nt, hsa; identical to SEQ ID NO: 48084

SEQ ID NO: 525460 - RNA, 64 nt, hsa; identical to SEQ ID NO: 48085

SEQ ID NO: 525461 - RNA, 64 nt, hsa; identical to SEQ ID NO: 48086

SEQ ID NO: 525462 - RNA, 64 nt, hsa; identical to SEQ ID NO: 48087

SEQ ID NO: 525463 - RNA, 64 nt, hsa; identical to SEQ ID NO: 48088

SEQ ID NO: 525464 - RNA, 64 nt, hsa; identical to SEQ ID NO: 48089

SEQ ID NO: 525465 - RNA, 64 nt, hsa; identical to SEQ ID NO: 48090

SEQ ID NO: 525466 - RNA, 64 nt, hsa; identical to SEQ ID NO: 48091

SEQ ID NO: 525467 - RNA, 64 nt, hsa; identical to SEQ ID NO: 48092

SEQ ID NO: 525468 - RNA, 64 nt, hsa; identical to SEQ ID NO: 48093

SEQ ID NO: 525469 - RNA, 64 nt, hsa; identical to SEQ ID NO: 48094

SEQ ID NO: 525470 - RNA, 64 nt, hsa; identical to SEQ ID NO: 48095

SEQ ID NO: 525471 - RNA, 64 nt, hsa; identical to SEQ ID NO: 48096

SEQ ID NO: 525472 - RNA, 64 nt, hsa; identical to SEQ ID NO: 48097

SEQ ID NO: 525473 - RNA, 64 nt, hsa; identical to SEQ ID NO: 48098

SEQ ID NO: 525474 - RNA, 64 nt, hsa; identical to SEQ ID NO: 48099

SEQ ID NO: 525475 - RNA, 64 nt, hsa; identical to SEQ ID NO: 48100

SEQ ID NO: 525476 - RNA, 64 nt, hsa; identical to SEQ ID NO: 48101

SEQ ID NO: 525477 - RNA, 64 nt, hsa; identical to SEQ ID NO: 48102

SEQ ID NO: 525478 - RNA, 64 nt, hsa; identical to SEQ ID NO: 48103

SEQ ID NO: 525479 - RNA, 64 nt, hsa; identical to SEQ ID NO: 48104

SEQ ID NO: 525480 - RNA, 64 nt, hsa; identical to SEQ ID NO: 48105

SEQ ID NO: 525481 - RNA, 64 nt, hsa; identical to SEQ ID NO: 48106

SEQ ID NO: 525482 - RNA, 64 nt, hsa; identical to SEQ ID NO: 48107

SEQ ID NO: 525483 - RNA, 64 nt, hsa; identical to SEQ ID NO: 48108

SEQ ID NO: 525484 - RNA, 64 nt, hsa; identical to SEQ ID NO: 48109

SEQ ID NO: 525485 - RNA, 64 nt, hsa; identical to SEQ ID NO: 48110

SEQ ID NO: 525486 - RNA, 64 nt, hsa; identical to SEQ ID NO: 48111

SEQ ID NO: 525487 - RNA, 64 nt, hsa; identical to SEQ ID NO: 48112

SEQ ID NO: 525488 - RNA, 64 nt, hsa; identical to SEQ ID NO: 48113

SEQ ID NO: 525489 - RNA, 64 nt, hsa; identical to SEQ ID NO: 48114

SEQ ID NO: 525490 - RNA, 64 nt, hsa; identical to SEQ ID NO: 48115

SEQ ID NO: 525491 - RNA, 64 nt, hsa; identical to SEQ ID NO: 48116

SEQ ID NO: 525492 - RNA, 64 nt, hsa; identical to SEQ ID NO: 48117

SEQ ID NO: 525493 - RNA, 64 nt, hsa; identical to SEQ ID NO: 48118

SEQ ID NO: 525494 - RNA, 64 nt, hsa; identical to SEQ ID NO: 48119

SEQ ID NO: 525495 - RNA, 64 nt, hsa; identical to SEQ ID NO: 48120

SEQ ID NO: 525496 - RNA, 64 nt, hsa; identical to SEQ ID NO: 48121

SEQ ID NO: 525497 - RNA, 64 nt, hsa; identical to SEQ ID NO: 48122

SEQ ID NO: 525498 - RNA, 64 nt, hsa; identical to SEQ ID NO: 48123

SEQ ID NO: 525499 - RNA, 64 nt, hsa; identical to SEQ ID NO: 48124

SEQ ID NO: 525500 - RNA, 64 nt, hsa; identical to SEQ ID NO: 48125

SEQ ID NO: 525501 - RNA, 64 nt, hsa; identical to SEQ ID NO: 48126

SEQ ID NO: 525502 - RNA, 64 nt, hsa; identical to SEQ ID NO: 48127

SEQ ID NO: 525503 - RNA, 64 nt, hsa; identical to SEQ ID NO: 48128

SEQ ID NO: 525504 - RNA, 64 nt, hsa; identical to SEQ ID NO: 48129

SEQ ID NO: 525505 - RNA, 64 nt, hsa; identical to SEQ ID NO: 48130

SEQ ID NO: 525506 - RNA, 64 nt, hsa; identical to SEQ ID NO: 48131

SEQ ID NO: 525507 - RNA, 59 nt, hsa; identical to SEQ ID NO: 48132

SEQ ID NO: 525508 - RNA, 64 nt, hsa; identical to SEQ ID NO: 48133

SEQ ID NO: 525509 - RNA, 64 nt, hsa; identical to SEQ ID NO: 48134

SEQ ID NO: 525510 - RNA, 64 nt, hsa; identical to SEQ ID NO: 48135

SEQ ID NO: 525511 - RNA, 64 nt, hsa; identical to SEQ ID NO: 48136

SEQ ID NO: 525512 - RNA, 64 nt, hsa; identical to SEQ ID NO: 48137

SEQ ID NO: 525513 - RNA, 64 nt, hsa; identical to SEQ ID NO: 48138

SEQ ID NO: 525514 - RNA, 64 nt, hsa; identical to SEQ ID NO: 48139

SEQ ID NO: 525515 - RNA, 64 nt, hsa; identical to SEQ ID NO: 48140

SEQ ID NO: 525516 - RNA, 64 nt, hsa; identical to SEQ ID NO: 48141

SEQ ID NO: 525517 - RNA, 64 nt, hsa; identical to SEQ ID NO: 48142

SEQ ID NO: 525518 - RNA, 64 nt, hsa; identical to SEQ ID NO: 48143

SEQ ID NO: 525519 - RNA, 64 nt, hsa; identical to SEQ ID NO: 48144

SEQ ID NO: 525520 - RNA, 64 nt, hsa; identical to SEQ ID NO: 48145

SEQ ID NO: 525521 - RNA, 64 nt, hsa; identical to SEQ ID NO: 48146

SEQ ID NO: 525522 - RNA, 64 nt, hsa; identical to SEQ ID NO: 48147

SEQ ID NO: 525523 - RNA, 64 nt, hsa; identical to SEQ ID NO: 48148

SEQ ID NO: 525524 - RNA, 64 nt, hsa; identical to SEQ ID NO: 48149

SEQ ID NO: 525525 - RNA, 64 nt, hsa; identical to SEQ ID NO: 48150

SEQ ID NO: 525526 - RNA, 64 nt, hsa; identical to SEQ ID NO: 48151

SEQ ID NO: 525527 - RNA, 64 nt, hsa; identical to SEQ ID NO: 48152

SEQ ID NO: 525528 - RNA, 64 nt, hsa; identical to SEQ ID NO: 48153

SEQ ID NO: 525529 - RNA, 64 nt, hsa; identical to SEQ ID NO: 48154

SEQ ID NO: 525530 - RNA, 64 nt, hsa; identical to SEQ ID NO: 48155

SEQ ID NO: 525531 - RNA, 64 nt, hsa; identical to SEQ ID NO: 48156

SEQ ID NO: 525532 - RNA, 64 nt, hsa; identical to SEQ ID NO: 48157

SEQ ID NO: 525533 - RNA, 64 nt, hsa; identical to SEQ ID NO: 48158

SEQ ID NO: 525534 - RNA, 64 nt, hsa; identical to SEQ ID NO: 48159

SEQ ID NO: 525535 - RNA, 64 nt, hsa; identical to SEQ ID NO: 48160

SEQ ID NO: 525536 - RNA, 64 nt, hsa; identical to SEQ ID NO: 48161

SEQ ID NO: 525537 - RNA, 64 nt, hsa; identical to SEQ ID NO: 48162

SEQ ID NO: 525538 - RNA, 64 nt, hsa; identical to SEQ ID NO: 48163

SEQ ID NO: 525539 - RNA, 64 nt, hsa; identical to SEQ ID NO: 48164

SEQ ID NO: 525540 - RNA, 64 nt, hsa; identical to SEQ ID NO: 48165

SEQ ID NO: 525541 - RNA, 64 nt, hsa; identical to SEQ ID NO: 48166

SEQ ID NO: 525542 - RNA, 64 nt, hsa; identical to SEQ ID NO: 48167

SEQ ID NO: 525543 - RNA, 64 nt, hsa; identical to SEQ ID NO: 48168

SEQ ID NO: 525544 - RNA, 64 nt, hsa; identical to SEQ ID NO: 48169

SEQ ID NO: 525545 - RNA, 64 nt, hsa; identical to SEQ ID NO: 48170

SEQ ID NO: 525546 - RNA, 64 nt, hsa; identical to SEQ ID NO: 48171

SEQ ID NO: 525547 - RNA, 64 nt, hsa; identical to SEQ ID NO: 48172

SEQ ID NO: 525548 - RNA, 64 nt, hsa; identical to SEQ ID NO: 48173

SEQ ID NO: 525549 - RNA, 64 nt, hsa; identical to SEQ ID NO: 48174

SEQ ID NO: 525550 - RNA, 64 nt, hsa; identical to SEQ ID NO: 48175

SEQ ID NO: 525551 - RNA, 64 nt, hsa; identical to SEQ ID NO: 48176

SEQ ID NO: 525552 - RNA, 64 nt, hsa; identical to SEQ ID NO: 48177

SEQ ID NO: 525553 - RNA, 64 nt, hsa; identical to SEQ ID NO: 48178

SEQ ID NO: 525554 - RNA, 64 nt, hsa; identical to SEQ ID NO: 48179

SEQ ID NO: 525555 - RNA, 64 nt, hsa; identical to SEQ ID NO: 48180

SEQ ID NO: 525556 - RNA, 64 nt, hsa; identical to SEQ ID NO: 48181

SEQ ID NO: 525557 - RNA, 64 nt, hsa; identical to SEQ ID NO: 48182

SEQ ID NO: 525558 - RNA, 64 nt, hsa; identical to SEQ ID NO: 48183

SEQ ID NO: 525559 - RNA, 64 nt, hsa; identical to SEQ ID NO: 48184

SEQ ID NO: 525560 - RNA, 64 nt, hsa; identical to SEQ ID NO: 48185

SEQ ID NO: 525561 - RNA, 64 nt, hsa; identical to SEQ ID NO: 48186

SEQ ID NO: 525562 - RNA, 64 nt, hsa; identical to SEQ ID NO: 48187

SEQ ID NO: 525563 - RNA, 64 nt, hsa; identical to SEQ ID NO: 48188

SEQ ID NO: 525564 - RNA, 64 nt, hsa; identical to SEQ ID NO: 48189

SEQ ID NO: 525565 - RNA, 64 nt, hsa; identical to SEQ ID NO: 48190

SEQ ID NO: 525566 - RNA, 64 nt, hsa; identical to SEQ ID NO: 48191

SEQ ID NO: 525567 - RNA, 64 nt, hsa; identical to SEQ ID NO: 48192

SEQ ID NO: 525568 - RNA, 64 nt, hsa; identical to SEQ ID NO: 48193

SEQ ID NO: 525569 - RNA, 64 nt, hsa; identical to SEQ ID NO: 48194

SEQ ID NO: 525570 - RNA, 64 nt, hsa; identical to SEQ ID NO: 48195

SEQ ID NO: 525571 - RNA, 64 nt, hsa; identical to SEQ ID NO: 48196

SEQ ID NO: 525572 - RNA, 64 nt, hsa; identical to SEQ ID NO: 48197

SEQ ID NO: 525573 - RNA, 64 nt, hsa; identical to SEQ ID NO: 48198

SEQ ID NO: 525574 - RNA, 64 nt, hsa; identical to SEQ ID NO: 48199

SEQ ID NO: 525575 - RNA, 64 nt, hsa; identical to SEQ ID NO: 48200

SEQ ID NO: 525576 - RNA, 64 nt, hsa; identical to SEQ ID NO: 48201

SEQ ID NO: 525577 - RNA, 64 nt, hsa; identical to SEQ ID NO: 48202

SEQ ID NO: 525578 - RNA, 64 nt, hsa; identical to SEQ ID NO: 48203

SEQ ID NO: 525579 - RNA, 64 nt, hsa; identical to SEQ ID NO: 48204

SEQ ID NO: 525580 - RNA, 64 nt, hsa; identical to SEQ ID NO: 48205

SEQ ID NO: 525581 - RNA, 64 nt, hsa; identical to SEQ ID NO: 48206

SEQ ID NO: 525582 - RNA, 64 nt, hsa; identical to SEQ ID NO: 48207

SEQ ID NO: 525583 - RNA, 64 nt, hsa; identical to SEQ ID NO: 48208

SEQ ID NO: 525584 - RNA, 64 nt, hsa; identical to SEQ ID NO: 48209

SEQ ID NO: 525585 - RNA, 64 nt, hsa; identical to SEQ ID NO: 48210

SEQ ID NO: 525586 - RNA, 64 nt, hsa; identical to SEQ ID NO: 48211

SEQ ID NO: 525587 - RNA, 64 nt, hsa; identical to SEQ ID NO: 48212

SEQ ID NO: 525588 - RNA, 64 nt, hsa; identical to SEQ ID NO: 48213

SEQ ID NO: 525589 - RNA, 64 nt, hsa; identical to SEQ ID NO: 48214

SEQ ID NO: 525590 - RNA, 64 nt, hsa; identical to SEQ ID NO: 48215

SEQ ID NO: 525591 - RNA, 64 nt, hsa; identical to SEQ ID NO: 48216

SEQ ID NO: 525592 - RNA, 64 nt, hsa; identical to SEQ ID NO: 48217

SEQ ID NO: 525593 - RNA, 64 nt, hsa; identical to SEQ ID NO: 48218

SEQ ID NO: 525594 - RNA, 64 nt, hsa; identical to SEQ ID NO: 48219

SEQ ID NO: 525595 - RNA, 64 nt, hsa; identical to SEQ ID NO: 48220

SEQ ID NO: 525596 - RNA, 64 nt, hsa; identical to SEQ ID NO: 48221

SEQ ID NO: 525597 - RNA, 64 nt, hsa; identical to SEQ ID NO: 48222

SEQ ID NO: 525598 - RNA, 64 nt, hsa; identical to SEQ ID NO: 48223

SEQ ID NO: 525599 - RNA, 64 nt, hsa; identical to SEQ ID NO: 48224

SEQ ID NO: 525600 - RNA, 64 nt, hsa; identical to SEQ ID NO: 48225

SEQ ID NO: 525601 - RNA, 64 nt, hsa; identical to SEQ ID NO: 48226

SEQ ID NO: 525602 - RNA, 64 nt, hsa; identical to SEQ ID NO: 48227

SEQ ID NO: 525603 - RNA, 64 nt, hsa; identical to SEQ ID NO: 48228

SEQ ID NO: 525604 - RNA, 64 nt, hsa; identical to SEQ ID NO: 48229

SEQ ID NO: 525605 - RNA, 64 nt, hsa; identical to SEQ ID NO: 48230

SEQ ID NO: 525606 - RNA, 64 nt, hsa; identical to SEQ ID NO: 48231

SEQ ID NO: 525607 - RNA, 64 nt, hsa; identical to SEQ ID NO: 48232

SEQ ID NO: 525608 - RNA, 64 nt, hsa; identical to SEQ ID NO: 48233

SEQ ID NO: 525609 - RNA, 64 nt, hsa; identical to SEQ ID NO: 48234

SEQ ID NO: 525610 - RNA, 64 nt, hsa; identical to SEQ ID NO: 48235

SEQ ID NO: 525611 - RNA, 64 nt, hsa; identical to SEQ ID NO: 48236

SEQ ID NO: 525612 - RNA, 64 nt, hsa; identical to SEQ ID NO: 48237

SEQ ID NO: 525613 - RNA, 64 nt, hsa; identical to SEQ ID NO: 48238

SEQ ID NO: 525614 - RNA, 64 nt, hsa; identical to SEQ ID NO: 48239

SEQ ID NO: 525615 - RNA, 64 nt, hsa; identical to SEQ ID NO: 48240

SEQ ID NO: 525616 - RNA, 64 nt, hsa; identical to SEQ ID NO: 48241

SEQ ID NO: 525617 - RNA, 64 nt, hsa; identical to SEQ ID NO: 48242

SEQ ID NO: 525618 - RNA, 64 nt, hsa; identical to SEQ ID NO: 48243

SEQ ID NO: 525619 - RNA, 64 nt, hsa; identical to SEQ ID NO: 48244

SEQ ID NO: 525620 - RNA, 64 nt, hsa; identical to SEQ ID NO: 48245

SEQ ID NO: 525621 - RNA, 64 nt, hsa; identical to SEQ ID NO: 48246

SEQ ID NO: 525622 - RNA, 64 nt, hsa; identical to SEQ ID NO: 48247

SEQ ID NO: 525623 - RNA, 64 nt, hsa; identical to SEQ ID NO: 48248

SEQ ID NO: 525624 - RNA, 64 nt, hsa; identical to SEQ ID NO: 48249

SEQ ID NO: 525625 - RNA, 64 nt, hsa; identical to SEQ ID NO: 48250

SEQ ID NO: 525626 - RNA, 64 nt, hsa; identical to SEQ ID NO: 48251

SEQ ID NO: 525627 - RNA, 64 nt, hsa; identical to SEQ ID NO: 48252

SEQ ID NO: 525628 - RNA, 64 nt, hsa; identical to SEQ ID NO: 48253

SEQ ID NO: 525629 - RNA, 64 nt, hsa; identical to SEQ ID NO: 48254

SEQ ID NO: 525630 - RNA, 64 nt, hsa; identical to SEQ ID NO: 48255

SEQ ID NO: 525631 - RNA, 64 nt, hsa; identical to SEQ ID NO: 48256

SEQ ID NO: 525632 - RNA, 64 nt, hsa; identical to SEQ ID NO: 48257

SEQ ID NO: 525633 - RNA, 64 nt, hsa; identical to SEQ ID NO: 48258

SEQ ID NO: 525634 - RNA, 64 nt, hsa; identical to SEQ ID NO: 48259

SEQ ID NO: 525635 - RNA, 64 nt, hsa; identical to SEQ ID NO: 48260

SEQ ID NO: 525636 - RNA, 64 nt, hsa; identical to SEQ ID NO: 48261

SEQ ID NO: 525637 - RNA, 64 nt, hsa; identical to SEQ ID NO: 48262

SEQ ID NO: 525638 - RNA, 64 nt, hsa; identical to SEQ ID NO: 48263

SEQ ID NO: 525639 - RNA, 64 nt, hsa; identical to SEQ ID NO: 48264

SEQ ID NO: 525640 - RNA, 64 nt, hsa; identical to SEQ ID NO: 48265

SEQ ID NO: 525641 - RNA, 64 nt, hsa; identical to SEQ ID NO: 48266

SEQ ID NO: 525642 - RNA, 64 nt, hsa; identical to SEQ ID NO: 48267

SEQ ID NO: 525643 - RNA, 64 nt, hsa; identical to SEQ ID NO: 48268

SEQ ID NO: 525644 - RNA, 64 nt, hsa; identical to SEQ ID NO: 48269

SEQ ID NO: 525645 - RNA, 64 nt, hsa; identical to SEQ ID NO: 48270

SEQ ID NO: 525646 - RNA, 64 nt, hsa; identical to SEQ ID NO: 48271

SEQ ID NO: 525647 - RNA, 64 nt, hsa; identical to SEQ ID NO: 48272

SEQ ID NO: 525648 - RNA, 64 nt, hsa; identical to SEQ ID NO: 48273

SEQ ID NO: 525649 - RNA, 64 nt, hsa; identical to SEQ ID NO: 48274

SEQ ID NO: 525650 - RNA, 64 nt, hsa; identical to SEQ ID NO: 48275

SEQ ID NO: 525651 - RNA, 64 nt, hsa; identical to SEQ ID NO: 48276

SEQ ID NO: 525652 - RNA, 64 nt, hsa; identical to SEQ ID NO: 48277

SEQ ID NO: 525653 - RNA, 64 nt, hsa; identical to SEQ ID NO: 48278

SEQ ID NO: 525654 - RNA, 64 nt, hsa; identical to SEQ ID NO: 48279

SEQ ID NO: 525655 - RNA, 64 nt, hsa; identical to SEQ ID NO: 48280

SEQ ID NO: 525656 - RNA, 64 nt, hsa; identical to SEQ ID NO: 48281

SEQ ID NO: 525657 - RNA, 64 nt, hsa; identical to SEQ ID NO: 48282

SEQ ID NO: 525658 - RNA, 64 nt, hsa; identical to SEQ ID NO: 48283

SEQ ID NO: 525659 - RNA, 64 nt, hsa; identical to SEQ ID NO: 48284

SEQ ID NO: 525660 - RNA, 64 nt, hsa; identical to SEQ ID NO: 48285

SEQ ID NO: 525661 - RNA, 64 nt, hsa; identical to SEQ ID NO: 48286

SEQ ID NO: 525662 - RNA, 64 nt, hsa; identical to SEQ ID NO: 48287

SEQ ID NO: 525663 - RNA, 64 nt, hsa; identical to SEQ ID NO: 48288

SEQ ID NO: 525664 - RNA, 64 nt, hsa; identical to SEQ ID NO: 48289

SEQ ID NO: 525665 - RNA, 64 nt, hsa; identical to SEQ ID NO: 48290

SEQ ID NO: 525666 - RNA, 64 nt, hsa; identical to SEQ ID NO: 48291

SEQ ID NO: 525667 - RNA, 64 nt, hsa; identical to SEQ ID NO: 48292

SEQ ID NO: 525668 - RNA, 64 nt, hsa; identical to SEQ ID NO: 48293

SEQ ID NO: 525669 - RNA, 64 nt, hsa; identical to SEQ ID NO: 48294

SEQ ID NO: 525670 - RNA, 64 nt, hsa; identical to SEQ ID NO: 48295

SEQ ID NO: 525671 - RNA, 64 nt, hsa; identical to SEQ ID NO: 48296

SEQ ID NO: 525672 - RNA, 64 nt, hsa; identical to SEQ ID NO: 48297

SEQ ID NO: 525673 - RNA, 64 nt, hsa; identical to SEQ ID NO: 48298

SEQ ID NO: 525674 - RNA, 64 nt, hsa; identical to SEQ ID NO: 48299

SEQ ID NO: 525675 - RNA, 64 nt, hsa; identical to SEQ ID NO: 48300

SEQ ID NO: 525676 - RNA, 64 nt, hsa; identical to SEQ ID NO: 48301

SEQ ID NO: 525677 - RNA, 64 nt, hsa; identical to SEQ ID NO: 48302

SEQ ID NO: 525678 - RNA, 64 nt, hsa
uggaccaaaggcugaggcuuggccaucuagcauuccauacaaaauuguuuccuauaagcauucc

SEQ ID NO: 525679 - RNA, 64 nt, hsa
gaguguauuuuccuuguguauauauuaaacacacccauacaaacauugguaaaguugauuacau

SEQ ID NO: 525680 - RNA, 64 nt, hsa
uccaucccaggacacagcccagccccuccccacaccauacaagguaucagaaaagucuaggacc

SEQ ID NO: 525681 - RNA, 64 nt, hsa
cuuguccuuucagaaaacaugcaaauaccaagauccauacaaaacaauaauuuauuccacugau

SEQ ID NO: 525682 - RNA, 64 nt, hsa
cauuuuaaguuaggagucaugaauacuguauugaccauacaaguggauuaugguugucuggaug

SEQ ID NO: 525683 - RNA, 64 nt, hsa
ugaggaugguguccuggagucuuguccacccucuccauacaagucucaaaagucauccuccuac

SEQ ID NO: 525684 - RNA, 64 nt, hsa
uuuaaaagauuuagauguuuuuucagcaagcuagccauacaaccauuguaucucuuucucuuca

SEQ ID NO: 525685 - RNA, 64 nt, hsa
cccuugucagcaggggcguaagggcuggguuuggccauacaagguuggcuacgcccucaauccc

SEQ ID NO: 525686 - RNA, 64 nt, hsa
uacuccgaaaauuucaucaucuaagaaaaugauuccauacaaauaacucagcacacaagugacc

SEQ ID NO: 525687 - RNA, 63 nt, hsa
cuacauuaguaaaaauaaaaauggaauuuuuuacccauacaaauucauaaauucccugaauuc

SEQ ID NO: 525688 - RNA, 64 nt, hsa
gaguugggcaaaagcuuggguaggacaagaacuuccauacaaauuugagauagaucucgccugu

SEQ ID NO: 525689 - RNA, 64 nt, hsa
uuuaaaaaauauuaaaacgauucuuagcucagagccauacaaaaguaggcuggauucaguccau

SEQ ID NO: 525690 - RNA, 64 nt, hsa
acacacauauauauuacaagggauaauuuagaccccauacaaguuuauaaagagucauuguuau

SEQ ID NO: 525691 - RNA, 64 nt, hsa
gugcugcucuuaaauccuaccuuccacucaacucccauacaacuuucuuuuguacauuuugaua

SEQ ID NO: 525692 - RNA, 64 nt, hsa
ccuguauuaauuuuaguucaguuaaugguucagcccauacaaaggugcuauccuagggauuuua

SEQ ID NO: 525693 - RNA, 64 nt, hsa
cacagugcccacucuggaccuaagucuaguguauccauacaauuggugcagagaaauaaggugu

SEQ ID NO: 525694 - RNA, 64 nt, hsa
aaagugauacauguuuuuaauuaaagaguaaagcccauacaaguauucauuuuuucuacccuuu

SEQ ID NO: 525695 - RNA, 64 nt, hsa
uuugaggccaaugcugcuuucugguguauauucuccauacaagauuauuauuaacugcucuuuu

SEQ ID NO: 525696 - RNA, 64 nt, hsa
ucaguaucugaacuauaagcccauuuauacuguuccauacaaaagcuauuuuucaaaaauuaau

SEQ ID NO: 525697 - RNA, 64 nt, hsa
ucaccugcuucccuaccacuccucacugcauuuuccauacaaauguuucuauuuuauuguuccu

SEQ ID NO: 525698 - RNA, 64 nt, hsa
acacuagauguuaucaaucaaacacuaaaauguaccauacaaaucccuuaagccucucaaauau

SEQ ID NO: 525699 - RNA, 64 nt, hsa
gaacuaaugaauagauaaaccaaaucugguauauccauacaauggacuauauuauucagccaua

SEQ ID NO: 525700 - RNA, 64 nt, hsa
gugugucuugguuuaguuaugguuucauuucuagccauacaauugaugaauuguguacaacuuu

SEQ ID NO: 525701 - RNA, 64 nt, hsa
uuuuaaaauagcuuugcagugaaagcuuucaugaccauacaaauuaucuuuuuucuuccuauuu

SEQ ID NO: 525702 - RNA, 64 nt, hsa
ccacagaugaauuaagacaugaaguguguucuguccauacaauggaauauuauuuggccauaaa

SEQ ID NO: 525703 - RNA, 64 nt, hsa
caccugaacaccagaauuagaauuaaacauuguaccauacaauuucauuaucuuaucagaauga

SEQ ID NO: 525704 - RNA, 64 nt, hsa
cuuaguuaaaucuuuuccaggaaaaagaacuuccccauacaaauaagcaugagacuauguaaaa

SEQ ID NO: 525705 - RNA, 64 nt, hsa
uauuaaauuacacaauuacacuugucuuuacuggccauacaaaaugauuuuuuuuuuuuuuuug

SEQ ID NO: 525706 - RNA, 64 nt, hsa
acaaaugaaggacaagcauacuacauaauauaauccauacaauucucuucaguuaguguaaacu

SEQ ID NO: 525707 - RNA, 64 nt, hsa
uuuauagaucagccagugaccaaccuuuucccaaccauacaaaaauuccuuuucccgaaggaaa

SEQ ID NO: 525708 - RNA, 64 nt, hsa
gaauuuacauuuuauauuaaagaaauugagcuauccauacaaccuguauuuacuuuaauuucac

SEQ ID NO: 525709 - RNA, 64 nt, hsa
guuuuuuugccuccuguucuaauaaauuuugucuccauacaaaucugaaccccaaguguguacc

SEQ ID NO: 525710 - RNA, 64 nt, hsa
ccacggcagugaaucuucauggaucuucaugcagccauacaaacccugguuccaacagaauggu

SEQ ID NO: 525711 - RNA, 64 nt, hsa
uaauauuccuucuagucaguggaaauuuguauucccauacaaacucagaaugcuauauuuuuaa

SEQ ID NO: 525712 - RNA, 64 nt, hsa
caugaugagcacaggaacaggcaugaagauauugccauacaauuuuaauuuauacaaguauugg

SEQ ID NO: 525713 - RNA, 64 nt, hsa
ucuaauuggacacccugaagcuuaggacuaccagccauacaaauaguaaacucuguccacgauu

SEQ ID NO: 525714 - RNA, 64 nt, hsa
ccaaaaguagaaaucccugcacucaucacaaagcccauacaacucaaccaaacuuaccccugag

SEQ ID NO: 525715 - RNA, 64 nt, hsa
uacuaaacauaagguaauucauacuggagaaaagccauacaaaugagaagaauguggcaaugcc

SEQ ID NO: 525716 - RNA, 64 nt, hsa
ccgcgccccucuuuuuccccuugauggaaauugaccauacaauuucauccuccuucaggggauc

SEQ ID NO: 525717 - RNA, 64 nt, hsa
acuuuuuaccaagucuguguucuguuuaaucuguccauacaaguuauuacugagaaaguguuua

SEQ ID NO: 525718 - RNA, 64 nt, hsa
cacauuccaaaggagacauuggaccaguuaauucccauacaagucaagguaacagaacaaaagg

SEQ ID NO: 525719 - RNA, 64 nt, hsa
ccuucagcugcaagggauugaaugcuaucaacaaccauacaaguggagaagcagaugcuucccu

SEQ ID NO: 525720 - RNA, 64 nt, hsa
uuguuuucuagagcaagauaauaaaggagaugggccauacaaauguuuucuacuuucguuguga

SEQ ID NO: 525721 - RNA, 64 nt, hsa
auccucccccuaugcauugguuuuuuucccuguaccauacaauucuacuguaacuacccaucaa

SEQ ID NO: 525722 - RNA, 64 nt, hsa
caaucggggaugcagacaaguggcuacaaacuuuccauacaacaggugaagauaacgagacuuu

SEQ ID NO: 525723 - RNA, 64 nt, hsa
guugugaauuauggaucaggguucuuuuuuucccccauacaaguauccagucauuguaacacug

SEQ ID NO: 525724 - RNA, 64 nt, hsa
guuuaccaaucaacagcaugucuacugcuuggauccauacaaaacuaucgguucaaguugaugu

SEQ ID NO: 525725 - RNA, 64 nt, hsa
uucagguaauauguuuaaagauauuuauauauugccauacaaaaacuuaacauuuaaaacugau

SEQ ID NO: 525726 - RNA, 64 nt, hsa
cccucccagugcuggcuccaggcuccucguguggccauacaagggugcugugguuuugucccuu

SEQ ID NO: 525727 - RNA, 64 nt, hsa
uaguagaauauaagauaaaagaggcugagaauuaccauacaaggguauuacaacuguaaaacaa

SEQ ID NO: 525728 - RNA, 64 nt, hsa
cagguguuugccaugugguaccuacauagaaucuccauacaacacacagguaacagguuauaca

SEQ ID NO: 525729 - RNA, 64 nt, hsa
caucuguguuuaguacacaugcaugcauacacacccauacaaacaucugugugagggcaguucu

SEQ ID NO: 525730 - RNA, 64 nt, hsa
augaauuggcuucuaggggucugaaccuuacugcccauacaaguguugauucauuuuaaugcug

SEQ ID NO: 525731 - RNA, 64 nt, hsa
agucugccacaugccaaacaauguuagguacuuuccauacaacgaaucuauuauucccaucuua

SEQ ID NO: 525732 - RNA, 64 nt, hsa
ucugcuugggucacauugccaauguccucucagcccauacaaguggcaggaccaggcccaauau

SEQ ID NO: 525733 - RNA, 64 nt, hsa
cugugggaucuauuacugcaggccgguguauauaccauacaaaagaggaccacacaucuguugg

SEQ ID NO: 525734 - RNA, 64 nt, hsa
caaaucagcuuccacuuagcauuaggaggucaugccauacaacucacguaugcgggcaaacacu

SEQ ID NO: 525735 - RNA, 64 nt, hsa
ugaucaagugugagacaguuugaagacugugcuaccauacaaagugaaugaagccagugacuaa

SEQ ID NO: 525736 - RNA, 64 nt, hsa
cucugcugcuccucccccacccccaccuuccacuccauacaaucugggccugguggagucuucg

SEQ ID NO: 525737 - RNA, 64 nt, hsa
agccauaaggcuuuggaguuaaaccacaguaucaccauacaaguauuuguuuaucauuauuuug

SEQ ID NO: 525738 - RNA, 64 nt, hsa
ucuguuuuccauuuccauugcaauacuacuaaagccauacaauaucaagcacccucccucuagg

SEQ ID NO: 525739 - RNA, 64 nt, hsa
ucuuccuacuagaacauuuuauuuuccuuguucaccauacaaucauguacucuuuaacagaaau

SEQ ID NO: 525740 - RNA, 64 nt, hsa
aauacuuuaccuuagaucuuugagggcaugcuucccauacaaagagcaucagaaaaucagggca

SEQ ID NO: 525741 - RNA, 64 nt, hsa
gaggggaggagaacugcucacuccuuuucccuccccauacaaacucaaaguccccugggcccca

SEQ ID NO: 525742 - RNA, 64 nt, hsa
aacugaagaaaaaaaaaaaacaggaaaaaaagaaccauacaaaauuuuuccaccacacauaccc

SEQ ID NO: 525743 - RNA, 64 nt, hsa
cuacauauuugugguuaagguuagacuauaugauccauacaaauuaaagugagagacaugguua

SEQ ID NO: 525744 - RNA, 64 nt, hsa
gauguuuguucaccauggggaccauuacauaugaccauacaaugcacugaauugacagguuaau

SEQ ID NO: 525745 - RNA, 64 nt, hsa
uaacauaggucuaauuuauuugccgugucauuuuccauacaaaucaguugauuuaaaaaaguuc

SEQ ID NO: 525746 - RNA, 64 nt, hsa
ugugguuugagcacuggguucuuuuagccaaauuccauacaaaaagaauuuggauguuuuccag

SEQ ID NO: 525747 - RNA, 64 nt, hsa
ccgacaaagaagacaaaauagcauugaaacuaacccauacaaaauauccaacucuggauucugu

SEQ ID NO: 525748 - RNA, 64 nt, hsa
uguacauacacucaggaagguaguacaagauacuccauacaacacaaccaugugcuauuuauca

SEQ ID NO: 525749 - RNA, 64 nt, hsa
cagcacgcuuuacuuaguagccgguucccauuugccauacaauguagguucugcuuaauguaac

SEQ ID NO: 525750 - RNA, 64 nt, hsa
ccacugucacucagaagggcaagcuaggcagggcccauacaacagcaggggucugcagguuaga

SEQ ID NO: 525751 - RNA, 64 nt, hsa
gauuuaugcugacuuaacuguuuaccuauaaaccccauacaaagcagggucauaauuugugauc

SEQ ID NO: 525752 - RNA, 64 nt, hsa
aaacaaaucuuucuucauuuaugaauuucuuacuccauacaagcaguuuauggaugucugggca

SEQ ID NO: 525753 - RNA, 64 nt, hsa
uuauuugcucagguaucaugcugucuguacaguuccauacaacaaggaggugaaaucagagaua

SEQ ID NO: 525754 - RNA, 64 nt, hsa
uguuuucuuauugcacugaauucaacuccagacaccauacaaagggagaugauggccauuccgu

SEQ ID NO: 525755 - RNA, 64 nt, hsa
ugagaaacagaguuauuaaguaaguugccagaagccauacaaguacaaagugucaaggggagac

SEQ ID NO: 525756 - RNA, 64 nt, hsa
gaagcagugauacucccuggcucgguuauuuucuccauacaaugcacacaugguacaaugauag

SEQ ID NO: 525757 - RNA, 64 nt, hsa
cucccauaggaaauagaauuacagguaagguacaccauacaaaaauugugucauugaggacaau

SEQ ID NO: 525758 - RNA, 64 nt, hsa
accuguugaaaaaaacugguucuccaccccucccccauacaaaauccacaacaaagcgcagugg

SEQ ID NO: 525759 - RNA, 64 nt, hsa
cuccuauaccgcacauaaauagauuucagagcccccauacaaugggcagugucugcuauagggc

SEQ ID NO: 525760 - RNA, 64 nt, hsa
aaaaccacuaaguuagaucucuaccucacaguguccauacaaauuaguuccagagggaagauau

SEQ ID NO: 525761 - RNA, 64 nt, hsa
cacuggaguuaauuagucuuagaaaugugugcauccauacaaaugcacaacauaaagugaacau

SEQ ID NO: 525762 - RNA, 64 nt, hsa
auuuagcauuauaauacaucuuggcuaaauaauaccauacaaucuagugucaaaaacauaaaug

SEQ ID NO: 525763 - RNA, 64 nt, hsa
uuguuuacaacauuuuugcaaaucuaaaguugcuccauacaaugacuagucaccuggggggguu

SEQ ID NO: 525764 - RNA, 64 nt, hsa
uaaacaugaauauugaauacugacaagagaauacccauacaaaucgucccaccgcccuagaggc

SEQ ID NO: 525765 - RNA, 64 nt, hsa
uuacacaauagcagagaauauaaacugaaaaaauccauacaaauauuaaaaauguggcaaauua

SEQ ID NO: 525766 - RNA, 64 nt, hsa
aaagagugaccugcacaaacuuggaauuuuuuuuccauacaacccugacccauuuacuguauuu

SEQ ID NO: 525767 - RNA, 64 nt, hsa
uacaagugguuuaacaugcauuaucuuacucaauccauacaaaagucuuauggagguguuagca

SEQ ID NO: 525768 - RNA, 64 nt, hsa
aacuugaaauauauaauauucagccagcuuaaacccauacaauguauguacaauacaauguaca

SEQ ID NO: 525769 - RNA, 64 nt, hsa
uacaaaaugcuuuguagaccccauugucuuuaaaccauacaacaugcccgugaagcugaucugg

SEQ ID NO: 525770 - RNA, 64 nt, hsa
ucuacgauggagcauuuuuugagaagaaacuaaaccauacaaaguguuggcaacguagggaugg

SEQ ID NO: 525771 - RNA, 64 nt, hsa
cuaaaacuuggauauuugugaaaacuccuuaccaccauacaagcaucagaagagcucucuuguu

SEQ ID NO: 525772 - RNA, 64 nt, hsa
auucuagacugcuuucacuuauuucauuuccuccccauacaaauuugaugagcagguacacacu

SEQ ID NO: 525773 - RNA, 64 nt, hsa
ucaaccaauggcauccagagagggcauggaggcuccauacaaccucuuccacccccacaucuuu

SEQ ID NO: 525774 - RNA, 64 nt, hsa
uaccagaugaaaggauaaacaaaauaugguccauccauacaauggaguauuacacagccauaaa

SEQ ID NO: 525775 - RNA, 64 nt, hsa
acuccuaguaaacauaauuaaugauggagagaaaccauacaacugugaagaauguggcaaagcu

SEQ ID NO: 525776 - RNA, 64 nt, hsa
aacacacacccauuaucugugugugccugggaguccauacaauguccauacaugggugaacucu

SEQ ID NO: 525777 - RNA, 64 nt, hsa
uaccagaugaaaggauaaacaaaaugugguccauccauacaauggaguauuacacagccauaaa

SEQ ID NO: 525778 - RNA, 64 nt, hsa
agcuuauucugagacagacauuccuggcaauguaccauacaaaaaauaagccaacucugacauu

SEQ ID NO: 525779 - RNA, 64 nt, hsa
gucucacuaggcaucaaaaacuuuuuugaugaaaccauacaaauguaacgugcaugcuuaagcu

SEQ ID NO: 525780 - RNA, 64 nt, hsa
ugugagucaucaaagaauuuauaucagagagaaaccauacaaguauaauaaauguggcaagguu

SEQ ID NO: 525781 - RNA, 64 nt, hsa
aauaaaaaucaagaagaacacuuuucucccuuuuccauacaaauuaaaacuuaacagcaucaaa

SEQ ID NO: 525782 - RNA, 64 nt, hsa
acugaggcauagggagaggaaguuaauuucagagccauacaaaaauaagccacaaccagcuuca

SEQ ID NO: 525783 - RNA, 64 nt, hsa
ugauuccuggaugaucauacacagaggacuuacaccauacaaaaauauugggcaccgcagugcc

SEQ ID NO: 525784 - RNA, 64 nt, hsa
uagaguuacaagccccuggaaaagggagcaggucccauacaaucagccuuucuccucuucucuu

SEQ ID NO: 525785 - RNA, 64 nt, hsa
uucuaaagcaagugaccugaaggcucugggcucaccauacaacacccacguuguuuauuucaaa

SEQ ID NO: 525786 - RNA, 64 nt, hsa
uauuggagcauacaguacugcggugugucuccucccauacaaagggacacauccuuauuuugag

SEQ ID NO: 525787 - RNA, 64 nt, hsa
uggccaacaggaccaaccaagcaccuuaccucucccauacaagaugacccucugagcuuuucau

SEQ ID NO: 525788 - RNA, 64 nt, hsa
ucugugccugcauaaugcugacaccugcuuguuuccauacaaauugauaucaaaauaaaauuug

SEQ ID NO: 525789 - RNA, 64 nt, hsa
uuaagaggcuuagauugguauucauacuuauuuaccauacaaaaguaugguaccuuaaagcuuu

SEQ ID NO: 525790 - RNA, 64 nt, hsa
acucccauuugagacuuuccggacauacgcagcaccauacaauauuucacaagcaauggaaaag

SEQ ID NO: 525791 - RNA, 64 nt, hsa
agguaagugaaugccaaagucuucuuuuuucagaccauacaagaagucauuuugauuuucaaag

SEQ ID NO: 525792 - RNA, 64 nt, hsa; identical to SEQ ID NO: 286377

SEQ ID NO: 525793 - RNA, 64 nt, hsa; identical to SEQ ID NO: 286378

SEQ ID NO: 525794 - RNA, 64 nt, hsa; identical to SEQ ID NO: 286379

SEQ ID NO: 525795 - RNA, 64 nt, hsa; identical to SEQ ID NO: 286380

SEQ ID NO: 525796 - RNA, 64 nt, hsa; identical to SEQ ID NO: 286381

SEQ ID NO: 525797 - RNA, 64 nt, hsa; identical to SEQ ID NO: 286382

SEQ ID NO: 525798 - RNA, 64 nt, hsa; identical to SEQ ID NO: 286383

SEQ ID NO: 525799 - RNA, 64 nt, hsa; identical to SEQ ID NO: 286384

SEQ ID NO: 525800 - RNA, 64 nt, hsa
ugaaccuguaaaaacaaaacaaacaaaacaaaacaaaaaagacaaaaccuaaaacugagcuauc

SEQ ID NO: 525801 - RNA, 64 nt, hsa
gcaauuuuugaagaucuuaaauguuccuuuuuaaaaaaaagaauuguguuauagguuacaaaau

SEQ ID NO: 525802 - RNA, 64 nt, hsa
auagauaagaaaagguggggcuauacuagcaacaaaaaaagaaugcuguuccugcaccugccgg

SEQ ID NO: 525803 - RNA, 64 nt, hsa
uauauuaaaacagagauaugugcaugaaaucaagaaaaaagaaaugaacaaaagcaaagcauua

SEQ ID NO: 525804 - RNA, 64 nt, hsa
cauuuugcuaaagcaugacuaaacugcaaaaaaaaaaaaagagcuacuguauuuagacuuagga

SEQ ID NO: 525805 - RNA, 64 nt, hsa
aagagauuaauaucuccaugcauaguuuuagacaaaaaaagauguuucaauaaaauuacugucu

SEQ ID NO: 525806 - RNA, 64 nt, hsa
aucuccauuuuuuuuuuaaugauuuuuuaauuaaaaaaaagaacaacaggauagagcuguuggg

SEQ ID NO: 525807 - RNA, 64 nt, hsa
gagcccagagaagcccccuacauccccccgggaaaaaaaagaaaacuagacagaaacucaucua

SEQ ID NO: 525808 - RNA, 64 nt, hsa
ccaggccaccauauuuagaacuaguuaccuuauuaaaaaagaaaaaacagucuguuggcuucuc

SEQ ID NO: 525809 - RNA, 64 nt, hsa
acugagcgagacucuaucucaaaacaaucaaaacaaaaaagaccuguggacucuaguagauuuu

SEQ ID NO: 525810 - RNA, 64 nt, hsa
aaaugcacucauguuaggaaggucaaaaaaaaggaaaaaagaaaaauaauaaaaaauaauaaaa

SEQ ID NO: 525811 - RNA, 64 nt, hsa
auuuaauaugugcccagauuauucuaaaaucuuaaaaaaagaugcauauagugaaauuuuuuaa

SEQ ID NO: 525812 - RNA, 64 nt, hsa
gacaguucagugcauauauaguagaagccuuaagaaaaaagaaaaugagcaagcaaauauuuga

SEQ ID NO: 525813 - RNA, 64 nt, hsa
ugugugugugucucugcauguguaaaagaaggguaaaaaagagauggguaggguagaacuacuu

SEQ ID NO: 525814 - RNA, 64 nt, hsa
uaauucuuaauauuaccucucuuggaaagacacaaaaaaagagcuguuauuuuuaggcauaaga

SEQ ID NO: 525815 - RNA, 64 nt, hsa
gaaccugggcuaaugggagacuguagagaaaaugaaaaaagauccaccagaggacaucuugggg

SEQ ID NO: 525816 - RNA, 64 nt, hsa
uguccuaauguugcuacucccauggcaaagaaaaaaaaaagaaugaaaaaaagaaaaaaauuug

SEQ ID NO: 525817 - RNA, 64 nt, hsa
gcuacucccauggcaaagaaaaaaaaaagaaugaaaaaaagaaaaaaauuuggaaaaaaaaauc

SEQ ID NO: 525818 - RNA, 64 nt, hsa
aaauuguauguuacuuauuuccagaaucucgaagaaaaaagaaaaaagagugguauuauuaugg

SEQ ID NO: 525819 - RNA, 64 nt, hsa
auguuacuuauuuccagaaucucgaagaaaaaagaaaaaagagugguauuauuaugggcaaaua

SEQ ID NO: 525820 - RNA, 64 nt, hsa
cuccagcuugggcgacagagugagacuccgucucaaaaaagaaaaaaaaaagaugcuccucuga

SEQ ID NO: 525821 - RNA, 64 nt, hsa
gcgacagagugagacuccgucucaaaaaagaaaaaaaaaagaugcuccucugaggucccuccgg

SEQ ID NO: 525822 - RNA, 64 nt, hsa
uccagccuggguaacagagcaagacuccaucucaaaaaaagaaagaaagaaaaaagaaaguaca

SEQ ID NO: 525823 - RNA, 64 nt, hsa
agagcaagacuccaucucaaaaaaagaaagaaagaaaaaagaaaguacaaguuuauaaaguauu

SEQ ID NO: 525824 - RNA, 64 nt, hsa
aaguaaucccagaacaauggcuauucaugugggaaaaaaagaaauuuuacuuucucucaccuua

SEQ ID NO: 525825 - RNA, 64 nt, hsa
aagcauacguauacaauaaaacuaugcuauuaaaaaaaaagaagguaacugauaaaccaaaauu

SEQ ID NO: 525826 - RNA, 64 nt, hsa
gauauauuuuccuuucugacacauaauuuggggcaaaaaagaaagucuuaagaguuuaucuuuu

SEQ ID NO: 525827 - RNA, 64 nt, hsa
cuggaucaucccauucugguucccguucaaguucaaaaaagaaauaauguauuaaaauuuacau

SEQ ID NO: 525828 - RNA, 64 nt, hsa
uaugucaaacucuucuguuucuccaaauauaaggaaaaaagacuaaagcaagagaucuggcagu

SEQ ID NO: 525829 - RNA, 64 nt, hsa
uauauaagaagaacaaccuauuucgcucccagaaaaaaaagaucaaagagcuuucagaaacuuu

SEQ ID NO: 525830 - RNA, 64 nt, hsa
uagcaaauuaaguuauuuuccuaaaaaaaaaagaaaaaaagaauucagaacuacuuuccucugu

SEQ ID NO: 525831 - RNA, 64 nt, hsa
gaugaauuuagcaaauuaaguuauuuuccuaaaaaaaaaagaaaaaaagaauucagaacuacuu

SEQ ID NO: 525832 - RNA, 64 nt, hsa
aacaaugguuucucugcguuaauuauugaggaaaaaaaaagaugggguaagaaaacuacccaug

SEQ ID NO: 525833 - RNA, 64 nt, hsa
aauauguaaagcaauuguaggaaauuugaaaggaaaaaaagaaaccgaagccaguauuuuaaua

SEQ ID NO: 525834 - RNA, 64 nt, hsa
aacacauuagagguacaggagcggcucagucaugaaaaaagaaggucuuuugccccauuucuuu

SEQ ID NO: 525835 - RNA, 64 nt, hsa
guaacacagcaagacucuaucucaaaaaaaagaaaaaaaagaaauacauagaguucagucccua

SEQ ID NO: 525836 - RNA, 64 nt, hsa
ccacccuggguaacacagcaagacucuaucucaaaaaaaagaaaaaaaagaaauacauagaguu

SEQ ID NO: 525837 - RNA, 64 nt, hsa
ucucacuucuacuccugcucuccuaguuccccccaaaaaagaaauacugaccagugucucuacu

SEQ ID NO: 525838 - RNA, 64 nt, hsa
uccagccugggugacagagcaagacccugucuuaaaaaaagaggauucaacacauauuuuuaua

SEQ ID NO: 525839 - RNA, 64 nt, hsa
ggacaacauagugagaccuugucuccacaaaaauaaaaaagaaacuauccaggagugguggugu

SEQ ID NO: 525840 - RNA, 64 nt, hsa
ugaguguaugaauuugucacauguaucacccccaaaaaaagagaaaaagaaaaauagaagacau

SEQ ID NO: 525841 - RNA, 64 nt, hsa
uauuaguauaaacucauaauaaacucugccuuuaaaaaaagauaaauauuuccuacgucuguuc

SEQ ID NO: 525842 - RNA, 64 nt, hsa
cauuacacauaguaaacuuucuuuaaaaaaaaaaaaaaaagauuuuggagacuaccaggguaag

SEQ ID NO: 525843 - RNA, 64 nt, hsa
ugcaugccacgcacuguguugggcuuaguaauaaaaaaaagaaaagauaagugcuuguucuagc

SEQ ID NO: 525844 - RNA, 64 nt, hsa
aaaaaaagaaaaaaaaagaaaaaagagggaggaaaaaaaagaaccuacuuaagauagaacaugg

SEQ ID NO: 525845 - RNA, 64 nt, hsa
uggucuggggagagauuuuauuaaaaaaaaaaagaaaaaagagggaggaaaaaaaagaaccuac

SEQ ID NO: 525846 - RNA, 64 nt, hsa
gugaugauggucuggggagagauuuuauuaaaaaaaaaaagaaaaaagagggaggaaaaaaaag

SEQ ID NO: 525847 - RNA, 64 nt, hsa
gugacagagaaggacuccgucucaaaaaaaaaagaaaaaagaauagucauuuuuaaacuaccua

SEQ ID NO: 525848 - RNA, 64 nt, hsa
agccugggugacagagaaggacuccgucucaaaaaaaaaagaaaaaagaauagucauuuuuaaa

SEQ ID NO: 525849 - RNA, 64 nt, hsa
aguauuuuuuuuuaauuuugauauacauugugugaaaaaagaaaauggcuaauaaacuguauua

SEQ ID NO: 525850 - RNA, 64 nt, hsa
caauccugguaaccaaauauuaaagauucucuuuaaaaaagacugaacauguuuacagguuuga

SEQ ID NO: 525851 - RNA, 64 nt, hsa
gaagcaacuucaguucuuuuacugcaaagaacagaaaaaagaaagaaagcaaacaagaagacuc

SEQ ID NO: 525852 - RNA, 64 nt, hsa
aggugaaaaaacaaugcauucuugcuuuaaaaaaaaaaaagaaggcuaaaaaauuaccucuuuu

SEQ ID NO: 525853 - RNA, 64 nt, hsa
uuuuucugugggaaucacaagaguuuauccacuaaaaaaagauauguaaaaaagauacuuucca

SEQ ID NO: 525854 - RNA, 64 nt, hsa
aucacaagaguuuauccacuaaaaaaagauauguaaaaaagauacuuuccagcacauaaauaaa

SEQ ID NO: 525855 - RNA, 64 nt, hsa
uacagaagcaucacauuuaaaccaaugugaauucaaaaaagagaaggaaacuuuuuaaauucaa

SEQ ID NO: 525856 - RNA, 64 nt, hsa
aaggaaacuuuuuaaauucaauuuagaguacauaaaaaaagaaauccgcgaagcauugagggga

SEQ ID NO: 525857 - RNA, 64 nt, hsa
gaauuauguaaaguuguuaagagacauacccucuaaaaaagaacuuuagcaugguauugaagga

SEQ ID NO: 525858 - RNA, 64 nt, hsa
ucgauaaaucuaacaguuacucuuaaaaaaaaaaaaaaaagacuaagguggauuuuaaaaauug

SEQ ID NO: 525859 - RNA, 64 nt, hsa
ugauuguucauuuuuuucugcuacuuuuggguagaaaaaagauucaauugcuuggcuguagcuu

SEQ ID NO: 525860 - RNA, 64 nt, hsa
uuacauguguuucugggaacaaggaaaauuucucaaaaaagaauauuucacacaucccuucuuu

SEQ ID NO: 525861 - RNA, 64 nt, hsa
ugucaggugugcaugaagaaaagacacugaagcuaaaaaagacagcagaacugcuauuuuucau

SEQ ID NO: 525862 - RNA, 64 nt, hsa
ggcacuguacuaaccuacagagaugcuaagagaaaaaaaagacuuguuucugaucuaauauccc

SEQ ID NO: 525863 - RNA, 64 nt, hsa
uguuuucuuuuuucuagaaaacacuuuccuggauaaaaaagaaaacauuccagaugcaugaucc

SEQ ID NO: 525864 - RNA, 64 nt, hsa
guuugacauuuaauaacuuugcuggaaaaucuguaaaaaagaaaaacaaguuugcuagugacua

SEQ ID NO: 525865 - RNA, 64 nt, hsa
agcagccacugcaagcucugaaucaguuuuuuaaaaaaaagaaaaaaaaaaaaaaggagcugug

SEQ ID NO: 525866 - RNA, 64 nt, hsa
ggcuaaaacguuuuuauagagaaucuuguuuuucaaaaaagaauaaaaaguuugaauagcuauu

SEQ ID NO: 525867 - RNA, 64 nt, hsa
ggcacaacacaaaaaccaacacaaaacauaacacaaaaaagaagcuaccuaugauccuggauuu

SEQ ID NO: 525868 - RNA, 64 nt, hsa
aaauaaaaacaaguaucucaugcucuuguuucucaaaaaagaaaaacaaaaaacaaaaaacagg

SEQ ID NO: 525869 - RNA, 64 nt, hsa
uauagugcaaauuauuuguaugcuucaaaaaaaaaaaaaagagagaaacaaaaaagugugacau

SEQ ID NO: 525870 - RNA, 64 nt, hsa
aagguaucaauguaccuuuuuugguaguggaaaaaaaaaagacaggcugccacaguauauuuuu

SEQ ID NO: 525871 - RNA, 64 nt, hsa
uucuuaagacuugcauuuaaaugugacauucuuaaaaaaagaagagaaagaauuuuaagaguag

SEQ ID NO: 525872 - RNA, 64 nt, hsa
agccuucuuaaaugacaaauguaaaaaaaaaaaaaaaaaagacucuacuucgugcagcaauugc

SEQ ID NO: 525873 - RNA, 64 nt, hsa
ugccauggauaaaauugggucuuucuggcuaauuaaaaaagacaacuuuauaaaauggcacuuu

SEQ ID NO: 525874 - RNA, 64 nt, hsa
caauagagcgagacuccgucucaaaaaaaaaaaaaaaaaagaaagaaauagcauugaagaaaau

SEQ ID NO: 525875 - RNA, 64 nt, hsa
agacuucagcagcaaaccaaaacagcagguuaaaaaaaaagaugcuuuuuugggugcaagucua

SEQ ID NO: 525876 - RNA, 64 nt, hsa
uuuucuuuuuuauaaaaaaagagagaugggggagaaaaaagacaagagggaaaguauuucucuu

SEQ ID NO: 525877 - RNA, 64 nt, hsa
caccuucucucugacugcacuuuucuuuuuuauaaaaaaagagagaugggggagaaaaaagaca

SEQ ID NO: 525878 - RNA, 64 nt, hsa
caaauguuaugaugcaaaaaaagaaaaagaaaaaaaaaaagaaaagaaaacuucaauuuucugg

SEQ ID NO: 525879 - RNA, 64 nt, hsa
aaaacaaaagauuuuuaucaaauguuaugaugcaaaaaaagaaaaagaaaaaaaaaaagaaaag

SEQ ID NO: 525880 - RNA, 64 nt, hsa
aucgacuggagaagaaaaaaaagaaaaaagauagaaaaaagaaaaaguuucagaagagcagaag

SEQ ID NO: 525881 - RNA, 64 nt, hsa
caggaaauuagaucgacuggagaagaaaaaaaagaaaaaagauagaaaaaagaaaaaguuucag

SEQ ID NO: 525882 - RNA, 64 nt, hsa
ccaauuacaggaaauuagaucgacuggagaagaaaaaaaagaaaaaagauagaaaaaagaaaaa

SEQ ID NO: 525883 - RNA, 64 nt, hsa
uguacuaaaaaaaaaaaaaaagaaaaagaaaaagaaaaaagaauacccaggugugguagugcau

SEQ ID NO: 525884 - RNA, 64 nt, hsa
aacguggugaaacccggucuguacuaaaaaaaaaaaaaaagaaaaagaaaaagaaaaaagaaua

SEQ ID NO: 525885 - RNA, 64 nt, hsa
auaaguuccaaaaauaccauuuaucuacuauuugaaaaaagaagaggauaucccuuccuacagu

SEQ ID NO: 525886 - RNA, 64 nt, hsa
guuauaacaccaucuggagucuuccuguaguggcaaaaaagaacaguguugaaauuggaaagga

SEQ ID NO: 525887 - RNA, 64 nt, hsa
aaugaauacuuaccuuagaaauauucaccuuaggaaaaaagacuuugcucugcccuuuuauauu

SEQ ID NO: 525888 - RNA, 64 nt, hsa
aaagagaccaauaaaaauaaaaaaaauaaaaaaaaaaaaagacgaacuauuggaggugguggcc

SEQ ID NO: 525889 - RNA, 64 nt, hsa
uagcuuuugacugcuuucccaaaggcccugcugcaaaaaagaaguaugucaguuauaauaaccu

SEQ ID NO: 525890 - RNA, 64 nt, hsa
guaccacugcacaucauguuuuuuuuuuuaagacaaaaaagauguuuaaagaccaaaaacugug

SEQ ID NO: 525891 - RNA, 64 nt, hsa
ugcaaaaucucuacugcuuuggauccugggucaaaaaaaagaaaaaaaaaagaaaugcaaaacu

SEQ ID NO: 525892 - RNA, 64 nt, hsa
uacugcuuuggauccugggucaaaaaaaagaaaaaaaaaagaaaugcaaaacuuuaggcccugc

SEQ ID NO: 525893 - RNA, 64 nt, hsa
agauacaugucuuucuccagggacauguggaaaaaaaaaagauguuauacaaccaucaaagugg

SEQ ID NO: 525894 - RNA, 64 nt, hsa
ggguaucccaaaaauaaaacuauccuuuuggaaaaaaaaagauuuaaaauaauuccugguuuga

SEQ ID NO: 525895 - RNA, 64 nt, hsa
acaaacaaacaaaaacaaauuuuaagaacacaacaaaaaagauuugacuuccgaauagaauguu

SEQ ID NO: 525896 - RNA, 64 nt, hsa
guguacuguguaagccuugcaaacaaaaaacaacaaaaaagaagcagcagcagcagccugcugu

SEQ ID NO: 525897 - RNA, 64 nt, hsa
aaauccaagucugaacgggaaugcccucauucaaaaaaaagaacuuugaaagagaaucuuucug

SEQ ID NO: 525898 - RNA, 64 nt, hsa
acacaccaaaaaagugaaagagaaauugaaagggaaaaaagacaaaaagcauaaggcuccaaaa

SEQ ID NO: 525899 - RNA, 64 nt, hsa
cacucagggcuggggccaagaggaaaaacagggaaaaaaagaaaaaaaaaagaaaaaggaaaag

SEQ ID NO: 525900 - RNA, 64 nt, hsa
ggggccaagaggaaaaacagggaaaaaaagaaaaaaaaaagaaaaaggaaaaggaagcggugug

SEQ ID NO: 525901 - RNA, 64 nt, hsa
cacccaccuuaacucuuucuugucaggaguauauaaaaaagaaagaaaacaaaacucgcccuac

SEQ ID NO: 525902 - RNA, 64 nt, hsa
uaugcagguagcaaagauguaauaaauuugcuuaaaaaaagaaauuaaaguuuuauuuagaauc

SEQ ID NO: 525903 - RNA, 64 nt, hsa
ccagaaagacuauauauuguuuuuuuuuuaaaaaaaaaaagaagaaaaaagagacagagaaaau

SEQ ID NO: 525904 - RNA, 64 nt, hsa
uauauauuguuuuuuuuuuaaaaaaaaaaagaagaaaaaagagacagagaaaauugguauuuau

SEQ ID NO: 525905 - RNA, 64 nt, hsa
cuaggaaaagguuaaacuggauuuuuuuuuuuaaaaaaaagaaaaaaaaagaagaaaaguauac

SEQ ID NO: 525906 - RNA, 64 nt, hsa
guuaaacuggauuuuuuuuuuuaaaaaaaagaaaaaaaaagaagaaaaguauaccagauaccaa

SEQ ID NO: 525907 - RNA, 64 nt, hsa
aauguuuauugcuguuuugucuuucuuuuuucuaaaaaaagaaaaaaaagaaaaaaaggaaaag

SEQ ID NO: 525908 - RNA, 64 nt, hsa
ugcuguuuugucuuucuuuuuucuaaaaaaagaaaaaaaagaaaaaaaggaaaagaagaacaaa

SEQ ID NO: 525909 - RNA, 64 nt, hsa
auaaggugaugucggaaacacgcaaaacaaaacgaaaaaagauuucucaguauacacaacugaa

SEQ ID NO: 525910 - RNA, 64 nt, hsa
agaguaucuguaaauaaaaggguuccaaccuuuuaaaaaagaaggaaaaaacuuuuuggugcuc

SEQ ID NO: 525911 - RNA, 64 nt, hsa
ggaaacuugccccuuauuuaaaaaaaaaaaagaaaaaaaagaguuuguuacucuauuguauguu

SEQ ID NO: 525912 - RNA, 64 nt, hsa
cugaucuuuggaaacuugccccuuauuuaaaaaaaaaaaagaaaaaaaagaguuuguuacucua

SEQ ID NO: 525913 - RNA, 64 nt, hsa
cuauaagcuagucuuguuuguaaaaaaaaaaaaaaaaaaagaaaaagaaaaaaguguauuuuac

SEQ ID NO: 525914 - RNA, 64 nt, hsa
agacacaaguuuggcccuaucaaaaacgaugaggaaaaaagauugcacuccaggauuaggaggu

SEQ ID NO: 525915 - RNA, 64 nt, hsa
aagaaaagaaacaugguucaaauuauaucuaaacaaaaaagaauaagaaacaaaaaacacauua

SEQ ID NO: 525916 - RNA, 64 nt, hsa
acuccagccuggugacagagugagacucuguuucaaaaaagaaaagaaaagaaacaugguucaa

SEQ ID NO: 525917 - RNA, 64 nt, hsa
gccugggcaacagagugagacuccaucucaaaaaaaaaaagagagagagaugaaaagaguagga

SEQ ID NO: 525918 - RNA, 64 nt, hsa
gggugacagagccagacucugucucaaaaaaaaaaaaaaagaaaagaaaaagauaaagggauug

SEQ ID NO: 525919 - RNA, 64 nt, hsa
caugcuuagucuaaagacuguagcaaaaaaaaaaaaaaaagaaaaauuagauuuuacauaucuu

SEQ ID NO: 525920 - RNA, 64 nt, hsa
acguccugccagaaagagaaugaaugacagaaaaaaaaaagagagacaaacucuaggaacaaug

SEQ ID NO: 525921 - RNA, 64 nt, hsa
guucugugacaaaaaaaaaaaaaaaaaaaagaaaaaaaaagaaaaaacagaaauauauccagcu

SEQ ID NO: 525922 - RNA, 64 nt, hsa
ugcaaacaguguucugugacaaaaaaaaaaaaaaaaaaaagaaaaaaaaagaaaaaacagaaau

SEQ ID NO: 525923 - RNA, 64 nt, hsa
uuuggacaaaccuugaaaauguuuauuuaaaaaaaaaaaagaugacaaagaaaaacagagagag

SEQ ID NO: 525924 - RNA, 64 nt, hsa
caaaaaaaaaccccacgaaauuuaaagauggggaaaaaaagaugguauaaaaauggcucugguu

SEQ ID NO: 525925 - RNA, 64 nt, hsa
cagaacaagugcugggucugucacagagaaguuuaaaaaagaaaacuaagauuauaaauuagca

SEQ ID NO: 525926 - RNA, 64 nt, hsa
ucucaaaaaaaaaaaaaaaaaaaaaaaaaaaaaaaaaaaagaaaagagaaaaaaaagacuagcc

SEQ ID NO: 525927 - RNA, 64 nt, hsa
aaaaaaaaaaaaaaaaaaaaaaaagaaaagagaaaaaaaagacuagccagccaggaagaugaau

SEQ ID NO: 525928 - RNA, 64 nt, hsa
gggugacagaguaacacucugucucagaaaaaaaaaaaaagaaaaauauaugggguaaauacag

SEQ ID NO: 525929 - RNA, 64 nt, hsa
guguauaccuauguuaaugaaacaacagaaguacaaaaaagaauaucagauacaaaaaucaauc

SEQ ID NO: 525930 - RNA, 64 nt, hsa
aaaacccaaguuuuuaaucguuuuuguuuuaaggaaaaaagauuuuuaaaaugaaucuuaugca

SEQ ID NO: 525931 - RNA, 64 nt, hsa
uuuugaccaguuucuuuucuuuuguuuuuuuuuuaaaaaagacauuuaaagacaaagacauuau

SEQ ID NO: 525932 - RNA, 64 nt, hsa
caggaagguaaugguuugaguagccuuuguuuaaaaaaaagacuaaauauauuuaaaaggccac

SEQ ID NO: 525933 - RNA, 64 nt, hsa
caaccugggugaugaagugagacucuccaaaaaaaaaaaagaaauuauuaaucccugccugugc

SEQ ID NO: 525934 - RNA, 64 nt, hsa
ucuagccuagacaacauagugagacuuggucucuaaaaaagaaaaaaaaaaauaaaacugaugu

SEQ ID NO: 525935 - RNA, 64 nt, hsa
uaaaaaguguauaugcaguaugauaccacuuuuaaaaaaagauaaauuuauagaaaaaaguuua

SEQ ID NO: 525936 - RNA, 64 nt, hsa
caaaaacuucucgaaccgcugugucuccuacguaaaaaaagagauguacaaaucaauaauaauu

SEQ ID NO: 525937 - RNA, 64 nt, hsa
uccagccuaggcaacagagugagacuuugucucaaaaaaagagaaauuuuccuuaauaagaaaa

SEQ ID NO: 525938 - RNA, 64 nt, hsa
caacaacccagaaagguuuaaaaaacauaaggaaaaaaaagacaaauuaaaggaggggcuaggg

SEQ ID NO: 525939 - RNA, 64 nt, hsa
gggggccucaaccaacuuagugacuuguuuagaaaaaaaagacaaaaaaguaaaaauaaaaaca

SEQ ID NO: 525940 - RNA, 64 nt, hsa
aaaauugaaaucugcauucaugccaauucagcauaaaaaagaauaggcuacaguucucucacac

SEQ ID NO: 525941 - RNA, 64 nt, hsa
auuacuaauauuuauguagcaacuuuugugccagaaaaaagacuguuaauuuguuuuuucuugc

SEQ ID NO: 525942 - RNA, 64 nt, hsa
cuauacuggaaauguaaaauugaaaauauguuggaaaaaagauucugucuuauaggguaaaaaa

SEQ ID NO: 525943 - RNA, 64 nt, hsa
uuuccccuuaauucaguaugauuuauccucacauaaaaaagaagcacuuugauugaaguauuca

SEQ ID NO: 525944 - RNA, 64 nt, hsa
gcagucuuaaaaaaaaaaaaaaacagaaaaagaaaaaaaagaacguugcaaauuuguuaaaaug

SEQ ID NO: 525945 - RNA, 64 nt, hsa
gggccaggaauuggauucaguuuacacuaucauuaaaaaagagggagagagauaauaaacuaua

SEQ ID NO: 525946 - RNA, 64 nt, hsa
acugaauuccaaauuugcucuaguuugguuauggaaaaaagacuuuuugccacugaaacuugag

SEQ ID NO: 525947 - RNA, 64 nt, hsa
cgauauacucccugcccuucccccugcaaaaagaaaaaaagaaaagaaaaagaaaaaaaucccu

SEQ ID NO: 525948 - RNA, 64 nt, hsa
uauaugcuauucaaugaucuuagaaguacugaaaaaaaaagacguuuuuaaaacguagaggauu

SEQ ID NO: 525949 - RNA, 64 nt, hsa
ugucauuugacauuuuuuguuugcugaagugaaaaaaaaagauaaagguuguacgguggucuuu

SEQ ID NO: 525950 - RNA, 64 nt, hsa
ugcaauaaaauauguaaugucuuuuuuauaaagcaaaaaagacaauaauugcauuuaugagcuc

SEQ ID NO: 525951 - RNA, 64 nt, hsa
auucacuuauuguauguguguuguaaucuaaaaaaaaaaagaaugacaaacagcuucuuuaaga

SEQ ID NO: 525952 - RNA, 64 nt, hsa
ucuuucuuuggaugggacuagagcuuucuuucacaaaaaagaaguaggggaagacaugcagccu

SEQ ID NO: 525953 - RNA, 64 nt, hsa
gccugauaagcuucaaagcugcuuuauucaauaaaaaaaagaaaugaaaaagauauaugaauau

SEQ ID NO: 525954 - RNA, 64 nt, hsa
cuccagcuugggcaacagagcaagacuccaucucaaaaaagaaaaaagaaaagaaauagaauua

SEQ ID NO: 525955 - RNA, 64 nt, hsa
uugggcaacagagcaagacuccaucucaaaaaagaaaaaagaaaagaaauagaauuaucaagcu

SEQ ID NO: 525956 - RNA, 64 nt, hsa
uauuugaagauggagcacugcugauuuaugaaggaaaaaagaagaauuuucuaaagauuacaca

SEQ ID NO: 525957 - RNA, 64 nt, hsa
uauaaauaauaaaguaggcauuuguuuauuuuguaaaaaagaaaugaaaaucugcuggccagcu

SEQ ID NO: 525958 - RNA, 64 nt, hsa
ccuuucuugauacuuagucaugggaggauauuacaaaaaagaaauuuaaauuguguucauaguc

SEQ ID NO: 525959 - RNA, 64 nt, hsa
caugguacuccuaaagcauaugccucaccugguuaaaaaagaacaaacauguuuuugugaaagc

SEQ ID NO: 525960 - RNA, 58 nt, hsa
gaagauacaaagucuuauagacauccggaaaaaagauuuuuaccugugcuggucuaug

SEQ ID NO: 525961 - RNA, 64 nt, hsa
uaaaccaaccacagaucaaaaauagaaaaaaaaaaaaaaagaaaaaaagaauguaaaauuuuaa

SEQ ID NO: 525962 - RNA, 64 nt, hsa
ccacagaucaaaaauagaaaaaaaaaaaaaaagaaaaaaagaauguaaaauuuuaaaaauacag

SEQ ID NO: 525963 - RNA, 64 nt, hsa
aauuguucuuaaggcaucauaucuagaagcaaagaaaaaagaaaaauaacaauuuaaguugugu

SEQ ID NO: 525964 - RNA, 64 nt, hsa
ccaguuacuuauauuaauaauauucagaaaaaaaaaaaaagaaaaggaaaaagaaaaauauaua

SEQ ID NO: 525965 - RNA, 64 nt, hsa
cuucuucugagaaugugacuuuuucugguguuguaaaaaagaaaaaaaaaagaaugcucauugu

SEQ ID NO: 525966 - RNA, 64 nt, hsa
aaugugacuuuuucugguguuguaaaaaagaaaaaaaaaagaaugcucauuguaaaaauaaaaa

SEQ ID NO: 525967 - RNA, 64 nt, hsa
uuucucugaccuuuccauccuugaaaaaauggggaaaaaagaagaaaaaagacaaaaucgacca

SEQ ID NO: 525968 - RNA, 64 nt, hsa
cuuuccauccuugaaaaaauggggaaaaaagaagaaaaaagacaaaaucgaccauaaaagacca

SEQ ID NO: 525969 - RNA, 64 nt, hsa
uuguaagaaaagaaaaaagaaaagaaaaaaagggaaaaaagaaaagcaaggaaaaggcucuuua

SEQ ID NO: 525970 - RNA, 64 nt, hsa
cugauucacgacuuaauguauguuguaagaaaagaaaaaagaaaagaaaaaaagggaaaaaaga

SEQ ID NO: 525971 - RNA, 64 nt, hsa
uucuggguuuaguuuugucuuuaaaaagaauucaaaaaaagacugacaaugacaguuuugaguu

SEQ ID NO: 525972 - RNA, 64 nt, hsa
uuuuuuaaaaucaagaaaauuuaaaaagacaaaaaaaaaagaauucauugauaauucuaacuca

SEQ ID NO: 525973 - RNA, 64 nt, hsa
agcauuuuuuacaacugccauuuacuguauguagaaaaaagacauaaaaccuuagagaaagcca

SEQ ID NO: 525974 - RNA, 64 nt, hsa
aauguacuaaauccuauguuuacauuaauaugugaaaaaagauuuagaagauauuuuggagaua

SEQ ID NO: 525975 - RNA, 64 nt, hsa
aaggaaucugaccauuuuacgucucuacggcccaaaaaaagacaaaaauaaaaauuccuuuuua

SEQ ID NO: 525976 - RNA, 64 nt, hsa
auguccauuggauacuuuccuuuuuaucaucuuaaaaaaagauaacuaguacuaaucauuguag

SEQ ID NO: 525977 - RNA, 64 nt, hsa
acagagcaagacuccgucucaaaaaaaagaaaagaaaaaagaaagcauuguuuuaauugagagg

SEQ ID NO: 525978 - RNA, 64 nt, hsa
ccagcccgggugacagagcaagacuccgucucaaaaaaaagaaaagaaaaaagaaagcauuguu

SEQ ID NO: 525979 - RNA, 64 nt, hsa
ccgggggggguaggagaggagaaaaaaaaagugaaaaaaagaaacgaaaaggacagacgaagag

SEQ ID NO: 525980 - RNA, 64 nt, hsa
aaaaggacagacgaagaguuuaaagagaaaagggaaaaaagaaagaaaaaguaagcagggcugg

SEQ ID NO: 525981 - RNA, 64 nt, hsa
ggcagucaguggagggcgagugguuucggaaaaaaaaaaagaaaaaaagaaaaaaaaagaaaaa

SEQ ID NO: 525982 - RNA, 64 nt, hsa
guggagggcgagugguuucggaaaaaaaaaaagaaaaaaagaaaaaaaaagaaaaaaaaaagau

SEQ ID NO: 525983 - RNA, 64 nt, hsa
agugguuucggaaaaaaaaaaagaaaaaaagaaaaaaaaagaaaaaaaaaagauuuuuuucuuc

SEQ ID NO: 525984 - RNA, 64 nt, hsa
aaaaaaaaaaagaaaaaaagaaaaaaaaagaaaaaaaaaagauuuuuuucuucucuuaaucgga

SEQ ID NO: 525985 - RNA, 64 nt, hsa
uuuaaauguagacuuuugacacuuuuaaaaaacaaaaaaagacaagagagaugaaaacguuuga

SEQ ID NO: 525986 - RNA, 64 nt, hsa
aaauucaaggccacaaaaacaauguuugggggaaaaaaaagaaaaaaucaugccagcuaaucau

SEQ ID NO: 525987 - RNA, 64 nt, hsa
ggauuguguguauauuugggauaucuauugaagaaaaaaagaaaaccccuuaaagauaauguac

SEQ ID NO: 525988 - RNA, 64 nt, hsa
uuauaccauacugguuagugaauaauuacaugaaaaaaaagagucuguacaucuucagaguuuc

SEQ ID NO: 525989 - RNA, 64 nt, hsa
aggcaguguuucugggggagguuauggagggaagaaaaaagaaaaaucgauagugagugacuga

SEQ ID NO: 525990 - RNA, 64 nt, hsa
aacuuuguuucucuaauagcuuuuuuuuuacauaaaaaaagacccaggaacuuaauaguguaug

SEQ ID NO: 525991 - RNA, 64 nt, hsa
cucauuuccuucaauuuccuuugaccuauaggcuaaaaaagaaaggcucauuccagccacaggg

SEQ ID NO: 525992 - RNA, 64 nt, hsa
uagcacaauuauggguuacuuccuuuuucuuaacaaaaaagaauguuugauuuccucuggguga

SEQ ID NO: 525993 - RNA, 64 nt, hsa
uuuuauauauuuuuucauuagggccauaucuccaaaaaaagaaagaaaaaauacaaaaaacaaa

SEQ ID NO: 525994 - RNA, 64 nt, hsa
aaagaaagaaaaaauacaaaaaacaaaaacaaaaaaaaaagaggguaauguacaaguuucugua

SEQ ID NO: 525995 - RNA, 64 nt, hsa
uggauugauuuagaaaaugguuaccaguacagucaaaaaagagaaaaugaaaaaaauacaacua

SEQ ID NO: 525996 - RNA, 64 nt, hsa
auuuguauuucaagauaauguaguuuaaaaaaaaaaaaaagaaaaaaacuugauguaaauuccu

SEQ ID NO: 525997 - RNA, 64 nt, hsa
aauuuaaaaaguuuauuauaaauuaaauucagcaaaaaaagauuugcuacaaaguauagagaag

SEQ ID NO: 525998 - RNA, 64 nt, hsa
aagauuuugacauaaaagagccuugauuuuaaaaaaaaaagagagagagauguaauuuaaaaag

SEQ ID NO: 525999 - RNA, 64 nt, hsa
gggggauguuaaauguuaaucuaaaauauagcuaaaaaaagauuuugacauaaaagagccuuga

SEQ ID NO: 526000 - RNA, 64 nt, hsa
ucuucaucauuccccagugaaauagcaaaauacaaaaaaagagcucccuaauguuuuuauaaau

SEQ ID NO: 526001 - RNA, 64 nt, hsa
uaaaugacaucaaagucugaaauuuauaaguauaaaaaaagacucucucuucaucauuccccag

SEQ ID NO: 526002 - RNA, 64 nt, hsa
ccagaccuugucucaaaaaaaaaaaaaaaaaaagaaaaaagaaaguacugucugucuuaaauuu

SEQ ID NO: 526003 - RNA, 64 nt, hsa
gacagagccagaccuugucucaaaaaaaaaaaaaaaaaaagaaaaaagaaaguacugucugucu

SEQ ID NO: 526004 - RNA, 64 nt, hsa
ucucucacuauaguauaagaaucuauuuuggagaaaaaaagaaaauaugagggucucgaagcau

SEQ ID NO: 526005 - RNA, 64 nt, hsa
ugaagaaucaaaacaaaagcaaaaaaaaaaagcaaaaaaagaaaagagaaaaaaagaaaaaaug

SEQ ID NO: 526006 - RNA, 64 nt, hsa
aaagcaaaaaaaaaaagcaaaaaaagaaaagagaaaaaaagaaaaaaugcaaauggaauaauuu

SEQ ID NO: 526007 - RNA, 64 nt, hsa
cacuccagccugggugauagagcaagacugucucaaaaaagaaaaaaaagaaaaaauuuuaauu

SEQ ID NO: 526008 - RNA, 64 nt, hsa
cugggugauagagcaagacugucucaaaaaagaaaaaaaagaaaaaauuuuaauuuaauccuuc

SEQ ID NO: 526009 - RNA, 64 nt, hsa
agcccuacuuuggccaacauccugcuuauuucucaaaaaagagggacagugaaaacaaaaacga

SEQ ID NO: 526010 - RNA, 64 nt, hsa
cauguaugaaguuuuuaaucacccccuaacccccaaaaaagauucgguugucaagggauauauu

SEQ ID NO: 526011 - RNA, 64 nt, hsa
cugggugacuagcaaaacuccaucucaaaaaaaaaaaaaagaaagaaagaaacugaaaagugag

SEQ ID NO: 526012 - RNA, 64 nt, hsa
aacaugguaaaaccccgucucuacuaaaaauagaaaaaaagaaauuagccuagcgugguggcug

SEQ ID NO: 526013 - RNA, 64 nt, hsa
gcaagacuccgucucaaaaaaaaaaaaaaaaaaaaaaaaagagugaauguaauagucuugcaga

SEQ ID NO: 526014 - RNA, 64 nt, hsa
cgccuggcaacagagcaagagucugucucaaaaaaaaaaagaaaaaaagaaaaaaagaaaaaag

SEQ ID NO: 526015 - RNA, 64 nt, hsa
aacagagcaagagucugucucaaaaaaaaaaagaaaaaaagaaaaaaagaaaaaagaaaaaucu

SEQ ID NO: 526016 - RNA, 64 nt, hsa
aagagucugucucaaaaaaaaaaagaaaaaaagaaaaaaagaaaaaagaaaaaucucauuauuu

SEQ ID NO: 526017 - RNA, 64 nt, hsa
ugucucaaaaaaaaaaagaaaaaaagaaaaaaagaaaaaagaaaaaucucauuauuucaaaaug

SEQ ID NO: 526018 - RNA, 64 nt, hsa
ggcuguuaaauuggccugcuccagagacuggcucaaaaaagaaagaagcaacgaaaacaaaaug

SEQ ID NO: 526019 - RNA, 64 nt, hsa
aaaaaugaaagauugaauguucauguguggguuaaaaaaagaagcuuuaacacuaauuuuccaa

SEQ ID NO: 526020 - RNA, 64 nt, hsa
ugugcuugggucccacgugacugaucugacaaaaaaaaaagagggauauuaccauggcaacccu

SEQ ID NO: 526021 - RNA, 64 nt, hsa
cucccagcuuugccgccugugcugccauuagagaaaaaaagaagcauaaucgugggcaucucua

SEQ ID NO: 526022 - RNA, 64 nt, hsa
ccugggucacagagugagacuccaucucaaaaaaaaaaaagagagagagagagaaagaaauaga

SEQ ID NO: 526023 - RNA, 64 nt, hsa
gccugggugacagagugagacccugucucaaaaaaaaaaagauucugugucagagcccagccca

SEQ ID NO: 526024 - RNA, 64 nt, hsa
guugcacaggguggagucaaaacaaccuacauauaaaaaagaaacuuguccauuuagcuuucau

SEQ ID NO: 526025 - RNA, 64 nt, hsa
uagguuuagggaguguaccucagauagauuuuaaaaaaaagaauagaaagccuuuauuuccugg

SEQ ID NO: 526026 - RNA, 64 nt, hsa
agcuugggcaacagagcaagacuccaucucaaaaaaaaaagaguucuagcccaggagcgguggc

SEQ ID NO: 526027 - RNA, 64 nt, hsa
auucagaaacuugagugcaaugucuuggauaugcaaaaaagaaaaucaaaacgcauucuucauu

SEQ ID NO: 526028 - RNA, 64 nt, hsa
aaauccccgucuuuacaaaaacaaacaaacaaacaaaaaagauauugcaguuguguuguaagcg

SEQ ID NO: 526029 - RNA, 64 nt, hsa
uauguuauaccuauuuuacuacaauaaaaaguauaaaaaagagaagauauuuaggugacuuaca

SEQ ID NO: 526030 - RNA, 64 nt, hsa
ggugaccucccgucucucucggaaaaaaaaaaagaaaaaagaaaaagccgggugagguggugug

SEQ ID NO: 526031 - RNA, 64 nt, hsa
gcaacauggugaccucccgucucucucggaaaaaaaaaaagaaaaaagaaaaagccgggugagg

SEQ ID NO: 526032 - RNA, 64 nt, hsa
uuaacauugcaaugaaaaaaugaaaaaaagaaggaaaaaagaauaagaaugaaaacugcugacg

SEQ ID NO: 526033 - RNA, 64 nt, hsa
acucugguguguuaacauugcaaugaaaaaaugaaaaaaagaaggaaaaaagaauaagaaugaa

SEQ ID NO: 526034 - RNA, 64 nt, hsa
ugacagagugagacucuaucucaaaaaaaaaaaaaaaaaagaaagguuguuauggacuggacac

SEQ ID NO: 526035 - RNA, 64 nt, hsa
uagacuaaauagaaaccccucagcccuaaaauagaaaaaagaacaguucuggacuauugaacag

SEQ ID NO: 526036 - RNA, 64 nt, hsa
cugggcaacaagagugaaacuccaucuccaaaaaaaaaaagaaaaaguaacaaaaggaaauuau

SEQ ID NO: 526037 - RNA, 64 nt, hsa
caauguagugacaccucauuucuauuuauuuuaaaaaaaagagagaguaacuacagaagaacuu

SEQ ID NO: 526038 - RNA, 64 nt, hsa
cuauaguagaaaaggaaacuaguagggccaaaaaaaaaaagaaaaagaaaaagaaaaaagaaaa

SEQ ID NO: 526039 - RNA, 64 nt, hsa
uaguagggccaaaaaaaaaaagaaaaagaaaaagaaaaaagaaaaaaaaagaaaaaacugggac

SEQ ID NO: 526040 - RNA, 64 nt, hsa
aaaaaaaaaaagaaaaagaaaaagaaaaaagaaaaaaaaagaaaaaacugggaccuaaguauaa

SEQ ID NO: 526041 - RNA, 64 nt, hsa
aaaauaaaaaaaaauuuaaaaaauuaaaaaauaaaaaaaagaggucacuaaaagaccaagaugg

SEQ ID NO: 526042 - RNA, 64 nt, hsa
cauuucagccugagcgacagagugaaacugucucaaaaaagagagacuuccgggacagucauua

SEQ ID NO: 526043 - RNA, 64 nt, hsa
gggcagcagagcgagacuccgucucaaacagaaaaaaaaagagaauuuugaaucuccuuuccca

SEQ ID NO: 526044 - RNA, 64 nt, hsa
cuccguccaaaagauuccuccaaaaaaagauuuaaaaaaagauuucggcaucgacacggacguu

SEQ ID NO: 526045 - RNA, 64 nt, hsa
gaagacuuuugccuccguccaaaagauuccuccaaaaaaagauuuaaaaaaagauuucggcauc

SEQ ID NO: 526046 - RNA, 64 nt, hsa
gaugcuuuaaaugaaaaauugaaaucagaagaacaaaaaagaagagcaagagaaaaagcaaauu

SEQ ID NO: 526047 - RNA, 64 nt, hsa
cuguaggaucguaaaaaaauagaaaaaaagaaaaaaaaaagaaagaaagagggaaaaagagcug

SEQ ID NO: 526048 - RNA, 64 nt, hsa
cuggaccaucucuguaggaucguaaaaaaauagaaaaaaagaaaaaaaaaagaaagaaagaggg

SEQ ID NO: 526049 - RNA, 64 nt, hsa
auuuacuuuucuuaaaaaaaaaaaaaaaaaaaaaaaaaaagaguuucuggcugaugggugacuc

SEQ ID NO: 526050 - RNA, 64 nt, hsa
uuuucucccauugugcgaacauuuuauuuuuuaaaaaaaagaaacaaaaauauuuuucccccua

SEQ ID NO: 526051 - RNA, 64 nt, hsa
uccagccugggcaacgggcgagacucugucucaaaaaaaagaaagaaagaaaagguacauguau

SEQ ID NO: 526052 - RNA, 64 nt, hsa
uuuuaagacucugucuuaaaaaaaacuaaaaagaaaaaaagaagccccuucacucuacagggga

SEQ ID NO: 526053 - RNA, 64 nt, hsa
uccagccugggcaagaguuuuuuuaagacucuuaaaaaaagagccugggcaauuuuuuuaagac

SEQ ID NO: 526054 - RNA, 64 nt, hsa
gauauuucucuaguaguuaaaaaaaaaaaaaggaaaaaaagacucuuuuugguuguccucaaga

SEQ ID NO: 526055 - RNA, 64 nt, hsa
ucacaauguucuuuauauacaauaauggaaaaaaaaaaaagaggaaaacccucaagggcaugag

SEQ ID NO: 526056 - RNA, 64 nt, hsa
caaacucauauuacaaaaacaaaauaaaauaauaaaaaaagaaagcaugauauuuacuguuuug

SEQ ID NO: 526057 - RNA, 64 nt, hsa
gaugauaaauaugguuaauuucauguaaaacagaaaaaaagagugaaaaagagaauauacauga

SEQ ID NO: 526058 - RNA, 64 nt, hsa
aauuuuaaugaacgaaugaaugacagagaggaggaaaaaagaugaggauugcauacauguucua

SEQ ID NO: 526059 - RNA, 64 nt, hsa
gcugcagauuuagagaacauuggcuucugaaaaaaaaaaagagugaagauaguacuagcaagua

SEQ ID NO: 526060 - RNA, 64 nt, hsa
auagccagacuugagaggugacaauuaaagaucuaaaaaagagaggagauucccccaaacaaca

SEQ ID NO: 526061 - RNA, 64 nt, hsa
auuuucauuuuugcauuuuuuuguuugcauauuaaaaaaagagaaaagagaaagcaagagacag

SEQ ID NO: 526062 - RNA, 64 nt, hsa
gugccauuuuaauaaaaaauguauuuaaaaaaagaaaaaagacaauauacugacagucuaauca

SEQ ID NO: 526063 - RNA, 64 nt, hsa
cagacaagugccauuuuaauaaaaaauguauuuaaaaaaagaaaaaagacaauauacugacagu

SEQ ID NO: 526064 - RNA, 64 nt, hsa
aacauagggagaccccaucucuaccggaggaaaaaaaaaagagucaggccugguggugugcgcc

SEQ ID NO: 526065 - RNA, 64 nt, hsa
gagugagaccuugucucaaaaaaguaacauaaggaaaaaagaagccuugcuuuagcacagguau

SEQ ID NO: 526066 - RNA, 64 nt, hsa
ccaaagauacacuauaaaaauagaguuuuuaccaaaaaaagauguuuguucucaucucaguagg

SEQ ID NO: 526067 - RNA, 64 nt, hsa
cauggcacaacuaaaaaucuaagccugaaaccugaaaaaagagauaugacaagggaaauuaauc

SEQ ID NO: 526068 - RNA, 64 nt, hsa
ucccuuccuauaaccucuagguaaaaagaaaagaaaaaaagaaauuucgagauauuuucaacau

SEQ ID NO: 526069 - RNA, 64 nt, hsa
cuaucucaaaccgcagaaaggcuuuaauacuggaaaaaaagaauucaagacuacaggcagcucc

SEQ ID NO: 526070 - RNA, 64 nt, hsa
agccugggugacaagagugaaacuccaucucaaaaaaaaagaaaagaagguccagcuuuuggau

SEQ ID NO: 526071 - RNA, 64 nt, hsa
cagcccgggugacaaagcaagacccugucucagaaaaaaagaaaauucaaggccaguuaagaca

SEQ ID NO: 526072 - RNA, 64 nt, hsa
gggcgacaagagcaaaacuccgucucaaaaaaaaaaaaaagauacaaagucugcauuugauaua

SEQ ID NO: 526073 - RNA, 64 nt, hsa
aaugacucgcaaccccucaccccacaauuucuuuaaaaaagaaauuaucuuuaguugaauucca

SEQ ID NO: 526074 - RNA, 64 nt, hsa
cacauuuuaggaucucgccuggaaacagagguaaaaaaaagaagugugcgcccggcuaaugcag

SEQ ID NO: 526075 - RNA, 64 nt, hsa
acuguauggaaucaacaccaccgagcucugugggaaaaaagaaaaaccugcucccuucgcucug

SEQ ID NO: 526076 - RNA, 64 nt, hsa
uaccaacauguaucugucuacuuucucuuguuuaaaaaaagaaaaaaaaacuuaaaaaaauggg

SEQ ID NO: 526077 - RNA, 64 nt, hsa
cacuuuuaagcuauguguaugugcuuauauaaauaaaaaagagugaaaacagauauuauucaau

SEQ ID NO: 526078 - RNA, 64 nt, hsa
agauuauuaaaugugacaaauuacccaaggcgguaaaaaagacauguucacuuuuaagcuaugu

SEQ ID NO: 526079 - RNA, 64 nt, hsa
uaguaccaucucccccgccaauaaaaaagagaagaaaaaagagaaacccguggcacuauguaaa

SEQ ID NO: 526080 - RNA, 64 nt, hsa
aauaacaaguuauaguaccaucucccccgccaauaaaaaagagaagaaaaaagagaaacccgug

SEQ ID NO: 526081 - RNA, 64 nt, hsa
uacguaaucagaaauuugugcauagauugaugccaaaaaagacauuuccagcauuguggaacau

SEQ ID NO: 526082 - RNA, 64 nt, hsa
aaucuuaaaaaaagaaaaaaugaaaaaaaaaggaaaaaaagaaaaaaggaaaaaaacaguuuga

SEQ ID NO: 526083 - RNA, 64 nt, hsa
ccuuuuccaguguguaacccaguuugaaaucuuaaaaaaagaaaaaaugaaaaaaaaaggaaaa

SEQ ID NO: 526084 - RNA, 64 nt, hsa
uauucauuuauguuagcauuaaugcacauuuuuaaaaaaagaaaaaaacauggucuuguuuuua

SEQ ID NO: 526085 - RNA, 64 nt, hsa
acuguugccugcaaaaauaaaagggaaaaaaaagaaaaaagaaacaaaaaggaacuucuuauag

SEQ ID NO: 526086 - RNA, 64 nt, hsa
acccaugacuguugccugcaaaaauaaaagggaaaaaaaagaaaaaagaaacaaaaaggaacuu

SEQ ID NO: 526087 - RNA, 64 nt, hsa
ugcacacugagauauaauaaaagguguuuaucauaaaaaagaaacaguauuagauuuuggucuc

SEQ ID NO: 526088 - RNA, 64 nt, hsa
cauuuuuauggauuguagacccaguuuugaaaccaaaaaagaaaccuagaaucuaaugcagaag

SEQ ID NO: 526089 - RNA, 64 nt, hsa
ggccacaguuguuugaugcauuaaaagaaaauaaaaaaaagaaaaaagagaaaagaaaaaaaaa

SEQ ID NO: 526090 - RNA, 64 nt, hsa
guuguuugaugcauuaaaagaaaauaaaaaaaagaaaaaagagaaaagaaaaaaaaagaaaaaa

SEQ ID NO: 526091 - RNA, 64 nt, hsa
aagaaaauaaaaaaaagaaaaaagagaaaagaaaaaaaaagaaaaaaguuguaggcgaaucauu

SEQ ID NO: 526092 - RNA, 64 nt, hsa
gaaauaggaaaacaacaaaagaaaaacaauaacaaaaaaagaaagugugauggcugggugcagu

SEQ ID NO: 526093 - RNA, 64 nt, hsa
aaaaauaaauaaauagaaagagagagagaggaaaaaaaaagaaaagaacacuucuuuauuugag

SEQ ID NO: 526094 - RNA, 64 nt, hsa
caauuuaauuaauugguaagauauaaugcaaaaaaaaaaagagaaauguuugccuuauguauau

SEQ ID NO: 526095 - RNA, 64 nt, hsa
aaucuacuguacugucagcuucacuccaccugagaaaaaagaaaaaaaaauugauagcucaaau

SEQ ID NO: 526096 - RNA, 64 nt, hsa
aauaauaccaggcuuuuauaaacuuuucuagaagaaaaaagauggaacuuuuccaauucaguuu

SEQ ID NO: 526097 - RNA, 64 nt, hsa
uagccuggaagacagagugagaccccaucucaggaaaaaagaaaaaaaaaaagaugucauucag

SEQ ID NO: 526098 - RNA, 64 nt, hsa
cagagugagaccccaucucaggaaaaaagaaaaaaaaaaagaugucauucagcagguuaaugga

SEQ ID NO: 526099 - RNA, 63 nt, hsa
ccgaacagccugaaaugugaacugaacaggagaaaaaaagaaaagcaaaaaacuccuguaacc

SEQ ID NO: 526100 - RNA, 64 nt, hsa
aacacuaaauucaagucauuuguuuuaagucucuaaaaaagaagauugcagucauccauucaua

SEQ ID NO: 526101 - RNA, 64 nt, hsa
guuuuuucuuaaguuauauuuguuuuuacuuuuuaaaaaagaagaggaaacaaagcccccuuuu

SEQ ID NO: 526102 - RNA, 64 nt, hsa
gcuaguggucccuuuugaauuucaugagccucucaaaaaagaaaaacuuaaaaaaaaaaaaaaa

SEQ ID NO: 526103 - RNA, 64 nt, hsa
aacagagcgagacucugucuccccccgcaaaaaaaaaaaagaaagaaagaaagagaaaagaaaa

SEQ ID NO: 526104 - RNA, 64 nt, hsa
caaagauuuucuucagguuaaaaaaaaaguuuaaaaaaaagauuuuaaaauaaagcauuuauga

SEQ ID NO: 526105 - RNA, 64 nt, hsa
uuuuuauuuccuaagaaauaauuuaauguuuaguaaaaaagaaaacagaaaaaagaaagaugcg

SEQ ID NO: 526106 - RNA, 64 nt, hsa
gaaauaauuuaauguuuaguaaaaaagaaaacagaaaaaagaaagaugcguguguuggcuuacg

SEQ ID NO: 526107 - RNA, 64 nt, hsa
guuuuauuguuccacuugaauauuucuacuguaaaaaaaagacagugguuuugaaauuguugaa

SEQ ID NO: 526108 - RNA, 64 nt, hsa
uauuuucacaaaggguuaucugauaaccaaaaaaaaaaaagacauuucaucuaagccacuuaac

SEQ ID NO: 526109 - RNA, 64 nt, hsa
gccugggcaacagagcaagacuccgucuccaaaaaaaaaagaauuccuggggccugcccagucu

SEQ ID NO: 526110 - RNA, 64 nt, hsa
aaagauguacguuguagacaaaguugcagaauuaaaaaaagaaaucugcuuuuaauuuauucuu

SEQ ID NO: 526111 - RNA, 64 nt, hsa
uuguguaaaauggacucuaguuuaauaaugggggaaaaaagauuagguugcuccugaaacugac

SEQ ID NO: 526112 - RNA, 64 nt, hsa
ccauacucucaugacaauuuuguuggugaacaacaaaaaagagaucuauuucuuuaaaagauau

SEQ ID NO: 526113 - RNA, 64 nt, hsa
aaaucagcaaaggcaguguuucaaaaagugcaaaaaaaaagauucuguuauaaagugauuuucu

SEQ ID NO: 526114 - RNA, 64 nt, hsa
agguguuuuuuacauuuaagaaaaaaaaaaaagaaaaaaagauuguuuaaaaaaaaaaggaauc

SEQ ID NO: 526115 - RNA, 64 nt, hsa
cuguaccgagguguuuuuuacauuuaagaaaaaaaaaaaagaaaaaaagauuguuuaaaaaaaa

SEQ ID NO: 526116 - RNA, 64 nt, hsa
gaauaaauaaaacaaacuuaaucuucaucuuuaaaaaaaagaaaaaagaaaccaaaaugagaau

SEQ ID NO: 526117 - RNA, 64 nt, hsa
uaaaacaaacuuaaucuucaucuuuaaaaaaaagaaaaaagaaaccaaaaugagaaucaacacu

SEQ ID NO: 526118 - RNA, 64 nt, hsa
gccguugaaaugaaaagagagacagagagaaaaaaaaaaagagaacccacaugaagcucugaaa

SEQ ID NO: 526119 - RNA, 64 nt, hsa
uuguguggaugcgugaccaugggaaaaagaaaaaaaaaaagauccauuuuuuagguucuuuucg

SEQ ID NO: 526120 - RNA, 64 nt, hsa
uaaaauugauguugucuuuaccagaaagguagacaaaaaagaagcagcagcagcucuuaaagug

SEQ ID NO: 526121 - RNA, 64 nt, hsa
gcucuuggaaagaaugacguuuugcuggaaaaaaaaaaaagaacaguuuguguuucacaaacau

SEQ ID NO: 526122 - RNA, 64 nt, hsa
uuuaacuguuugauuauaacugugcaaauacagaaaaaaagaaggcuggcugaaaguugaguua

SEQ ID NO: 526123 - RNA, 64 nt, hsa
uaacauuucacaaauguuuagugaaacauuugugaaaaaagaagacuaaauuaagaccugagcu

SEQ ID NO: 526124 - RNA, 64 nt, hsa
ugggagacuccaucucaaaaaaaaaaaaaaaaaaaaaaaagauaaaaagucagaaaucugaaaa

SEQ ID NO: 526125 - RNA, 64 nt, hsa
uucauuuauuuuaaauaaaugaauaaaauaaaauaaaaaagaauauucagucguuggcacauaa

SEQ ID NO: 526126 - RNA, 64 nt, hsa
gaauuguuaaauguucuuaaauguucucacuacaaaaaaagaaaaaagauaacuacgugaggug

SEQ ID NO: 526127 - RNA, 64 nt, hsa
uaaauguucuuaaauguucucacuacaaaaaaagaaaaaagauaacuacgugaggugauggaua

SEQ ID NO: 526128 - RNA, 64 nt, hsa
gcaccucagaugaaaacucacuuuuauuaaaaaaaaaaaagacaaggguuuauauucauauaca

SEQ ID NO: 526129 - RNA, 64 nt, hsa
gugacagagcaacacucugucuuaaaagaaaaaaaaaaaagagagagauaguaaucucuugggc

SEQ ID NO: 526130 - RNA, 64 nt, hsa
gaggaccaaaccaugcacauaaagcuuguaguuuaaaaaagaaaagcaaaaaaauaauuaugcc

SEQ ID NO: 526131 - RNA, 64 nt, hsa
cagccugggcaacagagggagacucugucucaaaaaaaaagaaguuacuuccaagacagacuuu

SEQ ID NO: 526132 - RNA, 64 nt, hsa
cuacuguuucaaaaaagugucuuuacaaaaaaacaaaaaagaaaagaaauuuauuuauuaaaaa

SEQ ID NO: 526133 - RNA, 64 nt, hsa
acauuuacagaguuacaaaaaacaaacaaucaaaaaaaaagacaguuuauuaaaaaugacacaa

SEQ ID NO: 526134 - RNA, 64 nt, hsa
augacagagugagaccuuaucucaaaaaaaaaaaaaaaaagagagagagagagaaaaagaaaug

SEQ ID NO: 526135 - RNA, 64 nt, hsa
ucucguaauuguguauagcaugguaaaagaaaaaaaaaaagacagguaaauguuauauaauugu

SEQ ID NO: 526136 - RNA, 64 nt, hsa
auguccucuugcugucuacaguagcugcuaccuaaaaaaagauguuuuauuuugccaguuggac

SEQ ID NO: 526137 - RNA, 64 nt, hsa
gaagcuauuuguuaaaauauuugccuuuuuaaguaaaaaagaaaaaucagaacagggcuauuug

SEQ ID NO: 526138 - RNA, 64 nt, hsa
ccuuuaguguuggugguaggaggauggggagaggaaaaaagagcuggcaaagaaauggauaggg

SEQ ID NO: 526139 - RNA, 64 nt, hsa
cauuguuuuuuugcaugcuuucuuaauaaaaaaaaaaaaagaauguuuacaguuuuaucuuacu

SEQ ID NO: 526140 - RNA, 64 nt, hsa
uguugggucuuggcugaaaaaaaaaaaugcuuuuaaaaaagauaaaaugaaaaggagagcucuc

SEQ ID NO: 526141 - RNA, 64 nt, hsa
ugaauacauuuuugaaauaggaacucccuuuugcaaaaaagaaaccugggugucagggagguga

SEQ ID NO: 526142 - RNA, 64 nt, hsa
agcuuacuugaacuaauuacuugaaaacugguggaaaaaagagaccaacuuuguuauuuuuuaa

SEQ ID NO: 526143 - RNA, 64 nt, hsa
ugggcgacagugcaagacucugucuccaaaaaaaaaaaaagaaaaaagaaaaucccccuucauc

SEQ ID NO: 526144 - RNA, 64 nt, hsa
cagugcaagacucugucuccaaaaaaaaaaaaagaaaaaagaaaaucccccuucaucccccagg

SEQ ID NO: 526145 - RNA, 64 nt, hsa
ugccaucaaauggcuacaguucauuuaaauuuaaaaaaaagaaaaaagaaacagaaaacguguc

SEQ ID NO: 526146 - RNA, 64 nt, hsa
aaauggcuacaguucauuuaaauuuaaaaaaaagaaaaaagaaacagaaaacgugucucagaug

SEQ ID NO: 526147 - RNA, 52 nt, hsa
aggaagaaaacaaggacuaagcaaaaaagaaagacccccccccccuuagcaa

SEQ ID NO: 526148 - RNA, 64 nt, hsa
aaagagaaaaauuuuaaaauccugcuauaggagaaaaaaagagaaaaaaauaaaaaucaaaaaa

SEQ ID NO: 526149 - RNA, 64 nt, hsa
gaaaaaaagagaaaaaaauaaaaaucaaaaaaaaaaaaaagaaagaaagaaaccuccagcguau

SEQ ID NO: 526150 - RNA, 64 nt, hsa
aaauuauuaaucugaaaauagcaacccagaauguaaaaaagaaaaaacuggggggaaaaagacc

SEQ ID NO: 526151 - RNA, 64 nt, hsa
gaaucuuuaagggagguuuaaaaaaaaaaaaaaaaaaaaagauugguugccucugccuuuguga

SEQ ID NO: 526152 - RNA, 64 nt, hsa
gacaagagcaagacucugucucagaaaaaaaaaaaaaaaagagagagagagagaaagagaacaa

SEQ ID NO: 526153 - RNA, 64 nt, hsa
auaacaagauccugucucucaaaaaaaaaaaaaaaaaaaagaaagagagagggccgggcguggu

SEQ ID NO: 526154 - RNA, 64 nt, hsa
caccacccuaaaguuggauuuuuacauauaaauaaaaaaagaaucccuuuuauuuuucucucuc

SEQ ID NO: 526155 - RNA, 64 nt, hsa
uucauuuuuuuucuuuguaaugcaccugacagaaaaaaaagaaaaaugaauuucucuuuacuuc

SEQ ID NO: 526156 - RNA, 64 nt, hsa
acuuuucucauuuuccugagaauuuaccagaaaaaaaaaagauacauagauuugucucuguguu

SEQ ID NO: 526157 - RNA, 64 nt, hsa
cccuuucuuuuauucaaacaauaauuuuugaaacaaaaaagaggaaggaaaucaguggcagaaa

SEQ ID NO: 526158 - RNA, 64 nt, hsa
acagagcgaaccucugucucaaaaaaaaaaaaagaaaaaagaaagaaagaaaaaaggcagaagc

SEQ ID NO: 526159 - RNA, 64 nt, hsa
cggggugacagagcgaaccucugucucaaaaaaaaaaaaagaaaaaagaaagaaagaaaaaagg

SEQ ID NO: 526160 - RNA, 64 nt, hsa
ucugggaaagacaccaaaucaugggcucacuuuaaaaaaagaaagaauaaaaaaaccuucagcu

SEQ ID NO: 526161 - RNA, 64 nt, hsa
agcaguaugccacuucuuaaaacagaacaaaacaaaaaaagaaaauugugcucuuuucuaaucc

SEQ ID NO: 526162 - RNA, 64 nt, hsa
ucuucugguuuacuauauacaaaaacuguaguugaaaaaagaugacaauuuaaaagucagccua

SEQ ID NO: 526163 - RNA, 64 nt, hsa
caaaauguuccuuuugaagacuauacaaggcuucaaaaaagacuaaaagauauacagagaagac

SEQ ID NO: 526164 - RNA, 64 nt, hsa
aaaguacuugacuaaaaaaaaaagaaaaaaagaaaaaaaagaaagcauagacauauuuuuuuaa

SEQ ID NO: 526165 - RNA, 64 nt, hsa
uucuuuaagaaaguacuugacuaaaaaaaaaagaaaaaaagaaaaaaaagaaagcauagacaua

SEQ ID NO: 526166 - RNA, 64 nt, hsa
gcuauuguuucuuuaagaaaguacuugacuaaaaaaaaaagaaaaaaagaaaaaaaagaaagca

SEQ ID NO: 526167 - RNA, 64 nt, hsa
ggucaccucaaggaucagaggccaggaaaaaaaaaaaaaagacucccuggaucucugaauauau

SEQ ID NO: 526168 - RNA, 64 nt, hsa
gacacaaagcuuuauuuuuccacaucaugcuuacaaaaaagaauaaugcaaauaguugcaacuu

SEQ ID NO: 526169 - RNA, 64 nt, hsa
ggcaacaaaagcgaaacucugucucaaaaaagaaaaaaaagaaaaaaaagcacgugaccuuaug

SEQ ID NO: 526170 - RNA, 64 nt, hsa
uccagccugggcaacaaaagcgaaacucugucucaaaaaagaaaaaaaagaaaaaaaagcacgu

SEQ ID NO: 526171 - RNA, 64 nt, hsa
gggcaacaagagcgaaacucugucucaaaaaaaaaaaaaagagguggguggauuacuugagguc

SEQ ID NO: 526172 - RNA, 64 nt, hsa
aggcuacacacagaaaauguuuacucaaucauucaaaaaagagaaaaggagagaaaguaacuuu

SEQ ID NO: 526173 - RNA, 64 nt, hsa
guagacuuaaggcuucauugugggguuaaaaaaaaaaaaagauacaaagaaauaugucucaaaa

SEQ ID NO: 526174 - RNA, 64 nt, hsa
cugauaaacagaauacuuuuaaaacaccuugagaaaaaaagauaauacauacacaugaacaaag

SEQ ID NO: 526175 - RNA, 64 nt, hsa
agaauaaaaacuaccaaagugauauacagagagaaaaaaagacuuagagaagaggaagagaaua

SEQ ID NO: 526176 - RNA, 64 nt, hsa
uccagccugggcaacaagagcaaaacuccgucucaaaaaagaugaaaauaaaauaaaauauaua

SEQ ID NO: 526177 - RNA, 64 nt, hsa
ugcuuaauuuggaauagagaaaccaguauauuuuaaaaaagaaaaauauucuuuguagcaacug

SEQ ID NO: 526178 - RNA, 64 nt, hsa
uuuagugauuauuaagcacuucugucagucuuugaaaaaagaacguauuuuuugugcuuugaag

SEQ ID NO: 526179 - RNA, 64 nt, hsa
gaucugugcuguagaaaaacauuaacccuuguucaaaaaagaaauggauaaacuuggccuuucu

SEQ ID NO: 526180 - RNA, 64 nt, hsa
cagcacauugcauguaguugagccacauuuuuuaaaaaaagaaaauggaugaccauuaauugac

SEQ ID NO: 526181 - RNA, 64 nt, hsa
gaugacccuuuugaauauaccuaaugauuuccuuaaaaaagaaauuuuaaacagacuuguuuaa

SEQ ID NO: 526182 - RNA, 64 nt, hsa
gccggggaaacgacccuguggcugugagaaagugaaaaaagaaaaaaaaaaaggcauuggcauu

SEQ ID NO: 526183 - RNA, 64 nt, hsa
uaggacagaauuaaugaugcuuaaagagaaaagaaaaaaagagagaagaaaaaggagagaugaa

SEQ ID NO: 526184 - RNA, 64 nt, hsa
cccagcuauugucuguuguguucagcugagaugcaaaaaagaaauuaagcaaaaaagaaaaaga

SEQ ID NO: 526185 - RNA, 64 nt, hsa
uguguucagcugagaugcaaaaaagaaauuaagcaaaaaagaaaaagaugaagacuuuucauga

SEQ ID NO: 526186 - RNA, 64 nt, hsa
uuucaaauuuagcaauaaacaauuagcauuaguuaaaaaagaaacauauuccaagggcagguuc

SEQ ID NO: 526187 - RNA, 64 nt, hsa
agaugcaccaaccguaucauuauuuguuugaggaaaaaaagaaaucugcauuuuaauucauguu

SEQ ID NO: 526188 - RNA, 64 nt, hsa
uucuaguugugucaccaaaucaucaaaaaaccuuaaaaaagaaguaacuugcuuuguagguuug

SEQ ID NO: 526189 - RNA, 64 nt, hsa
ucucaaaaaaaaaaaaaaaaaaaaaaggaaaaaaaaaaaagaaaaaaaaccauauguguauuag

SEQ ID NO: 526190 - RNA, 64 nt, hsa
uaaauuaaauuucacccuauuuaaacauaugauaaaaaaagaaaugcacuuguaaacagaaugu

SEQ ID NO: 526191 - RNA, 64 nt, hsa
aaauguuuuaacugacuuuggaucuucaucaccuaaaaaagaguguguugauggcaguuccaau

SEQ ID NO: 526192 - RNA, 64 nt, hsa
gccugggugacagaacaagacugucucaaaaaaaaaaaaagagaagaaaaacugccuacaggcc

SEQ ID NO: 526193 - RNA, 64 nt, hsa
augagagugagacuccaucgcaaaaaaaaaaaaaaaaaaagaaaagaaaauuagccaggugugg

SEQ ID NO: 526194 - RNA, 64 nt, hsa
auuuuugucauauucuuguauucaaagaaaaaggaaaaaagauuauuguaaauauuuuauuuaa

SEQ ID NO: 526195 - RNA, 64 nt, hsa
auaaucugcaacuucauuuucccccauagaagagaaaaaagagcaccaccauuauuaccaccuc

SEQ ID NO: 526196 - RNA, 64 nt, hsa
cuaaaaaaaguguguauuaggaggagagagaggaaaaaaagaggaaagaaggaaaaaaaaaaga

SEQ ID NO: 526197 - RNA, 64 nt, hsa
ggagagagaggaaaaaaagaggaaagaaggaaaaaaaaaagaauuaaaaaaaaaaaaaagaaaa

SEQ ID NO: 526198 - RNA, 64 nt, hsa
aggaaagaaggaaaaaaaaaagaauuaaaaaaaaaaaaaagaaaaacagaagaugaccuugaug

SEQ ID NO: 526199 - RNA, 64 nt, hsa
aagaugaccuugauggaaaaaaaauauuuuuuaaaaaaaagauauacuguggaaggggggagaa

SEQ ID NO: 526200 - RNA, 64 nt, hsa
ugcauccagaaaggccagauuuuaccuaccaagaaaaaaagauauuuuuccagagaguuaggua

SEQ ID NO: 526201 - RNA, 64 nt, hsa
auauuuuucaguuguuuaugucguuuacuacaaaaaaaaagauucagaguggauggaguacaac

SEQ ID NO: 526202 - RNA, 64 nt, hsa
uucccaaaugggaaaggugcugacagaguuggagaaaaaagaauagacucauuuuuccccauua

SEQ ID NO: 526203 - RNA, 64 nt, hsa
uccucucucaccccguaaacugacaagcaugaugaaaaaagaagcacauccaaguuucugccuc

SEQ ID NO: 526204 - RNA, 64 nt, hsa
guuuaauuauguaaaaaacaaaacuacaacaacaaaaaaagaaaaaaguuaaaaaagaaaaaaa

SEQ ID NO: 526205 - RNA, 64 nt, hsa
aacaaaacuacaacaacaaaaaaagaaaaaaguuaaaaaagaaaaaaacaccaaaaaacaaaaa

SEQ ID NO: 526206 - RNA, 64 nt, hsa
gcuggaucugugacugauugaaaugcaugcaaauaaaaaagacaauauuaaagucuguuaucaa

SEQ ID NO: 526207 - RNA, 64 nt, hsa
aauguguuaagaguuuaauuuuuuuguuaucauuaaaaaagacaggauuauaaagagauaucaa

SEQ ID NO: 526208 - RNA, 64 nt, hsa
aauccaacucugaauuuuaaagcaaaagcgucaaaaaaaagauucccuccuuacccccaaccca

SEQ ID NO: 526209 - RNA, 64 nt, hsa
gucaaacugugccacacauggugaaugaaaaaaaaaaaaagaggcuguguuuugucacacaggg

SEQ ID NO: 526210 - RNA, 64 nt, hsa
cuccaagcuuuugugauuguauauuccuauaggaaaaaaagaauugauuaugcauacccaguau

SEQ ID NO: 526211 - RNA, 64 nt, hsa
guacaaaaaaaaaguuuuauuuuucuaaaaaaagaaaaaagaagaaaaaauuuaaaggguguac

SEQ ID NO: 526212 - RNA, 64 nt, hsa
uauauuuguacaaaaaaaaaguuuuauuuuucuaaaaaaagaaaaaagaagaaaaaauuuaaag

SEQ ID NO: 526213 - RNA, 64 nt, hsa
ucuggaaaaaaaaaaaaaaaugaaaaaaagaaaaaaaaaagagcuauagaaauccuugucaaag

SEQ ID NO: 526214 - RNA, 64 nt, hsa
ucugguugaacucuggaaaaaaaaaaaaaaaugaaaaaaagaaaaaaaaaagagcuauagaaau

SEQ ID NO: 526215 - RNA, 64 nt, hsa
agaaaaaguauuuuuucuccaccagacaaauggaaaaaaagaggaaagauuaacuauuugcacc

SEQ ID NO: 526216 - RNA, 64 nt, hsa
ccgcgaagugacaguuuacaaaauuauuuucugcaaaaaagaaaaaaaaguuacguuaaaaacc

SEQ ID NO: 526217 - RNA, 64 nt, hsa
auuauuaaacuuuuucuaaaaagugaaaaaaaaaaaaaaagauauaagaacucaaggucccaua

SEQ ID NO: 526218 - RNA, 64 nt, hsa
aacaaugauuuaucagagaaaggggucuguuuucaaaaaagauucuguaaugaauuuuaugugu

SEQ ID NO: 526219 - RNA, 64 nt, hsa
uagggagaaaacuagucuaaauuauuucaacuggaaaaaagaaaaaagaguccucuucuuuucc

SEQ ID NO: 526220 - RNA, 64 nt, hsa
aaaacuagucuaaauuauuucaacuggaaaaaagaaaaaagaguccucuucuuuucccagccuu

SEQ ID NO: 526221 - RNA, 64 nt, hsa
agaaguaaggaaaaggagagagcuagucuagauaaaaaaagagauaaagacuacagaaggaaag

SEQ ID NO: 526222 - RNA, 64 nt, hsa
aaaagaagagaaaagaucgucugagaaaucugaaaaaaaagaaagcaaggauacuaagaaaaua

SEQ ID NO: 526223 - RNA, 64 nt, hsa
cuggggcgguauggucaggacacaagccucugucaaaaaagaagagaaaagaucgucugagaaa

SEQ ID NO: 526224 - RNA, 64 nt, hsa
ucuuaagcaaacagucccaaaccucuuaggggugaaaaaagaaacaugccacuugauuaggaga

SEQ ID NO: 526225 - RNA, 64 nt, hsa
cugggcaagaagagcgaaacugggucucaaguuaaaaaaagaaagcaaggaaagaguaauuuac

SEQ ID NO: 526226 - RNA, 64 nt, hsa
aaaagcacuguuucuauuuuuuucuuuuuuuccaaaaaaagaaaguaauaaaaacuuaaauucu

SEQ ID NO: 526227 - RNA, 64 nt, hsa
cuccaaggcccaggacacuugucagaaggaugcaaaaaaagaaaaaaguacauccacccucuua

SEQ ID NO: 526228 - RNA, 64 nt, hsa
uugggguuuuguuucuguuguuguucaaaugcaaaaaaaagaaaaaaaaagaaaaaaaaaggug

SEQ ID NO: 526229 - RNA, 64 nt, hsa
guuucuguuguuguucaaaugcaaaaaaaagaaaaaaaaagaaaaaaaaaggugacucacauug

SEQ ID NO: 526230 - RNA, 64 nt, hsa
cuccagccuggcgacagagcaaggcuccacucaaaaaaaagauuuaaaggggaaaaaauugaaa

SEQ ID NO: 526231 - RNA, 64 nt, hsa
ucagccugagugacagagagacuuugucucaaaaaaaaaagaaaauuuuaauuuuaauguagac

SEQ ID NO: 526232 - RNA, 64 nt, hsa
caacacagugagaccccuucucaaaaaaaaaaaaaaaaaagagagagugugugauuagaagcua

SEQ ID NO: 526233 - RNA, 64 nt, hsa
uaggaaaguuuugagcuucaagucagugaggaguaaaaaagauuuuuaaaaagcaaagaaaaca

SEQ ID NO: 526234 - RNA, 64 nt, hsa
aaaggaaacaaacagacaacaaaaagaagaaaaaaaaaaagaaccuccuuggaaaaauuaauug

SEQ ID NO: 526235 - RNA, 64 nt, hsa
cccacuaugcccucauuuuuuuaaaaaaggaaaaaaaaaagaaacuggguuccagucuuaauuc

SEQ ID NO: 526236 - RNA, 64 nt, hsa
uaaauaaaaauaaaaaaaauaaaaaaggaaaaaaaaaaaagaagaaacaagacaugccaccuuu

SEQ ID NO: 526237 - RNA, 64 nt, hsa
aagccaaaaaaaaaaaaaaaaaaaaaaaaaaaagaaaaaagaaaaaaaaaauccaaaagagaga

SEQ ID NO: 526238 - RNA, 64 nt, hsa
ccuuuaaaagccaaaaaaaaaaaaaaaaaaaaaaaaaaaagaaaaaagaaaaaaaaaauccaaa

SEQ ID NO: 526239 - RNA, 64 nt, hsa
ccaggcaccauguuuucuuugaguccaacucauuaaaaaagaagaaucucugucaccucagcca

SEQ ID NO: 526240 - RNA, 64 nt, hsa
uuauauauauauauauaaaaauauauauauuaaaaaaaaagacaguauuuaucguagcauuagu

SEQ ID NO: 526241 - RNA, 64 nt, hsa
aggagugaaacuccgucucaaaaaaaaaaaagaaaaaaaagaaguacaagaguauaauaccuuc

SEQ ID NO: 526242 - RNA, 64 nt, hsa
cuggacaacaggagugaaacuccgucucaaaaaaaaaaaagaaaaaaaagaaguacaagaguau

SEQ ID NO: 526243 - RNA, 64 nt, hsa
gggagucaauauguaguggaaagaagcauguagcaaaaaagacaaccuugaucuuuaauaaaaa

SEQ ID NO: 526244 - RNA, 64 nt, hsa
gcauguagcaaaaaagacaaccuugaucuuuaauaaaaaagaaguugguuuauuuccaaaauaa

SEQ ID NO: 526245 - RNA, 64 nt, hsa
cagaaaaaaaaagcauuaaaauuuauuugaaaccaaaaaagagcccaaaaagccaaagcaaucc

SEQ ID NO: 526246 - RNA, 64 nt, hsa
ugggcaaccaagcgagacucugccuuaaaaaaaaaaaaaagaaaauguggcacauauacaccau

SEQ ID NO: 526247 - RNA, 64 nt, hsa
ggcacauauacaccauggaauacuaugcagccauaaaaaagaaugggaucauguccugugcagc

SEQ ID NO: 526248 - RNA, 64 nt, hsa
ugguuugcccaaggacuacaaauaaaccaacgggaaaaaagaaagguuccaguuuugucugaaa

SEQ ID NO: 526249 - RNA, 64 nt, hsa
cuggcccaacuugggaguggggaaauugcuuaaaaaaaaagaaaaagaaaaaaaaaaagauuau

SEQ ID NO: 526250 - RNA, 64 nt, hsa
ggggaaauugcuuaaaaaaaaagaaaaagaaaaaaaaaaagauuauucuaaauaaaaggaaaaa

SEQ ID NO: 526251 - RNA, 64 nt, hsa
gccugggcgacagagugagacuccgucucaaaaaaaaaaagaagguuguacccacaguauacgu

SEQ ID NO: 526252 - RNA, 64 nt, hsa
cagggagacuccaucucaaaaaaaaaaaaaaaaaaaaaaagacauucaacuugaggcuccuguu

SEQ ID NO: 526253 - RNA, 64 nt, hsa
uuuuguuuuuuugcagcuugcugauauuuuauauaaaaaagaaaagcaaagcaaaagagaagcu

SEQ ID NO: 526254 - RNA, 64 nt, hsa
ucuaaaaauaugggagcugagauuccguucguggaaaaaagacaaggccacccucucgcccuca

SEQ ID NO: 526255 - RNA, 64 nt, hsa
uguggcagaagcgagaaaacuuuguuuauugaaaaaaaaagaaaaagaaagcaagaaaaaaaga

SEQ ID NO: 526256 - RNA, 64 nt, hsa
uguuuauugaaaaaaaaagaaaaagaaagcaagaaaaaaagauacuauggggucaaguguaacu

SEQ ID NO: 526257 - RNA, 64 nt, hsa
cagaaaacuuuugacuguauuuauuuauuguugcaaaaaagacgcuuuuuuauugcugcccuca

SEQ ID NO: 526258 - RNA, 64 nt, hsa
cugcuguggcuagagaguuugaggauugcuuuuuaaaaaagacagcaaacuuuuuuuuuuauuu

SEQ ID NO: 526259 - RNA, 64 nt, hsa
uuuaaaaaagacagcaaacuuuuuuuuuuauuuaaaaaaagauauauuaacaguuuuagaaguc

SEQ ID NO: 526260 - RNA, 64 nt, hsa
agaaaaagaaaaaucuuaaaaaaaaaaaaaaaaaaaaaaagaaaaaaagaaaaacaggaaaaag

SEQ ID NO: 526261 - RNA, 64 nt, hsa
aaaaaucuuaaaaaaaaaaaaaaaaaaaaaaagaaaaaaagaaaaacaggaaaaaggacuuuuu

SEQ ID NO: 526262 - RNA, 64 nt, hsa
cagagugagacccugucuccgaaaaaaaaaaaaaaaaaaagaacggaaaaagaaaugcuuacau

SEQ ID NO: 526263 - RNA, 64 nt, hsa
cugggugacagagcgagacuccgucucaaaaaaaaaaaaagaaagcagauccucauggcuauag

SEQ ID NO: 526264 - RNA, 64 nt, hsa
aguuaucagacauuauuuauaaaacuuaguuuaaaaaaaagacaaaaaaaaaaaagccaagccg

SEQ ID NO: 526265 - RNA, 64 nt, hsa
uaauagaaacuuugcuaguuaaaaaaaaaagaaaaaaaaagaaaaaaaaucccuuucuuguaaa

SEQ ID NO: 526266 - RNA, 64 nt, hsa
gaagaaaguauaauagaaacuuugcuaguuaaaaaaaaaagaaaaaaaaagaaaaaaaaucccu

SEQ ID NO: 526267 - RNA, 64 nt, hsa
guuauuaaauuaauuauauguuuaaaaguuaaagaaaaaagagcugcagaguauuuauaaaacu

SEQ ID NO: 526268 - RNA, 64 nt, hsa
uacaacacuggugacagucauaugguuuugaaaaaaaaaagaaauuuugcuucuucccagcuuu

SEQ ID NO: 526269 - RNA, 64 nt, hsa
uaacagauugcuagacaagagaaaaaacuugaagaaaaaagaagcuuaauuucaugcuucauaa

SEQ ID NO: 526270 - RNA, 64 nt, hsa
aggcugaugaugguauaaaguuugcucauuaagaaaaaaagacaaggcugauuuugaagagagu

SEQ ID NO: 526271 - RNA, 64 nt, hsa
cuguaauauuuuuguaaaaaaaaaaaaaaaggaaaaaaaagaccagcuaaaauuuucgacuuga

SEQ ID NO: 526272 - RNA, 64 nt, hsa
agcgagacuccgccucaaaaaaaaaaaaaaaagaaaaaaagaaauguaccuguuggcaggagaa

SEQ ID NO: 526273 - RNA, 64 nt, hsa
ggcgacagagcgagacuccgccucaaaaaaaaaaaaaaaagaaaaaaagaaauguaccuguugg

SEQ ID NO: 526274 - RNA, 64 nt, hsa
gaucauuaccuguaaaugaaagaccuuaauaggaaaaaaagaguaaagcucagugugaaugcaa

SEQ ID NO: 526275 - RNA, 64 nt, hsa
uagcauguccagugacaagucacauccgguguaaaaaaaagagaucagccaguuaccuucucca

SEQ ID NO: 526276 - RNA, 64 nt, hsa
ccucaaagacucuuguccucuugucccuccugagaaaaaagaaaacgaaaagugggguuuuuuu

SEQ ID NO: 526277 - RNA, 64 nt, hsa
gaauuuuaauuguaacauuuuuagaaaaagaacaaaaaaagaaaaaaaaaagaaagaaacacag

SEQ ID NO: 526278 - RNA, 64 nt, hsa
guaacauuuuuagaaaaagaacaaaaaaagaaaaaaaaaagaaagaaacacagcaacuguagau

SEQ ID NO: 526279 - RNA, 64 nt, hsa
ccgggaagggaccuugcagggaccucucccuccaaaaaaagaaaaaaagaaaaagaaagaaaaa

SEQ ID NO: 526280 - RNA, 64 nt, hsa
ggaccuugcagggaccucucccuccaaaaaaagaaaaaaagaaaaagaaagaaaaaauaaauga

SEQ ID NO: 526281 - RNA, 64 nt, hsa
agaccuugucucaaaaauaaacaaacuaaaauuaaaaaaagaagacgagagauagugggugugg

SEQ ID NO: 526282 - RNA, 64 nt, hsa
uccagccugggcgaaagagcgacucugucuccaaaaaaaagagaagaggagaggacacagagac

SEQ ID NO: 526283 - RNA, 64 nt, hsa
gaggaagaucuacgaagcaaauggaaaacaaacaaaaaaagaggcagggguugcaauccuaguc

SEQ ID NO: 526284 - RNA, 64 nt, hsa
cuuccuguuaccaaagcugggcagagacaaaaccaaaaaagagaauuuuagaccaauauccuug

SEQ ID NO: 526285 - RNA, 64 nt, hsa
uugaaaaacacuacuuuaaaguucauauggaaccaaaaaagagcccacauugccaagucaaucc

SEQ ID NO: 526286 - RNA, 64 nt, hsa
aucauucuaauaccaaaaccugacaggcacaaugaaaaaagaaaacuucaggcugguacuccug

SEQ ID NO: 526287 - RNA, 64 nt, hsa
gcuacagcaacuaaaacagcaugguacugguauaaaaaaagacacauagaucaauggaauaggu

SEQ ID NO: 526288 - RNA, 64 nt, hsa
gguacauauacaccauggaauacuaugcagccauaaaaaagaacaagacuguguccuuuacagc

SEQ ID NO: 526289 - RNA, 64 nt, hsa
ggaggugauaaaaaacuguaaaaaaaaaaaaaaaaaaaaagacaaaacaaaagacaaaaaaaaa

SEQ ID NO: 526290 - RNA, 64 nt, hsa
cacagaagagauuuaaaaaaaaaaaaggaaaaaaaaaaaagacauaaacuggcaccaguuaacu

SEQ ID NO: 526291 - RNA, 64 nt, hsa
aaaaacacaaacagaagaggaaaaaaaagcaacaaaaaaagaaaacacacagaagagauuuaaa

SEQ ID NO: 526292 - RNA, 64 nt, hsa
auuaaacgucuguggagcuucugcugcaaggaacaaaaaagaaaaaaaucaaaaaagcgacaaa

SEQ ID NO: 526293 - RNA, 64 nt, hsa
uugaaaaaaaaaaacacaaaaaaagacaaaaaaaaaaaaagaaaauauuuuggcagguuauguu

SEQ ID NO: 526294 - RNA, 64 nt, hsa
cuggggauucuugaacuugaaaaaaaaaaacacaaaaaaagacaaaaaaaaaaaaagaaaauau

SEQ ID NO: 526295 - RNA, 64 nt, hsa
gaaauggaaaagaaaaaaaaaagacaaaaaaaaaaaaaaagaaaagaaaaaaaaucucaucacu

SEQ ID NO: 526296 - RNA, 64 nt, hsa
ugcuguaaauauuucaacgaaauggaaaagaaaaaaaaaagacaaaaaaaaaaaaaaagaaaag

SEQ ID NO: 526297 - RNA, 64 nt, hsa
cuauuugaaaagguuaaaaaaaagaacaaaaaaaaaaaaagaacuuguacuguauuuccuaaac

SEQ ID NO: 526298 - RNA, 64 nt, hsa
ugcucaaaggguuaagucuauuugaaaagguuaaaaaaaagaacaaaaaaaaaaaaagaacuug

SEQ ID NO: 526299 - RNA, 64 nt, hsa
aaaguuuuguuuuguuuuuuucuggaaaaaaaagaaaaaagauacgacucucagaagccuguuu

SEQ ID NO: 526300 - RNA, 64 nt, hsa
uggcaaaaaaguuuuguuuuguuuuuuucuggaaaaaaaagaaaaaagauacgacucucagaag

SEQ ID NO: 526301 - RNA, 64 nt, hsa
guaaaacugaucaaaagcauaauugaaaguucugaaaaaagaaaaauaauaauauguagaaaaa

SEQ ID NO: 526302 - RNA, 64 nt, hsa
auuggacguugugacucuugccuuuuaagaagaaaaaaaagauaggacaaaguauuugaagcuc

SEQ ID NO: 526303 - RNA, 64 nt, hsa
uagagacuucuaaaucauaaucauccuuuuuuaaaaaaaagaauuuuaaaaaagauggauuuga

SEQ ID NO: 526304 - RNA, 64 nt, hsa
aucauaaucauccuuuuuuaaaaaaaagaauuuuaaaaaagauggauuugacacacucaccauu

SEQ ID NO: 526305 - RNA, 64 nt, hsa
uauaucccuugugcgauaaaaaaaaaaaaaaaaaaaaaaagagaaucguacgucgacuuucgau

SEQ ID NO: 526306 - RNA, 64 nt, hsa
uccagccugggcaacauagcgagaccucaucuccaaaaaagaaaacaaaaaacaaaaaaaggaa

SEQ ID NO: 526307 - RNA, 64 nt, hsa
gaaaaauuuaugcacugauuuaaaacaaaccaaaaaaaaagaaaaaaacaaaaaaaaaaauccc

SEQ ID NO: 526308 - RNA, 64 nt, hsa
gcaagcacacccgugguugugaaaauaguauagcaaaaaagaaaaauccccgguuauugaugua

SEQ ID NO: 526309 - RNA, 64 nt, hsa
agaacacagaaagucuuaggaucaugaacucugaaaaaaagagaaaccuuaucuuugcuuugug

SEQ ID NO: 526310 - RNA, 64 nt, hsa
aaaaaaaaaaaaaaaagcaaccaaccccaacaacaaaaaagaauguuuugguauuggagaaggg

SEQ ID NO: 526311 - RNA, 64 nt, hsa
uuauauuuguauuaacuuuaacuuauuaaaaaaaaaaaaagaaaaagaaaaacgauuuaaaaaa

SEQ ID NO: 526312 - RNA, 64 nt, hsa
ugcacaagcuaagagagcuugcaaaaaaaaaaagaaaaaagaaaaaaaaaaaccacguuucuuu

SEQ ID NO: 526313 - RNA, 64 nt, hsa
gucugaaugcacaagcuaagagagcuugcaaaaaaaaaaagaaaaaagaaaaaaaaaaaccacg

SEQ ID NO: 526314 - RNA, 64 nt, hsa
ucacaaacuuaagaggaaauaaggaaaaggagagaaaaaagaaauugguuaugaauaaaaguga

SEQ ID NO: 526315 - RNA, 64 nt, hsa
ggaagggauuccugauuuuacuaaaaaaaaaaaaaaaaaagagagggcggggacaaauaucaaa

SEQ ID NO: 526316 - RNA, 64 nt, hsa
cuacugggaauauuuuuguagagcugcauugugaaaaaaagauggucuuaccugaaucuuaggg

SEQ ID NO: 526317 - RNA, 64 nt, hsa
caugauuuucaaguuguaaugcagauggacagauaaaaaagauuuuacguuugucuuuuggcca

SEQ ID NO: 526318 - RNA, 64 nt, hsa
aggguagauguaguugcuuaguagcauuuuggaaaaaaaagaaaaaaagguuugguuugguuuu

SEQ ID NO: 526319 - RNA, 64 nt, hsa
aagagcgaaacuccgucucaaaaaaaaaaaaaaaaaaaaagaaagaaaagaguaacagaaagau

SEQ ID NO: 526320 - RNA, 64 nt, hsa
ucacuuuuuuuguucuaggggaaaugaaugugcaaaaaaagaaaaagaacuguugguuauuugu

SEQ ID NO: 526321 - RNA, 64 nt, hsa
caaaguuaaauguaucacauugaagaaggcuagaaaaaaagaaugaguaaugugaucgcuuggu

SEQ ID NO: 526322 - RNA, 64 nt, hsa
augagacacucuuugcauuuugucuaagcgaaauaaaaaagaaaagguugucugccuuuauuuc

SEQ ID NO: 526323 - RNA, 64 nt, hsa
uaauuaaagaaaauugccaaaauauauuaaaaaaaaaaaagagaaaauacugaaaccacagaca

SEQ ID NO: 526324 - RNA, 64 nt, hsa
cagauaucauguaggaaagagaggauaaacaaagaaaaaagaaaaaaaaauaagcucauaccca

SEQ ID NO: 526325 - RNA, 64 nt, hsa
auuuugaaugaguauggaaccuccaugggcucagaaaaaagaugcuaauauauuuaucucauug

SEQ ID NO: 526326 - RNA, 64 nt, hsa
aaaaaagagaaaaaacauaacaaguaaauuuuaaaaaaaagaacaaaauauaagaggaacaaag

SEQ ID NO: 526327 - RNA, 64 nt, hsa
aaaaaaacaaaaaacaaaaaaacacacacacacaaaaaaagagaaaaaacauaacaaguaaauu

SEQ ID NO: 526328 - RNA, 64 nt, hsa
aaacauauuuuuucaggaaaaacaaacuuuaaaaaaaaaagaggagaaauaaaaccuuuucucc

SEQ ID NO: 526329 - RNA, 64 nt, hsa
aaaagauuuucgaucuucucacucuuacuucuagaaaaaagauccagcccaggcacggaauggg

SEQ ID NO: 526330 - RNA, 64 nt, hsa
cccaagaccacagaaaagagaaaggaaaggccaaaaaaaagaggaaaagaaaaauguacaaaaa

SEQ ID NO: 526331 - RNA, 64 nt, hsa
ugcaauaaccagcauaauaaaaaggcaaucacauaaaaaagaguuuagucgucuaaacauaagu

SEQ ID NO: 526332 - RNA, 64 nt, hsa
cguuaauuuugcuucucuuucuaaaaaaaaaaaaaaaaaagaaagagaagaaagaagugauucc

SEQ ID NO: 526333 - RNA, 64 nt, hsa
uuggaucugcggaaguaaccacaaaauauuaucgaaaaaagaaaagaauucuaaugaccagccg

SEQ ID NO: 526334 - RNA, 64 nt, hsa
uuuucuguuuuuuaaccuuuuguuccgccauuuaaaaaaagaaaaaaaaaaagcuuauguuucu

SEQ ID NO: 526335 - RNA, 64 nt, hsa
gucauggggguggguuuccuggcaccuacaugaaaaaaaagacaaguuauaugggugaugaaga

SEQ ID NO: 526336 - RNA, 64 nt, hsa
guuugaauucuggcuacauguuuuaaguaagaaaaaaaaagacguauuuuugcuuacucagaua

SEQ ID NO: 526337 - RNA, 64 nt, hsa
ucugucuuuuaauaaaagaacuuuacacauuuguaaaaaagagguucuugguaagauauaaaau

SEQ ID NO: 526338 - RNA, 64 nt, hsa
cacauuauuauugcuagaauaauaaaaguuuuauaaaaaagaagcaacaagcagcacguauuag

SEQ ID NO: 526339 - RNA, 64 nt, hsa
uuuucacuugcauugucauuagauguccagaaaaaaaaaagaugucaaaauguuuuucuaaaaa

SEQ ID NO: 526340 - RNA, 64 nt, hsa
ccagaaaaaaaaaagaugucaaaauguuuuucuaaaaaaagaaagcaaaaaaagcaaggcaaaa

SEQ ID NO: 526341 - RNA, 64 nt, hsa
ugggcagcauagcgagaccccaucucuauauaaaaaaaaagauguuaaaacagugaaauuacag

SEQ ID NO: 526342 - RNA, 64 nt, hsa
acagagugagacccuguccaaaaaaaaaaaaaaaaaaaaagaaggcaauggcuuugugcuuuug

SEQ ID NO: 526343 - RNA, 64 nt, hsa
gagaaaaaauauacuugcuaucuauaaaaaagagaaaaaagaaaaaaaaugagaaaaaaguaag

SEQ ID NO: 526344 - RNA, 64 nt, hsa
gaguucuaugagaaaaaauauacuugcuaucuauaaaaaagagaaaaaagaaaaaaaaugagaa

SEQ ID NO: 526345 - RNA, 64 nt, hsa
uagugauauaucaguguuugagagugaccucuagaaaaaagaaaaguguuuuuagaaaugcgua

SEQ ID NO: 526346 - RNA, 64 nt, hsa
aggaagaguugcuucccauuucagggcccugccaaaaaaagaagaaagcuugccuuuggugggg

SEQ ID NO: 526347 - RNA, 64 nt, hsa
uuugccagccugaacuauauuuaagagacuuuguaaaaaagaaaaauguauauagcugugaguu

SEQ ID NO: 526348 - RNA, 64 nt, hsa
gccuuuuccucaaguuacuuuccuucauuuucuuaaaaaagaaaaaaaauuauuaaauguuucu

SEQ ID NO: 526349 - RNA, 64 nt, hsa
gagucaaggucaguucaggaaagcuuaagcaucgaaaaaagaaaaaaagccaugauguacccuc

SEQ ID NO: 526350 - RNA, 64 nt, hsa
uagcugugagcucaaacaaaaacugcagacaaacaaaaaagagaaaagcuuuuauuuguguuuu

SEQ ID NO: 526351 - RNA, 64 nt, hsa
ugggaagaguugcuuccuauuucaggacccugccaaaaaagaagaaagcuugccuuuggugggg

SEQ ID NO: 526352 - RNA, 64 nt, hsa
uagugauauaucaguguuugggagugaccucuagaaaaaagaaaacuguuuuuagaaauacaua

SEQ ID NO: 526353 - RNA, 64 nt, hsa; identical to SEQ ID NO: 313156

SEQ ID NO: 526354 - RNA, 64 nt, hsa; identical to SEQ ID NO: 313157

SEQ ID NO: 526355 - RNA, 64 nt, hsa; identical to SEQ ID NO: 313158

SEQ ID NO: 526356 - RNA, 64 nt, hsa; identical to SEQ ID NO: 313159

SEQ ID NO: 526357 - RNA, 64 nt, hsa
ucuucuucuuuuuuuuuuucugaaaaaaggaaaaagcacacagcacacaauuucaagccauuuu

SEQ ID NO: 526358 - RNA, 64 nt, hsa
cuuuuuuuuuuucugaaaaaaggaaaaagcacacagcacacaauuucaagccauuuucagauca

SEQ ID NO: 526359 - RNA, 64 nt, hsa
ggaugcagagaaucagacuggccugaggugaaggagcacacagcccugagggcuuggaacccug

SEQ ID NO: 526360 - RNA, 64 nt, hsa
aucccaucugugcuuaaccagaauccagcaagucagcacacaagugauuuuauuguuauuuugu

SEQ ID NO: 526361 - RNA, 64 nt, hsa
agaaggauggcggggcuagggaagcagagagcagagcacacacuggcucaagcagcagagguaa

SEQ ID NO: 526362 - RNA, 64 nt, hsa
augagaugcugcuccaagccugugaggggcgaacagcacacaaggcugcccgucuugggaucac

SEQ ID NO: 526363 - RNA, 64 nt, hsa
ugcagcuguccagccacugcccuuuaacaugcccagcacacaugggaggccuguggcccugugu

SEQ ID NO: 526364 - RNA, 64 nt, hsa
acaguaugaacccugcuugauguaaaauggaaauagcacacaggcagauggcccuggguuugga

SEQ ID NO: 526365 - RNA, 64 nt, hsa
aagucaaggaacccagggccagcuggaaguguggagcacacaugcuguggagcacacaugcugu

SEQ ID NO: 526366 - RNA, 64 nt, hsa
ggccagcuggaaguguggagcacacaugcuguggagcacacaugcuguggagauugcagugugu

SEQ ID NO: 526367 - RNA, 64 nt, hsa
cguaaagccucaaaacacagcacacacacacacgagcacacacacacacacacacacgaacaca

SEQ ID NO: 526368 - RNA, 64 nt, hsa
gugccuucaaagcccacguaaagccucaaaacacagcacacacacacacgagcacacacacaca

SEQ ID NO: 526369 - RNA, 64 nt, hsa
guguguuuuucuccucuugguuuucauuugcucaagcacacaaaagggacuuuuguuuacucua

SEQ ID NO: 526370 - RNA, 64 nt, hsa
agacaccugggaggagucuccaagccaugugcacagcacacacgugcagugcacacaaagaaau

SEQ ID NO: 526371 - RNA, 64 nt, hsa
acagacagcuuggucacaacacaacuguguccugagcacacaagauuccaucagcccugaagga

SEQ ID NO: 526372 - RNA, 64 nt, hsa
uuuaacaauccugacaugcucccuccaauuuaaaagcacacacacacacacacacacacacaca

SEQ ID NO: 526373 - RNA, 64 nt, hsa
cagcccccuguauucucaugauuuucucucaggaagcacacacugugaauggcagacuuuucau

SEQ ID NO: 526374 - RNA, 64 nt, hsa
aauaaugaguaggaucuuguuuuguuuuaucaccagcacacagauugcuauaaacuguuacuuu

SEQ ID NO: 526375 - RNA, 64 nt, hsa
uuuucugauaauuagcugauauucaugguuguuuagcacacaguucaggaccuuugagaucaug

SEQ ID NO: 526376 - RNA, 64 nt, hsa
aaugccuccuuuguuacacacucaagaauuugucagcacacaauuaauugcagccauaguaccu

SEQ ID NO: 526377 - RNA, 64 nt, hsa
aacugaagggccugcucuuuccauuguggaucacagcacacacauacauacacccuccaccucc

SEQ ID NO: 526378 - RNA, 64 nt, hsa
uuuagggccccuuagcagggugagcuguuaaaacagcacacaucucucauccccucuuccuuua

SEQ ID NO: 526379 - RNA, 64 nt, hsa
uaccauuucauuuuuuggcacuaggucauuaaguagcacacagucugaaugcccuuuucuggag

SEQ ID NO: 526380 - RNA, 64 nt, hsa
gaccggcaagcuggcuguguacaggaaaauuggaagcacacaguggacugugccucuuaaagau

SEQ ID NO: 526381 - RNA, 64 nt, hsa
auauauauauauauauauauauauaugguaaacaagcacacacaauuuuauccaaugcaaacaa

SEQ ID NO: 526382 - RNA, 64 nt, hsa
acaguguuccucuacgacccgaccucucuauguaagcacacaugcgcacacacacuugcauuca

SEQ ID NO: 526383 - RNA, 64 nt, hsa
gaugaaggcaaaaacuguacuguguuucgcauuaagcacacacaucuggcccugacuucuggag

SEQ ID NO: 526384 - RNA, 64 nt, hsa
ggcgcaaaggugccucauagcauagccagcauucagcacacacaaaccuacugcccacauuugg

SEQ ID NO: 526385 - RNA, 64 nt, hsa
acacagcacaugcacacaggugcacagaccacacagcacacacaagugcacagagcacacugca

SEQ ID NO: 526386 - RNA, 64 nt, hsa
caugcacgcuugcacacaugcacacagaccacauagcacacaugugcacugaccacaccuguau

SEQ ID NO: 526387 - RNA, 64 nt, hsa
ucaaggaacuguguguuuccaacaucaugguagcagcacacacuuccaaagcucagccagggac

SEQ ID NO: 526388 - RNA, 64 nt, hsa
uauauaaauaugugaaauauuaugaucugaacuuagcacacaugaagcaacauuucuuugcuac

SEQ ID NO: 526389 - RNA, 64 nt, hsa; identical to SEQ ID NO: 221340

SEQ ID NO: 526390 - RNA, 64 nt, hsa; identical to SEQ ID NO: 221341

SEQ ID NO: 526391 - RNA, 64 nt, hsa; identical to SEQ ID NO: 221342

SEQ ID NO: 526392 - RNA, 64 nt, hsa; identical to SEQ ID NO: 221343

SEQ ID NO: 526393 - RNA, 64 nt, hsa; identical to SEQ ID NO: 221344

SEQ ID NO: 526394 - RNA, 64 nt, hsa; identical to SEQ ID NO: 221345

SEQ ID NO: 526395 - RNA, 64 nt, hsa; identical to SEQ ID NO: 221346

SEQ ID NO: 526396 - RNA, 64 nt, hsa; identical to SEQ ID NO: 221347

SEQ ID NO: 526397 - RNA, 64 nt, hsa; identical to SEQ ID NO: 221348

SEQ ID NO: 526398 - RNA, 64 nt, hsa; identical to SEQ ID NO: 221349

SEQ ID NO: 526399 - RNA, 64 nt, hsa; identical to SEQ ID NO: 221350

SEQ ID NO: 526400 - RNA, 64 nt, hsa; identical to SEQ ID NO: 221351

SEQ ID NO: 526401 - RNA, 64 nt, hsa; identical to SEQ ID NO: 221352

SEQ ID NO: 526402 - RNA, 64 nt, hsa; identical to SEQ ID NO: 221353

SEQ ID NO: 526403 - RNA, 64 nt, hsa; identical to SEQ ID NO: 221354

SEQ ID NO: 526404 - RNA, 64 nt, hsa; identical to SEQ ID NO: 221355

SEQ ID NO: 526405 - RNA, 64 nt, hsa; identical to SEQ ID NO: 221356

SEQ ID NO: 526406 - RNA, 64 nt, hsa; identical to SEQ ID NO: 221357

SEQ ID NO: 526407 - RNA, 64 nt, hsa; identical to SEQ ID NO: 221358

SEQ ID NO: 526408 - RNA, 64 nt, hsa; identical to SEQ ID NO: 221359

SEQ ID NO: 526409 - RNA, 64 nt, hsa; identical to SEQ ID NO: 221360

SEQ ID NO: 526410 - RNA, 64 nt, hsa; identical to SEQ ID NO: 221361

SEQ ID NO: 526411 - RNA, 64 nt, hsa; identical to SEQ ID NO: 221362

SEQ ID NO: 526412 - RNA, 64 nt, hsa; identical to SEQ ID NO: 221363

SEQ ID NO: 526413 - RNA, 64 nt, hsa; identical to SEQ ID NO: 221364

SEQ ID NO: 526414 - RNA, 64 nt, hsa; identical to SEQ ID NO: 221365

SEQ ID NO: 526415 - RNA, 64 nt, hsa; identical to SEQ ID NO: 221366

SEQ ID NO: 526416 - RNA, 64 nt, hsa; identical to SEQ ID NO: 221367

SEQ ID NO: 526417 - RNA, 64 nt, hsa; identical to SEQ ID NO: 221368

SEQ ID NO: 526418 - RNA, 64 nt, hsa; identical to SEQ ID NO: 221369

SEQ ID NO: 526419 - RNA, 64 nt, hsa; identical to SEQ ID NO: 221370

SEQ ID NO: 526420 - RNA, 64 nt, hsa; identical to SEQ ID NO: 221371

SEQ ID NO: 526421 - RNA, 64 nt, hsa; identical to SEQ ID NO: 221372

SEQ ID NO: 526422 - RNA, 64 nt, hsa; identical to SEQ ID NO: 221373

SEQ ID NO: 526423 - RNA, 64 nt, hsa; identical to SEQ ID NO: 221374

SEQ ID NO: 526424 - RNA, 64 nt, hsa; identical to SEQ ID NO: 221375

SEQ ID NO: 526425 - RNA, 64 nt, hsa; identical to SEQ ID NO: 221376

SEQ ID NO: 526426 - RNA, 64 nt, hsa; identical to SEQ ID NO: 221377

SEQ ID NO: 526427 - RNA, 64 nt, hsa; identical to SEQ ID NO: 221378

SEQ ID NO: 526428 - RNA, 64 nt, hsa; identical to SEQ ID NO: 221379

SEQ ID NO: 526429 - RNA, 64 nt, hsa; identical to SEQ ID NO: 221380

SEQ ID NO: 526430 - RNA, 64 nt, hsa; identical to SEQ ID NO: 221381

SEQ ID NO: 526431 - RNA, 64 nt, hsa; identical to SEQ ID NO: 221382

SEQ ID NO: 526432 - RNA, 64 nt, hsa; identical to SEQ ID NO: 221383

SEQ ID NO: 526433 - RNA, 64 nt, hsa; identical to SEQ ID NO: 221384

SEQ ID NO: 526434 - RNA, 64 nt, hsa; identical to SEQ ID NO: 221385

SEQ ID NO: 526435 - RNA, 64 nt, hsa; identical to SEQ ID NO: 221386

SEQ ID NO: 526436 - RNA, 64 nt, hsa; identical to SEQ ID NO: 221387

SEQ ID NO: 526437 - RNA, 64 nt, hsa; identical to SEQ ID NO: 257800

SEQ ID NO: 526438 - RNA, 64 nt, hsa; identical to SEQ ID NO: 257801

SEQ ID NO: 526439 - RNA, 64 nt, hsa; identical to SEQ ID NO: 257802

SEQ ID NO: 526440 - RNA, 64 nt, hsa; identical to SEQ ID NO: 257803

SEQ ID NO: 526441 - RNA, 64 nt, hsa; identical to SEQ ID NO: 257804

SEQ ID NO: 526442 - RNA, 64 nt, hsa; identical to SEQ ID NO: 257805

SEQ ID NO: 526443 - RNA, 64 nt, hsa; identical to SEQ ID NO: 257806

SEQ ID NO: 526444 - RNA, 64 nt, hsa; identical to SEQ ID NO: 257807

SEQ ID NO: 526445 - RNA, 64 nt, hsa; identical to SEQ ID NO: 257808

SEQ ID NO: 526446 - RNA, 64 nt, hsa; identical to SEQ ID NO: 257809

SEQ ID NO: 526447 - RNA, 64 nt, hsa; identical to SEQ ID NO: 257810

SEQ ID NO: 526448 - RNA, 64 nt, hsa; identical to SEQ ID NO: 257811

SEQ ID NO: 526449 - RNA, 64 nt, hsa; identical to SEQ ID NO: 257812

SEQ ID NO: 526450 - RNA, 64 nt, hsa; identical to SEQ ID NO: 257813

SEQ ID NO: 526451 - RNA, 64 nt, hsa; identical to SEQ ID NO: 257814

SEQ ID NO: 526452 - RNA, 64 nt, hsa; identical to SEQ ID NO: 257815

SEQ ID NO: 526453 - RNA, 64 nt, hsa; identical to SEQ ID NO: 257816

SEQ ID NO: 526454 - RNA, 64 nt, hsa; identical to SEQ ID NO: 257817

SEQ ID NO: 526455 - RNA, 64 nt, hsa; identical to SEQ ID NO: 257818

SEQ ID NO: 526456 - RNA, 64 nt, hsa; identical to SEQ ID NO: 257819

SEQ ID NO: 526457 - RNA, 64 nt, hsa; identical to SEQ ID NO: 257820

SEQ ID NO: 526458 - RNA, 64 nt, hsa; identical to SEQ ID NO: 257821

SEQ ID NO: 526459 - RNA, 64 nt, hsa; identical to SEQ ID NO: 257822

SEQ ID NO: 526460 - RNA, 64 nt, hsa; identical to SEQ ID NO: 257823

SEQ ID NO: 526461 - RNA, 64 nt, hsa; identical to SEQ ID NO: 257824

SEQ ID NO: 526462 - RNA, 64 nt, hsa; identical to SEQ ID NO: 257825

SEQ ID NO: 526463 - RNA, 64 nt, hsa; identical to SEQ ID NO: 257826

SEQ ID NO: 526464 - RNA, 64 nt, hsa; identical to SEQ ID NO: 257827

SEQ ID NO: 526465 - RNA, 64 nt, hsa; identical to SEQ ID NO: 257828

SEQ ID NO: 526466 - RNA, 64 nt, hsa; identical to SEQ ID NO: 257829

SEQ ID NO: 526467 - RNA, 64 nt, hsa; identical to SEQ ID NO: 257830

SEQ ID NO: 526468 - RNA, 64 nt, hsa; identical to SEQ ID NO: 257831

SEQ ID NO: 526469 - RNA, 64 nt, hsa; identical to SEQ ID NO: 236246

SEQ ID NO: 526470 - RNA, 64 nt, hsa; identical to SEQ ID NO: 236247

SEQ ID NO: 526471 - RNA, 64 nt, hsa; identical to SEQ ID NO: 236248

SEQ ID NO: 526472 - RNA, 64 nt, hsa; identical to SEQ ID NO: 236249

SEQ ID NO: 526473 - RNA, 64 nt, hsa; identical to SEQ ID NO: 236250

SEQ ID NO: 526474 - RNA, 64 nt, hsa; identical to SEQ ID NO: 236251

SEQ ID NO: 526475 - RNA, 64 nt, hsa; identical to SEQ ID NO: 236252

SEQ ID NO: 526476 - RNA, 64 nt, hsa; identical to SEQ ID NO: 236253

SEQ ID NO: 526477 - RNA, 64 nt, hsa; identical to SEQ ID NO: 236254

SEQ ID NO: 526478 - RNA, 64 nt, hsa; identical to SEQ ID NO: 236255

SEQ ID NO: 526479 - RNA, 64 nt, hsa; identical to SEQ ID NO: 236256

SEQ ID NO: 526480 - RNA, 64 nt, hsa; identical to SEQ ID NO: 236257

SEQ ID NO: 526481 - RNA, 64 nt, hsa; identical to SEQ ID NO: 236258

SEQ ID NO: 526482 - RNA, 64 nt, hsa; identical to SEQ ID NO: 236259

SEQ ID NO: 526483 - RNA, 64 nt, hsa; identical to SEQ ID NO: 236260

SEQ ID NO: 526484 - RNA, 64 nt, hsa; identical to SEQ ID NO: 236261

SEQ ID NO: 526485 - RNA, 64 nt, hsa; identical to SEQ ID NO: 68405

SEQ ID NO: 526486 - RNA, 64 nt, hsa; identical to SEQ ID NO: 68406

SEQ ID NO: 526487 - RNA, 64 nt, hsa; identical to SEQ ID NO: 68407

SEQ ID NO: 526488 - RNA, 64 nt, hsa; identical to SEQ ID NO: 68408

SEQ ID NO: 526489 - RNA, 64 nt, hsa; identical to SEQ ID NO: 68409

SEQ ID NO: 526490 - RNA, 64 nt, hsa; identical to SEQ ID NO: 68410

SEQ ID NO: 526491 - RNA, 64 nt, hsa; identical to SEQ ID NO: 68411

SEQ ID NO: 526492 - RNA, 64 nt, hsa; identical to SEQ ID NO: 68412

SEQ ID NO: 526493 - RNA, 64 nt, hsa; identical to SEQ ID NO: 68413

SEQ ID NO: 526494 - RNA, 64 nt, hsa; identical to SEQ ID NO: 68414

SEQ ID NO: 526495 - RNA, 64 nt, hsa; identical to SEQ ID NO: 68415

SEQ ID NO: 526496 - RNA, 64 nt, hsa; identical to SEQ ID NO: 210233

SEQ ID NO: 526497 - RNA, 64 nt, hsa; identical to SEQ ID NO: 210234

SEQ ID NO: 526498 - RNA, 64 nt, hsa; identical to SEQ ID NO: 210235

SEQ ID NO: 526499 - RNA, 64 nt, hsa; identical to SEQ ID NO: 210236

SEQ ID NO: 526500 - RNA, 64 nt, hsa; identical to SEQ ID NO: 210237

SEQ ID NO: 526501 - RNA, 64 nt, hsa; identical to SEQ ID NO: 210238

SEQ ID NO: 526502 - RNA, 64 nt, hsa; identical to SEQ ID NO: 210239

SEQ ID NO: 526503 - RNA, 64 nt, hsa; identical to SEQ ID NO: 210240

SEQ ID NO: 526504 - RNA, 64 nt, hsa
aaacuuaugagugacaucuggaaaguaacaaccaugcuaagauggcaaacacacuggaaacaau

SEQ ID NO: 526505 - RNA, 64 nt, hsa
acaguagauaacgcuggcaguaagagaaaucaaaugcuaagaguuguugaagcagaaggcggcu

SEQ ID NO: 526506 - RNA, 64 nt, hsa
cuggccgguggucucucauccuugugugcugcucugcuaagagauguccaaggcggagccgggg

SEQ ID NO: 526507 - RNA, 64 nt, hsa
ucggcgacaagguugugcguggcuccugaccugcugcuaagagucacuugaccagacugcaucu

SEQ ID NO: 526508 - RNA, 64 nt, hsa
gcccagccgcuaucuuagcugucuuucccagcggugcuaagaguggucucagugagaagguaga

SEQ ID NO: 526509 - RNA, 64 nt, hsa
aaguggcauuauuuauguugugcugcuguccagcugcuaagaucccuucaucugcacaagcccu

SEQ ID NO: 526510 - RNA, 64 nt, hsa
ggugcuucucagugggaagguguaaggaggggcuugcuaagaauuugagcacauguagcuaauu

SEQ ID NO: 526511 - RNA, 64 nt, hsa
ccuaagcuuuuuuuuuuuuuuuuuuuccaguuaaugcuaagaaaagauuuggggaagguuauaa

SEQ ID NO: 526512 - RNA, 64 nt, hsa
uuugccuuugaaacguuaauaaauggauuuacuuugcuaagauuuauggcaagugucaaaaaua

SEQ ID NO: 526513 - RNA, 64 nt, hsa
uuuauuuucaccuuguguacaacauggcaaagacugcuaagauuaaaauccgucucccauuugu

SEQ ID NO: 526514 - RNA, 64 nt, hsa
uugccugaugcucuuucuaaagucaaaauaugaaugcuaagaaggcauaaccuacauccuucuc

SEQ ID NO: 526515 - RNA, 64 nt, hsa
uuucucuuuucuguuuaugaaguacaacccaugcugcuaagaugcgagcaggaagaggcauccu

SEQ ID NO: 526516 - RNA, 64 nt, hsa
cccagcugcuauaaccaaguguccaccaacuaccugcuaagagccgggagcauggaacguguug

SEQ ID NO: 526517 - RNA, 64 nt, hsa
ugugucaauauaaaauauacuaaaacugaugaaaugcuaagacaugucuugugaaggaagguuu

SEQ ID NO: 526518 - RNA, 64 nt, hsa
augucgaaugaccaaauaacuauguauauugaucugcuaagaccaggauuuuucugauauggca

SEQ ID NO: 526519 - RNA, 64 nt, hsa
uguguguguuuuuuuuccuuuaaagaagaaacgcugcuaagaucccacguggcucccacguguc

SEQ ID NO: 526520 - RNA, 64 nt, hsa
ugcagaugcuguacuucagcaauaaccuugccuuugcuaagacccccuccgagggcuucagggg

SEQ ID NO: 526521 - RNA, 64 nt, hsa
ccggggaaggcacugguuaggaaggauguucaaacggucccacccaagccugucaccucugcuc

SEQ ID NO: 526522 - RNA, 64 nt, hsa
guccgcacuccucagccucucccgggaguuccugcggucccagcggaacucagggagucuauuu

SEQ ID NO: 526523 - RNA, 64 nt, hsa
cugugugggucaugaggcuggggcccaggagacacggucccaggcacugcacaggccugcagua

SEQ ID NO: 526524 - RNA, 64 nt, hsa
uggggggccaacugaggcccugacccucuucucccggucccaucuucugagagggcuucucagc

SEQ ID NO: 526525 - RNA, 64 nt, hsa
cagccgggcccgcagcucuacgacgugauggacgcggucccagcgcggcgcuggaaggaguucg

SEQ ID NO: 526526 - RNA, 64 nt, hsa
gggcgggaaugggaccugcgcuccaggguggucucggucccaggguggucccagcuggugggag

SEQ ID NO: 526527 - RNA, 64 nt, hsa
uuuuaaauucuaggauagauuuuaacauccuuugcggucccaguccaagguaggcuggugucau

SEQ ID NO: 526528 - RNA, 64 nt, hsa
ccuaagaggugaaagagaagccuggcucuguucacggucccaggagcuguccuugcugcaugcc

SEQ ID NO: 526529 - RNA, 64 nt, hsa
aguugccgcucagaggcuucagccugacuuccagcggucccaagaacaccuacuaauuccucug

SEQ ID NO: 526530 - RNA, 64 nt, hsa
ucccgccugauuggggccucacccagaaggaacccggucccaggccgcauggccccuccaggaa

SEQ ID NO: 526531 - RNA, 64 nt, hsa
gaugccagccccuccagagaaaagguccugcagacggucccagcugggaggaaccuuauaccau

SEQ ID NO: 526532 - RNA, 64 nt, hsa
ggggacucccugccaccacugccaguuucugaaacggucccacuggguccucacuguccuuccc

SEQ ID NO: 526533 - RNA, 64 nt, hsa
uuuucuauauugugaagggcaaagguuacagaaacggucccaagaaaaucuaacacccaaauuu

SEQ ID NO: 526534 - RNA, 64 nt, hsa
ucuguuggcccauaaccuucagcugugagcgggucggucccacaguauugguuggguguugguu

SEQ ID NO: 526535 - RNA, 64 nt, hsa
uguccuggugggcccagguccuuguaucaugccacggucccaacuacaggguccuagcuggggg

SEQ ID NO: 526536 - RNA, 64 nt, hsa
cucuguggggaagccccgacucccccacgagaaacggucccacggugcggaucucccccuuccc

SEQ ID NO: 526537 - RNA, 64 nt, hsa
aucuugaguaauuuuaaaauguugacaccuuaaucggucccagguaugagcuauaauaaacuug

SEQ ID NO: 526538 - RNA, 64 nt, hsa
guuucucccuccacagggccaaagccauaguguccggucccaaggacaaggcucuuccagugcu

SEQ ID NO: 526539 - RNA, 64 nt, hsa
cucagcuccggggagaagggccucucugccauuucggucccaaggugagcugacacaggcguuc

SEQ ID NO: 526540 - RNA, 64 nt, hsa
ucucccgcuuaucgccuauucucacaccucuucucggucccaucuucugcacccauugcccagu

SEQ ID NO: 526541 - RNA, 64 nt, hsa
aauacaaaaaauaauccauuuaggugcugaguuacggucccaucucuucacaggcauggauucu

SEQ ID NO: 526542 - RNA, 64 nt, hsa
acggucggcagguaauggcucucagccggcgaggcggucccacagcucuccucccagggcagcc

SEQ ID NO: 526543 - RNA, 64 nt, hsa
gccaaccucacacugcuaugauugccaacuccagcggucccaugucagccuucugaugauccca

SEQ ID NO: 526544 - RNA, 64 nt, hsa
cugcccuucaggagcucgcagcuggugugcuuggcggucccaggccuguguagugucucucccc

SEQ ID NO: 526545 - RNA, 64 nt, hsa
cugcuagggaguggucuuuccuaucauggagugacggucccacacuggugacugcgaucuucag

SEQ ID NO: 526546 - RNA, 64 nt, hsa
ccuccgcuccagguaccacaccgaggagagcggccggucccagccauggcccgccuuguggcca

SEQ ID NO: 526547 - RNA, 64 nt, hsa
aauaaaaugaaccgggcauaguagcaugugccugcggucccagcugcucugauaagaggaggcu

SEQ ID NO: 526548 - RNA, 64 nt, hsa
agagagcaaggauugagucugagacuuaagcacucggucccagcuugccaguuccugguucugu

SEQ ID NO: 526549 - RNA, 64 nt, hsa
gacgcucagccucagggcucagaaggugccaguccggucccaggucccuugucccuuccacaga

SEQ ID NO: 526550 - RNA, 64 nt, hsa
gagacuuggucucaaagcucagagagagccaguccggucccagcuccuuugucccuuccucaga

SEQ ID NO: 526551 - RNA, 64 nt, hsa
ggccccuccucacagcaauagggggaggggggcccggucccaccccgccccgcccgccaggggc

SEQ ID NO: 526552 - RNA, 51 nt, hsa
cagcugcauggcgcuccuaggcggucccagcuggaauuacccaaccccaug

SEQ ID NO: 526553 - RNA, 64 nt, hsa
ggccuggauuaggagucuuagaguaccuggaauccggucccaucucuaccaccaacuggcuguu

SEQ ID NO: 526554 - RNA, 64 nt, hsa
ccccugcuccgaggggcucauguucaggcagaaccggucccagccugggcuccucugcaucuug

SEQ ID NO: 526555 - RNA, 64 nt, hsa
gaaaaccugacugaggagacauucuggaagguuccggucccacuguguguccccuggcgcucuu

SEQ ID NO: 526556 - RNA, 64 nt, hsa
gguuauuugggggggcgugagacccagugcacuccggucccaaauguagcagguguaaccguaa

SEQ ID NO: 526557 - RNA, 64 nt, hsa
aaggaaacaaaauaagaccgucugacagcaacaacggucccacaaacaagucacaaaagauacc

SEQ ID NO: 526558 - RNA, 64 nt, hsa
ggaugagggcucaagacacgagagaagauguccacggucccaggugguuaacaaaguucuggca

SEQ ID NO: 526559 - RNA, 64 nt, hsa
cuaccacccucccugcuccuuccugucccuuuaccggucccaggcugcugacuggccccacacu

SEQ ID NO: 526560 - RNA, 64 nt, hsa
ugggagaucaagucggcacuggggaagcaggcagcggucccagagccacccugugguccugaua

SEQ ID NO: 526561 - RNA, 64 nt, hsa
agagugcagccccagaauaggcggggcuuggaggcggucccaauguccccuggguccacagugg

SEQ ID NO: 526562 - RNA, 64 nt, hsa
ggacagggcacggagggagcgagggagagaggaccggucccagcuuuuggauauuuuggguuau

SEQ ID NO: 526563 - RNA, 64 nt, hsa
gagcuacaagcacuaaagugcugccuccagcucucggucccacaguccucaggcccuucucugg

SEQ ID NO: 526564 - RNA, 64 nt, hsa
gagcuauaagcacuaaagugcgucugcuagcucucggucccacaguccucaggccccucucugg

SEQ ID NO: 526565 - RNA, 64 nt, hsa
ugucuuccugggagccgagcuggggguuggggcccggucccaccucuuucccaggcaccugggc

SEQ ID NO: 526566 - RNA, 64 nt, hsa
acgcagugcuucagagccucgggcucagguggcacggucccaggguccaggcugagggcuggga

SEQ ID NO: 526567 - RNA, 64 nt, hsa
ccguugaccccaaagccucagggcuuauguccaacggucccauugggagcaacagugauuguuu

SEQ ID NO: 526568 - RNA, 64 nt, hsa
gcaggagcccugagcuuguuuuccugcaauuagacggucccauaugggagugaugggagacagu

SEQ ID NO: 526569 - RNA, 64 nt, hsa
uuuaguuguuugguuuucuuuucuuuccccccuccggucccauacuucacagcacucuggugcg

SEQ ID NO: 526570 - RNA, 64 nt, hsa
cuugaccuggaucagcucuuacaggaguauaucacggucccagccuauuuugcaagacacuaac

SEQ ID NO: 526571 - RNA, 64 nt, hsa
gugaccccaggagggaggcaggggaggggugcggcggucccagcucccuggcucccaugucaag

SEQ ID NO: 526572 - RNA, 64 nt, hsa
cuccucgacagggagccuguccaccagcaggcugcggucccagcgggugcgucugcagcuccuc

SEQ ID NO: 526573 - RNA, 64 nt, hsa
ccuguuucauaccaguugcaaagcuuguggggagcggucccacaaagcacuuucuuaaaccuug

SEQ ID NO: 526574 - RNA, 64 nt, hsa
uaacuguguaggaauguauauguguguguauauacggucccaguuuuaauuuacuuauuaaaag

SEQ ID NO: 526575 - RNA, 64 nt, hsa
gccucgcagcccagguccagagcccccggcgagccggucccauaaccggcccccugccccugcc

SEQ ID NO: 526576 - RNA, 64 nt, hsa
uuccugggucuucagcauucccucccaucaugcccggucccaccccucccucuguccaccagcc

SEQ ID NO: 526577 - RNA, 64 nt, hsa
cagcuuccuccccccgacuccccccccagagacacggucccaccauguuacccagccuggucuc

SEQ ID NO: 526578 - RNA, 64 nt, hsa
uggucuccaacuccugcccucaagugauccgccucggucccauuuuuuauucuuuggguccuuc

SEQ ID NO: 526579 - RNA, 64 nt, hsa
cgcaucuccaacgaccucgagcucugagccaccacggucccagggcccuuacucuuccucuccc

SEQ ID NO: 526580 - RNA, 64 nt, hsa
acagccucgccucgcacccuucaucccuggcugccggucccauccuuggagggacuaagcuggg

SEQ ID NO: 526581 - RNA, 64 nt, hsa
agccccugcucgcuguccuugcucucagaagucccggucccauguagauagaggggggcgcauc

SEQ ID NO: 526582 - RNA, 57 nt, hsa
augagaagaacgaggacugagcggcugcggucccaggaaggucuuacccccucuucu

SEQ ID NO: 526583 - RNA, 64 nt, hsa
acucucauucacacacacaaaucucaggaacaaacggucccagaguccuccggaccccugccca

SEQ ID NO: 526584 - RNA, 64 nt, hsa
uuuagguuccccugucaaauaucaguuacccacucggucccaguuuuguugccccagaaaggga

SEQ ID NO: 526585 - RNA, 64 nt, hsa
gaagauaccagaucccuucccaaccccuuugcaccggucccacuaaggggcagggucgagagag

SEQ ID NO: 526586 - RNA, 64 nt, hsa
gcaccgggucucucuaagucucaccuggggaauucggucccaccuggggcaccaguucccaccu

SEQ ID NO: 526587 - RNA, 64 nt, hsa
ugggaugggcuuuucccugugggccagggaugcucggucccagaggaggaccuagugacaucau

SEQ ID NO: 526588 - RNA, 64 nt, hsa
gccuuuggucccacccuguuccuggucccggucccggucccagucccaccaggcaacuccuucc

SEQ ID NO: 526589 - RNA, 62 nt, hsa
augaugaggucaaggugugaggggcuggggcacggucccagggccccaccuaggugcagagc

SEQ ID NO: 526590 - RNA, 64 nt, hsa
aacugaggccuagaagggaggagugguccacccacggucccagcacaaggcagagcugggauga

SEQ ID NO: 526591 - RNA, 64 nt, hsa
cucucuuccuucacaccuuccucugaaucccacccggucccaccuccugaaccuauccagacac

SEQ ID NO: 526592 - RNA, 64 nt, hsa
uguggccuggguccucggcccuguagcccuggcccggucccaguccggugccuuccacccugcc

SEQ ID NO: 526593 - RNA, 64 nt, hsa
ggaaagagggagcaggugcccccaggugagacagcggucccaggggccugaaaaggaaggacca

SEQ ID NO: 526594 - RNA, 64 nt, hsa
uuguaguauugcuuuuacaucuuuagauauguuccggucccacaugcaaggaagugaacaucaa

SEQ ID NO: 526595 - RNA, 64 nt, hsa; identical to SEQ ID NO: 159954

SEQ ID NO: 526596 - RNA, 64 nt, hsa; identical to SEQ ID NO: 159955

SEQ ID NO: 526597 - RNA, 64 nt, hsa; identical to SEQ ID NO: 159956

SEQ ID NO: 526598 - RNA, 64 nt, hsa; identical to SEQ ID NO: 159957

SEQ ID NO: 526599 - RNA, 64 nt, hsa; identical to SEQ ID NO: 159958

SEQ ID NO: 526600 - RNA, 64 nt, hsa; identical to SEQ ID NO: 159959

SEQ ID NO: 526601 - RNA, 64 nt, hsa
cguccgggagggaggugggggggucagccccccgcccggccagccgccccguccgggagggagg

SEQ ID NO: 526602 - RNA, 64 nt, hsa
ggcugccccuacugggaagugaggagccccucugcccggccagccgccccguccaggagggagg

SEQ ID NO: 526603 - RNA, 64 nt, hsa
cguccaggagggaggugggggggucagccccccgcccggccagccgcccgguccgggagggagg

SEQ ID NO: 526604 - RNA, 64 nt, hsa
gguccgggagggaggugggggggucagccccccgcccggccagccgccccguccgggagguuag

SEQ ID NO: 526605 - RNA, 64 nt, hsa
ggccgccccuacugggaagugaggagccccucugcccggccaccaccccgucugggagguguac

SEQ ID NO: 526606 - RNA, 64 nt, hsa
caaaaugcugggauuacaggugugagccacugugcccggccaaaagaacagaaauuauuuuauc

SEQ ID NO: 526607 - RNA, 64 nt, hsa
ggaagggaaggagaggggccagggaggccacaggcccggccauaugagcaucaugggucauuac

SEQ ID NO: 526608 - RNA, 64 nt, hsa
gcagaggccuuaggaccccguuccaagugcacugcccggccaagccccagccucagccugcgcc

SEQ ID NO: 526609 - RNA, 64 nt, hsa
ccuggcucugccuccccacccuggggugggggcucccggccaccugucuugcuccuauggaguc

SEQ ID NO: 526610 - RNA, 64 nt, hsa; identical to SEQ ID NO: 526601

SEQ ID NO: 526611 - RNA, 64 nt, hsa
guccgggagggaggugggggggaucagccccccgcccggccagccgccccguccgggagggagg

SEQ ID NO: 526612 - RNA, 64 nt, hsa
cuggaguaggcggugcguacccggugucccgaggcccggccaggggcugggcagggaugccagg

SEQ ID NO: 526613 - RNA, 64 nt, hsa
gggaugccaggugggcccagccagcuccuggggucccggccaccuggggaagccgcgccugcca

SEQ ID NO: 526614 - RNA, 64 nt, hsa
cugucucccccagggcucgggaugucuccagcagcccggccacgcagcuucccaggugggcucg

SEQ ID NO: 526615 - RNA, 64 nt, hsa
caaagugcugggauuacaggcgugagccacugugcccggccaagaauuuuuuuaucgauaacau

SEQ ID NO: 526616 - RNA, 64 nt, hsa
uccccagcacccaagcaugcaauugccugucccccccggccagccuccccaacuugauguuugu

SEQ ID NO: 526617 - RNA, 64 nt, hsa
gccuggggcucccugugaccucucaguccccuggcccggccagccaccguccccagcacccaag

SEQ ID NO: 526618 - RNA, 64 nt, hsa
ccugggaccccgcccccucauccugccuccaguucccggccacgccccccaggaccccugcccc

SEQ ID NO: 526619 - RNA, 64 nt, hsa
cccgcccccguggacccggccccaccccgaauaccccggccacgcuccccguccuuggccgccc

SEQ ID NO: 526620 - RNA, 64 nt, hsa
ggaaccaugaggaggguggcaggucuuugcagcucccggccagggugaggcggaagugagcccu

SEQ ID NO: 526621 - RNA, 64 nt, hsa
aacagggauggcacuucccugagcaguccuggcccccggccacugucucggggcccaccucucg

SEQ ID NO: 526622 - RNA, 64 nt, hsa
caaagugcuaggauuacaggcaugaaccaccgugcccggccaggaauaagcuuuugacuuaccc

SEQ ID NO: 526623 - RNA, 64 nt, hsa
aagugcugggauuacaggcgugugagccaccacgcccggccaugaaauauuuuuacuuaaaaau

SEQ ID NO: 526624 - RNA, 64 nt, hsa
accugcaaaaaauauuuuguauauauccaauuuaauaauaaaugcacucauguuaggaagguca

SEQ ID NO: 526625 - RNA, 64 nt, hsa
uguuaggaaggucaaaaaaaaggaaaaaagaaaaauaauaaaaaauaauaaaaauccuuaggau

SEQ ID NO: 526626 - RNA, 64 nt, hsa
gucaaaaaaaaggaaaaaagaaaaauaauaaaaaauaauaaaaauccuuaggauaacuugaggc

SEQ ID NO: 526627 - RNA, 64 nt, hsa
uauagaaaguauauagcaaaguaauuuuacucugauaauaaaaauuguuugacauguauuuugu

SEQ ID NO: 526628 - RNA, 64 nt, hsa
uauuuuaaaguguagaagaauacacugcuaauaaauaauaaaaguuuuauucaauuuacuuauu

SEQ ID NO: 526629 - RNA, 64 nt, hsa
aaaagcacuuugugcuguguucuauauaaaaaacauaauaaaaauugaaaugaaagaauaauug

SEQ ID NO: 526630 - RNA, 64 nt, hsa
uuuuuaaaacacaacuuuuaaaaaauguaucaaaauaauaaacguguucugauauuuuuaaaau

SEQ ID NO: 526631 - RNA, 64 nt, hsa
guuaugaacuguaaaauuaaagucaguaugaacuauaauaaauaucuguagcuuaaaaaguagg

SEQ ID NO: 526632 - RNA, 64 nt, hsa
uguauuucuguucauuuucuguucauagaguuguauaauaaaacaugauugcuuaaaaacuugu

SEQ ID NO: 526633 - RNA, 64 nt, hsa
uggugcacacugaaauuuuacuugaacaguucucauaauaaagcacuugucuuuugcucuuuau

SEQ ID NO: 526634 - RNA, 64 nt, hsa
uaaaggguuugggacagcaccugguauagaauaaauaauaaauguaaacuauuauuuuugguua

SEQ ID NO: 526635 - RNA, 64 nt, hsa
agccuguaauuaugagaacaguaaacuuuaaguaauaauaaagaaucccauccauauauccaau

SEQ ID NO: 526636 - RNA, 64 nt, hsa
gguuuuacaauuuaaaaaguauauucuauaauaaauaauaaaacaaauuguuuuaaauguuuag

SEQ ID NO: 526637 - RNA, 64 nt, hsa
auagguugguuuuacaauuuaaaaaguauauucuauaauaaauaauaaaacaaauuguuuuaaa

SEQ ID NO: 526638 - RNA, 64 nt, hsa
uugcuaccaguuacauugaacugcuuuaaaauaaauaauaaaauuauuucuaaugaugaaaacu

SEQ ID NO: 526639 - RNA, 64 nt, hsa
uuucuuuucauaaugaagcagaucaacuuaaaggauaauaaaauuuuuaaagaaaagauauucu

SEQ ID NO: 526640 - RNA, 64 nt, hsa
gucucauaaaaugagacuuuuuauauguuaauguauaauaaaacugaaacaagauuauuuucca

SEQ ID NO: 526641 - RNA, 64 nt, hsa
ugcaaugugacaugguucuguagaucauuuuauaauaauaaauauuuuaauuuaucauaacaua

SEQ ID NO: 526642 - RNA, 64 nt, hsa
accaauuccaauuucaaaaugucucaauggugcuauaauaaauaaacuucaacacucuuuauga

SEQ ID NO: 526643 - RNA, 64 nt, hsa
ugguuguugaucuuuuuuuuccuuacagacacccauaauaaaauaucauauuaaaauucuccug

SEQ ID NO: 526644 - RNA, 64 nt, hsa
acuugaagauuaccaaugauuuugaggcuuuucuauaauaaaaagagguucuaaccauuauuug

SEQ ID NO: 526645 - RNA, 64 nt, hsa
uuaaaugcaaucagguaguguugcuuuuuacagcauaauaaauauauguaucaaaaaaaaaacu

SEQ ID NO: 526646 - RNA, 64 nt, hsa
ccccagggccucugcucuccugggagacaaagcaauaauaaaaggaaguguuuguaaucccagc

SEQ ID NO: 526647 - RNA, 64 nt, hsa
caaaaauaaacaaauaaauuuuaaaaauaaauaaauaauaaaaggaaguguuagacaauguaau

SEQ ID NO: 526648 - RNA, 64 nt, hsa
uguguaucauugaaaauaagagaaguaaucccagauaauaaauuccuaaaaggaaacuguauaa

SEQ ID NO: 526649 - RNA, 64 nt, hsa
aaaaucaggucacaauuuuguggaugauuuagcaauaauaaaauggcagucauaacagggacug

SEQ ID NO: 526650 - RNA, 64 nt, hsa
uuguaguugagacauuacauauauuuuauuguuuauaauaaaaaucaucuauacaaaagaaguc

SEQ ID NO: 526651 - RNA, 64 nt, hsa
cacugugagauucuuaaaacuuuuuugcuucauaauaauaaaacaacucauguuagagacccuu

SEQ ID NO: 526652 - RNA, 64 nt, hsa
gaaguagaagguaacucuuugcacauaaauugguauaauaaaaagaaaaacacaaacauucaaa

SEQ ID NO: 526653 - RNA, 64 nt, hsa
acugaugugugcauauuuagcaucccuggaaaucauaauaaaguuuccauuagaacaaaagaau

SEQ ID NO: 526654 - RNA, 64 nt, hsa
gugggagugguuguguaaugaaaggaccaccaaaauaauaaaaggcagcuaauggaaaggagag

SEQ ID NO: 526655 - RNA, 64 nt, hsa
cuaauccaaaguauaacacuaucaauuugugaggauaauaaauggaaugccauuaguguagaug

SEQ ID NO: 526656 - RNA, 64 nt, hsa
gcagauguuuaguuuuaaaaauucaauuauaaaaauaauaaaugcucaugauagaaaauuugga

SEQ ID NO: 526657 - RNA, 64 nt, hsa
gguuuucuuucuguguguguguaagccacugcuuauaauaaaaccaacaauacccucagacuga

SEQ ID NO: 526658 - RNA, 64 nt, hsa
uucguuuuaagucauguucacaggaauuucuacaauaauaaacccaucaucuccauaggucaga

SEQ ID NO: 526659 - RNA, 64 nt, hsa
ucaggaaaaaaguuguuagaagauuuuuuaauguauaauaaaguccaugauuuuuguacagugu

SEQ ID NO: 526660 - RNA, 64 nt, hsa
uuuucagacauuuuaguaucuguauauagugcauauaauaaauccaauuaaacauuauuugaua

SEQ ID NO: 526661 - RNA, 64 nt, hsa
gaacauaaauaauaugaugugguugaguguuaacauaauaaaucauauacaguaugacauuuua

SEQ ID NO: 526662 - RNA, 64 nt, hsa
gaaacucaaaucucagacgccgugguugcaacuuauaauaaagaauggguugggggaaggggga

SEQ ID NO: 526663 - RNA, 64 nt, hsa
gggggagaaauaaaagccaagaagaggaaacaagauaauaaauguacaaaacaugaaaauuaaa

SEQ ID NO: 526664 - RNA, 64 nt, hsa
gccuaaaucccuguauuccaaaaccugcugcaucauaauaaauauaucuauauauauuuagcau

SEQ ID NO: 526665 - RNA, 64 nt, hsa
ucuacagcaugccaguaaauaauauguaggaccaauaauaaauuaucaauuacacauuuuugug

SEQ ID NO: 526666 - RNA, 64 nt, hsa
augauagauaaauauguaucuacacagaguaauaauaauaaaacacaguaaacauucuauuucu

SEQ ID NO: 526667 - RNA, 64 nt, hsa
aucggcagaugaugcuuuggaagaugcagaagcaauaauaaaguacuugacuaccuacuggugu

SEQ ID NO: 526668 - RNA, 64 nt, hsa
gcacuuuugaauguccaaaauuuauauuuuagaaauaauaaaaagaaagauacuuacauguucc

SEQ ID NO: 526669 - RNA, 64 nt, hsa
uauuuguucauaacauuaaaacaauaaagggcucauaauaaauaaauauauuuuugacacaauu

SEQ ID NO: 526670 - RNA, 64 nt, hsa
acuugauguuuauaauuaauaccauuacaacuguauaauaaaagcaauuugaagaaaagcugua

SEQ ID NO: 526671 - RNA, 64 nt, hsa
caacguguuucugaaaaacagauuuucauaaguaauaauaaaaauaauaauaaaaaaguuuugg

SEQ ID NO: 526672 - RNA, 64 nt, hsa
gaaaaacagauuuucauaaguaauaauaaaaauaauaauaaaaaaguuuugguaugguaagccu

SEQ ID NO: 526673 - RNA, 64 nt, hsa
uuucugaauuuugaguaucuucuguuguagaauaauaauaaaaagacuauuaagagcaauaaau

SEQ ID NO: 526674 - RNA, 64 nt, hsa
uagccuauuuauuauaaauuaugagaugaugaaaauaauaaagccaguggaaauuuucuaccua

SEQ ID NO: 526675 - RNA, 64 nt, hsa
cuucaguaaauacuaaaguuacuuguauuagaacauaauaaaaguagagaauuaaacuaccuaa

SEQ ID NO: 526676 - RNA, 64 nt, hsa
gugauuuuuaaaaacuuuuuuuuggaccuaaauaauaauaaaaaaaaaagcccuuuaaacuuug

SEQ ID NO: 526677 - RNA, 64 nt, hsa
uaacauuguucaucuuuagugcacuuuguuuuauauaauaaaguaugccuguuauauuaaauaa

SEQ ID NO: 526678 - RNA, 64 nt, hsa
caguuuacacuaucauuaaaaaagagggagagagauaauaaacuauauuuugguggggauggug

SEQ ID NO: 526679 - RNA, 64 nt, hsa
agaaacagaaucaccuaguauuggauguauuucaauaauaaauagaguggugucuuuuccauaa

SEQ ID NO: 526680 - RNA, 64 nt, hsa
uggcuuugaagaagugaugccaccaucucuagccauaauaaagaaacagaaucaccuaguauug

SEQ ID NO: 526681 - RNA, 64 nt, hsa
uucucugugagaagguuuauuguuaauacaagguauaauaaaauuaucgcaaccccucuccuuc

SEQ ID NO: 526682 - RNA, 64 nt, hsa
agcaguuguaccaagugaaauuauuuuggagauuauaauaaauauauacauucaaucugaguug

SEQ ID NO: 526683 - RNA, 64 nt, hsa
cacuuuugguuaagucuguuuuaugacuucauuaauaauaaauucccuggccuuucauauuuua

SEQ ID NO: 526684 - RNA, 64 nt, hsa
uguuauauaaaugguuaaaagagguuuuucuuaaauaauaaagaucauguaaaaguaacaaaug

SEQ ID NO: 526685 - RNA, 64 nt, hsa
agacaaaaaagucuagauuggucuugauauugagauaauaaaaaguaaguagcauuaagaaagg

SEQ ID NO: 526686 - RNA, 64 nt, hsa
ugugugguguuucuauauaauuuucuguguauaaauaauaaaguaggcauuuguuuauuuugua

SEQ ID NO: 526687 - RNA, 64 nt, hsa
aauaauccaagacuucucacuggggaauaagggaauaauaaauaggguacaaacuccuaauaga

SEQ ID NO: 526688 - RNA, 64 nt, hsa
aaaaggaauuuuaaauuuaacucuucacauggaaauaauaaagcucuuuauaugagcuguccca

SEQ ID NO: 526689 - RNA, 64 nt, hsa
uugcugugucuggcacuucauuguacagacuuuuauaauaaaagaacuugaaaguucuaaguca

SEQ ID NO: 526690 - RNA, 64 nt, hsa
gcacuauuacauaguaagcacaugaaguaguuugauaauaaauagcaguucuaguacuucacau

SEQ ID NO: 526691 - RNA, 64 nt, hsa
guugcuuaccuagaagaacuugacaggauaguuaauaauaaaccuuaaaacccaugaagaaauc

SEQ ID NO: 526692 - RNA, 64 nt, hsa
aaguaacagguacugagauuuguggccuaaauucauaauaaagugaaauguucaaguucaguca

SEQ ID NO: 526693 - RNA, 64 nt, hsa
cagcaagucuaacucucuguuccauuaaacccuuauaauaaaauccuucuguaauaauaaaguu

SEQ ID NO: 526694 - RNA, 64 nt, hsa
uuccauuaaacccuuauaauaaaauccuucuguaauaauaaaguuucaaaagaaaauguuuauu

SEQ ID NO: 526695 - RNA, 64 nt, hsa
acaguucuuucugcuacugaugacacucauugucauaauaaaacaaauaauuuccucaaauaac

SEQ ID NO: 526696 - RNA, 64 nt, hsa
uuaucaucaagguauuaaauauaagacguuaaauauaauaaaguggggauauauagaaaacaca

SEQ ID NO: 526697 - RNA, 64 nt, hsa
gagaacucagaaaauuauuuuaaauuucuaaguuauaauaaauuugcacacagauaacaugcau

SEQ ID NO: 526698 - RNA, 64 nt, hsa
gagaaaacugaagauuuaguuuccauuuuucuuuauaauaaaauauuugagccacuguauaaac

SEQ ID NO: 526699 - RNA, 64 nt, hsa
guauaacauguuaauggaaaaaaauggauuuagaauaauaaauggauuuuaaacuauccucuaa

SEQ ID NO: 526700 - RNA, 64 nt, hsa
cuaaaagacuguaauaugauuuuugaacuagcugauaauaaaguuguagauaagauguuuuaac

SEQ ID NO: 526701 - RNA, 64 nt, hsa
aauuaaccugguuaaagagaaaugucuuauguaaauaauaaacuaauuguggcuuguaaaugau

SEQ ID NO: 526702 - RNA, 64 nt, hsa
cagccaugaggagccucaguuuugaaagaggugcauaauaaaacuacuaaccagaggagucuau

SEQ ID NO: 526703 - RNA, 64 nt, hsa
cccagagacugucgcuacuaaaagaaugaaggaaauaauaaagugauagacagggaaggauaga

SEQ ID NO: 526704 - RNA, 64 nt, hsa
ucugaaacaaaugguuauuucuuuuauaauccauauaauaaauuuaaaaucuaaaauguaaaau

SEQ ID NO: 526705 - RNA, 64 nt, hsa
uugaguugucacuuaaaaauuauagcauauugcuauaauaaaaccuuauuuaugucuuauuuga

SEQ ID NO: 526706 - RNA, 64 nt, hsa
uugggugcauccaaaaauguauaaaaauauuauuauaauaaacuuauuacugcuuguaggguaa

SEQ ID NO: 526707 - RNA, 64 nt, hsa
ucuucuaaauuaccacuugccauuaagcuauuucauaauaaauucuguacaguuuccccccaaa

SEQ ID NO: 526708 - RNA, 64 nt, hsa
cauuuaucaauaaaagccuuugaaaauacuuuggauaauaaauuggaguuuuaaaaaugcaaau

SEQ ID NO: 526709 - RNA, 64 nt, hsa
aauauauuuugaaauauugaugcagacaaaugaaauaauaaagagauuuucaugguuuauaaaa

SEQ ID NO: 526710 - RNA, 64 nt, hsa
uuuaaauacagaagucauguuguuucugcacuuuauaauaaagcauggaagaaauuaucuuagu

SEQ ID NO: 526711 - RNA, 64 nt, hsa
auguacaauauugauagugagagguaugucuauuauaauaaagauuauggcacaguaaaaccug

SEQ ID NO: 526712 - RNA, 64 nt, hsa
uuaugcuauguacagagaaaugugauaauuuuuuauaauaaauauuuuuuaugaugauaaaaga

SEQ ID NO: 526713 - RNA, 64 nt, hsa
ugccucucacucuuacaagauaguaggcuuugagauaauaaacuuacccgugucaauuaacauu

SEQ ID NO: 526714 - RNA, 64 nt, hsa
uaauagaucuaaucaaauauguugauucauggcuauaauaaagcaggagcaauuauaaaaucuu

SEQ ID NO: 526715 - RNA, 64 nt, hsa
auuuuaagcacuaaaaauuuuuucauaaccuuucauaauaaaguuuaauaauagguuuauuaac

SEQ ID NO: 526716 - RNA, 64 nt, hsa
uucucagucaccaacagaugaauaauuaugcuuaauaauaaaguauuuauuaagacuuucuuca

SEQ ID NO: 526717 - RNA, 64 nt, hsa
ggccagccagaauggcaauaaggacuccgaauacauaauaaaagcaaacagaacacuccaacuu

SEQ ID NO: 526718 - RNA, 64 nt, hsa
augagaauuguuugagguuuguugcuagagaacaauaauaaaauaauucuuuuucagaaaauau

SEQ ID NO: 526719 - RNA, 64 nt, hsa
caucguuuacuuuuuaacuggcuucauuuuaggaauaauaaauucaucagaauccuuggcugaa

SEQ ID NO: 526720 - RNA, 64 nt, hsa
caggaacgggggaccauugcauugugcccaaguaauaauaaaacuauuucagauguauuauaug

SEQ ID NO: 526721 - RNA, 64 nt, hsa
ucuaaucuauguugaacuuuguauacuugaaaugauaauaaaaaggauauaauuucuuaguaaa

SEQ ID NO: 526722 - RNA, 64 nt, hsa
aauauguuugcuauccuuagagacagaaaugaauauaauaaauugaucugcuuauuuauuaaaa

SEQ ID NO: 526723 - RNA, 64 nt, hsa
auauuuucauuaauaguuuaaaucagugaccaucauaauaaagauaaaauuuaguugaguuuuu

SEQ ID NO: 526724 - RNA, 64 nt, hsa
gguuugagaaaugaaauauuguuuccaauuauuuauaauaaaucaguauaaaauguuuuaugau

SEQ ID NO: 526725 - RNA, 64 nt, hsa
uauuuccaaacucauauuacaaaaacaaaauaaaauaauaaaaaaagaaagcaugauauuuacu

SEQ ID NO: 526726 - RNA, 64 nt, hsa
acagagcgacccucugucucaaaaaauaauaauaauaauaaauaaaacaacaacaaaaugcauc

SEQ ID NO: 526727 - RNA, 64 nt, hsa
uacuauuuccaauguauguuuguuaaaaauaauaauaauaaaaccaaaagccuuuguggaaacc

SEQ ID NO: 526728 - RNA, 64 nt, hsa
caucacccaccaucaccgcugcugcaaagaggcaauaauaaaggaacugaagacagcuguauuu

SEQ ID NO: 526729 - RNA, 64 nt, hsa
uaugaauuguuaauuaaggugccaaaaaaaauuaauaauaaagcuugguuuuuugaaaaaccca

SEQ ID NO: 526730 - RNA, 64 nt, hsa
uuguuuuucguaucaaguuauaggaucucuuuauauaauaaauguaauuuaacuugcauuugcu

SEQ ID NO: 526731 - RNA, 64 nt, hsa
aaucaggaacaacuuucuccuuauugacaaucccauaauaaaacucaggaaccaaggcaaaaug

SEQ ID NO: 526732 - RNA, 64 nt, hsa
uucagaauauuugaaguuucuuacguagacagaaauaauaaaaauauuaacuaggaaaaaacag

SEQ ID NO: 526733 - RNA, 64 nt, hsa
aaaacggagggacuuugcuacuuguaaaaauaacauaauaaauagaucuuaaacauaggaaaac

SEQ ID NO: 526734 - RNA, 64 nt, hsa
uagaucuuaaacauaggaaaaccauacuguucugauaauaaaaugcuuucuaugaaauacguug

SEQ ID NO: 526735 - RNA, 64 nt, hsa
auuagcuaacaggaaacaacuacuguguuucaacauaauaaauauaauagaaaaauauuuuauu

SEQ ID NO: 526736 - RNA, 64 nt, hsa
uguugaccuuuuacuuccuuuuacaaaaaugaaaauaauaaacauguuuucguauaaaauaaca

SEQ ID NO: 526737 - RNA, 64 nt, hsa
gacuugcccaaguggcaauagaguucuaauaucuauaauaaagggagauuugcuauuauuagug

SEQ ID NO: 526738 - RNA, 64 nt, hsa
augagcacaaugauauuaaucacuuuuauggugaauaauaaaugcaauaauugccucaugggug

SEQ ID NO: 526739 - RNA, 64 nt, hsa
ugauaagcugcugcuccuauauuuuuuaagaaauauaauaaagcacuuagggcaggggaaauca

SEQ ID NO: 526740 - RNA, 64 nt, hsa
cuauuuauuuucuuguucacaguaaugcaugucaauaauaaauguuuccccuuacugauaagcg

SEQ ID NO: 526741 - RNA, 64 nt, hsa
accacagcaaaagcaaauaauaauaauauuaauaauaauaaagagaaauaaaauaauaaaauaa

SEQ ID NO: 526742 - RNA, 64 nt, hsa
aauaauaauauuaauaauaauaaagagaaauaaaauaauaaaauaaaaaacaauagcacagccc

SEQ ID NO: 526743 - RNA, 64 nt, hsa
auaauaaauugcaugcugcuuuaauugugaauugauaauaaacuguccucuuucagaaaacaga

SEQ ID NO: 526744 - RNA, 64 nt, hsa
ugccaagaacugaaaacauaaaaaguuaaaaaaaauaauaaauugcaugcugcuuuaauuguga

SEQ ID NO: 526745 - RNA, 64 nt, hsa
auaacagucugaacuuauuuguuuauuuaaaauaauaauaaaauaauuaaaaauuuauuuauca

SEQ ID NO: 526746 - RNA, 64 nt, hsa
uauaauuugaggaguggaugguggaugaaaagaaauaauaaauuguaaucagcaguaaaggagu

SEQ ID NO: 526747 - RNA, 64 nt, hsa
gaauuaugucugcugaauaauaaacuuuuuugaaauaauaaaucugguagaaaaaugaaaacuu

SEQ ID NO: 526748 - RNA, 64 nt, hsa
cuucuguaaagguuuuuggaauuaugucugcugaauaauaaacuuuuuugaaauaauaaaucug

SEQ ID NO: 526749 - RNA, 64 nt, hsa
gugcucagaaaucaccauaaucacgaaaauaauaauaauaaaucuuuaacauacuaccuaaagg

SEQ ID NO: 526750 - RNA, 64 nt, hsa
guccaaguacuuuguauuguauacgugagucauaauaauaaaaagaagaagaaaaauaauagaa

SEQ ID NO: 526751 - RNA, 64 nt, hsa
cacugugcuuaaacaaaaugccauuaaugggauuauaauaaauauaaugugguagaauucaagu

SEQ ID NO: 526752 - RNA, 64 nt, hsa
guauuaacugaggaauaaaagacugaagaaagacauaauaaauaguuaaaggauuauggaaaag

SEQ ID NO: 526753 - RNA, 64 nt, hsa
acucuuuaacuucucguaaaagucauauaccuauauaauaaagcuacugauuuccuuuggagcu

SEQ ID NO: 526754 - RNA, 64 nt, hsa
gaaauauuuauuuuuuuaagcguaauuuugccaaauaauaaaaacagaaggaaauugagauuag

SEQ ID NO: 526755 - RNA, 64 nt, hsa
cuucuuuuuuauuacagaaaguguauauugguauauaauaaaugaacuuuucaaaugacuauga

SEQ ID NO: 526756 - RNA, 64 nt, hsa
cuucugaauguucaagagcauccuauagugccaaauaauaaagcaccauuuuuuucuucauaac

SEQ ID NO: 526757 - RNA, 64 nt, hsa
uucaaaaagaaugauacauucugaagguauguuuauaauaaacauuuuucauauguaaaacaau

SEQ ID NO: 526758 - RNA, 64 nt, hsa
agcagcaauaguagaaguagucauaauaacaauaauaauaaaugaugauaaagauguuucugac

SEQ ID NO: 526759 - RNA, 64 nt, hsa
auauuuccaagauugguuauaauagauggggcauauaauaaagaagcuacuauuuuggaaaaug

SEQ ID NO: 526760 - RNA, 64 nt, hsa
cugcacucuguagcaaauuuguuuaaucuacauuauaauaaaauuucuugcugcagugcaacag

SEQ ID NO: 526761 - RNA, 64 nt, hsa
guaacuuagucucaauagaguaucuguuauuagaauaauaaaggaguucauuuucagaaucauc

SEQ ID NO: 526762 - RNA, 64 nt, hsa
agcacugcuaccuucuuugauuguauuaaugauuauaauaaaaaguuacaggucacuuuaaaag

SEQ ID NO: 526763 - RNA, 64 nt, hsa
gaaacuacacacaaaaagcauacuugcauuauuuauaauaaaauugcauucaguggcuuuuuaa

SEQ ID NO: 526764 - RNA, 64 nt, hsa
cauagcuuuacgauggagagaugccagugaccucauaauaaagacugugaacugccuggugcag

SEQ ID NO: 526765 - RNA, 64 nt, hsa
auccccauaugucuguguuuguuugagauuuuuaauaauaaauaauaaauuuuugaagaaugga

SEQ ID NO: 526766 - RNA, 64 nt, hsa
uaugucuguguuuguuugagauuuuuaauaauaaauaauaaauuuuugaagaauggaaguggau

SEQ ID NO: 526767 - RNA, 64 nt, hsa
uaaugguuugcugcuugacuagccuagggaaauaauaauaaagguaaaguaaacuuuuuuaaug

SEQ ID NO: 526768 - RNA, 64 nt, hsa
uggacagacacauuagagcagcuguuuguuauugauaauaaaauauuauaaaacuacuuuuugu

SEQ ID NO: 526769 - RNA, 64 nt, hsa
guauguuacuguuggcuacaucauuuuguguugaauaauaaagugcaauacuuuauucuccaua

SEQ ID NO: 526770 - RNA, 64 nt, hsa
acagcuguugaaaaauaauguauauaaaaugcauauaauaaauauuaaauuguguaccuguaug

SEQ ID NO: 526771 - RNA, 64 nt, hsa
aguuaaaaguuagcaauuuaaaaaauuuugcugcauaauaaagauaauuauaguuacauguauu

SEQ ID NO: 526772 - RNA, 64 nt, hsa
gauauaguuaauggaauuggcuuaauuugaugacauaauaaaucacuuauaaaauuuuaaauau

SEQ ID NO: 526773 - RNA, 64 nt, hsa
ggacauuuauuuuacaugggaaaaauuauuuggaauaauaaagcaggaacuuuuccugaaguug

SEQ ID NO: 526774 - RNA, 64 nt, hsa
guuuguacagaugcaugccacaguagauguccacauaauaaaauucauaguuaccaaugcaguu

SEQ ID NO: 526775 - RNA, 64 nt, hsa
acuauuaauauuaaauuaaaaccuuuacuuuuguauaauaaauuaaaacucagaauaaaccugu

SEQ ID NO: 526776 - RNA, 64 nt, hsa
cuuuuguuuugacacugaauauuuuaaaaagcaaauaauaaaauaacuaagcauuugaggaaaa

SEQ ID NO: 526777 - RNA, 64 nt, hsa
ugcauucuuuauucacuuaagaagcuugucugcaauaauaaagccacgucaugucuucuuuugg

SEQ ID NO: 526778 - RNA, 64 nt, hsa
uauacuagaaguaauuguuuuaucaauucauuguauaauaaacaggagugagacuucauuguau

SEQ ID NO: 526779 - RNA, 64 nt, hsa
uuuauuguuuuuaugaguaaauacaugcauugucauaauaaaaugcauuucagagaauaugcau

SEQ ID NO: 526780 - RNA, 64 nt, hsa
cggauagcauuugguagguagugauuaacugugaauaauaaauacacaaugaauucuucacuug

SEQ ID NO: 526781 - RNA, 64 nt, hsa
cguuuaaggccacguauaguccuagcugacgccaauaauaaaaaacaagaaaccaagugggcug

SEQ ID NO: 526782 - RNA, 64 nt, hsa
gccacuggcaaauguaacugugccaguucuuuccauaauaaaaggcuuugaguuaacucacuga

SEQ ID NO: 526783 - RNA, 64 nt, hsa
gaacuuuaaaguuauaguuguuuuauauguugcuauaauaaagaaguguucugcauucguccac

SEQ ID NO: 526784 - RNA, 64 nt, hsa
ccauaaaugacaagguuuugacauuuuugaagagauaauaaauguuuuaauuuggcaguuugag

SEQ ID NO: 526785 - RNA, 64 nt, hsa
acuuuaauauauaauccaucagacagaggaaucaauaauaaaacugcaacagaacuaucaacug

SEQ ID NO: 526786 - RNA, 64 nt, hsa
uggggccaguaaaucaguagacugaacauucaauauaauaaaagaacauggggauuuuguauaa

SEQ ID NO: 526787 - RNA, 64 nt, hsa
aauaaaagaacauggggauuuuguauaaccagggauaauaaaaagaaaaaagaaguuaauuuuu

SEQ ID NO: 526788 - RNA, 64 nt, hsa
caucagggaauuuauauugaaaaauugugcaaauauaauaaauuuggaaaaacaauuuuucaaa

SEQ ID NO: 526789 - RNA, 64 nt, hsa
aauuuuuauuuaccacaguguuauuuuuaucgucauaauaaaaauuauauacgaguauaaauga

SEQ ID NO: 526790 - RNA, 64 nt, hsa
uauguaacauacuuuuauuaaaauauauacuuauauaauaaaaguauaacauaauuuuuuuuuu

SEQ ID NO: 526791 - RNA, 64 nt, hsa
auuuuuauggucauaauaaaaguuauguagaaguauaauaaaaucccuacauuucugaggccug

SEQ ID NO: 526792 - RNA, 64 nt, hsa
aauuguuauugauuacaguguuauuuuuauggucauaauaaaaguuauguagaaguauaauaaa

SEQ ID NO: 526793 - RNA, 64 nt, hsa
aauauuucuacuuuuguauguguuugaaauuucaauaauaaaauguuuaaaaucaaaaccaaaa

SEQ ID NO: 526794 - RNA, 64 nt, hsa
uuagugaauucacguaaaaggaagaucuguagacauaauaaauguagaaaugccuccugucacc

SEQ ID NO: 526795 - RNA, 64 nt, hsa
uuugagaaaauguguuucaugcucaauuccaagcauaauaaauuuuauauuagagaaagaauau

SEQ ID NO: 526796 - RNA, 64 nt, hsa
ucugaauuauguaugaaaauuauucuauguuuuuauaauaaaaauaauauaucagacaucgaca

SEQ ID NO: 526797 - RNA, 64 nt, hsa
aucuuuucuucuauggggucuauaaauguaucuuauaauaaaaaggaaggacaggaggaagaca

SEQ ID NO: 526798 - RNA, 64 nt, hsa
guuuagugcuaaugagcagaaaaugaaugguuccauaauaaauugauaucugauuaaaauauac

SEQ ID NO: 526799 - RNA, 64 nt, hsa
guuuuuaaggaugguugugaaucccccuggccccauaauaaauuguaauuuuauacugcuuacu

SEQ ID NO: 526800 - RNA, 64 nt, hsa
uuuuaagaauaucugaguaaaauaacaauaugaaauaauaaacagaagcucuaacgucagguaa

SEQ ID NO: 526801 - RNA, 64 nt, hsa
agagaguugacaaguugcuuguaguuuuaaaaaaauaauaaaguauacccuucugguauaucau

SEQ ID NO: 526802 - RNA, 64 nt, hsa
uuuauaaacuaacaaaaacuugcucucagucaauauaauaaaugauaguuaaacucuaaggaag

SEQ ID NO: 526803 - RNA, 64 nt, hsa
gugucauaagaaacaaaauauuuuuuaaacaagaauaauaaagguuggagauuguuacgcuuga

SEQ ID NO: 526804 - RNA, 64 nt, hsa
ggugauucugugcaguaagguauaaaacagauauauaauaaauagccuagcuuagucuaacauc

SEQ ID NO: 526805 - RNA, 64 nt, hsa
uaaaauaaaacaaauuuaaacaccaaaauaagauauaauaaaacauuuguuuuugcaaaauaag

SEQ ID NO: 526806 - RNA, 64 nt, hsa
cauauuccauaaagugcucagagucacagguuuuauaauaaauuauguuauuauguaaacgaau

SEQ ID NO: 526807 - RNA, 64 nt, hsa
ugaacuugcuaucugcucuguuucuaguuaaaauauaauaaauauuaucuuccugugcuguacu

SEQ ID NO: 526808 - RNA, 64 nt, hsa
uuuuguaccuaaggugauggggaacuccauucagauaauaaaauucucuuucagcuagagaagu

SEQ ID NO: 526809 - RNA, 64 nt, hsa
cucugagccuaaguuuccacaucuguaaaaggagauaauaaacaccuaccuugcaguagugaag

SEQ ID NO: 526810 - RNA, 64 nt, hsa
uauccgcaugugugcaugugaguauguuugcaaaauaauaaaggauauuggagaccuguuuuag

SEQ ID NO: 526811 - RNA, 64 nt, hsa
aauaauuaaugauaaaacauaauaauaaacauaaauaauaaacaaaauuaccgagaaccccauc

SEQ ID NO: 526812 - RNA, 64 nt, hsa
uaaaaauuuauugaauaauuaaugauaaaacauaauaauaaacauaaauaauaaacaaaauuac

SEQ ID NO: 526813 - RNA, 64 nt, hsa
caagauugcaucucaaaacaaacaauaauaauaaauaauaaaaaccugauauuuggcugggcgc

SEQ ID NO: 526814 - RNA, 64 nt, hsa
gacagagcaagauugcaucucaaaacaaacaauaauaauaaauaauaaaaaccugauauuuggc

SEQ ID NO: 526815 - RNA, 64 nt, hsa
uccuggcuguugacuucccauugcucuuggagccaccaaucaaagagauucaaagagauuccug

SEQ ID NO: 526816 - RNA, 64 nt, hsa
cggcucagugacagccaaccugcccccuccccacaccaaucagccaggcugagcccccaccccu

SEQ ID NO: 526817 - RNA, 64 nt, hsa
cccuaccuuuuucuucucuucauugaccaaaucaaccaaucacuacagcugcucugcuucugcu

SEQ ID NO: 526818 - RNA, 64 nt, hsa
cacggggaucacagcguuucaggaacguugccacaccaaucagagagccuagaacaucccuggg

SEQ ID NO: 526819 - RNA, 64 nt, hsa
ucaugagcaaauaugucaagggagucaauuucugaccaaucaaguacacuaaauuagaauauuu

SEQ ID NO: 526820 - RNA, 64 nt, hsa
aagaaugguuuuccaccuuuucccccuaaucucuaccaaucagacacauuuuauuauuuaaauc

SEQ ID NO: 526821 - RNA, 64 nt, hsa
cacccuccauagccaccaaaccuguuagaacuggaccaaucaaaccucaggcgaucaaaaccga

SEQ ID NO: 526822 - RNA, 64 nt, hsa
guaaugcagaaaucuguuuuguucccaugaaaucaccaaucaaggccuccguucuucuaaagau

SEQ ID NO: 526823 - RNA, 64 nt, hsa
ugagaaaaguuaaccaaggaauuauucuuuucucaccaaucaacacuuuuaagaaauauauaua

SEQ ID NO: 526824 - RNA, 64 nt, hsa
ccugugguguuuggcaugugcccccugucuacugaccaaucaguguggcaugaggcccacgcca

SEQ ID NO: 526825 - RNA, 64 nt, hsa
uuuuagucucuugaugucucaaucuuacauguauaccaaucacaauggaauaaaguguugaguu

SEQ ID NO: 526826 - RNA, 64 nt, hsa
agccaauguaugguuauccacucugugugccaaaaccaaucaugccuuucacggcccuuuaguu

SEQ ID NO: 526827 - RNA, 64 nt, hsa
caggaucuuucagaucaugugcaauuuuuaucuaaccaaucagaaauacuaguuuaaaaugaau

SEQ ID NO: 526828 - RNA, 64 nt, hsa
guuacauuuucccaauaucuuuucuauuccuuggaccaaucagagaugcuguagcuccuugggg

SEQ ID NO: 526829 - RNA, 64 nt, hsa
acacugauuaggccugggucacauguccacccugaccaaucacuguggccaggaggaugauaca

SEQ ID NO: 526830 - RNA, 64 nt, hsa
aagugggcuuggggaauugaauagcagagagcaaaccaaucagucccucaggaaagggaagaaa

SEQ ID NO: 526831 - RNA, 64 nt, hsa
uacacuguucugggguuuguucucuacccuuccaaccaaucacaccccugccuuuuuuuuuuuu

SEQ ID NO: 526832 - RNA, 64 nt, hsa
uuuccucuuucuuggcuucuacccacaaacauucaccaaucauuuauucguucauuuagcaaau

SEQ ID NO: 526833 - RNA, 64 nt, hsa
auaaauaaaaagccugauuauuuuaggccaguuuaccaaucacuguguaauucuucugguagua

SEQ ID NO: 526834 - RNA, 64 nt, hsa
augcaaaaguucacuguugcaguguuuucaaaugaccaaucaaguacuacuucuugguuaaaag

SEQ ID NO: 526835 - RNA, 64 nt, hsa
uggucucuccccuggcuugcuucauggccacugaaccaaucacuuuguaugcuaugcuccuacu

SEQ ID NO: 526836 - RNA, 64 nt, hsa
uuagacaucuucugugauuguuauggcauauuacaccaaucagagaaauagaguuuuaaaguag

SEQ ID NO: 526837 - RNA, 64 nt, hsa
cuucauuuagagaccacaguaacaacagcagcccaccaaucagagaagcugguuguuauuaacc

SEQ ID NO: 526838 - RNA, 64 nt, hsa
cuuucuuuuucuggaaauuuuguccauuuuaaaaaccaaucauuuuaagaagacaugacaaugc

SEQ ID NO: 526839 - RNA, 64 nt, hsa
gugcuuuaucaucuccaucuuuagccuuuacaccaccaaucaaaacucuagguacaccaacaca

SEQ ID NO: 526840 - RNA, 64 nt, hsa
aauauuuuuauccuagggccaaguguugccugccaccaaucaguaaguuagucuauaacaaauu

SEQ ID NO: 526841 - RNA, 64 nt, hsa
ggccccuccaaaucucauguccucacuauucaaaaccaaucaugccuuccuaacagucccccaa

SEQ ID NO: 526842 - RNA, 64 nt, hsa
ggguugaggcuugacuguagcauccugcuuagagaccaaucaacggacacugguuuuuagaccu

SEQ ID NO: 526843 - RNA, 64 nt, hsa
ugaggacaccucagugacaaacacaccuuuuuauaccaaucaguauccucuguucauuaaaacu

SEQ ID NO: 526844 - RNA, 64 nt, hsa
uguuauuuaaagaacacccuauauuuugcauaguaccaaucauuuuaauuauuauucuucauaa

SEQ ID NO: 526845 - RNA, 64 nt, hsa
cuguugacaauuugccauagcagugcuaggauaaaccaaucaucuuaacuuggcuaacauagca

SEQ ID NO: 526846 - RNA, 64 nt, hsa
auuaggccaaacagauguacuucacucaaggagaaccaaucauauuuucucucugucucucaaa

SEQ ID NO: 526847 - RNA, 64 nt, hsa
ccaugauuagacguugacugcaucucccugauagaccaaucagcugugucgcacuuaaacugga

SEQ ID NO: 526848 - RNA, 64 nt, hsa
cucaauuaagaaaaacagucacaugucacgacaaaccaaucaaucuuuaugagauauuccugua

SEQ ID NO: 526849 - RNA, 64 nt, hsa
aguauuauccugcuuccagaccuaugucaccaguaccaaucagucagugucaucacauuucagg

SEQ ID NO: 526850 - RNA, 64 nt, hsa
uuguuugcuuguugaauuuuugaacagccaguugaccaaucauagaaaguauuacuuucuuuca

SEQ ID NO: 526851 - RNA, 64 nt, hsa
uuuugaacccaacucuaccuuucauuuucuuaagaccaaucacagcuugugccucagaucaucc

SEQ ID NO: 526852 - RNA, 64 nt, hsa
ugcccuggcagugacuuggagcccugaagaagggaccaaucaugggaccacagccacugugccc

SEQ ID NO: 526853 - RNA, 64 nt, hsa
ucauugcucuggcugaguugugugccuguuucugaccaaucacugagucaggaggaugaaauau

SEQ ID NO: 526854 - RNA, 64 nt, hsa
ucaucuggaucaugggacccucucuaauccuuccaccaaucaaauaagcuauugcuauugguuu

SEQ ID NO: 526855 - RNA, 64 nt, hsa
agaguagaaaaaucuguugccugauauacauaacaccaaucagaccguguggauuuuucucuga

SEQ ID NO: 526856 - RNA, 64 nt, hsa
gauuucaggugcuugcaacuggacugcagacucuaccaaucacgggcauuuuaucuucucugaa

SEQ ID NO: 526857 - RNA, 64 nt, hsa
uggugucaccacuacuuaauugggagauaaugaaaccaaucauggaugcuguuuuuauugggca

SEQ ID NO: 526858 - RNA, 64 nt, hsa
uuuuggaagaggaaaacaggaacccaccaaaccaaccaaucaaccaaacaaagaaaaaauucca

SEQ ID NO: 526859 - RNA, 64 nt, hsa
agguugaagaguggccccuugaggcccuggaaagaccaaucacuggacuucuucccuugagagu

SEQ ID NO: 526860 - RNA, 64 nt, hsa
gacacugaggcugcagcgggaauucgcacucggcaccaaucagagccccaugccgcggccccuc

SEQ ID NO: 526861 - RNA, 64 nt, hsa
uucauuaugaaaggucaagcaaagacagcagaauaccaaucacuucaucauuuaggaaguaugg

SEQ ID NO: 526862 - RNA, 64 nt, hsa
uaaggcugguguagaaacaaagggccuaaugagaaccaaucaucauggaagucaguugcggggg

SEQ ID NO: 526863 - RNA, 64 nt, hsa
uauuaaguguuauuugcaaaagguagauuauguaaccaaucagguacguaccaggcagugaugu

SEQ ID NO: 526864 - RNA, 64 nt, hsa
aggcagagguugcucggggccuugggucggguuuaccaaucagccaggacgcccggggccacca

SEQ ID NO: 526865 - RNA, 64 nt, hsa
aaagaaaauaaaucucaugucagacccagaaaggaccaaucacuguccgauuguaagcuauguu

SEQ ID NO: 526866 - RNA, 64 nt, hsa
guauuacuuuuuauguuugguauuauucugccaaaccaaucauguuauuguuuuuaaucauuga

SEQ ID NO: 526867 - RNA, 64 nt, hsa
gcuaauguuuuuuccucaaacucugcuuucuguaaccaaucaguguuuuaauguuuguguguuc

SEQ ID NO: 526868 - RNA, 64 nt, hsa
cuauccacagugaaccugguuacgaagaaaacucaccaaucaucuccuuccuguuaaucacaug

SEQ ID NO: 526869 - RNA, 64 nt, hsa
ugagcuccagaaaggacguaacuuagcauggaucaccaaucaaucaaaaaauaaauaaaucacu

SEQ ID NO: 526870 - RNA, 64 nt, hsa
aaguuuuaaauauuuuucuucaaaggcuuguuaaaccaaucauguuaaaaggaaauucuugguu

SEQ ID NO: 526871 - RNA, 64 nt, hsa
auaaccauuuguauaaugagaaaucuaggggaaaaccaaucaguccaacaugagauuuuaggaa

SEQ ID NO: 526872 - RNA, 64 nt, hsa
cuggagaggauugugcaggcacauuaauauugugaccaaucacagaaucugggaauaugaagcu

SEQ ID NO: 526873 - RNA, 51 nt, hsa
cagaaucagaacagaaguaguaccaaucaaugucacaugaacaaacaagcu

SEQ ID NO: 526874 - RNA, 64 nt, hsa
uccauauccuaaugauucaaucucccuuacccugaccaaucaguggcccaaauuuuccagcccc

SEQ ID NO: 526875 - RNA, 64 nt, hsa
aauauuaucacuugacagauagaguuaauaaauuaccaaucaggcacauuuuauaauguuuguc

SEQ ID NO: 526876 - RNA, 64 nt, hsa
gaaggaaaaaagaaccuauuuuugugcaucauuuaccaaucaugccacacaagcauuuauuuuu

SEQ ID NO: 526877 - RNA, 64 nt, hsa
cagcucagagcugagggccucccccuccacagcaaccaaucacaaccauaaagcuacaagcacg

SEQ ID NO: 526878 - RNA, 64 nt, hsa
aauaccauuuggagcuggacaacauuugacaccaaccaaucauacuggacaaggcccuuagagg

SEQ ID NO: 526879 - RNA, 64 nt, hsa
uauauuuuaucuuuuaucuuuuucuuugacauuuaccaaucaccaagcaugcaccaaacacugc

SEQ ID NO: 526880 - RNA, 64 nt, hsa
aaaugaauuuauucuuucgguaugguaaaauugaaccaaucacaguuaagaugagagaucaacc

SEQ ID NO: 526881 - RNA, 64 nt, hsa
cguuugauuucuuguguuuuauuugccaaauguuaccaaucagugagcaagcaagcacagccaa

SEQ ID NO: 526882 - RNA, 64 nt, hsa
acacccacgcugguuucugugcaguguuaggaaaaccaaucagguuauugcauugacuucacuc

SEQ ID NO: 526883 - RNA, 64 nt, hsa
augccuaugugucuugcagauugcaagauauuuuaccaaucagcauguguuaccuguacaauua

SEQ ID NO: 526884 - RNA, 64 nt, hsa
aauugucauaggagggaagcuucaaagucaugaaaccaaucaacagccaagucagcaagcaauc

SEQ ID NO: 526885 - RNA, 64 nt, hsa
uccuuaaggaaggacugaucugugugcucuuaucaccaaucaguucagaccugguugauuuugu

SEQ ID NO: 526886 - RNA, 64 nt, hsa
uacagauuaauuuuuccauaaaaccauuuuuugaaccaaucaguaauuuuaagguuuuguuugu

SEQ ID NO: 526887 - RNA, 64 nt, hsa
caugugggcagacauugggauaacaacuuucaucaccaaucauuggacuuuugugaaguugaca

SEQ ID NO: 526888 - RNA, 64 nt, hsa
cugggggagaaccacugacccaaaugaauucuaaaccaaucaaaugucugggaagcccuccaag

SEQ ID NO: 526889 - RNA, 64 nt, hsa
cuuuuggaccuacauacauuuuccuuuguuuuugaccaaucaaugaagccaaauuuauaugucc

SEQ ID NO: 526890 - RNA, 64 nt, hsa
cacuaagagagaaugagagacacacugaagaagcaccaaucaugaauuaguuuuauaugcuucu

SEQ ID NO: 526891 - RNA, 64 nt, hsa
aauucuucccagcacaguguucugggcagccaguaccaaucaauuuggcacucaugaugggacc

SEQ ID NO: 526892 - RNA, 64 nt, hsa
gggauggugaauggcugugaccauggcagacaucaccaaucaagugcagcacaugggugauguc

SEQ ID NO: 526893 - RNA, 64 nt, hsa
uugugauauaaaauaaagcugaguauaaaauaaaaccaaucaaacacagaauuugauuggauuu

SEQ ID NO: 526894 - RNA, 64 nt, hsa
uuaaacacggggcuugcaacuuagcucacaccugaccaaucagagagcucacuaaaaugcuaau

SEQ ID NO: 526895 - RNA, 64 nt, hsa
ucaguuaaccucuaaauaugaacuuuccacucuaaccaaucaaauaguuucuuugucuugcucc

SEQ ID NO: 526896 - RNA, 64 nt, hsa
gcucagugguuuccaaauuuggcugcacauucauaccaaucaccaggggauuuuuuuaaaaucc

SEQ ID NO: 526897 - RNA, 64 nt, hsa
uuuuuuuucuuguuuccuuauaaaacagguaauaaccaaucauuuuguguuuguauuuccauuc

SEQ ID NO: 526898 - RNA, 64 nt, hsa
guggagaaaguaaucuccuugcaaucauguggacaccaaucacaaaaguaaagcccugguguug

SEQ ID NO: 526899 - RNA, 64 nt, hsa
aauuuaagaccauauuauuaucaaaaaccuagagaccaaucauauaucugaaaagaaauaccca

SEQ ID NO: 526900 - RNA, 64 nt, hsa
uccuguaagaccuccuaccacauggcgaguauacaccaaucaggagaggguagcugccugcaua

SEQ ID NO: 526901 - RNA, 64 nt, hsa
aaaugaucuguaguuccguggcuugcaugggugcaccaaucaucuuuagaacgauguacacuga

SEQ ID NO: 526902 - RNA, 64 nt, hsa
cggaaggccagcucuucuuggaggacaagacaggaccaaucaaagaggggaccugcugggaaug

SEQ ID NO: 526903 - RNA, 64 nt, hsa
guaaaccaucuuuuauccucuauucauauuuucuaccaaucacuauguauuggggauaucuuug

SEQ ID NO: 526904 - RNA, 64 nt, hsa
uaugaaguuaacagucucauuacagauuuaguuuaccaaucaacagcaugucuacugcuuggau

SEQ ID NO: 526905 - RNA, 64 nt, hsa
agugaaaauguugucucuuuacaaccaauugauaaccaaucacauaguuuuaucaguguauuua

SEQ ID NO: 526906 - RNA, 64 nt, hsa
ggcugaaucgaaacauguguaaugucaauguaaaaccaaucacagcugugaacugcaugaaaug

SEQ ID NO: 526907 - RNA, 64 nt, hsa
auuaaccuuuucaaauuaauguuccaguuugaagaccaaucaaauauauuauuuagucaacaua

SEQ ID NO: 526908 - RNA, 64 nt, hsa
ccaugccacaccuuauccaguuagacacauacauaccaaucauuagaagaacaaguuuagaagg

SEQ ID NO: 526909 - RNA, 64 nt, hsa
uauauaguguagcaaaagaguauuuauacaucccaccaaucaaaacacagcuuuauuaccucau

SEQ ID NO: 526910 - RNA, 64 nt, hsa
ucuuagggcccucucccugccccagcuuuccccgaccaaucacgccuacagugcuuugaagguu

SEQ ID NO: 526911 - RNA, 64 nt, hsa
aaucugggacagggaggugacaguggaacaggcuaccaaucagaacuagaugacuuuuaaggcu

SEQ ID NO: 526912 - RNA, 64 nt, hsa
cucggaguguguaugccaagagugcacccaugguaccaaucaugaaucuuuguuucagguucag

SEQ ID NO: 526913 - RNA, 64 nt, hsa
auucacugugcacuuugcucaaaauuuuaaaaauaccaaucacaaggauaauagaguagccuaa

SEQ ID NO: 526914 - RNA, 64 nt, hsa
ucccuagacacuagaacuaaaggauugguaauaaaccaaucagaaagaaauccucugugggguc

SEQ ID NO: 526915 - RNA, 64 nt, hsa
ccugacuccagccacaaagcucauacccagcccuaccaaucaugaacuggaacuccauaaggag

SEQ ID NO: 526916 - RNA, 64 nt, hsa
ggcaccuccaaaucucauguccucacauuucaaaaccaaucaugccuucccaacagucccccaa

SEQ ID NO: 526917 - RNA, 64 nt, hsa
gucucauggucagcucgccucucaaagauggcucaccaaucaccugccuguuuuuacuuagaaa

SEQ ID NO: 526918 - RNA, 64 nt, hsa
cugcugcaaaggaaucucuugcugaguccaggccaccaaucaggcaaauagcccauacauuuga

SEQ ID NO: 526919 - RNA, 64 nt, hsa
ucaaccaauauaaauccacaagcagcuugauuccaccaaucagagaaguugaagaugaauguug

SEQ ID NO: 526920 - RNA, 64 nt, hsa
cccagugacaccagcacugauuggacugcccuacaccaaucagaagcucagugcccaaugggcc

SEQ ID NO: 526921 - RNA, 64 nt, hsa
gccugcucguaaagcucaauccuucuaucauggcaccaaucacaagaaccuuggacguuugacu

SEQ ID NO: 526922 - RNA, 64 nt, hsa
auggaugccauuccuuuugcccaguuaaauguucaccaaucauuuuaacuaaauacucagacuu

SEQ ID NO: 526923 - RNA, 64 nt, hsa
auaacaguaauuaauuguguaauucagaauucauaccaaucaguguugaaacucaaacauugca

SEQ ID NO: 526924 - RNA, 64 nt, hsa
gcugugcgcuugucagaccaucagaccagggccaaccaaucagaaggcaacuuacuguauaaau

SEQ ID NO: 526925 - RNA, 64 nt, hsa
caccaacacaacagcaauggcaacaccgacagcaaccaaucagauauauacaaaugaaauuaga

SEQ ID NO: 526926 - RNA, 64 nt, hsa
aguguucacauucacacuuaaugacuuccuuggcaccaaucauguauuucaccguuugcacuuu

SEQ ID NO: 526927 - RNA, 64 nt, hsa
uuaccaagugcuuuccucaaguuugucucucuugaccaaucauuuuuuccaaaucaaucaccag

SEQ ID NO: 526928 - RNA, 64 nt, hsa
ucaaugugaaaacauagacuuauuuuuaaauuguaccaaucacaagaaaauaauggcaauaauu

SEQ ID NO: 526929 - RNA, 64 nt, hsa
gaaaaauugucuccuaauuuggggagaugaaccaaccaaucaaugacaagaaaacgcuuacaca

SEQ ID NO: 526930 - RNA, 64 nt, hsa
uuguaaaacucugauuguacuuagagaugugacuaccaaucaguuugauacucaaggaaagggg

SEQ ID NO: 526931 - RNA, 64 nt, hsa
cccuggcuccggagaaugcuggauggaacaggaaaccaaucaccuggcaccacuuucaagaugc

SEQ ID NO: 526932 - RNA, 64 nt, hsa
ccggaagaucuggcgaagcucaggcaaaaacaccaccaaucacguggaaguuaauuuuauaaaa

SEQ ID NO: 526933 - RNA, 64 nt, hsa
acugcaaaacugguuuuacccaccacugucacacaccaaucagaacuugccagcuccucaaaac

SEQ ID NO: 526934 - RNA, 64 nt, hsa
aaacaagacagacucgaguuguuagggcugaggaaccaaucaagguagaacaaagaaaauguug

SEQ ID NO: 526935 - RNA, 64 nt, hsa
uuaguggaauguagaauguggcaaucuuaaggucaccaaucaguuuuuguucuuuuuuccugga

SEQ ID NO: 526936 - RNA, 64 nt, hsa
agcuagcccgaacugacuucagcagcuaccccaaaccaaucaaggguuuguuuacgggagugcc

SEQ ID NO: 526937 - RNA, 64 nt, hsa
aacaugguuucaagcccagcccccagccuuucuuaccaaucaaggacucagaacugaaggcaau

SEQ ID NO: 526938 - RNA, 64 nt, hsa
uagucaaggaaccucaagucaugcuuuugcuaucaccaaucauaguguacccaucuuuaauuua

SEQ ID NO: 526939 - RNA, 64 nt, hsa
gugauggggaccgucuuucuuuuacugacacaugaccaaucauaugguauuuucaagggaauuu

SEQ ID NO: 526940 - RNA, 64 nt, hsa
cacauauuuugacccaaguggauauuuucuuaaaaccaaucaauaauagcuagcuauuacugca

SEQ ID NO: 526941 - RNA, 64 nt, hsa
ugggguuuuuuuuuuuccuuuguuaagaaagccaaccaaucacaaugauauagucauuguugug

SEQ ID NO: 526942 - RNA, 64 nt, hsa
ggauucuguagaaaauacauacuuccugugccauaccaaucaguuacacucaaagcuuucuugg

SEQ ID NO: 526943 - RNA, 64 nt, hsa
acuuaguaaaugucauaacuacaccugcuccaggaccaaucagugaaaccugcucggaauuaaa

SEQ ID NO: 526944 - RNA, 64 nt, hsa
ggcaucacuuuccuggauccaggauaauuuuuaaaccaaucaaaugaaaaaaacaaacaaacaa

SEQ ID NO: 526945 - RNA, 64 nt, hsa
uguaaaaugcacccaucagugcucuguaaaacacaccaaucagcgcucuguagcuagcaauagg

SEQ ID NO: 526946 - RNA, 64 nt, hsa
uguaaaaugcacccaucagcacucuguaaaacgcaccaaucagcacucuguaaaaugcaccaau

SEQ ID NO: 526947 - RNA, 64 nt, hsa
uguaaaacgcaccaaucagcacucuguaaaaugcaccaaucagcaggauucuaaaaguagacaa

SEQ ID NO: 526948 - RNA, 64 nt, hsa
gaggcagggaggggagcaucugucugccacugagaccaaucacagccucuuugcacagcaugcc

SEQ ID NO: 526949 - RNA, 64 nt, hsa
ucuucucuuaagaggcuuccagagaaaacggcacaccaaucaauaaagaacugagcagaaacca

SEQ ID NO: 526950 - RNA, 64 nt, hsa
ggcaccaaguuaggucucagaggaaagaauggaaaccaaucacuuuacauuuuuauuuuuauuu

SEQ ID NO: 526951 - RNA, 64 nt, hsa
uccaagggccugaugacucuuuugguaaccagacaccaaucaaauaaggggaggagacgaaaau

SEQ ID NO: 526952 - RNA, 64 nt, hsa
guggauuuaccuguagaguuuauuggauccugaaaccaaucaauuacuuagaacuaggcaaaga

SEQ ID NO: 526953 - RNA, 64 nt, hsa
ggcacucuguaucuagcucaagguuuguaaacacaccaaucagcacccugugucuagcucagug

SEQ ID NO: 526954 - RNA, 64 nt, hsa
gaaccuuugugucuagcucagggaucguaaacgcaccaaucagcacccugucaaaacagaccac

SEQ ID NO: 526955 - RNA, 64 nt, hsa
gucaaaacagaccacuugacucucuguaaaauggaccaaucagcaggauguggguggggcgaga

SEQ ID NO: 526956 - RNA, 64 nt, hsa
gacccuggcuucuggaguccucugugagugagggaccaaucaaaauuauuuuucaaaaagcaaa

SEQ ID NO: 526957 - RNA, 64 nt, hsa
gggaaaauuuuuagaagaaaagcaaacaugugagaccaaucauuaucaaauacuuuuauuuuuu

SEQ ID NO: 526958 - RNA, 64 nt, hsa
ggcugccaugagaccugaggaccacacuugggggaccaaucauguccuucaccacugugccuua

SEQ ID NO: 526959 - RNA, 64 nt, hsa
ccauccuggacgacagagugagacucugucucaaaccaaucaaucaaucaaucaaucacugucc

SEQ ID NO: 526960 - RNA, 64 nt, hsa
guuuuuauucucucaggcagucuauauauguuaaaccaaucaaggaacuuacucuauucagugg

SEQ ID NO: 526961 - RNA, 64 nt, hsa
gcuccggcccgggacccaggaccagcaacccgcgaccaaucaugcugcagcccaggggcgucug

SEQ ID NO: 526962 - RNA, 64 nt, hsa
ucuaaaacuaaagaaucuaggaaccuugccugcgaccaaucauggagccacgugagcugaucgu

SEQ ID NO: 526963 - RNA, 64 nt, hsa
uucaguugcuuuugucucccuaggaggcagguaaaccaaucaaaaacagaguuuucuguguuuc

SEQ ID NO: 526964 - RNA, 64 nt, hsa
ccuugcaaauaaucacagauuagcuguaauuuuaaccaaucagaugacaacaaagauugauaga

SEQ ID NO: 526965 - RNA, 64 nt, hsa
uuggaauucuuagguucuacucaagaguggaaggaccaaucaccucugauauucuguggaaggu

SEQ ID NO: 526966 - RNA, 64 nt, hsa
ccuguauucccaucuccccagugucacuccccucaccaaucacuccagaugguuuugggggaac

SEQ ID NO: 526967 - RNA, 64 nt, hsa
caaccagggguuucuuucccuacccuuugugaaaaccaaucaauuacuagaugaguggauggau

SEQ ID NO: 526968 - RNA, 64 nt, hsa
uguauuuuguauuguauguuuucuucaacauguaaccaaucaguaucuugucaauauagucagc

SEQ ID NO: 526969 - RNA, 64 nt, hsa
auuuucccuuuuuauuuuucagcaucaagagaaaaccaaucagcuucaucaaaacagaagaaaa

SEQ ID NO: 526970 - RNA, 64 nt, hsa
auaguaguuggcaagaugaaaugccagaauuaaaaccaaucauaaguagaacccacuucaaaau

SEQ ID NO: 526971 - RNA, 64 nt, hsa
gcccacccugcugcccaacuccugugagagaaaaaccaaucaauguuuacaaaauggaaaagga

SEQ ID NO: 526972 - RNA, 64 nt, hsa
uacuguauuauuuugguaugcuuacaaaugacuaaccaaucaaauugucauuaauguuuggaaa

SEQ ID NO: 526973 - RNA, 56 nt, hsa
guugcucaagcaugucauaaagcuucaccaaucaagucccaugaaaagacuuaaug

SEQ ID NO: 526974 - RNA, 64 nt, hsa
gcauagcagaugcucguucuugccuccuucaggcaccaaucaggagaaggguucugccucccau

SEQ ID NO: 526975 - RNA, 64 nt, hsa
cucccagccugaaucugccuggauggaacugaggaccaaucaugcugcaaggaacacuuccacg

SEQ ID NO: 526976 - RNA, 64 nt, hsa
cuccucccuccuccacaccuugagugaugaccacaccaaucacuguauuuuauagcuuuuuuuu

SEQ ID NO: 526977 - RNA, 64 nt, hsa
aaaagaaaaaaaggauaugguuaccuguaaucuuaccaaucauagauaaucacugucaaacuuu

SEQ ID NO: 526978 - RNA, 64 nt, hsa
cauuggcccaaaugggccaugugauuuucucuaaaccaaucacugugacucuagaguggccaga

SEQ ID NO: 526979 - RNA, 64 nt, hsa
augagccaccacgccuggccagaugcauguucaaaccaaucaaaugguguuuucuuaugcagga

SEQ ID NO: 526980 - RNA, 64 nt, hsa
ucgguaauagaaaaaucucugaaagacuuuacugaccaaucagccggagccccaggagcccaag

SEQ ID NO: 526981 - RNA, 60 nt, hsa
aagauuguggacaaauuugagucacuucucaccaaucagacuuuauggagaacagaaggg

SEQ ID NO: 526982 - RNA, 64 nt, hsa
uuagaaaaaaguaauaugaaguauucugaaauuaaccaaucaguuuauuuaaaucaauuuauuu

SEQ ID NO: 526983 - RNA, 64 nt, hsa
gagcuagauuuaacucaguuucuaggcaccucagaccaaucaucaacuaccauucuauuccaug

SEQ ID NO: 526984 - RNA, 64 nt, hsa
ccaggcucagaucgaccaauaugugggguuggugaccaaucaguugagccacaucaaagcuaag

SEQ ID NO: 526985 - RNA, 64 nt, hsa
auauauuuaaaccaaccucaugcccuguugauaaaccaaucaaauugguaaagaccuaaaacca

SEQ ID NO: 526986 - RNA, 64 nt, hsa
uguaagauggaccaaucagcgcucuguaaaauggaccaaucagcaggacaugggcggggacaau

SEQ ID NO: 526987 - RNA, 64 nt, hsa
uguaaaauggaccaaucagcacucuguaagauggaccaaucagcgcucuguaaaauggaccaau

SEQ ID NO: 526988 - RNA, 64 nt, hsa
aacuuuucugucuuacaagaggauuguaaaauggaccaaucagcacucuguaagauggaccaau

SEQ ID NO: 526989 - RNA, 64 nt, hsa
ccaggaguuugagguuacagugagccacaaucacaccaaucacugcacuccagccugggcaaua

SEQ ID NO: 526990 - RNA, 64 nt, hsa
ccuuccacccauuuuuaauugugagagauuugucaccaaucaucacugguuccuccuuaaaaau

SEQ ID NO: 526991 - RNA, 64 nt, hsa
uuacagaauguaguauuuugauaucauuaaguaaaccaaucagaaaacuccuugagcaauaguu

SEQ ID NO: 526992 - RNA, 64 nt, hsa
ucaggguuccagaaaucccccguucccaaaccaaaccaaucauggaucuucccuuuaaggggua

SEQ ID NO: 526993 - RNA, 64 nt, hsa
ccuauuuuguuacccaacucuuccuauuuuuguuaccaaucacugugcucucugccgcccccug

SEQ ID NO: 526994 - RNA, 64 nt, hsa
ucuggagcuggccagguccucugcagcaggcaagaccaaucaaucacugaaccugccucauggc

SEQ ID NO: 526995 - RNA, 64 nt, hsa
auagaaggaggagagggaaaauguuuuguaagaaaccaaucaagauaaaggacagugaaguaau

SEQ ID NO: 526996 - RNA, 64 nt, hsa
uugagaacuuuauuuccaaguuguucaaacauuuaccaaucauauuaauacaaugaugcuauuu

SEQ ID NO: 526997 - RNA, 64 nt, hsa
aauggaccaaauacauuuuuaaaagaaaacugagaccaaucagauggaaauggaguuuuaaggc

SEQ ID NO: 526998 - RNA, 64 nt, hsa
caggagcccucuugaaauuaacaauggaaauaaaaccaaucagucaguuagccuaaaccuauug

SEQ ID NO: 526999 - RNA, 64 nt, hsa
uagccaugaacacagcuugcuugcauuuaguaagaccaaucagcuuaguguuuauuucuucuac

SEQ ID NO: 527000 - RNA, 64 nt, hsa
gcuugacugauuucagugauauucagaaguguguaccaaucaaggcucuuuaaaauacggaacg

SEQ ID NO: 527001 - RNA, 65 nt, hsa
cuccuggcuguugacuucccauugcucuuggagccaccaaucaaagagauucaaagagauuccug

SEQ ID NO: 527002 - RNA, 65 nt, hsa
ucggcucagugacagccaaccugcccccuccccacaccaaucagccaggcugagcccccaccccu

SEQ ID NO: 527003 - RNA, 65 nt, hsa
ucccuaccuuuuucuucucuucauugaccaaaucaaccaaucacuacagcugcucugcuucugcu

SEQ ID NO: 527004 - RNA, 65 nt, hsa
ccacggggaucacagcguuucaggaacguugccacaccaaucagagagccuagaacaucccuggg

SEQ ID NO: 527005 - RNA, 65 nt, hsa
gucaugagcaaauaugucaagggagucaauuucugaccaaucaaguacacuaaauuagaauauuu

SEQ ID NO: 527006 - RNA, 65 nt, hsa
uaagaaugguuuuccaccuuuucccccuaaucucuaccaaucagacacauuuuauuauuuaaauc

SEQ ID NO: 527007 - RNA, 65 nt, hsa
gcacccuccauagccaccaaaccuguuagaacuggaccaaucaaaccucaggcgaucaaaaccga

SEQ ID NO: 527008 - RNA, 65 nt, hsa
gguaaugcagaaaucuguuuuguucccaugaaaucaccaaucaaggccuccguucuucuaaagau

SEQ ID NO: 527009 - RNA, 65 nt, hsa
augagaaaaguuaaccaaggaauuauucuuuucucaccaaucaacacuuuuaagaaauauauaua

SEQ ID NO: 527010 - RNA, 65 nt, hsa
cccugugguguuuggcaugugcccccugucuacugaccaaucaguguggcaugaggcccacgcca

SEQ ID NO: 527011 - RNA, 65 nt, hsa
uuuuuagucucuugaugucucaaucuuacauguauaccaaucacaauggaauaaaguguugaguu

SEQ ID NO: 527012 - RNA, 65 nt, hsa
cagccaauguaugguuauccacucugugugccaaaaccaaucaugccuuucacggcccuuuaguu

SEQ ID NO: 527013 - RNA, 65 nt, hsa
acaggaucuuucagaucaugugcaauuuuuaucuaaccaaucagaaauacuaguuuaaaaugaau

SEQ ID NO: 527014 - RNA, 65 nt, hsa
uguuacauuuucccaauaucuuuucuauuccuuggaccaaucagagaugcuguagcuccuugggg

SEQ ID NO: 527015 - RNA, 65 nt, hsa
cacacugauuaggccugggucacauguccacccugaccaaucacuguggccaggaggaugauaca

SEQ ID NO: 527016 - RNA, 65 nt, hsa
caagugggcuuggggaauugaauagcagagagcaaaccaaucagucccucaggaaagggaagaaa

SEQ ID NO: 527017 - RNA, 65 nt, hsa
uuacacuguucugggguuuguucucuacccuuccaaccaaucacaccccugccuuuuuuuuuuuu

SEQ ID NO: 527018 - RNA, 65 nt, hsa
uuuuccucuuucuuggcuucuacccacaaacauucaccaaucauuuauucguucauuuagcaaau

SEQ ID NO: 527019 - RNA, 65 nt, hsa
uauaaauaaaaagccugauuauuuuaggccaguuuaccaaucacuguguaauucuucugguagua

SEQ ID NO: 527020 - RNA, 65 nt, hsa
gaugcaaaaguucacuguugcaguguuuucaaaugaccaaucaaguacuacuucuugguuaaaag

SEQ ID NO: 527021 - RNA, 65 nt, hsa
guggucucuccccuggcuugcuucauggccacugaaccaaucacuuuguaugcuaugcuccuacu

SEQ ID NO: 527022 - RNA, 65 nt, hsa
guuagacaucuucugugauuguuauggcauauuacaccaaucagagaaauagaguuuuaaaguag

SEQ ID NO: 527023 - RNA, 65 nt, hsa
gcuucauuuagagaccacaguaacaacagcagcccaccaaucagagaagcugguuguuauuaacc

SEQ ID NO: 527024 - RNA, 65 nt, hsa
ucuuucuuuuucuggaaauuuuguccauuuuaaaaaccaaucauuuuaagaagacaugacaaugc

SEQ ID NO: 527025 - RNA, 65 nt, hsa
ugugcuuuaucaucuccaucuuuagccuuuacaccaccaaucaaaacucuagguacaccaacaca

SEQ ID NO: 527026 - RNA, 65 nt, hsa
aaauauuuuuauccuagggccaaguguugccugccaccaaucaguaaguuagucuauaacaaauu

SEQ ID NO: 527027 - RNA, 65 nt, hsa
uggccccuccaaaucucauguccucacuauucaaaaccaaucaugccuuccuaacagucccccaa

SEQ ID NO: 527028 - RNA, 65 nt, hsa
uggguugaggcuugacuguagcauccugcuuagagaccaaucaacggacacugguuuuuagaccu

SEQ ID NO: 527029 - RNA, 65 nt, hsa
augaggacaccucagugacaaacacaccuuuuuauaccaaucaguauccucuguucauuaaaacu

SEQ ID NO: 527030 - RNA, 65 nt, hsa
uuguuauuuaaagaacacccuauauuuugcauaguaccaaucauuuuaauuauuauucuucauaa

SEQ ID NO: 527031 - RNA, 65 nt, hsa
ucuguugacaauuugccauagcagugcuaggauaaaccaaucaucuuaacuuggcuaacauagca

SEQ ID NO: 527032 - RNA, 65 nt, hsa
aauuaggccaaacagauguacuucacucaaggagaaccaaucauauuuucucucugucucucaaa

SEQ ID NO: 527033 - RNA, 65 nt, hsa
gccaugauuagacguugacugcaucucccugauagaccaaucagcugugucgcacuuaaacugga

SEQ ID NO: 527034 - RNA, 65 nt, hsa
ucucaauuaagaaaaacagucacaugucacgacaaaccaaucaaucuuuaugagauauuccugua

SEQ ID NO: 527035 - RNA, 65 nt, hsa
aaguauuauccugcuuccagaccuaugucaccaguaccaaucagucagugucaucacauuucagg

SEQ ID NO: 527036 - RNA, 65 nt, hsa
uuuguuugcuuguugaauuuuugaacagccaguugaccaaucauagaaaguauuacuuucuuuca

SEQ ID NO: 527037 - RNA, 65 nt, hsa
auuuugaacccaacucuaccuuucauuuucuuaagaccaaucacagcuugugccucagaucaucc

SEQ ID NO: 527038 - RNA, 65 nt, hsa
cugcccuggcagugacuuggagcccugaagaagggaccaaucaugggaccacagccacugugccc

SEQ ID NO: 527039 - RNA, 65 nt, hsa
cucauugcucuggcugaguugugugccuguuucugaccaaucacugagucaggaggaugaaauau

SEQ ID NO: 527040 - RNA, 65 nt, hsa
uucaucuggaucaugggacccucucuaauccuuccaccaaucaaauaagcuauugcuauugguuu

SEQ ID NO: 527041 - RNA, 65 nt, hsa
cagaguagaaaaaucuguugccugauauacauaacaccaaucagaccguguggauuuuucucuga

SEQ ID NO: 527042 - RNA, 65 nt, hsa
agauuucaggugcuugcaacuggacugcagacucuaccaaucacgggcauuuuaucuucucugaa

SEQ ID NO: 527043 - RNA, 65 nt, hsa
guggugucaccacuacuuaauugggagauaaugaaaccaaucauggaugcuguuuuuauugggca

SEQ ID NO: 527044 - RNA, 65 nt, hsa
guuuuggaagaggaaaacaggaacccaccaaaccaaccaaucaaccaaacaaagaaaaaauucca

SEQ ID NO: 527045 - RNA, 65 nt, hsa
cagguugaagaguggccccuugaggcccuggaaagaccaaucacuggacuucuucccuugagagu

SEQ ID NO: 527046 - RNA, 65 nt, hsa
cgacacugaggcugcagcgggaauucgcacucggcaccaaucagagccccaugccgcggccccuc

SEQ ID NO: 527047 - RNA, 65 nt, hsa
auucauuaugaaaggucaagcaaagacagcagaauaccaaucacuucaucauuuaggaaguaugg

SEQ ID NO: 527048 - RNA, 65 nt, hsa
cuaaggcugguguagaaacaaagggccuaaugagaaccaaucaucauggaagucaguugcggggg

SEQ ID NO: 527049 - RNA, 65 nt, hsa
guauuaaguguuauuugcaaaagguagauuauguaaccaaucagguacguaccaggcagugaugu

SEQ ID NO: 527050 - RNA, 65 nt, hsa
caggcagagguugcucggggccuugggucggguuuaccaaucagccaggacgcccggggccacca

SEQ ID NO: 527051 - RNA, 65 nt, hsa
aaaagaaaauaaaucucaugucagacccagaaaggaccaaucacuguccgauuguaagcuauguu

SEQ ID NO: 527052 - RNA, 65 nt, hsa
uguauuacuuuuuauguuugguauuauucugccaaaccaaucauguuauuguuuuuaaucauuga

SEQ ID NO: 527053 - RNA, 65 nt, hsa
agcuaauguuuuuuccucaaacucugcuuucuguaaccaaucaguguuuuaauguuuguguguuc

SEQ ID NO: 527054 - RNA, 65 nt, hsa
ccuauccacagugaaccugguuacgaagaaaacucaccaaucaucuccuuccuguuaaucacaug

SEQ ID NO: 527055 - RNA, 65 nt, hsa
cugagcuccagaaaggacguaacuuagcauggaucaccaaucaaucaaaaaauaaauaaaucacu

SEQ ID NO: 527056 - RNA, 65 nt, hsa
caaguuuuaaauauuuuucuucaaaggcuuguuaaaccaaucauguuaaaaggaaauucuugguu

SEQ ID NO: 527057 - RNA, 65 nt, hsa
cauaaccauuuguauaaugagaaaucuaggggaaaaccaaucaguccaacaugagauuuuaggaa

SEQ ID NO: 527058 - RNA, 65 nt, hsa
ccuggagaggauugugcaggcacauuaauauugugaccaaucacagaaucugggaauaugaagcu

SEQ ID NO: 527059 - RNA, 51 nt, hsa; identical to SEQ ID NO: 526873

SEQ ID NO: 527060 - RNA, 65 nt, hsa
uuccauauccuaaugauucaaucucccuuacccugaccaaucaguggcccaaauuuuccagcccc

SEQ ID NO: 527061 - RNA, 65 nt, hsa
gaauauuaucacuugacagauagaguuaauaaauuaccaaucaggcacauuuuauaauguuuguc

SEQ ID NO: 527062 - RNA, 65 nt, hsa
ugaaggaaaaaagaaccuauuuuugugcaucauuuaccaaucaugccacacaagcauuuauuuuu

SEQ ID NO: 527063 - RNA, 65 nt, hsa
ccagcucagagcugagggccucccccuccacagcaaccaaucacaaccauaaagcuacaagcacg

SEQ ID NO: 527064 - RNA, 65 nt, hsa
uaauaccauuuggagcuggacaacauuugacaccaaccaaucauacuggacaaggcccuuagagg

SEQ ID NO: 527065 - RNA, 65 nt, hsa
cuauauuuuaucuuuuaucuuuuucuuugacauuuaccaaucaccaagcaugcaccaaacacugc

SEQ ID NO: 527066 - RNA, 65 nt, hsa
caaaugaauuuauucuuucgguaugguaaaauugaaccaaucacaguuaagaugagagaucaacc

SEQ ID NO: 527067 - RNA, 65 nt, hsa
ucguuugauuucuuguguuuuauuugccaaauguuaccaaucagugagcaagcaagcacagccaa

SEQ ID NO: 527068 - RNA, 65 nt, hsa
aacacccacgcugguuucugugcaguguuaggaaaaccaaucagguuauugcauugacuucacuc

SEQ ID NO: 527069 - RNA, 65 nt, hsa
uaugccuaugugucuugcagauugcaagauauuuuaccaaucagcauguguuaccuguacaauua

SEQ ID NO: 527070 - RNA, 65 nt, hsa
gaauugucauaggagggaagcuucaaagucaugaaaccaaucaacagccaagucagcaagcaauc

SEQ ID NO: 527071 - RNA, 65 nt, hsa
uuccuuaaggaaggacugaucugugugcucuuaucaccaaucaguucagaccugguugauuuugu

SEQ ID NO: 527072 - RNA, 65 nt, hsa
uuacagauuaauuuuuccauaaaaccauuuuuugaaccaaucaguaauuuuaagguuuuguuugu

SEQ ID NO: 527073 - RNA, 65 nt, hsa
acaugugggcagacauugggauaacaacuuucaucaccaaucauuggacuuuugugaaguugaca

SEQ ID NO: 527074 - RNA, 65 nt, hsa
ccugggggagaaccacugacccaaaugaauucuaaaccaaucaaaugucugggaagcccuccaag

SEQ ID NO: 527075 - RNA, 65 nt, hsa
ucuuuuggaccuacauacauuuuccuuuguuuuugaccaaucaaugaagccaaauuuauaugucc

SEQ ID NO: 527076 - RNA, 65 nt, hsa
acacuaagagagaaugagagacacacugaagaagcaccaaucaugaauuaguuuuauaugcuucu

SEQ ID NO: 527077 - RNA, 65 nt, hsa
gaauucuucccagcacaguguucugggcagccaguaccaaucaauuuggcacucaugaugggacc

SEQ ID NO: 527078 - RNA, 65 nt, hsa
agggauggugaauggcugugaccauggcagacaucaccaaucaagugcagcacaugggugauguc

SEQ ID NO: 527079 - RNA, 65 nt, hsa
uuugugauauaaaauaaagcugaguauaaaauaaaaccaaucaaacacagaauuugauuggauuu

SEQ ID NO: 527080 - RNA, 65 nt, hsa
uuuaaacacggggcuugcaacuuagcucacaccugaccaaucagagagcucacuaaaaugcuaau

SEQ ID NO: 527081 - RNA, 65 nt, hsa
gucaguuaaccucuaaauaugaacuuuccacucuaaccaaucaaauaguuucuuugucuugcucc

SEQ ID NO: 527082 - RNA, 65 nt, hsa
agcucagugguuuccaaauuuggcugcacauucauaccaaucaccaggggauuuuuuuaaaaucc

SEQ ID NO: 527083 - RNA, 65 nt, hsa
uuuuuuuuucuuguuuccuuauaaaacagguaauaaccaaucauuuuguguuuguauuuccauuc

SEQ ID NO: 527084 - RNA, 65 nt, hsa
gguggagaaaguaaucuccuugcaaucauguggacaccaaucacaaaaguaaagcccugguguug

SEQ ID NO: 527085 - RNA, 65 nt, hsa
gaauuuaagaccauauuauuaucaaaaaccuagagaccaaucauauaucugaaaagaaauaccca

SEQ ID NO: 527086 - RNA, 65 nt, hsa
cuccuguaagaccuccuaccacauggcgaguauacaccaaucaggagaggguagcugccugcaua

SEQ ID NO: 527087 - RNA, 65 nt, hsa
uaaaugaucuguaguuccguggcuugcaugggugcaccaaucaucuuuagaacgauguacacuga

SEQ ID NO: 527088 - RNA, 65 nt, hsa
ucggaaggccagcucuucuuggaggacaagacaggaccaaucaaagaggggaccugcugggaaug

SEQ ID NO: 527089 - RNA, 65 nt, hsa
aguaaaccaucuuuuauccucuauucauauuuucuaccaaucacuauguauuggggauaucuuug

SEQ ID NO: 527090 - RNA, 65 nt, hsa
uuaugaaguuaacagucucauuacagauuuaguuuaccaaucaacagcaugucuacugcuuggau

SEQ ID NO: 527091 - RNA, 65 nt, hsa
cagugaaaauguugucucuuuacaaccaauugauaaccaaucacauaguuuuaucaguguauuua

SEQ ID NO: 527092 - RNA, 65 nt, hsa
uggcugaaucgaaacauguguaaugucaauguaaaaccaaucacagcugugaacugcaugaaaug

SEQ ID NO: 527093 - RNA, 65 nt, hsa
gauuaaccuuuucaaauuaauguuccaguuugaagaccaaucaaauauauuauuuagucaacaua

SEQ ID NO: 527094 - RNA, 65 nt, hsa
uccaugccacaccuuauccaguuagacacauacauaccaaucauuagaagaacaaguuuagaagg

SEQ ID NO: 527095 - RNA, 65 nt, hsa
guauauaguguagcaaaagaguauuuauacaucccaccaaucaaaacacagcuuuauuaccucau

SEQ ID NO: 527096 - RNA, 65 nt, hsa
uucuuagggcccucucccugccccagcuuuccccgaccaaucacgccuacagugcuuugaagguu

SEQ ID NO: 527097 - RNA, 65 nt, hsa
aaaucugggacagggaggugacaguggaacaggcuaccaaucagaacuagaugacuuuuaaggcu

SEQ ID NO: 527098 - RNA, 65 nt, hsa
ucucggaguguguaugccaagagugcacccaugguaccaaucaugaaucuuuguuucagguucag

SEQ ID NO: 527099 - RNA, 65 nt, hsa
cauucacugugcacuuugcucaaaauuuuaaaaauaccaaucacaaggauaauagaguagccuaa

SEQ ID NO: 527100 - RNA, 65 nt, hsa
aucccuagacacuagaacuaaaggauugguaauaaaccaaucagaaagaaauccucugugggguc

SEQ ID NO: 527101 - RNA, 65 nt, hsa
cccugacuccagccacaaagcucauacccagcccuaccaaucaugaacuggaacuccauaaggag

SEQ ID NO: 527102 - RNA, 65 nt, hsa
uggcaccuccaaaucucauguccucacauuucaaaaccaaucaugccuucccaacagucccccaa

SEQ ID NO: 527103 - RNA, 65 nt, hsa
ugucucauggucagcucgccucucaaagauggcucaccaaucaccugccuguuuuuacuuagaaa

SEQ ID NO: 527104 - RNA, 65 nt, hsa
ucugcugcaaaggaaucucuugcugaguccaggccaccaaucaggcaaauagcccauacauuuga

SEQ ID NO: 527105 - RNA, 65 nt, hsa
aucaaccaauauaaauccacaagcagcuugauuccaccaaucagagaaguugaagaugaauguug

SEQ ID NO: 527106 - RNA, 65 nt, hsa
acccagugacaccagcacugauuggacugcccuacaccaaucagaagcucagugcccaaugggcc

SEQ ID NO: 527107 - RNA, 65 nt, hsa
agccugcucguaaagcucaauccuucuaucauggcaccaaucacaagaaccuuggacguuugacu

SEQ ID NO: 527108 - RNA, 65 nt, hsa
gauggaugccauuccuuuugcccaguuaaauguucaccaaucauuuuaacuaaauacucagacuu

SEQ ID NO: 527109 - RNA, 65 nt, hsa
aauaacaguaauuaauuguguaauucagaauucauaccaaucaguguugaaacucaaacauugca

SEQ ID NO: 527110 - RNA, 65 nt, hsa
ugcugugcgcuugucagaccaucagaccagggccaaccaaucagaaggcaacuuacuguauaaau

SEQ ID NO: 527111 - RNA, 65 nt, hsa
ccaccaacacaacagcaauggcaacaccgacagcaaccaaucagauauauacaaaugaaauuaga

SEQ ID NO: 527112 - RNA, 65 nt, hsa
caguguucacauucacacuuaaugacuuccuuggcaccaaucauguauuucaccguuugcacuuu

SEQ ID NO: 527113 - RNA, 65 nt, hsa
cuuaccaagugcuuuccucaaguuugucucucuugaccaaucauuuuuuccaaaucaaucaccag

SEQ ID NO: 527114 - RNA, 65 nt, hsa
aucaaugugaaaacauagacuuauuuuuaaauuguaccaaucacaagaaaauaauggcaauaauu

SEQ ID NO: 527115 - RNA, 65 nt, hsa
ggaaaaauugucuccuaauuuggggagaugaaccaaccaaucaaugacaagaaaacgcuuacaca

SEQ ID NO: 527116 - RNA, 65 nt, hsa
guuguaaaacucugauuguacuuagagaugugacuaccaaucaguuugauacucaaggaaagggg

SEQ ID NO: 527117 - RNA, 65 nt, hsa
ccccuggcuccggagaaugcuggauggaacaggaaaccaaucaccuggcaccacuuucaagaugc

SEQ ID NO: 527118 - RNA, 65 nt, hsa
gccggaagaucuggcgaagcucaggcaaaaacaccaccaaucacguggaaguuaauuuuauaaaa

SEQ ID NO: 527119 - RNA, 65 nt, hsa
gacugcaaaacugguuuuacccaccacugucacacaccaaucagaacuugccagcuccucaaaac

SEQ ID NO: 527120 - RNA, 65 nt, hsa
aaaacaagacagacucgaguuguuagggcugaggaaccaaucaagguagaacaaagaaaauguug

SEQ ID NO: 527121 - RNA, 65 nt, hsa
uuuaguggaauguagaauguggcaaucuuaaggucaccaaucaguuuuuguucuuuuuuccugga

SEQ ID NO: 527122 - RNA, 65 nt, hsa
gagcuagcccgaacugacuucagcagcuaccccaaaccaaucaaggguuuguuuacgggagugcc

SEQ ID NO: 527123 - RNA, 65 nt, hsa
uaacaugguuucaagcccagcccccagccuuucuuaccaaucaaggacucagaacugaaggcaau

SEQ ID NO: 527124 - RNA, 65 nt, hsa
cuagucaaggaaccucaagucaugcuuuugcuaucaccaaucauaguguacccaucuuuaauuua

SEQ ID NO: 527125 - RNA, 65 nt, hsa
ggugauggggaccgucuuucuuuuacugacacaugaccaaucauaugguauuuucaagggaauuu

SEQ ID NO: 527126 - RNA, 65 nt, hsa
acacauauuuugacccaaguggauauuuucuuaaaaccaaucaauaauagcuagcuauuacugca

SEQ ID NO: 527127 - RNA, 65 nt, hsa
uugggguuuuuuuuuuuccuuuguuaagaaagccaaccaaucacaaugauauagucauuguugug

SEQ ID NO: 527128 - RNA, 65 nt, hsa
cggauucuguagaaaauacauacuuccugugccauaccaaucaguuacacucaaagcuuucuugg

SEQ ID NO: 527129 - RNA, 65 nt, hsa
cacuuaguaaaugucauaacuacaccugcuccaggaccaaucagugaaaccugcucggaauuaaa

SEQ ID NO: 527130 - RNA, 65 nt, hsa
aggcaucacuuuccuggauccaggauaauuuuuaaaccaaucaaaugaaaaaaacaaacaaacaa

SEQ ID NO: 527131 - RNA, 65 nt, hsa
uuguaaaaugcacccaucagugcucuguaaaacacaccaaucagcgcucuguagcuagcaauagg

SEQ ID NO: 527132 - RNA, 65 nt, hsa
uuguaaaaugcacccaucagcacucuguaaaacgcaccaaucagcacucuguaaaaugcaccaau

SEQ ID NO: 527133 - RNA, 65 nt, hsa
cuguaaaacgcaccaaucagcacucuguaaaaugcaccaaucagcaggauucuaaaaguagacaa

SEQ ID NO: 527134 - RNA, 65 nt, hsa
ggaggcagggaggggagcaucugucugccacugagaccaaucacagccucuuugcacagcaugcc

SEQ ID NO: 527135 - RNA, 65 nt, hsa
uucuucucuuaagaggcuuccagagaaaacggcacaccaaucaauaaagaacugagcagaaacca

SEQ ID NO: 527136 - RNA, 65 nt, hsa
uggcaccaaguuaggucucagaggaaagaauggaaaccaaucacuuuacauuuuuauuuuuauuu

SEQ ID NO: 527137 - RNA, 65 nt, hsa
auccaagggccugaugacucuuuugguaaccagacaccaaucaaauaaggggaggagacgaaaau

SEQ ID NO: 527138 - RNA, 65 nt, hsa
aguggauuuaccuguagaguuuauuggauccugaaaccaaucaauuacuuagaacuaggcaaaga

SEQ ID NO: 527139 - RNA, 65 nt, hsa
gggcacucuguaucuagcucaagguuuguaaacacaccaaucagcacccugugucuagcucagug

SEQ ID NO: 527140 - RNA, 65 nt, hsa
agaaccuuugugucuagcucagggaucguaaacgcaccaaucagcacccugucaaaacagaccac

SEQ ID NO: 527141 - RNA, 65 nt, hsa
ugucaaaacagaccacuugacucucuguaaaauggaccaaucagcaggauguggguggggcgaga

SEQ ID NO: 527142 - RNA, 65 nt, hsa
agacccuggcuucuggaguccucugugagugagggaccaaucaaaauuauuuuucaaaaagcaaa

SEQ ID NO: 527143 - RNA, 65 nt, hsa
ggggaaaauuuuuagaagaaaagcaaacaugugagaccaaucauuaucaaauacuuuuauuuuuu

SEQ ID NO: 527144 - RNA, 65 nt, hsa
uggcugccaugagaccugaggaccacacuugggggaccaaucauguccuucaccacugugccuua

SEQ ID NO: 527145 - RNA, 65 nt, hsa
uccauccuggacgacagagugagacucugucucaaaccaaucaaucaaucaaucaaucacugucc

SEQ ID NO: 527146 - RNA, 65 nt, hsa
uguuuuuauucucucaggcagucuauauauguuaaaccaaucaaggaacuuacucuauucagugg

SEQ ID NO: 527147 - RNA, 65 nt, hsa
ggcuccggcccgggacccaggaccagcaacccgcgaccaaucaugcugcagcccaggggcgucug

SEQ ID NO: 527148 - RNA, 65 nt, hsa
uucuaaaacuaaagaaucuaggaaccuugccugcgaccaaucauggagccacgugagcugaucgu

SEQ ID NO: 527149 - RNA, 65 nt, hsa
uuucaguugcuuuugucucccuaggaggcagguaaaccaaucaaaaacagaguuuucuguguuuc

SEQ ID NO: 527150 - RNA, 65 nt, hsa
gccuugcaaauaaucacagauuagcuguaauuuuaaccaaucagaugacaacaaagauugauaga

SEQ ID NO: 527151 - RNA, 65 nt, hsa
cuuggaauucuuagguucuacucaagaguggaaggaccaaucaccucugauauucuguggaaggu

SEQ ID NO: 527152 - RNA, 65 nt, hsa
accuguauucccaucuccccagugucacuccccucaccaaucacuccagaugguuuugggggaac

SEQ ID NO: 527153 - RNA, 65 nt, hsa
ccaaccagggguuucuuucccuacccuuugugaaaaccaaucaauuacuagaugaguggauggau

SEQ ID NO: 527154 - RNA, 65 nt, hsa
cuguauuuuguauuguauguuuucuucaacauguaaccaaucaguaucuugucaauauagucagc

SEQ ID NO: 527155 - RNA, 65 nt, hsa
aauuuucccuuuuuauuuuucagcaucaagagaaaaccaaucagcuucaucaaaacagaagaaaa

SEQ ID NO: 527156 - RNA, 65 nt, hsa
gauaguaguuggcaagaugaaaugccagaauuaaaaccaaucauaaguagaacccacuucaaaau

SEQ ID NO: 527157 - RNA, 65 nt, hsa
ugcccacccugcugcccaacuccugugagagaaaaaccaaucaauguuuacaaaauggaaaagga

SEQ ID NO: 527158 - RNA, 65 nt, hsa
auacuguauuauuuugguaugcuuacaaaugacuaaccaaucaaauugucauuaauguuuggaaa

SEQ ID NO: 527159 - RNA, 56 nt, hsa; identical to SEQ ID NO: 526973

SEQ ID NO: 527160 - RNA, 65 nt, hsa
ggcauagcagaugcucguucuugccuccuucaggcaccaaucaggagaaggguucugccucccau

SEQ ID NO: 527161 - RNA, 65 nt, hsa
gcucccagccugaaucugccuggauggaacugaggaccaaucaugcugcaaggaacacuuccacg

SEQ ID NO: 527162 - RNA, 65 nt, hsa
ucuccucccuccuccacaccuugagugaugaccacaccaaucacuguauuuuauagcuuuuuuuu

SEQ ID NO: 527163 - RNA, 65 nt, hsa
aaaaagaaaaaaaggauaugguuaccuguaaucuuaccaaucauagauaaucacugucaaacuuu

SEQ ID NO: 527164 - RNA, 65 nt, hsa
ucauuggcccaaaugggccaugugauuuucucuaaaccaaucacugugacucuagaguggccaga

SEQ ID NO: 527165 - RNA, 65 nt, hsa
caugagccaccacgccuggccagaugcauguucaaaccaaucaaaugguguuuucuuaugcagga

SEQ ID NO: 527166 - RNA, 65 nt, hsa
uucgguaauagaaaaaucucugaaagacuuuacugaccaaucagccggagccccaggagcccaag

SEQ ID NO: 527167 - RNA, 60 nt, hsa; identical to SEQ ID NO: 526981

SEQ ID NO: 527168 - RNA, 65 nt, hsa
cuuagaaaaaaguaauaugaaguauucugaaauuaaccaaucaguuuauuuaaaucaauuuauuu

SEQ ID NO: 527169 - RNA, 65 nt, hsa
agagcuagauuuaacucaguuucuaggcaccucagaccaaucaucaacuaccauucuauuccaug

SEQ ID NO: 527170 - RNA, 65 nt, hsa
cccaggcucagaucgaccaauaugugggguuggugaccaaucaguugagccacaucaaagcuaag

SEQ ID NO: 527171 - RNA, 65 nt, hsa
gauauauuuaaaccaaccucaugcccuguugauaaaccaaucaaauugguaaagaccuaaaacca

SEQ ID NO: 527172 - RNA, 65 nt, hsa
cuguaagauggaccaaucagcgcucuguaaaauggaccaaucagcaggacaugggcggggacaau

SEQ ID NO: 527173 - RNA, 65 nt, hsa
uuguaaaauggaccaaucagcacucuguaagauggaccaaucagcgcucuguaaaauggaccaau

SEQ ID NO: 527174 - RNA, 65 nt, hsa
gaacuuuucugucuuacaagaggauuguaaaauggaccaaucagcacucuguaagauggaccaau

SEQ ID NO: 527175 - RNA, 65 nt, hsa
cccaggaguuugagguuacagugagccacaaucacaccaaucacugcacuccagccugggcaaua

SEQ ID NO: 527176 - RNA, 65 nt, hsa
cccuuccacccauuuuuaauugugagagauuugucaccaaucaucacugguuccuccuuaaaaau

SEQ ID NO: 527177 - RNA, 65 nt, hsa
uuuacagaauguaguauuuugauaucauuaaguaaaccaaucagaaaacuccuugagcaauaguu

SEQ ID NO: 527178 - RNA, 65 nt, hsa
cucaggguuccagaaaucccccguucccaaaccaaaccaaucauggaucuucccuuuaaggggua

SEQ ID NO: 527179 - RNA, 65 nt, hsa
uccuauuuuguuacccaacucuuccuauuuuuguuaccaaucacugugcucucugccgcccccug

SEQ ID NO: 527180 - RNA, 65 nt, hsa
uucuggagcuggccagguccucugcagcaggcaagaccaaucaaucacugaaccugccucauggc

SEQ ID NO: 527181 - RNA, 65 nt, hsa
cauagaaggaggagagggaaaauguuuuguaagaaaccaaucaagauaaaggacagugaaguaau

SEQ ID NO: 527182 - RNA, 65 nt, hsa
cuugagaacuuuauuuccaaguuguucaaacauuuaccaaucauauuaauacaaugaugcuauuu

SEQ ID NO: 527183 - RNA, 65 nt, hsa
gaauggaccaaauacauuuuuaaaagaaaacugagaccaaucagauggaaauggaguuuuaaggc

SEQ ID NO: 527184 - RNA, 65 nt, hsa
gcaggagcccucuugaaauuaacaauggaaauaaaaccaaucagucaguuagccuaaaccuauug

SEQ ID NO: 527185 - RNA, 65 nt, hsa
guagccaugaacacagcuugcuugcauuuaguaagaccaaucagcuuaguguuuauuucuucuac

SEQ ID NO: 527186 - RNA, 65 nt, hsa
ugcuugacugauuucagugauauucagaaguguguaccaaucaaggcucuuuaaaauacggaacg

SEQ ID NO: 527187 - RNA, 64 nt, hsa; identical to SEQ ID NO: 218878

SEQ ID NO: 527188 - RNA, 64 nt, hsa; identical to SEQ ID NO: 218879

SEQ ID NO: 527189 - RNA, 64 nt, hsa; identical to SEQ ID NO: 218880

SEQ ID NO: 527190 - RNA, 64 nt, hsa; identical to SEQ ID NO: 218881

SEQ ID NO: 527191 - RNA, 64 nt, hsa; identical to SEQ ID NO: 218882

SEQ ID NO: 527192 - RNA, 64 nt, hsa; identical to SEQ ID NO: 218883

SEQ ID NO: 527193 - RNA, 64 nt, hsa; identical to SEQ ID NO: 218884

SEQ ID NO: 527194 - RNA, 64 nt, hsa; identical to SEQ ID NO: 218885

SEQ ID NO: 527195 - RNA, 64 nt, hsa; identical to SEQ ID NO: 218886

SEQ ID NO: 527196 - RNA, 64 nt, hsa; identical to SEQ ID NO: 218887

SEQ ID NO: 527197 - RNA, 64 nt, hsa; identical to SEQ ID NO: 218888

SEQ ID NO: 527198 - RNA, 64 nt, hsa; identical to SEQ ID NO: 218889

SEQ ID NO: 527199 - RNA, 64 nt, hsa; identical to SEQ ID NO: 218890

SEQ ID NO: 527200 - RNA, 64 nt, hsa; identical to SEQ ID NO: 218891

SEQ ID NO: 527201 - RNA, 64 nt, hsa; identical to SEQ ID NO: 218892

SEQ ID NO: 527202 - RNA, 64 nt, hsa; identical to SEQ ID NO: 218893

SEQ ID NO: 527203 - RNA, 64 nt, hsa; identical to SEQ ID NO: 218894

SEQ ID NO: 527204 - RNA, 64 nt, hsa; identical to SEQ ID NO: 218895

SEQ ID NO: 527205 - RNA, 64 nt, hsa; identical to SEQ ID NO: 218896

SEQ ID NO: 527206 - RNA, 64 nt, hsa; identical to SEQ ID NO: 218897

SEQ ID NO: 527207 - RNA, 64 nt, hsa; identical to SEQ ID NO: 218898

SEQ ID NO: 527208 - RNA, 64 nt, hsa; identical to SEQ ID NO: 218899

SEQ ID NO: 527209 - RNA, 64 nt, hsa; identical to SEQ ID NO: 218900

SEQ ID NO: 527210 - RNA, 64 nt, hsa; identical to SEQ ID NO: 218901

SEQ ID NO: 527211 - RNA, 64 nt, hsa; identical to SEQ ID NO: 218902

SEQ ID NO: 527212 - RNA, 64 nt, hsa; identical to SEQ ID NO: 218903

SEQ ID NO: 527213 - RNA, 64 nt, hsa; identical to SEQ ID NO: 218904

SEQ ID NO: 527214 - RNA, 64 nt, hsa; identical to SEQ ID NO: 218905

SEQ ID NO: 527215 - RNA, 64 nt, hsa; identical to SEQ ID NO: 218906

SEQ ID NO: 527216 - RNA, 64 nt, hsa; identical to SEQ ID NO: 218907

SEQ ID NO: 527217 - RNA, 64 nt, hsa; identical to SEQ ID NO: 218908

SEQ ID NO: 527218 - RNA, 64 nt, hsa; identical to SEQ ID NO: 218909

SEQ ID NO: 527219 - RNA, 64 nt, hsa; identical to SEQ ID NO: 218910

SEQ ID NO: 527220 - RNA, 64 nt, hsa; identical to SEQ ID NO: 218911

SEQ ID NO: 527221 - RNA, 64 nt, hsa; identical to SEQ ID NO: 218912

SEQ ID NO: 527222 - RNA, 64 nt, hsa; identical to SEQ ID NO: 218913

SEQ ID NO: 527223 - RNA, 60 nt, hsa; identical to SEQ ID NO: 218914

SEQ ID NO: 527224 - RNA, 64 nt, hsa; identical to SEQ ID NO: 218915

SEQ ID NO: 527225 - RNA, 64 nt, hsa; identical to SEQ ID NO: 218916

SEQ ID NO: 527226 - RNA, 64 nt, hsa; identical to SEQ ID NO: 218917

SEQ ID NO: 527227 - RNA, 64 nt, hsa; identical to SEQ ID NO: 218918

SEQ ID NO: 527228 - RNA, 64 nt, hsa; identical to SEQ ID NO: 218919

SEQ ID NO: 527229 - RNA, 64 nt, hsa; identical to SEQ ID NO: 218920

SEQ ID NO: 527230 - RNA, 64 nt, hsa; identical to SEQ ID NO: 218921

SEQ ID NO: 527231 - RNA, 64 nt, hsa; identical to SEQ ID NO: 218922

SEQ ID NO: 527232 - RNA, 64 nt, hsa; identical to SEQ ID NO: 218923

SEQ ID NO: 527233 - RNA, 64 nt, hsa; identical to SEQ ID NO: 218924

SEQ ID NO: 527234 - RNA, 64 nt, hsa; identical to SEQ ID NO: 218925

SEQ ID NO: 527235 - RNA, 64 nt, hsa; identical to SEQ ID NO: 218926

SEQ ID NO: 527236 - RNA, 64 nt, hsa; identical to SEQ ID NO: 218927

SEQ ID NO: 527237 - RNA, 64 nt, hsa; identical to SEQ ID NO: 218928

SEQ ID NO: 527238 - RNA, 64 nt, hsa; identical to SEQ ID NO: 218929

SEQ ID NO: 527239 - RNA, 64 nt, hsa; identical to SEQ ID NO: 218930

SEQ ID NO: 527240 - RNA, 64 nt, hsa; identical to SEQ ID NO: 218931

SEQ ID NO: 527241 - RNA, 64 nt, hsa; identical to SEQ ID NO: 218932

SEQ ID NO: 527242 - RNA, 64 nt, hsa; identical to SEQ ID NO: 218933

SEQ ID NO: 527243 - RNA, 64 nt, hsa; identical to SEQ ID NO: 218934

SEQ ID NO: 527244 - RNA, 64 nt, hsa; identical to SEQ ID NO: 218935

SEQ ID NO: 527245 - RNA, 64 nt, hsa; identical to SEQ ID NO: 218936

SEQ ID NO: 527246 - RNA, 64 nt, hsa; identical to SEQ ID NO: 218937

SEQ ID NO: 527247 - RNA, 64 nt, hsa; identical to SEQ ID NO: 218938

SEQ ID NO: 527248 - RNA, 64 nt, hsa; identical to SEQ ID NO: 218939

SEQ ID NO: 527249 - RNA, 64 nt, hsa; identical to SEQ ID NO: 218940

SEQ ID NO: 527250 - RNA, 64 nt, hsa; identical to SEQ ID NO: 218941

SEQ ID NO: 527251 - RNA, 64 nt, hsa; identical to SEQ ID NO: 218942

SEQ ID NO: 527252 - RNA, 64 nt, hsa; identical to SEQ ID NO: 218943

SEQ ID NO: 527253 - RNA, 64 nt, hsa; identical to SEQ ID NO: 218944

SEQ ID NO: 527254 - RNA, 64 nt, hsa; identical to SEQ ID NO: 218945

SEQ ID NO: 527255 - RNA, 59 nt, hsa; identical to SEQ ID NO: 218946

SEQ ID NO: 527256 - RNA, 64 nt, hsa; identical to SEQ ID NO: 218947

SEQ ID NO: 527257 - RNA, 64 nt, hsa; identical to SEQ ID NO: 218948

SEQ ID NO: 527258 - RNA, 64 nt, hsa; identical to SEQ ID NO: 218949

SEQ ID NO: 527259 - RNA, 64 nt, hsa; identical to SEQ ID NO: 218950

SEQ ID NO: 527260 - RNA, 64 nt, hsa; identical to SEQ ID NO: 218951

SEQ ID NO: 527261 - RNA, 64 nt, hsa; identical to SEQ ID NO: 218952

SEQ ID NO: 527262 - RNA, 64 nt, hsa; identical to SEQ ID NO: 218953

SEQ ID NO: 527263 - RNA, 64 nt, hsa; identical to SEQ ID NO: 218954

SEQ ID NO: 527264 - RNA, 64 nt, hsa; identical to SEQ ID NO: 218955

SEQ ID NO: 527265 - RNA, 64 nt, hsa; identical to SEQ ID NO: 166184

SEQ ID NO: 527266 - RNA, 64 nt, hsa; identical to SEQ ID NO: 166185

SEQ ID NO: 527267 - RNA, 64 nt, hsa; identical to SEQ ID NO: 166186

SEQ ID NO: 527268 - RNA, 64 nt, hsa; identical to SEQ ID NO: 166187

SEQ ID NO: 527269 - RNA, 64 nt, hsa; identical to SEQ ID NO: 166188

SEQ ID NO: 527270 - RNA, 64 nt, hsa; identical to SEQ ID NO: 166189

SEQ ID NO: 527271 - RNA, 64 nt, hsa; identical to SEQ ID NO: 166190

SEQ ID NO: 527272 - RNA, 64 nt, hsa; identical to SEQ ID NO: 166191

SEQ ID NO: 527273 - RNA, 64 nt, hsa; identical to SEQ ID NO: 166192

SEQ ID NO: 527274 - RNA, 64 nt, hsa; identical to SEQ ID NO: 166193

SEQ ID NO: 527275 - RNA, 64 nt, hsa; identical to SEQ ID NO: 166194

SEQ ID NO: 527276 - RNA, 64 nt, hsa; identical to SEQ ID NO: 166195

SEQ ID NO: 527277 - RNA, 64 nt, hsa; identical to SEQ ID NO: 166196

SEQ ID NO: 527278 - RNA, 64 nt, hsa; identical to SEQ ID NO: 166197

SEQ ID NO: 527279 - RNA, 64 nt, hsa; identical to SEQ ID NO: 166198

SEQ ID NO: 527280 - RNA, 64 nt, hsa; identical to SEQ ID NO: 166199

SEQ ID NO: 527281 - RNA, 64 nt, hsa; identical to SEQ ID NO: 166200

SEQ ID NO: 527282 - RNA, 64 nt, hsa; identical to SEQ ID NO: 166201

SEQ ID NO: 527283 - RNA, 64 nt, hsa; identical to SEQ ID NO: 166202

SEQ ID NO: 527284 - RNA, 64 nt, hsa; identical to SEQ ID NO: 166203

SEQ ID NO: 527285 - RNA, 64 nt, hsa; identical to SEQ ID NO: 166204

SEQ ID NO: 527286 - RNA, 64 nt, hsa; identical to SEQ ID NO: 166205

SEQ ID NO: 527287 - RNA, 64 nt, hsa; identical to SEQ ID NO: 166206

SEQ ID NO: 527288 - RNA, 64 nt, hsa; identical to SEQ ID NO: 166207

SEQ ID NO: 527289 - RNA, 64 nt, hsa; identical to SEQ ID NO: 166208

SEQ ID NO: 527290 - RNA, 64 nt, hsa; identical to SEQ ID NO: 166209

SEQ ID NO: 527291 - RNA, 64 nt, hsa; identical to SEQ ID NO: 166210

SEQ ID NO: 527292 - RNA, 64 nt, hsa; identical to SEQ ID NO: 166211

SEQ ID NO: 527293 - RNA, 64 nt, hsa; identical to SEQ ID NO: 166212

SEQ ID NO: 527294 - RNA, 64 nt, hsa; identical to SEQ ID NO: 166213

SEQ ID NO: 527295 - RNA, 64 nt, hsa; identical to SEQ ID NO: 166214

SEQ ID NO: 527296 - RNA, 64 nt, hsa; identical to SEQ ID NO: 166215

SEQ ID NO: 527297 - RNA, 64 nt, hsa; identical to SEQ ID NO: 166216

SEQ ID NO: 527298 - RNA, 64 nt, hsa; identical to SEQ ID NO: 166217

SEQ ID NO: 527299 - RNA, 64 nt, hsa; identical to SEQ ID NO: 166218

SEQ ID NO: 527300 - RNA, 64 nt, hsa; identical to SEQ ID NO: 166219

SEQ ID NO: 527301 - RNA, 64 nt, hsa; identical to SEQ ID NO: 166220

SEQ ID NO: 527302 - RNA, 64 nt, hsa; identical to SEQ ID NO: 166221

SEQ ID NO: 527303 - RNA, 64 nt, hsa; identical to SEQ ID NO: 166222

SEQ ID NO: 527304 - RNA, 64 nt, hsa; identical to SEQ ID NO: 166223

SEQ ID NO: 527305 - RNA, 64 nt, hsa; identical to SEQ ID NO: 166224

SEQ ID NO: 527306 - RNA, 58 nt, hsa; identical to SEQ ID NO: 96080

SEQ ID NO: 527307 - RNA, 64 nt, hsa; identical to SEQ ID NO: 166226

SEQ ID NO: 527308 - RNA, 64 nt, hsa; identical to SEQ ID NO: 166227

SEQ ID NO: 527309 - RNA, 64 nt, hsa; identical to SEQ ID NO: 166228

SEQ ID NO: 527310 - RNA, 64 nt, hsa; identical to SEQ ID NO: 166229

SEQ ID NO: 527311 - RNA, 64 nt, hsa; identical to SEQ ID NO: 166230

SEQ ID NO: 527312 - RNA, 64 nt, hsa; identical to SEQ ID NO: 166231

SEQ ID NO: 527313 - RNA, 64 nt, hsa; identical to SEQ ID NO: 166232

SEQ ID NO: 527314 - RNA, 64 nt, hsa; identical to SEQ ID NO: 166233

SEQ ID NO: 527315 - RNA, 64 nt, hsa; identical to SEQ ID NO: 166234

SEQ ID NO: 527316 - RNA, 64 nt, hsa; identical to SEQ ID NO: 166235

SEQ ID NO: 527317 - RNA, 64 nt, hsa; identical to SEQ ID NO: 166236

SEQ ID NO: 527318 - RNA, 64 nt, hsa; identical to SEQ ID NO: 166237

SEQ ID NO: 527319 - RNA, 64 nt, hsa; identical to SEQ ID NO: 166238

SEQ ID NO: 527320 - RNA, 64 nt, hsa; identical to SEQ ID NO: 166239

SEQ ID NO: 527321 - RNA, 64 nt, hsa; identical to SEQ ID NO: 166240

SEQ ID NO: 527322 - RNA, 64 nt, hsa; identical to SEQ ID NO: 166241

SEQ ID NO: 527323 - RNA, 64 nt, hsa; identical to SEQ ID NO: 166242

SEQ ID NO: 527324 - RNA, 64 nt, hsa; identical to SEQ ID NO: 166243

SEQ ID NO: 527325 - RNA, 64 nt, hsa; identical to SEQ ID NO: 166244

SEQ ID NO: 527326 - RNA, 64 nt, hsa; identical to SEQ ID NO: 166245

SEQ ID NO: 527327 - RNA, 64 nt, hsa; identical to SEQ ID NO: 166246

SEQ ID NO: 527328 - RNA, 64 nt, hsa; identical to SEQ ID NO: 166247

SEQ ID NO: 527329 - RNA, 64 nt, hsa; identical to SEQ ID NO: 166248

SEQ ID NO: 527330 - RNA, 64 nt, hsa; identical to SEQ ID NO: 166249

SEQ ID NO: 527331 - RNA, 64 nt, hsa; identical to SEQ ID NO: 166250

SEQ ID NO: 527332 - RNA, 64 nt, hsa; identical to SEQ ID NO: 166251

SEQ ID NO: 527333 - RNA, 64 nt, hsa; identical to SEQ ID NO: 166252

SEQ ID NO: 527334 - RNA, 64 nt, hsa; identical to SEQ ID NO: 166253

SEQ ID NO: 527335 - RNA, 64 nt, hsa; identical to SEQ ID NO: 166254

SEQ ID NO: 527336 - RNA, 64 nt, hsa; identical to SEQ ID NO: 166255

SEQ ID NO: 527337 - RNA, 64 nt, hsa; identical to SEQ ID NO: 166256

SEQ ID NO: 527338 - RNA, 64 nt, hsa; identical to SEQ ID NO: 166257

SEQ ID NO: 527339 - RNA, 64 nt, hsa; identical to SEQ ID NO: 166258

SEQ ID NO: 527340 - RNA, 64 nt, hsa; identical to SEQ ID NO: 166259

SEQ ID NO: 527341 - RNA, 64 nt, hsa; identical to SEQ ID NO: 166260

SEQ ID NO: 527342 - RNA, 64 nt, hsa; identical to SEQ ID NO: 166261

SEQ ID NO: 527343 - RNA, 64 nt, hsa; identical to SEQ ID NO: 166262

SEQ ID NO: 527344 - RNA, 64 nt, hsa; identical to SEQ ID NO: 166263

SEQ ID NO: 527345 - RNA, 64 nt, hsa; identical to SEQ ID NO: 166264

SEQ ID NO: 527346 - RNA, 64 nt, hsa; identical to SEQ ID NO: 166265

SEQ ID NO: 527347 - RNA, 64 nt, hsa; identical to SEQ ID NO: 166266

SEQ ID NO: 527348 - RNA, 64 nt, hsa; identical to SEQ ID NO: 166267

SEQ ID NO: 527349 - RNA, 64 nt, hsa; identical to SEQ ID NO: 166268

SEQ ID NO: 527350 - RNA, 64 nt, hsa; identical to SEQ ID NO: 166269

SEQ ID NO: 527351 - RNA, 64 nt, hsa; identical to SEQ ID NO: 166270

SEQ ID NO: 527352 - RNA, 64 nt, hsa; identical to SEQ ID NO: 166271

SEQ ID NO: 527353 - RNA, 64 nt, hsa; identical to SEQ ID NO: 166272

SEQ ID NO: 527354 - RNA, 64 nt, hsa; identical to SEQ ID NO: 166273

SEQ ID NO: 527355 - RNA, 64 nt, hsa; identical to SEQ ID NO: 166274

SEQ ID NO: 527356 - RNA, 64 nt, hsa; identical to SEQ ID NO: 166275

SEQ ID NO: 527357 - RNA, 64 nt, hsa; identical to SEQ ID NO: 166276

SEQ ID NO: 527358 - RNA, 64 nt, hsa; identical to SEQ ID NO: 166277

SEQ ID NO: 527359 - RNA, 64 nt, hsa; identical to SEQ ID NO: 166278

SEQ ID NO: 527360 - RNA, 64 nt, hsa; identical to SEQ ID NO: 166279

SEQ ID NO: 527361 - RNA, 64 nt, hsa; identical to SEQ ID NO: 166280

SEQ ID NO: 527362 - RNA, 64 nt, hsa; identical to SEQ ID NO: 166281

SEQ ID NO: 527363 - RNA, 64 nt, hsa; identical to SEQ ID NO: 166282

SEQ ID NO: 527364 - RNA, 64 nt, hsa; identical to SEQ ID NO: 166283

SEQ ID NO: 527365 - RNA, 64 nt, hsa; identical to SEQ ID NO: 166284

SEQ ID NO: 527366 - RNA, 64 nt, hsa; identical to SEQ ID NO: 166285

SEQ ID NO: 527367 - RNA, 64 nt, hsa; identical to SEQ ID NO: 166286

SEQ ID NO: 527368 - RNA, 64 nt, hsa; identical to SEQ ID NO: 166287

SEQ ID NO: 527369 - RNA, 64 nt, hsa; identical to SEQ ID NO: 166288

SEQ ID NO: 527370 - RNA, 64 nt, hsa; identical to SEQ ID NO: 166289

SEQ ID NO: 527371 - RNA, 64 nt, hsa; identical to SEQ ID NO: 166290

SEQ ID NO: 527372 - RNA, 64 nt, hsa; identical to SEQ ID NO: 166291

SEQ ID NO: 527373 - RNA, 64 nt, hsa; identical to SEQ ID NO: 166292

SEQ ID NO: 527374 - RNA, 64 nt, hsa; identical to SEQ ID NO: 166293

SEQ ID NO: 527375 - RNA, 64 nt, hsa; identical to SEQ ID NO: 166294

SEQ ID NO: 527376 - RNA, 64 nt, hsa; identical to SEQ ID NO: 166295

SEQ ID NO: 527377 - RNA, 64 nt, hsa; identical to SEQ ID NO: 166296

SEQ ID NO: 527378 - RNA, 64 nt, hsa; identical to SEQ ID NO: 166297

SEQ ID NO: 527379 - RNA, 64 nt, hsa; identical to SEQ ID NO: 166298

SEQ ID NO: 527380 - RNA, 64 nt, hsa; identical to SEQ ID NO: 166299

SEQ ID NO: 527381 - RNA, 64 nt, hsa; identical to SEQ ID NO: 166300

SEQ ID NO: 527382 - RNA, 64 nt, hsa; identical to SEQ ID NO: 166301

SEQ ID NO: 527383 - RNA, 64 nt, hsa; identical to SEQ ID NO: 166302

SEQ ID NO: 527384 - RNA, 64 nt, hsa; identical to SEQ ID NO: 166303

SEQ ID NO: 527385 - RNA, 64 nt, hsa; identical to SEQ ID NO: 166304

SEQ ID NO: 527386 - RNA, 64 nt, hsa; identical to SEQ ID NO: 166305

SEQ ID NO: 527387 - RNA, 64 nt, hsa; identical to SEQ ID NO: 166306

SEQ ID NO: 527388 - RNA, 64 nt, hsa; identical to SEQ ID NO: 166307

SEQ ID NO: 527389 - RNA, 64 nt, hsa; identical to SEQ ID NO: 166308

SEQ ID NO: 527390 - RNA, 64 nt, hsa; identical to SEQ ID NO: 166309

SEQ ID NO: 527391 - RNA, 64 nt, hsa; identical to SEQ ID NO: 166310

SEQ ID NO: 527392 - RNA, 64 nt, hsa; identical to SEQ ID NO: 166311

SEQ ID NO: 527393 - RNA, 64 nt, hsa; identical to SEQ ID NO: 166312

SEQ ID NO: 527394 - RNA, 64 nt, hsa; identical to SEQ ID NO: 166313

SEQ ID NO: 527395 - RNA, 64 nt, hsa; identical to SEQ ID NO: 166314

SEQ ID NO: 527396 - RNA, 64 nt, hsa; identical to SEQ ID NO: 166315

SEQ ID NO: 527397 - RNA, 64 nt, hsa; identical to SEQ ID NO: 155383

SEQ ID NO: 527398 - RNA, 64 nt, hsa; identical to SEQ ID NO: 155384

SEQ ID NO: 527399 - RNA, 64 nt, hsa; identical to SEQ ID NO: 155385

SEQ ID NO: 527400 - RNA, 64 nt, hsa; identical to SEQ ID NO: 155386

SEQ ID NO: 527401 - RNA, 64 nt, hsa; identical to SEQ ID NO: 155387

SEQ ID NO: 527402 - RNA, 64 nt, hsa; identical to SEQ ID NO: 155388

SEQ ID NO: 527403 - RNA, 64 nt, hsa; identical to SEQ ID NO: 155389

SEQ ID NO: 527404 - RNA, 64 nt, hsa; identical to SEQ ID NO: 155390

SEQ ID NO: 527405 - RNA, 64 nt, hsa; identical to SEQ ID NO: 155391

SEQ ID NO: 527406 - RNA, 64 nt, hsa; identical to SEQ ID NO: 155392

SEQ ID NO: 527407 - RNA, 64 nt, hsa; identical to SEQ ID NO: 155393

SEQ ID NO: 527408 - RNA, 64 nt, hsa; identical to SEQ ID NO: 155394

SEQ ID NO: 527409 - RNA, 64 nt, hsa; identical to SEQ ID NO: 155395

SEQ ID NO: 527410 - RNA, 64 nt, hsa; identical to SEQ ID NO: 155396

SEQ ID NO: 527411 - RNA, 64 nt, hsa; identical to SEQ ID NO: 155397

SEQ ID NO: 527412 - RNA, 64 nt, hsa; identical to SEQ ID NO: 155398

SEQ ID NO: 527413 - RNA, 64 nt, hsa; identical to SEQ ID NO: 155399

SEQ ID NO: 527414 - RNA, 64 nt, hsa; identical to SEQ ID NO: 155400

SEQ ID NO: 527415 - RNA, 64 nt, hsa; identical to SEQ ID NO: 155401

SEQ ID NO: 527416 - RNA, 64 nt, hsa; identical to SEQ ID NO: 155402

SEQ ID NO: 527417 - RNA, 64 nt, hsa; identical to SEQ ID NO: 155403

SEQ ID NO: 527418 - RNA, 64 nt, hsa; identical to SEQ ID NO: 155404

SEQ ID NO: 527419 - RNA, 64 nt, hsa; identical to SEQ ID NO: 155405

SEQ ID NO: 527420 - RNA, 64 nt, hsa; identical to SEQ ID NO: 155406

SEQ ID NO: 527421 - RNA, 64 nt, hsa; identical to SEQ ID NO: 155407

SEQ ID NO: 527422 - RNA, 64 nt, hsa; identical to SEQ ID NO: 155408

SEQ ID NO: 527423 - RNA, 64 nt, hsa; identical to SEQ ID NO: 155409

SEQ ID NO: 527424 - RNA, 64 nt, hsa; identical to SEQ ID NO: 155410

SEQ ID NO: 527425 - RNA, 64 nt, hsa; identical to SEQ ID NO: 155411

SEQ ID NO: 527426 - RNA, 64 nt, hsa; identical to SEQ ID NO: 155412

SEQ ID NO: 527427 - RNA, 64 nt, hsa; identical to SEQ ID NO: 155413

SEQ ID NO: 527428 - RNA, 64 nt, hsa; identical to SEQ ID NO: 155414

SEQ ID NO: 527429 - RNA, 64 nt, hsa; identical to SEQ ID NO: 155415

SEQ ID NO: 527430 - RNA, 64 nt, hsa; identical to SEQ ID NO: 155416

SEQ ID NO: 527431 - RNA, 64 nt, hsa; identical to SEQ ID NO: 155417

SEQ ID NO: 527432 - RNA, 64 nt, hsa; identical to SEQ ID NO: 155418

SEQ ID NO: 527433 - RNA, 64 nt, hsa; identical to SEQ ID NO: 155419

SEQ ID NO: 527434 - RNA, 64 nt, hsa; identical to SEQ ID NO: 155420

SEQ ID NO: 527435 - RNA, 64 nt, hsa; identical to SEQ ID NO: 155421

SEQ ID NO: 527436 - RNA, 64 nt, hsa; identical to SEQ ID NO: 155422

SEQ ID NO: 527437 - RNA, 64 nt, hsa; identical to SEQ ID NO: 155423

SEQ ID NO: 527438 - RNA, 64 nt, hsa; identical to SEQ ID NO: 155424

SEQ ID NO: 527439 - RNA, 64 nt, hsa; identical to SEQ ID NO: 155425

SEQ ID NO: 527440 - RNA, 64 nt, hsa; identical to SEQ ID NO: 155426

SEQ ID NO: 527441 - RNA, 64 nt, hsa; identical to SEQ ID NO: 155427

SEQ ID NO: 527442 - RNA, 64 nt, hsa; identical to SEQ ID NO: 155428

SEQ ID NO: 527443 - RNA, 64 nt, hsa; identical to SEQ ID NO: 155429

SEQ ID NO: 527444 - RNA, 64 nt, hsa; identical to SEQ ID NO: 155430

SEQ ID NO: 527445 - RNA, 64 nt, hsa; identical to SEQ ID NO: 155431

SEQ ID NO: 527446 - RNA, 64 nt, hsa; identical to SEQ ID NO: 155432

SEQ ID NO: 527447 - RNA, 64 nt, hsa; identical to SEQ ID NO: 155433

SEQ ID NO: 527448 - RNA, 64 nt, hsa; identical to SEQ ID NO: 155434

SEQ ID NO: 527449 - RNA, 64 nt, hsa; identical to SEQ ID NO: 155435

SEQ ID NO: 527450 - RNA, 64 nt, hsa; identical to SEQ ID NO: 155436

SEQ ID NO: 527451 - RNA, 64 nt, hsa; identical to SEQ ID NO: 155437

SEQ ID NO: 527452 - RNA, 64 nt, hsa; identical to SEQ ID NO: 155438

SEQ ID NO: 527453 - RNA, 64 nt, hsa; identical to SEQ ID NO: 155439

SEQ ID NO: 527454 - RNA, 64 nt, hsa; identical to SEQ ID NO: 155440

SEQ ID NO: 527455 - RNA, 64 nt, hsa; identical to SEQ ID NO: 155441

SEQ ID NO: 527456 - RNA, 64 nt, hsa; identical to SEQ ID NO: 155442

SEQ ID NO: 527457 - RNA, 64 nt, hsa; identical to SEQ ID NO: 155443

SEQ ID NO: 527458 - RNA, 64 nt, hsa; identical to SEQ ID NO: 155444

SEQ ID NO: 527459 - RNA, 64 nt, hsa; identical to SEQ ID NO: 155445

SEQ ID NO: 527460 - RNA, 64 nt, hsa; identical to SEQ ID NO: 155446

SEQ ID NO: 527461 - RNA, 64 nt, hsa; identical to SEQ ID NO: 155447

SEQ ID NO: 527462 - RNA, 64 nt, hsa; identical to SEQ ID NO: 155448

SEQ ID NO: 527463 - RNA, 64 nt, hsa; identical to SEQ ID NO: 155449

SEQ ID NO: 527464 - RNA, 64 nt, hsa; identical to SEQ ID NO: 155450

SEQ ID NO: 527465 - RNA, 64 nt, hsa; identical to SEQ ID NO: 155451

SEQ ID NO: 527466 - RNA, 64 nt, hsa; identical to SEQ ID NO: 155452

SEQ ID NO: 527467 - RNA, 64 nt, hsa; identical to SEQ ID NO: 155453

SEQ ID NO: 527468 - RNA, 64 nt, hsa; identical to SEQ ID NO: 155454

SEQ ID NO: 527469 - RNA, 64 nt, hsa; identical to SEQ ID NO: 155455

SEQ ID NO: 527470 - RNA, 64 nt, hsa; identical to SEQ ID NO: 155456

SEQ ID NO: 527471 - RNA, 64 nt, hsa; identical to SEQ ID NO: 155457

SEQ ID NO: 527472 - RNA, 64 nt, hsa; identical to SEQ ID NO: 155458

SEQ ID NO: 527473 - RNA, 64 nt, hsa; identical to SEQ ID NO: 155459

SEQ ID NO: 527474 - RNA, 64 nt, hsa; identical to SEQ ID NO: 155460

SEQ ID NO: 527475 - RNA, 64 nt, hsa; identical to SEQ ID NO: 155461

SEQ ID NO: 527476 - RNA, 64 nt, hsa; identical to SEQ ID NO: 155462

SEQ ID NO: 527477 - RNA, 64 nt, hsa; identical to SEQ ID NO: 155463

SEQ ID NO: 527478 - RNA, 64 nt, hsa; identical to SEQ ID NO: 155464

SEQ ID NO: 527479 - RNA, 64 nt, hsa; identical to SEQ ID NO: 155465

SEQ ID NO: 527480 - RNA, 64 nt, hsa; identical to SEQ ID NO: 155466

SEQ ID NO: 527481 - RNA, 64 nt, hsa; identical to SEQ ID NO: 155467

SEQ ID NO: 527482 - RNA, 64 nt, hsa; identical to SEQ ID NO: 155468

SEQ ID NO: 527483 - RNA, 64 nt, hsa; identical to SEQ ID NO: 155469

SEQ ID NO: 527484 - RNA, 64 nt, hsa; identical to SEQ ID NO: 155470

SEQ ID NO: 527485 - RNA, 64 nt, hsa; identical to SEQ ID NO: 155471

SEQ ID NO: 527486 - RNA, 64 nt, hsa; identical to SEQ ID NO: 155472

SEQ ID NO: 527487 - RNA, 64 nt, hsa; identical to SEQ ID NO: 155473

SEQ ID NO: 527488 - RNA, 64 nt, hsa; identical to SEQ ID NO: 155474

SEQ ID NO: 527489 - RNA, 64 nt, hsa; identical to SEQ ID NO: 155475

SEQ ID NO: 527490 - RNA, 64 nt, hsa; identical to SEQ ID NO: 155476

SEQ ID NO: 527491 - RNA, 64 nt, hsa; identical to SEQ ID NO: 155477

SEQ ID NO: 527492 - RNA, 64 nt, hsa; identical to SEQ ID NO: 155478

SEQ ID NO: 527493 - RNA, 64 nt, hsa; identical to SEQ ID NO: 155479

SEQ ID NO: 527494 - RNA, 64 nt, hsa; identical to SEQ ID NO: 155480

SEQ ID NO: 527495 - RNA, 64 nt, hsa; identical to SEQ ID NO: 155481

SEQ ID NO: 527496 - RNA, 64 nt, hsa; identical to SEQ ID NO: 155482

SEQ ID NO: 527497 - RNA, 64 nt, hsa; identical to SEQ ID NO: 155483

SEQ ID NO: 527498 - RNA, 64 nt, hsa; identical to SEQ ID NO: 155484

SEQ ID NO: 527499 - RNA, 64 nt, hsa; identical to SEQ ID NO: 155485

SEQ ID NO: 527500 - RNA, 64 nt, hsa; identical to SEQ ID NO: 155486

SEQ ID NO: 527501 - RNA, 64 nt, hsa; identical to SEQ ID NO: 155487

SEQ ID NO: 527502 - RNA, 64 nt, hsa; identical to SEQ ID NO: 155488

SEQ ID NO: 527503 - RNA, 64 nt, hsa; identical to SEQ ID NO: 507092

SEQ ID NO: 527504 - RNA, 64 nt, hsa; identical to SEQ ID NO: 507093

SEQ ID NO: 527505 - RNA, 64 nt, hsa; identical to SEQ ID NO: 507094

SEQ ID NO: 527506 - RNA, 64 nt, hsa; identical to SEQ ID NO: 507095

SEQ ID NO: 527507 - RNA, 64 nt, hsa
auuauauccacauggaaguagaagguaaggaguuuaggaaaauacuagaaucuacucugcuuac

SEQ ID NO: 527508 - RNA, 64 nt, hsa
uucaaacuauuuagauaaccacuugaugcacaaauaggaaaaagcagauuguggcagugucgcc

SEQ ID NO: 527509 - RNA, 64 nt, hsa
uaacuccagcaggaaacuguaacugcuaugucuuuaggaaaauguagaagaaagaacauuauug

SEQ ID NO: 527510 - RNA, 64 nt, hsa
aaauauuaacuauccugaauauuuuauaauuuuguaggaaaaauaugcaucuauuuuuucuuga

SEQ ID NO: 527511 - RNA, 64 nt, hsa
uggcaucaguuugcuacagugagcucagaucaaauaggaaaauacuugaaaugcaugucucaag

SEQ ID NO: 527512 - RNA, 64 nt, hsa
uguucaaugaagucuucuguucaucuguugaaacuaggaaaauacccaaacuuaaauggaagaa

SEQ ID NO: 527513 - RNA, 64 nt, hsa
uugugaacugaauaauuaaaacuuuggcuucucuuaggaaaagacgacuuccuagucauaggug

SEQ ID NO: 527514 - RNA, 64 nt, hsa
uuucagcagguuuuaaaccuucaggaacaccaguuaggaaaauagcuccagaaaauauagauau

SEQ ID NO: 527515 - RNA, 64 nt, hsa
gacuacccagccagugaagugcagaggauagacauaggaaaacauuccaggcauuuggagacag

SEQ ID NO: 527516 - RNA, 64 nt, hsa
uaagguguuaauguguguguaugugcuuugguuguaggaaaacuugaaaauuccaaaauccuua

SEQ ID NO: 527517 - RNA, 64 nt, hsa
uagcacauacuacaucuaagaggcuaaacucugauaggaaaagcacuuuaaacauaauuaaaag

SEQ ID NO: 527518 - RNA, 64 nt, hsa
uaagccacagaacauggugaaaacuaagugucacuaggaaaaguaaugggaaaguaaacccugc

SEQ ID NO: 527519 - RNA, 64 nt, hsa
ugcuuuguuuccuuuuuuagaaaguucuagaaaauaggaaaacgaaaaauuucauugagaugag

SEQ ID NO: 527520 - RNA, 64 nt, hsa
uccaaaguggauuauauuaagcagguauuagauuuaggaaaaccuuuccauuucuuaaaguauu

SEQ ID NO: 527521 - RNA, 64 nt, hsa
cuucuacccaauagaauauuuucaugccuggaaauaggaaaaugugugaacagcguauucucuu

SEQ ID NO: 527522 - RNA, 64 nt, hsa
caggcaggggagcaaaaggacgccaugugagcauuaggaaaaaaaauacucacucuuacuaaca

SEQ ID NO: 527523 - RNA, 64 nt, hsa
agauugucagcauccagccauguccuaucuagauuaggaaaaugaucagaauauuccagcucaa

SEQ ID NO: 527524 - RNA, 64 nt, hsa
cuuccuuguuaucaagccucucggacaaaagggcuaggaaaaggugauaugucuccugaucaua

SEQ ID NO: 527525 - RNA, 64 nt, hsa
uucccugggaucccucugucaaccccacgccuuuuaggaaaaagaaaagugagugaacagcaag

SEQ ID NO: 527526 - RNA, 64 nt, hsa
uagcuaauuaaaaagcacucaggugauaauuauguaggaaaaacaaucuugccaaauaaugaau

SEQ ID NO: 527527 - RNA, 64 nt, hsa
uuguuaaugaauaucaggcuauuauuuauuguauuaggaaaauauaauauuuacuguuagaauu

SEQ ID NO: 527528 - RNA, 64 nt, hsa
cccccuguuuuuagagcuuccaaaugugucagaauaggaaaacauugcaauaaauggcuugauu

SEQ ID NO: 527529 - RNA, 64 nt, hsa
acaagaaggaaaugaaaauauuuuuaugccuacuuaggaaaaaaaggguagcacuuauucauuc

SEQ ID NO: 527530 - RNA, 64 nt, hsa
uaacuuauuucauuaaagaaguugggagaacaaauaggaaaaaaaaaacuuauuuuucuaguaa

SEQ ID NO: 527531 - RNA, 64 nt, hsa
uugaguucucucuaacccagcuuacugugggacauaggaaaacucaguagaaauaccuuuggug

SEQ ID NO: 527532 - RNA, 64 nt, hsa
aauuucacagaagcacaacucccaacccaacccuuaggaaaagcccucuuccaucguuacagug

SEQ ID NO: 527533 - RNA, 64 nt, hsa
ccuccuucaauuccauauauccuuuucuucuauguaggaaaaaaauagucuaguguaguauucu

SEQ ID NO: 527534 - RNA, 64 nt, hsa
cuuuaggcuuucagcuuacacaaaucuauuuaauuaggaaaaaaacuauuaaggauguagcuuu

SEQ ID NO: 527535 - RNA, 64 nt, hsa
aaguaucuuuugagauuaaagugacucuuuacuguaggaaaaauauuacucuguguuuacagau

SEQ ID NO: 527536 - RNA, 64 nt, hsa
uuaaauaaaauuuuaagugaugcuguauuauauauaggaaaaaaugcuuaaaauccugucauuu

SEQ ID NO: 527537 - RNA, 64 nt, hsa
uuaaaucugaacaauccuacagggaaaucagaauuaggaaaaaaaucuggagaacaauaugguu

SEQ ID NO: 527538 - RNA, 64 nt, hsa
auuggagugauacauugugggaacccucagaagauaggaaaaaagcauggaauagauucucccu

SEQ ID NO: 527539 - RNA, 64 nt, hsa
uuuauuauguaaugaauauguguugcuuuuguaauaggaaaauaauaaaguuaaaauuucaacu

SEQ ID NO: 527540 - RNA, 64 nt, hsa
auagaguaauauuugagcuguguucaaaaauacauaggaaaagacugauaaaaugaaauauggc

SEQ ID NO: 527541 - RNA, 64 nt, hsa
aagcagaauuccggagcuucgagauaucuuauucuaggaaaaugaaacaauuuuaacaacaguu

SEQ ID NO: 527542 - RNA, 64 nt, hsa
ucugggguuuggguggggggagacgcgggaaggguaggaaaauggacuguuucugaccagagac

SEQ ID NO: 527543 - RNA, 64 nt, hsa
ugaucacuuuguucugguauugacgcaauuauauuaggaaaaaaguugguugacuguuuuuguu

SEQ ID NO: 527544 - RNA, 64 nt, hsa
aauuuuggguauacuugugguuaguuuugugccauaggaaaaaauuaucuuaaaacuuuggcca

SEQ ID NO: 527545 - RNA, 64 nt, hsa
ugugauacagcggucacuauuuucucuuaacacauaggaaaaaaguucagacaucgcuacaaua

SEQ ID NO: 527546 - RNA, 64 nt, hsa
ggccaggaaagggaaaugaucguuucuuuuguauuaggaaaaacaagacuuagacuucccgagu

SEQ ID NO: 527547 - RNA, 64 nt, hsa
ucuuuauacuuuauaguaaugcacaacauuuuuauaggaaaauauuuguaucauuuccuuuuua

SEQ ID NO: 527548 - RNA, 64 nt, hsa
caagaugaaucuuauaaacuauauuuuaugaauauaggaaaaucuucauuaggaauuuaucaga

SEQ ID NO: 527549 - RNA, 64 nt, hsa
auuaucuaaagaaucauugucuuucagagacucauaggaaaaaaaaacuaggaaaagugucacc

SEQ ID NO: 527550 - RNA, 64 nt, hsa
cauugucuuucagagacucauaggaaaaaaaaacuaggaaaagugucaccgcauuguucucuuu

SEQ ID NO: 527551 - RNA, 64 nt, hsa
cuguugcauuagcuaaagcagccucuugcaaugguaggaaaaaaggaucucaaauagcaugagu

SEQ ID NO: 527552 - RNA, 64 nt, hsa
accaaauaguaugacaccaauuggcacaaaguuauaggaaaaucaccuacaggagauguaaaca

SEQ ID NO: 527553 - RNA, 64 nt, hsa
uuuauucagcuaaaauaguacuucacaggaaauauaggaaaagaaacacuaguucaguuuuauu

SEQ ID NO: 527554 - RNA, 64 nt, hsa
gaauuucuucaugauacauuuucaggcacacuuguaggaaaauuaggaucaugaguccugcuuu

SEQ ID NO: 527555 - RNA, 64 nt, hsa
ugaucagaaauagaaacguuuucauuuguugauuuaggaaaaagcauaaauagaaugcaguaua

SEQ ID NO: 527556 - RNA, 64 nt, hsa
uucagaguugaauuuaaugaaaacucagaggaaauaggaaaaucugcucaggagaaagaagcua

SEQ ID NO: 527557 - RNA, 64 nt, hsa
gcauguucccagguccugcacccuuagggugaucuaggaaaauuuuaaauagcuucuacucuua

SEQ ID NO: 527558 - RNA, 64 nt, hsa
gaaagagguuccgcaacugugucauuuggagagcuaggaaaaauaaacaaccuuaugccaccgg

SEQ ID NO: 527559 - RNA, 64 nt, hsa
ucuaagcuauuuacuaauaggcuuuucauauaauuaggaaaaccuaauaucacaucuauaguaa

SEQ ID NO: 527560 - RNA, 64 nt, hsa
uguuauauaacauuuguuuugugauuugaacuccuaggaaaaauaugauuucauaaauguaaaa

SEQ ID NO: 527561 - RNA, 64 nt, hsa
auccauuuacuguagcucugcuuaauguacuacuuaggaaaaugucccugcuuaauaauguaag

SEQ ID NO: 527562 - RNA, 64 nt, hsa
ccucuucuucgugauaauauaaucucuauuuuuuuaggaaaacaaaaaugaaaaacuacuccau

SEQ ID NO: 527563 - RNA, 64 nt, hsa
cuccucccuauuggaaucccaauggcuccuggaguaggaaaaaaguuuaaacuacauucauguu

SEQ ID NO: 527564 - RNA, 64 nt, hsa; identical to SEQ ID NO: 129516

SEQ ID NO: 527565 - RNA, 64 nt, hsa; identical to SEQ ID NO: 129517

SEQ ID NO: 527566 - RNA, 64 nt, hsa; identical to SEQ ID NO: 129518

SEQ ID NO: 527567 - RNA, 64 nt, hsa; identical to SEQ ID NO: 129519

SEQ ID NO: 527568 - RNA, 64 nt, hsa; identical to SEQ ID NO: 129520

SEQ ID NO: 527569 - RNA, 64 nt, hsa; identical to SEQ ID NO: 129521

SEQ ID NO: 527570 - RNA, 64 nt, hsa; identical to SEQ ID NO: 129522

SEQ ID NO: 527571 - RNA, 64 nt, hsa; identical to SEQ ID NO: 129523

SEQ ID NO: 527572 - RNA, 64 nt, hsa; identical to SEQ ID NO: 129524

SEQ ID NO: 527573 - RNA, 64 nt, hsa; identical to SEQ ID NO: 129525

SEQ ID NO: 527574 - RNA, 59 nt, hsa; identical to SEQ ID NO: 129526

SEQ ID NO: 527575 - RNA, 64 nt, hsa; identical to SEQ ID NO: 129527

SEQ ID NO: 527576 - RNA, 64 nt, hsa; identical to SEQ ID NO: 129528

SEQ ID NO: 527577 - RNA, 64 nt, hsa; identical to SEQ ID NO: 129529

SEQ ID NO: 527578 - RNA, 64 nt, hsa; identical to SEQ ID NO: 129530

SEQ ID NO: 527579 - RNA, 64 nt, hsa; identical to SEQ ID NO: 129531

SEQ ID NO: 527580 - RNA, 64 nt, hsa; identical to SEQ ID NO: 129532

SEQ ID NO: 527581 - RNA, 53 nt, hsa; identical to SEQ ID NO: 129533

SEQ ID NO: 527582 - RNA, 64 nt, hsa; identical to SEQ ID NO: 129534

SEQ ID NO: 527583 - RNA, 64 nt, hsa; identical to SEQ ID NO: 129535

SEQ ID NO: 527584 - RNA, 64 nt, hsa; identical to SEQ ID NO: 129536

SEQ ID NO: 527585 - RNA, 64 nt, hsa; identical to SEQ ID NO: 129537

SEQ ID NO: 527586 - RNA, 64 nt, hsa; identical to SEQ ID NO: 129538

SEQ ID NO: 527587 - RNA, 64 nt, hsa; identical to SEQ ID NO: 129539

SEQ ID NO: 527588 - RNA, 64 nt, hsa; identical to SEQ ID NO: 129540

SEQ ID NO: 527589 - RNA, 64 nt, hsa; identical to SEQ ID NO: 129541

SEQ ID NO: 527590 - RNA, 64 nt, hsa; identical to SEQ ID NO: 129542

SEQ ID NO: 527591 - RNA, 64 nt, hsa; identical to SEQ ID NO: 129543

SEQ ID NO: 527592 - RNA, 64 nt, hsa; identical to SEQ ID NO: 129544

SEQ ID NO: 527593 - RNA, 64 nt, hsa; identical to SEQ ID NO: 129545

SEQ ID NO: 527594 - RNA, 64 nt, hsa; identical to SEQ ID NO: 129546

SEQ ID NO: 527595 - RNA, 64 nt, hsa; identical to SEQ ID NO: 129547

SEQ ID NO: 527596 - RNA, 64 nt, hsa; identical to SEQ ID NO: 129548

SEQ ID NO: 527597 - RNA, 64 nt, hsa; identical to SEQ ID NO: 129549

SEQ ID NO: 527598 - RNA, 64 nt, hsa; identical to SEQ ID NO: 129550

SEQ ID NO: 527599 - RNA, 64 nt, hsa; identical to SEQ ID NO: 129551

SEQ ID NO: 527600 - RNA, 64 nt, hsa; identical to SEQ ID NO: 129552

SEQ ID NO: 527601 - RNA, 64 nt, hsa; identical to SEQ ID NO: 129553

SEQ ID NO: 527602 - RNA, 64 nt, hsa; identical to SEQ ID NO: 129554

SEQ ID NO: 527603 - RNA, 64 nt, hsa; identical to SEQ ID NO: 129555

SEQ ID NO: 527604 - RNA, 64 nt, hsa; identical to SEQ ID NO: 129556

SEQ ID NO: 527605 - RNA, 64 nt, hsa; identical to SEQ ID NO: 129557

SEQ ID NO: 527606 - RNA, 64 nt, hsa
gaaaaugaccugguaucuugccagagggcuuucuuaaacggagaauaagucaguauucuuaugc

SEQ ID NO: 527607 - RNA, 64 nt, hsa
uuuggauuuuuuuaagguauuugcuaagucuuuguaaacggaaauugaaaaugaccugguaucu

SEQ ID NO: 527608 - RNA, 64 nt, hsa
cuugaugggaccuccacuuauuuaggccucaugugcuuugaagaagcuuugagagccaaugugu

SEQ ID NO: 527609 - RNA, 64 nt, hsa
augaggaauagcauucuuuuuguggggauggugagcuuugaaucauaaaaugaaguuggugcuu

SEQ ID NO: 527610 - RNA, 64 nt, hsa
uggagaacuuuuuugaaugguuuuguauuaaauugcuuugaaauagauuucauuucuugugcac

SEQ ID NO: 527611 - RNA, 64 nt, hsa
gcaguaucucauccucccccuguaccaggccauagcuuugaaguguauuuuguaaauucaacua

SEQ ID NO: 527612 - RNA, 64 nt, hsa
aaguaaugcaugcuuuauuauaaauaaaauucuagcuuugaaaggcguuauguguugaacagua

SEQ ID NO: 527613 - RNA, 64 nt, hsa
ugaguuaacaagaaauaacacuguuugagaacuagcuuugaauaauaauuuuucccuuuguaca

SEQ ID NO: 527614 - RNA, 64 nt, hsa
augucaugaaagugguaaaagugggaaccagugugcuuugaaaccaaauuagaaacacauuccu

SEQ ID NO: 527615 - RNA, 64 nt, hsa
aagaagcaggaccccuacuugcugaagacaggccgcuuugaagaggcggcgggugccgcgccgu

SEQ ID NO: 527616 - RNA, 64 nt, hsa
uuuaacaaaugacuguaucuaggcauuucauuaugcuuugaacuuuaguuugccugcaguuucu

SEQ ID NO: 527617 - RNA, 64 nt, hsa
ggcccaaagaauuggaauccuccuuaauuuaauugcuuugaagcauagcuacaauuuguuuuug

SEQ ID NO: 527618 - RNA, 64 nt, hsa
aaguucccacacugcuggaccuguggcaaagagugcuuugaauaagucagcuagggauucuugc

SEQ ID NO: 527619 - RNA, 64 nt, hsa
agagcagggguuuuggaaggagaggucuuuaauagcuuugaaaugcuuugagaucauuggucaa

SEQ ID NO: 527620 - RNA, 64 nt, hsa
guauaaaaagugugaaugagcuguuuuugcuuuugcuuugaaaucuggaguguaucuuacacau

SEQ ID NO: 527621 - RNA, 64 nt, hsa
cccggcccaagggccgcauguggcccaggauauggcuuugaauggggccuaacacaaauucaua

SEQ ID NO: 527622 - RNA, 64 nt, hsa
cucauagacuuauauuuuauaaucagaauauguugcuuugaaaaagccucuaauggacugaccu

SEQ ID NO: 527623 - RNA, 64 nt, hsa
aauguuaaugguuaauguucccaaaccagagaaugcuuugaaaauguaucauucaguguaaauu

SEQ ID NO: 527624 - RNA, 64 nt, hsa
accaacagagucaacaaggaaacauaauuagagggcuuugaaaugaucuacugaaauaccuaaa

SEQ ID NO: 527625 - RNA, 64 nt, hsa
acuuaaaaaauacuaagacgugauagugaaaauagcuuugaaaagaaacuacauauggcaaagg

SEQ ID NO: 527626 - RNA, 64 nt, hsa
uucuaaauuuaucaguaccuaaguaagauguagcgcuuugaauaugaaaucauaggugaagaca

SEQ ID NO: 527627 - RNA, 64 nt, hsa
caugucucuguguaguuccagcaaaucaagcugagcuuugaaaaaguuugucuuaguuuuguga

SEQ ID NO: 527628 - RNA, 64 nt, hsa; identical to SEQ ID NO: 395715

SEQ ID NO: 527629 - RNA, 64 nt, hsa; identical to SEQ ID NO: 395716

SEQ ID NO: 527630 - RNA, 64 nt, hsa; identical to SEQ ID NO: 395717

SEQ ID NO: 527631 - RNA, 64 nt, hsa; identical to SEQ ID NO: 395718

SEQ ID NO: 527632 - RNA, 64 nt, hsa; identical to SEQ ID NO: 395719

SEQ ID NO: 527633 - RNA, 64 nt, hsa; identical to SEQ ID NO: 395720

SEQ ID NO: 527634 - RNA, 64 nt, hsa; identical to SEQ ID NO: 395721

SEQ ID NO: 527635 - RNA, 64 nt, hsa; identical to SEQ ID NO: 395722

SEQ ID NO: 527636 - RNA, 64 nt, hsa; identical to SEQ ID NO: 395723

SEQ ID NO: 527637 - RNA, 64 nt, hsa; identical to SEQ ID NO: 395724

SEQ ID NO: 527638 - RNA, 64 nt, hsa; identical to SEQ ID NO: 395725

SEQ ID NO: 527639 - RNA, 64 nt, hsa; identical to SEQ ID NO: 395726

SEQ ID NO: 527640 - RNA, 64 nt, hsa; identical to SEQ ID NO: 395727

SEQ ID NO: 527641 - RNA, 64 nt, hsa; identical to SEQ ID NO: 395728

SEQ ID NO: 527642 - RNA, 64 nt, hsa; identical to SEQ ID NO: 395729

SEQ ID NO: 527643 - RNA, 64 nt, hsa; identical to SEQ ID NO: 395730

SEQ ID NO: 527644 - RNA, 64 nt, hsa; identical to SEQ ID NO: 395731

SEQ ID NO: 527645 - RNA, 64 nt, hsa; identical to SEQ ID NO: 395732

SEQ ID NO: 527646 - RNA, 64 nt, hsa; identical to SEQ ID NO: 395733

SEQ ID NO: 527647 - RNA, 64 nt, hsa; identical to SEQ ID NO: 395734

SEQ ID NO: 527648 - RNA, 64 nt, hsa; identical to SEQ ID NO: 395735

SEQ ID NO: 527649 - RNA, 64 nt, hsa; identical to SEQ ID NO: 395736

SEQ ID NO: 527650 - RNA, 64 nt, hsa; identical to SEQ ID NO: 395737

SEQ ID NO: 527651 - RNA, 64 nt, hsa; identical to SEQ ID NO: 509152

SEQ ID NO: 527652 - RNA, 64 nt, hsa; identical to SEQ ID NO: 509153

SEQ ID NO: 527653 - RNA, 64 nt, hsa; identical to SEQ ID NO: 509154

SEQ ID NO: 527654 - RNA, 64 nt, hsa; identical to SEQ ID NO: 509155

SEQ ID NO: 527655 - RNA, 64 nt, hsa; identical to SEQ ID NO: 509156

SEQ ID NO: 527656 - RNA, 64 nt, hsa; identical to SEQ ID NO: 509157

SEQ ID NO: 527657 - RNA, 64 nt, hsa; identical to SEQ ID NO: 509158

SEQ ID NO: 527658 - RNA, 64 nt, hsa; identical to SEQ ID NO: 509159

SEQ ID NO: 527659 - RNA, 64 nt, hsa; identical to SEQ ID NO: 509160

SEQ ID NO: 527660 - RNA, 64 nt, hsa; identical to SEQ ID NO: 509161

SEQ ID NO: 527661 - RNA, 64 nt, hsa; identical to SEQ ID NO: 166169

SEQ ID NO: 527662 - RNA, 64 nt, hsa; identical to SEQ ID NO: 166170

SEQ ID NO: 527663 - RNA, 64 nt, hsa; identical to SEQ ID NO: 166171

SEQ ID NO: 527664 - RNA, 64 nt, hsa; identical to SEQ ID NO: 166172

SEQ ID NO: 527665 - RNA, 64 nt, hsa; identical to SEQ ID NO: 166173

SEQ ID NO: 527666 - RNA, 64 nt, hsa; identical to SEQ ID NO: 166174

SEQ ID NO: 527667 - RNA, 64 nt, hsa; identical to SEQ ID NO: 166175

SEQ ID NO: 527668 - RNA, 64 nt, hsa; identical to SEQ ID NO: 166176

SEQ ID NO: 527669 - RNA, 64 nt, hsa; identical to SEQ ID NO: 166177

SEQ ID NO: 527670 - RNA, 64 nt, hsa; identical to SEQ ID NO: 166178

SEQ ID NO: 527671 - RNA, 64 nt, hsa; identical to SEQ ID NO: 166179

SEQ ID NO: 527672 - RNA, 64 nt, hsa; identical to SEQ ID NO: 166180

SEQ ID NO: 527673 - RNA, 64 nt, hsa; identical to SEQ ID NO: 166181

SEQ ID NO: 527674 - RNA, 64 nt, hsa; identical to SEQ ID NO: 166182

SEQ ID NO: 527675 - RNA, 64 nt, hsa; identical to SEQ ID NO: 166183

SEQ ID NO: 527676 - RNA, 64 nt, hsa; identical to SEQ ID NO: 159261

SEQ ID NO: 527677 - RNA, 64 nt, hsa; identical to SEQ ID NO: 159262

SEQ ID NO: 527678 - RNA, 64 nt, hsa; identical to SEQ ID NO: 159263

SEQ ID NO: 527679 - RNA, 64 nt, hsa; identical to SEQ ID NO: 159264

SEQ ID NO: 527680 - RNA, 64 nt, hsa; identical to SEQ ID NO: 159265

SEQ ID NO: 527681 - RNA, 64 nt, hsa; identical to SEQ ID NO: 159266

SEQ ID NO: 527682 - RNA, 64 nt, hsa; identical to SEQ ID NO: 159267

SEQ ID NO: 527683 - RNA, 64 nt, hsa; identical to SEQ ID NO: 159268

SEQ ID NO: 527684 - RNA, 64 nt, hsa; identical to SEQ ID NO: 159269

SEQ ID NO: 527685 - RNA, 64 nt, hsa; identical to SEQ ID NO: 159270

SEQ ID NO: 527686 - RNA, 64 nt, hsa; identical to SEQ ID NO: 159271

SEQ ID NO: 527687 - RNA, 64 nt, hsa; identical to SEQ ID NO: 159272

SEQ ID NO: 527688 - RNA, 64 nt, hsa; identical to SEQ ID NO: 159273

SEQ ID NO: 527689 - RNA, 64 nt, hsa; identical to SEQ ID NO: 159274

SEQ ID NO: 527690 - RNA, 64 nt, hsa; identical to SEQ ID NO: 159275

SEQ ID NO: 527691 - RNA, 64 nt, hsa; identical to SEQ ID NO: 159276

SEQ ID NO: 527692 - RNA, 59 nt, hsa; identical to SEQ ID NO: 159277

SEQ ID NO: 527693 - RNA, 64 nt, hsa; identical to SEQ ID NO: 159278

SEQ ID NO: 527694 - RNA, 64 nt, hsa; identical to SEQ ID NO: 159279

SEQ ID NO: 527695 - RNA, 58 nt, hsa; identical to SEQ ID NO: 159280

SEQ ID NO: 527696 - RNA, 64 nt, hsa; identical to SEQ ID NO: 159281

SEQ ID NO: 527697 - RNA, 64 nt, hsa; identical to SEQ ID NO: 159282

SEQ ID NO: 527698 - RNA, 64 nt, hsa; identical to SEQ ID NO: 159283

SEQ ID NO: 527699 - RNA, 64 nt, hsa; identical to SEQ ID NO: 159284

SEQ ID NO: 527700 - RNA, 64 nt, hsa; identical to SEQ ID NO: 159285

SEQ ID NO: 527701 - RNA, 64 nt, hsa; identical to SEQ ID NO: 159286

SEQ ID NO: 527702 - RNA, 64 nt, hsa; identical to SEQ ID NO: 159287

SEQ ID NO: 527703 - RNA, 64 nt, hsa; identical to SEQ ID NO: 159288

SEQ ID NO: 527704 - RNA, 64 nt, hsa; identical to SEQ ID NO: 159289

SEQ ID NO: 527705 - RNA, 64 nt, hsa; identical to SEQ ID NO: 159290

SEQ ID NO: 527706 - RNA, 64 nt, hsa; identical to SEQ ID NO: 159291

SEQ ID NO: 527707 - RNA, 64 nt, hsa; identical to SEQ ID NO: 159292

SEQ ID NO: 527708 - RNA, 64 nt, hsa; identical to SEQ ID NO: 159293

SEQ ID NO: 527709 - RNA, 64 nt, hsa; identical to SEQ ID NO: 159294

SEQ ID NO: 527710 - RNA, 64 nt, hsa; identical to SEQ ID NO: 159295

SEQ ID NO: 527711 - RNA, 64 nt, hsa; identical to SEQ ID NO: 159296

SEQ ID NO: 527712 - RNA, 64 nt, hsa; identical to SEQ ID NO: 159297

SEQ ID NO: 527713 - RNA, 64 nt, hsa; identical to SEQ ID NO: 159298

SEQ ID NO: 527714 - RNA, 64 nt, hsa; identical to SEQ ID NO: 159299

SEQ ID NO: 527715 - RNA, 64 nt, hsa; identical to SEQ ID NO: 159300

SEQ ID NO: 527716 - RNA, 64 nt, hsa; identical to SEQ ID NO: 159301

SEQ ID NO: 527717 - RNA, 64 nt, hsa; identical to SEQ ID NO: 159302

SEQ ID NO: 527718 - RNA, 64 nt, hsa; identical to SEQ ID NO: 159303

SEQ ID NO: 527719 - RNA, 64 nt, hsa; identical to SEQ ID NO: 159304

SEQ ID NO: 527720 - RNA, 64 nt, hsa; identical to SEQ ID NO: 159305

SEQ ID NO: 527721 - RNA, 64 nt, hsa; identical to SEQ ID NO: 159306

SEQ ID NO: 527722 - RNA, 64 nt, hsa; identical to SEQ ID NO: 159307

SEQ ID NO: 527723 - RNA, 64 nt, hsa; identical to SEQ ID NO: 159308

SEQ ID NO: 527724 - RNA, 64 nt, hsa; identical to SEQ ID NO: 159309

SEQ ID NO: 527725 - RNA, 64 nt, hsa; identical to SEQ ID NO: 159310

SEQ ID NO: 527726 - RNA, 64 nt, hsa; identical to SEQ ID NO: 159311

SEQ ID NO: 527727 - RNA, 64 nt, hsa; identical to SEQ ID NO: 159312

SEQ ID NO: 527728 - RNA, 64 nt, hsa; identical to SEQ ID NO: 159313

SEQ ID NO: 527729 - RNA, 64 nt, hsa; identical to SEQ ID NO: 159314

SEQ ID NO: 527730 - RNA, 64 nt, hsa; identical to SEQ ID NO: 159315

SEQ ID NO: 527731 - RNA, 64 nt, hsa; identical to SEQ ID NO: 159316

SEQ ID NO: 527732 - RNA, 64 nt, hsa; identical to SEQ ID NO: 159317

SEQ ID NO: 527733 - RNA, 64 nt, hsa; identical to SEQ ID NO: 159318

SEQ ID NO: 527734 - RNA, 64 nt, hsa; identical to SEQ ID NO: 159319

SEQ ID NO: 527735 - RNA, 64 nt, hsa; identical to SEQ ID NO: 159320

SEQ ID NO: 527736 - RNA, 64 nt, hsa; identical to SEQ ID NO: 159321

SEQ ID NO: 527737 - RNA, 64 nt, hsa; identical to SEQ ID NO: 412124

SEQ ID NO: 527738 - RNA, 64 nt, hsa; identical to SEQ ID NO: 412125

SEQ ID NO: 527739 - RNA, 64 nt, hsa; identical to SEQ ID NO: 412126

SEQ ID NO: 527740 - RNA, 64 nt, hsa; identical to SEQ ID NO: 412127

SEQ ID NO: 527741 - RNA, 64 nt, hsa; identical to SEQ ID NO: 412128

SEQ ID NO: 527742 - RNA, 64 nt, hsa; identical to SEQ ID NO: 412129

SEQ ID NO: 527743 - RNA, 64 nt, hsa; identical to SEQ ID NO: 412130

SEQ ID NO: 527744 - RNA, 64 nt, hsa; identical to SEQ ID NO: 412131

SEQ ID NO: 527745 - RNA, 64 nt, hsa; identical to SEQ ID NO: 412132

SEQ ID NO: 527746 - RNA, 64 nt, hsa; identical to SEQ ID NO: 412133

SEQ ID NO: 527747 - RNA, 64 nt, hsa; identical to SEQ ID NO: 412134

SEQ ID NO: 527748 - RNA, 64 nt, hsa; identical to SEQ ID NO: 412135

SEQ ID NO: 527749 - RNA, 64 nt, hsa; identical to SEQ ID NO: 412136

SEQ ID NO: 527750 - RNA, 64 nt, hsa; identical to SEQ ID NO: 412137

SEQ ID NO: 527751 - RNA, 64 nt, hsa; identical to SEQ ID NO: 412138

SEQ ID NO: 527752 - RNA, 64 nt, hsa; identical to SEQ ID NO: 412139

SEQ ID NO: 527753 - RNA, 64 nt, hsa; identical to SEQ ID NO: 412140

SEQ ID NO: 527754 - RNA, 64 nt, hsa; identical to SEQ ID NO: 412141

SEQ ID NO: 527755 - RNA, 64 nt, hsa
ccaugugaugucauccugcuuuguuaucuucuuauaacuuuauccugcuauaacuuuauccucu

SEQ ID NO: 527756 - RNA, 64 nt, hsa
ugcuuuguuaucuucuuauaacuuuauccugcuauaacuuuauccucuucccagccucaucccu

SEQ ID NO: 527757 - RNA, 64 nt, hsa
gaacucauugcucccuaagacugugacaacugucuaacuuuagaagugcauuucugaauagaaa

SEQ ID NO: 527758 - RNA, 64 nt, hsa
uugcauaaagcauaaguauacaguucaauaaacuuaacuuuaacugaacaauggcccuguagcc

SEQ ID NO: 527759 - RNA, 64 nt, hsa
uuuuauggcuuuuuacuguuagacuaaucaaaaauaacuuuaaaaggaacaaagaaacuccaac

SEQ ID NO: 527760 - RNA, 64 nt, hsa
uggauuuuucaauuuucaaaccauauggccuagguaacuuuaauugaaauaauauagauuuagu

SEQ ID NO: 527761 - RNA, 64 nt, hsa
agauccuuaucaccaaacauuagaaaagaucucauaacuuuauacagcauguuguaagcauuuu

SEQ ID NO: 527762 - RNA, 64 nt, hsa
ugcuaugcuguugucuuauuauuauauagaaaaauaacuuuagaaaaauauugaagacauugua

SEQ ID NO: 527763 - RNA, 64 nt, hsa
agauaauuuuuauuuauguagcuuuuuuuggaaguaacuuuauaaauuuuuauaauucagaaga

SEQ ID NO: 527764 - RNA, 64 nt, hsa
ucuucuuaaccaguacauagaacucuuuaugaauuaacuuuagcuuauguuggaaguaguaguu

SEQ ID NO: 527765 - RNA, 64 nt, hsa
cccuuaccauucaguaugcaaaacuuaaaauacauaacuuuacccuuaaauauuuuuucuuucu

SEQ ID NO: 527766 - RNA, 64 nt, hsa
aaugacagcagagacauuuacuucugcaguuaguuaacuuuauaggaguugugauuuuuuugau

SEQ ID NO: 527767 - RNA, 64 nt, hsa
aaaauaaacuaccaauacuaaauaguaagaaaccuaacuuuaguagcaaaucuugauuaauuga

SEQ ID NO: 527768 - RNA, 64 nt, hsa
uauuuuuaaaaaaauuuguaggugcuuuuauguauaacuuuaaugauuuauaagaugcuaaaug

SEQ ID NO: 527769 - RNA, 64 nt, hsa
cuagccugggggaugggguucauauguguuguuguaacuuuagauuacuaaacaaaacaaacug

SEQ ID NO: 527770 - RNA, 64 nt, hsa
aaaacuuuucuauuguuuucuuucccuuucacaguaacuuuauguaaaauaaaccaucuucaaa

SEQ ID NO: 527771 - RNA, 64 nt, hsa
cuaaucaagagaaguaggaagcauaucaaacguuuaacuuuauuuaaaaaguauaaugugaaaa

SEQ ID NO: 527772 - RNA, 64 nt, hsa
ugugcacuuuuuuucuauauuauugcccaugauauaacuuuagaaauaaaccuuaauauuucuu

SEQ ID NO: 527773 - RNA, 64 nt, hsa
agaagagucuauugucuccuugguuauauuuuuuuaacuuuaccaugcucaaugaaaaggugau

SEQ ID NO: 527774 - RNA, 64 nt, hsa
uauuuccuagagaauaguaaccagguuuuguuuuuaacuuuaaaaccuaauuacuuuugugccu

SEQ ID NO: 527775 - RNA, 64 nt, hsa
ccuaauuacuuuugugccucucagccguugauuguaacuuuaaagucccaugguuuuggagugu

SEQ ID NO: 527776 - RNA, 64 nt, hsa
cugguauuaacuuuauacacuuggauuucauuuguaacuuuaggauguaaagguauauugugaa

SEQ ID NO: 527777 - RNA, 64 nt, hsa
ugagaaaugauggggagugagugaucacugguauuaacuuuauacacuuggauuucauuuguaa

SEQ ID NO: 527778 - RNA, 64 nt, hsa
ugcccagaucucuccacaagagcugaggguuucauaacuuuauggcuuaauaaauguaugacac

SEQ ID NO: 527779 - RNA, 64 nt, hsa
uuuuauaccaacgugaaaagugccauuuuuagaauaacuuuaaagcuuaacagguuuccuuuua

SEQ ID NO: 527780 - RNA, 64 nt, hsa
uuacacuuuuucacuuaagugcuuuaguuuagacuaacuuuacaacuucuauaacuuuuggaac

SEQ ID NO: 527781 - RNA, 64 nt, hsa
aaguuuaguauagucugauuacauuccauucaccuaacuuuagacauucguuuagacaccauaa

SEQ ID NO: 527782 - RNA, 64 nt, hsa
auuacccuaaaaguaauaacuuugaugcuugcuuuaacuuuagucccaucucugccacuuugau

SEQ ID NO: 527783 - RNA, 64 nt, hsa
uacucacacugcaaauaacuagucagcucaguuuuaacuuuauagguuuauugaguuuccuuug

SEQ ID NO: 527784 - RNA, 64 nt, hsa
acaagaacagauaacuucuucagauacauuuguguaacuuuacagaaugucaucaagcuuuggg

SEQ ID NO: 527785 - RNA, 64 nt, hsa
ucuaugugacuuauggucaaaagagcaguuuuaauaacuuuaaaaguacuucagauagacgcag

SEQ ID NO: 527786 - RNA, 64 nt, hsa
auaauacaaacagauuugucuaaacauuuguauauaacuuuaaaaauagaauauuuuuuggagg

SEQ ID NO: 527787 - RNA, 64 nt, hsa
cuauugugaauucaaugaaguguucuuaugccacuaacuuuaaccuauucccuuacucaaggau

SEQ ID NO: 527788 - RNA, 64 nt, hsa
ggaggcauuccacacaggcacugccccaggacaacacaacaaggacagucacaacaaggacaac

SEQ ID NO: 527789 - RNA, 64 nt, hsa
aggcacugccccaggacaacacaacaaggacagucacaacaaggacaacaaggacacaacacaa

SEQ ID NO: 527790 - RNA, 64 nt, hsa
gucacaacaaggacaacaaggacacaacacaacacacaacaaggacagucacaacaagccuaga

SEQ ID NO: 527791 - RNA, 64 nt, hsa
acaaggacacaacacaacacacaacaaggacagucacaacaagccuagagccagaaagcagaug

SEQ ID NO: 527792 - RNA, 64 nt, hsa
gcuaauucaugcacugcaauacucuauauacaaacacaacaaugcaaauucuucuucaagacug

SEQ ID NO: 527793 - RNA, 64 nt, hsa
uaguauaaaccucauuuagguaguaguauuaagccacaacaauaaugccacauugaaacagcau

SEQ ID NO: 527794 - RNA, 64 nt, hsa
agucaguauguagaaugggauguauucuucugcugcugcuuauuaaauaaagaaagccugagug

SEQ ID NO: 527795 - RNA, 64 nt, hsa
cacuuuauaaaaagugaaagcgacaaauuccaccgcugcuuaauacugcuuugcuucuuuuuau

SEQ ID NO: 527796 - RNA, 64 nt, hsa
ucauuggacuuuugugaaguugacaccagcuaaggcugcuuaaaauaaguucugaucauuauau

SEQ ID NO: 527797 - RNA, 64 nt, hsa
uguauuguacauaguuuaaccaaguguuauuugagcugcuuauuaauauuaacuuguacuuguc

SEQ ID NO: 527798 - RNA, 64 nt, hsa
aauuuuauggguuuuuuucuuuuuugcgaagggggcugcuuaggguuucaccuuuuuuuaaucc

SEQ ID NO: 527799 - RNA, 64 nt, hsa
aaaaguuguaauuuaaaagucugaauaaccaucugcugcuuaggaaacucaaugaaaugacaug

SEQ ID NO: 527800 - RNA, 64 nt, hsa
ggagaaguguggucagaggggagcaaugggcuuugcugcuuaugagcacagaggaauucagucc

SEQ ID NO: 527801 - RNA, 64 nt, hsa
acagcuauuggguccaccccagucccuuucagcugcugcuuaaugcccugcucucucccuggcc

SEQ ID NO: 527802 - RNA, 64 nt, hsa
uagcuagaugugguggcaugagccuguguucccagcugcuuaggaggcugaagcaggaggauug

SEQ ID NO: 527803 - RNA, 64 nt, hsa
uugaaaauuaauaacgagccuaguuuaggaaaaagcugcuuaaaacuguggcucuaagagagua

SEQ ID NO: 527804 - RNA, 64 nt, hsa
uuaaaugcuggacacggaggcaggcuguuuaaacgcugcuuaaagucgcaacugggccccuuuc

SEQ ID NO: 527805 - RNA, 64 nt, hsa
caaccacccucggaugauggguugcagccggccugcugcuuaaggugggggcugccaugagggg

SEQ ID NO: 527806 - RNA, 64 nt, hsa
ggggauauauguuuguggaauggauuuuccugaagcugcuuaacaguugcuuuggauucucuaa

SEQ ID NO: 527807 - RNA, 64 nt, hsa
agagagcacuguccaaggaugucgggagcauccugcugcuuaggggaauguuuucgcaaauguu

SEQ ID NO: 527808 - RNA, 64 nt, hsa
aauguugcaaggcuuuuaucccugaaaaucauuuacagauaaccacaauuugcugugguauaua

SEQ ID NO: 527809 - RNA, 64 nt, hsa
augauaaaauuuaagauuuuucuaauaaaagaguacagauaaugggacaguugagagagauggc

SEQ ID NO: 527810 - RNA, 64 nt, hsa
auucaggauuacagugcuccuuucauucuuucaaacagauaacauaaaaguucuguuacccuca

SEQ ID NO: 527811 - RNA, 64 nt, hsa
cuuccauauauauuacccugaacuuucuaucaccacagauaaagauuuuguuuugcccugcaaa

SEQ ID NO: 527812 - RNA, 64 nt, hsa
ucauguagccaaaagaccaagaaaaaucuggcccacagauaaguugcagacugccuuuaaaaua

SEQ ID NO: 527813 - RNA, 64 nt, hsa
aaucugugauuguuggcagugucaucucugagaaacagauaaauaaaguuuauuuacuauauaa

SEQ ID NO: 527814 - RNA, 64 nt, hsa
cacacgcacaugcacagauaugccgccugggcacacagauaagcugcccaaaugcacgcacacg

SEQ ID NO: 527815 - RNA, 64 nt, hsa
gacacacacgugcacagauaugcugccuggacacacagauaaugcugccuugacacacacaugc

SEQ ID NO: 527816 - RNA, 64 nt, hsa
cacacgcacgcagauaugcugccuggacacacacacagauaaugcugccucaacacucacacac

SEQ ID NO: 527817 - RNA, 64 nt, hsa
uaguuauauuuaaaaauauuuuuuuaaauucuuuacagauaauauuauacuuguuacccuucac

SEQ ID NO: 527818 - RNA, 64 nt, hsa
agucggcaauuucuuggccauggauguagaaccuacagauaaggugagccaacugcauuaggaa

SEQ ID NO: 527819 - RNA, 64 nt, hsa
aaaaaaaaaaggaauccgugacccacagagcuagacagauaagaugcauaguugaccagucaua

SEQ ID NO: 527820 - RNA, 64 nt, hsa
cucuuuucucaccaaaaaggagauaaauuugaaaacagauaaauguaacaaccagucaaagaag

SEQ ID NO: 527821 - RNA, 64 nt, hsa
uaacagccaagaauuggucuuuccuaaaaaugcaacagauaaugcugcuagauuguuauuuugu

SEQ ID NO: 527822 - RNA, 64 nt, hsa
cuagcuuccuggucugaucagugcuaugagauggacagauaagugugaauguuuuauacagaaa

SEQ ID NO: 527823 - RNA, 64 nt, hsa
uuauuuuuaaacagaacuccucuuaccccccaaaacagauaaaccucaguguacaauuuugaaa

SEQ ID NO: 527824 - RNA, 64 nt, hsa
gcaucaguaucacaucuagcucccuuacuuguccacagauaauguaaacaaaggagggaaaaac

SEQ ID NO: 527825 - RNA, 64 nt, hsa
gaagucguauuauucacuuguaaaaaugauuguaacagauaaaaaauguaucugcagcaacucu

SEQ ID NO: 527826 - RNA, 64 nt, hsa
uaucuacaugauuuucaaguuguaaugcagauggacagauaaaaaagauuuuacguuugucuuu

SEQ ID NO: 527827 - RNA, 64 nt, hsa
auaugacaaauguuucuaagguaacaagaugagaacagauaaagauugugugguguuuuggauu

SEQ ID NO: 527828 - RNA, 64 nt, hsa
gaguagagguauaauugugugauauuucagaaauacagauaaaugauucaaaaagucacaguua

SEQ ID NO: 527829 - RNA, 64 nt, hsa; identical to SEQ ID NO: 147038

SEQ ID NO: 527830 - RNA, 64 nt, hsa; identical to SEQ ID NO: 147039

SEQ ID NO: 527831 - RNA, 64 nt, hsa; identical to SEQ ID NO: 147040

SEQ ID NO: 527832 - RNA, 64 nt, hsa; identical to SEQ ID NO: 147041

SEQ ID NO: 527833 - RNA, 64 nt, hsa; identical to SEQ ID NO: 147042

SEQ ID NO: 527834 - RNA, 64 nt, hsa; identical to SEQ ID NO: 147043

SEQ ID NO: 527835 - RNA, 64 nt, hsa; identical to SEQ ID NO: 147044

SEQ ID NO: 527836 - RNA, 64 nt, hsa; identical to SEQ ID NO: 147045

SEQ ID NO: 527837 - RNA, 64 nt, hsa; identical to SEQ ID NO: 147046

SEQ ID NO: 527838 - RNA, 64 nt, hsa; identical to SEQ ID NO: 147047

SEQ ID NO: 527839 - RNA, 64 nt, hsa; identical to SEQ ID NO: 147048

SEQ ID NO: 527840 - RNA, 64 nt, hsa; identical to SEQ ID NO: 147049

SEQ ID NO: 527841 - RNA, 64 nt, hsa; identical to SEQ ID NO: 147050

SEQ ID NO: 527842 - RNA, 64 nt, hsa; identical to SEQ ID NO: 147051

SEQ ID NO: 527843 - RNA, 64 nt, hsa; identical to SEQ ID NO: 147052

SEQ ID NO: 527844 - RNA, 64 nt, hsa; identical to SEQ ID NO: 147053

SEQ ID NO: 527845 - RNA, 64 nt, hsa; identical to SEQ ID NO: 147054

SEQ ID NO: 527846 - RNA, 64 nt, hsa; identical to SEQ ID NO: 147055

SEQ ID NO: 527847 - RNA, 64 nt, hsa; identical to SEQ ID NO: 147056

SEQ ID NO: 527848 - RNA, 64 nt, hsa; identical to SEQ ID NO: 147057

SEQ ID NO: 527849 - RNA, 64 nt, hsa; identical to SEQ ID NO: 147058

SEQ ID NO: 527850 - RNA, 64 nt, hsa; identical to SEQ ID NO: 147059

SEQ ID NO: 527851 - RNA, 64 nt, hsa; identical to SEQ ID NO: 147060

SEQ ID NO: 527852 - RNA, 64 nt, hsa; identical to SEQ ID NO: 147061

SEQ ID NO: 527853 - RNA, 64 nt, hsa; identical to SEQ ID NO: 147062

SEQ ID NO: 527854 - RNA, 64 nt, hsa; identical to SEQ ID NO: 147063

SEQ ID NO: 527855 - RNA, 64 nt, hsa; identical to SEQ ID NO: 147064

SEQ ID NO: 527856 - RNA, 64 nt, hsa; identical to SEQ ID NO: 147065

SEQ ID NO: 527857 - RNA, 64 nt, hsa; identical to SEQ ID NO: 147066

SEQ ID NO: 527858 - RNA, 64 nt, hsa; identical to SEQ ID NO: 147067

SEQ ID NO: 527859 - RNA, 64 nt, hsa; identical to SEQ ID NO: 147068

SEQ ID NO: 527860 - RNA, 64 nt, hsa; identical to SEQ ID NO: 147069

SEQ ID NO: 527861 - RNA, 64 nt, hsa; identical to SEQ ID NO: 147070

SEQ ID NO: 527862 - RNA, 64 nt, hsa; identical to SEQ ID NO: 147071

SEQ ID NO: 527863 - RNA, 64 nt, hsa; identical to SEQ ID NO: 147072

SEQ ID NO: 527864 - RNA, 64 nt, hsa; identical to SEQ ID NO: 147073

SEQ ID NO: 527865 - RNA, 64 nt, hsa; identical to SEQ ID NO: 147074

SEQ ID NO: 527866 - RNA, 64 nt, hsa; identical to SEQ ID NO: 147075

SEQ ID NO: 527867 - RNA, 64 nt, hsa; identical to SEQ ID NO: 147076

SEQ ID NO: 527868 - RNA, 64 nt, hsa; identical to SEQ ID NO: 147077

SEQ ID NO: 527869 - RNA, 64 nt, hsa; identical to SEQ ID NO: 147078

SEQ ID NO: 527870 - RNA, 64 nt, hsa; identical to SEQ ID NO: 147079

SEQ ID NO: 527871 - RNA, 64 nt, hsa; identical to SEQ ID NO: 147080

SEQ ID NO: 527872 - RNA, 64 nt, hsa; identical to SEQ ID NO: 147081

SEQ ID NO: 527873 - RNA, 53 nt, hsa; identical to SEQ ID NO: 147082

SEQ ID NO: 527874 - RNA, 64 nt, hsa; identical to SEQ ID NO: 147083

SEQ ID NO: 527875 - RNA, 64 nt, hsa; identical to SEQ ID NO: 147084

SEQ ID NO: 527876 - RNA, 64 nt, hsa; identical to SEQ ID NO: 147085

SEQ ID NO: 527877 - RNA, 64 nt, hsa; identical to SEQ ID NO: 147086

SEQ ID NO: 527878 - RNA, 64 nt, hsa; identical to SEQ ID NO: 147087

SEQ ID NO: 527879 - RNA, 64 nt, hsa
gccuccaaggcaaauagugcuucacccugaccucucacuccaggacagccucuaagggauuuga

SEQ ID NO: 527880 - RNA, 64 nt, hsa
gggauuugaucugcucaucuucaguugaaugcccucacuccaagacuggaugcuggaucucaua

SEQ ID NO: 527881 - RNA, 64 nt, hsa
gcugggaugccgcccucaguaagcagcuugccaaucacuccaggucugaaaagcaaguccccca

SEQ ID NO: 527882 - RNA, 64 nt, hsa
ucaccagugugggucccuucugauaccaccagguucacuccaggcagaguggggcggaaggcug

SEQ ID NO: 527883 - RNA, 64 nt, hsa
caaaggcuccacagcuccaccgcuccaccuggcuucacuccagcacccugucccuggagcaccu

SEQ ID NO: 527884 - RNA, 64 nt, hsa
acuuccacuucucgccccccaggcaggagcacccucacuccaagggcuuggccuggaaaggcag

SEQ ID NO: 527885 - RNA, 64 nt, hsa
gaggaggaacgggcagccacaggacugagcccucucacuccagccaaagaaaugggccugccug

SEQ ID NO: 527886 - RNA, 64 nt, hsa
uguaacugcccagccccuuuucucugcucuuguuucacuccaccaucacucacucacuccccac

SEQ ID NO: 527887 - RNA, 64 nt, hsa
gacucagcacuagcacuccaucagcacuagcaccucacuccaucagcacuagcaccucacucca

SEQ ID NO: 527888 - RNA, 64 nt, hsa
agcacuagcaccucacuccaucagcacuagcaccucacuccaucggccccggcacccugcucca

SEQ ID NO: 527889 - RNA, 64 nt, hsa
ucacaacaucuuguaagacugugcccggccccauucacuccauccugugagaccacgcccggcc

SEQ ID NO: 527890 - RNA, 64 nt, hsa
cccaccauccugugagccccacucccggccccacucacuccauccugugagccccacucccagc

SEQ ID NO: 527891 - RNA, 64 nt, hsa
ucacuccaucuuguaagacuaugcccagccccauucacuccauccugugagucccacucccagc

SEQ ID NO: 527892 - RNA, 64 nt, hsa
cacaccaaccugugagccccacucccggccccacucacuccaucuuguaagacuaugcccagcc

SEQ ID NO: 527893 - RNA, 64 nt, hsa
ucccaccaucuuguaagacugugcccagccccacucacuccauccugugagucccacucccagc

SEQ ID NO: 527894 - RNA, 64 nt, hsa
uaaacuugguaaaauccaagucuuuuuuuuuuuuuccaggaacaacuacauuuucucauauaca

SEQ ID NO: 527895 - RNA, 64 nt, hsa
guucuuguuccugagaaggguggguaacagauauuccaggaaaaagaaugcacauugaauggau

SEQ ID NO: 527896 - RNA, 64 nt, hsa
auuaugcccaaaucaaccucugaaaaaagguuuuuccaggaagauuuacauuuagguuuaauau

SEQ ID NO: 527897 - RNA, 64 nt, hsa
cacuauguguugcuaaaacacaugcuaugagcacuccaggaaacacuauauuuuuuccaaaaaa

SEQ ID NO: 527898 - RNA, 64 nt, hsa
ucauucgcuacuaguuauucagagcguacuuuguuccaggaacuaugcuggaaacugauaguuc

SEQ ID NO: 527899 - RNA, 64 nt, hsa
uauuuacuacauaguuauucagagccuacuguguuccaggaacuaugcuagaaacugucucucu

SEQ ID NO: 527900 - RNA, 64 nt, hsa
ccugggccagagaagauaauguucuuuaauguuguccaggaaacccuggcuugcuugccgagcc

SEQ ID NO: 527901 - RNA, 64 nt, hsa
augucucuuguagaagauggacucugaaaaacauuccaggaaaccauggcagcauggagagccu

SEQ ID NO: 527902 - RNA, 64 nt, hsa
ccccgccuggaggagauccgcaucuggggaccccuccaggaagaugcugacauccaggucagca

SEQ ID NO: 527903 - RNA, 64 nt, hsa
uuccugugcauggacucugcccucagggugccuguccaggaagagcuguguggccuggcaagca

SEQ ID NO: 527904 - RNA, 64 nt, hsa
ucuuaguuaaauuggauugagaaugccuuuuguuuccaggaaaauauugaucaccaugaaagaa

SEQ ID NO: 527905 - RNA, 64 nt, hsa
uuuuucucucuuagaauuggaggauuugccauuguccaggaaagaaacuugcagcuuuaaccug

SEQ ID NO: 527906 - RNA, 64 nt, hsa
cuugccucuuagcauguuugauuuaagaaaagccuccaggaaaucuugagagccugucuuggca

SEQ ID NO: 527907 - RNA, 64 nt, hsa
uugcagcuccccagucucuaccugucaggaugacuccaggaagacagcuggaguacugcauuug

SEQ ID NO: 527908 - RNA, 64 nt, hsa
uucuguuacauccaccuuugaggcuggucauaccuccaggaacaauacagagccagucaacuuc

SEQ ID NO: 527909 - RNA, 64 nt, hsa
caccugagcgcaccaccaccuggcguguagaaucuccaggaagccuggcugcagcuucccauuu

SEQ ID NO: 527910 - RNA, 64 nt, hsa
caggauuuagaucuuggcuacugucaugcaggcuuccaggaacauagacuguuuuaccuccaca

SEQ ID NO: 527911 - RNA, 64 nt, hsa
ucauggagaaugcaggcaguuaacuuaauaucccuccaggaaugguuccuacguuguguauuac

SEQ ID NO: 527912 - RNA, 64 nt, hsa
guuucuuccccgaguggagcuucgacccacccacuccaggaacccagagccacauuagaaguuc

SEQ ID NO: 527913 - RNA, 64 nt, hsa
acagauuuaaagacagguggccacugacagccacuccaggaacuugaacugcaggggcagagcc

SEQ ID NO: 527914 - RNA, 64 nt, hsa
uacccgcgggaccucuuguaacccaucggcaucuuccaggaauccgccgagugacuugaggaag

SEQ ID NO: 527915 - RNA, 64 nt, hsa
gaggccccugguggccuucaguuucaguuucucauccaggaagguaaccuugggcauuggcagu

SEQ ID NO: 527916 - RNA, 64 nt, hsa
agaacaaucaucuguuugacuucuuugguuccucaugcagcagaaggaagacagaaagauagaa

SEQ ID NO: 527917 - RNA, 64 nt, hsa
auguuguauacuguaaauuacaguauaaugccaaaugcagcaaaaucuuccagcuguacguuac

SEQ ID NO: 527918 - RNA, 64 nt, hsa
ucugagauuucuaauuguguugugaaaaugauaaaugcagcaaaucuagcuuucaguauuccua

SEQ ID NO: 527919 - RNA, 64 nt, hsa
aauaagcuuggauaaaauugaaccaacuucaagaaugcagcacuucuuaaucuuuagcucuuuc

SEQ ID NO: 527920 - RNA, 64 nt, hsa
gaaugacggucacuccagacgucagccggcagggaugcagcaggcuggccgcgcaccggggcuc

SEQ ID NO: 527921 - RNA, 64 nt, hsa
gagggagguggacggugccagcugaggcugaggcaugcagcagcccccagcuaccuuugcuuag

SEQ ID NO: 527922 - RNA, 64 nt, hsa
aucagagaguucacacuggagaaagaccuuuugaaugcagcauuugugggaaauccuuuagaug

SEQ ID NO: 527923 - RNA, 64 nt, hsa
accaaaaaguucacacuagggaaagaacuuacaaaugcagcaaaugugggaaauuuuuuaugga

SEQ ID NO: 527924 - RNA, 64 nt, hsa
agacauggggaacuuggcaugacgucacaccgagaugcagcaacgacgucacgggccaugucga

SEQ ID NO: 527925 - RNA, 64 nt, hsa
cgucacgaagagauauagcgauggcgucgugcagaugcagcacgucgcacacagacauggggaa

SEQ ID NO: 527926 - RNA, 64 nt, hsa
ugcccugcagaugcagcagauguacgacaugaucaugcagcacaagcgggccaugcaggacaug

SEQ ID NO: 527927 - RNA, 64 nt, hsa
cgcccagaagaagcagcugaaggagcagcaggagaugcagcagauguacgacaugaucaugcag

SEQ ID NO: 527928 - RNA, 64 nt, hsa
ccagcccaggaaccuuugcagggccaucucacccaugcagcauaaggcagaagccauagucacu

SEQ ID NO: 527929 - RNA, 64 nt, hsa
cuuugugagaaaaucuucagccaagucaaacuucaugcagcagaauccccauaccagaaaaauu

SEQ ID NO: 527930 - RNA, 64 nt, hsa
cccgcggggugcagagcaccccaacuuugcacucaugcagcaguccuacaacaccuucaaguac

SEQ ID NO: 527931 - RNA, 64 nt, hsa
gcaguuccgucagcugcagcuguucaagcacgagaugcagcauuucgugaaggucauccagggc

SEQ ID NO: 527932 - RNA, 64 nt, hsa; identical to SEQ ID NO: 491366

SEQ ID NO: 527933 - RNA, 64 nt, hsa; identical to SEQ ID NO: 491367

SEQ ID NO: 527934 - RNA, 64 nt, hsa; identical to SEQ ID NO: 491368

SEQ ID NO: 527935 - RNA, 64 nt, hsa; identical to SEQ ID NO: 491369

SEQ ID NO: 527936 - RNA, 64 nt, hsa; identical to SEQ ID NO: 491370

SEQ ID NO: 527937 - RNA, 64 nt, hsa; identical to SEQ ID NO: 491371

SEQ ID NO: 527938 - RNA, 64 nt, hsa; identical to SEQ ID NO: 491372

SEQ ID NO: 527939 - RNA, 64 nt, hsa; identical to SEQ ID NO: 491373

SEQ ID NO: 527940 - RNA, 64 nt, hsa; identical to SEQ ID NO: 491374

SEQ ID NO: 527941 - RNA, 64 nt, hsa; identical to SEQ ID NO: 491375

SEQ ID NO: 527942 - RNA, 64 nt, hsa; identical to SEQ ID NO: 491376

SEQ ID NO: 527943 - RNA, 64 nt, hsa; identical to SEQ ID NO: 491377

SEQ ID NO: 527944 - RNA, 64 nt, hsa; identical to SEQ ID NO: 491378

SEQ ID NO: 527945 - RNA, 64 nt, hsa; identical to SEQ ID NO: 491379

SEQ ID NO: 527946 - RNA, 64 nt, hsa; identical to SEQ ID NO: 491380

SEQ ID NO: 527947 - RNA, 64 nt, hsa; identical to SEQ ID NO: 491381

SEQ ID NO: 527948 - RNA, 64 nt, hsa; identical to SEQ ID NO: 491382

SEQ ID NO: 527949 - RNA, 64 nt, hsa; identical to SEQ ID NO: 491383

SEQ ID NO: 527950 - RNA, 64 nt, hsa; identical to SEQ ID NO: 491384

SEQ ID NO: 527951 - RNA, 64 nt, hsa; identical to SEQ ID NO: 491385

SEQ ID NO: 527952 - RNA, 64 nt, hsa; identical to SEQ ID NO: 491386

SEQ ID NO: 527953 - RNA, 64 nt, hsa; identical to SEQ ID NO: 491387

SEQ ID NO: 527954 - RNA, 64 nt, hsa; identical to SEQ ID NO: 491388

SEQ ID NO: 527955 - RNA, 64 nt, hsa; identical to SEQ ID NO: 491389

SEQ ID NO: 527956 - RNA, 64 nt, hsa; identical to SEQ ID NO: 491390

SEQ ID NO: 527957 - RNA, 64 nt, hsa; identical to SEQ ID NO: 491391

SEQ ID NO: 527958 - RNA, 64 nt, hsa; identical to SEQ ID NO: 491392

SEQ ID NO: 527959 - RNA, 64 nt, hsa; identical to SEQ ID NO: 491393

SEQ ID NO: 527960 - RNA, 64 nt, hsa; identical to SEQ ID NO: 491394

SEQ ID NO: 527961 - RNA, 64 nt, hsa; identical to SEQ ID NO: 491395

SEQ ID NO: 527962 - RNA, 64 nt, hsa; identical to SEQ ID NO: 491396

SEQ ID NO: 527963 - RNA, 64 nt, hsa; identical to SEQ ID NO: 491397

SEQ ID NO: 527964 - RNA, 64 nt, hsa; identical to SEQ ID NO: 491398

SEQ ID NO: 527965 - RNA, 64 nt, hsa; identical to SEQ ID NO: 491399

SEQ ID NO: 527966 - RNA, 64 nt, hsa; identical to SEQ ID NO: 491400

SEQ ID NO: 527967 - RNA, 64 nt, hsa; identical to SEQ ID NO: 491401

SEQ ID NO: 527968 - RNA, 64 nt, hsa; identical to SEQ ID NO: 491402

SEQ ID NO: 527969 - RNA, 64 nt, hsa; identical to SEQ ID NO: 491403

SEQ ID NO: 527970 - RNA, 64 nt, hsa; identical to SEQ ID NO: 491404

SEQ ID NO: 527971 - RNA, 64 nt, hsa; identical to SEQ ID NO: 491405

SEQ ID NO: 527972 - RNA, 64 nt, hsa; identical to SEQ ID NO: 491406

SEQ ID NO: 527973 - RNA, 64 nt, hsa; identical to SEQ ID NO: 491407

SEQ ID NO: 527974 - RNA, 64 nt, hsa; identical to SEQ ID NO: 491408

SEQ ID NO: 527975 - RNA, 64 nt, hsa; identical to SEQ ID NO: 491409

SEQ ID NO: 527976 - RNA, 64 nt, hsa; identical to SEQ ID NO: 491410

SEQ ID NO: 527977 - RNA, 64 nt, hsa; identical to SEQ ID NO: 491411

SEQ ID NO: 527978 - RNA, 64 nt, hsa; identical to SEQ ID NO: 491412

SEQ ID NO: 527979 - RNA, 64 nt, hsa; identical to SEQ ID NO: 491413

SEQ ID NO: 527980 - RNA, 64 nt, hsa; identical to SEQ ID NO: 491414

SEQ ID NO: 527981 - RNA, 64 nt, hsa; identical to SEQ ID NO: 491415

SEQ ID NO: 527982 - RNA, 64 nt, hsa; identical to SEQ ID NO: 491416

SEQ ID NO: 527983 - RNA, 64 nt, hsa; identical to SEQ ID NO: 491417

SEQ ID NO: 527984 - RNA, 64 nt, hsa; identical to SEQ ID NO: 491418

SEQ ID NO: 527985 - RNA, 64 nt, hsa; identical to SEQ ID NO: 491419

SEQ ID NO: 527986 - RNA, 64 nt, hsa; identical to SEQ ID NO: 491420

SEQ ID NO: 527987 - RNA, 64 nt, hsa; identical to SEQ ID NO: 491421

SEQ ID NO: 527988 - RNA, 64 nt, hsa; identical to SEQ ID NO: 491422

SEQ ID NO: 527989 - RNA, 64 nt, hsa; identical to SEQ ID NO: 491423

SEQ ID NO: 527990 - RNA, 64 nt, hsa; identical to SEQ ID NO: 491424

SEQ ID NO: 527991 - RNA, 64 nt, hsa; identical to SEQ ID NO: 491425

SEQ ID NO: 527992 - RNA, 64 nt, hsa; identical to SEQ ID NO: 491426

SEQ ID NO: 527993 - RNA, 64 nt, hsa; identical to SEQ ID NO: 491427

SEQ ID NO: 527994 - RNA, 64 nt, hsa; identical to SEQ ID NO: 491428

SEQ ID NO: 527995 - RNA, 64 nt, hsa; identical to SEQ ID NO: 491429

SEQ ID NO: 527996 - RNA, 64 nt, hsa; identical to SEQ ID NO: 491430

SEQ ID NO: 527997 - RNA, 64 nt, hsa; identical to SEQ ID NO: 491431

SEQ ID NO: 527998 - RNA, 64 nt, hsa; identical to SEQ ID NO: 491432

SEQ ID NO: 527999 - RNA, 64 nt, hsa; identical to SEQ ID NO: 491433

SEQ ID NO: 528000 - RNA, 64 nt, hsa; identical to SEQ ID NO: 491434

SEQ ID NO: 528001 - RNA, 64 nt, hsa; identical to SEQ ID NO: 491435

SEQ ID NO: 528002 - RNA, 64 nt, hsa; identical to SEQ ID NO: 491436

SEQ ID NO: 528003 - RNA, 64 nt, hsa; identical to SEQ ID NO: 491437

SEQ ID NO: 528004 - RNA, 64 nt, hsa; identical to SEQ ID NO: 491438

SEQ ID NO: 528005 - RNA, 64 nt, hsa; identical to SEQ ID NO: 491439

SEQ ID NO: 528006 - RNA, 64 nt, hsa; identical to SEQ ID NO: 491440

SEQ ID NO: 528007 - RNA, 64 nt, hsa; identical to SEQ ID NO: 491441

SEQ ID NO: 528008 - RNA, 64 nt, hsa; identical to SEQ ID NO: 491442

SEQ ID NO: 528009 - RNA, 64 nt, hsa; identical to SEQ ID NO: 491443

SEQ ID NO: 528010 - RNA, 64 nt, hsa; identical to SEQ ID NO: 491444

SEQ ID NO: 528011 - RNA, 64 nt, hsa; identical to SEQ ID NO: 491445

SEQ ID NO: 528012 - RNA, 64 nt, hsa; identical to SEQ ID NO: 491446

SEQ ID NO: 528013 - RNA, 64 nt, hsa; identical to SEQ ID NO: 491447

SEQ ID NO: 528014 - RNA, 64 nt, hsa; identical to SEQ ID NO: 491448

SEQ ID NO: 528015 - RNA, 64 nt, hsa; identical to SEQ ID NO: 491449

SEQ ID NO: 528016 - RNA, 64 nt, hsa; identical to SEQ ID NO: 491450

SEQ ID NO: 528017 - RNA, 64 nt, hsa; identical to SEQ ID NO: 491451

SEQ ID NO: 528018 - RNA, 64 nt, hsa; identical to SEQ ID NO: 491452

SEQ ID NO: 528019 - RNA, 64 nt, hsa; identical to SEQ ID NO: 491453

SEQ ID NO: 528020 - RNA, 64 nt, hsa; identical to SEQ ID NO: 491454

SEQ ID NO: 528021 - RNA, 64 nt, hsa; identical to SEQ ID NO: 491455

SEQ ID NO: 528022 - RNA, 64 nt, hsa; identical to SEQ ID NO: 491456

SEQ ID NO: 528023 - RNA, 64 nt, hsa; identical to SEQ ID NO: 491457

SEQ ID NO: 528024 - RNA, 64 nt, hsa; identical to SEQ ID NO: 491458

SEQ ID NO: 528025 - RNA, 64 nt, hsa; identical to SEQ ID NO: 491459

SEQ ID NO: 528026 - RNA, 64 nt, hsa; identical to SEQ ID NO: 491460

SEQ ID NO: 528027 - RNA, 64 nt, hsa; identical to SEQ ID NO: 491461

SEQ ID NO: 528028 - RNA, 64 nt, hsa; identical to SEQ ID NO: 491462

SEQ ID NO: 528029 - RNA, 64 nt, hsa; identical to SEQ ID NO: 491463

SEQ ID NO: 528030 - RNA, 64 nt, hsa; identical to SEQ ID NO: 491464

SEQ ID NO: 528031 - RNA, 64 nt, hsa; identical to SEQ ID NO: 491465

SEQ ID NO: 528032 - RNA, 64 nt, hsa; identical to SEQ ID NO: 491466

SEQ ID NO: 528033 - RNA, 64 nt, hsa; identical to SEQ ID NO: 491467

SEQ ID NO: 528034 - RNA, 64 nt, hsa; identical to SEQ ID NO: 491468

SEQ ID NO: 528035 - RNA, 64 nt, hsa; identical to SEQ ID NO: 491469

SEQ ID NO: 528036 - RNA, 64 nt, hsa; identical to SEQ ID NO: 491470

SEQ ID NO: 528037 - RNA, 64 nt, hsa; identical to SEQ ID NO: 491471

SEQ ID NO: 528038 - RNA, 64 nt, hsa; identical to SEQ ID NO: 491472

SEQ ID NO: 528039 - RNA, 64 nt, hsa; identical to SEQ ID NO: 491473

SEQ ID NO: 528040 - RNA, 64 nt, hsa; identical to SEQ ID NO: 491474

SEQ ID NO: 528041 - RNA, 64 nt, hsa; identical to SEQ ID NO: 491475

SEQ ID NO: 528042 - RNA, 64 nt, hsa; identical to SEQ ID NO: 491476

SEQ ID NO: 528043 - RNA, 65 nt, hsa; identical to SEQ ID NO: 393598

SEQ ID NO: 528044 - RNA, 65 nt, hsa; identical to SEQ ID NO: 393599

SEQ ID NO: 528045 - RNA, 65 nt, hsa; identical to SEQ ID NO: 393600

SEQ ID NO: 528046 - RNA, 65 nt, hsa; identical to SEQ ID NO: 393601

SEQ ID NO: 528047 - RNA, 65 nt, hsa; identical to SEQ ID NO: 393602

SEQ ID NO: 528048 - RNA, 65 nt, hsa; identical to SEQ ID NO: 393603

SEQ ID NO: 528049 - RNA, 65 nt, hsa; identical to SEQ ID NO: 393604

SEQ ID NO: 528050 - RNA, 65 nt, hsa; identical to SEQ ID NO: 393605

SEQ ID NO: 528051 - RNA, 65 nt, hsa; identical to SEQ ID NO: 393606

SEQ ID NO: 528052 - RNA, 65 nt, hsa; identical to SEQ ID NO: 393607

SEQ ID NO: 528053 - RNA, 65 nt, hsa; identical to SEQ ID NO: 393608

SEQ ID NO: 528054 - RNA, 65 nt, hsa; identical to SEQ ID NO: 393609

SEQ ID NO: 528055 - RNA, 65 nt, hsa; identical to SEQ ID NO: 393610

SEQ ID NO: 528056 - RNA, 65 nt, hsa; identical to SEQ ID NO: 393611

SEQ ID NO: 528057 - RNA, 65 nt, hsa; identical to SEQ ID NO: 393612

SEQ ID NO: 528058 - RNA, 65 nt, hsa; identical to SEQ ID NO: 393613

SEQ ID NO: 528059 - RNA, 65 nt, hsa; identical to SEQ ID NO: 393614

SEQ ID NO: 528060 - RNA, 65 nt, hsa; identical to SEQ ID NO: 393615

SEQ ID NO: 528061 - RNA, 65 nt, hsa; identical to SEQ ID NO: 393616

SEQ ID NO: 528062 - RNA, 65 nt, hsa; identical to SEQ ID NO: 393617

SEQ ID NO: 528063 - RNA, 65 nt, hsa; identical to SEQ ID NO: 393618

SEQ ID NO: 528064 - RNA, 65 nt, hsa; identical to SEQ ID NO: 393619

SEQ ID NO: 528065 - RNA, 65 nt, hsa; identical to SEQ ID NO: 393620

SEQ ID NO: 528066 - RNA, 65 nt, hsa; identical to SEQ ID NO: 393621

SEQ ID NO: 528067 - RNA, 65 nt, hsa; identical to SEQ ID NO: 393622

SEQ ID NO: 528068 - RNA, 65 nt, hsa; identical to SEQ ID NO: 393623

SEQ ID NO: 528069 - RNA, 65 nt, hsa; identical to SEQ ID NO: 393624

SEQ ID NO: 528070 - RNA, 65 nt, hsa; identical to SEQ ID NO: 393625

SEQ ID NO: 528071 - RNA, 65 nt, hsa; identical to SEQ ID NO: 393626

SEQ ID NO: 528072 - RNA, 65 nt, hsa; identical to SEQ ID NO: 393627

SEQ ID NO: 528073 - RNA, 65 nt, hsa; identical to SEQ ID NO: 393628

SEQ ID NO: 528074 - RNA, 65 nt, hsa; identical to SEQ ID NO: 393629

SEQ ID NO: 528075 - RNA, 65 nt, hsa; identical to SEQ ID NO: 393630

SEQ ID NO: 528076 - RNA, 65 nt, hsa; identical to SEQ ID NO: 393631

SEQ ID NO: 528077 - RNA, 65 nt, hsa; identical to SEQ ID NO: 393632

SEQ ID NO: 528078 - RNA, 65 nt, hsa; identical to SEQ ID NO: 393633

SEQ ID NO: 528079 - RNA, 65 nt, hsa; identical to SEQ ID NO: 393634

SEQ ID NO: 528080 - RNA, 65 nt, hsa; identical to SEQ ID NO: 393635

SEQ ID NO: 528081 - RNA, 65 nt, hsa; identical to SEQ ID NO: 393636

SEQ ID NO: 528082 - RNA, 65 nt, hsa; identical to SEQ ID NO: 393637

SEQ ID NO: 528083 - RNA, 65 nt, hsa; identical to SEQ ID NO: 393638

SEQ ID NO: 528084 - RNA, 65 nt, hsa; identical to SEQ ID NO: 393639

SEQ ID NO: 528085 - RNA, 65 nt, hsa; identical to SEQ ID NO: 393640

SEQ ID NO: 528086 - RNA, 65 nt, hsa; identical to SEQ ID NO: 393641

SEQ ID NO: 528087 - RNA, 65 nt, hsa; identical to SEQ ID NO: 393642

SEQ ID NO: 528088 - RNA, 65 nt, hsa; identical to SEQ ID NO: 393643

SEQ ID NO: 528089 - RNA, 65 nt, hsa; identical to SEQ ID NO: 393644

SEQ ID NO: 528090 - RNA, 65 nt, hsa; identical to SEQ ID NO: 393645

SEQ ID NO: 528091 - RNA, 65 nt, hsa; identical to SEQ ID NO: 393646

SEQ ID NO: 528092 - RNA, 65 nt, hsa; identical to SEQ ID NO: 393647

SEQ ID NO: 528093 - RNA, 65 nt, hsa; identical to SEQ ID NO: 393648

SEQ ID NO: 528094 - RNA, 65 nt, hsa; identical to SEQ ID NO: 393649

SEQ ID NO: 528095 - RNA, 65 nt, hsa; identical to SEQ ID NO: 393650

SEQ ID NO: 528096 - RNA, 65 nt, hsa; identical to SEQ ID NO: 393651

SEQ ID NO: 528097 - RNA, 65 nt, hsa; identical to SEQ ID NO: 393652

SEQ ID NO: 528098 - RNA, 65 nt, hsa; identical to SEQ ID NO: 393653

SEQ ID NO: 528099 - RNA, 65 nt, hsa; identical to SEQ ID NO: 393654

SEQ ID NO: 528100 - RNA, 65 nt, hsa; identical to SEQ ID NO: 393655

SEQ ID NO: 528101 - RNA, 65 nt, hsa; identical to SEQ ID NO: 393656

SEQ ID NO: 528102 - RNA, 65 nt, hsa; identical to SEQ ID NO: 393657

SEQ ID NO: 528103 - RNA, 65 nt, hsa; identical to SEQ ID NO: 393658

SEQ ID NO: 528104 - RNA, 65 nt, hsa; identical to SEQ ID NO: 393659

SEQ ID NO: 528105 - RNA, 65 nt, hsa; identical to SEQ ID NO: 393660

SEQ ID NO: 528106 - RNA, 64 nt, hsa; identical to SEQ ID NO: 409180

SEQ ID NO: 528107 - RNA, 64 nt, hsa; identical to SEQ ID NO: 409181

SEQ ID NO: 528108 - RNA, 64 nt, hsa; identical to SEQ ID NO: 409182

SEQ ID NO: 528109 - RNA, 64 nt, hsa; identical to SEQ ID NO: 409183

SEQ ID NO: 528110 - RNA, 64 nt, hsa; identical to SEQ ID NO: 409184

SEQ ID NO: 528111 - RNA, 64 nt, hsa; identical to SEQ ID NO: 409185

SEQ ID NO: 528112 - RNA, 64 nt, hsa; identical to SEQ ID NO: 409186

SEQ ID NO: 528113 - RNA, 64 nt, hsa; identical to SEQ ID NO: 409187

SEQ ID NO: 528114 - RNA, 64 nt, hsa; identical to SEQ ID NO: 409188

SEQ ID NO: 528115 - RNA, 64 nt, hsa; identical to SEQ ID NO: 409189

SEQ ID NO: 528116 - RNA, 64 nt, hsa; identical to SEQ ID NO: 409190

SEQ ID NO: 528117 - RNA, 64 nt, hsa; identical to SEQ ID NO: 409191

SEQ ID NO: 528118 - RNA, 64 nt, hsa; identical to SEQ ID NO: 409192

SEQ ID NO: 528119 - RNA, 64 nt, hsa; identical to SEQ ID NO: 409193

SEQ ID NO: 528120 - RNA, 64 nt, hsa; identical to SEQ ID NO: 409194

SEQ ID NO: 528121 - RNA, 64 nt, hsa; identical to SEQ ID NO: 409195

SEQ ID NO: 528122 - RNA, 64 nt, hsa; identical to SEQ ID NO: 409196

SEQ ID NO: 528123 - RNA, 64 nt, hsa; identical to SEQ ID NO: 409197

SEQ ID NO: 528124 - RNA, 64 nt, hsa; identical to SEQ ID NO: 85524

SEQ ID NO: 528125 - RNA, 64 nt, hsa; identical to SEQ ID NO: 85525

SEQ ID NO: 528126 - RNA, 64 nt, hsa; identical to SEQ ID NO: 85526

SEQ ID NO: 528127 - RNA, 64 nt, hsa; identical to SEQ ID NO: 85527

SEQ ID NO: 528128 - RNA, 64 nt, hsa; identical to SEQ ID NO: 85528

SEQ ID NO: 528129 - RNA, 64 nt, hsa; identical to SEQ ID NO: 85529

SEQ ID NO: 528130 - RNA, 64 nt, hsa; identical to SEQ ID NO: 85530

SEQ ID NO: 528131 - RNA, 64 nt, hsa; identical to SEQ ID NO: 85531

SEQ ID NO: 528132 - RNA, 64 nt, hsa; identical to SEQ ID NO: 85532

SEQ ID NO: 528133 - RNA, 64 nt, hsa; identical to SEQ ID NO: 85533

SEQ ID NO: 528134 - RNA, 64 nt, hsa; identical to SEQ ID NO: 85534

SEQ ID NO: 528135 - RNA, 64 nt, hsa; identical to SEQ ID NO: 85535

SEQ ID NO: 528136 - RNA, 55 nt, hsa; identical to SEQ ID NO: 85536

SEQ ID NO: 528137 - RNA, 64 nt, hsa; identical to SEQ ID NO: 85537

SEQ ID NO: 528138 - RNA, 64 nt, hsa; identical to SEQ ID NO: 85538

SEQ ID NO: 528139 - RNA, 64 nt, hsa; identical to SEQ ID NO: 85539

SEQ ID NO: 528140 - RNA, 64 nt, hsa; identical to SEQ ID NO: 85540

SEQ ID NO: 528141 - RNA, 64 nt, hsa; identical to SEQ ID NO: 85541

SEQ ID NO: 528142 - RNA, 64 nt, hsa; identical to SEQ ID NO: 85542

SEQ ID NO: 528143 - RNA, 64 nt, hsa; identical to SEQ ID NO: 85543

SEQ ID NO: 528144 - RNA, 64 nt, hsa; identical to SEQ ID NO: 85544

SEQ ID NO: 528145 - RNA, 64 nt, hsa; identical to SEQ ID NO: 85545

SEQ ID NO: 528146 - RNA, 64 nt, hsa; identical to SEQ ID NO: 85546

SEQ ID NO: 528147 - RNA, 64 nt, hsa; identical to SEQ ID NO: 85547

SEQ ID NO: 528148 - RNA, 64 nt, hsa; identical to SEQ ID NO: 85548

SEQ ID NO: 528149 - RNA, 64 nt, hsa; identical to SEQ ID NO: 85549

SEQ ID NO: 528150 - RNA, 64 nt, hsa; identical to SEQ ID NO: 85550

SEQ ID NO: 528151 - RNA, 64 nt, hsa; identical to SEQ ID NO: 85551

SEQ ID NO: 528152 - RNA, 64 nt, hsa; identical to SEQ ID NO: 85552

SEQ ID NO: 528153 - RNA, 64 nt, hsa; identical to SEQ ID NO: 85553

SEQ ID NO: 528154 - RNA, 64 nt, hsa; identical to SEQ ID NO: 85554

SEQ ID NO: 528155 - RNA, 64 nt, hsa; identical to SEQ ID NO: 85555

SEQ ID NO: 528156 - RNA, 64 nt, hsa; identical to SEQ ID NO: 85556

SEQ ID NO: 528157 - RNA, 64 nt, hsa; identical to SEQ ID NO: 85557

SEQ ID NO: 528158 - RNA, 64 nt, hsa; identical to SEQ ID NO: 85558

SEQ ID NO: 528159 - RNA, 64 nt, hsa; identical to SEQ ID NO: 85559

SEQ ID NO: 528160 - RNA, 64 nt, hsa; identical to SEQ ID NO: 85560

SEQ ID NO: 528161 - RNA, 64 nt, hsa; identical to SEQ ID NO: 85561

SEQ ID NO: 528162 - RNA, 64 nt, hsa; identical to SEQ ID NO: 85562

SEQ ID NO: 528163 - RNA, 64 nt, hsa; identical to SEQ ID NO: 85563

SEQ ID NO: 528164 - RNA, 62 nt, hsa; identical to SEQ ID NO: 85564

SEQ ID NO: 528165 - RNA, 57 nt, hsa; identical to SEQ ID NO: 85565

SEQ ID NO: 528166 - RNA, 64 nt, hsa; identical to SEQ ID NO: 85566

SEQ ID NO: 528167 - RNA, 64 nt, hsa; identical to SEQ ID NO: 85567

SEQ ID NO: 528168 - RNA, 64 nt, hsa; identical to SEQ ID NO: 85568

SEQ ID NO: 528169 - RNA, 64 nt, hsa; identical to SEQ ID NO: 85569

SEQ ID NO: 528170 - RNA, 64 nt, hsa; identical to SEQ ID NO: 85570

SEQ ID NO: 528171 - RNA, 64 nt, hsa; identical to SEQ ID NO: 85571

SEQ ID NO: 528172 - RNA, 61 nt, hsa
aagaauaggggcaagacgacaaaaguaccuuugaauaaaacaauuuaagaaauugguuuaa

SEQ ID NO: 528173 - RNA, 61 nt, hsa
guauuuuuaguaacagaagcaucugguucugugaauaaaggaauguauagauguuuggaug

SEQ ID NO: 528174 - RNA, 61 nt, hsa
ugggcaucuaacuguuacaccaaaucuuaagugaauaaaacuuuaccaaggcuucucaguu

SEQ ID NO: 528175 - RNA, 61 nt, hsa
uaguuuugccaauagaaaaugcuucuuccauugaauaaaaguuauuucaaauugaauuugu

SEQ ID NO: 528176 - RNA, 61 nt, hsa
agggcacaaaaugaaugaauaaauaaauaaaugaauaaagacaaaagccaagguguaugcu

SEQ ID NO: 528177 - RNA, 61 nt, hsa
cugguucauucccagaagggcacaaaaugaaugaauaaauaaauaaaugaauaaagacaaa

SEQ ID NO: 528178 - RNA, 61 nt, hsa
gggacuggcagcccauccaaguguauaugaaugaauaaagcauccaaguauauaugaauga

SEQ ID NO: 528179 - RNA, 61 nt, hsa
ugaaugaauaaagcauccaaguauauaugaaugaauaaaguauguaaguaucaccagaaaa

SEQ ID NO: 528180 - RNA, 61 nt, hsa
auuuugugauuugucuauauuguugcauuuaugaauaaaucauuuaucugcugcugaguag

SEQ ID NO: 528181 - RNA, 61 nt, hsa
gaugauggacauuaauaguucuaggcuauuaugaauaaaguuuccaugaacaucuauguac

SEQ ID NO: 528182 - RNA, 61 nt, hsa
gguuuuucuaugggcauguuuuuaauucauuugaauaaauaccaagagcuucagugcugga

SEQ ID NO: 528183 - RNA, 61 nt, hsa
cuucuuggugguuuccaaguuuuggcaauuaugaauaaagcuguuguaaacaucuuugugc

SEQ ID NO: 528184 - RNA, 61 nt, hsa
aaagaaaaacacagcaugagaacacaguaaaugaauaaaaccauaaaauauuuagccccuc

SEQ ID NO: 528185 - RNA, 61 nt, hsa
gcaaauaaugaaagagcucgguaaagcauucugaauaaauucagccugacugaauuuucag

SEQ ID NO: 528186 - RNA, 61 nt, hsa
acuaacugagcuccuucacuuaaaaaucagcugaauaaauuccuuaaguauacuucaagac

SEQ ID NO: 528187 - RNA, 61 nt, hsa
ugucauuuguaugagagaggaucauggacaaugaauaaaugcacacuucugacuauaauuu

SEQ ID NO: 528188 - RNA, 61 nt, hsa
uucacuuaacuucuccauggcugcuuccugcugaauaaauagggacaggcauaauggauag

SEQ ID NO: 528189 - RNA, 61 nt, hsa
gguuuucuuuuucuuaguaugggaguguccaugaauaaauucaugggcauccucauaacuc

SEQ ID NO: 528190 - RNA, 61 nt, hsa
ggaugugcuggucccccuacucugugugugcugaauaaauggcuuguaaagaaguuuuucc

SEQ ID NO: 528191 - RNA, 61 nt, hsa
uggagucuucuuuagugccaguccuugugguugaauaaaaaggaugguccgcuuucuauug

SEQ ID NO: 528192 - RNA, 61 nt, hsa
aguguuuccauguuauggaucucucugcguuugaauaaagacuaucucuguugcucacaaa

SEQ ID NO: 528193 - RNA, 61 nt, hsa
gggcgcauccaagcgggggccacuugagaagugaauaaauggggcgguuucggaagcguca

SEQ ID NO: 528194 - RNA, 61 nt, hsa
acagauaucauuucaggugacuuaacaugaaugaauaaaagucaaugcuauuggauuguuu

SEQ ID NO: 528195 - RNA, 61 nt, hsa
cuaucuuccaauacacuguuuaauauagcacugaauaaaugaugcaaguugucaauggaug

SEQ ID NO: 528196 - RNA, 61 nt, hsa
uaagaguuggggggaguaucuauaguaaacuugaauaaaggggacaaagcuagaacuuauu

SEQ ID NO: 528197 - RNA, 61 nt, hsa
aguuuuaagcacauaauguaauucuaaaagaugaauaaacuagagagguucacuuugugcc

SEQ ID NO: 528198 - RNA, 61 nt, hsa
auuauagagaaugauuauaugauguuuguaaugaauaaaauaguaguuucauuauuuggca

SEQ ID NO: 528199 - RNA, 61 nt, hsa
uuuuucugugauuaugaaaugcaauaaaaucugaauaaagggcaaaguuucuuccugauca

SEQ ID NO: 528200 - RNA, 61 nt, hsa
cuuaguagaauacagagcuuugguaauuacaugaauaaaauuaagaaaauagccauauaca

SEQ ID NO: 528201 - RNA, 61 nt, hsa
acuuuauaguuugggagacagaaucaggucuugaauaaaauaauuguaaugagugcuaaau

SEQ ID NO: 528202 - RNA, 61 nt, hsa
gguuuuguuauugguuuuuuuuuguaaagugugaauaaaagguauguuuacucauuuuucc

SEQ ID NO: 528203 - RNA, 61 nt, hsa
cagacagcucuuugaugagggugaugggaacugaauaaaccauacggacuggcaguaacaa

SEQ ID NO: 528204 - RNA, 61 nt, hsa
aguaauggauguuuguuuuuuguguaauuugugaauaaauaguuuuuuucugcauuuugaa

SEQ ID NO: 528205 - RNA, 61 nt, hsa
uaaaaaaguagggcuguuauuagagugccaaugaauaaauaacuuaagcacaaaauacaua

SEQ ID NO: 528206 - RNA, 61 nt, hsa
uuuuguuucuuagggaaaacagucugagaaaugaauaaaaagcaugaaguacgugugugug

SEQ ID NO: 528207 - RNA, 61 nt, hsa
ggguuucagcauccaccaaugaacugaaaggugaauaaaggacguucaugagaaaucgacu

SEQ ID NO: 528208 - RNA, 61 nt, hsa
uacuagauugaauuuauuuagugaaugcuccugaauaaaugugcauuccucuuuuagagua

SEQ ID NO: 528209 - RNA, 61 nt, hsa
gugcauguuucuaauugacuuacugggaaacugaauaaaauaugccucuuauuaucauauu

SEQ ID NO: 528210 - RNA, 61 nt, hsa
cccagauggaccaaguggggccggggagggaugaauaaacacccuaccccgugcccugucu

SEQ ID NO: 528211 - RNA, 61 nt, hsa
gcuuggaccgauguccccauauguacagaacugaauaaagugggucucugagaagucugau

SEQ ID NO: 528212 - RNA, 61 nt, hsa
agugcuggucucacagcuuaauauuugguaaugaauaaauucugcuagugguauauguuga

SEQ ID NO: 528213 - RNA, 61 nt, hsa
guuuuuaaaagaucgaucuacauacaauagaugaauaaauguuuucagugauaugaaaagg

SEQ ID NO: 528214 - RNA, 61 nt, hsa
uagcuuucguuccuuagaaugucuuuucuuuugaauaaacaguauugggugauuuauuaaa

SEQ ID NO: 528215 - RNA, 61 nt, hsa
uggccauggcggacacucagcauuuguugauugaauaaauguuagcucuucucauugugaa

SEQ ID NO: 528216 - RNA, 61 nt, hsa
uugaaaccauauggugugugauuaaaaaaaaugaauaaauugugaagaacugguuuugguu

SEQ ID NO: 528217 - RNA, 61 nt, hsa
ggaaaaguuaacuuguuaaauucuuuugaauugaauaaaaaaaugcauugaaaccauaugg

SEQ ID NO: 528218 - RNA, 61 nt, hsa
cuuacacaauucaguuaagaugcuuugacacugaauaaaauauugauuucaugaaaucauu

SEQ ID NO: 528219 - RNA, 61 nt, hsa
guaccuaaguggauauagauaacugcauaaaugaauaaauucagaauuaacuccuucaaua

SEQ ID NO: 528220 - RNA, 61 nt, hsa
cuagcaaucuauaaagugcaccaggucaacuugaauaaaaacacuaugacagacagguuug

SEQ ID NO: 528221 - RNA, 61 nt, hsa
aaucugauggcucacugauuuuugaaaagccugaauaaaauuggaaagacuggaaaguuag

SEQ ID NO: 528222 - RNA, 61 nt, hsa
uucuguugauuuuuuaagccacaugcuaugaugaauaaacugauuuauuuucuaccauuac

SEQ ID NO: 528223 - RNA, 61 nt, hsa
aaacuuuuuuaaagauguuagucuuguagcgugaauaaauuugccaucaccuuuugugugg

SEQ ID NO: 528224 - RNA, 61 nt, hsa
gugcuguaguauaugaugaaagauguaaagcugaauaaagcauuauuucugcccuagaguu

SEQ ID NO: 528225 - RNA, 61 nt, hsa
uauuuucauaauucuauguguauuuuuauuuugaauaaacagaaagaaauuuuggguuuuu

SEQ ID NO: 528226 - RNA, 61 nt, hsa
uggucuacacauucugauuuuuuuuuuagauugaauaaaauuuguaaaucauuauuuucau

SEQ ID NO: 528227 - RNA, 61 nt, hsa
caacacagcaagacucugucucaaaaauaaaugaauaaaauaaaaaccugccaccaaauua

SEQ ID NO: 528228 - RNA, 61 nt, hsa
gaaaaaaaaauaugcauuugcuuaguuuauuugaauaaaagcucuaaaccuagguuauaua

SEQ ID NO: 528229 - RNA, 61 nt, hsa
ugugggcugaugcagggaagcucugaagcagugaauaaagguguuucgggcccuguaagug

SEQ ID NO: 528230 - RNA, 61 nt, hsa
aggaaggccccagcccuaguccuaggcgacuugaauaaagugggaggucaaacaugggccu

SEQ ID NO: 528231 - RNA, 61 nt, hsa
aagaacgaagcaggauguugucacucccgucugaauaaagcuccaugagcuggguuggaaa

SEQ ID NO: 528232 - RNA, 61 nt, hsa
uguccagcauaugguagauacuuguaguguuugaauaaaugaaaccagcauuagagcuuua

SEQ ID NO: 528233 - RNA, 61 nt, hsa
cuggguguuccacagcugauagugauugccuugaauaaauucaagggcaauuuauucauuu

SEQ ID NO: 528234 - RNA, 61 nt, hsa
aaauaucaaggauucuaguaauuguauuuccugaauaaauguauguuuaugaauuuucuaa

SEQ ID NO: 528235 - RNA, 61 nt, hsa
gggaauuuuuaucuuagaaauggaugauucgugaauaaaacuagguacauaguaaguguau

SEQ ID NO: 528236 - RNA, 61 nt, hsa
uaggaaaauaagagaaagguaagggcucuuuugaauaaacugcuguuuuauuuguggcaca

SEQ ID NO: 528237 - RNA, 61 nt, hsa
uuguuuauaccagucuuaaagauccagguucugaauaaaaaaauuaauugauacaauugau

SEQ ID NO: 528238 - RNA, 61 nt, hsa
guagauuaauguugugacuauucagaaaaggugaauaaaauugggauauaaaauggacucu

SEQ ID NO: 528239 - RNA, 61 nt, hsa
uugguaauaauguuggcaaguaauaguuaucugaauaaaucaaucauauaagaauguauag

SEQ ID NO: 528240 - RNA, 61 nt, hsa
auuuacacaagagauggcuuuuuccuuugcuugaauaaacauuuuggaucaccuccaaaga

SEQ ID NO: 528241 - RNA, 61 nt, hsa
cauggauugccaauuuuuaaaacacuaaaguugaauaaaaugcaugaacaauagaaaaaug

SEQ ID NO: 528242 - RNA, 61 nt, hsa
gaauucccuguuaguugauuuaaauccuuucugaauaaagaucagauaaacaguaacugaa

SEQ ID NO: 528243 - RNA, 61 nt, hsa
auauaaaagguagacagcugauauguuuucaugaauaaauauugucagccagaaaagguug

SEQ ID NO: 528244 - RNA, 61 nt, hsa
cuuuuuuuuuuuuuuuggucaagcuugaggcugaauaaagccuuugaugcacaaaauggga

SEQ ID NO: 528245 - RNA, 61 nt, hsa
uuucagacacauuuuuggauuucugugaaguugaauaaacauaaaagcuaauacaguugua

SEQ ID NO: 528246 - RNA, 61 nt, hsa
uauggugagagugaugaauuguuggaucauuugaauaaaaucuuuuacuaaccccaugaua

SEQ ID NO: 528247 - RNA, 61 nt, hsa
uaugcagaggcagcccucaauaugcagugguugaauaaaugaaugaagaaaccacuaucaa

SEQ ID NO: 528248 - RNA, 61 nt, hsa
gcauauuaaaauaagcagagaaaaaaaaaugugaauaaacuacugaaaacacuugguguuu

SEQ ID NO: 528249 - RNA, 61 nt, hsa
cacaucacuguagaauuugagugaucuaugcugaauaaacaguggaaugugaccagucaag

SEQ ID NO: 528250 - RNA, 61 nt, hsa
aauccagaauguucuaacaauaaguuuucagugaauaaaccacuggcaagacaauuccaug

SEQ ID NO: 528251 - RNA, 61 nt, hsa
cuugauuuauuauacuuaccaaagcugcaacugaauaaaucuggugaggugaggccuucaa

SEQ ID NO: 528252 - RNA, 61 nt, hsa
auaaugcgccucuugaggagaaaagcaauaaugaauaaaaggacuuuccuacaauaacuuc

SEQ ID NO: 528253 - RNA, 61 nt, hsa
auguauugguaaugaugucauuaaaaguauaugaauaaaaauaugaguaacaucauaaaaa

SEQ ID NO: 528254 - RNA, 61 nt, hsa
uuguaucauuuguuuuccucaucuaaaaaguugaauaaaaucuguuugauucaguucuccu

SEQ ID NO: 528255 - RNA, 61 nt, hsa
ggaacauaguaagggcucaguaaauacuuguugaauaaacucagucuccuacauuagcauu

SEQ ID NO: 528256 - RNA, 61 nt, hsa
cagccccauuuugcugaaaauaaugacuuucugaauaaagauggcaacacaauuuuuucuc

SEQ ID NO: 528257 - RNA, 61 nt, hsa
aaagugccagcccugaagcuggagccguuugugaauaaacuguucuucaucauugacacug

SEQ ID NO: 528258 - RNA, 61 nt, hsa
ggagauggauuuaguuauucaauuuuguggaugaauaaauugaggcacagaaagauuaagu

SEQ ID NO: 528259 - RNA, 61 nt, hsa
uugguuucuuuuacuuaccugcuugaauacuugaauaaaccauucaccaauuuuaauccuu

SEQ ID NO: 528260 - RNA, 61 nt, hsa
caagaguguuuggcucccaguuuggacuuggugaauaaauguaccuuagaacuaggauaau

SEQ ID NO: 528261 - RNA, 61 nt, hsa
ucauuuuuaaaauuccuaauuuucagaaauaugaauaaauaguuuuuguuaaacccuuugu

SEQ ID NO: 528262 - RNA, 61 nt, hsa
ccuauggucuugucugaauaaacuacucuccugaauaaaacaacauccaacccaggucauu

SEQ ID NO: 528263 - RNA, 61 nt, hsa
uuuuucuuuucuuucuuccuauggucuugucugaauaaacuacucuccugaauaaaacaac

SEQ ID NO: 528264 - RNA, 61 nt, hsa
augauguuuguaagaccauguuuguaagacaugaauaaauugcugcuuuugcccaacccgu

SEQ ID NO: 528265 - RNA, 61 nt, hsa
uguaccuuugugaaauuguugaauuaguuagugaauaaagaaauaaacuucaacuagaaau

SEQ ID NO: 528266 - RNA, 61 nt, hsa
ugaacauauuguaaugaugcuucugugaauuugaauaaaaucaacacuaaccagcccuagu

SEQ ID NO: 528267 - RNA, 61 nt, hsa
gggaaacaaaugcugucucuugugaaauagaugaauaaaaugugauaguaacauaguagag

SEQ ID NO: 528268 - RNA, 61 nt, hsa
acuuagaggggagagaugaaagccaaacaaaugaauaaacauaaaugauaccaucagugcu

SEQ ID NO: 528269 - RNA, 61 nt, hsa
aaggaaaaggagagaaaaaagaaauugguuaugaauaaaagugacaauaaaacaugagaua

SEQ ID NO: 528270 - RNA, 61 nt, hsa
aaaggaaaucuugaggucauauacugaaauaugaauaaauuaaaauaaugaauucagaucu

SEQ ID NO: 528271 - RNA, 61 nt, hsa
cuuuuucuuaaaagaaaaauauuuugggguuugaauaaaauggaccaccauuucucauugg

SEQ ID NO: 528272 - RNA, 61 nt, hsa
aaccagcaugguuugacaccacaugggaacaugaauaaaucugucucaugauuugaaaagu

SEQ ID NO: 528273 - RNA, 61 nt, hsa
ucaagugcauugaggggcaguuuuguuugccugaauaaacguaaaggacaaguaaacaauu

SEQ ID NO: 528274 - RNA, 61 nt, hsa
uuuguauuuaugucuugagacaguaacuuuuugaauaaaaauaaaccuacaguauguugua

SEQ ID NO: 528275 - RNA, 61 nt, hsa
aaauguauaaaaagaauuaguguaugcuuccugaauaaaaaggagccaaaguugaucagaa

SEQ ID NO: 528276 - RNA, 61 nt, hsa
cgggaagggcuuggucuggauguagagagggugaauaaaauugccaagagagauauugaac

SEQ ID NO: 528277 - RNA, 64 nt, hsa
gagacuccgucucaaaaaaaaaaaaaaaaaaaguaauuggcagugacuaugggcgcacugccua

SEQ ID NO: 528278 - RNA, 64 nt, hsa
cucuaauuacauaugauguucucuguucaaaaguaauuggcagugauuggccaggcgcaguggc

SEQ ID NO: 528279 - RNA, 64 nt, hsa
aaccgagggcuccaguaacaccuucuaaccugugaauuggcagaaaaggguagcgguaucaugu

SEQ ID NO: 528280 - RNA, 64 nt, hsa
cugcacacacacccacuuuaguacaguuccugucaauuggcaacauggagagggugaccuggcu

SEQ ID NO: 528281 - RNA, 64 nt, hsa
ugggucagauaacccuguggcagugacacgggcaaauuggcauuugaauaaagcccugggacca

SEQ ID NO: 528282 - RNA, 64 nt, hsa
uuaauuaagauuucauuaugauggaaggagacauaauuggcagaucuuugccaucucucuuuga

SEQ ID NO: 528283 - RNA, 64 nt, hsa
aaaagaaauaauuggcaaagagagcuggaaacuaaauuggcaacauguugauaauuuaagugga

SEQ ID NO: 528284 - RNA, 64 nt, hsa
cacauuuggauuaaaauauucuagcaaaagaaauaauuggcaaagagagcuggaaacuaaauug

SEQ ID NO: 528285 - RNA, 64 nt, hsa
caaagagugggaaggccugggauuugcugcugcucccuuagagcagggccccucuuuucagcac

SEQ ID NO: 528286 - RNA, 64 nt, hsa
caccauuucugugggccuagaauauggcccucaacccuuagaguggggcagugagggcuugagg

SEQ ID NO: 528287 - RNA, 64 nt, hsa
auugaauacuuacauucucuaauaagaaaaccaccccuuagauugaaguaaacugcaguccugg

SEQ ID NO: 528288 - RNA, 64 nt, hsa
guggugauauagaauuagcuuuuucauccccuuacccuuagaauccacguauuccccuucccac

SEQ ID NO: 528289 - RNA, 64 nt, hsa; identical to SEQ ID NO: 265947

SEQ ID NO: 528290 - RNA, 64 nt, hsa; identical to SEQ ID NO: 265948

SEQ ID NO: 528291 - RNA, 64 nt, hsa; identical to SEQ ID NO: 265949

SEQ ID NO: 528292 - RNA, 64 nt, hsa; identical to SEQ ID NO: 265950

SEQ ID NO: 528293 - RNA, 64 nt, hsa; identical to SEQ ID NO: 265951

SEQ ID NO: 528294 - RNA, 64 nt, hsa; identical to SEQ ID NO: 265952

SEQ ID NO: 528295 - RNA, 64 nt, hsa; identical to SEQ ID NO: 265953

SEQ ID NO: 528296 - RNA, 64 nt, hsa; identical to SEQ ID NO: 265954

SEQ ID NO: 528297 - RNA, 64 nt, hsa; identical to SEQ ID NO: 265955

SEQ ID NO: 528298 - RNA, 64 nt, hsa; identical to SEQ ID NO: 265956

SEQ ID NO: 528299 - RNA, 64 nt, hsa; identical to SEQ ID NO: 265957

SEQ ID NO: 528300 - RNA, 64 nt, hsa; identical to SEQ ID NO: 265958

SEQ ID NO: 528301 - RNA, 64 nt, hsa; identical to SEQ ID NO: 265959

SEQ ID NO: 528302 - RNA, 64 nt, hsa; identical to SEQ ID NO: 265960

SEQ ID NO: 528303 - RNA, 64 nt, hsa; identical to SEQ ID NO: 265961

SEQ ID NO: 528304 - RNA, 64 nt, hsa; identical to SEQ ID NO: 265962

SEQ ID NO: 528305 - RNA, 64 nt, hsa; identical to SEQ ID NO: 265963

SEQ ID NO: 528306 - RNA, 64 nt, hsa; identical to SEQ ID NO: 265964

SEQ ID NO: 528307 - RNA, 64 nt, hsa; identical to SEQ ID NO: 265965

SEQ ID NO: 528308 - RNA, 64 nt, hsa; identical to SEQ ID NO: 265966

SEQ ID NO: 528309 - RNA, 64 nt, hsa; identical to SEQ ID NO: 265967

SEQ ID NO: 528310 - RNA, 64 nt, hsa; identical to SEQ ID NO: 265968

SEQ ID NO: 528311 - RNA, 64 nt, hsa; identical to SEQ ID NO: 265969

SEQ ID NO: 528312 - RNA, 64 nt, hsa; identical to SEQ ID NO: 265970

SEQ ID NO: 528313 - RNA, 64 nt, hsa; identical to SEQ ID NO: 265971

SEQ ID NO: 528314 - RNA, 64 nt, hsa; identical to SEQ ID NO: 265972

SEQ ID NO: 528315 - RNA, 64 nt, hsa; identical to SEQ ID NO: 265973

SEQ ID NO: 528316 - RNA, 64 nt, hsa; identical to SEQ ID NO: 265974

SEQ ID NO: 528317 - RNA, 64 nt, hsa; identical to SEQ ID NO: 265975

SEQ ID NO: 528318 - RNA, 64 nt, hsa; identical to SEQ ID NO: 265976

SEQ ID NO: 528319 - RNA, 64 nt, hsa; identical to SEQ ID NO: 265977

SEQ ID NO: 528320 - RNA, 64 nt, hsa; identical to SEQ ID NO: 265978

SEQ ID NO: 528321 - RNA, 64 nt, hsa; identical to SEQ ID NO: 265979

SEQ ID NO: 528322 - RNA, 64 nt, hsa; identical to SEQ ID NO: 265980

SEQ ID NO: 528323 - RNA, 64 nt, hsa; identical to SEQ ID NO: 265981

SEQ ID NO: 528324 - RNA, 64 nt, hsa; identical to SEQ ID NO: 265982

SEQ ID NO: 528325 - RNA, 64 nt, hsa; identical to SEQ ID NO: 265983

SEQ ID NO: 528326 - RNA, 64 nt, hsa; identical to SEQ ID NO: 265984

SEQ ID NO: 528327 - RNA, 64 nt, hsa; identical to SEQ ID NO: 265985

SEQ ID NO: 528328 - RNA, 64 nt, hsa; identical to SEQ ID NO: 265986

SEQ ID NO: 528329 - RNA, 64 nt, hsa; identical to SEQ ID NO: 265987

SEQ ID NO: 528330 - RNA, 64 nt, hsa; identical to SEQ ID NO: 265988

SEQ ID NO: 528331 - RNA, 64 nt, hsa; identical to SEQ ID NO: 265989

SEQ ID NO: 528332 - RNA, 64 nt, hsa; identical to SEQ ID NO: 265990

SEQ ID NO: 528333 - RNA, 64 nt, hsa; identical to SEQ ID NO: 265991

SEQ ID NO: 528334 - RNA, 64 nt, hsa; identical to SEQ ID NO: 265992

SEQ ID NO: 528335 - RNA, 64 nt, hsa; identical to SEQ ID NO: 265993

SEQ ID NO: 528336 - RNA, 64 nt, hsa; identical to SEQ ID NO: 265994

SEQ ID NO: 528337 - RNA, 64 nt, hsa; identical to SEQ ID NO: 265995

SEQ ID NO: 528338 - RNA, 64 nt, hsa; identical to SEQ ID NO: 265996

SEQ ID NO: 528339 - RNA, 64 nt, hsa; identical to SEQ ID NO: 265997

SEQ ID NO: 528340 - RNA, 64 nt, hsa; identical to SEQ ID NO: 265998

SEQ ID NO: 528341 - RNA, 64 nt, hsa; identical to SEQ ID NO: 265999

SEQ ID NO: 528342 - RNA, 64 nt, hsa; identical to SEQ ID NO: 266000

SEQ ID NO: 528343 - RNA, 64 nt, hsa; identical to SEQ ID NO: 266001

SEQ ID NO: 528344 - RNA, 64 nt, hsa; identical to SEQ ID NO: 266002

SEQ ID NO: 528345 - RNA, 64 nt, hsa; identical to SEQ ID NO: 266003

SEQ ID NO: 528346 - RNA, 64 nt, hsa; identical to SEQ ID NO: 266004

SEQ ID NO: 528347 - RNA, 64 nt, hsa; identical to SEQ ID NO: 266005

SEQ ID NO: 528348 - RNA, 64 nt, hsa; identical to SEQ ID NO: 266006

SEQ ID NO: 528349 - RNA, 64 nt, hsa; identical to SEQ ID NO: 266007

SEQ ID NO: 528350 - RNA, 64 nt, hsa; identical to SEQ ID NO: 266008

SEQ ID NO: 528351 - RNA, 64 nt, hsa; identical to SEQ ID NO: 266009

SEQ ID NO: 528352 - RNA, 64 nt, hsa; identical to SEQ ID NO: 266010

SEQ ID NO: 528353 - RNA, 64 nt, hsa; identical to SEQ ID NO: 266011

SEQ ID NO: 528354 - RNA, 64 nt, hsa; identical to SEQ ID NO: 266012

SEQ ID NO: 528355 - RNA, 64 nt, hsa; identical to SEQ ID NO: 266013

SEQ ID NO: 528356 - RNA, 64 nt, hsa; identical to SEQ ID NO: 266014

SEQ ID NO: 528357 - RNA, 64 nt, hsa; identical to SEQ ID NO: 266015

SEQ ID NO: 528358 - RNA, 64 nt, hsa; identical to SEQ ID NO: 266016

SEQ ID NO: 528359 - RNA, 64 nt, hsa; identical to SEQ ID NO: 266017

SEQ ID NO: 528360 - RNA, 64 nt, hsa; identical to SEQ ID NO: 266018

SEQ ID NO: 528361 - RNA, 64 nt, hsa; identical to SEQ ID NO: 266019

SEQ ID NO: 528362 - RNA, 64 nt, hsa; identical to SEQ ID NO: 266020

SEQ ID NO: 528363 - RNA, 64 nt, hsa; identical to SEQ ID NO: 266021

SEQ ID NO: 528364 - RNA, 64 nt, hsa; identical to SEQ ID NO: 266022

SEQ ID NO: 528365 - RNA, 64 nt, hsa; identical to SEQ ID NO: 266023

SEQ ID NO: 528366 - RNA, 64 nt, hsa; identical to SEQ ID NO: 266024

SEQ ID NO: 528367 - RNA, 64 nt, hsa; identical to SEQ ID NO: 266025

SEQ ID NO: 528368 - RNA, 64 nt, hsa; identical to SEQ ID NO: 266026

SEQ ID NO: 528369 - RNA, 64 nt, hsa; identical to SEQ ID NO: 266027

SEQ ID NO: 528370 - RNA, 64 nt, hsa; identical to SEQ ID NO: 266028

SEQ ID NO: 528371 - RNA, 64 nt, hsa; identical to SEQ ID NO: 266029

SEQ ID NO: 528372 - RNA, 64 nt, hsa; identical to SEQ ID NO: 266030

SEQ ID NO: 528373 - RNA, 64 nt, hsa; identical to SEQ ID NO: 266031

SEQ ID NO: 528374 - RNA, 64 nt, hsa; identical to SEQ ID NO: 266032

SEQ ID NO: 528375 - RNA, 64 nt, hsa; identical to SEQ ID NO: 266033

SEQ ID NO: 528376 - RNA, 64 nt, hsa; identical to SEQ ID NO: 266034

SEQ ID NO: 528377 - RNA, 64 nt, hsa; identical to SEQ ID NO: 266035

SEQ ID NO: 528378 - RNA, 64 nt, hsa; identical to SEQ ID NO: 266036

SEQ ID NO: 528379 - RNA, 64 nt, hsa; identical to SEQ ID NO: 266037

SEQ ID NO: 528380 - RNA, 64 nt, hsa; identical to SEQ ID NO: 266038

SEQ ID NO: 528381 - RNA, 64 nt, hsa; identical to SEQ ID NO: 266039

SEQ ID NO: 528382 - RNA, 64 nt, hsa; identical to SEQ ID NO: 266040

SEQ ID NO: 528383 - RNA, 64 nt, hsa; identical to SEQ ID NO: 266041

SEQ ID NO: 528384 - RNA, 64 nt, hsa; identical to SEQ ID NO: 266042

SEQ ID NO: 528385 - RNA, 64 nt, hsa; identical to SEQ ID NO: 266043

SEQ ID NO: 528386 - RNA, 64 nt, hsa; identical to SEQ ID NO: 266044

SEQ ID NO: 528387 - RNA, 64 nt, hsa; identical to SEQ ID NO: 266045

SEQ ID NO: 528388 - RNA, 64 nt, hsa; identical to SEQ ID NO: 266046

SEQ ID NO: 528389 - RNA, 64 nt, hsa; identical to SEQ ID NO: 266047

SEQ ID NO: 528390 - RNA, 64 nt, hsa; identical to SEQ ID NO: 266048

SEQ ID NO: 528391 - RNA, 64 nt, hsa; identical to SEQ ID NO: 266049

SEQ ID NO: 528392 - RNA, 64 nt, hsa; identical to SEQ ID NO: 266050

SEQ ID NO: 528393 - RNA, 64 nt, hsa; identical to SEQ ID NO: 266051

SEQ ID NO: 528394 - RNA, 64 nt, hsa; identical to SEQ ID NO: 266052

SEQ ID NO: 528395 - RNA, 64 nt, hsa; identical to SEQ ID NO: 266053

SEQ ID NO: 528396 - RNA, 64 nt, hsa; identical to SEQ ID NO: 266054

SEQ ID NO: 528397 - RNA, 64 nt, hsa; identical to SEQ ID NO: 266055

SEQ ID NO: 528398 - RNA, 64 nt, hsa; identical to SEQ ID NO: 266056

SEQ ID NO: 528399 - RNA, 64 nt, hsa; identical to SEQ ID NO: 266057

SEQ ID NO: 528400 - RNA, 64 nt, hsa; identical to SEQ ID NO: 266058

SEQ ID NO: 528401 - RNA, 64 nt, hsa; identical to SEQ ID NO: 266059

SEQ ID NO: 528402 - RNA, 64 nt, hsa; identical to SEQ ID NO: 266060

SEQ ID NO: 528403 - RNA, 64 nt, hsa; identical to SEQ ID NO: 266061

SEQ ID NO: 528404 - RNA, 64 nt, hsa; identical to SEQ ID NO: 266062

SEQ ID NO: 528405 - RNA, 64 nt, hsa; identical to SEQ ID NO: 266063

SEQ ID NO: 528406 - RNA, 64 nt, hsa; identical to SEQ ID NO: 266064

SEQ ID NO: 528407 - RNA, 64 nt, hsa; identical to SEQ ID NO: 266065

SEQ ID NO: 528408 - RNA, 64 nt, hsa; identical to SEQ ID NO: 266066

SEQ ID NO: 528409 - RNA, 64 nt, hsa; identical to SEQ ID NO: 266067

SEQ ID NO: 528410 - RNA, 64 nt, hsa; identical to SEQ ID NO: 266068

SEQ ID NO: 528411 - RNA, 64 nt, hsa; identical to SEQ ID NO: 266069

SEQ ID NO: 528412 - RNA, 64 nt, hsa; identical to SEQ ID NO: 266070

SEQ ID NO: 528413 - RNA, 64 nt, hsa; identical to SEQ ID NO: 266071

SEQ ID NO: 528414 - RNA, 64 nt, hsa; identical to SEQ ID NO: 266072

SEQ ID NO: 528415 - RNA, 64 nt, hsa; identical to SEQ ID NO: 266073

SEQ ID NO: 528416 - RNA, 64 nt, hsa; identical to SEQ ID NO: 266074

SEQ ID NO: 528417 - RNA, 64 nt, hsa; identical to SEQ ID NO: 266075

SEQ ID NO: 528418 - RNA, 64 nt, hsa; identical to SEQ ID NO: 266076

SEQ ID NO: 528419 - RNA, 64 nt, hsa; identical to SEQ ID NO: 266077

SEQ ID NO: 528420 - RNA, 64 nt, hsa; identical to SEQ ID NO: 266078

SEQ ID NO: 528421 - RNA, 64 nt, hsa; identical to SEQ ID NO: 266079

SEQ ID NO: 528422 - RNA, 64 nt, hsa; identical to SEQ ID NO: 266080

SEQ ID NO: 528423 - RNA, 64 nt, hsa; identical to SEQ ID NO: 266081

SEQ ID NO: 528424 - RNA, 64 nt, hsa; identical to SEQ ID NO: 266082

SEQ ID NO: 528425 - RNA, 64 nt, hsa; identical to SEQ ID NO: 266083

SEQ ID NO: 528426 - RNA, 64 nt, hsa; identical to SEQ ID NO: 266084

SEQ ID NO: 528427 - RNA, 64 nt, hsa; identical to SEQ ID NO: 266085

SEQ ID NO: 528428 - RNA, 64 nt, hsa; identical to SEQ ID NO: 266086

SEQ ID NO: 528429 - RNA, 64 nt, hsa; identical to SEQ ID NO: 266087

SEQ ID NO: 528430 - RNA, 64 nt, hsa; identical to SEQ ID NO: 266088

SEQ ID NO: 528431 - RNA, 64 nt, hsa; identical to SEQ ID NO: 266089

SEQ ID NO: 528432 - RNA, 64 nt, hsa; identical to SEQ ID NO: 266090

SEQ ID NO: 528433 - RNA, 64 nt, hsa; identical to SEQ ID NO: 266091

SEQ ID NO: 528434 - RNA, 64 nt, hsa; identical to SEQ ID NO: 266092

SEQ ID NO: 528435 - RNA, 64 nt, hsa; identical to SEQ ID NO: 266093

SEQ ID NO: 528436 - RNA, 64 nt, hsa; identical to SEQ ID NO: 266094

SEQ ID NO: 528437 - RNA, 64 nt, hsa; identical to SEQ ID NO: 266095

SEQ ID NO: 528438 - RNA, 64 nt, hsa; identical to SEQ ID NO: 266096

SEQ ID NO: 528439 - RNA, 64 nt, hsa; identical to SEQ ID NO: 266097

SEQ ID NO: 528440 - RNA, 64 nt, hsa; identical to SEQ ID NO: 266098

SEQ ID NO: 528441 - RNA, 64 nt, hsa; identical to SEQ ID NO: 266099

SEQ ID NO: 528442 - RNA, 64 nt, hsa; identical to SEQ ID NO: 266100

SEQ ID NO: 528443 - RNA, 64 nt, hsa; identical to SEQ ID NO: 266101

SEQ ID NO: 528444 - RNA, 64 nt, hsa; identical to SEQ ID NO: 266102

SEQ ID NO: 528445 - RNA, 64 nt, hsa; identical to SEQ ID NO: 266103

SEQ ID NO: 528446 - RNA, 64 nt, hsa; identical to SEQ ID NO: 266104

SEQ ID NO: 528447 - RNA, 64 nt, hsa; identical to SEQ ID NO: 266105

SEQ ID NO: 528448 - RNA, 64 nt, hsa; identical to SEQ ID NO: 266106

SEQ ID NO: 528449 - RNA, 64 nt, hsa; identical to SEQ ID NO: 266107

SEQ ID NO: 528450 - RNA, 64 nt, hsa; identical to SEQ ID NO: 266108

SEQ ID NO: 528451 - RNA, 64 nt, hsa; identical to SEQ ID NO: 266109

SEQ ID NO: 528452 - RNA, 64 nt, hsa; identical to SEQ ID NO: 266110

SEQ ID NO: 528453 - RNA, 64 nt, hsa; identical to SEQ ID NO: 266111

SEQ ID NO: 528454 - RNA, 64 nt, hsa; identical to SEQ ID NO: 266112

SEQ ID NO: 528455 - RNA, 64 nt, hsa; identical to SEQ ID NO: 266113

SEQ ID NO: 528456 - RNA, 64 nt, hsa; identical to SEQ ID NO: 266114

SEQ ID NO: 528457 - RNA, 64 nt, hsa; identical to SEQ ID NO: 266115

SEQ ID NO: 528458 - RNA, 64 nt, hsa; identical to SEQ ID NO: 206029

SEQ ID NO: 528459 - RNA, 64 nt, hsa; identical to SEQ ID NO: 206030

SEQ ID NO: 528460 - RNA, 64 nt, hsa; identical to SEQ ID NO: 206031

SEQ ID NO: 528461 - RNA, 64 nt, hsa; identical to SEQ ID NO: 206032

SEQ ID NO: 528462 - RNA, 64 nt, hsa; identical to SEQ ID NO: 206033

SEQ ID NO: 528463 - RNA, 64 nt, hsa; identical to SEQ ID NO: 206034

SEQ ID NO: 528464 - RNA, 64 nt, hsa; identical to SEQ ID NO: 206035

SEQ ID NO: 528465 - RNA, 64 nt, hsa; identical to SEQ ID NO: 206036

SEQ ID NO: 528466 - RNA, 64 nt, hsa; identical to SEQ ID NO: 206037

SEQ ID NO: 528467 - RNA, 64 nt, hsa; identical to SEQ ID NO: 206038

SEQ ID NO: 528468 - RNA, 64 nt, hsa; identical to SEQ ID NO: 206039

SEQ ID NO: 528469 - RNA, 64 nt, hsa; identical to SEQ ID NO: 206040

SEQ ID NO: 528470 - RNA, 64 nt, hsa; identical to SEQ ID NO: 206041

SEQ ID NO: 528471 - RNA, 64 nt, hsa; identical to SEQ ID NO: 206042

SEQ ID NO: 528472 - RNA, 64 nt, hsa; identical to SEQ ID NO: 206043

SEQ ID NO: 528473 - RNA, 64 nt, hsa; identical to SEQ ID NO: 206044

SEQ ID NO: 528474 - RNA, 64 nt, hsa; identical to SEQ ID NO: 206045

SEQ ID NO: 528475 - RNA, 64 nt, hsa; identical to SEQ ID NO: 206046

SEQ ID NO: 528476 - RNA, 64 nt, hsa; identical to SEQ ID NO: 206047

SEQ ID NO: 528477 - RNA, 64 nt, hsa; identical to SEQ ID NO: 206048

SEQ ID NO: 528478 - RNA, 64 nt, hsa; identical to SEQ ID NO: 206049

SEQ ID NO: 528479 - RNA, 64 nt, hsa; identical to SEQ ID NO: 206050

SEQ ID NO: 528480 - RNA, 64 nt, hsa; identical to SEQ ID NO: 206051

SEQ ID NO: 528481 - RNA, 64 nt, hsa; identical to SEQ ID NO: 206052

SEQ ID NO: 528482 - RNA, 64 nt, hsa; identical to SEQ ID NO: 206053

SEQ ID NO: 528483 - RNA, 64 nt, hsa; identical to SEQ ID NO: 206054

SEQ ID NO: 528484 - RNA, 64 nt, hsa; identical to SEQ ID NO: 206055

SEQ ID NO: 528485 - RNA, 64 nt, hsa; identical to SEQ ID NO: 206056

SEQ ID NO: 528486 - RNA, 64 nt, hsa; identical to SEQ ID NO: 206057

SEQ ID NO: 528487 - RNA, 64 nt, hsa; identical to SEQ ID NO: 206058

SEQ ID NO: 528488 - RNA, 64 nt, hsa; identical to SEQ ID NO: 206059

SEQ ID NO: 528489 - RNA, 64 nt, hsa; identical to SEQ ID NO: 206060

SEQ ID NO: 528490 - RNA, 64 nt, hsa; identical to SEQ ID NO: 206061

SEQ ID NO: 528491 - RNA, 64 nt, hsa; identical to SEQ ID NO: 206062

SEQ ID NO: 528492 - RNA, 64 nt, hsa; identical to SEQ ID NO: 206063

SEQ ID NO: 528493 - RNA, 64 nt, hsa; identical to SEQ ID NO: 206064

SEQ ID NO: 528494 - RNA, 64 nt, hsa; identical to SEQ ID NO: 206065

SEQ ID NO: 528495 - RNA, 64 nt, hsa; identical to SEQ ID NO: 206066

SEQ ID NO: 528496 - RNA, 64 nt, hsa; identical to SEQ ID NO: 206067

SEQ ID NO: 528497 - RNA, 64 nt, hsa; identical to SEQ ID NO: 206068

SEQ ID NO: 528498 - RNA, 64 nt, hsa; identical to SEQ ID NO: 206069

SEQ ID NO: 528499 - RNA, 64 nt, hsa; identical to SEQ ID NO: 206070

SEQ ID NO: 528500 - RNA, 64 nt, hsa; identical to SEQ ID NO: 206071

SEQ ID NO: 528501 - RNA, 64 nt, hsa; identical to SEQ ID NO: 206072

SEQ ID NO: 528502 - RNA, 64 nt, hsa; identical to SEQ ID NO: 206073

SEQ ID NO: 528503 - RNA, 64 nt, hsa; identical to SEQ ID NO: 206074

SEQ ID NO: 528504 - RNA, 64 nt, hsa; identical to SEQ ID NO: 206075

SEQ ID NO: 528505 - RNA, 64 nt, hsa; identical to SEQ ID NO: 206076

SEQ ID NO: 528506 - RNA, 64 nt, hsa; identical to SEQ ID NO: 206077

SEQ ID NO: 528507 - RNA, 64 nt, hsa; identical to SEQ ID NO: 206078

SEQ ID NO: 528508 - RNA, 64 nt, hsa
caugucuuaacaaaaugacaggucucagaaagggggagcucaauagcucaaaagugacaagucc

SEQ ID NO: 528509 - RNA, 64 nt, hsa
aguauguguguaccguaaagaauauaucuuaucuggagcucagccucaaucaugucuuaacaaa

SEQ ID NO: 528510 - RNA, 64 nt, hsa
gaagaaaaauguguuuaaaguuuuacaggaacguggagcucauguucuucugauauguagacuu

SEQ ID NO: 528511 - RNA, 64 nt, hsa
uguagucaaaagacucaucuaauuugagcugaguggagcucagcuguguuugacccacauccuc

SEQ ID NO: 528512 - RNA, 64 nt, hsa
cuauaugauacaacuguggccaugacugaggaaaggagcucacgcccagagacugggcugcucu

SEQ ID NO: 528513 - RNA, 64 nt, hsa
ccccggucauccggacaucccaacgcaugcuccuggagcucacagccuucuguggugucauuuc

SEQ ID NO: 528514 - RNA, 64 nt, hsa
cagagcaaguagacgccugccgcaagguuaauguggagcucaaauaugccuuauuuugcacaaa

SEQ ID NO: 528515 - RNA, 64 nt, hsa
ucucggagaagaucgaccagcuagagaagagccuggagcucaaguuuggugagggugggcaccg

SEQ ID NO: 528516 - RNA, 64 nt, hsa
gggacaucgugggcacugagcugaaguugaagaaggagcucacaggccucaaccacugggugcg

SEQ ID NO: 528517 - RNA, 64 nt, hsa
agcuaugagagucgggacucuccugcaccugacuggagcucagaugugggcaggaauucccaaa

SEQ ID NO: 528518 - RNA, 64 nt, hsa
cuaaggcugagcaccuccagucucuccuugauuuggagcucaguguuuaagggcuuggaaaagg

SEQ ID NO: 528519 - RNA, 60 nt, hsa
cccguagggucguugauuccugaacguaucacaucucaccugcccccuuccucgugggac

SEQ ID NO: 528520 - RNA, 60 nt, hsa
uugcgccacuauuaaggcaccugucaccuuacaucucaaucuggaaucaaagugcccugg

SEQ ID NO: 528521 - RNA, 60 nt, hsa
acaccacaccgcacugcaccauaccucaccacaucucaccacaccacagcacaccucacc

SEQ ID NO: 528522 - RNA, 60 nt, hsa
gcaccgcaccgcaccgcaccguaccucgccacaucucaccacaccacaccacaccacacc

SEQ ID NO: 528523 - RNA, 60 nt, hsa
acaucucaaagcagacaauguaaagagagaacaucucacacacccagcucgccaugccua

SEQ ID NO: 528524 - RNA, 60 nt, hsa
caggaccaacucucucccuccccucaucccacaucucaaagcagacaauguaaagagaga

SEQ ID NO: 528525 - RNA, 64 nt, hsa; identical to SEQ ID NO: 233051

SEQ ID NO: 528526 - RNA, 64 nt, hsa; identical to SEQ ID NO: 233052

SEQ ID NO: 528527 - RNA, 64 nt, hsa; identical to SEQ ID NO: 233053

SEQ ID NO: 528528 - RNA, 64 nt, hsa; identical to SEQ ID NO: 233054

SEQ ID NO: 528529 - RNA, 64 nt, hsa; identical to SEQ ID NO: 233055

SEQ ID NO: 528530 - RNA, 64 nt, hsa; identical to SEQ ID NO: 233055

SEQ ID NO: 528531 - RNA, 64 nt, hsa; identical to SEQ ID NO: 233057

SEQ ID NO: 528532 - RNA, 60 nt, hsa
cccaggaucaagucacucaucucagaauguccccaccaauccccgccacagcaggcgccu

SEQ ID NO: 528533 - RNA, 60 nt, hsa
cugcccugcuugcaaauccacuagcaccgaccccaccaccugguuccggcucugcacgcu

SEQ ID NO: 528534 - RNA, 60 nt, hsa
gccccuggaagcagauucccauugaguuuuccccaccaaggggaccaugcacaugguaga

SEQ ID NO: 528535 - RNA, 60 nt, hsa
ccuguggugggaagacgggcaacaaguauaccccaccagggccugagugacuagaggaag

SEQ ID NO: 528536 - RNA, 60 nt, hsa
ugcuaaucugagcuacuuagaguguggucuccccaccaacuccaguuuugugcccuaagc

SEQ ID NO: 528537 - RNA, 60 nt, hsa
ggugaaaaagagaaaugugagcauccgcucccccaccaccccgcccagccccuagcccca

SEQ ID NO: 528538 - RNA, 60 nt, hsa
uucagggacagugggcaagaggacacccccccccaccaccucaguggaacacaccauucu

SEQ ID NO: 528539 - RNA, 60 nt, hsa
ggggaugcucucauccccucuuucuguaccccccaccauuuucacuggcuggggggcucu

SEQ ID NO: 528540 - RNA, 60 nt, hsa
uaggagagagccuggaucucuggccccaacccccaccagaccucaugcccuggacacugc

SEQ ID NO: 528541 - RNA, 60 nt, hsa
gaugggagguggugaggcguccucaccuccccccaccacagcuguggcugguaaggcaac

SEQ ID NO: 528542 - RNA, 60 nt, hsa
cacucagugccauggggaagcgggcgucucccccaccagccccaccaggcgguguagggg

SEQ ID NO: 528543 - RNA, 60 nt, hsa
ccauggggaagcgggcgucucccccaccagccccaccaggcgguguaggggcagcaggcu

SEQ ID NO: 528544 - RNA, 60 nt, hsa
ugaucaugccccuucucucccaccccaucuccccaccaccaccucuguggccuccauggu

SEQ ID NO: 528545 - RNA, 60 nt, hsa
gggaaaagccaauagaaauuuccuuagcuuccccaccauauguauuuucuaggauuugag

SEQ ID NO: 528546 - RNA, 60 nt, hsa
aaugaggccugaccuuuuuugcuauaaccgccccaccacuccccugcccuugccaacauc

SEQ ID NO: 528547 - RNA, 60 nt, hsa
gcaagcacacaucacuuuagaggggcugcgccccaccagauaggaaggggaggauuuucu

SEQ ID NO: 528548 - RNA, 60 nt, hsa
guggucuaaggaugucuugagcccugugugccccaccauucaugaccucuguauucucua

SEQ ID NO: 528549 - RNA, 60 nt, hsa
gggggcagaucccagagccccucucaccccccccaccacaggccugcuccuuccuuagcc

SEQ ID NO: 528550 - RNA, 60 nt, hsa
cccguuggguagcuggggccaggcuucucuccccaccaccugcagauuucuugcugcuuc

SEQ ID NO: 528551 - RNA, 60 nt, hsa
acagggagcagccaggagacucccuagugcccccaccauggcgggugucacucacgcacu

SEQ ID NO: 528552 - RNA, 60 nt, hsa
agcagccaacaacacccauguuuguagcucccccaccaaagacccagcggcuucuucacu

SEQ ID NO: 528553 - RNA, 60 nt, hsa
augcagccacuucacccuggggggccuccaccccaccaucuuccgccaggugugccuggc

SEQ ID NO: 528554 - RNA, 60 nt, hsa
ccaaccaccagcagcagcagggcccuccucccccaccagcucuccccacagggccccuca

SEQ ID NO: 528555 - RNA, 60 nt, hsa
ccccuuccuugcccgccucuccccccgccgccccaccaguuaaacggaugaccaaagacc

SEQ ID NO: 528556 - RNA, 60 nt, hsa
gcuggggagcucagcuuggucucagagucuccccaccagauacuguuuaaaaaaguagca

SEQ ID NO: 528557 - RNA, 60 nt, hsa
uccuggaucuggagagagcagcugcugcugccccaccaccugccaggcccggccacugag

SEQ ID NO: 528558 - RNA, 60 nt, hsa
ggccccuucccccaggagucacugugccagccccaccacauccuggaagaggagggggcc

SEQ ID NO: 528559 - RNA, 60 nt, hsa
ccugccuuucuuuggucagucccuguggucccccaccagcucccccucccauagggcugc

SEQ ID NO: 528560 - RNA, 60 nt, hsa
gcaguguuggccacguaggggcucccauccccccaccauugugucacaugggcugccagg

SEQ ID NO: 528561 - RNA, 60 nt, hsa
uuaagaccagaauaucaguggauuuguuuuccccaccaaguggccucuuagacuagucau

SEQ ID NO: 528562 - RNA, 60 nt, hsa
cucucucucugucucuccuucucucucuccccccaccacccacccccacacacgucaucu

SEQ ID NO: 528563 - RNA, 60 nt, hsa
uggccucgggagcggccccuggcuaugcacccccaccauuccuacacaucuugccagccc

SEQ ID NO: 528564 - RNA, 60 nt, hsa
cacaggcaugcccagugccuuccaguauggccccaccauguuugugaguauuucagaggg

SEQ ID NO: 528565 - RNA, 60 nt, hsa
augaccccccaucuuuccuccgccccugacccccaccacccugcugcucggacuaugcuc

SEQ ID NO: 528566 - RNA, 60 nt, hsa
agagcaucagggcugcucucugaggagcugccccaccagccauccuugaagagacaauuc

SEQ ID NO: 528567 - RNA, 60 nt, hsa
ugcucccgagagccugccuuuccugcccuuccccaccaccugcacugccccccacauucu

SEQ ID NO: 528568 - RNA, 60 nt, hsa
ccuucaaaacccacccccaccccuacccuaccccaccacaccccaucccagaggccuugc

SEQ ID NO: 528569 - RNA, 60 nt, hsa
uuucuaggacagaggggccucccagucuccccccaccacccgugcacgacuuccucacca

SEQ ID NO: 528570 - RNA, 60 nt, hsa
ugccuggacuuggagagaugggaggcagacccccaccaccauacaugcugucuguggccc

SEQ ID NO: 528571 - RNA, 60 nt, hsa
auuagcgaccaggcuugggcuuccccagcgccccaccaccaccacgugcagguggagcuc

SEQ ID NO: 528572 - RNA, 60 nt, hsa
cucucuuggauccgccucgguuuccuguccccccaccacccgccugccccgcggaagacc

SEQ ID NO: 528573 - RNA, 60 nt, hsa
accgaaauuuucugaaauuaaaucgcacacccccaccauuuccucucccugggaucugga

SEQ ID NO: 528574 - RNA, 60 nt, hsa
ccauugcagggggcagggaaguucacccccccccaccacccccccgcccccccgaagcca

SEQ ID NO: 528575 - RNA, 60 nt, hsa
aggccugggggggaugguauauggcccuuuccccaccaggcgcuaaggggaacacccccu

SEQ ID NO: 528576 - RNA, 60 nt, hsa
uggaauuuucuggcacuuccucucuauugcccccaccaccaccacccccaucacugcuuu

SEQ ID NO: 528577 - RNA, 60 nt, hsa
ggaaugggccggcgauugggaccagcugggccccaccacggccacgccaggcaaagcgcc

SEQ ID NO: 528578 - RNA, 60 nt, hsa
cccccacccacccugcaccccucgcccuccccccaccacagaaucuaagaccuuucagcu

SEQ ID NO: 528579 - RNA, 60 nt, hsa
uccuggaaauaucaguuacucagcccugggccccaccaccuaggccacuccuccaaagga

SEQ ID NO: 528580 - RNA, 60 nt, hsa
caccucugccucaaugugaaucagacccuaccccaccacgauguggcccuggccugcugg

SEQ ID NO: 528581 - RNA, 60 nt, hsa
augggccaaucccauuccugccuuccagugccccaccacccuucugaucuuagggguugg

SEQ ID NO: 528582 - RNA, 60 nt, hsa
uuaucagcuuagaguguucaacugauccuuccccaccaucuucagaucuguuccucugga

SEQ ID NO: 528583 - RNA, 60 nt, hsa
guuugugcuucuagccaugcccauucccgcccccaccaugccucuuugcauugcccauuu

SEQ ID NO: 528584 - RNA, 58 nt, hsa; identical to SEQ ID NO: 119962

SEQ ID NO: 528585 - RNA, 60 nt, hsa
ugacacuggcguucuccucuccccuccuucccccaccacaggucucuccugcauaggcag

SEQ ID NO: 528586 - RNA, 60 nt, hsa
cuguugcaugagccugcgacaggaccucacccccaccaccaggcuucuauuugggauuca

SEQ ID NO: 528587 - RNA, 60 nt, hsa
uaaugaucaugucagccuucagaagagaauccccaccaacuucugugccuccucagaugg

SEQ ID NO: 528588 - RNA, 60 nt, hsa
cccugccaucuugccuuaggaacagccuucccccaccagcagccauggcuggcuggggcu

SEQ ID NO: 528589 - RNA, 60 nt, hsa
uggcccugagcucuauccaccaagccagcaccccaccaucccuuugcaggggagucaaag

SEQ ID NO: 528590 - RNA, 60 nt, hsa
cuucuccuuccccuuucugagaaacgucauccccaccaguuaacguuuccuguacacccu

SEQ ID NO: 528591 - RNA, 60 nt, hsa
ugucuucacugggagcguggggcccccaggccccaccagcaccguccuccccuaaugagg

SEQ ID NO: 528592 - RNA, 60 nt, hsa
aggaaagcacaggcuaagcaguugaagguuccccaccauucagugagagcagaaccccca

SEQ ID NO: 528593 - RNA, 55 nt, hsa; identical to SEQ ID NO: 119971

SEQ ID NO: 528594 - RNA, 60 nt, hsa
ggggguguggggcugcccuggggcccgugcccccaccaggccagccccugcuggguucag

SEQ ID NO: 528595 - RNA, 60 nt, hsa
cgcguccugcaggguaguccgcccccuccuccccaccauccucccuaccuccuuaacuuu

SEQ ID NO: 528596 - RNA, 60 nt, hsa
ccccauugcuaacaacaugguacauuccggccccaccacucagagccuuccgaagccaac

SEQ ID NO: 528597 - RNA, 60 nt, hsa
acccuucccccaccacaucgggagcaauacccccaccaccccuuucacuccauccccugc

SEQ ID NO: 528598 - RNA, 60 nt, hsa
ccccccacccuucucucucccagacccuucccccaccacaucgggagcaauacccccacc

SEQ ID NO: 528599 - RNA, 60 nt, hsa
cccgucagggagaggucaccagcugcugugccccaccacgucuggcucccugccccuuaa

SEQ ID NO: 528600 - RNA, 60 nt, hsa
gggaaggauaaagccacuucuggcuucagcccccaccaggggaaggaaggagggcacauu

SEQ ID NO: 528601 - RNA, 60 nt, hsa
cucaacaaccauguuacuccacuuccccacccccaccaggccucccuccuccccuccuac

SEQ ID NO: 528602 - RNA, 60 nt, hsa
uccccuccuacucccuuuucucacucucauccccaccacagaucccuggauugcugggaa

SEQ ID NO: 528603 - RNA, 60 nt, hsa
aacguggauuguuuaaagaagcucuccaggccccaccaagaggguggaucacaccucagu

SEQ ID NO: 528604 - RNA, 60 nt, hsa
aacugaaauuuccccacucuguuggggcuuccccaccacauucaugucccucucccgugu

SEQ ID NO: 528605 - RNA, 60 nt, hsa
auucuacucuucuggugggcuuugggguauccccaccaacuuucccuucaaaauagcacc

SEQ ID NO: 528606 - RNA, 60 nt, hsa
auauacuuaaccugaaucucuacucacagcccccaccagcucugaaugucuaaccugcuc

SEQ ID NO: 528607 - RNA, 60 nt, hsa
ccuuucaccagaugccacccucccugaaccccccaccacuaccagcucccuggccucccu

SEQ ID NO: 528608 - RNA, 60 nt, hsa
cagggaguugaaguccaaccuauuuaaaaaccccaccauuuggagaauuacaaggguuuu

SEQ ID NO: 528609 - RNA, 60 nt, hsa
uaaaggaacuaugcaaaugcaggccacucuccccaccacgucugugcccugcacuguccc

SEQ ID NO: 528610 - RNA, 55 nt, hsa; identical to SEQ ID NO: 119988

SEQ ID NO: 528611 - RNA, 60 nt, hsa
aggucgccccagggccucugcccacccgagccccaccacucucagaacccccgcccagcg

SEQ ID NO: 528612 - RNA, 60 nt, hsa
ggguggauggagcucagaaggaaaccccagccccaccacggaugacaccaucccucccgu

SEQ ID NO: 528613 - RNA, 60 nt, hsa
ugagaccccgguugcccauucauggcugcaccccaccaugucaaacccaagaccagcccc

SEQ ID NO: 528614 - RNA, 60 nt, hsa
gggccugagcugagcacugcccccucacccccccaccaccccuucccauuucaucggugg

SEQ ID NO: 528615 - RNA, 60 nt, hsa
gcaccccauccucagugcccaaugcuguggccccaccaggcccagagccugguuggccau

SEQ ID NO: 528616 - RNA, 60 nt, hsa
acugaccacccucaacccauugcgcccaguccccaccacagugaccacacccucacuggc

SEQ ID NO: 528617 - RNA, 60 nt, hsa
uagcuaaaggguggggagagggaagaugggccccaccacgcucucaagagaacgcaccug

SEQ ID NO: 528618 - RNA, 60 nt, hsa
uccccuuuucuguucauuucaucuggcuccccccaccaccuccccaccccaccccccacc

SEQ ID NO: 528619 - RNA, 60 nt, hsa
cagggccuuggguucccugagcuguccagaccccaccaucucccggaccccagggaggug

SEQ ID NO: 528620 - RNA, 60 nt, hsa
gggagccggcaggguuuggggugugggcguccccaccacgcauagcaggaauggcaggaa

SEQ ID NO: 528621 - RNA, 58 nt, hsa
uuccugcaauaaaaaaguggauccugcauuccccaccagcauggcgcccugucucugu

SEQ ID NO: 528622 - RNA, 60 nt, hsa
ccggacagaggucugccccacccacuuccuccccaccaccugugccccagagagcagggc

SEQ ID NO: 528623 - RNA, 60 nt, hsa
cagcagggacccacugccccaucucccucuccccaccaagacagccccagaaggagcagc

SEQ ID NO: 528624 - RNA, 60 nt, hsa
aguuccaaagagccucuggcccaggccccuccccaccagggcuuugcagauguccuugaa

SEQ ID NO: 528625 - RNA, 60 nt, hsa
aggucuggagaaaccccuggagaaggguguccccaccagcccauacagcgugugugugga

SEQ ID NO: 528626 - RNA, 60 nt, hsa
aggccccugugugugggguggugagggucuccccaccagugcugcaccccgcagcagcau

SEQ ID NO: 528627 - RNA, 60 nt, hsa
cagcuaggucggggccccaguuaagcugugccccaccacccuaggcaaugaggggcagga

SEQ ID NO: 528628 - RNA, 60 nt, hsa
accucaaagucauuugacugcccccauccaccccaccacccuaaucuuccaccaccucuc

SEQ ID NO: 528629 - RNA, 60 nt, hsa
cuccucgagggcuccagcauccucugcuucccccaccacguucccaucacccaccucauu

SEQ ID NO: 528630 - RNA, 60 nt, hsa
uaguggccuuuggagaugcccccaccucccccccaccaacucucgcguguuggagagaag

SEQ ID NO: 528631 - RNA, 64 nt, hsa
ccuccuagucucuguucgcucgcuuaagcuguuuugaagccaagugaagagugugguuugcauc

SEQ ID NO: 528632 - RNA, 64 nt, hsa
caggcuuugcagaccacgcggggcagggcuccacugaagccacccccaccccucgccagcuagc

SEQ ID NO: 528633 - RNA, 64 nt, hsa
ccacccccugcccugcacgucaugggagggggcuugaagccaaagaaaaauaacccuuugguuu

SEQ ID NO: 528634 - RNA, 64 nt, hsa
gacccugggugggcucugugcagucacuggagguugaagccaaguggggugcugggaggaggga

SEQ ID NO: 528635 - RNA, 64 nt, hsa
uauuaaggauccaaaaagaaaaacaaaaugcuaaugaagccaucagucaagggucacaugccaa

SEQ ID NO: 528636 - RNA, 64 nt, hsa
uguuguggagagcauaguaaauuuucagagaacuugaagccaaaaggauuuaaaaccgcugcuc

SEQ ID NO: 528637 - RNA, 64 nt, hsa
agauguugcuuacuaugagugucaaggugacggaugaagccagcugcuccuaaggacacagggc

SEQ ID NO: 528638 - RNA, 64 nt, hsa
agacgugaugaguuaaaguuguauucugaaaucaugaagccagagccugugccagaccuucugc

SEQ ID NO: 528639 - RNA, 64 nt, hsa
cucugugaagccacauuuuccaacaugagccucaugaagccaacuaaguguuauugaacuguaa

SEQ ID NO: 528640 - RNA, 64 nt, hsa
ucucuguguauuuaaauggaaguauuuuucucugugaagccacauuuuccaacaugagccucau

SEQ ID NO: 528641 - RNA, 64 nt, hsa
ugcuacauguuguccuuaaacaugguuauugaccugaagccagccuaggccuugcccuacaguu

SEQ ID NO: 528642 - RNA, 64 nt, hsa
uggcuugugggcuucaccaaagaggaccccacucugaagccagccuggagccaccuaccucugg

SEQ ID NO: 528643 - RNA, 64 nt, hsa
ccagcacuucugcuugcugggcuggcuggaccugugaagccaugggcagguagugcccucuuga

SEQ ID NO: 528644 - RNA, 64 nt, hsa
uuccucugccccaagucacuacaguugguucuauugaagccagucuuuaagaaaccuggguuaa

SEQ ID NO: 528645 - RNA, 64 nt, hsa
ucuccucuccccuguccugcacccaucccccgccugaagccaccggcuccaauugccagcaacc

SEQ ID NO: 528646 - RNA, 64 nt, hsa
uuccuccaucguccugcccuuuggccuuuugguuugaagccacagguguggcuucuggccuuag

SEQ ID NO: 528647 - RNA, 64 nt, hsa
auccucagcagcaucgaggaagggccgaggaaugugaagccagaucucgggacucagauuggaa

SEQ ID NO: 528648 - RNA, 64 nt, hsa
auuuggucagcauaucuuagguauauaauaacuuugaagccauaacuuuuaacuggagugguuu

SEQ ID NO: 528649 - RNA, 64 nt, hsa
cugagagcuauuuuuuccuguggcugcaaaugucugaagccaguuaguuugauuacccugugca

SEQ ID NO: 528650 - RNA, 64 nt, hsa
uuagaagaagaggcguguggggaacgggggcucuugaagccagguagcuggggacuaugguguc

SEQ ID NO: 528651 - RNA, 64 nt, hsa
cucccuaaucaguauucuuucaagaguucuuuggugaagccaucuaucugaaacuaaaaugaac

SEQ ID NO: 528652 - RNA, 64 nt, hsa
uuggacccuuaagaauuuuauuuuuaaaggagauugaagccauagaacucauauugacacucag

SEQ ID NO: 528653 - RNA, 64 nt, hsa
uucgggccugaaaacaaauaugaccuuuuuuacuugaagccaaugaauuuuaaucuauagauuc

SEQ ID NO: 528654 - RNA, 64 nt, hsa
ccuaggcugucccacagucuuugcugcccuuagaugaagccacuuguuucaagaugacuacuuu

SEQ ID NO: 528655 - RNA, 57 nt, hsa
cacuuccacugggaucaugagucacucugaagccacucugaaaucacucugaagcca

SEQ ID NO: 528656 - RNA, 64 nt, hsa
caugagucacucugaagccacucugaaaucacucugaagccaaagcugggcucaguggggaagg

SEQ ID NO: 528657 - RNA, 64 nt, hsa
gcguagguguuugcuuccuucuacuggcauucacugaagccacuggggugggggucucuaaaga

SEQ ID NO: 528658 - RNA, 64 nt, hsa
ccuaugaccccagaggacgcugugaucuccaccuugaagccaggcaggcugcccugagacgagg

SEQ ID NO: 528659 - RNA, 64 nt, hsa
caugcuuacacacuaaacuauaauauaaaggaaaugaagccauguuaaucugagagcagugucg

SEQ ID NO: 528660 - RNA, 64 nt, hsa
guggguuuugcaaauauuguuuaaaaaccaaacuugaagccaggcaugguggcccacaccugug

SEQ ID NO: 528661 - RNA, 64 nt, hsa; identical to SEQ ID NO: 441009

SEQ ID NO: 528662 - RNA, 64 nt, hsa; identical to SEQ ID NO: 441010

SEQ ID NO: 528663 - RNA, 64 nt, hsa; identical to SEQ ID NO: 441011

SEQ ID NO: 528664 - RNA, 64 nt, hsa; identical to SEQ ID NO: 441012

SEQ ID NO: 528665 - RNA, 64 nt, hsa; identical to SEQ ID NO: 441013

SEQ ID NO: 528666 - RNA, 64 nt, hsa; identical to SEQ ID NO: 441014

SEQ ID NO: 528667 - RNA, 64 nt, hsa; identical to SEQ ID NO: 441015

SEQ ID NO: 528668 - RNA, 64 nt, hsa
ucuuagaguuaaaggagggggugcuggccaagagccaacacauucuuggcccaggagcauugcu

SEQ ID NO: 528669 - RNA, 64 nt, hsa
acccagagacucagaggggaagagggugcuaguaccaacacagggaaaacggaugggaccuggg

SEQ ID NO: 528670 - RNA, 64 nt, hsa
gacaagccaugggcaugcauacaaugcagcaagaccaacacaagagcaauauugaauuguucau

SEQ ID NO: 528671 - RNA, 64 nt, hsa
agucacagaaucugccaggcgguucaagugaaaaccaacacacucagcaucccugggaacugag

SEQ ID NO: 528672 - RNA, 64 nt, hsa
guuguaggacugcaagacacuggaccgaaagccuccaacacaaacccuagcugccaaccugcuc

SEQ ID NO: 528673 - RNA, 64 nt, hsa
uacccuccuuaggacccauuuugggggggaaaaaccaacacauuccagagcuuuccaaguccuu

SEQ ID NO: 528674 - RNA, 64 nt, hsa
uaccaccaacuacuaccuguaaugacaggccuguccaacacaucucccuuuuccaugacugugg

SEQ ID NO: 528675 - RNA, 64 nt, hsa
ugcucagcugucaaggcucagucgcuagcauuucccaacacaaagauucugaccuuaaaugcaa

SEQ ID NO: 528676 - RNA, 64 nt, hsa
ucuucaaguaaaauuaaagucucuuguguaagagccaacacaugcccagcugcggaugggagcu

SEQ ID NO: 528677 - RNA, 64 nt, hsa
ccagcaucacaaggcacuugucuacaagugugucccaacacaguccugggccacuuuccccacc

SEQ ID NO: 528678 - RNA, 64 nt, hsa
gagucuggcugguccaacacagauucugccugguccaacacagauucugccugagccuccuuau

SEQ ID NO: 528679 - RNA, 64 nt, hsa
ccuggccacugggcugggcuggagucuggcugguccaacacagauucugccugguccaacacag

SEQ ID NO: 528680 - RNA, 64 nt, hsa
uagcagagguuuaaauguacccuccccuuuuaugcacuucaaauaauuaaaucucuuuaagaau

SEQ ID NO: 528681 - RNA, 64 nt, hsa
uuuuaaaauaagcuuucucagaauguuggcaaaucacuucaauccucaaaucagucuuccuugu

SEQ ID NO: 528682 - RNA, 64 nt, hsa
caccccuggugucccugccuggcccuccucuggucacuucaaacaugcccucaggcuuggggau

SEQ ID NO: 528683 - RNA, 64 nt, hsa
gugcuggcaugucugggucgucuuuugaaaagcucacuucaagcucacccugcuccuaccuauc

SEQ ID NO: 528684 - RNA, 64 nt, hsa
auacugacauuuauaaaugaaccuuuauuaaagacacuucaaugccauuuguuagacacuucaa

SEQ ID NO: 528685 - RNA, 64 nt, hsa
cuuuauuaaagacacuucaaugccauuuguuagacacuucaauauuuuacaugguuuucaaugu

SEQ ID NO: 528686 - RNA, 64 nt, hsa
uugugugacaaguguguuuacagauuauugguuacacuucaauuuacagggcauaaacaaugau

SEQ ID NO: 528687 - RNA, 64 nt, hsa
uuaacauguaauuaguuuacagauuguagggcaucacuucaauucaccaagcauguaguucuag

SEQ ID NO: 528688 - RNA, 64 nt, hsa
ccugccauuacgggagcuguggacagagcucccucacuucaagauuccuaguguuuuugcacaa

SEQ ID NO: 528689 - RNA, 64 nt, hsa
acaaaccucacuguucagaugggcuguaaguucucacuucaaagcuauggaauggauuuuagca

SEQ ID NO: 528690 - RNA, 64 nt, hsa
uggaagugauuuuuucuguguauguauauguauacacuucaauagguuuuaauuuugaagugaa

SEQ ID NO: 528691 - RNA, 64 nt, hsa
ugaauuagauguuaucccaaaaaaaauaucuuuucacuucaaaaugaaaauauauguucaaaga

SEQ ID NO: 528692 - RNA, 64 nt, hsa
ugaugacggugaugacgacugggugaacagccaucacuucaacauugugauaauccuucacagc

SEQ ID NO: 528693 - RNA, 64 nt, hsa
uuuucuuuuuuaguuccccuggcaauaauaauggcacuucaauagaagauggacaaauuccaga

SEQ ID NO: 528694 - RNA, 64 nt, hsa
uagcuggugauacccuguccuguggaaggacuuccacuucaacacuuccacuucaacaguuccc

SEQ ID NO: 528695 - RNA, 64 nt, hsa
cuguccuguggaaggacuuccacuucaacacuuccacuucaacaguucccgcacggccugaacg

SEQ ID NO: 528696 - RNA, 60 nt, hsa
aaacuaugaagcaacacugagauguccaggaucugugacugaagacauuucugauuauuu

SEQ ID NO: 528697 - RNA, 64 nt, hsa
aggagcaguccuaugcuuuuauucagcauccuuuaucugugacuucaugcucugauaacugccu

SEQ ID NO: 528698 - RNA, 64 nt, hsa
cugugcgucagaauccaccuugcgugcugugcguaucugugaaccuggagcgguuacuuauuuu

SEQ ID NO: 528699 - RNA, 64 nt, hsa
uuucuuauguccucauaaaagcucagaugaugguaucugugaguauguuuugcaaauucaaaau

SEQ ID NO: 528700 - RNA, 64 nt, hsa
gaaaugugaagggucaacuccaacguaugugguuaucugugaaaguugcacagcguggcuuuuc

SEQ ID NO: 528701 - RNA, 64 nt, hsa
acuguggaaggccucccucugucggcuuuuugccaucugugauaugccauaggugugacaaucc

SEQ ID NO: 528702 - RNA, 64 nt, hsa
cugaaccugguccugugggccauugaaaaguuagaucugugaucucugggguuuuuguggcuuu

SEQ ID NO: 528703 - RNA, 64 nt, hsa
gccugcuugaccuccaaguagagcugauacagagaucugugaauauugugauagaaauucuuug

SEQ ID NO: 528704 - RNA, 64 nt, hsa
ucuucuacugaaucuauaaaaacugcaguuuuacaucugugaacuauggcuuaagggacaggau

SEQ ID NO: 528705 - RNA, 64 nt, hsa
uggaguuaacuggaauagcaguacacuagcaaguaucugugaauccuuagcacugacggguuaa

SEQ ID NO: 528706 - RNA, 64 nt, hsa
uaaauauauugagccauguuaaccugccaaugagaucugugaaaaaauaauggccucauuuuuc

SEQ ID NO: 528707 - RNA, 64 nt, hsa
gaauuugcugaauugaauuguuuuucuuucucaaaucugugaucucuuuucuuuauccuguuuc

SEQ ID NO: 528708 - RNA, 64 nt, hsa
uggcaaauaacccaauagccugcguaccagagacaucugugauuguucuauuacuugaauaguu

SEQ ID NO: 528709 - RNA, 64 nt, hsa
auaauguaaagauuaaaauggggaaauaaugagcaucugugaauaaugaggugucauuuuuuga

SEQ ID NO: 528710 - RNA, 64 nt, hsa
gccaaauuuuaggaacagaaucaaaagaauaaaaaucugugaagagauccuacuacucuuccuu

SEQ ID NO: 528711 - RNA, 64 nt, hsa
auucaagcagugcacccgguggaagcugaaauccaucugugaauggaacugaagugaacgugaa

SEQ ID NO: 528712 - RNA, 64 nt, hsa
cccgccaacuccuauacccaucuucccuaggugaaucugugaaugguccuuucuggcagcaauc

SEQ ID NO: 528713 - RNA, 64 nt, hsa
uuuuauauaacuaaaauaaaauagauguggagggaucugugaucauauaaaaagggaggguuac

SEQ ID NO: 528714 - RNA, 64 nt, hsa
caaaguaucacauuauaaaguuaguagauaaaacaucugugagugaaaauccaguuucaagaac

SEQ ID NO: 528715 - RNA, 64 nt, hsa
caucucucaaaaagccuccacuccuuucccucacaucugugaucaucaugauucuuuuaguuca

SEQ ID NO: 528716 - RNA, 64 nt, hsa
ucacuuagagcuuaucuucccuaugaaucuccagaucugugagucgagcagauuucauguugca

SEQ ID NO: 528717 - RNA, 64 nt, hsa
uucccacucccaacuccugaaaugaagucuugcuaucugugacuaguuuuauuuuugugcuuuu

SEQ ID NO: 528718 - RNA, 64 nt, hsa
cucugucucauccuccuggaaccuugcuguccugaucugugauaguucacccccugagaucccc

SEQ ID NO: 528719 - RNA, 64 nt, hsa
auuauaaaaggggguccguggaagaaugaucagcaucugugaugggagcgucaggguuggugug

SEQ ID NO: 528720 - RNA, 64 nt, hsa
uggugagggcuggaaauccaaacucaccaccaugaucugugaaauaaagcccuuagcgguguga

SEQ ID NO: 528721 - RNA, 64 nt, hsa
aaaguugucauuugaggucgcacuuggaaguuacaucugugaaguuucugucauucguccagau

SEQ ID NO: 528722 - RNA, 64 nt, hsa
ucucccuccugggaauuguuuugccuuucuguucaucugugaacuguuuuuuguuuuuaauuac

SEQ ID NO: 528723 - RNA, 64 nt, hsa
uuuguacauuuuuugccggacgcaucaagaagcaaucugugacaaagucugagggucuuccuuu

SEQ ID NO: 528724 - RNA, 64 nt, hsa
uauuuauuuggggucugaaggauaucaacagcucaucugugaccaacagggcaacuggaaccua

SEQ ID NO: 528725 - RNA, 64 nt, hsa
aacuugguaaaaacccacaggugcugcugcuuauaucugugaagcacuagcuuauucuaggaau

SEQ ID NO: 528726 - RNA, 64 nt, hsa
aagaauaaugaggucaugucauuuguuaauaaguaucugugauaaauccgugguucaagguuaa

SEQ ID NO: 528727 - RNA, 64 nt, hsa
acacacacacacacacacacacucugagcacauuaucugugauucuuucauccucccagaaagg

SEQ ID NO: 528728 - RNA, 64 nt, hsa
ccucuuccccacgugcucccaucuguaacucuccaucugugauuugcaacaggucuuccacugg

SEQ ID NO: 528729 - RNA, 64 nt, hsa; identical to SEQ ID NO: 97587

SEQ ID NO: 528730 - RNA, 64 nt, hsa; identical to SEQ ID NO: 97588

SEQ ID NO: 528731 - RNA, 64 nt, hsa; identical to SEQ ID NO: 97589

SEQ ID NO: 528732 - RNA, 64 nt, hsa; identical to SEQ ID NO: 97590

SEQ ID NO: 528733 - RNA, 64 nt, hsa; identical to SEQ ID NO: 97591

SEQ ID NO: 528734 - RNA, 64 nt, hsa; identical to SEQ ID NO: 97592

SEQ ID NO: 528735 - RNA, 64 nt, hsa; identical to SEQ ID NO: 97593

SEQ ID NO: 528736 - RNA, 61 nt, hsa; identical to SEQ ID NO: 97594

SEQ ID NO: 528737 - RNA, 64 nt, hsa; identical to SEQ ID NO: 97595

SEQ ID NO: 528738 - RNA, 64 nt, hsa; identical to SEQ ID NO: 97596

SEQ ID NO: 528739 - RNA, 64 nt, hsa; identical to SEQ ID NO: 97597

SEQ ID NO: 528740 - RNA, 64 nt, hsa; identical to SEQ ID NO: 97598

SEQ ID NO: 528741 - RNA, 64 nt, hsa; identical to SEQ ID NO: 97599

SEQ ID NO: 528742 - RNA, 64 nt, hsa; identical to SEQ ID NO: 97600

SEQ ID NO: 528743 - RNA, 64 nt, hsa; identical to SEQ ID NO: 97601

SEQ ID NO: 528744 - RNA, 64 nt, hsa; identical to SEQ ID NO: 97602

SEQ ID NO: 528745 - RNA, 64 nt, hsa; identical to SEQ ID NO: 97603

SEQ ID NO: 528746 - RNA, 64 nt, hsa; identical to SEQ ID NO: 97604

SEQ ID NO: 528747 - RNA, 64 nt, hsa; identical to SEQ ID NO: 97605

SEQ ID NO: 528748 - RNA, 64 nt, hsa; identical to SEQ ID NO: 97606

SEQ ID NO: 528749 - RNA, 64 nt, hsa; identical to SEQ ID NO: 97607

SEQ ID NO: 528750 - RNA, 64 nt, hsa; identical to SEQ ID NO: 97608

SEQ ID NO: 528751 - RNA, 64 nt, hsa; identical to SEQ ID NO: 97609

SEQ ID NO: 528752 - RNA, 64 nt, hsa; identical to SEQ ID NO: 97610

SEQ ID NO: 528753 - RNA, 64 nt, hsa; identical to SEQ ID NO: 97611

SEQ ID NO: 528754 - RNA, 64 nt, hsa; identical to SEQ ID NO: 97612

SEQ ID NO: 528755 - RNA, 64 nt, hsa; identical to SEQ ID NO: 97613

SEQ ID NO: 528756 - RNA, 64 nt, hsa; identical to SEQ ID NO: 97614

SEQ ID NO: 528757 - RNA, 64 nt, hsa; identical to SEQ ID NO: 97615

SEQ ID NO: 528758 - RNA, 64 nt, hsa; identical to SEQ ID NO: 97616

SEQ ID NO: 528759 - RNA, 64 nt, hsa; identical to SEQ ID NO: 97617

SEQ ID NO: 528760 - RNA, 64 nt, hsa; identical to SEQ ID NO: 97618

SEQ ID NO: 528761 - RNA, 64 nt, hsa; identical to SEQ ID NO: 97619

SEQ ID NO: 528762 - RNA, 64 nt, hsa; identical to SEQ ID NO: 97620

SEQ ID NO: 528763 - RNA, 64 nt, hsa; identical to SEQ ID NO: 97621

SEQ ID NO: 528764 - RNA, 64 nt, hsa; identical to SEQ ID NO: 97622

SEQ ID NO: 528765 - RNA, 64 nt, hsa; identical to SEQ ID NO: 97623

SEQ ID NO: 528766 - RNA, 64 nt, hsa; identical to SEQ ID NO: 97624

SEQ ID NO: 528767 - RNA, 64 nt, hsa; identical to SEQ ID NO: 97625

SEQ ID NO: 528768 - RNA, 64 nt, hsa; identical to SEQ ID NO: 97626

SEQ ID NO: 528769 - RNA, 64 nt, hsa; identical to SEQ ID NO: 97627

SEQ ID NO: 528770 - RNA, 64 nt, hsa; identical to SEQ ID NO: 97628

SEQ ID NO: 528771 - RNA, 64 nt, hsa; identical to SEQ ID NO: 97629

SEQ ID NO: 528772 - RNA, 64 nt, hsa; identical to SEQ ID NO: 97630

SEQ ID NO: 528773 - RNA, 64 nt, hsa; identical to SEQ ID NO: 97631

SEQ ID NO: 528774 - RNA, 64 nt, hsa; identical to SEQ ID NO: 97632

SEQ ID NO: 528775 - RNA, 64 nt, hsa; identical to SEQ ID NO: 97633

SEQ ID NO: 528776 - RNA, 64 nt, hsa; identical to SEQ ID NO: 97634

SEQ ID NO: 528777 - RNA, 64 nt, hsa; identical to SEQ ID NO: 97635

SEQ ID NO: 528778 - RNA, 64 nt, hsa; identical to SEQ ID NO: 97636

SEQ ID NO: 528779 - RNA, 64 nt, hsa; identical to SEQ ID NO: 97637

SEQ ID NO: 528780 - RNA, 64 nt, hsa; identical to SEQ ID NO: 97638

SEQ ID NO: 528781 - RNA, 64 nt, hsa; identical to SEQ ID NO: 97639

SEQ ID NO: 528782 - RNA, 64 nt, hsa; identical to SEQ ID NO: 97640

SEQ ID NO: 528783 - RNA, 64 nt, hsa; identical to SEQ ID NO: 97641

SEQ ID NO: 528784 - RNA, 64 nt, hsa; identical to SEQ ID NO: 97642

SEQ ID NO: 528785 - RNA, 64 nt, hsa; identical to SEQ ID NO: 97643

SEQ ID NO: 528786 - RNA, 64 nt, hsa; identical to SEQ ID NO: 97644

SEQ ID NO: 528787 - RNA, 64 nt, hsa; identical to SEQ ID NO: 97645

SEQ ID NO: 528788 - RNA, 64 nt, hsa; identical to SEQ ID NO: 97646

SEQ ID NO: 528789 - RNA, 64 nt, hsa; identical to SEQ ID NO: 97647

SEQ ID NO: 528790 - RNA, 64 nt, hsa; identical to SEQ ID NO: 97648

SEQ ID NO: 528791 - RNA, 64 nt, hsa; identical to SEQ ID NO: 97649

SEQ ID NO: 528792 - RNA, 64 nt, hsa; identical to SEQ ID NO: 97650

SEQ ID NO: 528793 - RNA, 64 nt, hsa; identical to SEQ ID NO: 97651

SEQ ID NO: 528794 - RNA, 64 nt, hsa; identical to SEQ ID NO: 97652

SEQ ID NO: 528795 - RNA, 64 nt, hsa; identical to SEQ ID NO: 97653

SEQ ID NO: 528796 - RNA, 64 nt, hsa; identical to SEQ ID NO: 97654

SEQ ID NO: 528797 - RNA, 64 nt, hsa; identical to SEQ ID NO: 97655

SEQ ID NO: 528798 - RNA, 64 nt, hsa; identical to SEQ ID NO: 97656

SEQ ID NO: 528799 - RNA, 64 nt, hsa; identical to SEQ ID NO: 97657

SEQ ID NO: 528800 - RNA, 64 nt, hsa; identical to SEQ ID NO: 97658

SEQ ID NO: 528801 - RNA, 64 nt, hsa; identical to SEQ ID NO: 97659

SEQ ID NO: 528802 - RNA, 58 nt, hsa; identical to SEQ ID NO: 97660

SEQ ID NO: 528803 - RNA, 64 nt, hsa; identical to SEQ ID NO: 97661

SEQ ID NO: 528804 - RNA, 64 nt, hsa; identical to SEQ ID NO: 97662

SEQ ID NO: 528805 - RNA, 64 nt, hsa; identical to SEQ ID NO: 97663

SEQ ID NO: 528806 - RNA, 64 nt, hsa; identical to SEQ ID NO: 97664

SEQ ID NO: 528807 - RNA, 64 nt, hsa; identical to SEQ ID NO: 97665

SEQ ID NO: 528808 - RNA, 64 nt, hsa; identical to SEQ ID NO: 97666

SEQ ID NO: 528809 - RNA, 64 nt, hsa; identical to SEQ ID NO: 97667

SEQ ID NO: 528810 - RNA, 64 nt, hsa; identical to SEQ ID NO: 97668

SEQ ID NO: 528811 - RNA, 64 nt, hsa; identical to SEQ ID NO: 97669

SEQ ID NO: 528812 - RNA, 64 nt, hsa; identical to SEQ ID NO: 97670

SEQ ID NO: 528813 - RNA, 64 nt, hsa; identical to SEQ ID NO: 266984

SEQ ID NO: 528814 - RNA, 64 nt, hsa; identical to SEQ ID NO: 266985

SEQ ID NO: 528815 - RNA, 64 nt, hsa; identical to SEQ ID NO: 266986

SEQ ID NO: 528816 - RNA, 64 nt, hsa; identical to SEQ ID NO: 266987

SEQ ID NO: 528817 - RNA, 64 nt, hsa; identical to SEQ ID NO: 266988

SEQ ID NO: 528818 - RNA, 64 nt, hsa; identical to SEQ ID NO: 266989

SEQ ID NO: 528819 - RNA, 64 nt, hsa; identical to SEQ ID NO: 266990

SEQ ID NO: 528820 - RNA, 64 nt, hsa; identical to SEQ ID NO: 266991

SEQ ID NO: 528821 - RNA, 64 nt, hsa; identical to SEQ ID NO: 266992

SEQ ID NO: 528822 - RNA, 64 nt, hsa; identical to SEQ ID NO: 266993

SEQ ID NO: 528823 - RNA, 64 nt, hsa; identical to SEQ ID NO: 266994

SEQ ID NO: 528824 - RNA, 64 nt, hsa; identical to SEQ ID NO: 266995

SEQ ID NO: 528825 - RNA, 64 nt, hsa; identical to SEQ ID NO: 266996

SEQ ID NO: 528826 - RNA, 64 nt, hsa; identical to SEQ ID NO: 266997

SEQ ID NO: 528827 - RNA, 64 nt, hsa; identical to SEQ ID NO: 266998

SEQ ID NO: 528828 - RNA, 64 nt, hsa; identical to SEQ ID NO: 266999

SEQ ID NO: 528829 - RNA, 64 nt, hsa; identical to SEQ ID NO: 267000

SEQ ID NO: 528830 - RNA, 64 nt, hsa; identical to SEQ ID NO: 267001

SEQ ID NO: 528831 - RNA, 64 nt, hsa; identical to SEQ ID NO: 267002

SEQ ID NO: 528832 - RNA, 64 nt, hsa; identical to SEQ ID NO: 267003

SEQ ID NO: 528833 - RNA, 64 nt, hsa; identical to SEQ ID NO: 267004

SEQ ID NO: 528834 - RNA, 64 nt, hsa; identical to SEQ ID NO: 267005

SEQ ID NO: 528835 - RNA, 64 nt, hsa; identical to SEQ ID NO: 267006

SEQ ID NO: 528836 - RNA, 64 nt, hsa; identical to SEQ ID NO: 267007

SEQ ID NO: 528837 - RNA, 64 nt, hsa; identical to SEQ ID NO: 267008

SEQ ID NO: 528838 - RNA, 64 nt, hsa; identical to SEQ ID NO: 267009

SEQ ID NO: 528839 - RNA, 64 nt, hsa; identical to SEQ ID NO: 267010

SEQ ID NO: 528840 - RNA, 64 nt, hsa; identical to SEQ ID NO: 267011

SEQ ID NO: 528841 - RNA, 64 nt, hsa; identical to SEQ ID NO: 267012

SEQ ID NO: 528842 - RNA, 64 nt, hsa; identical to SEQ ID NO: 267013

SEQ ID NO: 528843 - RNA, 64 nt, hsa; identical to SEQ ID NO: 267014

SEQ ID NO: 528844 - RNA, 64 nt, hsa; identical to SEQ ID NO: 267015

SEQ ID NO: 528845 - RNA, 64 nt, hsa; identical to SEQ ID NO: 267016

SEQ ID NO: 528846 - RNA, 64 nt, hsa; identical to SEQ ID NO: 267017

SEQ ID NO: 528847 - RNA, 64 nt, hsa; identical to SEQ ID NO: 267018

SEQ ID NO: 528848 - RNA, 64 nt, hsa; identical to SEQ ID NO: 267019

SEQ ID NO: 528849 - RNA, 64 nt, hsa; identical to SEQ ID NO: 267020

SEQ ID NO: 528850 - RNA, 64 nt, hsa; identical to SEQ ID NO: 267021

SEQ ID NO: 528851 - RNA, 64 nt, hsa; identical to SEQ ID NO: 267022

SEQ ID NO: 528852 - RNA, 64 nt, hsa; identical to SEQ ID NO: 267023

SEQ ID NO: 528853 - RNA, 64 nt, hsa; identical to SEQ ID NO: 267024

SEQ ID NO: 528854 - RNA, 64 nt, hsa
guucgccaucauaccgccagcgcgacagccaccuggugccaacucacugagccgccugccgcug

SEQ ID NO: 528855 - RNA, 64 nt, hsa
uuacaguggaguauauuuuuuaaagcacaaaauuggugccaagacugggugagaaauguacauu

SEQ ID NO: 528856 - RNA, 64 nt, hsa
acauaucaccucauuucuaagaaauaaacuacaaggugccaagaagguuuuauuuccuuuuauu

SEQ ID NO: 528857 - RNA, 64 nt, hsa
aagaugacaaauguacagauguuaauauauuuuuggugccaauggcgauguuuuuaagaguggg

SEQ ID NO: 528858 - RNA, 64 nt, hsa
uaccuggagguuugacucuaauuuuugcacugauggugccaaagggcccugagucaaaaggaua

SEQ ID NO: 528859 - RNA, 64 nt, hsa
accuccuagaaggaagccuuccccaccauuuccaggugccaacugcuaagcagauauauuccaa

SEQ ID NO: 528860 - RNA, 64 nt, hsa
gcugccugcauuguaucuccaucuggucacugcaggugccaacccuucaucccccauguuuucc

SEQ ID NO: 528861 - RNA, 64 nt, hsa
caaggacgugagccagugggagcuggugucugugggugccaagggcagccagggucuucccugc

SEQ ID NO: 528862 - RNA, 64 nt, hsa
ggcagaggaagagaggucgacuguggggucauuuggugccaaacauggaggugggcaggcucac

SEQ ID NO: 528863 - RNA, 64 nt, hsa
uuuauaggcaggagccccacugcuuccagccucuggugccaacacaguugccaaacccauugag

SEQ ID NO: 528864 - RNA, 64 nt, hsa
cuaagaaggucgaccucaucaucugggagaucgaggugccaaagguaggggcggagucccccag

SEQ ID NO: 528865 - RNA, 64 nt, hsa
ggggcgcuaugugaguuuucugaagcaaacaucuggugccaagaucuacauuucaacccugccu

SEQ ID NO: 528866 - RNA, 64 nt, hsa
gcaguacaagaaccucuccaucaucuuccgcgcaggugccaacccagccuuugaagaggcugug

SEQ ID NO: 528867 - RNA, 64 nt, hsa
cgcuauuccucacucagaggaagacuuugauccaggugccaaguuccacuuuucugcaggugug

SEQ ID NO: 528868 - RNA, 64 nt, hsa
ggggaggcuaaggaaaguugggauugggacugguggugccaagauaaggguuucucaaauugga

SEQ ID NO: 528869 - RNA, 64 nt, hsa
gagccauguccagaacccagccggccaucuccauggugccaauuaccagcaagugucuuuccug

SEQ ID NO: 528870 - RNA, 64 nt, hsa; identical to SEQ ID NO: 113667

SEQ ID NO: 528871 - RNA, 64 nt, hsa; identical to SEQ ID NO: 113668

SEQ ID NO: 528872 - RNA, 64 nt, hsa; identical to SEQ ID NO: 113669

SEQ ID NO: 528873 - RNA, 64 nt, hsa; identical to SEQ ID NO: 113670

SEQ ID NO: 528874 - RNA, 64 nt, hsa; identical to SEQ ID NO: 113671

SEQ ID NO: 528875 - RNA, 64 nt, hsa; identical to SEQ ID NO: 113672

SEQ ID NO: 528876 - RNA, 64 nt, hsa; identical to SEQ ID NO: 113673

SEQ ID NO: 528877 - RNA, 64 nt, hsa; identical to SEQ ID NO: 113674

SEQ ID NO: 528878 - RNA, 64 nt, hsa; identical to SEQ ID NO: 113675

SEQ ID NO: 528879 - RNA, 64 nt, hsa; identical to SEQ ID NO: 113676

SEQ ID NO: 528880 - RNA, 64 nt, hsa; identical to SEQ ID NO: 113677

SEQ ID NO: 528881 - RNA, 64 nt, hsa; identical to SEQ ID NO: 113678

SEQ ID NO: 528882 - RNA, 64 nt, hsa; identical to SEQ ID NO: 113679

SEQ ID NO: 528883 - RNA, 64 nt, hsa; identical to SEQ ID NO: 113680

SEQ ID NO: 528884 - RNA, 64 nt, hsa; identical to SEQ ID NO: 113681

SEQ ID NO: 528885 - RNA, 64 nt, hsa; identical to SEQ ID NO: 113682

SEQ ID NO: 528886 - RNA, 64 nt, hsa; identical to SEQ ID NO: 113683

SEQ ID NO: 528887 - RNA, 64 nt, hsa; identical to SEQ ID NO: 113684

SEQ ID NO: 528888 - RNA, 64 nt, hsa; identical to SEQ ID NO: 113685

SEQ ID NO: 528889 - RNA, 64 nt, hsa; identical to SEQ ID NO: 113686

SEQ ID NO: 528890 - RNA, 64 nt, hsa; identical to SEQ ID NO: 113687

SEQ ID NO: 528891 - RNA, 64 nt, hsa; identical to SEQ ID NO: 113688

SEQ ID NO: 528892 - RNA, 64 nt, hsa; identical to SEQ ID NO: 113689

SEQ ID NO: 528893 - RNA, 62 nt, hsa; identical to SEQ ID NO: 113690

SEQ ID NO: 528894 - RNA, 64 nt, hsa; identical to SEQ ID NO: 113691

SEQ ID NO: 528895 - RNA, 59 nt, hsa; identical to SEQ ID NO: 113692

SEQ ID NO: 528896 - RNA, 64 nt, hsa; identical to SEQ ID NO: 113693

SEQ ID NO: 528897 - RNA, 64 nt, hsa; identical to SEQ ID NO: 113694

SEQ ID NO: 528898 - RNA, 64 nt, hsa; identical to SEQ ID NO: 113695

SEQ ID NO: 528899 - RNA, 64 nt, hsa; identical to SEQ ID NO: 113696

SEQ ID NO: 528900 - RNA, 64 nt, hsa; identical to SEQ ID NO: 113697

SEQ ID NO: 528901 - RNA, 64 nt, hsa; identical to SEQ ID NO: 113698

SEQ ID NO: 528902 - RNA, 64 nt, hsa; identical to SEQ ID NO: 113699

SEQ ID NO: 528903 - RNA, 64 nt, hsa; identical to SEQ ID NO: 113700

SEQ ID NO: 528904 - RNA, 64 nt, hsa; identical to SEQ ID NO: 113701

SEQ ID NO: 528905 - RNA, 64 nt, hsa; identical to SEQ ID NO: 113702

SEQ ID NO: 528906 - RNA, 64 nt, hsa; identical to SEQ ID NO: 113703

SEQ ID NO: 528907 - RNA, 64 nt, hsa; identical to SEQ ID NO: 113704

SEQ ID NO: 528908 - RNA, 64 nt, hsa; identical to SEQ ID NO: 113705

SEQ ID NO: 528909 - RNA, 64 nt, hsa; identical to SEQ ID NO: 113706

SEQ ID NO: 528910 - RNA, 64 nt, hsa; identical to SEQ ID NO: 113707

SEQ ID NO: 528911 - RNA, 64 nt, hsa; identical to SEQ ID NO: 113708

SEQ ID NO: 528912 - RNA, 64 nt, hsa; identical to SEQ ID NO: 113709

SEQ ID NO: 528913 - RNA, 64 nt, hsa; identical to SEQ ID NO: 113710

SEQ ID NO: 528914 - RNA, 64 nt, hsa; identical to SEQ ID NO: 113711

SEQ ID NO: 528915 - RNA, 64 nt, hsa; identical to SEQ ID NO: 113712

SEQ ID NO: 528916 - RNA, 64 nt, hsa; identical to SEQ ID NO: 113713

SEQ ID NO: 528917 - RNA, 64 nt, hsa; identical to SEQ ID NO: 113714

SEQ ID NO: 528918 - RNA, 64 nt, hsa; identical to SEQ ID NO: 113715

SEQ ID NO: 528919 - RNA, 64 nt, hsa; identical to SEQ ID NO: 113716

SEQ ID NO: 528920 - RNA, 64 nt, hsa; identical to SEQ ID NO: 113717

SEQ ID NO: 528921 - RNA, 64 nt, hsa; identical to SEQ ID NO: 113718

SEQ ID NO: 528922 - RNA, 64 nt, hsa; identical to SEQ ID NO: 113719

SEQ ID NO: 528923 - RNA, 64 nt, hsa; identical to SEQ ID NO: 113720

SEQ ID NO: 528924 - RNA, 64 nt, hsa; identical to SEQ ID NO: 113721

SEQ ID NO: 528925 - RNA, 64 nt, hsa; identical to SEQ ID NO: 113722

SEQ ID NO: 528926 - RNA, 64 nt, hsa; identical to SEQ ID NO: 113723

SEQ ID NO: 528927 - RNA, 64 nt, hsa; identical to SEQ ID NO: 113724

SEQ ID NO: 528928 - RNA, 64 nt, hsa; identical to SEQ ID NO: 113725

SEQ ID NO: 528929 - RNA, 64 nt, hsa; identical to SEQ ID NO: 113726

SEQ ID NO: 528930 - RNA, 64 nt, hsa; identical to SEQ ID NO: 113727

SEQ ID NO: 528931 - RNA, 64 nt, hsa; identical to SEQ ID NO: 113728

SEQ ID NO: 528932 - RNA, 64 nt, hsa; identical to SEQ ID NO: 113729

SEQ ID NO: 528933 - RNA, 64 nt, hsa; identical to SEQ ID NO: 113730

SEQ ID NO: 528934 - RNA, 64 nt, hsa; identical to SEQ ID NO: 113731

SEQ ID NO: 528935 - RNA, 64 nt, hsa; identical to SEQ ID NO: 113732

SEQ ID NO: 528936 - RNA, 64 nt, hsa; identical to SEQ ID NO: 113733

SEQ ID NO: 528937 - RNA, 64 nt, hsa; identical to SEQ ID NO: 113734

SEQ ID NO: 528938 - RNA, 64 nt, hsa; identical to SEQ ID NO: 113735

SEQ ID NO: 528939 - RNA, 64 nt, hsa; identical to SEQ ID NO: 113736

SEQ ID NO: 528940 - RNA, 64 nt, hsa; identical to SEQ ID NO: 113737

SEQ ID NO: 528941 - RNA, 64 nt, hsa; identical to SEQ ID NO: 113738

SEQ ID NO: 528942 - RNA, 64 nt, hsa; identical to SEQ ID NO: 113739

SEQ ID NO: 528943 - RNA, 64 nt, hsa; identical to SEQ ID NO: 113740

SEQ ID NO: 528944 - RNA, 64 nt, hsa; identical to SEQ ID NO: 113741

SEQ ID NO: 528945 - RNA, 64 nt, hsa; identical to SEQ ID NO: 113742

SEQ ID NO: 528946 - RNA, 64 nt, hsa; identical to SEQ ID NO: 113743

SEQ ID NO: 528947 - RNA, 64 nt, hsa; identical to SEQ ID NO: 113744

SEQ ID NO: 528948 - RNA, 64 nt, hsa; identical to SEQ ID NO: 113745

SEQ ID NO: 528949 - RNA, 64 nt, hsa; identical to SEQ ID NO: 113746

SEQ ID NO: 528950 - RNA, 64 nt, hsa; identical to SEQ ID NO: 113747

SEQ ID NO: 528951 - RNA, 64 nt, hsa; identical to SEQ ID NO: 113748

SEQ ID NO: 528952 - RNA, 64 nt, hsa; identical to SEQ ID NO: 113749

SEQ ID NO: 528953 - RNA, 64 nt, hsa; identical to SEQ ID NO: 113750

SEQ ID NO: 528954 - RNA, 64 nt, hsa; identical to SEQ ID NO: 113751

SEQ ID NO: 528955 - RNA, 64 nt, hsa; identical to SEQ ID NO: 113752

SEQ ID NO: 528956 - RNA, 64 nt, hsa; identical to SEQ ID NO: 113753

SEQ ID NO: 528957 - RNA, 64 nt, hsa; identical to SEQ ID NO: 113754

SEQ ID NO: 528958 - RNA, 64 nt, hsa; identical to SEQ ID NO: 113755

SEQ ID NO: 528959 - RNA, 64 nt, hsa; identical to SEQ ID NO: 113756

SEQ ID NO: 528960 - RNA, 64 nt, hsa; identical to SEQ ID NO: 113757

SEQ ID NO: 528961 - RNA, 64 nt, hsa; identical to SEQ ID NO: 113758

SEQ ID NO: 528962 - RNA, 64 nt, hsa; identical to SEQ ID NO: 113759

SEQ ID NO: 528963 - RNA, 64 nt, hsa; identical to SEQ ID NO: 113760

SEQ ID NO: 528964 - RNA, 64 nt, hsa; identical to SEQ ID NO: 113761

SEQ ID NO: 528965 - RNA, 64 nt, hsa; identical to SEQ ID NO: 113762

SEQ ID NO: 528966 - RNA, 64 nt, hsa; identical to SEQ ID NO: 113763

SEQ ID NO: 528967 - RNA, 64 nt, hsa; identical to SEQ ID NO: 113764

SEQ ID NO: 528968 - RNA, 61 nt, hsa; identical to SEQ ID NO: 113765

SEQ ID NO: 528969 - RNA, 64 nt, hsa; identical to SEQ ID NO: 113766

SEQ ID NO: 528970 - RNA, 64 nt, hsa; identical to SEQ ID NO: 113767

SEQ ID NO: 528971 - RNA, 64 nt, hsa; identical to SEQ ID NO: 113768

SEQ ID NO: 528972 - RNA, 64 nt, hsa; identical to SEQ ID NO: 113769

SEQ ID NO: 528973 - RNA, 64 nt, hsa; identical to SEQ ID NO: 113770

SEQ ID NO: 528974 - RNA, 64 nt, hsa; identical to SEQ ID NO: 113771

SEQ ID NO: 528975 - RNA, 64 nt, hsa; identical to SEQ ID NO: 113772

SEQ ID NO: 528976 - RNA, 64 nt, hsa; identical to SEQ ID NO: 113773

SEQ ID NO: 528977 - RNA, 64 nt, hsa; identical to SEQ ID NO: 113774

SEQ ID NO: 528978 - RNA, 64 nt, hsa; identical to SEQ ID NO: 113775

SEQ ID NO: 528979 - RNA, 64 nt, hsa; identical to SEQ ID NO: 113776

SEQ ID NO: 528980 - RNA, 64 nt, hsa; identical to SEQ ID NO: 113777

SEQ ID NO: 528981 - RNA, 64 nt, hsa; identical to SEQ ID NO: 113778

SEQ ID NO: 528982 - RNA, 64 nt, hsa; identical to SEQ ID NO: 113779

SEQ ID NO: 528983 - RNA, 64 nt, hsa; identical to SEQ ID NO: 113780

SEQ ID NO: 528984 - RNA, 64 nt, hsa; identical to SEQ ID NO: 113781

SEQ ID NO: 528985 - RNA, 64 nt, hsa; identical to SEQ ID NO: 113782

SEQ ID NO: 528986 - RNA, 64 nt, hsa; identical to SEQ ID NO: 113783

SEQ ID NO: 528987 - RNA, 64 nt, hsa; identical to SEQ ID NO: 113784

SEQ ID NO: 528988 - RNA, 64 nt, hsa; identical to SEQ ID NO: 113785

SEQ ID NO: 528989 - RNA, 64 nt, hsa; identical to SEQ ID NO: 113786

SEQ ID NO: 528990 - RNA, 64 nt, hsa; identical to SEQ ID NO: 113787

SEQ ID NO: 528991 - RNA, 64 nt, hsa; identical to SEQ ID NO: 113788

SEQ ID NO: 528992 - RNA, 64 nt, hsa; identical to SEQ ID NO: 113789

SEQ ID NO: 528993 - RNA, 64 nt, hsa; identical to SEQ ID NO: 113790

SEQ ID NO: 528994 - RNA, 64 nt, hsa; identical to SEQ ID NO: 113791

SEQ ID NO: 528995 - RNA, 64 nt, hsa; identical to SEQ ID NO: 113792

SEQ ID NO: 528996 - RNA, 64 nt, hsa; identical to SEQ ID NO: 113793

SEQ ID NO: 528997 - RNA, 64 nt, hsa; identical to SEQ ID NO: 113794

SEQ ID NO: 528998 - RNA, 64 nt, hsa; identical to SEQ ID NO: 113795

SEQ ID NO: 528999 - RNA, 64 nt, hsa; identical to SEQ ID NO: 113796

SEQ ID NO: 529000 - RNA, 64 nt, hsa; identical to SEQ ID NO: 113797

SEQ ID NO: 529001 - RNA, 64 nt, hsa; identical to SEQ ID NO: 113798

SEQ ID NO: 529002 - RNA, 64 nt, hsa; identical to SEQ ID NO: 113799

SEQ ID NO: 529003 - RNA, 64 nt, hsa; identical to SEQ ID NO: 113800

SEQ ID NO: 529004 - RNA, 64 nt, hsa; identical to SEQ ID NO: 113801

SEQ ID NO: 529005 - RNA, 64 nt, hsa; identical to SEQ ID NO: 113802

SEQ ID NO: 529006 - RNA, 64 nt, hsa; identical to SEQ ID NO: 113803

SEQ ID NO: 529007 - RNA, 64 nt, hsa; identical to SEQ ID NO: 113804

SEQ ID NO: 529008 - RNA, 64 nt, hsa; identical to SEQ ID NO: 113805

SEQ ID NO: 529009 - RNA, 64 nt, hsa; identical to SEQ ID NO: 113806

SEQ ID NO: 529010 - RNA, 64 nt, hsa; identical to SEQ ID NO: 113807

SEQ ID NO: 529011 - RNA, 64 nt, hsa; identical to SEQ ID NO: 113808

SEQ ID NO: 529012 - RNA, 64 nt, hsa; identical to SEQ ID NO: 113809

SEQ ID NO: 529013 - RNA, 64 nt, hsa; identical to SEQ ID NO: 113810

SEQ ID NO: 529014 - RNA, 64 nt, hsa; identical to SEQ ID NO: 113811

SEQ ID NO: 529015 - RNA, 64 nt, hsa
guguuagauggaaaaugcugugugcugccaugguaaucagaaauaauaaccuguuagggaugua

SEQ ID NO: 529016 - RNA, 64 nt, hsa
agaaauaauaaccuguuagggauguauucuaggaaaucagaaguaguucucuuuucuugcugga

SEQ ID NO: 529017 - RNA, 64 nt, hsa
uguaaaaccuucuauuugaugucauuccauuuauaaucagaaaaaaaacuuauuucuuaaucaa

SEQ ID NO: 529018 - RNA, 64 nt, hsa
cgucucauguuuggcccuuuagaauugggguagaaaucagaaaugagaugaggggaagaagcaa

SEQ ID NO: 529019 - RNA, 64 nt, hsa
cuucuaagguuuuaaaauccaguaucaagaagaaaaucagaaauacugguuggugaaauaaaga

SEQ ID NO: 529020 - RNA, 64 nt, hsa
guacgguuuuacacaacuccuuaccauuaaacugaaucagaaauccauuuucuggcugaauaaa

SEQ ID NO: 529021 - RNA, 64 nt, hsa
aauuuggaggcuggaguaaucagauuacugcuuuaaucagaaacccucauuguguuucuaccgg

SEQ ID NO: 529022 - RNA, 64 nt, hsa
aguuaacauuaaugccugcuuuuuggaaagucagaaucagaagauagucuuggaagcuguuugg

SEQ ID NO: 529023 - RNA, 64 nt, hsa
uaauugugaaauuauaugauucauauauuuuaugaaucagaauaaccuucaaauaaaauaaauc

SEQ ID NO: 529024 - RNA, 64 nt, hsa
gcaguaugauuuguacaugccauugaaaauuauuaaucagaagaaaauuaagcagggucuuugc

SEQ ID NO: 529025 - RNA, 64 nt, hsa
uaacuuugaauccauccagccacuugcaaaugauaaucagaagucagcuuguucacuguuagaa

SEQ ID NO: 529026 - RNA, 64 nt, hsa
cagaccucuccacagcucaaagcauugcccuaagaaucagaaguaaagauaauccaagagcaaa

SEQ ID NO: 529027 - RNA, 64 nt, hsa
uagauaaaucagaacucuccuuaaaaugcauuucaaucagaagcaaaguacacccauuauuuau

SEQ ID NO: 529028 - RNA, 64 nt, hsa
ugaauucaaucaaugcagagaacgcuuuuagauaaaucagaacucuccuuaaaaugcauuucaa

SEQ ID NO: 529029 - RNA, 64 nt, hsa
aauaauaauaaaguaaaaauaaaaauaaaaaaguaaucagaagcuaaaguaaaguuccuuuccu

SEQ ID NO: 529030 - RNA, 64 nt, hsa
uuccucaguaucuauuccaagauacugaggucauaaucagaagcuaagcugggugcaguggcuc

SEQ ID NO: 529031 - RNA, 64 nt, hsa
cucaucuuucugcccggcuacaucagccuucaagaaucagaagaaaggccaaggugcuggacug

SEQ ID NO: 529032 - RNA, 64 nt, hsa
aagcagcaacagccuacaaagagaugcuuggagcaaucagaacuucaggugugacucuagcaag

SEQ ID NO: 529033 - RNA, 64 nt, hsa
ggaccugacuaugagaaguagaaauaaucagaaaaaucagaaaugauugcauuggaagaucauu

SEQ ID NO: 529034 - RNA, 64 nt, hsa
uuguggcuuggaccugacuaugagaaguagaaauaaucagaaaaaucagaaaugauugcauugg

SEQ ID NO: 529035 - RNA, 64 nt, hsa
acccuguagugcaaaaugucaauuuuuaauguauaaucagaagucugaauuuuuauaaaacaua

SEQ ID NO: 529036 - RNA, 64 nt, hsa
ugaauucauggagccaucauaaaaauauuuuuaaaaucagaauuauugauacccuguagugcaa

SEQ ID NO: 529037 - RNA, 64 nt, hsa
ucuggugagacggagaccccgguggcaguggaaaaaucagaagcacaaaggaaaacucuuggcc

SEQ ID NO: 529038 - RNA, 64 nt, hsa
ggcgaacacagguguuggaagccaggacugugauaaucagaagcuauaagagaacuuucggagc

SEQ ID NO: 529039 - RNA, 64 nt, hsa
caucugugucuuuuguccuuuuauuuguacagauaaucagaagaugauacugaauagauauaaa

SEQ ID NO: 529040 - RNA, 64 nt, hsa
auaaaaagggauuaaucugcuaaaauguaaucuaaaucagaauuuugauaaauuuuuuuuguaa

SEQ ID NO: 529041 - RNA, 64 nt, hsa
cucaaauguagcauuaguauuucuaagugaacagaaucagaaguuaauuuuuaaguguuuguaa

SEQ ID NO: 529042 - RNA, 64 nt, hsa
augauauuaagcaucuaggaucacgugcucauugaaucagaaaaaaaguggaagguuugguuuc

SEQ ID NO: 529043 - RNA, 64 nt, hsa
agcuguauagcuggguucuaagcuucaccaugcaaaucagaaauuuuaucucuaaguacaggcu

SEQ ID NO: 529044 - RNA, 64 nt, hsa
aagagaacucgacuggcuaucaggaagagauggaaaucagaaaaucccaucacuccagcagcug

SEQ ID NO: 529045 - RNA, 64 nt, hsa
uuuuuuuuauuuuuaauuuuggaaauucugcagaaaucagaacucuuaccaugguuugaacaaa

SEQ ID NO: 529046 - RNA, 64 nt, hsa
ugacuuuaaaaauauugcagugcuauuuuuucuuaaucagaaaggaaaauucucaaggccuuuu

SEQ ID NO: 529047 - RNA, 64 nt, hsa
uagugcuaguagauauuacuacccuccugagggaaaucagaaaugauuuaaccccgguggaaua

SEQ ID NO: 529048 - RNA, 64 nt, hsa
acaaagcuguuuaaagaaaaagguauauauaaguaaucagaacacuuagaagacugauagaugu

SEQ ID NO: 529049 - RNA, 64 nt, hsa
cuagcggcuaaguaccuccuacacauuucccaucaaucagaaaauagacagguacacuaaaggg

SEQ ID NO: 529050 - RNA, 64 nt, hsa
aucgaauuuaauuuccuuucccucauucugcagcaaucagaauacacaaucuuaaccacucggu

SEQ ID NO: 529051 - RNA, 64 nt, hsa
gacggguuaccaaugucagguuauacuaaaacuaaaucagaaagucugaauguagcacauaaug

SEQ ID NO: 529052 - RNA, 64 nt, hsa
gguuuguuugguuuguccuuuuuuuugcguuuuuaaucagaaaacaaaauagaggcagcuuuug

SEQ ID NO: 529053 - RNA, 64 nt, hsa
uuuggcccaggcuccacggcgacaguugggcccaaaucagaaaggagagagggggccaaugagg

SEQ ID NO: 529054 - RNA, 64 nt, hsa
uuuauuuuggagucuaguauuucaauaauuuaagaaucagaagcacugaccuuucuacauuuua

SEQ ID NO: 529055 - RNA, 64 nt, hsa
guggucacauauaguguucucaagcuuuacugugaaucagaaacauccaguaagcuugugacaa

SEQ ID NO: 529056 - RNA, 64 nt, hsa
agucccauuauauacuuuuggggacaguguuauaaaucagaauuuuacgacaguuugcagaaca

SEQ ID NO: 529057 - RNA, 64 nt, hsa
uuagggggccucuuggccuugguccaaaauugucaaucagaaaugaacauaaaggacuccagag

SEQ ID NO: 529058 - RNA, 64 nt, hsa
aagacauggaugaucugggagagucucacuuuggaaucagaauuggaaucacauucuguuuauc

SEQ ID NO: 529059 - RNA, 64 nt, hsa
auacuaauuuguaagccccaccucaggccuacugaaucagaagcucuggggguuggguccagaa

SEQ ID NO: 529060 - RNA, 64 nt, hsa
gcauuuuuacuuuugaaccaaaaagagaaaaaaaaaucagaaguguugcaucuugaggcgaauu

SEQ ID NO: 529061 - RNA, 64 nt, hsa
uuucacaccuugcaaaaggagaucuaaaaaacacaaucagaaaugacaaaggggacauuaccac

SEQ ID NO: 529062 - RNA, 64 nt, hsa
ucuacaaugagaauuacaaagcagugcacaaagaaaucagaaacaauaaaaauugaaaaauauc

SEQ ID NO: 529063 - RNA, 64 nt, hsa
auuucuaucaaacuaccaauggcauuuuucacagaaucagaagaaaacauucugaaauuuauuu

SEQ ID NO: 529064 - RNA, 64 nt, hsa
agggaccacugaaugccccgaucccaaucagguuaaucagaaucacuuagagaacuuaaaaaua

SEQ ID NO: 529065 - RNA, 64 nt, hsa
uccaagaccuacugagugagaaucuugaggguggaaucagaaucuauuuugaaaaggcaucccc

SEQ ID NO: 529066 - RNA, 64 nt, hsa
cagaauguaguauuuugauaucauuaaguaaaccaaucagaaaacuccuugagcaauaguuguu

SEQ ID NO: 529067 - RNA, 64 nt, hsa
uuuuguuuucaaaacuagaauaaucucaccacagaaucagaauuuucuaccguuccacacccaa

SEQ ID NO: 529068 - RNA, 64 nt, hsa
acugacauuaaauucuagauguugacaauuacugaaucagaaggcaugaaagaguauaauuuua

SEQ ID NO: 529069 - RNA, 64 nt, hsa
cuuuaaaaaaguauauagaacaguuacuucuaauaaucagaaagagauguuuuauagaacauuu

SEQ ID NO: 529070 - RNA, 64 nt, hsa
gaauuccacugccagugacccacugccuccggccguacacgacagugccuugacccaacagcca

SEQ ID NO: 529071 - RNA, 64 nt, hsa
caagcuaaaagaaucgaagacaucccuagugcauguacacgaaugcccuacgucauccuuccag

SEQ ID NO: 529072 - RNA, 64 nt, hsa
gagccaacuucuacccauugcagcagaccaauguguacacgacuacuuacuacccaagcccccu

SEQ ID NO: 529073 - RNA, 64 nt, hsa
cacaauucuuuuuuauuacacuucgaauuuuaggguacacgagcacaacgugcagguuaguuac

SEQ ID NO: 529074 - RNA, 64 nt, hsa
gcugcacaugcaucaacaaauuacaacauguuuuguacacgaauaaacccauuacaagaaugua

SEQ ID NO: 529075 - RNA, 64 nt, hsa
acccggccaggagacaaggguacgggccucucugguacacgagcgugggguucggcggccuggu

SEQ ID NO: 529076 - RNA, 64 nt, hsa
uaaugccuguuuucaucuguaaauaguuaaguauguacacgaggcacuacuucugauuuauugc

SEQ ID NO: 529077 - RNA, 64 nt, hsa
cugcccacgcuccuucuuuagcucugacaccugaguacacgaucacccacucuuaccugcucgg

SEQ ID NO: 529078 - RNA, 64 nt, hsa
guuuaaaauauacugaaugcaaucuagauguauuguacacgaaaggugaaaaauaacaggugcu

SEQ ID NO: 529079 - RNA, 64 nt, hsa
uggcagugggcugcaguggaaaucaacucaagauguacacgaagguuuuuuaggggggcagaua

SEQ ID NO: 529080 - RNA, 64 nt, hsa
uuuaaucauuuuaagugcaugaaauguaugcuuuguacacgacacuucaauaaagcuauccaga

SEQ ID NO: 529081 - RNA, 64 nt, hsa
gugugugagacuacuaagaggcauggccccaacgguacacgacucaguauccaugcucuugacc

SEQ ID NO: 529082 - RNA, 64 nt, hsa
guauguuaacuuuuuagcacauguuuuguacuugguacacgagaaaacccagcuuucaucuuuu

SEQ ID NO: 529083 - RNA, 64 nt, hsa
guucccuguuuuaaucacaugacuaccugucccaguacacgaaagggcgcugguuggcauucuu

SEQ ID NO: 529084 - RNA, 64 nt, hsa
uaauguuuauccguuuaaacauuucguccuccugguacacgaagggaacugucugcccaggagc

SEQ ID NO: 529085 - RNA, 64 nt, hsa
acggcccagcagcuccuguggccacagcagcuuuguacacgaagaccauccauccucccuucgu

SEQ ID NO: 529086 - RNA, 64 nt, hsa
aguacacaggcaugacugggaucccguguaccgaguacacgacccagguauguaccaaguaggc

SEQ ID NO: 529087 - RNA, 64 nt, hsa
aucagguagaacaacaaaagcacuuuuccaucuuguacacgagauacaccaacauagcuacaau

SEQ ID NO: 529088 - RNA, 64 nt, hsa
cuccugcuccuccaaccuuuuuuugccaagguuuguacacgacucccaucuaggcugaaaaccu

SEQ ID NO: 529089 - RNA, 64 nt, hsa
auaaaacucugcuuuguccgacauuugcaaagagguacacgaggaaauggaauugguauuucau

SEQ ID NO: 529090 - RNA, 64 nt, hsa
cuaacauuguucaggcgcauggccccugcgguguguacacgaacucggcuucuuuuguccuagg

SEQ ID NO: 529091 - RNA, 64 nt, hsa; identical to SEQ ID NO: 115977

SEQ ID NO: 529092 - RNA, 64 nt, hsa; identical to SEQ ID NO: 115978

SEQ ID NO: 529093 - RNA, 64 nt, hsa; identical to SEQ ID NO: 115979

SEQ ID NO: 529094 - RNA, 64 nt, hsa; identical to SEQ ID NO: 115980

SEQ ID NO: 529095 - RNA, 64 nt, hsa; identical to SEQ ID NO: 115981

SEQ ID NO: 529096 - RNA, 64 nt, hsa; identical to SEQ ID NO: 115982

SEQ ID NO: 529097 - RNA, 64 nt, hsa; identical to SEQ ID NO: 115983

SEQ ID NO: 529098 - RNA, 64 nt, hsa; identical to SEQ ID NO: 115984

SEQ ID NO: 529099 - RNA, 64 nt, hsa; identical to SEQ ID NO: 115985

SEQ ID NO: 529100 - RNA, 64 nt, hsa; identical to SEQ ID NO: 115986

SEQ ID NO: 529101 - RNA, 64 nt, hsa; identical to SEQ ID NO: 115987

SEQ ID NO: 529102 - RNA, 64 nt, hsa; identical to SEQ ID NO: 115988

SEQ ID NO: 529103 - RNA, 64 nt, hsa; identical to SEQ ID NO: 115989

SEQ ID NO: 529104 - RNA, 64 nt, hsa; identical to SEQ ID NO: 115990

SEQ ID NO: 529105 - RNA, 64 nt, hsa; identical to SEQ ID NO: 115991

SEQ ID NO: 529106 - RNA, 64 nt, hsa; identical to SEQ ID NO: 115992

SEQ ID NO: 529107 - RNA, 64 nt, hsa; identical to SEQ ID NO: 115993

SEQ ID NO: 529108 - RNA, 64 nt, hsa; identical to SEQ ID NO: 115994

SEQ ID NO: 529109 - RNA, 64 nt, hsa; identical to SEQ ID NO: 115995

SEQ ID NO: 529110 - RNA, 64 nt, hsa; identical to SEQ ID NO: 115996

SEQ ID NO: 529111 - RNA, 64 nt, hsa; identical to SEQ ID NO: 115997

SEQ ID NO: 529112 - RNA, 64 nt, hsa; identical to SEQ ID NO: 115998

SEQ ID NO: 529113 - RNA, 64 nt, hsa; identical to SEQ ID NO: 115999

SEQ ID NO: 529114 - RNA, 64 nt, hsa; identical to SEQ ID NO: 116000

SEQ ID NO: 529115 - RNA, 64 nt, hsa; identical to SEQ ID NO: 116001

SEQ ID NO: 529116 - RNA, 64 nt, hsa; identical to SEQ ID NO: 116002

SEQ ID NO: 529117 - RNA, 64 nt, hsa; identical to SEQ ID NO: 116003

SEQ ID NO: 529118 - RNA, 64 nt, hsa; identical to SEQ ID NO: 116004

SEQ ID NO: 529119 - RNA, 64 nt, hsa; identical to SEQ ID NO: 116005

SEQ ID NO: 529120 - RNA, 64 nt, hsa; identical to SEQ ID NO: 116006

SEQ ID NO: 529121 - RNA, 64 nt, hsa; identical to SEQ ID NO: 116007

SEQ ID NO: 529122 - RNA, 64 nt, hsa; identical to SEQ ID NO: 116008

SEQ ID NO: 529123 - RNA, 64 nt, hsa; identical to SEQ ID NO: 116009

SEQ ID NO: 529124 - RNA, 64 nt, hsa; identical to SEQ ID NO: 116010

SEQ ID NO: 529125 - RNA, 64 nt, hsa; identical to SEQ ID NO: 116011

SEQ ID NO: 529126 - RNA, 64 nt, hsa; identical to SEQ ID NO: 116012

SEQ ID NO: 529127 - RNA, 64 nt, hsa; identical to SEQ ID NO: 116013

SEQ ID NO: 529128 - RNA, 64 nt, hsa; identical to SEQ ID NO: 116014

SEQ ID NO: 529129 - RNA, 64 nt, hsa; identical to SEQ ID NO: 116015

SEQ ID NO: 529130 - RNA, 64 nt, hsa; identical to SEQ ID NO: 116016

SEQ ID NO: 529131 - RNA, 64 nt, hsa; identical to SEQ ID NO: 116017

SEQ ID NO: 529132 - RNA, 64 nt, hsa; identical to SEQ ID NO: 116018

SEQ ID NO: 529133 - RNA, 64 nt, hsa; identical to SEQ ID NO: 116019

SEQ ID NO: 529134 - RNA, 64 nt, hsa; identical to SEQ ID NO: 116020

SEQ ID NO: 529135 - RNA, 64 nt, hsa; identical to SEQ ID NO: 116021

SEQ ID NO: 529136 - RNA, 64 nt, hsa; identical to SEQ ID NO: 116022

SEQ ID NO: 529137 - RNA, 64 nt, hsa; identical to SEQ ID NO: 116023

SEQ ID NO: 529138 - RNA, 64 nt, hsa; identical to SEQ ID NO: 116024

SEQ ID NO: 529139 - RNA, 64 nt, hsa; identical to SEQ ID NO: 116025

SEQ ID NO: 529140 - RNA, 64 nt, hsa; identical to SEQ ID NO: 116026

SEQ ID NO: 529141 - RNA, 64 nt, hsa; identical to SEQ ID NO: 116027

SEQ ID NO: 529142 - RNA, 64 nt, hsa; identical to SEQ ID NO: 116028

SEQ ID NO: 529143 - RNA, 64 nt, hsa; identical to SEQ ID NO: 116029

SEQ ID NO: 529144 - RNA, 64 nt, hsa; identical to SEQ ID NO: 116030

SEQ ID NO: 529145 - RNA, 64 nt, hsa; identical to SEQ ID NO: 116031

SEQ ID NO: 529146 - RNA, 64 nt, hsa; identical to SEQ ID NO: 116032

SEQ ID NO: 529147 - RNA, 64 nt, hsa; identical to SEQ ID NO: 116033

SEQ ID NO: 529148 - RNA, 64 nt, hsa; identical to SEQ ID NO: 116034

SEQ ID NO: 529149 - RNA, 64 nt, hsa; identical to SEQ ID NO: 116035

SEQ ID NO: 529150 - RNA, 64 nt, hsa; identical to SEQ ID NO: 116036

SEQ ID NO: 529151 - RNA, 64 nt, hsa; identical to SEQ ID NO: 116037

SEQ ID NO: 529152 - RNA, 64 nt, hsa; identical to SEQ ID NO: 116038

SEQ ID NO: 529153 - RNA, 64 nt, hsa; identical to SEQ ID NO: 116039

SEQ ID NO: 529154 - RNA, 64 nt, hsa; identical to SEQ ID NO: 116040

SEQ ID NO: 529155 - RNA, 64 nt, hsa; identical to SEQ ID NO: 116041

SEQ ID NO: 529156 - RNA, 64 nt, hsa; identical to SEQ ID NO: 116042

SEQ ID NO: 529157 - RNA, 64 nt, hsa; identical to SEQ ID NO: 116043

SEQ ID NO: 529158 - RNA, 64 nt, hsa; identical to SEQ ID NO: 116044

SEQ ID NO: 529159 - RNA, 64 nt, hsa; identical to SEQ ID NO: 116045

SEQ ID NO: 529160 - RNA, 64 nt, hsa; identical to SEQ ID NO: 116046

SEQ ID NO: 529161 - RNA, 64 nt, hsa; identical to SEQ ID NO: 116047

SEQ ID NO: 529162 - RNA, 64 nt, hsa; identical to SEQ ID NO: 116048

SEQ ID NO: 529163 - RNA, 64 nt, hsa; identical to SEQ ID NO: 116049

SEQ ID NO: 529164 - RNA, 64 nt, hsa; identical to SEQ ID NO: 116050

SEQ ID NO: 529165 - RNA, 64 nt, hsa; identical to SEQ ID NO: 116051

SEQ ID NO: 529166 - RNA, 64 nt, hsa; identical to SEQ ID NO: 116052

SEQ ID NO: 529167 - RNA, 64 nt, hsa; identical to SEQ ID NO: 116053

SEQ ID NO: 529168 - RNA, 64 nt, hsa; identical to SEQ ID NO: 116054

SEQ ID NO: 529169 - RNA, 64 nt, hsa; identical to SEQ ID NO: 116055

SEQ ID NO: 529170 - RNA, 64 nt, hsa; identical to SEQ ID NO: 116056

SEQ ID NO: 529171 - RNA, 64 nt, hsa; identical to SEQ ID NO: 116057

SEQ ID NO: 529172 - RNA, 64 nt, hsa; identical to SEQ ID NO: 116058

SEQ ID NO: 529173 - RNA, 64 nt, hsa; identical to SEQ ID NO: 116059

SEQ ID NO: 529174 - RNA, 64 nt, hsa; identical to SEQ ID NO: 116060

SEQ ID NO: 529175 - RNA, 64 nt, hsa; identical to SEQ ID NO: 116061

SEQ ID NO: 529176 - RNA, 64 nt, hsa; identical to SEQ ID NO: 116062

SEQ ID NO: 529177 - RNA, 64 nt, hsa; identical to SEQ ID NO: 116063

SEQ ID NO: 529178 - RNA, 64 nt, hsa; identical to SEQ ID NO: 116064

SEQ ID NO: 529179 - RNA, 64 nt, hsa; identical to SEQ ID NO: 116065

SEQ ID NO: 529180 - RNA, 64 nt, hsa; identical to SEQ ID NO: 116066

SEQ ID NO: 529181 - RNA, 64 nt, hsa; identical to SEQ ID NO: 116067

SEQ ID NO: 529182 - RNA, 64 nt, hsa; identical to SEQ ID NO: 116068

SEQ ID NO: 529183 - RNA, 64 nt, hsa; identical to SEQ ID NO: 116069

SEQ ID NO: 529184 - RNA, 64 nt, hsa; identical to SEQ ID NO: 116070

SEQ ID NO: 529185 - RNA, 64 nt, hsa; identical to SEQ ID NO: 116071

SEQ ID NO: 529186 - RNA, 64 nt, hsa; identical to SEQ ID NO: 116072

SEQ ID NO: 529187 - RNA, 64 nt, hsa; identical to SEQ ID NO: 116073

SEQ ID NO: 529188 - RNA, 64 nt, hsa; identical to SEQ ID NO: 116074

SEQ ID NO: 529189 - RNA, 64 nt, hsa; identical to SEQ ID NO: 116075

SEQ ID NO: 529190 - RNA, 64 nt, hsa; identical to SEQ ID NO: 116076

SEQ ID NO: 529191 - RNA, 64 nt, hsa; identical to SEQ ID NO: 116077

SEQ ID NO: 529192 - RNA, 64 nt, hsa; identical to SEQ ID NO: 116078

SEQ ID NO: 529193 - RNA, 64 nt, hsa; identical to SEQ ID NO: 116079

SEQ ID NO: 529194 - RNA, 64 nt, hsa; identical to SEQ ID NO: 116080

SEQ ID NO: 529195 - RNA, 64 nt, hsa; identical to SEQ ID NO: 116081

SEQ ID NO: 529196 - RNA, 64 nt, hsa; identical to SEQ ID NO: 116082

SEQ ID NO: 529197 - RNA, 64 nt, hsa; identical to SEQ ID NO: 116083

SEQ ID NO: 529198 - RNA, 64 nt, hsa; identical to SEQ ID NO: 116084

SEQ ID NO: 529199 - RNA, 64 nt, hsa; identical to SEQ ID NO: 116085

SEQ ID NO: 529200 - RNA, 64 nt, hsa; identical to SEQ ID NO: 116086

SEQ ID NO: 529201 - RNA, 64 nt, hsa; identical to SEQ ID NO: 116087

SEQ ID NO: 529202 - RNA, 64 nt, hsa; identical to SEQ ID NO: 116088

SEQ ID NO: 529203 - RNA, 64 nt, hsa; identical to SEQ ID NO: 116089

SEQ ID NO: 529204 - RNA, 64 nt, hsa; identical to SEQ ID NO: 116090

SEQ ID NO: 529205 - RNA, 64 nt, hsa; identical to SEQ ID NO: 116091

SEQ ID NO: 529206 - RNA, 64 nt, hsa; identical to SEQ ID NO: 116092

SEQ ID NO: 529207 - RNA, 64 nt, hsa; identical to SEQ ID NO: 116093

SEQ ID NO: 529208 - RNA, 64 nt, hsa; identical to SEQ ID NO: 116094

SEQ ID NO: 529209 - RNA, 64 nt, hsa; identical to SEQ ID NO: 116095

SEQ ID NO: 529210 - RNA, 64 nt, hsa; identical to SEQ ID NO: 116096

SEQ ID NO: 529211 - RNA, 64 nt, hsa; identical to SEQ ID NO: 116097

SEQ ID NO: 529212 - RNA, 64 nt, hsa; identical to SEQ ID NO: 116098

SEQ ID NO: 529213 - RNA, 64 nt, hsa; identical to SEQ ID NO: 116099

SEQ ID NO: 529214 - RNA, 64 nt, hsa; identical to SEQ ID NO: 116100

SEQ ID NO: 529215 - RNA, 64 nt, hsa; identical to SEQ ID NO: 116101

SEQ ID NO: 529216 - RNA, 64 nt, hsa; identical to SEQ ID NO: 116102

SEQ ID NO: 529217 - RNA, 64 nt, hsa; identical to SEQ ID NO: 116103

SEQ ID NO: 529218 - RNA, 64 nt, hsa; identical to SEQ ID NO: 116104

SEQ ID NO: 529219 - RNA, 64 nt, hsa; identical to SEQ ID NO: 116105

SEQ ID NO: 529220 - RNA, 64 nt, hsa; identical to SEQ ID NO: 116106

SEQ ID NO: 529221 - RNA, 64 nt, hsa; identical to SEQ ID NO: 116107

SEQ ID NO: 529222 - RNA, 64 nt, hsa; identical to SEQ ID NO: 116108

SEQ ID NO: 529223 - RNA, 64 nt, hsa; identical to SEQ ID NO: 116109

SEQ ID NO: 529224 - RNA, 64 nt, hsa; identical to SEQ ID NO: 116110

SEQ ID NO: 529225 - RNA, 64 nt, hsa; identical to SEQ ID NO: 116111

SEQ ID NO: 529226 - RNA, 64 nt, hsa; identical to SEQ ID NO: 116112

SEQ ID NO: 529227 - RNA, 64 nt, hsa; identical to SEQ ID NO: 116113

SEQ ID NO: 529228 - RNA, 64 nt, hsa; identical to SEQ ID NO: 116114

SEQ ID NO: 529229 - RNA, 64 nt, hsa; identical to SEQ ID NO: 116115

SEQ ID NO: 529230 - RNA, 64 nt, hsa; identical to SEQ ID NO: 116116

SEQ ID NO: 529231 - RNA, 64 nt, hsa; identical to SEQ ID NO: 116117

SEQ ID NO: 529232 - RNA, 64 nt, hsa; identical to SEQ ID NO: 116118

SEQ ID NO: 529233 - RNA, 64 nt, hsa; identical to SEQ ID NO: 116119

SEQ ID NO: 529234 - RNA, 64 nt, hsa; identical to SEQ ID NO: 116120

SEQ ID NO: 529235 - RNA, 64 nt, hsa; identical to SEQ ID NO: 116121

SEQ ID NO: 529236 - RNA, 64 nt, hsa; identical to SEQ ID NO: 116122

SEQ ID NO: 529237 - RNA, 64 nt, hsa; identical to SEQ ID NO: 116123

SEQ ID NO: 529238 - RNA, 64 nt, hsa; identical to SEQ ID NO: 116124

SEQ ID NO: 529239 - RNA, 64 nt, hsa; identical to SEQ ID NO: 116125

SEQ ID NO: 529240 - RNA, 64 nt, hsa; identical to SEQ ID NO: 116126

SEQ ID NO: 529241 - RNA, 64 nt, hsa; identical to SEQ ID NO: 116127

SEQ ID NO: 529242 - RNA, 64 nt, hsa; identical to SEQ ID NO: 116128

SEQ ID NO: 529243 - RNA, 64 nt, hsa; identical to SEQ ID NO: 116129

SEQ ID NO: 529244 - RNA, 64 nt, hsa; identical to SEQ ID NO: 116130

SEQ ID NO: 529245 - RNA, 64 nt, hsa; identical to SEQ ID NO: 116131

SEQ ID NO: 529246 - RNA, 64 nt, hsa; identical to SEQ ID NO: 116132

SEQ ID NO: 529247 - RNA, 64 nt, hsa; identical to SEQ ID NO: 116133

SEQ ID NO: 529248 - RNA, 64 nt, hsa; identical to SEQ ID NO: 116134

SEQ ID NO: 529249 - RNA, 64 nt, hsa; identical to SEQ ID NO: 116135

SEQ ID NO: 529250 - RNA, 64 nt, hsa; identical to SEQ ID NO: 116136

SEQ ID NO: 529251 - RNA, 64 nt, hsa; identical to SEQ ID NO: 116137

SEQ ID NO: 529252 - RNA, 64 nt, hsa; identical to SEQ ID NO: 116138

SEQ ID NO: 529253 - RNA, 64 nt, hsa; identical to SEQ ID NO: 116139

SEQ ID NO: 529254 - RNA, 64 nt, hsa; identical to SEQ ID NO: 116140

SEQ ID NO: 529255 - RNA, 64 nt, hsa; identical to SEQ ID NO: 116141

SEQ ID NO: 529256 - RNA, 64 nt, hsa; identical to SEQ ID NO: 116142

SEQ ID NO: 529257 - RNA, 64 nt, hsa; identical to SEQ ID NO: 116143

SEQ ID NO: 529258 - RNA, 64 nt, hsa; identical to SEQ ID NO: 116144

SEQ ID NO: 529259 - RNA, 64 nt, hsa; identical to SEQ ID NO: 116145

SEQ ID NO: 529260 - RNA, 64 nt, hsa; identical to SEQ ID NO: 116146

SEQ ID NO: 529261 - RNA, 64 nt, hsa; identical to SEQ ID NO: 116147

SEQ ID NO: 529262 - RNA, 64 nt, hsa; identical to SEQ ID NO: 116148

SEQ ID NO: 529263 - RNA, 64 nt, hsa; identical to SEQ ID NO: 116149

SEQ ID NO: 529264 - RNA, 64 nt, hsa; identical to SEQ ID NO: 116150

SEQ ID NO: 529265 - RNA, 64 nt, hsa; identical to SEQ ID NO: 116151

SEQ ID NO: 529266 - RNA, 64 nt, hsa; identical to SEQ ID NO: 116152

SEQ ID NO: 529267 - RNA, 64 nt, hsa; identical to SEQ ID NO: 116153

SEQ ID NO: 529268 - RNA, 64 nt, hsa; identical to SEQ ID NO: 116154

SEQ ID NO: 529269 - RNA, 64 nt, hsa; identical to SEQ ID NO: 116155

SEQ ID NO: 529270 - RNA, 64 nt, hsa; identical to SEQ ID NO: 116156

SEQ ID NO: 529271 - RNA, 64 nt, hsa; identical to SEQ ID NO: 116157

SEQ ID NO: 529272 - RNA, 64 nt, hsa; identical to SEQ ID NO: 116158

SEQ ID NO: 529273 - RNA, 64 nt, hsa; identical to SEQ ID NO: 116159

SEQ ID NO: 529274 - RNA, 64 nt, hsa; identical to SEQ ID NO: 116160

SEQ ID NO: 529275 - RNA, 64 nt, hsa; identical to SEQ ID NO: 116161

SEQ ID NO: 529276 - RNA, 64 nt, hsa; identical to SEQ ID NO: 116162

SEQ ID NO: 529277 - RNA, 64 nt, hsa; identical to SEQ ID NO: 116163

SEQ ID NO: 529278 - RNA, 64 nt, hsa; identical to SEQ ID NO: 116164

SEQ ID NO: 529279 - RNA, 64 nt, hsa; identical to SEQ ID NO: 116165

SEQ ID NO: 529280 - RNA, 64 nt, hsa; identical to SEQ ID NO: 116166

SEQ ID NO: 529281 - RNA, 64 nt, hsa; identical to SEQ ID NO: 116167

SEQ ID NO: 529282 - RNA, 64 nt, hsa; identical to SEQ ID NO: 116168

SEQ ID NO: 529283 - RNA, 64 nt, hsa; identical to SEQ ID NO: 116169

SEQ ID NO: 529284 - RNA, 64 nt, hsa; identical to SEQ ID NO: 116170

SEQ ID NO: 529285 - RNA, 64 nt, hsa; identical to SEQ ID NO: 116171

SEQ ID NO: 529286 - RNA, 64 nt, hsa; identical to SEQ ID NO: 116172

SEQ ID NO: 529287 - RNA, 64 nt, hsa; identical to SEQ ID NO: 116173

SEQ ID NO: 529288 - RNA, 64 nt, hsa; identical to SEQ ID NO: 116174

SEQ ID NO: 529289 - RNA, 64 nt, hsa; identical to SEQ ID NO: 116175

SEQ ID NO: 529290 - RNA, 64 nt, hsa; identical to SEQ ID NO: 116176

SEQ ID NO: 529291 - RNA, 64 nt, hsa; identical to SEQ ID NO: 116177

SEQ ID NO: 529292 - RNA, 64 nt, hsa; identical to SEQ ID NO: 116178

SEQ ID NO: 529293 - RNA, 64 nt, hsa; identical to SEQ ID NO: 116179

SEQ ID NO: 529294 - RNA, 64 nt, hsa; identical to SEQ ID NO: 116180

SEQ ID NO: 529295 - RNA, 64 nt, hsa; identical to SEQ ID NO: 116181

SEQ ID NO: 529296 - RNA, 64 nt, hsa; identical to SEQ ID NO: 116182

SEQ ID NO: 529297 - RNA, 64 nt, hsa; identical to SEQ ID NO: 116183

SEQ ID NO: 529298 - RNA, 64 nt, hsa; identical to SEQ ID NO: 116184

SEQ ID NO: 529299 - RNA, 64 nt, hsa; identical to SEQ ID NO: 116185

SEQ ID NO: 529300 - RNA, 64 nt, hsa; identical to SEQ ID NO: 116186

SEQ ID NO: 529301 - RNA, 64 nt, hsa; identical to SEQ ID NO: 116187

SEQ ID NO: 529302 - RNA, 64 nt, hsa; identical to SEQ ID NO: 116188

SEQ ID NO: 529303 - RNA, 64 nt, hsa; identical to SEQ ID NO: 116189

SEQ ID NO: 529304 - RNA, 64 nt, hsa; identical to SEQ ID NO: 116190

SEQ ID NO: 529305 - RNA, 64 nt, hsa; identical to SEQ ID NO: 116191

SEQ ID NO: 529306 - RNA, 64 nt, hsa; identical to SEQ ID NO: 116192

SEQ ID NO: 529307 - RNA, 64 nt, hsa; identical to SEQ ID NO: 116193

SEQ ID NO: 529308 - RNA, 64 nt, hsa; identical to SEQ ID NO: 116194

SEQ ID NO: 529309 - RNA, 64 nt, hsa; identical to SEQ ID NO: 116195

SEQ ID NO: 529310 - RNA, 64 nt, hsa; identical to SEQ ID NO: 116196

SEQ ID NO: 529311 - RNA, 64 nt, hsa; identical to SEQ ID NO: 116197

SEQ ID NO: 529312 - RNA, 64 nt, hsa; identical to SEQ ID NO: 116198

SEQ ID NO: 529313 - RNA, 64 nt, hsa; identical to SEQ ID NO: 116199

SEQ ID NO: 529314 - RNA, 64 nt, hsa; identical to SEQ ID NO: 116200

SEQ ID NO: 529315 - RNA, 64 nt, hsa; identical to SEQ ID NO: 116201

SEQ ID NO: 529316 - RNA, 64 nt, hsa; identical to SEQ ID NO: 116202

SEQ ID NO: 529317 - RNA, 64 nt, hsa; identical to SEQ ID NO: 116203

SEQ ID NO: 529318 - RNA, 64 nt, hsa; identical to SEQ ID NO: 116204

SEQ ID NO: 529319 - RNA, 64 nt, hsa; identical to SEQ ID NO: 116205

SEQ ID NO: 529320 - RNA, 64 nt, hsa; identical to SEQ ID NO: 116206

SEQ ID NO: 529321 - RNA, 64 nt, hsa; identical to SEQ ID NO: 116207

SEQ ID NO: 529322 - RNA, 64 nt, hsa; identical to SEQ ID NO: 116208

SEQ ID NO: 529323 - RNA, 64 nt, hsa; identical to SEQ ID NO: 116209

SEQ ID NO: 529324 - RNA, 64 nt, hsa; identical to SEQ ID NO: 116210

SEQ ID NO: 529325 - RNA, 64 nt, hsa; identical to SEQ ID NO: 116211

SEQ ID NO: 529326 - RNA, 64 nt, hsa; identical to SEQ ID NO: 116212

SEQ ID NO: 529327 - RNA, 64 nt, hsa; identical to SEQ ID NO: 116213

SEQ ID NO: 529328 - RNA, 64 nt, hsa; identical to SEQ ID NO: 116214

SEQ ID NO: 529329 - RNA, 64 nt, hsa; identical to SEQ ID NO: 116215

SEQ ID NO: 529330 - RNA, 64 nt, hsa; identical to SEQ ID NO: 116216

SEQ ID NO: 529331 - RNA, 64 nt, hsa; identical to SEQ ID NO: 116217

SEQ ID NO: 529332 - RNA, 64 nt, hsa; identical to SEQ ID NO: 116218

SEQ ID NO: 529333 - RNA, 64 nt, hsa; identical to SEQ ID NO: 116219

SEQ ID NO: 529334 - RNA, 64 nt, hsa; identical to SEQ ID NO: 116220

SEQ ID NO: 529335 - RNA, 64 nt, hsa; identical to SEQ ID NO: 116221

SEQ ID NO: 529336 - RNA, 64 nt, hsa; identical to SEQ ID NO: 116222

SEQ ID NO: 529337 - RNA, 64 nt, hsa; identical to SEQ ID NO: 116223

SEQ ID NO: 529338 - RNA, 64 nt, hsa; identical to SEQ ID NO: 116224

SEQ ID NO: 529339 - RNA, 64 nt, hsa; identical to SEQ ID NO: 116225

SEQ ID NO: 529340 - RNA, 64 nt, hsa; identical to SEQ ID NO: 116226

SEQ ID NO: 529341 - RNA, 64 nt, hsa; identical to SEQ ID NO: 116227

SEQ ID NO: 529342 - RNA, 64 nt, hsa; identical to SEQ ID NO: 116228

SEQ ID NO: 529343 - RNA, 64 nt, hsa; identical to SEQ ID NO: 116229

SEQ ID NO: 529344 - RNA, 64 nt, hsa; identical to SEQ ID NO: 116230

SEQ ID NO: 529345 - RNA, 64 nt, hsa; identical to SEQ ID NO: 116231

SEQ ID NO: 529346 - RNA, 64 nt, hsa; identical to SEQ ID NO: 116232

SEQ ID NO: 529347 - RNA, 64 nt, hsa; identical to SEQ ID NO: 116233

SEQ ID NO: 529348 - RNA, 64 nt, hsa; identical to SEQ ID NO: 116234

SEQ ID NO: 529349 - RNA, 64 nt, hsa; identical to SEQ ID NO: 116235

SEQ ID NO: 529350 - RNA, 64 nt, hsa; identical to SEQ ID NO: 116236

SEQ ID NO: 529351 - RNA, 64 nt, hsa; identical to SEQ ID NO: 116237

SEQ ID NO: 529352 - RNA, 64 nt, hsa; identical to SEQ ID NO: 116238

SEQ ID NO: 529353 - RNA, 64 nt, hsa; identical to SEQ ID NO: 116239

SEQ ID NO: 529354 - RNA, 64 nt, hsa; identical to SEQ ID NO: 116240

SEQ ID NO: 529355 - RNA, 64 nt, hsa; identical to SEQ ID NO: 116241

SEQ ID NO: 529356 - RNA, 64 nt, hsa; identical to SEQ ID NO: 116242

SEQ ID NO: 529357 - RNA, 64 nt, hsa; identical to SEQ ID NO: 116243

SEQ ID NO: 529358 - RNA, 64 nt, hsa; identical to SEQ ID NO: 116244

SEQ ID NO: 529359 - RNA, 64 nt, hsa; identical to SEQ ID NO: 116245

SEQ ID NO: 529360 - RNA, 64 nt, hsa; identical to SEQ ID NO: 116246

SEQ ID NO: 529361 - RNA, 64 nt, hsa; identical to SEQ ID NO: 116247

SEQ ID NO: 529362 - RNA, 64 nt, hsa; identical to SEQ ID NO: 116248

SEQ ID NO: 529363 - RNA, 64 nt, hsa; identical to SEQ ID NO: 116249

SEQ ID NO: 529364 - RNA, 64 nt, hsa; identical to SEQ ID NO: 116250

SEQ ID NO: 529365 - RNA, 64 nt, hsa; identical to SEQ ID NO: 116251

SEQ ID NO: 529366 - RNA, 64 nt, hsa; identical to SEQ ID NO: 116252

SEQ ID NO: 529367 - RNA, 64 nt, hsa; identical to SEQ ID NO: 116253

SEQ ID NO: 529368 - RNA, 64 nt, hsa; identical to SEQ ID NO: 116254

SEQ ID NO: 529369 - RNA, 64 nt, hsa; identical to SEQ ID NO: 116255

SEQ ID NO: 529370 - RNA, 64 nt, hsa; identical to SEQ ID NO: 116256

SEQ ID NO: 529371 - RNA, 64 nt, hsa; identical to SEQ ID NO: 116257

SEQ ID NO: 529372 - RNA, 64 nt, hsa; identical to SEQ ID NO: 116258

SEQ ID NO: 529373 - RNA, 64 nt, hsa; identical to SEQ ID NO: 116259

SEQ ID NO: 529374 - RNA, 64 nt, hsa; identical to SEQ ID NO: 116260

SEQ ID NO: 529375 - RNA, 64 nt, hsa; identical to SEQ ID NO: 116261

SEQ ID NO: 529376 - RNA, 64 nt, hsa; identical to SEQ ID NO: 116262

SEQ ID NO: 529377 - RNA, 64 nt, hsa; identical to SEQ ID NO: 116263

SEQ ID NO: 529378 - RNA, 64 nt, hsa; identical to SEQ ID NO: 116264

SEQ ID NO: 529379 - RNA, 64 nt, hsa; identical to SEQ ID NO: 116265

SEQ ID NO: 529380 - RNA, 64 nt, hsa; identical to SEQ ID NO: 116266

SEQ ID NO: 529381 - RNA, 64 nt, hsa; identical to SEQ ID NO: 116267

SEQ ID NO: 529382 - RNA, 64 nt, hsa; identical to SEQ ID NO: 116268

SEQ ID NO: 529383 - RNA, 64 nt, hsa; identical to SEQ ID NO: 116269

SEQ ID NO: 529384 - RNA, 64 nt, hsa; identical to SEQ ID NO: 116270

SEQ ID NO: 529385 - RNA, 64 nt, hsa; identical to SEQ ID NO: 116271

SEQ ID NO: 529386 - RNA, 64 nt, hsa; identical to SEQ ID NO: 116272

SEQ ID NO: 529387 - RNA, 64 nt, hsa; identical to SEQ ID NO: 116273

SEQ ID NO: 529388 - RNA, 64 nt, hsa; identical to SEQ ID NO: 116274

SEQ ID NO: 529389 - RNA, 64 nt, hsa; identical to SEQ ID NO: 116275

SEQ ID NO: 529390 - RNA, 64 nt, hsa; identical to SEQ ID NO: 116276

SEQ ID NO: 529391 - RNA, 64 nt, hsa; identical to SEQ ID NO: 116277

SEQ ID NO: 529392 - RNA, 64 nt, hsa; identical to SEQ ID NO: 116278

SEQ ID NO: 529393 - RNA, 64 nt, hsa; identical to SEQ ID NO: 116279

SEQ ID NO: 529394 - RNA, 64 nt, hsa; identical to SEQ ID NO: 116280

SEQ ID NO: 529395 - RNA, 64 nt, hsa; identical to SEQ ID NO: 116281

SEQ ID NO: 529396 - RNA, 64 nt, hsa; identical to SEQ ID NO: 116282

SEQ ID NO: 529397 - RNA, 64 nt, hsa; identical to SEQ ID NO: 116283

SEQ ID NO: 529398 - RNA, 64 nt, hsa; identical to SEQ ID NO: 116284

SEQ ID NO: 529399 - RNA, 64 nt, hsa; identical to SEQ ID NO: 116285

SEQ ID NO: 529400 - RNA, 64 nt, hsa; identical to SEQ ID NO: 116286

SEQ ID NO: 529401 - RNA, 64 nt, hsa; identical to SEQ ID NO: 116287

SEQ ID NO: 529402 - RNA, 64 nt, hsa; identical to SEQ ID NO: 116288

SEQ ID NO: 529403 - RNA, 64 nt, hsa; identical to SEQ ID NO: 116289

SEQ ID NO: 529404 - RNA, 64 nt, hsa; identical to SEQ ID NO: 116290

SEQ ID NO: 529405 - RNA, 64 nt, hsa; identical to SEQ ID NO: 116291

SEQ ID NO: 529406 - RNA, 64 nt, hsa; identical to SEQ ID NO: 116292

SEQ ID NO: 529407 - RNA, 64 nt, hsa; identical to SEQ ID NO: 116293

SEQ ID NO: 529408 - RNA, 64 nt, hsa; identical to SEQ ID NO: 116294

SEQ ID NO: 529409 - RNA, 64 nt, hsa; identical to SEQ ID NO: 116295

SEQ ID NO: 529410 - RNA, 64 nt, hsa; identical to SEQ ID NO: 116296

SEQ ID NO: 529411 - RNA, 64 nt, hsa; identical to SEQ ID NO: 116297

SEQ ID NO: 529412 - RNA, 64 nt, hsa; identical to SEQ ID NO: 116298

SEQ ID NO: 529413 - RNA, 64 nt, hsa; identical to SEQ ID NO: 116299

SEQ ID NO: 529414 - RNA, 64 nt, hsa; identical to SEQ ID NO: 116300

SEQ ID NO: 529415 - RNA, 64 nt, hsa; identical to SEQ ID NO: 116301

SEQ ID NO: 529416 - RNA, 64 nt, hsa; identical to SEQ ID NO: 116302

SEQ ID NO: 529417 - RNA, 64 nt, hsa; identical to SEQ ID NO: 116303

SEQ ID NO: 529418 - RNA, 64 nt, hsa; identical to SEQ ID NO: 116304

SEQ ID NO: 529419 - RNA, 64 nt, hsa; identical to SEQ ID NO: 116305

SEQ ID NO: 529420 - RNA, 64 nt, hsa; identical to SEQ ID NO: 116306

SEQ ID NO: 529421 - RNA, 64 nt, hsa; identical to SEQ ID NO: 116307

SEQ ID NO: 529422 - RNA, 64 nt, hsa; identical to SEQ ID NO: 116308

SEQ ID NO: 529423 - RNA, 64 nt, hsa; identical to SEQ ID NO: 116309

SEQ ID NO: 529424 - RNA, 64 nt, hsa; identical to SEQ ID NO: 116310

SEQ ID NO: 529425 - RNA, 64 nt, hsa; identical to SEQ ID NO: 116311

SEQ ID NO: 529426 - RNA, 64 nt, hsa; identical to SEQ ID NO: 116312

SEQ ID NO: 529427 - RNA, 64 nt, hsa; identical to SEQ ID NO: 116313

SEQ ID NO: 529428 - RNA, 64 nt, hsa; identical to SEQ ID NO: 116314

SEQ ID NO: 529429 - RNA, 64 nt, hsa; identical to SEQ ID NO: 116315

SEQ ID NO: 529430 - RNA, 64 nt, hsa; identical to SEQ ID NO: 116316

SEQ ID NO: 529431 - RNA, 64 nt, hsa; identical to SEQ ID NO: 116317

SEQ ID NO: 529432 - RNA, 64 nt, hsa; identical to SEQ ID NO: 116318

SEQ ID NO: 529433 - RNA, 64 nt, hsa; identical to SEQ ID NO: 116319

SEQ ID NO: 529434 - RNA, 64 nt, hsa; identical to SEQ ID NO: 116320

SEQ ID NO: 529435 - RNA, 64 nt, hsa; identical to SEQ ID NO: 116321

SEQ ID NO: 529436 - RNA, 64 nt, hsa; identical to SEQ ID NO: 116322

SEQ ID NO: 529437 - RNA, 64 nt, hsa; identical to SEQ ID NO: 116323

SEQ ID NO: 529438 - RNA, 64 nt, hsa; identical to SEQ ID NO: 116324

SEQ ID NO: 529439 - RNA, 64 nt, hsa; identical to SEQ ID NO: 116325

SEQ ID NO: 529440 - RNA, 64 nt, hsa; identical to SEQ ID NO: 116326

SEQ ID NO: 529441 - RNA, 64 nt, hsa; identical to SEQ ID NO: 116327

SEQ ID NO: 529442 - RNA, 64 nt, hsa; identical to SEQ ID NO: 116328

SEQ ID NO: 529443 - RNA, 64 nt, hsa; identical to SEQ ID NO: 116329

SEQ ID NO: 529444 - RNA, 64 nt, hsa; identical to SEQ ID NO: 116330

SEQ ID NO: 529445 - RNA, 64 nt, hsa; identical to SEQ ID NO: 116331

SEQ ID NO: 529446 - RNA, 64 nt, hsa; identical to SEQ ID NO: 116332

SEQ ID NO: 529447 - RNA, 64 nt, hsa; identical to SEQ ID NO: 116333

SEQ ID NO: 529448 - RNA, 64 nt, hsa; identical to SEQ ID NO: 116334

SEQ ID NO: 529449 - RNA, 64 nt, hsa; identical to SEQ ID NO: 116335

SEQ ID NO: 529450 - RNA, 64 nt, hsa; identical to SEQ ID NO: 116336

SEQ ID NO: 529451 - RNA, 64 nt, hsa; identical to SEQ ID NO: 116337

SEQ ID NO: 529452 - RNA, 64 nt, hsa; identical to SEQ ID NO: 116338

SEQ ID NO: 529453 - RNA, 64 nt, hsa; identical to SEQ ID NO: 116339

SEQ ID NO: 529454 - RNA, 64 nt, hsa; identical to SEQ ID NO: 116340

SEQ ID NO: 529455 - RNA, 64 nt, hsa; identical to SEQ ID NO: 116341

SEQ ID NO: 529456 - RNA, 64 nt, hsa; identical to SEQ ID NO: 116342

SEQ ID NO: 529457 - RNA, 64 nt, hsa; identical to SEQ ID NO: 116343

SEQ ID NO: 529458 - RNA, 64 nt, hsa; identical to SEQ ID NO: 116344

SEQ ID NO: 529459 - RNA, 64 nt, hsa; identical to SEQ ID NO: 116345

SEQ ID NO: 529460 - RNA, 64 nt, hsa; identical to SEQ ID NO: 116346

SEQ ID NO: 529461 - RNA, 64 nt, hsa; identical to SEQ ID NO: 116347

SEQ ID NO: 529462 - RNA, 64 nt, hsa; identical to SEQ ID NO: 116348

SEQ ID NO: 529463 - RNA, 64 nt, hsa; identical to SEQ ID NO: 116349

SEQ ID NO: 529464 - RNA, 64 nt, hsa; identical to SEQ ID NO: 116350

SEQ ID NO: 529465 - RNA, 64 nt, hsa; identical to SEQ ID NO: 116351

SEQ ID NO: 529466 - RNA, 64 nt, hsa; identical to SEQ ID NO: 116352

SEQ ID NO: 529467 - RNA, 64 nt, hsa; identical to SEQ ID NO: 116353

SEQ ID NO: 529468 - RNA, 64 nt, hsa; identical to SEQ ID NO: 116354

SEQ ID NO: 529469 - RNA, 64 nt, hsa; identical to SEQ ID NO: 116355

SEQ ID NO: 529470 - RNA, 64 nt, hsa; identical to SEQ ID NO: 116356

SEQ ID NO: 529471 - RNA, 64 nt, hsa; identical to SEQ ID NO: 116357

SEQ ID NO: 529472 - RNA, 64 nt, hsa; identical to SEQ ID NO: 116358

SEQ ID NO: 529473 - RNA, 64 nt, hsa; identical to SEQ ID NO: 116359

SEQ ID NO: 529474 - RNA, 64 nt, hsa; identical to SEQ ID NO: 116360

SEQ ID NO: 529475 - RNA, 64 nt, hsa; identical to SEQ ID NO: 116361

SEQ ID NO: 529476 - RNA, 64 nt, hsa; identical to SEQ ID NO: 116362

SEQ ID NO: 529477 - RNA, 64 nt, hsa; identical to SEQ ID NO: 116363

SEQ ID NO: 529478 - RNA, 64 nt, hsa; identical to SEQ ID NO: 116364

SEQ ID NO: 529479 - RNA, 64 nt, hsa; identical to SEQ ID NO: 116365

SEQ ID NO: 529480 - RNA, 64 nt, hsa; identical to SEQ ID NO: 116366

SEQ ID NO: 529481 - RNA, 64 nt, hsa; identical to SEQ ID NO: 116367

SEQ ID NO: 529482 - RNA, 64 nt, hsa; identical to SEQ ID NO: 116368

SEQ ID NO: 529483 - RNA, 64 nt, hsa; identical to SEQ ID NO: 144868

SEQ ID NO: 529484 - RNA, 64 nt, hsa; identical to SEQ ID NO: 144869

SEQ ID NO: 529485 - RNA, 64 nt, hsa; identical to SEQ ID NO: 144870

SEQ ID NO: 529486 - RNA, 64 nt, hsa; identical to SEQ ID NO: 144871

SEQ ID NO: 529487 - RNA, 64 nt, hsa; identical to SEQ ID NO: 144872

SEQ ID NO: 529488 - RNA, 64 nt, hsa; identical to SEQ ID NO: 144873

SEQ ID NO: 529489 - RNA, 64 nt, hsa; identical to SEQ ID NO: 144874

SEQ ID NO: 529490 - RNA, 64 nt, hsa; identical to SEQ ID NO: 144875

SEQ ID NO: 529491 - RNA, 64 nt, hsa; identical to SEQ ID NO: 144876

SEQ ID NO: 529492 - RNA, 64 nt, hsa; identical to SEQ ID NO: 144877

SEQ ID NO: 529493 - RNA, 64 nt, hsa; identical to SEQ ID NO: 144878

SEQ ID NO: 529494 - RNA, 64 nt, hsa; identical to SEQ ID NO: 144879

SEQ ID NO: 529495 - RNA, 64 nt, hsa; identical to SEQ ID NO: 144880

SEQ ID NO: 529496 - RNA, 64 nt, hsa; identical to SEQ ID NO: 144881

SEQ ID NO: 529497 - RNA, 64 nt, hsa; identical to SEQ ID NO: 144882

SEQ ID NO: 529498 - RNA, 64 nt, hsa; identical to SEQ ID NO: 144883

SEQ ID NO: 529499 - RNA, 64 nt, hsa; identical to SEQ ID NO: 144884

SEQ ID NO: 529500 - RNA, 64 nt, hsa; identical to SEQ ID NO: 144885

SEQ ID NO: 529501 - RNA, 64 nt, hsa; identical to SEQ ID NO: 144886

SEQ ID NO: 529502 - RNA, 64 nt, hsa; identical to SEQ ID NO: 144887

SEQ ID NO: 529503 - RNA, 64 nt, hsa; identical to SEQ ID NO: 144888

SEQ ID NO: 529504 - RNA, 64 nt, hsa; identical to SEQ ID NO: 144889

SEQ ID NO: 529505 - RNA, 64 nt, hsa; identical to SEQ ID NO: 144890

SEQ ID NO: 529506 - RNA, 64 nt, hsa; identical to SEQ ID NO: 144891

SEQ ID NO: 529507 - RNA, 64 nt, hsa; identical to SEQ ID NO: 144892

SEQ ID NO: 529508 - RNA, 64 nt, hsa; identical to SEQ ID NO: 144893

SEQ ID NO: 529509 - RNA, 64 nt, hsa; identical to SEQ ID NO: 144894

SEQ ID NO: 529510 - RNA, 64 nt, hsa; identical to SEQ ID NO: 144895

SEQ ID NO: 529511 - RNA, 64 nt, hsa; identical to SEQ ID NO: 144896

SEQ ID NO: 529512 - RNA, 64 nt, hsa; identical to SEQ ID NO: 144897

SEQ ID NO: 529513 - RNA, 64 nt, hsa; identical to SEQ ID NO: 144898

SEQ ID NO: 529514 - RNA, 64 nt, hsa; identical to SEQ ID NO: 144899

SEQ ID NO: 529515 - RNA, 64 nt, hsa; identical to SEQ ID NO: 144900

SEQ ID NO: 529516 - RNA, 64 nt, hsa; identical to SEQ ID NO: 144901

SEQ ID NO: 529517 - RNA, 64 nt, hsa; identical to SEQ ID NO: 144902

SEQ ID NO: 529518 - RNA, 64 nt, hsa; identical to SEQ ID NO: 144903

SEQ ID NO: 529519 - RNA, 64 nt, hsa; identical to SEQ ID NO: 144904

SEQ ID NO: 529520 - RNA, 64 nt, hsa; identical to SEQ ID NO: 144905

SEQ ID NO: 529521 - RNA, 64 nt, hsa; identical to SEQ ID NO: 144906

SEQ ID NO: 529522 - RNA, 64 nt, hsa; identical to SEQ ID NO: 144907

SEQ ID NO: 529523 - RNA, 64 nt, hsa; identical to SEQ ID NO: 109963

SEQ ID NO: 529524 - RNA, 64 nt, hsa; identical to SEQ ID NO: 109964

SEQ ID NO: 529525 - RNA, 64 nt, hsa; identical to SEQ ID NO: 109965

SEQ ID NO: 529526 - RNA, 64 nt, hsa; identical to SEQ ID NO: 109966

SEQ ID NO: 529527 - RNA, 64 nt, hsa; identical to SEQ ID NO: 109967

SEQ ID NO: 529528 - RNA, 64 nt, hsa; identical to SEQ ID NO: 109968

SEQ ID NO: 529529 - RNA, 64 nt, hsa; identical to SEQ ID NO: 109969

SEQ ID NO: 529530 - RNA, 64 nt, hsa; identical to SEQ ID NO: 109970

SEQ ID NO: 529531 - RNA, 64 nt, hsa; identical to SEQ ID NO: 109971

SEQ ID NO: 529532 - RNA, 64 nt, hsa; identical to SEQ ID NO: 109972

SEQ ID NO: 529533 - RNA, 64 nt, hsa; identical to SEQ ID NO: 109973

SEQ ID NO: 529534 - RNA, 64 nt, hsa; identical to SEQ ID NO: 109974

SEQ ID NO: 529535 - RNA, 64 nt, hsa; identical to SEQ ID NO: 109975

SEQ ID NO: 529536 - RNA, 64 nt, hsa; identical to SEQ ID NO: 109976

SEQ ID NO: 529537 - RNA, 64 nt, hsa; identical to SEQ ID NO: 109977

SEQ ID NO: 529538 - RNA, 64 nt, hsa; identical to SEQ ID NO: 109978

SEQ ID NO: 529539 - RNA, 64 nt, hsa; identical to SEQ ID NO: 109979

SEQ ID NO: 529540 - RNA, 64 nt, hsa; identical to SEQ ID NO: 109980

SEQ ID NO: 529541 - RNA, 64 nt, hsa; identical to SEQ ID NO: 109981

SEQ ID NO: 529542 - RNA, 64 nt, hsa; identical to SEQ ID NO: 109982

SEQ ID NO: 529543 - RNA, 64 nt, hsa; identical to SEQ ID NO: 109983

SEQ ID NO: 529544 - RNA, 64 nt, hsa; identical to SEQ ID NO: 109984

SEQ ID NO: 529545 - RNA, 64 nt, hsa; identical to SEQ ID NO: 109985

SEQ ID NO: 529546 - RNA, 64 nt, hsa; identical to SEQ ID NO: 109986

SEQ ID NO: 529547 - RNA, 64 nt, hsa; identical to SEQ ID NO: 109987

SEQ ID NO: 529548 - RNA, 64 nt, hsa; identical to SEQ ID NO: 109988

SEQ ID NO: 529549 - RNA, 64 nt, hsa; identical to SEQ ID NO: 109989

SEQ ID NO: 529550 - RNA, 64 nt, hsa; identical to SEQ ID NO: 109990

SEQ ID NO: 529551 - RNA, 64 nt, hsa; identical to SEQ ID NO: 109991

SEQ ID NO: 529552 - RNA, 52 nt, hsa; identical to SEQ ID NO: 109992

SEQ ID NO: 529553 - RNA, 64 nt, hsa; identical to SEQ ID NO: 109993

SEQ ID NO: 529554 - RNA, 64 nt, hsa; identical to SEQ ID NO: 109994

SEQ ID NO: 529555 - RNA, 64 nt, hsa; identical to SEQ ID NO: 109995

SEQ ID NO: 529556 - RNA, 64 nt, hsa; identical to SEQ ID NO: 109996

SEQ ID NO: 529557 - RNA, 64 nt, hsa; identical to SEQ ID NO: 109997

SEQ ID NO: 529558 - RNA, 64 nt, hsa; identical to SEQ ID NO: 109998

SEQ ID NO: 529559 - RNA, 64 nt, hsa; identical to SEQ ID NO: 109999

SEQ ID NO: 529560 - RNA, 64 nt, hsa; identical to SEQ ID NO: 110000

SEQ ID NO: 529561 - RNA, 64 nt, hsa; identical to SEQ ID NO: 206809

SEQ ID NO: 529562 - RNA, 64 nt, hsa; identical to SEQ ID NO: 206810

SEQ ID NO: 529563 - RNA, 64 nt, hsa; identical to SEQ ID NO: 206811

SEQ ID NO: 529564 - RNA, 64 nt, hsa; identical to SEQ ID NO: 206812

SEQ ID NO: 529565 - RNA, 64 nt, hsa; identical to SEQ ID NO: 206813

SEQ ID NO: 529566 - RNA, 64 nt, hsa; identical to SEQ ID NO: 206814

SEQ ID NO: 529567 - RNA, 64 nt, hsa; identical to SEQ ID NO: 206815

SEQ ID NO: 529568 - RNA, 64 nt, hsa; identical to SEQ ID NO: 206816

SEQ ID NO: 529569 - RNA, 64 nt, hsa; identical to SEQ ID NO: 206817

SEQ ID NO: 529570 - RNA, 64 nt, hsa; identical to SEQ ID NO: 206818

SEQ ID NO: 529571 - RNA, 64 nt, hsa; identical to SEQ ID NO: 206819

SEQ ID NO: 529572 - RNA, 64 nt, hsa; identical to SEQ ID NO: 206820

SEQ ID NO: 529573 - RNA, 64 nt, hsa; identical to SEQ ID NO: 206821

SEQ ID NO: 529574 - RNA, 64 nt, hsa; identical to SEQ ID NO: 206822

SEQ ID NO: 529575 - RNA, 64 nt, hsa; identical to SEQ ID NO: 206823

SEQ ID NO: 529576 - RNA, 64 nt, hsa; identical to SEQ ID NO: 206824

SEQ ID NO: 529577 - RNA, 64 nt, hsa; identical to SEQ ID NO: 206825

SEQ ID NO: 529578 - RNA, 64 nt, hsa; identical to SEQ ID NO: 206826

SEQ ID NO: 529579 - RNA, 64 nt, hsa; identical to SEQ ID NO: 206827

SEQ ID NO: 529580 - RNA, 64 nt, hsa; identical to SEQ ID NO: 206828

SEQ ID NO: 529581 - RNA, 64 nt, hsa; identical to SEQ ID NO: 206829

SEQ ID NO: 529582 - RNA, 56 nt, hsa; identical to SEQ ID NO: 206830

SEQ ID NO: 529583 - RNA, 64 nt, hsa; identical to SEQ ID NO: 206831

SEQ ID NO: 529584 - RNA, 64 nt, hsa; identical to SEQ ID NO: 206832

SEQ ID NO: 529585 - RNA, 64 nt, hsa; identical to SEQ ID NO: 206833

SEQ ID NO: 529586 - RNA, 61 nt, hsa
uagcucugggaauggaaugcgccccucguggagagccuauaaacggaugcauggaaggcgc

SEQ ID NO: 529587 - RNA, 61 nt, hsa
augagccaacagcacuugcuucccccuguagagagccuaugaauggacgugcagucaggga

SEQ ID NO: 529588 - RNA, 61 nt, hsa
uacuucucuacccuugacauccagcuucgcgagagccuagagccagaugccuaugcguugu

SEQ ID NO: 529589 - RNA, 61 nt, hsa
acaaugccuuuuacgccaagaauaaauguccagagccuaacugcagggugaaaaagucccu

SEQ ID NO: 529590 - RNA, 64 nt, hsa
uaaaauucaauuaagguacuucucccucagggacguagaacaauggaaugucagucagucucug

SEQ ID NO: 529591 - RNA, 64 nt, hsa; identical to SEQ ID NO: 529590

SEQ ID NO: 529592 - RNA, 64 nt, hsa
cuccacagccacagcugguuaggggcggcugccaguagaacagggcagaugccuggacucccaa

SEQ ID NO: 529593 - RNA, 64 nt, hsa
acaggaaaaaaugaugcauaaaaacauggcuucuguagaacaauagagacuguaaaagaacaag

SEQ ID NO: 529594 - RNA, 64 nt, hsa
gaaugaaauauucagggacuuaggggcgaugauuguagaacaggguacaguccuugacagaauu

SEQ ID NO: 529595 - RNA, 64 nt, hsa
uaucaauauggugcuugaauauauuccuauaacuguagaacaguguggaaagugaugguaacuu

SEQ ID NO: 529596 - RNA, 64 nt, hsa
aauuuaauuagucaggcauccauuuugccuuuuaaacaacuaggauucccuacuaaccuccacc

SEQ ID NO: 529597 - RNA, 64 nt, hsa
guucaggauauaugaguuggcugauugagacugcaacaacuacaucuauauuuaugggcaauau

SEQ ID NO: 529598 - RNA, 64 nt, hsa
uuucuuuuuuuuccugaaaaacaacuaaccuucuaacaacuaucuuucaaaaguaaauguaaua

SEQ ID NO: 529599 - RNA, 64 nt, hsa
cauuuuuacaucagauuucuuuuuuuuccugaaaaacaacuaaccuucuaacaacuaucuuuca

SEQ ID NO: 529600 - RNA, 64 nt, hsa
cauuugugugcccuggaauuuccaacuaguaauaaacaacuacuguugauguaguuuuaaacca

SEQ ID NO: 529601 - RNA, 64 nt, hsa
uggaguaccaugaggguugcuauuuguuguuuuuaacaacuaaucaagagugagugaacaacua

SEQ ID NO: 529602 - RNA, 64 nt, hsa
uuuguuguuuuuaacaacuaaucaagagugagugaacaacuauuuauaaacuagaucuccuauu

SEQ ID NO: 529603 - RNA, 64 nt, hsa
acugaagcaugcacaugccacugucaccaaaacaaacaacuaccacuuuccaaauuucauucag

SEQ ID NO: 529604 - RNA, 64 nt, hsa
guguuauuuauguuauuuauauuagcuaacaggaaacaacuacuguguuucaacauaauaaaua

SEQ ID NO: 529605 - RNA, 64 nt, hsa
ggacccuggaaggagggagagcaggcagcccuucacaggauaggauccgucucuguccuguccu

SEQ ID NO: 529606 - RNA, 64 nt, hsa
uguucagacagccacaugaggggacagugcagcuacaggauaugccaucauggcagaaaguucu

SEQ ID NO: 529607 - RNA, 64 nt, hsa
agccugaguguuauacuagagaucuaaaggguuaacaggauaggguggaaagguuagagacucc

SEQ ID NO: 529608 - RNA, 64 nt, hsa
uuguaaggaaaaccuguuuccuauuuugugcauuacaggauauuuagcagcaacccuggcccac

SEQ ID NO: 529609 - RNA, 64 nt, hsa
uagaaaauuugaagccauuacuuccagcugguauacaggauaaacuacauacacugaucccuug

SEQ ID NO: 529610 - RNA, 64 nt, hsa
uuuuacuuuuuauucccguuaaaacugauguaaaacaggauaaaggcuuguuauagucacuuau

SEQ ID NO: 529611 - RNA, 64 nt, hsa
uuaaguuaaaauaguuucucuucagcuguaaauaacaggauacagaauuaacaagagaaaaugu

SEQ ID NO: 529612 - RNA, 64 nt, hsa
uucuucgguuuuugaaaaacauaauggaaauaaaacaggauauugacauaauagcacaaaauga

SEQ ID NO: 529613 - RNA, 64 nt, hsa; identical to SEQ ID NO: 183774

SEQ ID NO: 529614 - RNA, 64 nt, hsa; identical to SEQ ID NO: 183775

SEQ ID NO: 529615 - RNA, 64 nt, hsa; identical to SEQ ID NO: 183776

SEQ ID NO: 529616 - RNA, 64 nt, hsa; identical to SEQ ID NO: 183777

SEQ ID NO: 529617 - RNA, 64 nt, hsa; identical to SEQ ID NO: 183778

SEQ ID NO: 529618 - RNA, 64 nt, hsa; identical to SEQ ID NO: 183779

SEQ ID NO: 529619 - RNA, 64 nt, hsa; identical to SEQ ID NO: 183780

SEQ ID NO: 529620 - RNA, 64 nt, hsa; identical to SEQ ID NO: 183781

SEQ ID NO: 529621 - RNA, 64 nt, hsa; identical to SEQ ID NO: 183782

SEQ ID NO: 529622 - RNA, 64 nt, hsa; identical to SEQ ID NO: 183783

SEQ ID NO: 529623 - RNA, 64 nt, hsa; identical to SEQ ID NO: 183784

SEQ ID NO: 529624 - RNA, 64 nt, hsa; identical to SEQ ID NO: 183785

SEQ ID NO: 529625 - RNA, 64 nt, hsa; identical to SEQ ID NO: 183786

SEQ ID NO: 529626 - RNA, 64 nt, hsa; identical to SEQ ID NO: 183787

SEQ ID NO: 529627 - RNA, 64 nt, hsa; identical to SEQ ID NO: 183788

SEQ ID NO: 529628 - RNA, 64 nt, hsa; identical to SEQ ID NO: 183789

SEQ ID NO: 529629 - RNA, 64 nt, hsa; identical to SEQ ID NO: 183790

SEQ ID NO: 529630 - RNA, 64 nt, hsa; identical to SEQ ID NO: 183791

SEQ ID NO: 529631 - RNA, 64 nt, hsa; identical to SEQ ID NO: 183792

SEQ ID NO: 529632 - RNA, 64 nt, hsa; identical to SEQ ID NO: 183793

SEQ ID NO: 529633 - RNA, 64 nt, hsa; identical to SEQ ID NO: 183794

SEQ ID NO: 529634 - RNA, 64 nt, hsa; identical to SEQ ID NO: 183795

SEQ ID NO: 529635 - RNA, 64 nt, hsa; identical to SEQ ID NO: 183796

SEQ ID NO: 529636 - RNA, 64 nt, hsa; identical to SEQ ID NO: 183797

SEQ ID NO: 529637 - RNA, 64 nt, hsa; identical to SEQ ID NO: 183798

SEQ ID NO: 529638 - RNA, 64 nt, hsa; identical to SEQ ID NO: 183799

SEQ ID NO: 529639 - RNA, 64 nt, hsa; identical to SEQ ID NO: 183800

SEQ ID NO: 529640 - RNA, 64 nt, hsa; identical to SEQ ID NO: 183801

SEQ ID NO: 529641 - RNA, 64 nt, hsa; identical to SEQ ID NO: 183802

SEQ ID NO: 529642 - RNA, 64 nt, hsa; identical to SEQ ID NO: 183803

SEQ ID NO: 529643 - RNA, 64 nt, hsa; identical to SEQ ID NO: 183804

SEQ ID NO: 529644 - RNA, 64 nt, hsa; identical to SEQ ID NO: 183805

SEQ ID NO: 529645 - RNA, 64 nt, hsa; identical to SEQ ID NO: 183806

SEQ ID NO: 529646 - RNA, 64 nt, hsa; identical to SEQ ID NO: 183807

SEQ ID NO: 529647 - RNA, 64 nt, hsa; identical to SEQ ID NO: 183808

SEQ ID NO: 529648 - RNA, 64 nt, hsa; identical to SEQ ID NO: 183809

SEQ ID NO: 529649 - RNA, 64 nt, hsa; identical to SEQ ID NO: 183810

SEQ ID NO: 529650 - RNA, 64 nt, hsa; identical to SEQ ID NO: 183811

SEQ ID NO: 529651 - RNA, 64 nt, hsa; identical to SEQ ID NO: 183812

SEQ ID NO: 529652 - RNA, 64 nt, hsa; identical to SEQ ID NO: 183813

SEQ ID NO: 529653 - RNA, 64 nt, hsa; identical to SEQ ID NO: 183814

SEQ ID NO: 529654 - RNA, 64 nt, hsa; identical to SEQ ID NO: 183815

SEQ ID NO: 529655 - RNA, 64 nt, hsa; identical to SEQ ID NO: 183816

SEQ ID NO: 529656 - RNA, 64 nt, hsa; identical to SEQ ID NO: 183817

SEQ ID NO: 529657 - RNA, 64 nt, hsa; identical to SEQ ID NO: 183818

SEQ ID NO: 529658 - RNA, 64 nt, hsa; identical to SEQ ID NO: 183819

SEQ ID NO: 529659 - RNA, 64 nt, hsa; identical to SEQ ID NO: 183820

SEQ ID NO: 529660 - RNA, 64 nt, hsa; identical to SEQ ID NO: 183821

SEQ ID NO: 529661 - RNA, 64 nt, hsa; identical to SEQ ID NO: 183822

SEQ ID NO: 529662 - RNA, 64 nt, hsa; identical to SEQ ID NO: 183823

SEQ ID NO: 529663 - RNA, 64 nt, hsa; identical to SEQ ID NO: 183824

SEQ ID NO: 529664 - RNA, 64 nt, hsa; identical to SEQ ID NO: 183825

SEQ ID NO: 529665 - RNA, 64 nt, hsa; identical to SEQ ID NO: 183826

SEQ ID NO: 529666 - RNA, 64 nt, hsa; identical to SEQ ID NO: 183827

SEQ ID NO: 529667 - RNA, 64 nt, hsa; identical to SEQ ID NO: 183828

SEQ ID NO: 529668 - RNA, 64 nt, hsa; identical to SEQ ID NO: 183829

SEQ ID NO: 529669 - RNA, 52 nt, hsa; identical to SEQ ID NO: 183830

SEQ ID NO: 529670 - RNA, 64 nt, hsa; identical to SEQ ID NO: 183831

SEQ ID NO: 529671 - RNA, 64 nt, hsa; identical to SEQ ID NO: 183832

SEQ ID NO: 529672 - RNA, 64 nt, hsa; identical to SEQ ID NO: 183833

SEQ ID NO: 529673 - RNA, 64 nt, hsa; identical to SEQ ID NO: 183834

SEQ ID NO: 529674 - RNA, 64 nt, hsa; identical to SEQ ID NO: 183835

SEQ ID NO: 529675 - RNA, 64 nt, hsa; identical to SEQ ID NO: 183836

SEQ ID NO: 529676 - RNA, 64 nt, hsa; identical to SEQ ID NO: 183837

SEQ ID NO: 529677 - RNA, 64 nt, hsa; identical to SEQ ID NO: 183838

SEQ ID NO: 529678 - RNA, 64 nt, hsa; identical to SEQ ID NO: 382152

SEQ ID NO: 529679 - RNA, 64 nt, hsa; identical to SEQ ID NO: 382153

SEQ ID NO: 529680 - RNA, 64 nt, hsa; identical to SEQ ID NO: 382154

SEQ ID NO: 529681 - RNA, 64 nt, hsa; identical to SEQ ID NO: 382155

SEQ ID NO: 529682 - RNA, 64 nt, hsa; identical to SEQ ID NO: 382156

SEQ ID NO: 529683 - RNA, 64 nt, hsa; identical to SEQ ID NO: 382157

SEQ ID NO: 529684 - RNA, 64 nt, hsa; identical to SEQ ID NO: 382158

SEQ ID NO: 529685 - RNA, 64 nt, hsa; identical to SEQ ID NO: 382159

SEQ ID NO: 529686 - RNA, 64 nt, hsa; identical to SEQ ID NO: 382160

SEQ ID NO: 529687 - RNA, 64 nt, hsa; identical to SEQ ID NO: 382161

SEQ ID NO: 529688 - RNA, 64 nt, hsa; identical to SEQ ID NO: 382162

SEQ ID NO: 529689 - RNA, 64 nt, hsa; identical to SEQ ID NO: 382163

SEQ ID NO: 529690 - RNA, 64 nt, hsa; identical to SEQ ID NO: 382164

SEQ ID NO: 529691 - RNA, 64 nt, hsa; identical to SEQ ID NO: 382165

SEQ ID NO: 529692 - RNA, 64 nt, hsa; identical to SEQ ID NO: 382166

SEQ ID NO: 529693 - RNA, 64 nt, hsa; identical to SEQ ID NO: 382167

SEQ ID NO: 529694 - RNA, 64 nt, hsa; identical to SEQ ID NO: 382168

SEQ ID NO: 529695 - RNA, 64 nt, hsa; identical to SEQ ID NO: 382169

SEQ ID NO: 529696 - RNA, 64 nt, hsa; identical to SEQ ID NO: 382170

SEQ ID NO: 529697 - RNA, 64 nt, hsa; identical to SEQ ID NO: 382171

SEQ ID NO: 529698 - RNA, 64 nt, hsa; identical to SEQ ID NO: 382172

SEQ ID NO: 529699 - RNA, 64 nt, hsa; identical to SEQ ID NO: 382173

SEQ ID NO: 529700 - RNA, 64 nt, hsa; identical to SEQ ID NO: 382174

SEQ ID NO: 529701 - RNA, 64 nt, hsa; identical to SEQ ID NO: 382175

SEQ ID NO: 529702 - RNA, 64 nt, hsa; identical to SEQ ID NO: 382176

SEQ ID NO: 529703 - RNA, 64 nt, hsa; identical to SEQ ID NO: 382177

SEQ ID NO: 529704 - RNA, 64 nt, hsa; identical to SEQ ID NO: 382178

SEQ ID NO: 529705 - RNA, 64 nt, hsa; identical to SEQ ID NO: 382179

SEQ ID NO: 529706 - RNA, 64 nt, hsa; identical to SEQ ID NO: 382180

SEQ ID NO: 529707 - RNA, 64 nt, hsa; identical to SEQ ID NO: 382181

SEQ ID NO: 529708 - RNA, 64 nt, hsa; identical to SEQ ID NO: 382182

SEQ ID NO: 529709 - RNA, 64 nt, hsa; identical to SEQ ID NO: 382183

SEQ ID NO: 529710 - RNA, 64 nt, hsa; identical to SEQ ID NO: 382184

SEQ ID NO: 529711 - RNA, 64 nt, hsa; identical to SEQ ID NO: 382185

SEQ ID NO: 529712 - RNA, 64 nt, hsa; identical to SEQ ID NO: 382186

SEQ ID NO: 529713 - RNA, 64 nt, hsa; identical to SEQ ID NO: 382187

SEQ ID NO: 529714 - RNA, 64 nt, hsa; identical to SEQ ID NO: 382188

SEQ ID NO: 529715 - RNA, 64 nt, hsa; identical to SEQ ID NO: 382189

SEQ ID NO: 529716 - RNA, 64 nt, hsa; identical to SEQ ID NO: 382190

SEQ ID NO: 529717 - RNA, 64 nt, hsa; identical to SEQ ID NO: 382191

SEQ ID NO: 529718 - RNA, 64 nt, hsa; identical to SEQ ID NO: 382192

SEQ ID NO: 529719 - RNA, 64 nt, hsa
guacauagaacucuuuaugaauuaacuuuagcuuauguuggaaguaguaguuuguuuauagugu

SEQ ID NO: 529720 - RNA, 64 nt, hsa
aaaugacacauuggggguaaauaacagacacuauauguuggaguugggaaucagauccaaguuu

SEQ ID NO: 529721 - RNA, 64 nt, hsa
aggaugauccuugaaagcccuuuagaagggugccauguuggaaaccuguacauccacaacaagu

SEQ ID NO: 529722 - RNA, 64 nt, hsa
accuguacauccacaacaaguagcuuuuccuccuauguuggaaaaaaagacuguuucuuuguuu

SEQ ID NO: 529723 - RNA, 64 nt, hsa
gggacacagcuucuggcaccauggauuuaagaccauguuggauccaaaaguuggccugaaaccc

SEQ ID NO: 529724 - RNA, 64 nt, hsa
cuuagacugcguaagaagaaauauauguggugaaauguuggaaccauuucucucuuggucucug

SEQ ID NO: 529725 - RNA, 64 nt, hsa
cucaaacuuaaacuuggauuugaaguuagaagaaauguuggaagucauuuauauaugaagaaau

SEQ ID NO: 529726 - RNA, 64 nt, hsa
gaagaaauguuggaagucauuuauauaugaagaaauguuggaaggacucauauaugcauacauu

SEQ ID NO: 529727 - RNA, 64 nt, hsa
cuuucaccucauucugguagcagcauaaagguuaggcaaucacugggacccgcaugguguuccu

SEQ ID NO: 529728 - RNA, 64 nt, hsa
accuguaaucccagcacuuugggaggccaaggcaggcaaucaccugaggucaggaguucaagac

SEQ ID NO: 529729 - RNA, 64 nt, hsa
guuguggcucaaauccucuauauuuuuagccaauggcaaucaaauucuuucagcuccuuuguuu

SEQ ID NO: 529730 - RNA, 64 nt, hsa
uuggggucagaguauauguuguuuggagaaagagggcaaucaggacucuucugggacccagaug

SEQ ID NO: 529731 - RNA, 64 nt, hsa
guccaaggaccuucccucuucuccccaguuccugggcaaucacuucaccuuggacaaaggauca

SEQ ID NO: 529732 - RNA, 64 nt, hsa
ucucaucaggguagcagcagaggcaggaccagaaggcaaucaagagcuuccagaaaugccacac

SEQ ID NO: 529733 - RNA, 64 nt, hsa
ucacuugauguaaccuggaaacuaugcuuuacauggcaaucaaagccuuuugaucauguacauu

SEQ ID NO: 529734 - RNA, 64 nt, hsa
agccuauuccacauauuuaaaccgcauuaaucauggcaaucaagcccccuuccagauuacuguc

SEQ ID NO: 529735 - RNA, 64 nt, hsa
cuacuggaaaaaaaaaaaauuagcuggacaugguggcaaucagcucuagucccaacuacuugga

SEQ ID NO: 529736 - RNA, 56 nt, hsa
accuucaggcaacacuuuaaggguucggcaaucacugucacccccggacagcagaa

SEQ ID NO: 529737 - RNA, 64 nt, hsa
gauguaacauaaugaaacacaccugucuaggggcggcaaucaacagucuuacacagagagggua

SEQ ID NO: 529738 - RNA, 64 nt, hsa
uuacauguaaaauuuuagauuucuaaaacaggugggcaaucauuuugaauacuguucugugacc

SEQ ID NO: 529739 - RNA, 64 nt, hsa
auuuuauaaauugugugaagcgaauuucccauuuggcaaucauuuacugauuugcagugaugaa

SEQ ID NO: 529740 - RNA, 64 nt, hsa
ucuauuagaagauggggauauaaaagaaguauaaggcaaucauauauucauucaaaagauauuu

SEQ ID NO: 529741 - RNA, 64 nt, hsa
uuguuuugcuauuuagcaauaacauggucaaaaaggcaaucagaaauuuuaaauacaguuaaug

SEQ ID NO: 529742 - RNA, 64 nt, hsa
guuuaaaggccaguccaaacaccacggagcauuuggcaaucaaggccccagagucuccgugguc

SEQ ID NO: 529743 - RNA, 64 nt, hsa
aacagucacccgugcuggcuguagcccccacagaggcaaucaugcccaauagauucaagagaag

SEQ ID NO: 529744 - RNA, 64 nt, hsa
agcccauaucacauguggaugucgagacuucacgggcaaucaugagcaagugaacacuguucua

SEQ ID NO: 529745 - RNA, 64 nt, hsa
ucagcuucuucauaacguuuucaaggaaauucuaggcaaucauuccugucaccaaagaacuaaa

SEQ ID NO: 529746 - RNA, 64 nt, hsa
augagcuuauccagaacgguggcagagucuccuuggcaaucaaccaacguugcuaugaaauaug

SEQ ID NO: 529747 - RNA, 64 nt, hsa
gucucauucugucacccagacuggagugcaggggggcaaucacggcucacuguagucucgaccu

SEQ ID NO: 529748 - RNA, 64 nt, hsa
cugcuuccccgagccugacccuguuccgcccacuggcaaucagggcugcgcacuucccugucca

SEQ ID NO: 529749 - RNA, 64 nt, hsa
gccacccuucacagauaaaauaugaugcuggcauggcaaucagaccaaagcacuguccccaauu

SEQ ID NO: 529750 - RNA, 64 nt, hsa
aacacacacaaaauggaauaauucugagucacuaggcaaucaaucuacugugguuuuacuaugu

SEQ ID NO: 529751 - RNA, 64 nt, hsa
gugauuuuauacauaaaggccagaagcugucugaggcaaucaugauugauuguauguaucacuu

SEQ ID NO: 529752 - RNA, 64 nt, hsa
gggaugguaauagaaaaagacuauuuuauuuccuggcaaucacggguaaggaggauuaggaaug

SEQ ID NO: 529753 - RNA, 64 nt, hsa
aacccucgguguacacagaggcgggucuauaacaggcaaucaacaaacguuucuugagcuagac

SEQ ID NO: 529754 - RNA, 64 nt, hsa
agaggugggcgcuagaagaugcagcccaggauguggcaaucaaugacacuauugggguuuccca

SEQ ID NO: 529755 - RNA, 52 nt, hsa
caucuggcaagaaagcauaaguggcaaucauaaaaaguaauaaagguucuuu

SEQ ID NO: 529756 - RNA, 64 nt, hsa
ccuugucauuccuaucucuugaguucuccccagaggcaaucacugcuacugguuguguaucucu

SEQ ID NO: 529757 - RNA, 64 nt, hsa
ugauuuguguaaccugaggccaggauuaaggggaggcaaucaaugcaccuagggaaaaaauuua

SEQ ID NO: 529758 - RNA, 64 nt, hsa
ggaagugagucagggagggcggaguuuguuguaaggcaaucaccugucaaaacagaaauugggu

SEQ ID NO: 529759 - RNA, 64 nt, hsa
gcaacuuuuguacaguauuuaucgagauaaacauggcaaucaaaauguccauuguuuauaagcu

SEQ ID NO: 529760 - RNA, 64 nt, hsa
cuucaccaucaacaggaggauuacaucuaaugcaggcaaucaucuauuacagaugccgaauaaa

SEQ ID NO: 529761 - RNA, 64 nt, hsa
uaaauuaagcacaguaaauguguauaaauaugaaggcaaucauaaggauuuuuucacuuguguu

SEQ ID NO: 529762 - RNA, 64 nt, hsa
uugauugaaacgagggcaguuaugaauugauuugggcaaucaaaugaauuuauaaaggagaaua

SEQ ID NO: 529763 - RNA, 64 nt, hsa
aauuugcugcuuguacagaaagugaaaauuaguuggcaaucauaagaaacaucugaauaacaac

SEQ ID NO: 529764 - RNA, 64 nt, hsa
guaaaauaugaaauacucagaaguaaagugugugggcaaucagaagcauagccuugaaggaccu

SEQ ID NO: 529765 - RNA, 64 nt, hsa
agccuugccuuuguaauuugacuucugacauguuggcaaucaaagcaugcacuuguaacaauga

SEQ ID NO: 529766 - RNA, 64 nt, hsa
gcaggauccauuuuugcagauagcuaugacuuguggcaaucaggcuucguagcuuggggaggua

SEQ ID NO: 529767 - RNA, 64 nt, hsa
augcguuugauucugcccacagggccugugccaaggcaaucagaucuuuaugagagcaguauuu

SEQ ID NO: 529768 - RNA, 64 nt, hsa
gccuguaauccuagcacuuugggaggcugaggcaggcaaucacuugaggucaggaguucgagac

SEQ ID NO: 529769 - RNA, 64 nt, hsa
ccaacaaacuuaaaaguuuaucuaccucguuuuaggcaaucaagauucuggagagucuugaaca

SEQ ID NO: 529770 - RNA, 64 nt, hsa
uuuauuuuucaucucucugauauacccaauguguggcaaucagccccuaccacgagcauuaaua

SEQ ID NO: 529771 - RNA, 64 nt, hsa
acuuguuauaaugcucuauagucauccacaguugggcaaucauagcuaauuuuuggucauagaa

SEQ ID NO: 529772 - RNA, 64 nt, hsa
aaaaaaaaaaaaaacaaggggaaaggguugguuaggcaaucauucuagggcagaaagaaguaca

SEQ ID NO: 529773 - RNA, 64 nt, hsa
ugcuuuccuuuuuuauaccugccuuaaauaauuuggcaaucagaauuaaaaaguuuuuuuuuuu

SEQ ID NO: 529774 - RNA, 64 nt, hsa
aaauaacauacccuguauucaaaauuacugaaauggcaaucaaagaugaucauuuuuaugugau

SEQ ID NO: 529775 - RNA, 64 nt, hsa
aagcaaccauacuucaccuagagaagacaguauuggcaaucaugacaccuguaauaaaaacuug

SEQ ID NO: 529776 - RNA, 64 nt, hsa
auuggguaccacauuuugagaaccauggggcauuggcaaucaacaaaugcaaugcuugugacuu

SEQ ID NO: 529777 - RNA, 64 nt, hsa
aggcuccucuuaccucccaagcucauggacaaguggcaaucagcuggggucccucuuuuggggu

SEQ ID NO: 529778 - RNA, 64 nt, hsa
uuaacuaaaaaaguuggcggcaggggugggggguggcaaucauuuuucuuccuauacauacaaa

SEQ ID NO: 529779 - RNA, 64 nt, hsa
cuccacgauuacuagguucuugauucccuuauauggcaaucaggcagaggcguuccuuaagcau

SEQ ID NO: 529780 - RNA, 64 nt, hsa
gggauaaaggauuauuuggucuucuggauuuggaggcaaucagcggacagcauggaagaugugu

SEQ ID NO: 529781 - RNA, 64 nt, hsa
ugggagaccccuucucugccuaguccacagauuaggcaaucaaggaagacgccaucagggaagc

SEQ ID NO: 529782 - RNA, 64 nt, hsa
agugguaggaaagccucacugauauauuuuccagggcaaucaauguucacgcaacuugaaauua

SEQ ID NO: 529783 - RNA, 64 nt, hsa
uccuaauuugagcaaaaucuaaaaucaauuauuaggcaaucagaaaaauuugaacacagacuag

SEQ ID NO: 529784 - RNA, 64 nt, hsa
aacuaggauuguagucccaaagaggcuacuguaaggcaaucauggugcucagagcaguguuucg

SEQ ID NO: 529785 - RNA, 64 nt, hsa
cagaaaaaaaaauaagcuguuugaauuacaucugggcaaucaggagauaauucauuauggcuga

SEQ ID NO: 529786 - RNA, 64 nt, hsa
gccuguaaucucagcacuuugggaggccaaggcaggcaaucaccugagggcaggagaccagccu

SEQ ID NO: 529787 - RNA, 64 nt, hsa
uggguggggugggcauuuuguuuauuuguuugguggcaaucagugguaguagggagugggaggg

SEQ ID NO: 529788 - RNA, 64 nt, hsa
ucuggccaaggggugggccugugaaucaauccugggcaaucagacacccucuccuuaaaaacug

SEQ ID NO: 529789 - RNA, 64 nt, hsa
uucuucuugcuaagucuuaccauguaccugcuuuggcaaucauugcaacucugagauuauaaaa

SEQ ID NO: 529790 - RNA, 64 nt, hsa
aaagugggauggaagaauuaaauccagaguuccaggcaaucaaaaugagugcagguugaaagaa

SEQ ID NO: 529791 - RNA, 64 nt, hsa
gcuguuggccucugcaaaggaaauaccaguucugggcaaucaguguuaccguucaccaguugcc

SEQ ID NO: 529792 - RNA, 64 nt, hsa
auaaacuauaucaucaccaagagauguuuauuagggcaaucaaaagauuuauuauuuuaaaaaa

SEQ ID NO: 529793 - RNA, 64 nt, hsa
ucagcaguguuaauggaagaaauuccuaccaaugggcaaucaaaaaagccagugugagaagaaa

SEQ ID NO: 529794 - RNA, 64 nt, hsa
ggagccagcaggcaggcgggaagggccaaguacaggcaaucacccccaucuucuugguuugaag

SEQ ID NO: 529795 - RNA, 64 nt, hsa
ucaucuagaccuggcaagaauguauauagaagcaggcaaucacagaaaagcugaagagaauuuu

SEQ ID NO: 529796 - RNA, 64 nt, hsa
cauuuuguuugcuuugacccuguuucaccaucugggcaaucauuuauuuuccuugagcauuuau

SEQ ID NO: 529797 - RNA, 64 nt, hsa
caauuuccucauauccaguauuguuccuuuugugggcaaucacuaaaaaugaucacuaacagca

SEQ ID NO: 529798 - RNA, 64 nt, hsa
uuguauuguauguacauuuuauauucauaauaaaggcaaucaaacucuaaaccucuaaguccuu

SEQ ID NO: 529799 - RNA, 55 nt, hsa
cgcagggggccgagggcugaggccaggcaaucacgggcuaugcccggggagcugu

SEQ ID NO: 529800 - RNA, 64 nt, hsa
ccuuugaacaaaggucugugugguugucuucacgggcaaucaggaagggagagagcuggggacc

SEQ ID NO: 529801 - RNA, 64 nt, hsa
ugucugugcgucuguguguuuauuuggggaaaagggcaaucagcaaucaacugagguuucuuaa

SEQ ID NO: 529802 - RNA, 64 nt, hsa
guuauucagaggaguaagauggugauguucaccuggcaaucagcugaguugagacuuuggaaua

SEQ ID NO: 529803 - RNA, 64 nt, hsa
caugcuucccauacaaagagcaucagaaaaucagggcaaucaucuagaucucacagaucuucaa

SEQ ID NO: 529804 - RNA, 64 nt, hsa
cauagacuucucagaccaagggaccuggaugacaggcaaucaaggccugagcaaccaaaaggag

SEQ ID NO: 529805 - RNA, 64 nt, hsa
cagguucccuucuaacaacuauuugaccaagagaggcaaucaggggguuguauacugcacugga

SEQ ID NO: 529806 - RNA, 64 nt, hsa
aaaauguggagcagccaacaagcaggggcucuuaggcaaucacauagugaaaguuuauaagagg

SEQ ID NO: 529807 - RNA, 64 nt, hsa
aggagaccuccuuauuauccugucucugcuuugaggcaaucaaguacccucucugaaccuaggu

SEQ ID NO: 529808 - RNA, 64 nt, hsa
ucacugaggccaccgaaaaggacauuucuaccuaggcaaucagucagauucacagaaaaaaguu

SEQ ID NO: 529809 - RNA, 64 nt, hsa
uucuuacuccauacaagcaguuuauggaugucugggcaaucauagcacuugccauuuaaaaaca

SEQ ID NO: 529810 - RNA, 64 nt, hsa
gcauauuaccuguaacauguuuaaauaaggcaaaggcaaucaaaaaccuuuuuguuuuguagcc

SEQ ID NO: 529811 - RNA, 64 nt, hsa
caaauucaauaguauagccaucacuuauuauaauggcaaucagaagagugaggcuucuuuuuuc

SEQ ID NO: 529812 - RNA, 64 nt, hsa
uuuuguuuuucagauuuagcauguagacugcuggggcaaucaauggaugaaaguggauuaccac

SEQ ID NO: 529813 - RNA, 64 nt, hsa
gaaaucucuuuguaauugcuguaaaugucaucaaggcaaucauagauuucuuuuccauuuugca

SEQ ID NO: 529814 - RNA, 64 nt, hsa
aaugguuaaugaugguuaaugauaaccauuaauaggcaaucauuuacaacugauuuugaucaca

SEQ ID NO: 529815 - RNA, 64 nt, hsa
ucucuauuuuacugaagcuaugcugggcaauucuggcaaucauuaaagugcauagauuucuauc

SEQ ID NO: 529816 - RNA, 64 nt, hsa
aguacgauuuugccgauggaauaacagauuugccggcaaucacugaaagagugcaaauaucggg

SEQ ID NO: 529817 - RNA, 54 nt, hsa
gggcuuugcucuuucagugagcuaggcaaucaagucucacagauugcugccuca

SEQ ID NO: 529818 - RNA, 64 nt, hsa
gccacacauccauccagucugagaaagugagagaggcaaucaugccaagaacaagccagcaaag

SEQ ID NO: 529819 - RNA, 64 nt, hsa
ggcuuaauaauuccuuauagccaauaucaacaguggcaaucagcacacagaggaaaggacccaa

SEQ ID NO: 529820 - RNA, 64 nt, hsa
aguacgauuuugccgauggaauaacagauuugccggcaaucacugaaagagugcaaacaucggg

SEQ ID NO: 529821 - RNA, 64 nt, hsa
cagucucucguggcgauugauuaugcuugugugaggcaaucaugguggcaucacccauaaaggg

SEQ ID NO: 529822 - RNA, 64 nt, hsa
ggaguuacagccucaagguuguagcaugugugcuggcaaucagggccgcaguguguucugcgcc

SEQ ID NO: 529823 - RNA, 53 nt, hsa
uaacuauuuccauguguugaaauggcaaucaaacauuuucuggccaguguuua

SEQ ID NO: 529824 - RNA, 64 nt, hsa
aauccgcauuuuuauguaaacaguaagggaacggggcaaucauauaagcguuugucucagggga

SEQ ID NO: 529825 - RNA, 64 nt, hsa
ccacaaaauguaaacccaaccuuuauaccacaaaggcaaucagaucccauccuccuccuucaua

SEQ ID NO: 529826 - RNA, 61 nt, hsa
uguuguucucugaagauuaagauuuuaggauggcaaucaugucuugauguccugauuuguu

SEQ ID NO: 529827 - RNA, 64 nt, hsa
uggaucaucaaggugaaacacuuugguauucuuuggcaaucagugcuccuguaagucaaaugug

SEQ ID NO: 529828 - RNA, 64 nt, hsa
ggugcgaugacucugaugccucacucagucucugggcaaucaucaucuuugccucuagccaccg

SEQ ID NO: 529829 - RNA, 64 nt, hsa
ucuaaccuguugucuuucuguuacuuucuuucugggcaaucaaugacagcaucuccccauucau

SEQ ID NO: 529830 - RNA, 64 nt, hsa
acagcuggacccugcuucacccucacccccuccuggcaaucaauacagcuucauuaucugaguu

SEQ ID NO: 529831 - RNA, 64 nt, hsa
uuguucauuugcagccaguuuuuacugaguuuguggcaaucaggaaugcauuugcuaagcaagu

SEQ ID NO: 529832 - RNA, 64 nt, hsa
aauuaauccuguuuuacauuucagaccuaaagcuggcaaucaggagaagaagcacuuuguuuua

SEQ ID NO: 529833 - RNA, 64 nt, hsa
aacugccuggaacuaaaagcagugaagcaagggaggcaaucacacugaagcgggucuuccucca

SEQ ID NO: 529834 - RNA, 64 nt, hsa
aacccauggguccaguuuaguaacgagugauuuaggcaaucaaugauagguuuauaaucuuaga

SEQ ID NO: 529835 - RNA, 64 nt, hsa
uuuuuauucaauuuauuucauucaguuuauucuuggcaaucaaacaucccauaaacuuugcuuu

SEQ ID NO: 529836 - RNA, 64 nt, hsa
guuucccacagggagcugagucuacagacuccagggcaaucaaaggucaccacccccaccccuc

SEQ ID NO: 529837 - RNA, 64 nt, hsa
gaugaagagggagaaugucagaacucaagugaagggcaaucagggcagacugccuggaggagug

SEQ ID NO: 529838 - RNA, 64 nt, hsa
uuauagucacaaccucuccucagcccuaacccuuggcaaucagaaaucuuuucaucuuuaguuu

SEQ ID NO: 529839 - RNA, 64 nt, hsa
gcauuguugggcaauuaguuuguaauuuguuuuaggcaaucacuauaaauuauaauuauggaca

SEQ ID NO: 529840 - RNA, 64 nt, hsa
uuauaaucuaaucacaauuugucaauauggucuuggcaaucaucugugcauuacucugguuugc

SEQ ID NO: 529841 - RNA, 64 nt, hsa
ggcuaugaaagggagcgagccccucggcucuggaggcaaucaagcagacauagaagagccaaga

SEQ ID NO: 529842 - RNA, 64 nt, hsa
caagaagucaagaccacuguccccugcugaguuaggcaaucacuuaaaacuccaaagaacucca

SEQ ID NO: 529843 - RNA, 64 nt, hsa
uuccucgacaucuuccuccucuacugguaaccaaggcaaucaggccuaccagaaucgcccagug

SEQ ID NO: 529844 - RNA, 64 nt, hsa
ggggacaugggucgcccaugagagcgcagcccgcggcaaucaauaaacagcaggugauacaagc

SEQ ID NO: 529845 - RNA, 64 nt, hsa
cccucuccagcgguuccaguuuguggaagucccaggcaaucacuguguccacaugagcgaaccc

SEQ ID NO: 529846 - RNA, 64 nt, hsa
guaccggaccucauaaaaggacucucagccucuuggcaaucauaaauauuaaagucgguuuauc

SEQ ID NO: 529847 - RNA, 64 nt, hsa
cugcuguguaauaauaaagaaagauucggcuuuuggcaaucacggacacuuuuuuccccuccac

SEQ ID NO: 529848 - RNA, 64 nt, hsa
aaaggcaccuuguagcauguacuccccgugccugggcaaucagaugggcugccuuuguccaagg

SEQ ID NO: 529849 - RNA, 64 nt, hsa
aucugcagugaugcaauaaccagcauaauaaaaaggcaaucacauaaaaaagaguuuagucguc

SEQ ID NO: 529850 - RNA, 64 nt, hsa
accguuuaguuccuaucaucuguggcaugugaagggcaaucacaguguuaaaagaagacaugcu

SEQ ID NO: 529851 - RNA, 64 nt, hsa
aauacauauuacaagaaaacuacaggguccacacggcaaucagaagaaaggagcugagaugagg

SEQ ID NO: 529852 - RNA, 64 nt, hsa
gguuuauggggagcuuuuguugcacccaugcaggggcaaucagaucagcaucuucaugcaaaaa

SEQ ID NO: 529853 - RNA, 64 nt, hsa
caggaacacucuuuuuaaugggagguuaugcuuuggcaaucagcgucucccugggaagagaguc

SEQ ID NO: 529854 - RNA, 64 nt, hsa
uaagcuccaccaacuucaagccaugugacuuuggggcaaucagucaccucugagccuccuuucu

SEQ ID NO: 529855 - RNA, 64 nt, hsa; identical to SEQ ID NO: 243972

SEQ ID NO: 529856 - RNA, 64 nt, hsa; identical to SEQ ID NO: 243973

SEQ ID NO: 529857 - RNA, 64 nt, hsa; identical to SEQ ID NO: 243974

SEQ ID NO: 529858 - RNA, 64 nt, hsa; identical to SEQ ID NO: 243975

SEQ ID NO: 529859 - RNA, 64 nt, hsa; identical to SEQ ID NO: 243976

SEQ ID NO: 529860 - RNA, 64 nt, hsa; identical to SEQ ID NO: 243977

SEQ ID NO: 529861 - RNA, 64 nt, hsa; identical to SEQ ID NO: 243978

SEQ ID NO: 529862 - RNA, 64 nt, hsa; identical to SEQ ID NO: 243979

SEQ ID NO: 529863 - RNA, 64 nt, hsa; identical to SEQ ID NO: 243980

SEQ ID NO: 529864 - RNA, 64 nt, hsa; identical to SEQ ID NO: 243981

SEQ ID NO: 529865 - RNA, 64 nt, hsa; identical to SEQ ID NO: 243982

SEQ ID NO: 529866 - RNA, 64 nt, hsa; identical to SEQ ID NO: 243983

SEQ ID NO: 529867 - RNA, 64 nt, hsa; identical to SEQ ID NO: 243984

SEQ ID NO: 529868 - RNA, 64 nt, hsa; identical to SEQ ID NO: 243985

SEQ ID NO: 529869 - RNA, 64 nt, hsa; identical to SEQ ID NO: 243986

SEQ ID NO: 529870 - RNA, 64 nt, hsa; identical to SEQ ID NO: 243987

SEQ ID NO: 529871 - RNA, 64 nt, hsa; identical to SEQ ID NO: 243988

SEQ ID NO: 529872 - RNA, 64 nt, hsa; identical to SEQ ID NO: 243989

SEQ ID NO: 529873 - RNA, 64 nt, hsa; identical to SEQ ID NO: 286003

SEQ ID NO: 529874 - RNA, 64 nt, hsa; identical to SEQ ID NO: 286004

SEQ ID NO: 529875 - RNA, 64 nt, hsa; identical to SEQ ID NO: 286005

SEQ ID NO: 529876 - RNA, 64 nt, hsa; identical to SEQ ID NO: 286006

SEQ ID NO: 529877 - RNA, 64 nt, hsa; identical to SEQ ID NO: 286007

SEQ ID NO: 529878 - RNA, 64 nt, hsa; identical to SEQ ID NO: 286008

SEQ ID NO: 529879 - RNA, 64 nt, hsa; identical to SEQ ID NO: 286009

SEQ ID NO: 529880 - RNA, 64 nt, hsa; identical to SEQ ID NO: 286010

SEQ ID NO: 529881 - RNA, 64 nt, hsa; identical to SEQ ID NO: 286011

SEQ ID NO: 529882 - RNA, 64 nt, hsa; identical to SEQ ID NO: 286012

SEQ ID NO: 529883 - RNA, 64 nt, hsa; identical to SEQ ID NO: 286013

SEQ ID NO: 529884 - RNA, 64 nt, hsa; identical to SEQ ID NO: 286014

SEQ ID NO: 529885 - RNA, 64 nt, hsa; identical to SEQ ID NO: 286015

SEQ ID NO: 529886 - RNA, 64 nt, hsa; identical to SEQ ID NO: 286016

SEQ ID NO: 529887 - RNA, 64 nt, hsa; identical to SEQ ID NO: 286017

SEQ ID NO: 529888 - RNA, 64 nt, hsa; identical to SEQ ID NO: 286018

SEQ ID NO: 529889 - RNA, 64 nt, hsa; identical to SEQ ID NO: 286019

SEQ ID NO: 529890 - RNA, 64 nt, hsa; identical to SEQ ID NO: 286020

SEQ ID NO: 529891 - RNA, 64 nt, hsa; identical to SEQ ID NO: 286021

SEQ ID NO: 529892 - RNA, 64 nt, hsa; identical to SEQ ID NO: 286022

SEQ ID NO: 529893 - RNA, 64 nt, hsa; identical to SEQ ID NO: 286023

SEQ ID NO: 529894 - RNA, 64 nt, hsa; identical to SEQ ID NO: 286024

SEQ ID NO: 529895 - RNA, 64 nt, hsa
accuuagaacuuuuuaagguaaaaucaaauauagcuacagcauaagagaaucgagaaauuugau

SEQ ID NO: 529896 - RNA, 64 nt, hsa
ugagugccacuauuaauguaaaaaggggggggcucuacagcagucgugaugaaacuuaaauaua

SEQ ID NO: 529897 - RNA, 64 nt, hsa
gauucucagauccagguuaggaaaggauucagcacuacagcauaccccucuacaacauacagcc

SEQ ID NO: 529898 - RNA, 64 nt, hsa
ucaccagguucuagcucuggcaaaggagugcugucuacagcaagauuuuugcuuuuagaauuuu

SEQ ID NO: 529899 - RNA, 64 nt, hsa
aacuccaguaaagcuaagugucuuaugaaaucuaaacucauauauguacacaguucacucuagc

SEQ ID NO: 529900 - RNA, 64 nt, hsa
ugcacacaucuaacauugguagauuucuaaagacaacucauaaauaauuucuuaacccauauaa

SEQ ID NO: 529901 - RNA, 64 nt, hsa
uaauuauagauuugcuuggacaaaauauuccaggaacucauagcgagcucaaagcaauuaagug

SEQ ID NO: 529902 - RNA, 64 nt, hsa
aggaaagacagccauaaauucuggcuuuggggaaaacucauauccccaugaaaaggaagaacaa

SEQ ID NO: 529903 - RNA, 64 nt, hsa
uucaucagaagucagcucuaauuguucaccacagaacucauauaagacagaaacccuaugggug

SEQ ID NO: 529904 - RNA, 64 nt, hsa
gagcuagaaaaccuggaguguggcauuagaauagaacucauaucuuuuaaauauauaggaacaa

SEQ ID NO: 529905 - RNA, 64 nt, hsa
ugauauuucacauuguaugaaauaccauguuugaaacucauagcaauaaugcuaugcuguugug

SEQ ID NO: 529906 - RNA, 64 nt, hsa
gauaacacuuggggggaccucagccucuauucgcaacucauaauccguagacuacaagaugaaa

SEQ ID NO: 529907 - RNA, 64 nt, hsa
cacuauucucuuugauuagaaaauaaacucauaaaacucauaauguugauauaaucaagaugua

SEQ ID NO: 529908 - RNA, 64 nt, hsa
acaggcugacacuauucucuuugauuagaaaauaaacucauaaaacucauaauguugauauaau

SEQ ID NO: 529909 - RNA, 64 nt, hsa
ucacucauucccguuuccuucaaggacaugaaagaacucauaccgcaaagaagcuaugugaaug

SEQ ID NO: 529910 - RNA, 64 nt, hsa
uuagugaucuuuauucccuucaaaaucaugagacaacucauaugggagagaagccauaugaaug

SEQ ID NO: 529911 - RNA, 64 nt, hsa; identical to SEQ ID NO: 502129

SEQ ID NO: 529912 - RNA, 64 nt, hsa; identical to SEQ ID NO: 502130

SEQ ID NO: 529913 - RNA, 64 nt, hsa; identical to SEQ ID NO: 502131

SEQ ID NO: 529914 - RNA, 64 nt, hsa; identical to SEQ ID NO: 502132

SEQ ID NO: 529915 - RNA, 64 nt, hsa; identical to SEQ ID NO: 502133

SEQ ID NO: 529916 - RNA, 64 nt, hsa
caucaacgucuagcggccccgcgggacuggggacugagcccaggagguuugcacaagccgggcg

SEQ ID NO: 529917 - RNA, 64 nt, hsa
cagcuauucuccaggcugaggugggaggaucgcuugagcccaagagguugaggcugcagugagc

SEQ ID NO: 529918 - RNA, 64 nt, hsa
caguauuuugggaggccgagguggaaagaucgcuugagcccaggaguucaagaccagccugggc

SEQ ID NO: 529919 - RNA, 64 nt, hsa
cagcuauucaggaggcugaggugggaggaucauuugagcccagagguagaggcugcagugagcc

SEQ ID NO: 529920 - RNA, 64 nt, hsa
agaaucacuuggaccugggaggcagagguuucagugagcccagaucgcgacacugcacuccagc

SEQ ID NO: 529921 - RNA, 64 nt, hsa
auacuaggugcucaauucaugccugugaauggcgugagcccauaauggauacacagagguugca

SEQ ID NO: 529922 - RNA, 64 nt, hsa
caucugcuugggaggcugagguugcaggaucacuugagcccaggaggucaaggcugcagugagc

SEQ ID NO: 529923 - RNA, 64 nt, hsa
cagcacuuuggaaggcugaggcagaaggaucacuugagcccaggaauuugagguuguaguaagc

SEQ ID NO: 529924 - RNA, 64 nt, hsa
cagcuacucaggaagcugagacaagaggaucaauugagcccaggaguucaaagcuguagugagc

SEQ ID NO: 529925 - RNA, 64 nt, hsa
cagcuacuugggaggcugaggcaggagaauugcuugagcccaagagguggagguuacagugagc

SEQ ID NO: 529926 - RNA, 64 nt, hsa
cucccaaagugcuaagauuacaggcgugagccacugagcccagccuacuuuucaguuuuuaaca

SEQ ID NO: 529927 - RNA, 64 nt, hsa
aacacuuugggaggcugaaguaggaggaucgucuugagcccaggaguucaagaccagccuggac

SEQ ID NO: 529928 - RNA, 64 nt, hsa
cauggaacuaagccucccaaaugggaguucuggcugagcccaggguggggagauccugggaagg

SEQ ID NO: 529929 - RNA, 64 nt, hsa
ucaggaagucacagucuccggacaccacaccacaugagcccaacagguccacgauggauccacc

SEQ ID NO: 529930 - RNA, 64 nt, hsa
uagcacuuugggaggcugaggaggaaggaucacuugagcccagaaguucgagacuagccugggc

SEQ ID NO: 529931 - RNA, 64 nt, hsa
cagcauuccgggaggcugaggugggaggaucacuugagcccagggagguuggggcugcagugag

SEQ ID NO: 529932 - RNA, 64 nt, hsa
ccacaaccaccaccagugcuaccaccguugccacugagcccacaucccaagagacaggcccaga

SEQ ID NO: 529933 - RNA, 64 nt, hsa
agccuaaaggcaaggacagugccaaaagguucugugagcccaucggggagaagaagaguccagc

SEQ ID NO: 529934 - RNA, 64 nt, hsa
cagcuacucaagaggcugaggcaggaggacugcuugagcccaggaguucagggcugcagugagg

SEQ ID NO: 529935 - RNA, 64 nt, hsa
aggcaggccccagugugaccaccacugcgaccccugagcccacaagggcagagcagcauucuga

SEQ ID NO: 529936 - RNA, 64 nt, hsa
caguuacucaggaggcugaggcaggaggaucacuugagcccaggagguugaggcuggagugagc

SEQ ID NO: 529937 - RNA, 64 nt, hsa
ccagcacuuugggaggcugaugugggcggauaguugagcccaggaguucgagaccagccugggc

SEQ ID NO: 529938 - RNA, 64 nt, hsa
cagcuacucaggaggcugaggugggaaaaucacuugagcccaggaggucgaggcugcagugugc

SEQ ID NO: 529939 - RNA, 64 nt, hsa
cagcacuaugggaggcugaggcaagcagguuguuugagcccaggaauuugagaacaggauuuug

SEQ ID NO: 529940 - RNA, 64 nt, hsa
cagcuauucaggaggcugaggugggaggauugcuugagcccagcagguugaggcuguggugauu

SEQ ID NO: 529941 - RNA, 64 nt, hsa
uagcacuuugagaggccgagauaggcggauugcuugagcccaggaguuugagggcagccuggga

SEQ ID NO: 529942 - RNA, 64 nt, hsa
uucugauuacucucaauucuaauuguuauauauuugagcccauacaguguauuagguugaacca

SEQ ID NO: 529943 - RNA, 64 nt, hsa
augcaagccccucuucuuaaccguuucuuggcuuugagcccagaaacacagcucucccugucuc

SEQ ID NO: 529944 - RNA, 64 nt, hsa
caccagcuuuacagggcaguguuucagauggcccugagcccacggaaaaggccagguagaccuc

SEQ ID NO: 529945 - RNA, 64 nt, hsa
uguguccucugagcacucuggcauuugucauugcugagcccauaucaguagguccugggacuug

SEQ ID NO: 529946 - RNA, 64 nt, hsa
ccagcuacucaggaggcucagcagcaggacgacuugagcccaagaguuccagaccagccuggcc

SEQ ID NO: 529947 - RNA, 64 nt, hsa
caucuagucaggaagcugagauggaagaauuaauugagcccacgaguucaaggcugcagugagu

SEQ ID NO: 529948 - RNA, 64 nt, hsa
cagcacuuugggaggcugaggugggagaauugccugagcccaggaguucaagaccagcuugugc

SEQ ID NO: 529949 - RNA, 64 nt, hsa
caggugcucaggaagcugaggugggaggaucacuugagcccaauucaaagcugcagugagcugu

SEQ ID NO: 529950 - RNA, 64 nt, hsa
cagcuacugaggaggcugaggugggaggauugcuugagcccaggaggcagagguugcagugagc

SEQ ID NO: 529951 - RNA, 64 nt, hsa
cagcacuuugggaggcugagguggguagauuacuugagcccaggaauucaagaccagccugggc

SEQ ID NO: 529952 - RNA, 64 nt, hsa
cagcuucucaggaggcuggggugggaagaucacuugagcccaggaggucgaggcugcagugagc

SEQ ID NO: 529953 - RNA, 64 nt, hsa
aaacacuuugggaggcugagucgggaggauagcgugagcccaggaguuugagaccagcuaaggc

SEQ ID NO: 529954 - RNA, 64 nt, hsa
aagccucuccuggggccacuguugggggugggagugagcccaccacagaggccacaggcaggcc

SEQ ID NO: 529955 - RNA, 64 nt, hsa
ggguuggguucguaccagcaaguagacuaggaacugagcccaggaaagggggauguuuuccugg

SEQ ID NO: 529956 - RNA, 64 nt, hsa
cagcacuuugggaggccaaggugggaggaucguuugagcccaggaguugaagaccagccugggc

SEQ ID NO: 529957 - RNA, 64 nt, hsa
aucuaggccuggccgcggccuuucgcugagccccugagcccaaggcacugagaccuccacccac

SEQ ID NO: 529958 - RNA, 64 nt, hsa
agcuacuuugggagguugaggcaggaggaucgcuugagcccaggaggcagaggcugcagugagc

SEQ ID NO: 529959 - RNA, 64 nt, hsa
cauuacuuugggaggcccaggugggaggaucgcuugagcccagaaguuugagaccagccuaggc

SEQ ID NO: 529960 - RNA, 64 nt, hsa
cggucccagcugcucugauaagaggaggcucacuugagcccaggagguugaggcugcagugagc

SEQ ID NO: 529961 - RNA, 64 nt, hsa
caccugcucagguggcuaggguggauggaucgcuugagcccaggagguggagguugcagugagc

SEQ ID NO: 529962 - RNA, 64 nt, hsa
uaggaucuugggaggucgaggcaagcugaucgcuugagcccaggaguuuaagaccggccugagu

SEQ ID NO: 529963 - RNA, 64 nt, hsa
gagcuacugggggugcugaggugggaggaucgcuugagcccaggagagugaggcugcagugagc

SEQ ID NO: 529964 - RNA, 64 nt, hsa
uggugggcuacucuggaggcccuugaggaucacuugagcccaggagauugaggcugcagugagc

SEQ ID NO: 529965 - RNA, 64 nt, hsa
uuguaaucccagcacuuugaggugggcaauggcuugagcccaggaguucgacaccagccuggcc

SEQ ID NO: 529966 - RNA, 64 nt, hsa
cagcuacuuggggugcugaggcgggaggauuacuugagcccaggaggauuacuucaaccuggga

SEQ ID NO: 529967 - RNA, 64 nt, hsa
cuagcacuuuggaggccaaggcaggaggacugcuugagcccaggaguuugagaccagccugggc

SEQ ID NO: 529968 - RNA, 64 nt, hsa
cagcacuuugggaggccgaggcaggaagacugcuugagcccaggaguucaagaccagccugggc

SEQ ID NO: 529969 - RNA, 64 nt, hsa
cagcuacucaggagguugaggugggaagauugcuugagcccaggaguuugagguugcagugagc

SEQ ID NO: 529970 - RNA, 64 nt, hsa
cagugcuuugggaggccauagcaggaggauugcuugagcccaggaguucgagaccagccagagc

SEQ ID NO: 529971 - RNA, 64 nt, hsa
cagcuacuugggagguugaggugggaggauugcuugagcccaggauuucaaggcugcagugagc

SEQ ID NO: 529972 - RNA, 64 nt, hsa
caauggaaguggccucauggaugaauccgggguaugagcccaggagaacgugcugcuuuuggua

SEQ ID NO: 529973 - RNA, 64 nt, hsa
gagaauggcaugaacccgguaggggagcuugcagugagcccagaucaugccacuguacuccagc

SEQ ID NO: 529974 - RNA, 64 nt, hsa
cagccacucaggaggcugaugcaagaggaucgcuugagcccaggaguugaaguccagccuaagc

SEQ ID NO: 529975 - RNA, 64 nt, hsa
uuuccuaauggccccaucuccugcagaagccaggugagcccagcacuggacugaaguucuugca

SEQ ID NO: 529976 - RNA, 64 nt, hsa
cugucaaaauugguuuucacucauuugauugguuugagcccagaacagccuacaggggaaaaac

SEQ ID NO: 529977 - RNA, 64 nt, hsa
aggggcaggagacacuugggcuguuugccuugggugagcccaaagaacuugccccuuuucuccu

SEQ ID NO: 529978 - RNA, 64 nt, hsa
agagaguuuuggaauuugacauuggcuggcuggcugagcccauuuucggcucuggagauuaucc

SEQ ID NO: 529979 - RNA, 64 nt, hsa
gguuuggccucuaucguuaugcugcagaucaguuugagcccaaggcauccaugaaacauuacag

SEQ ID NO: 529980 - RNA, 64 nt, hsa
cagcacugugggagaccacggugggggaaucccuugagcccaggaguuggagagcaacaucaca

SEQ ID NO: 529981 - RNA, 64 nt, hsa
cagcuacuugggaggcugaggcaggagaaucgcuugagcccaagagguagagguugcagugagc

SEQ ID NO: 529982 - RNA, 64 nt, hsa
ggucacuaaaggggugaccuuguuccuugcuuuaugagcccauuagcacuuugguucaaggggc

SEQ ID NO: 529983 - RNA, 64 nt, hsa
cuaucugcacuuccaggugccccaccuauuuaucugagcccacagguggaaaggggaacugccu

SEQ ID NO: 529984 - RNA, 64 nt, hsa
cagcacgaugggaggccaagacaggcagaucacuugagcccaggaguuugaggccagccugggc

SEQ ID NO: 529985 - RNA, 64 nt, hsa
cagcuacucaggaggcaaagaugggaggauuacuugagcccaggaggucaaggcuacagugagc

SEQ ID NO: 529986 - RNA, 64 nt, hsa
cagcuacuauggagguugaggugggaggaucgcuugagcccaugaggcccagguuacagugagc

SEQ ID NO: 529987 - RNA, 64 nt, hsa
caaaacuuuaggaggccaaggugggaggaucgcuugagcccaggaguuugagaccagccuggcc

SEQ ID NO: 529988 - RNA, 64 nt, hsa
gagccccacuccuggccccacucacaccauccuaugagcccacgcccggccccacucccaccau

SEQ ID NO: 529989 - RNA, 64 nt, hsa
gagucccacucccagccccacucccaccauccugugagcccaugcccggccccacucacaccaa

SEQ ID NO: 529990 - RNA, 64 nt, hsa
cccuuaccccucacugaaucugccuuuauauuguugagcccaugaccccaaacugcucuuucca

SEQ ID NO: 529991 - RNA, 64 nt, hsa
cagcuacucaggagguugaggugggaggaucacuugagcccagaaguucaaggcugcaaugagc

SEQ ID NO: 529992 - RNA, 64 nt, hsa
ccagcuacucaggaggcugaggcuagaggauccuugagcccaggagguugaggcugcagugagg

SEQ ID NO: 529993 - RNA, 64 nt, hsa
cagcacuuugggaggcugaggcaggaggaucacuugagcccaggaguucaagacuagccuaggc

SEQ ID NO: 529994 - RNA, 64 nt, hsa
ccucagguggagagccgcaugucacugucagagaugagcccacccccacccuucccugggggcg

SEQ ID NO: 529995 - RNA, 64 nt, hsa
cucuuuacuccccaccccagugcgucucgccugcugagcccaccgcuuucucagcgucagagcc

SEQ ID NO: 529996 - RNA, 64 nt, hsa
acccuaggaccauggauaccucugugauucacgcugagcccaaguccccacacuggaaaacugg

SEQ ID NO: 529997 - RNA, 64 nt, hsa
caucacuuugggaggugcaggcaggcagauggcuugagcccaggaauucaagaccaguccgagc

SEQ ID NO: 529998 - RNA, 64 nt, hsa
agccagccagcauggccacccucaagaggcgagaugagcccacagaggcauauccugcggggau

SEQ ID NO: 529999 - RNA, 64 nt, hsa
gaugaaugaaugaaugagccaaagaacaaauaaaugagcccacacacccugaacgcaugcgaca

SEQ ID NO: 530000 - RNA, 64 nt, hsa
uggggcccccucccucuccucuccucuccuauggugagcccagcgugggcaccgggccgucuca

SEQ ID NO: 530001 - RNA, 64 nt, hsa
gaagcagggccugccuuacagguguggcugacucugagcccaggccugcagggguggagggcag

SEQ ID NO: 530002 - RNA, 64 nt, hsa
acccucaaggccacccagcuggacacgggagacuugagcccagccuucugacugcauucagccc

SEQ ID NO: 530003 - RNA, 64 nt, hsa
uuaggaaggaggugacagcacuugcauggucacuugagcccacacacacgcucaaccccaaguc

SEQ ID NO: 530004 - RNA, 64 nt, hsa
ugucccugucauaaguaccucccuauuguagauagaagggaaggaaacuguugacuugagcuug

SEQ ID NO: 530005 - RNA, 64 nt, hsa
cugcuggcuaagaccagggagcuaaaaacuugaggaagggaaccugccugggugggugcuacuu

SEQ ID NO: 530006 - RNA, 64 nt, hsa
uuagaguaaaaagccaaauuuaaauuauaagaaagaagggaaaaaagagaaaaacucaagucua

SEQ ID NO: 530007 - RNA, 64 nt, hsa
ccagaugugaaaugggagccuaccagcugguauagaagggaauggguaggaggcacugggugcu

SEQ ID NO: 530008 - RNA, 64 nt, hsa
uggaguccaggaugcccagaugugaggggcagaugaagggaauguugcuggaaaggugccuuuu

SEQ ID NO: 530009 - RNA, 64 nt, hsa
ggccucagagaagcucugacgcagugcugcuggggaagggaagugacuaaccccgggucagccu

SEQ ID NO: 530010 - RNA, 64 nt, hsa
cagagaagggaagagaggaagaacgagaggaagagaagggaaggaaguguuuguguagaagaga

SEQ ID NO: 530011 - RNA, 64 nt, hsa
ugguuuucuuuuugaggcaaguuggaugaacagagaagggaagagaggaagaacgagaggaaga

SEQ ID NO: 530012 - RNA, 64 nt, hsa
ucucaucugguaggaugaaaagauccagacccgggaagggaaguccgcagccgacgcccgcuac

SEQ ID NO: 530013 - RNA, 64 nt, hsa
ucuugccacaucaauaucccagaugguaaagacugaagggaaaggagcaaagagaaaaaccucc

SEQ ID NO: 530014 - RNA, 64 nt, hsa
aacugaaaaggguucuggaguguucauucagagugaagggaaaacuuuauccuucuauuucuua

SEQ ID NO: 530015 - RNA, 64 nt, hsa
aaaggaaugagaacuuugcaguuggaugaauagagaagggaaaaguugcuggagcacggaguga

SEQ ID NO: 530016 - RNA, 64 nt, hsa
gcuuaagcaacagauaaaguuuuuauuuuccucugaagggaaagggcucuuuuccugcuguuuc

SEQ ID NO: 530017 - RNA, 64 nt, hsa
uugucugacaaacucuuguguaccuuuguguaaagaagggaagcuuuguuugaaaauuguauuu

SEQ ID NO: 530018 - RNA, 64 nt, hsa
gacuugccuuaauuuauaaaggagggaagagguagaagggaaccauggguccuccagcuagagg

SEQ ID NO: 530019 - RNA, 64 nt, hsa
aaacacucugaucuuccuauuccacugagucucugaagggaauagggcugguagugggugggaa

SEQ ID NO: 530020 - RNA, 64 nt, hsa
ucagcucugcccagggccagccagguucugcugggaagggaagggaauggggagaagggagaag

SEQ ID NO: 530021 - RNA, 64 nt, hsa
ucugcccagggccagccagguucugcugggaagggaagggaauggggagaagggagaagcaagc

SEQ ID NO: 530022 - RNA, 64 nt, hsa
cagcaguacccccguuuggcacuugaggcacggagaagggaagggaaguccgcccagccagaac

SEQ ID NO: 530023 - RNA, 64 nt, hsa
guacccccguuuggcacuugaggcacggagaagggaagggaaguccgcccagccagaacuccca

SEQ ID NO: 530024 - RNA, 64 nt, hsa
uuuuccuuuuggaucauagcuuaacaaggcacaggaagggaagggaucuugacuaagauucaug

SEQ ID NO: 530025 - RNA, 64 nt, hsa
ugaaaguuggaaggagaagggagggaagagagcagaagggaagaagguguaagucaagcucuug

SEQ ID NO: 530026 - RNA, 64 nt, hsa
gccucugccuggaaccuggcucgugcugugaccagaagggaaaggcggcuguuuggcucuuucu

SEQ ID NO: 530027 - RNA, 64 nt, hsa
uuugaacagugaugaguuuggggcugguuucugggaagggaacguuuauuuaguaaagagcaga

SEQ ID NO: 530028 - RNA, 64 nt, hsa
cuuugauagaacuaaggaaauagugguuuugagugaagggaaaggaaacccagaaacauuuuac

SEQ ID NO: 530029 - RNA, 64 nt, hsa
uggggggaggggcggggcaugguacaaccugugggaagggaagcggguucauggcuuugagggc

SEQ ID NO: 530030 - RNA, 64 nt, hsa
aacuucuagaaaaugugugugccguagacacaaagaagggaacaauagacaccaggguauacuu

SEQ ID NO: 530031 - RNA, 64 nt, hsa
gacuguguugggaaaggauaagugcuaccguugagaagggaagaaaggcugagucuagguggag

SEQ ID NO: 530032 - RNA, 64 nt, hsa
caugagauaacacaucaggugucagaacuugcuugaagggaauuaccagaaguaauuuguguuu

SEQ ID NO: 530033 - RNA, 64 nt, hsa
cacagagacccugcacagcccugauuuacagagggaagggaagcgcgggugaggugguggcccc

SEQ ID NO: 530034 - RNA, 64 nt, hsa
ggaccugagucgggcagccgcucucccggaacuggaagggaaagccaggcggcucucaggggcu

SEQ ID NO: 530035 - RNA, 64 nt, hsa
uaguggccgauuugacuucagagugacagguagagaagggaagagcguguagaacuguggccag

SEQ ID NO: 530036 - RNA, 64 nt, hsa
uagcugguuagaaaaaugccacuguuuuuaucaagaagggaaauauauuugaaauauaaaauau

SEQ ID NO: 530037 - RNA, 64 nt, hsa
gcauggggauucuuuucuaagguaauauuaaugagaagggaaaaaaguaucuuuaacagcucuu

SEQ ID NO: 530038 - RNA, 64 nt, hsa
uuuuaauacuuaaggcuuuguaaaaacuauccaugaagggaaagcuccucagcauaacugcuca

SEQ ID NO: 530039 - RNA, 64 nt, hsa
ucugugccucucugggagaaaggagagaggauaagaagggaaaguucacaaccugugaacaggg

SEQ ID NO: 530040 - RNA, 64 nt, hsa
ugggggacagggcccaucuaccagccuucaucaggaagggaaagggcuuuggggucagguggca

SEQ ID NO: 530041 - RNA, 64 nt, hsa
auacuuucugaaaccuggagcugggaauugcggagaagggaaggucuagacuaguuacaucaca

SEQ ID NO: 530042 - RNA, 64 nt, hsa
gaaaugaguuuugauggugaauugggguguuaaggaagggaaagauugucauagaugguagggc

SEQ ID NO: 530043 - RNA, 64 nt, hsa
gucuuuuuguuuuuuuuaagauagcacuugaauagaagggaaaacugcauggcagauacgugac

SEQ ID NO: 530044 - RNA, 64 nt, hsa
gagucucaguaaucaagccaauggccuuugucaggaagggaaggggcucaacacagugauggac

SEQ ID NO: 530045 - RNA, 64 nt, hsa
uggugcccaggagcccuccagcccccugcccacagaagggaaggccugcagagggggccaggau

SEQ ID NO: 530046 - RNA, 64 nt, hsa
cggccuugcccaggcaucucgccugcggucugaggaagggaacagaaggucaugaguucagggu

SEQ ID NO: 530047 - RNA, 64 nt, hsa
ugagugugggugccaguccuccucaggagaaggggaagggaaggaggccacuuugagagggcug

SEQ ID NO: 530048 - RNA, 64 nt, hsa
guggauagagcagccugcugcucucaggaccagagaagggaaaugacuucuccaggcagaggca

SEQ ID NO: 530049 - RNA, 64 nt, hsa
uguauauuuuugguggugguggguuugggguggggaagggaagggcgggcaaggaguggggagg

SEQ ID NO: 530050 - RNA, 64 nt, hsa
gugagagguuugcauccacuucaggagcccuacugaagggaacagccugagccgaacauguuau

SEQ ID NO: 530051 - RNA, 64 nt, hsa
ccaugagcacagggcagggcuggggcagagaaaggaagggaacuggagcuggcccagggcugug

SEQ ID NO: 530052 - RNA, 64 nt, hsa
auuugcuuaccuucccguuucuccucugccccuggaagggaaugugggggcccacuuuuuugua

SEQ ID NO: 530053 - RNA, 64 nt, hsa
augaguacauguggacucaccugaggaagggaaggaagggaauaaucuuuuauguuucauuuac

SEQ ID NO: 530054 - RNA, 64 nt, hsa
ugucuccugaugaguacauguggacucaccugaggaagggaaggaagggaauaaucuuuuaugu

SEQ ID NO: 530055 - RNA, 64 nt, hsa
aggccuucucuccagcuggacacaaaccuccuuugaagggaaauaauugccguuaggcuucaca

SEQ ID NO: 530056 - RNA, 64 nt, hsa
cccccgcauggcaguuccuagguugcaguucagggaagggaaacaauaaaucucgcugaauuga

SEQ ID NO: 530057 - RNA, 64 nt, hsa
aagggacaagcagguuuauguguuuaaacagaaagaagggaaaagguacuaugugauaugguac

SEQ ID NO: 530058 - RNA, 64 nt, hsa
acuuuucaugaauuuugugaacuugccaaaaggggaagggaaaaaucuuuguguuacuucacuc

SEQ ID NO: 530059 - RNA, 64 nt, hsa
aagaaguuuggaaaguagauacauaaagacuugagaagggaauuguuuaagggaaaagaaaaga

SEQ ID NO: 530060 - RNA, 64 nt, hsa
uucuauaaccaugccauucacuuaaauaauucaugaagggaaugguuuaauuuaaaggaagacc

SEQ ID NO: 530061 - RNA, 64 nt, hsa
auuagagguccuugaguagaaccaaggauguuuugaagggaagggaaguuuaaguuaugcauua

SEQ ID NO: 530062 - RNA, 64 nt, hsa
agguccuugaguagaaccaaggauguuuugaagggaagggaaguuuaaguuaugcauuauuaua

SEQ ID NO: 530063 - RNA, 64 nt, hsa
gggcgagggugcguggggccugccccuuggaagggaagggaaggacgguguccuguggagacca

SEQ ID NO: 530064 - RNA, 64 nt, hsa
uuuuugggcgagggugcguggggccugccccuuggaagggaagggaaggacgguguccugugga

SEQ ID NO: 530065 - RNA, 64 nt, hsa
cugcaagcugaaauuuacagaagcaaauucaccagaagggaaacaucucaggccaacauaggca

SEQ ID NO: 530066 - RNA, 64 nt, hsa
ggauuuccuauggaaguccugcuuuauuccaggugaagggaaggaaguguauauacuuuuggca

SEQ ID NO: 530067 - RNA, 64 nt, hsa
cauaugaguguucucaccaccacuuaugccccuagaagggaaggggagagggaaacgugcccuc

SEQ ID NO: 530068 - RNA, 64 nt, hsa
ggaucaaaaucuguagagcagggcaaguaacauggaagggaagaaaaggugaaaaauuagaaau

SEQ ID NO: 530069 - RNA, 64 nt, hsa
cagcugcgacguacugucacugaugagagacugggaagggaaaagcauauauauauagauauau

SEQ ID NO: 530070 - RNA, 64 nt, hsa
gaaaagaaagcaagaacagaaaacgaagccacaggaagggaaguagacauuguaugcuuauggu

SEQ ID NO: 530071 - RNA, 64 nt, hsa
uugagaauggcccauacuucuggcccggcuggaugaagggaaugccgacccuuuggccucuccc

SEQ ID NO: 530072 - RNA, 64 nt, hsa
ggagccucaucuccaugucaagcaggaggguaaagaagggaacuaagagcaggucuuucaagcc

SEQ ID NO: 530073 - RNA, 64 nt, hsa
uacucaccuuccuuuagucucguccugugguguugaagggaaaucagccaguuguaaauuuugc

SEQ ID NO: 530074 - RNA, 64 nt, hsa
ugugauacagccaucuguaccuacuggagcugcagaagggaaguccacucagucacauccagaa

SEQ ID NO: 530075 - RNA, 64 nt, hsa
uuucaaagcacuguguauaaaacaucuaguuuuagaagggaaacaguugaaacuguuuaaaaau

SEQ ID NO: 530076 - RNA, 64 nt, hsa
uauguacauacacauacauacauauuaccauacugaagggaaauggauuuauauuugaauuuga

SEQ ID NO: 530077 - RNA, 64 nt, hsa
ucugaggaauggacauuucuaauuccuguuuguugaagggaaguugcuggaaagagcaucagua

SEQ ID NO: 530078 - RNA, 64 nt, hsa
ccacuugaguuggggccauugcuuaccuugguuggaagggaauagaaauguuugcugaacauug

SEQ ID NO: 530079 - RNA, 64 nt, hsa
uuuccuuugggggaggcggagaggggagaagaaggaagggaagggcagaaggaaggagggaaga

SEQ ID NO: 530080 - RNA, 64 nt, hsa
uucccgaggcuggggcuggggguggcugggaggggaagggaagggagaggcaagcuggcuguga

SEQ ID NO: 530081 - RNA, 64 nt, hsa; identical to SEQ ID NO: 129104

SEQ ID NO: 530082 - RNA, 64 nt, hsa; identical to SEQ ID NO: 129105

SEQ ID NO: 530083 - RNA, 64 nt, hsa; identical to SEQ ID NO: 129106

SEQ ID NO: 530084 - RNA, 64 nt, hsa; identical to SEQ ID NO: 129107

SEQ ID NO: 530085 - RNA, 64 nt, hsa; identical to SEQ ID NO: 129108

SEQ ID NO: 530086 - RNA, 64 nt, hsa; identical to SEQ ID NO: 129109

SEQ ID NO: 530087 - RNA, 64 nt, hsa; identical to SEQ ID NO: 129110

SEQ ID NO: 530088 - RNA, 64 nt, hsa; identical to SEQ ID NO: 129111

SEQ ID NO: 530089 - RNA, 64 nt, hsa
gggagcacuucuuccuuuguuaggcugugcuuuacugauaaaaccaaguauugaauaaagagag

SEQ ID NO: 530090 - RNA, 64 nt, hsa
guguuuaaaaaaauguuaugcaauguuuuccaaacugauaaaguuuguaaagugcuauaaaugu

SEQ ID NO: 530091 - RNA, 64 nt, hsa
agaaaaaaugaggaagaagcaaaagcagaaaccccugauaaacugaucagaucucaugagacuu

SEQ ID NO: 530092 - RNA, 64 nt, hsa
uaccaauuuacuguauuaguccguuuucacgcugcugauaaagacauacccgagacugggaaga

SEQ ID NO: 530093 - RNA, 64 nt, hsa
cuucaagcaucuguauuagucuguauuaaugcugcugauaaagacguacccgagacugggaaga

SEQ ID NO: 530094 - RNA, 64 nt, hsa
cacacuagagaaaaaccuuacaaaugugaagcaucugauaaauccugugaagcgucugauaaau

SEQ ID NO: 530095 - RNA, 64 nt, hsa
aaaugugaagcaucugauaaauccugugaagcgucugauaaauccuguaguccaagcucaggca

SEQ ID NO: 530096 - RNA, 64 nt, hsa
ucuacaggcuauauaaaagaacauggcuuuuugacugauaaaagugauuacagauguuggcuca

SEQ ID NO: 530097 - RNA, 64 nt, hsa
ucuggaagucaucuuugacuccuuccucucccuccugauaaacaucuaagcaguuucuaagucu

SEQ ID NO: 530098 - RNA, 64 nt, hsa
augaauugcaauaaccagcuucacacaagcauaacugauaaacgcgagugcuauuguagucuug

SEQ ID NO: 530099 - RNA, 64 nt, hsa
ugcuuauaagaaauaaugaaaaguucauccauuucugauaaaguucucuauggcaaagucuuuc

SEQ ID NO: 530100 - RNA, 64 nt, hsa
aggaaaacuuuccaaauaaaauaaauguuauucucugauaaagagcuaauacagaaauguucaa

SEQ ID NO: 530101 - RNA, 64 nt, hsa
auauaucugguuguauuagucuguuuucacgcugcugauaaagacauaccugagaccaggaaga

SEQ ID NO: 530102 - RNA, 64 nt, hsa
uagcaguuuacuguauuagucuguuuucacacugcugauaaagacauuccucaagauugugaag

SEQ ID NO: 530103 - RNA, 64 nt, hsa
agagaaaaugaagaagaagcaaaaguggaaaccccugauaaacccaucagaucucaugagacuu

SEQ ID NO: 530104 - RNA, 64 nt, hsa
uuaacccucaguaucaagcacaaaaauugauggacugauaaaagaacuaucuuagaacucagaa

SEQ ID NO: 530105 - RNA, 64 nt, hsa
ugauagugauaauuccugauuccaagaaugccaucugauaaaaaagaauagaaauggaaagugg

SEQ ID NO: 530106 - RNA, 64 nt, hsa
acuuguaaaugaagaucaguauuucugccuagaucugauaaaaaaauuuucuugucuuaguuau

SEQ ID NO: 530107 - RNA, 64 nt, hsa
ccuugagauaugguugacgaaagaauuuuauaaacugauaaauuaaggauuuuuauuauguugu

SEQ ID NO: 530108 - RNA, 64 nt, hsa
uccagcaacacucuucaguacauaauaagcuuaacugauaaacagaauauuuagaaaggugaga

SEQ ID NO: 530109 - RNA, 64 nt, hsa
cgucuucauucaguucaugcagggcaaaggcuuacugauaaacuugagucugcccucguaugag

SEQ ID NO: 530110 - RNA, 64 nt, hsa; identical to SEQ ID NO: 124385

SEQ ID NO: 530111 - RNA, 64 nt, hsa; identical to SEQ ID NO: 124386

SEQ ID NO: 530112 - RNA, 64 nt, hsa; identical to SEQ ID NO: 124387

SEQ ID NO: 530113 - RNA, 64 nt, hsa; identical to SEQ ID NO: 124388

SEQ ID NO: 530114 - RNA, 64 nt, hsa; identical to SEQ ID NO: 124389

SEQ ID NO: 530115 - RNA, 64 nt, hsa; identical to SEQ ID NO: 124390

SEQ ID NO: 530116 - RNA, 64 nt, hsa; identical to SEQ ID NO: 124391

SEQ ID NO: 530117 - RNA, 64 nt, hsa; identical to SEQ ID NO: 124392

SEQ ID NO: 530118 - RNA, 64 nt, hsa; identical to SEQ ID NO: 196118

SEQ ID NO: 530119 - RNA, 64 nt, hsa; identical to SEQ ID NO: 196119

SEQ ID NO: 530120 - RNA, 64 nt, hsa; identical to SEQ ID NO: 196120

SEQ ID NO: 530121 - RNA, 64 nt, hsa; identical to SEQ ID NO: 196121

SEQ ID NO: 530122 - RNA, 64 nt, hsa; identical to SEQ ID NO: 196122

SEQ ID NO: 530123 - RNA, 64 nt, hsa; identical to SEQ ID NO: 196123

SEQ ID NO: 530124 - RNA, 64 nt, hsa; identical to SEQ ID NO: 196124

SEQ ID NO: 530125 - RNA, 64 nt, hsa; identical to SEQ ID NO: 196125

SEQ ID NO: 530126 - RNA, 64 nt, hsa; identical to SEQ ID NO: 196126

SEQ ID NO: 530127 - RNA, 64 nt, hsa; identical to SEQ ID NO: 196127

SEQ ID NO: 530128 - RNA, 64 nt, hsa; identical to SEQ ID NO: 196128

SEQ ID NO: 530129 - RNA, 64 nt, hsa; identical to SEQ ID NO: 196129

SEQ ID NO: 530130 - RNA, 64 nt, hsa; identical to SEQ ID NO: 196130

SEQ ID NO: 530131 - RNA, 64 nt, hsa; identical to SEQ ID NO: 196131

SEQ ID NO: 530132 - RNA, 64 nt, hsa; identical to SEQ ID NO: 196132

SEQ ID NO: 530133 - RNA, 64 nt, hsa; identical to SEQ ID NO: 196133

SEQ ID NO: 530134 - RNA, 64 nt, hsa; identical to SEQ ID NO: 196134

SEQ ID NO: 530135 - RNA, 64 nt, hsa; identical to SEQ ID NO: 196135

SEQ ID NO: 530136 - RNA, 64 nt, hsa; identical to SEQ ID NO: 196136

SEQ ID NO: 530137 - RNA, 64 nt, hsa; identical to SEQ ID NO: 196137

SEQ ID NO: 530138 - RNA, 64 nt, hsa; identical to SEQ ID NO: 196138

SEQ ID NO: 530139 - RNA, 64 nt, hsa; identical to SEQ ID NO: 196139

SEQ ID NO: 530140 - RNA, 64 nt, hsa; identical to SEQ ID NO: 196140

SEQ ID NO: 530141 - RNA, 64 nt, hsa; identical to SEQ ID NO: 196141

SEQ ID NO: 530142 - RNA, 64 nt, hsa; identical to SEQ ID NO: 196142

SEQ ID NO: 530143 - RNA, 64 nt, hsa; identical to SEQ ID NO: 196143

SEQ ID NO: 530144 - RNA, 64 nt, hsa; identical to SEQ ID NO: 196144

SEQ ID NO: 530145 - RNA, 64 nt, hsa; identical to SEQ ID NO: 196145

SEQ ID NO: 530146 - RNA, 64 nt, hsa; identical to SEQ ID NO: 196146

SEQ ID NO: 530147 - RNA, 64 nt, hsa; identical to SEQ ID NO: 196147

SEQ ID NO: 530148 - RNA, 64 nt, hsa; identical to SEQ ID NO: 196148

SEQ ID NO: 530149 - RNA, 64 nt, hsa; identical to SEQ ID NO: 196149

SEQ ID NO: 530150 - RNA, 64 nt, hsa; identical to SEQ ID NO: 196150

SEQ ID NO: 530151 - RNA, 64 nt, hsa; identical to SEQ ID NO: 196151

SEQ ID NO: 530152 - RNA, 64 nt, hsa; identical to SEQ ID NO: 196152

SEQ ID NO: 530153 - RNA, 64 nt, hsa; identical to SEQ ID NO: 196153

SEQ ID NO: 530154 - RNA, 64 nt, hsa; identical to SEQ ID NO: 196154

SEQ ID NO: 530155 - RNA, 64 nt, hsa; identical to SEQ ID NO: 196155

SEQ ID NO: 530156 - RNA, 64 nt, hsa; identical to SEQ ID NO: 196156

SEQ ID NO: 530157 - RNA, 64 nt, hsa; identical to SEQ ID NO: 196157

SEQ ID NO: 530158 - RNA, 64 nt, hsa; identical to SEQ ID NO: 196158

SEQ ID NO: 530159 - RNA, 64 nt, hsa; identical to SEQ ID NO: 196159

SEQ ID NO: 530160 - RNA, 64 nt, hsa; identical to SEQ ID NO: 196160

SEQ ID NO: 530161 - RNA, 64 nt, hsa; identical to SEQ ID NO: 196161

SEQ ID NO: 530162 - RNA, 64 nt, hsa; identical to SEQ ID NO: 388383

SEQ ID NO: 530163 - RNA, 64 nt, hsa; identical to SEQ ID NO: 388384

SEQ ID NO: 530164 - RNA, 64 nt, hsa; identical to SEQ ID NO: 388385

SEQ ID NO: 530165 - RNA, 64 nt, hsa; identical to SEQ ID NO: 388386

SEQ ID NO: 530166 - RNA, 64 nt, hsa; identical to SEQ ID NO: 388387

SEQ ID NO: 530167 - RNA, 64 nt, hsa; identical to SEQ ID NO: 388388

SEQ ID NO: 530168 - RNA, 64 nt, hsa; identical to SEQ ID NO: 388389

SEQ ID NO: 530169 - RNA, 64 nt, hsa; identical to SEQ ID NO: 388390

SEQ ID NO: 530170 - RNA, 64 nt, hsa; identical to SEQ ID NO: 388391

SEQ ID NO: 530171 - RNA, 64 nt, hsa; identical to SEQ ID NO: 388392

SEQ ID NO: 530172 - RNA, 64 nt, hsa; identical to SEQ ID NO: 388393

SEQ ID NO: 530173 - RNA, 64 nt, hsa; identical to SEQ ID NO: 388394

SEQ ID NO: 530174 - RNA, 64 nt, hsa; identical to SEQ ID NO: 388395

SEQ ID NO: 530175 - RNA, 64 nt, hsa; identical to SEQ ID NO: 388396

SEQ ID NO: 530176 - RNA, 64 nt, hsa; identical to SEQ ID NO: 388397

SEQ ID NO: 530177 - RNA, 64 nt, hsa; identical to SEQ ID NO: 388398

SEQ ID NO: 530178 - RNA, 64 nt, hsa; identical to SEQ ID NO: 388399

SEQ ID NO: 530179 - RNA, 64 nt, hsa; identical to SEQ ID NO: 388400

SEQ ID NO: 530180 - RNA, 64 nt, hsa; identical to SEQ ID NO: 388401

SEQ ID NO: 530181 - RNA, 64 nt, hsa; identical to SEQ ID NO: 388402

SEQ ID NO: 530182 - RNA, 64 nt, hsa; identical to SEQ ID NO: 388403

SEQ ID NO: 530183 - RNA, 64 nt, hsa; identical to SEQ ID NO: 388404

SEQ ID NO: 530184 - RNA, 64 nt, hsa; identical to SEQ ID NO: 388405

SEQ ID NO: 530185 - RNA, 64 nt, hsa; identical to SEQ ID NO: 388406

SEQ ID NO: 530186 - RNA, 64 nt, hsa; identical to SEQ ID NO: 388407

SEQ ID NO: 530187 - RNA, 64 nt, hsa; identical to SEQ ID NO: 388408

SEQ ID NO: 530188 - RNA, 64 nt, hsa; identical to SEQ ID NO: 388409

SEQ ID NO: 530189 - RNA, 64 nt, hsa; identical to SEQ ID NO: 388410

SEQ ID NO: 530190 - RNA, 64 nt, hsa; identical to SEQ ID NO: 388411

SEQ ID NO: 530191 - RNA, 63 nt, hsa
uggagggcuuccagcuauaauaucugccuccagggaggggaggggaugggaagcaccaccagc

SEQ ID NO: 530192 - RNA, 64 nt, hsa
gggcuuccagcuauaauaucugccuccagggaggggaggggaugggaagcaccaccagccagcg

SEQ ID NO: 530193 - RNA, 64 nt, hsa
uugagcagacgguauauuccagaggugggaggugggaggggaagggagaaauccaaaacaaagu

SEQ ID NO: 530194 - RNA, 64 nt, hsa
auucucagcucuugggaacccccuugcucccaggggaggggaaaccuuuuucauucaacauugu

SEQ ID NO: 530195 - RNA, 64 nt, hsa
gcuuuggugcgcccccugcugaggagcagccccaggaggggaccagaggggaugcugugucgcu

SEQ ID NO: 530196 - RNA, 64 nt, hsa
ccaucucuuguaccagcccaggcaauaguguugaggaggggagcaaggcugcuaaguggaagac

SEQ ID NO: 530197 - RNA, 64 nt, hsa
accgggcuggccugacacaaugguagcucugaagggaggggaagagagaggccugggugugacc

SEQ ID NO: 530198 - RNA, 64 nt, hsa
gcauuaacuuauugucuaggccagagcgggggugggaggggaaugccacagugaagggaguggc

SEQ ID NO: 530199 - RNA, 64 nt, hsa
ggagcuuuuaggaugugggaguaaaacuuuaaugggaggggagggcuggcugcuggaagaagga

SEQ ID NO: 530200 - RNA, 64 nt, hsa
agaugacugccauguacacugcagucaagggcagggaggggaggaaugacacaaauggcaggga

SEQ ID NO: 530201 - RNA, 64 nt, hsa
gagguccaaggucuuuguccuagaaucagaguggggaggggacagccuggggcugcccagagac

SEQ ID NO: 530202 - RNA, 64 nt, hsa
augauggugguguugaugguggcggugguaggguggaggggagagaagaagaugcugaugauau

SEQ ID NO: 530203 - RNA, 64 nt, hsa
gugauugcaacaaaggcagagggggcggggcgggggaggggagguaggacccgcuccggaaggc

SEQ ID NO: 530204 - RNA, 64 nt, hsa
cgcccagcuuucccaggggcacagcucuaggcugggaggggagaaccagccccucccccugccc

SEQ ID NO: 530205 - RNA, 64 nt, hsa
agggccccuaccaaccuuugccucugccuuggagggaggggaggucuguuaccacuggggaagg

SEQ ID NO: 530206 - RNA, 64 nt, hsa
gggauaggaccgggggaccccagagggaggccuaggaggggacugcacccauacugcuucccua

SEQ ID NO: 530207 - RNA, 64 nt, hsa
guuccaacaggacagcgccuucccccaugcgcugggaggggacccuccauuucucccccucacc

SEQ ID NO: 530208 - RNA, 64 nt, hsa
cuccuccucccugccuggggagcccaguggccagggaggggagugguggagccagucgcuguaa

SEQ ID NO: 530209 - RNA, 64 nt, hsa
agaggaggaaaggaugggggcugaagagcagaagggaggggagacagaggggauuaaagagggg

SEQ ID NO: 530210 - RNA, 64 nt, hsa
gauucccuccauuaaaacaaccaagacaaagaaaggaggggaaaaaaagauaaaaagcaagcca

SEQ ID NO: 530211 - RNA, 64 nt, hsa
agccucccuucaaaaagacagcgccccuagucagggaggggauggcgguccuuugauaagaccc

SEQ ID NO: 530212 - RNA, 64 nt, hsa
agaccggccaggaauguuugcaugaccuaccucaggaggggaggcgaggaagaguaauauuuag

SEQ ID NO: 530213 - RNA, 64 nt, hsa
accucaauguagguacauuacacucuuguugcggggaggggauuuaccagaauacaguuuauuu

SEQ ID NO: 530214 - RNA, 64 nt, hsa
acacgggcgccuucccgggggagugggaggagagggaggggagggauuuuuuauguucuucugu

SEQ ID NO: 530215 - RNA, 64 nt, hsa
uguguguuuuuucuuuuuuuuuaaguucuuaugaggaggggaggguaaauaaaccacugugcgu

SEQ ID NO: 530216 - RNA, 64 nt, hsa
uuauucucugcuauauauaaaacggugcugugagggaggggaaaagcauuuuucaauauauuga

SEQ ID NO: 530217 - RNA, 64 nt, hsa
cuugcuagacaaacauaaaggggcaggguuguggggaggggaacguuuuugguggugugugcag

SEQ ID NO: 530218 - RNA, 64 nt, hsa
uaucaguagguccugggacuugacaaaguaugugggaggggaaggaaggacagaacuugacugg

SEQ ID NO: 530219 - RNA, 64 nt, hsa
ggcuggagguggcauccacacuggacagcagggaggaggggagugaggguaacauuuccauuuc

SEQ ID NO: 530220 - RNA, 64 nt, hsa
auagcgcuucucaaugugugucacccggaaccugggaggggagggaacacugggguuuaggacc

SEQ ID NO: 530221 - RNA, 64 nt, hsa
cuggucccucagcuggggggcagugcuguccaguggaggggagggcuuucacgcccacccaccc

SEQ ID NO: 530222 - RNA, 63 nt, hsa
gggcuccuggcaaggccugaccccaugguggggggaggggaggggaggggagggaaugaggca

SEQ ID NO: 530223 - RNA, 64 nt, hsa
uccuggcaaggccugaccccaugguggggggaggggaggggaggggagggaaugaggcagcucu

SEQ ID NO: 530224 - RNA, 64 nt, hsa
gcaaggccugaccccaugguggggggaggggaggggaggggagggaaugaggcagcucuaggau

SEQ ID NO: 530225 - RNA, 64 nt, hsa
cccauuuuggccuccccugccccccuuguuauggggaggggaccccgggugagggggcccuauu

SEQ ID NO: 530226 - RNA, 64 nt, hsa
uaggauggaugggguuugggguggguaggccaugggaggggagaagccccuccuuggcaccccc

SEQ ID NO: 530227 - RNA, 64 nt, hsa
cuuccgcuccugcccagccugggggaaggagaaaggaggggagaaagcgggcucucacccccuc

SEQ ID NO: 530228 - RNA, 64 nt, hsa
auucaccgggcccugugugugucaccgaggugcgggaggggaggagcauuaaagcugaaagauc

SEQ ID NO: 530229 - RNA, 64 nt, hsa
caaggcccagggaagaguguauuuggggagcaggggaggggaggguguugagaaagcugaacug

SEQ ID NO: 530230 - RNA, 64 nt, hsa
ucaaaguggaugcaauuuuucuuucuuuuguuggggaggggaaugggaggggaaaugggaauau

SEQ ID NO: 530231 - RNA, 64 nt, hsa
gcaauuuuucuuucuuuuguuggggaggggaaugggaggggaaaugggaauauaauauugucuc

SEQ ID NO: 530232 - RNA, 64 nt, hsa
ccuggggaguuggggaaaggaacgaacccuggcuggaggggauaggagggcuuuuaauuuauuu

SEQ ID NO: 530233 - RNA, 64 nt, hsa
ucccccucaucuccagugacucagccuacacaagggaggggaacauuccauccccaguggaguc

SEQ ID NO: 530234 - RNA, 64 nt, hsa
ugcaauucuaaacugcagugacugggaugggaggggaggggagcaguguugaugccaaaauacc

SEQ ID NO: 530235 - RNA, 64 nt, hsa
uggcaugcaauucuaaacugcagugacugggaugggaggggaggggagcaguguugaugccaaa

SEQ ID NO: 530236 - RNA, 64 nt, hsa
gaccaaaaagggggaauaugggagggcagaguggggaggggaguccaugggccuggggccccaa

SEQ ID NO: 530237 - RNA, 64 nt, hsa
aaucaaaagggguucaaaccccaccucaguagguggaggggagcgccugccauugguuguauuu

SEQ ID NO: 530238 - RNA, 64 nt, hsa
uccacguagggggcaggggcaggggcgggcggagggaggggaggggugaaauccauacuguaga

SEQ ID NO: 530239 - RNA, 64 nt, hsa
accccuggccacagccuucccucugcauugaccuggaggggagaggucagccuugaccuaauga

SEQ ID NO: 530240 - RNA, 64 nt, hsa
auggccaggggccaggaguggggagaguugugauggaggggagaggggucacacccacccccug

SEQ ID NO: 530241 - RNA, 64 nt, hsa
acuacggguucuccagcuccuuuccaggcagagaggaggggagguccugaggggacugcugccc

SEQ ID NO: 530242 - RNA, 64 nt, hsa
cuguacugaggacagcgguggaggccgaggugguggaggggaugcaccccaguguccacuuuug

SEQ ID NO: 530243 - RNA, 64 nt, hsa
gagcaguggcugauggggacacugagauaagaucggaggggagcugucaaugccagaagugguu

SEQ ID NO: 530244 - RNA, 64 nt, hsa
ggcggugguggggaggaggggugcgccauggccuggaggggaguguguguuggggugugugugu

SEQ ID NO: 530245 - RNA, 64 nt, hsa
agggccugagcuggacaggggagcuccuaguaggggaggggaggggaugcugggaucuagguga

SEQ ID NO: 530246 - RNA, 64 nt, hsa
cugagcuggacaggggagcuccuaguaggggaggggaggggaugcugggaucuaggugacaugc

SEQ ID NO: 530247 - RNA, 64 nt, hsa
cccacaugccugcgccugcugccugcugagaugaggaggggagcgucugggaacuugcgagucc

SEQ ID NO: 530248 - RNA, 64 nt, hsa
ucagggcugucccagccccggcaagccacaggaaggaggggagagacaggcagcccagcagugu

SEQ ID NO: 530249 - RNA, 64 nt, hsa
gaaagccccacggugggucagaaggcggaaggagggaggggaacgugugggcaagagacuuccu

SEQ ID NO: 530250 - RNA, 64 nt, hsa
caucucaucgaggugugguaaagccauuggaugaggaggggacugccauggaaaggagaguuug

SEQ ID NO: 530251 - RNA, 64 nt, hsa
auuaagguguuguauaaauaauauucuuuuggggggaggggaacuauauugaauuuuauauuuc

SEQ ID NO: 530252 - RNA, 64 nt, hsa
aucggagcuuuuuaaagaacugauguagaaugagggaggggaaaguuuaaaaucccagcugggc

SEQ ID NO: 530253 - RNA, 64 nt, hsa
gcccagccagcccgugacagcuucccccuaaucaggaggggacagcugggggcgcaagcuggug

SEQ ID NO: 530254 - RNA, 64 nt, hsa
ggaccugcagccaucugugaggcccgcggggaugggaggggaggaggguggccuguugguuucc

SEQ ID NO: 530255 - RNA, 64 nt, hsa
ugcaggucugcggaggggaaguguccugagugaaggaggggacccccauccugggggaugcugg

SEQ ID NO: 530256 - RNA, 64 nt, hsa
ugaaaugagaaaggcccagaacgugcaggucugcggaggggaaguguccugagugaaggagggg

SEQ ID NO: 530257 - RNA, 64 nt, hsa
acugcccucgggcgucuggcagccugagguggguggaggggacaguguucuggauagaucuauu

SEQ ID NO: 530258 - RNA, 64 nt, hsa
cagugaggugugcaagggugcacugaggguggugggaggggaucaccuggguuccaggccaucc

SEQ ID NO: 530259 - RNA, 64 nt, hsa
acuauuccggcuuuuuauauggcaccuuucugagggaggggauuuuacagccgagggaccucca

SEQ ID NO: 530260 - RNA, 64 nt, hsa
cugccuguuuuuacuuagaaagcaggcuugggcaggaggggaaauggauuugaaccaucucaga

SEQ ID NO: 530261 - RNA, 64 nt, hsa
gagaacccagaggaucuaggcccuguuggggaggggaggggagcucaagguuuggguggggacu

SEQ ID NO: 530262 - RNA, 64 nt, hsa
gcauggagaacccagaggaucuaggcccuguuggggaggggaggggagcucaagguuugggugg

SEQ ID NO: 530263 - RNA, 64 nt, hsa
gugggagagaguguggugggaagucuugagcggaggaggggaucugcccuucuccacuccucuc

SEQ ID NO: 530264 - RNA, 64 nt, hsa
gccacucccucuccagcccccgauguggacccggggaggggaggcugaggcguuuggccccggc

SEQ ID NO: 530265 - RNA, 64 nt, hsa
augcacaacgcccggccugagcccccugccauagggaggggaggacccugagggcucagccagg

SEQ ID NO: 530266 - RNA, 64 nt, hsa
cugaggcccaaaggcagaacagccagagggggcaggaggggaccaaaaaggaaaaugaggacgu

SEQ ID NO: 530267 - RNA, 64 nt, hsa
cuguuggucccuguccuugcugcccaggcagcguggaggggaaggguagggcagccagagaaag

SEQ ID NO: 530268 - RNA, 64 nt, hsa
cagguaguaggugccagccuaggggagcuuccaaggaggggaaggcaaagcccuggccccugcc

SEQ ID NO: 530269 - RNA, 64 nt, hsa
ccaggauguggcuucucaugaagcucuggccagaggaggggaacuuauugggggagggggggug

SEQ ID NO: 530270 - RNA, 64 nt, hsa
ccagaggaggggaacuuauugggggaggggggguggaggggaggaaucuggaccucuaagucau

SEQ ID NO: 530271 - RNA, 64 nt, hsa
guaaagcugagaucuaaauggggacaaggcagguggaggggaggccaguguacauguaaaugcc

SEQ ID NO: 530272 - RNA, 64 nt, hsa
uagauuuucugccagaggggugggucagagcaguggaggggagacaucgcccaugugcuucugc

SEQ ID NO: 530273 - RNA, 64 nt, hsa
uuuccucauuugucucuaaguugaaggcuuuguuggaggggacagagcacaggaacagccuuga

SEQ ID NO: 530274 - RNA, 64 nt, hsa
gcgggcuggugcgcggagggggcgggggugggguggaggggagggggaagagguacaggcggug

SEQ ID NO: 530275 - RNA, 64 nt, hsa
aguccuuugggguugagggagaugggagcuagggggaggggagggagaugucuuguugugggga

SEQ ID NO: 530276 - RNA, 64 nt, hsa
ugucucaaaccaaaguuaacagggagaggaugggggaggggacaaauuagaauaggauagcauc

SEQ ID NO: 530277 - RNA, 64 nt, hsa
gaggaaaagacaccugucaaaugucacagaucugggaggggacuuaagaccuaucaugccaaga

SEQ ID NO: 530278 - RNA, 64 nt, hsa
cuggcgcuggacuugggcgaccugggaggcacagggaggggagagaugggcggccccgccccag

SEQ ID NO: 530279 - RNA, 64 nt, hsa
cagggagugcggggaugcggaucagcugggaggaggaggggaggggaacuuccacccgagggga

SEQ ID NO: 530280 - RNA, 64 nt, hsa
agugcggggaugcggaucagcugggaggaggaggggaggggaacuuccacccgaggggaagaug

SEQ ID NO: 530281 - RNA, 64 nt, hsa
uuuguggggagggagcauuuuugguggucuugggggaggggaggggagggaagggcugguguug

SEQ ID NO: 530282 - RNA, 64 nt, hsa
ggggagggagcauuuuugguggucuugggggaggggaggggagggaagggcugguguugauuuu

SEQ ID NO: 530283 - RNA, 64 nt, hsa
auguuuuguguugguguuuccuauuuucugcacuggaggggaggggacuguugagguucugucu

SEQ ID NO: 530284 - RNA, 64 nt, hsa
uuguguugguguuuccuauuuucugcacuggaggggaggggacuguugagguucugucuuuuuu

SEQ ID NO: 530285 - RNA, 64 nt, hsa
uccucugaccugaugguguugggguuuggguaggggaggggagcucggcugucagaacuccaug

SEQ ID NO: 530286 - RNA, 64 nt, hsa
gcugucagaacuccauggauauguuucuuuggauggaggggagggccuuuguuaccuuuugcac

SEQ ID NO: 530287 - RNA, 64 nt, hsa
ggggcaggggccugggccggcgagggggccggggggaggggacagagcugaggauuuccuggag

SEQ ID NO: 530288 - RNA, 64 nt, hsa
ccuccggagccucauguucucuucccaggccuuuggaggggaaauggggaaagcagaacugaag

SEQ ID NO: 530289 - RNA, 64 nt, hsa
ccuuuuuguguccucggcccuccacccuugguggggaggggacccaggaccauaggaagguccu

SEQ ID NO: 530290 - RNA, 64 nt, hsa
cccuugcccaugccuggaccuugcuucuggccagggaggggaucaggcccccuuguccacucca

SEQ ID NO: 530291 - RNA, 64 nt, hsa
uagaggcuggaaaguguccccugcauucuggaggggaggggagauaauaaggagggcugcuggg

SEQ ID NO: 530292 - RNA, 64 nt, hsa
caacguagaggcuggaaaguguccccugcauucuggaggggaggggagauaauaaggagggcug

SEQ ID NO: 530293 - RNA, 64 nt, hsa
uuacugguguauuauuugggggagggagggauggggaggggagaaagggagauggguagcauca

SEQ ID NO: 530294 - RNA, 64 nt, hsa
uuucaagcuguauaguuugcacacccaucccaguggaggggaaaggggauaaguguuucaaggc

SEQ ID NO: 530295 - RNA, 64 nt, hsa
cacuuccaccgugggguugggggugggcaacagaggaggggagcaaguagggaaggggguggcc

SEQ ID NO: 530296 - RNA, 64 nt, hsa
ccacacuuuauauacgaauaaacgcagaagagggggaggggaagcuuuauuuauagaaaugaca

SEQ ID NO: 530297 - RNA, 64 nt, hsa
caauucucugccccaggcuaauauuagggacuggggaggggaccaccagaggggagagggaagc

SEQ ID NO: 530298 - RNA, 64 nt, hsa
gucaggccucagcaucucacauccaccaccuccaggaggggagaccacugguaaguccuccucc

SEQ ID NO: 530299 - RNA, 64 nt, hsa
cugcaggccaggagggccuccuuccugccacgagggaggggagucgggccccaggucgcccccg

SEQ ID NO: 530300 - RNA, 64 nt, hsa
cuguccagagggucuucagaagccccccugggagggaggggaggaugagcacgcccagcucccc

SEQ ID NO: 530301 - RNA, 64 nt, hsa
agcuggcggagggagggaagaggagggagugacgggaggggaggaggucagcgaccuggggccg

SEQ ID NO: 530302 - RNA, 64 nt, hsa
cggcacuucuaguggucucaccuggaggcaagagggaggggacagaggcccugccacgucccgc

SEQ ID NO: 530303 - RNA, 64 nt, hsa
cucuggagguacugagacagggugcugaugggaaggaggggagccuuuggggggccacccgggg

SEQ ID NO: 530304 - RNA, 64 nt, hsa
ucccuuccucccaaaaguaucgggggcuggggcaggaggggagugaggcaggugacagugaggu

SEQ ID NO: 530305 - RNA, 64 nt, hsa
gcuccucucuaaccuccuuuacccucaucugucuggaggggagcucugucuguccguguuauuu

SEQ ID NO: 530306 - RNA, 64 nt, hsa
uuucugaugguggcuggggcuggggugagcucagggaggggaagaggagaauacaugcagaguc

SEQ ID NO: 530307 - RNA, 64 nt, hsa
aagucaccugauauucuggccccaggggugggagggaggggagcuuggaaggcuaguccuguag

SEQ ID NO: 530308 - RNA, 64 nt, hsa
cacugaggacgcgugacauggugggcaccggaaaggaggggacuucuccugcaccccaagaagu

SEQ ID NO: 530309 - RNA, 64 nt, hsa
gguccccuggaccauccagggugcuagggggcagggaggggacacccccuccccgccuuuaccu

SEQ ID NO: 530310 - RNA, 64 nt, hsa
acucuuccucucccuugucgccuucacuucuacaggaggggaaggggccagggaggggauucuc

SEQ ID NO: 530311 - RNA, 64 nt, hsa
ucgccuucacuucuacaggaggggaaggggccagggaggggauucucccuuuaucaucaccuca

SEQ ID NO: 530312 - RNA, 64 nt, hsa
ccuugcccccagaggagcagucauugcccucugcggaggggaccaggguucagcagugacguag

SEQ ID NO: 530313 - RNA, 64 nt, hsa
ggaagagcuggcaaaaggagccucacacccccaaggaggggacggugccacuuccagacaagac

SEQ ID NO: 530314 - RNA, 64 nt, hsa
accugucacaacaauaagcagggaggggagauguggaggggacacaucugguugccuuggaggc

SEQ ID NO: 530315 - RNA, 64 nt, hsa
gucccgucguaagaccugucacaacaauaagcagggaggggagauguggaggggacacaucugg

SEQ ID NO: 530316 - RNA, 64 nt, hsa
ucaguuccugacugugcaaggccaacagggcaggggaggggaagaccuggggaaggaagaauga

SEQ ID NO: 530317 - RNA, 64 nt, hsa
accgaggccuaggccccugccacccccaagacugggaggggacuucuuuuucuaaaacacaaaa

SEQ ID NO: 530318 - RNA, 64 nt, hsa
gaagcagaaacaaaaugaaaaaaaaaggggggugggaggggaagaaaaacucuauuuuuguaaa

SEQ ID NO: 530319 - RNA, 64 nt, hsa
uuucauuucacacccccgaagggaggggaggccaggaggggagcugcuccugccagaagcuggu

SEQ ID NO: 530320 - RNA, 64 nt, hsa
uuccacuccaucauuucauuucacacccccgaagggaggggaggccaggaggggagcugcuccu

SEQ ID NO: 530321 - RNA, 64 nt, hsa
cuucccgaggcuacagcagacccccaugagagaaggaggggagcaggcccguggcaggaggagg

SEQ ID NO: 530322 - RNA, 64 nt, hsa
gaugagggggccaggcgguggcuucucccugcgaggaggggagaauucuuggggcugagcuggg

SEQ ID NO: 530323 - RNA, 64 nt, hsa
aggaaaggaaggaaggaaggaaaaggaggggagaggaggggaaggggaggcagaggaggaacau

SEQ ID NO: 530324 - RNA, 64 nt, hsa
cagugcuccaaggaaaggaaggaaggaaggaaaaggaggggagaggaggggaaggggaggcaga

SEQ ID NO: 530325 - RNA, 64 nt, hsa
ggcuggaugcuuggguaacuggggcagggcagguggaggggagaccuccauucagguggagguc

SEQ ID NO: 530326 - RNA, 64 nt, hsa
uuuaagcaauuacuuuucauguugggguggggacggaggggaaagggaagccuggguuuuugua

SEQ ID NO: 530327 - RNA, 64 nt, hsa
gugggaggcagguggacuccuggguccccgaggaggaggggacuggggucccggauucuugggu

SEQ ID NO: 530328 - RNA, 64 nt, hsa
ugugccagggacuauucucaggcugaagaaggugggaggggagggcggaaccugaggagccacc

SEQ ID NO: 530329 - RNA, 64 nt, hsa
ccuucuacggagaugcaggcagugccacgagggaggaggggaccugcaaagcuagaaucuaggg

SEQ ID NO: 530330 - RNA, 64 nt, hsa
cucacaucagaccuggggcaggugcgcaguguggggaggggauggggugcgucagggcccagca

SEQ ID NO: 530331 - RNA, 64 nt, hsa
cuccaaggcucuagaggguguucagguacacugaggaggggacggcuccgucuucacauugugc

SEQ ID NO: 530332 - RNA, 64 nt, hsa
cucugagaauccucggggcggucaggggaugucaggaggggaaggagccgcccucccuaucuug

SEQ ID NO: 530333 - RNA, 64 nt, hsa
ccaaaagcucucugguuguaaccuggagacauguggaggggaauggcgaugggauuauaggacu

SEQ ID NO: 530334 - RNA, 64 nt, hsa
gcuggggucccaggcagcgcugccugggggcuggggaggggaggcccagaggagggcuggccau

SEQ ID NO: 530335 - RNA, 64 nt, hsa
cgcgcgcugacacagugaugggcugcccagggcuggaggggacgcuguuccucccgccgccacu

SEQ ID NO: 530336 - RNA, 64 nt, hsa
ugcagaguuugggugcuggugguguggcuguaggggaggggagaccacacccaaggugggggcu

SEQ ID NO: 530337 - RNA, 64 nt, hsa
ugccccaucuggggacgauauggggagggagaugggaggggaaaggggagaggguuuuucucac

SEQ ID NO: 530338 - RNA, 64 nt, hsa
gccuggaauuagcuuggggccagggaagggacugggaggggagagaagagaaggagggaaggau

SEQ ID NO: 530339 - RNA, 64 nt, hsa
guuauguggaaguguguguggcagcaggcagcggggaggggaggaacagggaagggggagcugg

SEQ ID NO: 530340 - RNA, 64 nt, hsa
acccacgggugucccugcccacucguguggcaagggaggggagggcaggagggcucggccugag

SEQ ID NO: 530341 - RNA, 64 nt, hsa
ggagauggggucucagagcgagagcugcggagggggaggggaagaagaaggccucacuuuugcu

SEQ ID NO: 530342 - RNA, 64 nt, hsa
ugccuuuucccgaggcuggggcuggggguggcugggaggggaagggaagggagaggcaagcugg

SEQ ID NO: 530343 - RNA, 64 nt, hsa
caccccauccccagcuagcccaagcuccaggucaggaggggagggugcugggccugacauggcu

SEQ ID NO: 530344 - RNA, 64 nt, hsa
ccucccccaaaucgucauggaaaggguggagaauggaggggaaccaggcguccuuggaggcagc

SEQ ID NO: 530345 - RNA, 64 nt, hsa
gugcguuccugagggccaggucgggggcaggcauggaggggaggaaaggcgucccucuuggccc

SEQ ID NO: 530346 - RNA, 64 nt, hsa
aaauauagauaagaaaagguggggcuauacuagcaacaaaaaaagaaugcuguuccugcaccug

SEQ ID NO: 530347 - RNA, 64 nt, hsa
agcaaagcauuaguggcuauggucuguaaaaugaaacaaaaaaacuuuauuucacuauaagagu

SEQ ID NO: 530348 - RNA, 64 nt, hsa
cauuccucaucaccaucguguuugcaaagguuaaaacaaaaacaaaaaaccacaaaaauaaaaa

SEQ ID NO: 530349 - RNA, 64 nt, hsa
ucaucaccaucguguuugcaaagguuaaaacaaaaacaaaaaaccacaaaaauaaaaaacaaaa

SEQ ID NO: 530350 - RNA, 64 nt, hsa
guuaaaacaaaaacaaaaaaccacaaaaauaaaaaacaaaaaaaacaaaaaacccaagaaaaaa

SEQ ID NO: 530351 - RNA, 64 nt, hsa
aaaacaaaaaaccacaaaaauaaaaaacaaaaaaaacaaaaaacccaagaaaaaaaaaaagagu

SEQ ID NO: 530352 - RNA, 64 nt, hsa
cugguuuuaguacucugaaggacaaaaacaagcaaacaaaaaccccugcugcagcauuucaggu

SEQ ID NO: 530353 - RNA, 64 nt, hsa
ucugcauguauauuugauaacaugucuuuuguaaaacaaaaauuacaaaaaaauuuguuuacau

SEQ ID NO: 530354 - RNA, 64 nt, hsa
ccuuucaugucccauuucagacagaguaaccauuaacaaaaaagaagagaaaaaguuaaagucg

SEQ ID NO: 530355 - RNA, 64 nt, hsa
uugagccuuuucuuuuucccuucuccccuuucuaaacaaaaaccuuccuaggauggcaucuuuu

SEQ ID NO: 530356 - RNA, 64 nt, hsa
gauuaagaaaaagaaccagcugaaccaugaaacaaacaaaaauccuaaaagugauucuugucau

SEQ ID NO: 530357 - RNA, 64 nt, hsa
aauguguaggaaauguucuuuuuuaaaaaaaaauaacaaaaacaaaacaaaacuauuuauuuug

SEQ ID NO: 530358 - RNA, 64 nt, hsa
uuaaugaacuugcaaaggaauauugcuaaaaacaaacaaaaaaaacuguuaucgaacuuucuuu

SEQ ID NO: 530359 - RNA, 64 nt, hsa
acuuuauuuuuuugugccuucugaaaggaucuaaaacaaaaauauuuugccuuuuuuuccccac

SEQ ID NO: 530360 - RNA, 64 nt, hsa
uguuuaaaucaaucuguaaaagguaaaaaugaaaaacaaaaacaagcaaacaaacaaaaaacaa

SEQ ID NO: 530361 - RNA, 64 nt, hsa
aaagguaaaaaugaaaaacaaaaacaagcaaacaaacaaaaaacaauggaaaagaugaagcugg

SEQ ID NO: 530362 - RNA, 64 nt, hsa
aaauuuuucaguucacuagacuaaaauguuuuacaacaaaaagccuccaguuagccuccuuucu

SEQ ID NO: 530363 - RNA, 64 nt, hsa
uaacuaaaaaugcugagaccccuuuuuauagaaaaacaaaaagacaucaagucuucuuaauuca

SEQ ID NO: 530364 - RNA, 64 nt, hsa
gaaauacaaccuagggugccuuaaaaauaacaacaacaaaaaaccugugugcaucuggcugaca

SEQ ID NO: 530365 - RNA, 64 nt, hsa
cucccauaauuucauauuuccguaccccugaggaaacaaaaaggaaaugaggagagaaaguuac

SEQ ID NO: 530366 - RNA, 64 nt, hsa
auaguccugagcaaaaaaaaaaaaaaaacaaaaaaacaaaaaaaaaacaaaacaguuuuuaaaa

SEQ ID NO: 530367 - RNA, 64 nt, hsa
gaaagcaaauaguccugagcaaaaaaaaaaaaaaaacaaaaaaacaaaaaaaaaacaaaacagu

SEQ ID NO: 530368 - RNA, 64 nt, hsa
ccccaccuccucauuuuaguaaaaaacaaacaaaaacaaaaaaaccugagaaguuugaauugua

SEQ ID NO: 530369 - RNA, 64 nt, hsa
gcucuuccccaccuccucauuuuaguaaaaaacaaacaaaaacaaaaaaaccugagaaguuuga

SEQ ID NO: 530370 - RNA, 64 nt, hsa
uuucacauguggaaacuuucagggugguugguuuaacaaaaaaaaaaagcuuuaaaaaaaaaag

SEQ ID NO: 530371 - RNA, 64 nt, hsa
ccaccugggcacuuuuagauaaaaaaaaaaaaaaaacaaaaaacaacaccaaaaaaacagcagu

SEQ ID NO: 530372 - RNA, 64 nt, hsa
cucaaccacucuccuaaugauuggaacaaaagcaaacaaaaaagaaaucucucuauaaaaugaa

SEQ ID NO: 530373 - RNA, 64 nt, hsa
uauucuuuggaaaaaaacaaaaaacaaaaaaaacaacaaaaaaagcuaaguuauaagugaacug

SEQ ID NO: 530374 - RNA, 64 nt, hsa
auuuuaaggaacuauucuuuggaaaaaaacaaaaaacaaaaaaaacaacaaaaaaagcuaaguu

SEQ ID NO: 530375 - RNA, 64 nt, hsa
agcauccauuuuaaggaacuauucuuuggaaaaaaacaaaaaacaaaaaaaacaacaaaaaaag

SEQ ID NO: 530376 - RNA, 64 nt, hsa
aguauaugugucuuaaugcagucagauuguaaaaaacaaaaacaaagaaacuaagaaucuuacu

SEQ ID NO: 530377 - RNA, 60 nt, hsa
acuacaaaagaaaaauauaaaaguaaaacaaacaaaaacaaaccugaaaacugcuuggca

SEQ ID NO: 530378 - RNA, 64 nt, hsa
uaggacccgguuucuuuuacugauuuaaaaacaaaacaaaaaaaaauaaaaaaguugugccuga

SEQ ID NO: 530379 - RNA, 64 nt, hsa
cagcagugugauaauuuaaacauauuuaaacaaaaacaaaaaaaaugaaugcacaaacuugcug

SEQ ID NO: 530380 - RNA, 64 nt, hsa
gagugccagcagugugauaauuuaaacauauuuaaacaaaaacaaaaaaaaugaaugcacaaac

SEQ ID NO: 530381 - RNA, 64 nt, hsa
aguuaaggaaacaaaaauacuuauauauacacagaacaaaaauaauguucuuuuuaugcaaauc

SEQ ID NO: 530382 - RNA, 64 nt, hsa
uaguugugugugggcaacagaaacaaguuaaggaaacaaaaauacuuauauauacacagaacaa

SEQ ID NO: 530383 - RNA, 64 nt, hsa
ugauuccaggaggaguuagccaaacaacaacaaaaacaaaaaaugugcuguucaaguuuucagc

SEQ ID NO: 530384 - RNA, 64 nt, hsa
gaaaggugauuccaggaggaguuagccaaacaacaacaaaaacaaaaaaugugcuguucaaguu

SEQ ID NO: 530385 - RNA, 64 nt, hsa
uucacuugccuagucuugaagaaaaaaaacaaaaaacaaaaaaaaaccuuguuccuuuauaggu

SEQ ID NO: 530386 - RNA, 64 nt, hsa
ccacugcuucacuugccuagucuugaagaaaaaaaacaaaaaacaaaaaaaaaccuuguuccuu

SEQ ID NO: 530387 - RNA, 64 nt, hsa
augcacuuuuaugaaguuuuuaaaaauaaaggaaaacaaaaaacuuuacugaguguuauaagua

SEQ ID NO: 530388 - RNA, 64 nt, hsa
gaagaaguuaauucuuaaaacuauaacauuauauaacaaaaaagguuucccaaaacaaucuauu

SEQ ID NO: 530389 - RNA, 64 nt, hsa
uuuuugaauuugacauugaguuuaauucagcaacaacaaaaaauacauauaaaacuagaaaggg

SEQ ID NO: 530390 - RNA, 64 nt, hsa
agcuauacuuuaacauuaugagagaaaagcauaaaacaaaaauagguaguucuuggcuuuuaac

SEQ ID NO: 530391 - RNA, 64 nt, hsa
gcgagacucuaucucaaaaaaaaacaaaaaaaaaaacaaaaaacaaagaugagucgcacaucug

SEQ ID NO: 530392 - RNA, 64 nt, hsa
cugggcaacagagcgagacucuaucucaaaaaaaaacaaaaaaaaaaacaaaaaacaaagauga

SEQ ID NO: 530393 - RNA, 64 nt, hsa
gugaaacaaaaaaguguucccuuuucaaguugagaacaaaaauuggguuuuaaaauuaaaguau

SEQ ID NO: 530394 - RNA, 64 nt, hsa
caaaaagaauuccaaccgaccagcuuguuugugaaacaaaaaaguguucccuuuucaaguugag

SEQ ID NO: 530395 - RNA, 64 nt, hsa
auuuaucacugaauuaagccaucagggaaaaaacaacaaaaaaagagaacaccuccagcuuuuc

SEQ ID NO: 530396 - RNA, 64 nt, hsa
cauuuaagaauuugaaacguuaugaugaccuggcaacaaaaaguaaugaagaaaauugagaccu

SEQ ID NO: 530397 - RNA, 64 nt, hsa
aaaagauuccucguuauuguuguugccaaagagaaacaaaaaugauuuugcuuuccaagcuugg

SEQ ID NO: 530398 - RNA, 64 nt, hsa
cuauuuaguaagcccggauagacuuauugccaaaaacaaaaaauagcuuucaaaagaaauuuaa

SEQ ID NO: 530399 - RNA, 64 nt, hsa
uuagaagucuuaguaauguaacuugaagauguuaaacaaaaaucucaaguaaaaugaaaagcaa

SEQ ID NO: 530400 - RNA, 64 nt, hsa
ggcaacagagcgagacucugucucagaaaaaaaaaacaaaaaccaguuuaggcuggguauggug

SEQ ID NO: 530401 - RNA, 64 nt, hsa
ccaacuuuuauuuggaauaauaauuuuccuccuaaacaaaaacacauugaguuuaagucucuga

SEQ ID NO: 530402 - RNA, 64 nt, hsa
aacuuccuuugacuuauuguccccacuaaaacaaaacaaaaaacuuuuaaugccuuccacauua

SEQ ID NO: 530403 - RNA, 64 nt, hsa
aguucuuggcugccguccuguggcagcuuaauggaacaaaaauuacagacuuuggugaaccaag

SEQ ID NO: 530404 - RNA, 64 nt, hsa
gaacacucauuuuguuagcgagggugguaaagugaacaaaaaggggaaguaucaaacuacugcc

SEQ ID NO: 530405 - RNA, 64 nt, hsa
aaugcaguuccuuucauaauaucucagcaccagaaacaaaaauuaagauuaucaaagcauuuug

SEQ ID NO: 530406 - RNA, 64 nt, hsa
aaaucaagaaggccaucacuuagaacgaaccccaaacaaaaaugccauaauauaaaugugugaa

SEQ ID NO: 530407 - RNA, 64 nt, hsa
uaggcaucaaaaggcaaaaaucaaaaaaaaaaaaaacaaaaacaaaaaaaaagaugaaccuagg

SEQ ID NO: 530408 - RNA, 64 nt, hsa
ucaaaaggcaaaaaucaaaaaaaaaaaaaacaaaaacaaaaaaaaagaugaaccuaggucugug

SEQ ID NO: 530409 - RNA, 64 nt, hsa
cugaaacaagaagguuauugcagcaaaaaucaguaacaaaaaauaguaacaauaccuugcagag

SEQ ID NO: 530410 - RNA, 64 nt, hsa
aguaucagcacccagaagagaaaaaggaauuuaaaacaaaaaccacagaggcggaaauaccgga

SEQ ID NO: 530411 - RNA, 64 nt, hsa
caaacugagguagcgacacaaaguuaaacaaacaaacaaaaaacacaaaacauaauaaaacacc

SEQ ID NO: 530412 - RNA, 64 nt, hsa
gcuuugacucuauaagcaaauugcuuuuuuccaaaacaaaaagaugucucagguuuguuuugug

SEQ ID NO: 530413 - RNA, 64 nt, hsa
uaugcuuauaaccuaguuaaagaaaggaaaagaaaacaaaaaacgaaugaaaauaacugaauuu

SEQ ID NO: 530414 - RNA, 64 nt, hsa
gaaauauaaggcacguuuucacacaaaauuucaaaacaaaaacaagagggcauagaugcaauca

SEQ ID NO: 530415 - RNA, 64 nt, hsa
ucaugcucuuguuucucaaaaaagaaaaacaaaaaacaaaaaacaggggccaauaaauucccua

SEQ ID NO: 530416 - RNA, 64 nt, hsa
aaguaucucaugcucuuguuucucaaaaaagaaaaacaaaaaacaaaaaacaggggccaauaaa

SEQ ID NO: 530417 - RNA, 64 nt, hsa
agagaaaaggguguuuuaaauuuaaaaaaauaaaaacaaaaaaguuugauugagacaaugaaga

SEQ ID NO: 530418 - RNA, 64 nt, hsa
guuaggucaugaggacaccaaaaaccuaaaaauaaacaaaaagccaaacaagccuuagcuuuuc

SEQ ID NO: 530419 - RNA, 64 nt, hsa
acagguuuauuuuaguaaaaaaaaaaaaacaaaaaacaaaaacaaaagauuuuuaucaaauguu

SEQ ID NO: 530420 - RNA, 64 nt, hsa
cccccgaacagguuuauuuuaguaaaaaaaaaaaaacaaaaaacaaaaacaaaagauuuuuauc

SEQ ID NO: 530421 - RNA, 64 nt, hsa
cagagugagacugcaucucaaaaaaaacccaaaaaacaaaaacaaacaacaacaacaaaauuau

SEQ ID NO: 530422 - RNA, 64 nt, hsa
ugguaaaacccugucucuacugaaaaacaacaaaaacaaaaacacaaauuagucggguguggug

SEQ ID NO: 530423 - RNA, 64 nt, hsa
ccaacaugguaaaacccugucucuacugaaaaacaacaaaaacaaaaacacaaauuagucgggu

SEQ ID NO: 530424 - RNA, 64 nt, hsa
gagacuccaucucauuaaaaaaaacgaaaacaaaaacaaaaaaaacacaaaccaucaucacaga

SEQ ID NO: 530425 - RNA, 64 nt, hsa
cagagugagacuccaucucauuaaaaaaaacgaaaacaaaaacaaaaaaaacacaaaccaucau

SEQ ID NO: 530426 - RNA, 64 nt, hsa
ucaauaaaaaaaagagaaacuguccuuaaaacaaaacaaaaaccaaaaaagucacccuaucagg

SEQ ID NO: 530427 - RNA, 64 nt, hsa
guaaguauuaccuccuuaauuuuuaacaacuaagaacaaaaauuaacgagaaaaacaacaaagu

SEQ ID NO: 530428 - RNA, 64 nt, hsa
ggcucucgaggcaagcugucaacgucuuguugaaaacaaaaaucaagaaagaauugaaauacug

SEQ ID NO: 530429 - RNA, 64 nt, hsa
auaggagcuuauggucaaaaagugcaaaaaaaaaaacaaaaaaaaagcaauagauagagaaauu

SEQ ID NO: 530430 - RNA, 64 nt, hsa
uguucuguuggugugauucaaagcaaaacaaacaaacaaaaacaaauuuuaagaacacaacaaa

SEQ ID NO: 530431 - RNA, 64 nt, hsa
aaaacaaacaaacaaaaacaaauuuuaagaacacaacaaaaaagauuugacuuccgaauagaau

SEQ ID NO: 530432 - RNA, 64 nt, hsa
cuuugacaaaaauguguacuguguaagccuugcaaacaaaaaacaacaaaaaagaagcagcagc

SEQ ID NO: 530433 - RNA, 64 nt, hsa
aauguguacuguguaagccuugcaaacaaaaaacaacaaaaaagaagcagcagcagcagccugc

SEQ ID NO: 530434 - RNA, 64 nt, hsa
aacucuacuuagagaguguaugucugucuaacagaacaaaaagaugcucuguguaaauuccuuc

SEQ ID NO: 530435 - RNA, 64 nt, hsa
uauacauaaaaggguaaaauucacacauacagcaaacaaaaaugcacaaagccugcuucguaac

SEQ ID NO: 530436 - RNA, 64 nt, hsa
agacacaagaaaagcauuucagaggcuaauuuaaaacaaaaaguaagcaccuaaaggcaaggac

SEQ ID NO: 530437 - RNA, 64 nt, hsa
ccauuuccuagguaauuuuuuaaaagccagucaaaacaaaaacuuuacugaaaauggacagaaa

SEQ ID NO: 530438 - RNA, 51 nt, hsa
auuuauuguaucccauguaaaaacaaaaaaacaaaaaacaaagaaaagaaa

SEQ ID NO: 530439 - RNA, 59 nt, hsa
auuuauuguaucccauguaaaaacaaaaaaacaaaaaacaaagaaaagaaagagauuuu

SEQ ID NO: 530440 - RNA, 64 nt, hsa
uauucaaaagggauugccauuucugagacacaguaacaaaaaaaugaggaaauuauuuugcuuc

SEQ ID NO: 530441 - RNA, 64 nt, hsa
acauuuuucaaaacuacugcauguuuaaaacuucaacaaaaaaagagagaaagaacuauacuaa

SEQ ID NO: 530442 - RNA, 64 nt, hsa
auguguccauuguugcauuuuauauauaugaacaaacaaaaaaugcacaguucauaauaauuuc

SEQ ID NO: 530443 - RNA, 64 nt, hsa
auagacuuauuggaauuuacaagacauacaacauaacaaaaaguguugcuguaaauccaaaaga

SEQ ID NO: 530444 - RNA, 64 nt, hsa
uagccugggcaacagugagugagacucggucucaaacaaaaaccaaauugggaaauucuucuug

SEQ ID NO: 530445 - RNA, 64 nt, hsa
auauguuucucuuaacaccugaaacuuguuuuaaaacaaaaagcaguauucacuucaaaucaua

SEQ ID NO: 530446 - RNA, 64 nt, hsa
ucguacucauaaucagcucugcauacaucugaagaacaaaaacaucaacgucuuuuguccagcc

SEQ ID NO: 530447 - RNA, 64 nt, hsa
cuguaguucaaaagucagaaaugauucuaauuuaaacaaaaagauacuaaauauacagaaguua

SEQ ID NO: 530448 - RNA, 64 nt, hsa
gacaccccacaguggaagggagcaucaggagaggaacaaaaaaagggaucucagggagaggcca

SEQ ID NO: 530449 - RNA, 64 nt, hsa
gaagcaauauaccacuaaccugcagaaaaacacaaacaaaaacagacucccacugucuccagaa

SEQ ID NO: 530450 - RNA, 64 nt, hsa
gguucaaauuauaucuaaacaaaaaagaauaagaaacaaaaaacacauuaaaauuuuaaguugu

SEQ ID NO: 530451 - RNA, 64 nt, hsa
gaaaagaaaagaaacaugguucaaauuauaucuaaacaaaaaagaauaagaaacaaaaaacaca

SEQ ID NO: 530452 - RNA, 64 nt, hsa
acuucaucuuauucuucauguaaucccaccuucuaacaaaaaauaaauaaauauuuaaauucca

SEQ ID NO: 530453 - RNA, 64 nt, hsa
aucugucuuuccacucuugguucucuugccguagaacaaaaacaguuuaggaagcauaauuacg

SEQ ID NO: 530454 - RNA, 64 nt, hsa
auaauuuaguucauuuguucaggguaaaauuugaaacaaaaaauuuuaccugugcaaaauaguu

SEQ ID NO: 530455 - RNA, 64 nt, hsa
agaaaaugccauuuacggcaucccuucuguauguaacaaaaagacauucauaauguuaggaaga

SEQ ID NO: 530456 - RNA, 64 nt, hsa
caauuaugauuugucagucaaaaauaauauuaagaacaaaaaaagaguuaaaaaauucugauau

SEQ ID NO: 530457 - RNA, 64 nt, hsa
gaugccgaauaaaugauaucaaagagcauagagaaacaaaaaucuuuuaugauguacggaaaaa

SEQ ID NO: 530458 - RNA, 64 nt, hsa
augaacaaaacaaaacaacaacaaaaaacaaacaaacaaaaaagcuauggcacuagaauuuaag

SEQ ID NO: 530459 - RNA, 64 nt, hsa
cuuucucucuuucuuaugaacaaaacaaaacaacaacaaaaaacaaacaaacaaaaaagcuaug

SEQ ID NO: 530460 - RNA, 64 nt, hsa
cuaaguagauuuuuugacauuaauguauuuauuaaacaaaaacugagaauuccuuaaauugauu

SEQ ID NO: 530461 - RNA, 64 nt, hsa
cuuucagccuguguagggcaaacacaaauccuuaaacaaaaaucauguuaucaaaaacugucag

SEQ ID NO: 530462 - RNA, 64 nt, hsa
aaguuuuccguuguuaaaaagcaaacaaaaaaccaacaaaaaauccaagugugccuugaauugu

SEQ ID NO: 530463 - RNA, 64 nt, hsa
gaauggaguauaaguuuuccguuguuaaaaagcaaacaaaaaaccaacaaaaaauccaagugug

SEQ ID NO: 530464 - RNA, 64 nt, hsa
uuugguauuuaaagcaaaaaaacgaaaaacaaaaaacaaaaacaaaccuuuugguaacugugca

SEQ ID NO: 530465 - RNA, 64 nt, hsa
uuguaguuuugguauuuaaagcaaaaaaacgaaaaacaaaaaacaaaaacaaaccuuuugguaa

SEQ ID NO: 530466 - RNA, 64 nt, hsa
aauuuacaaaguguguauuaaaaaaaacaaaaagaacaaaaaaaucugcagaaggaaaaaugug

SEQ ID NO: 530467 - RNA, 64 nt, hsa
aagguuuacaauuuacaaaguguguauuaaaaaaaacaaaaagaacaaaaaaaucugcagaagg

SEQ ID NO: 530468 - RNA, 64 nt, hsa
cauacguuuugguguugcuuuucaaauguuugaaaacaaaaaaaauguuaagaaauggguuucu

SEQ ID NO: 530469 - RNA, 64 nt, hsa
aaucugaaguaugguauuacaaaacaaacaaacaaacaaaaaacccauguguuaaaauacucag

SEQ ID NO: 530470 - RNA, 64 nt, hsa
gauguguuuuauuauaaauaauauucaauuaugaaacaaaaaaauuaugauguuuuucaaaaug

SEQ ID NO: 530471 - RNA, 64 nt, hsa
cauaguagugguaguaaagaaaaaaaggagaucuaacaaaaacacuugaauauuuuuuauuuuc

SEQ ID NO: 530472 - RNA, 64 nt, hsa
aaugguagcuuuugcacagaacuuccaaaagcaaaacaaaaacaaaaucuauuguaguuauaua

SEQ ID NO: 530473 - RNA, 64 nt, hsa
ucagaaaauggccuucugugcuuucaaaaaaaaaaacaaaaaaaaaaccacacacacacauaaa

SEQ ID NO: 530474 - RNA, 64 nt, hsa
agaguguaccauuaacuugauuguugauaauaaaaacaaaaagcaagucuagcaauugaacucu

SEQ ID NO: 530475 - RNA, 64 nt, hsa
aaacaaaaaaguuggaaggcagaaaccauuaaaaaacaaaaagccaacaacccagaaagguuua

SEQ ID NO: 530476 - RNA, 64 nt, hsa
guuuagaaaaaaaagacaaaaaaguaaaaauaaaaacaaaaaaguuggaaggcagaaaccauua

SEQ ID NO: 530477 - RNA, 64 nt, hsa
uuuuuaaagcagaagcaaaaaagaaaaacaaaauaacaaaaacaacccuuccucuuuucucuca

SEQ ID NO: 530478 - RNA, 64 nt, hsa
ucuuccuccaaggaguuagaauuucccaguuuaaaacaaaaagggaaauguccuagguuuucuu

SEQ ID NO: 530479 - RNA, 64 nt, hsa
cauuuguaguaaaacuuaaaaagcaaaaacaaaaaacaaaaaagaccuuccugugauacuuuau

SEQ ID NO: 530480 - RNA, 64 nt, hsa
ugucacucauuuguaguaaaacuuaaaaagcaaaaacaaaaaacaaaaaagaccuuccugugau

SEQ ID NO: 530481 - RNA, 64 nt, hsa
ccaacacaccacucauuggaaaauggaaaaaaaaaacaaaaaaaaaacaaaaaaauguacaaug

SEQ ID NO: 530482 - RNA, 64 nt, hsa
cucauuggaaaauggaaaaaaaaaacaaaaaaaaaacaaaaaaauguacaauggaugcauugaa

SEQ ID NO: 530483 - RNA, 64 nt, hsa
uagaaagugccagaaaguguuuaacuugucaaaaaacaaaaacccagcaacagaaaaauggagu

SEQ ID NO: 530484 - RNA, 64 nt, hsa
uaugcacauauauauauguauuuaaaaaaaucaaaacaaaaaaaaacucauuuauaccugugua

SEQ ID NO: 530485 - RNA, 64 nt, hsa
aaaggagcaaagccuuguauuaccucuggaagacaacaaaaacaauuggcaacaacaaaaagcc

SEQ ID NO: 530486 - RNA, 64 nt, hsa
uuaccucuggaagacaacaaaaacaauuggcaacaacaaaaagccucuuucuugacuuuaauca

SEQ ID NO: 530487 - RNA, 64 nt, hsa
guacuuuucccuuuaaaaacaaaccaaaaaaaaaaacaaaaaaaaacuuuuuaauuaaagaacc

SEQ ID NO: 530488 - RNA, 64 nt, hsa
gggacauaucacugauucauuccuaaaaagcaugaacaaaaaguuuuuguucuguuccagcuau

SEQ ID NO: 530489 - RNA, 64 nt, hsa
uuaguuuggguccuacuguuguuauuaaaaacagaacaaaaacaaaacacacacacacacaaaa

SEQ ID NO: 530490 - RNA, 64 nt, hsa
acaaaaacaaaacacacacacacacaaaaacagaaacaaaaaaaaccagcauuaaaauaauaag

SEQ ID NO: 530491 - RNA, 64 nt, hsa
ucccuccuuuuguucuuccuuccugccuuaguggaacaaaaaccaacacauaguuuuaagcuac

SEQ ID NO: 530492 - RNA, 64 nt, hsa
cccauugcugccaaaaauacacgucuuuaaaagcaacaaaaauugaaauaagacaucgugaaaa

SEQ ID NO: 530493 - RNA, 64 nt, hsa
uuuacuuucgugccugcauuauuuuucuauuuaaaacaaaaauaaaucuaguuuagcacuaaaa

SEQ ID NO: 530494 - RNA, 64 nt, hsa
ccugggcaacagagcaagacccugucugucucaaaacaaaaaacaaaaccacuuauauugcuag

SEQ ID NO: 530495 - RNA, 64 nt, hsa
uuccaaucccgacaguagcagaauggcauucuacaacaaaaagaagcuaguuaugggaguuaag

SEQ ID NO: 530496 - RNA, 64 nt, hsa
aaagaaacaauaaggaccuauacaaucauaugagaacaaaaauaugaaaucuugcuagugaaga

SEQ ID NO: 530497 - RNA, 64 nt, hsa
aaaacaaaacaaaacaaaacaaaaacaggaaaaaaacaaaaaaccaaagugguaaggauucagu

SEQ ID NO: 530498 - RNA, 64 nt, hsa
gccucggguaacacugaaaaacaaaacaaaacaaaacaaaaacaggaaaaaaacaaaaaaccaa

SEQ ID NO: 530499 - RNA, 64 nt, hsa
cguucaucuugucuauuuuuucucuucauguuguaacaaaaaggaaaaaagaaaaaaaaauccc

SEQ ID NO: 530500 - RNA, 64 nt, hsa
acauuuauaagugcugcuuacaucacugaacaacaacaaaaaaauaauaauggaguagcuguug

SEQ ID NO: 530501 - RNA, 64 nt, hsa
ucuaagaauacgcggucuccugagaacuucaaaaaacaaaaacaaaaaaacccaaaggcccuuu

SEQ ID NO: 530502 - RNA, 64 nt, hsa
aauacgcggucuccugagaacuucaaaaaacaaaaacaaaaaaacccaaaggcccuuuucaggg

SEQ ID NO: 530503 - RNA, 64 nt, hsa
uauuuggguuaauauuuaugacauuugacauugaaacaaaaauuuaaaauguuaucuuuuaauu

SEQ ID NO: 530504 - RNA, 64 nt, hsa
ugugaaaaagcaaucuauuguguccaaauaaaaaaacaaaaagugugacacugguuaacuuuuu

SEQ ID NO: 530505 - RNA, 64 nt, hsa
aauucucuccuucuguuggcugggugcccaauacaacaaaaaggcagaggaaaggcaaauucuu

SEQ ID NO: 530506 - RNA, 64 nt, hsa
uccagccugggcaacagagcgagacuccaucucaaacaaaaacaagaacaaaaacaaacauaaa

SEQ ID NO: 530507 - RNA, 64 nt, hsa
aacagagcgagacuccaucucaaacaaaaacaagaacaaaaacaaacauaaaguuggcacagaa

SEQ ID NO: 530508 - RNA, 64 nt, hsa
caaaucucuacccuuccccaacccuccauaaaaaaacaaaaauggaaaugaaaaaugaaacaaa

SEQ ID NO: 530509 - RNA, 64 nt, hsa
uccauaaaaaaacaaaaauggaaaugaaaaaugaaacaaaaaaggacaaaaccaaaaaaaaaag

SEQ ID NO: 530510 - RNA, 64 nt, hsa
gaaugacaugaaugcugcuaaaggacuggacucaaacaaaaacgaggucaaucaugccauugac

SEQ ID NO: 530511 - RNA, 64 nt, hsa
guguaaauuuuaaaauuuuguauagguauuucauaacaaaaauauguauuucuuuuuuguuauu

SEQ ID NO: 530512 - RNA, 64 nt, hsa
uuaauuucuguaauugggaaggaggguaauaaugaacaaaaaguuugagaaaaaaaugcuuuaa

SEQ ID NO: 530513 - RNA, 64 nt, hsa
agauauacugugggaugaguaucucaggguaaguaacaaaaaaacaaacaaaaaaaaucacuga

SEQ ID NO: 530514 - RNA, 64 nt, hsa
ggaugaguaucucaggguaaguaacaaaaaaacaaacaaaaaaaaucacugaaauuuuucccuc

SEQ ID NO: 530515 - RNA, 64 nt, hsa
aaaccuuuguucugggauuuacuguuaaaaaacaaacaaaaaacaacaaaaaagcggugacagg

SEQ ID NO: 530516 - RNA, 64 nt, hsa
ucugggauuuacuguuaaaaaacaaacaaaaaacaacaaaaaagcggugacaggaaacaguuaa

SEQ ID NO: 530517 - RNA, 64 nt, hsa
cucuagcacaauuauggguuacuuccuuuuucuuaacaaaaaagaauguuugauuuccucuggg

SEQ ID NO: 530518 - RNA, 64 nt, hsa
auacuuagauuuucuuuuaaaaaaauuaaaauaaaacaaaaaaaaauuucuaggacuagacgau

SEQ ID NO: 530519 - RNA, 64 nt, hsa
cauaucuccaaaaaaagaaagaaaaaauacaaaaaacaaaaacaaaaaaaaaagaggguaaugu

SEQ ID NO: 530520 - RNA, 64 nt, hsa
uccaaaaaaagaaagaaaaaauacaaaaaacaaaaacaaaaaaaaaagaggguaauguacaagu

SEQ ID NO: 530521 - RNA, 64 nt, hsa
uaucucacuuuaaacucuuuggggaaaaaacaaaaacaaaaaaaacuaaguugcuuucuuuuuu

SEQ ID NO: 530522 - RNA, 64 nt, hsa
guacuguaucucacuuuaaacucuuuggggaaaaaacaaaaacaaaaaaaacuaaguugcuuuc

SEQ ID NO: 530523 - RNA, 64 nt, hsa
uguggaaagcaaaauaacaaaaaagagaaacgccaacaaaaaucagcagauguugaagacaggg

SEQ ID NO: 530524 - RNA, 64 nt, hsa
uuguauuaauuauuuaaaguguggaaagcaaaauaacaaaaaagagaaacgccaacaaaaauca

SEQ ID NO: 530525 - RNA, 64 nt, hsa
cugcuauguuaaaaacaaacaacaaaaaacaaacaacaaaaaaaaaauuaaaaaaaaaaacaga

SEQ ID NO: 530526 - RNA, 64 nt, hsa
ucaccaaagaaguccugcuauguuaaaaacaaacaacaaaaaacaaacaacaaaaaaaaaauua

SEQ ID NO: 530527 - RNA, 64 nt, hsa
caaacaaaaaacaaccuuagcauuaagaaauaaaaacaaaaaacaagaagcaaguuguacugcu

SEQ ID NO: 530528 - RNA, 64 nt, hsa
uaagaagccuuaauacucuguaaacaaacaaacaaacaaaaaacaaccuuagcauuaagaaaua

SEQ ID NO: 530529 - RNA, 64 nt, hsa
auuguuuuaauaucuuuacucaaaaaaacaaaaaaacaaaaacccauggaagcaacaaaagagu

SEQ ID NO: 530530 - RNA, 64 nt, hsa
gcaucugaauuguuuuaauaucuuuacucaaaaaaacaaaaaaacaaaaacccauggaagcaac

SEQ ID NO: 530531 - RNA, 64 nt, hsa
agcagugacuggaaggacaaacgugguguugcagaacaaaaauuccuugccuuugguauggaau

SEQ ID NO: 530532 - RNA, 64 nt, hsa
cccuuggaaccuuuguacgcuuugcucaaaaaaaaacaaaaaaaaaaaacaaaaaaaaaaaaca

SEQ ID NO: 530533 - RNA, 64 nt, hsa
uguacgcuuugcucaaaaaaaaacaaaaaaaaaaaacaaaaaaaaaaaacaacgguggagccuu

SEQ ID NO: 530534 - RNA, 64 nt, hsa
auucuggcaaauaacaauuagaaaagauagguuuaacaaaaaaauuuacuuguauauaaugcac

SEQ ID NO: 530535 - RNA, 64 nt, hsa
uuguauaauauuacuucaaagauauguaaucacaaacaaaaaaaacuauuuuuuauaaugucau

SEQ ID NO: 530536 - RNA, 64 nt, hsa
ggugacagggucugacauggucagucuacuaaaaaacaaaaaaaaaaaacaaaaaaaaaaaaac

SEQ ID NO: 530537 - RNA, 64 nt, hsa
gacauggucagucuacuaaaaaacaaaaaaaaaaaacaaaaaaaaaaaaacaaaagaaaaaaau

SEQ ID NO: 530538 - RNA, 64 nt, hsa
cagagcaggacucucucucaaaaaaacacaaaaaaacaaaaacaaaaaaccauacacacacaca

SEQ ID NO: 530539 - RNA, 64 nt, hsa
aggacucucucucaaaaaaacacaaaaaaacaaaaacaaaaaaccauacacacacacacacaca

SEQ ID NO: 530540 - RNA, 64 nt, hsa
cuaaaaaccaccaaggaaaccuacuccaaaaaugaacaaaaaaaaaaaaagcgaaagacugcag

SEQ ID NO: 530541 - RNA, 64 nt, hsa
aguugugcuaaaaacaaaacaaaacaaacaaacaaacaaaaaaguaaaaaaagauuacuuucga

SEQ ID NO: 530542 - RNA, 64 nt, hsa
uauaaacaaucccauuuuuauauuuuauuauuaaaacaaaaauaccucucuuugcuagagaguu

SEQ ID NO: 530543 - RNA, 64 nt, hsa
gccugggaacaagagugaaacucucaaaagcagaaacaaaaacccaacauauaugggcuguuag

SEQ ID NO: 530544 - RNA, 64 nt, hsa
aaaaauaaaagaaaauguaaaaaacaaaaacaaaaacaaaaaagcaacccaguccccaaccugc

SEQ ID NO: 530545 - RNA, 64 nt, hsa
aaugggaaaaauaaaagaaaauguaaaaaacaaaaacaaaaacaaaaaagcaacccagucccca

SEQ ID NO: 530546 - RNA, 64 nt, hsa
uacaaaaaugggaaaaauaaaagaaaauguaaaaaacaaaaacaaaaacaaaaaagcaacccag

SEQ ID NO: 530547 - RNA, 64 nt, hsa
gaaaaauagaaauuaaaaacaaaacaaaaaaaaaaacaaaaaaaaacaaaaguaaauuaaaaac

SEQ ID NO: 530548 - RNA, 64 nt, hsa
cugaguuaaccagaaaaauagaaauuaaaaacaaaacaaaaaaaaaaacaaaaaaaaacaaaag

SEQ ID NO: 530549 - RNA, 64 nt, hsa
gaaauuuucucuuguaaaacauuuagaaaacaaaaacaaaaaaaaugugauuuguuucugucuu

SEQ ID NO: 530550 - RNA, 64 nt, hsa
gcuuuugaaauuuucucuuguaaaacauuuagaaaacaaaaacaaaaaaaaugugauuuguuuc

SEQ ID NO: 530551 - RNA, 64 nt, hsa
cugccaaaaccauuaaguggaaagcugauuaaaaaacaaaaauuucuaauggauuuaucaaacu

SEQ ID NO: 530552 - RNA, 64 nt, hsa
uguacuggcagauuaacauacaaccuauguuuugaacaaaaacaaccagcgauacguaaucaaa

SEQ ID NO: 530553 - RNA, 64 nt, hsa
aaguuugaguugauaguuauuaaaaagaaaacaaaacaaaaaaaaaaggcaaggcacaacaaaa

SEQ ID NO: 530554 - RNA, 64 nt, hsa
aaagaaaacaaaacaaaaaaaaaaggcaaggcacaacaaaaaaauauccugggcaauaaaaaaa

SEQ ID NO: 530555 - RNA, 64 nt, hsa
cauucguuucccagugaaaagcaaaccagaacaaaacaaaaagccaccgcaauaauucgguaag

SEQ ID NO: 530556 - RNA, 64 nt, hsa
auuaaacaauuaaaugaaacaaaucuaaaagugaaacaaaaaccaaccaacaaauacaacacaa

SEQ ID NO: 530557 - RNA, 64 nt, hsa
gaaagaacaaaacaaaacaaaacaaacacaaacaaacaaaaaaccuucaacugccuuaugcccu

SEQ ID NO: 530558 - RNA, 64 nt, hsa
uauacaaagauauucucuauguuuuguaaguaaaaacaaaaagaaaaccuuucuuuuguuuuuu

SEQ ID NO: 530559 - RNA, 64 nt, hsa
uuugguguacucagcaaauaaacuuuucauuuuaaacaaaaacauucauuuauuguguugugca

SEQ ID NO: 530560 - RNA, 64 nt, hsa
guauaccuggcuuuuuaaaauauauguauuuaaaaacaaaaagcaacaguaaucuauguguuuc

SEQ ID NO: 530561 - RNA, 64 nt, hsa
uaggugcaucuaucucuucgcucugucuuccacaaacaaaaauucugccuucagacauuuggug

SEQ ID NO: 530562 - RNA, 62 nt, hsa
uucaaggcuuucagguaugaauuaaaagcaaaaacaaaaaacaaaacaauucauuagccuca

SEQ ID NO: 530563 - RNA, 64 nt, hsa
caacaauaagcuagaaaagacaaaaaaaacaaaaaacaaaaaaacguguaauaaaguuaguggc

SEQ ID NO: 530564 - RNA, 64 nt, hsa
uuucuaccaacaauaagcuagaaaagacaaaaaaaacaaaaaacaaaaaaacguguaauaaagu

SEQ ID NO: 530565 - RNA, 64 nt, hsa
uagaauaguuaucccccccuuuuuuuuuuuuuuuaacaaaaaaacacuuuucuaaggacugaag

SEQ ID NO: 530566 - RNA, 64 nt, hsa
guaucuucauuauucucauuuucucugaguuggaaacaaaaacaugaaggacuccaacuagaag

SEQ ID NO: 530567 - RNA, 64 nt, hsa
ccuggggcuaguuuuuuaugcuuuguaccuagaaaacaaaaaauuacauucguugggcuuuuuu

SEQ ID NO: 530568 - RNA, 64 nt, hsa
aaaauauuuccucaguacuuugcagaaaacaccaaacaaaaaugccauuuuaaaaaagguguau

SEQ ID NO: 530569 - RNA, 64 nt, hsa
ggcucuuaccaaguuuaaacacaaaauuuaucauaacaaaaauacuacuaauauaacuacuguu

SEQ ID NO: 530570 - RNA, 64 nt, hsa
uucauuacuucauguauaucaagcacagcaguaaaacaaaaacccauguauuuaacuuuuuuuu

SEQ ID NO: 530571 - RNA, 64 nt, hsa
aacugguuuuuuucaaaaaaaaaaaaaaaacaaaaacaaaaaaaaaacacaaaagcugcauguc

SEQ ID NO: 530572 - RNA, 64 nt, hsa
aaaauaaacugguuuuuuucaaaaaaaaaaaaaaaacaaaaacaaaaaaaaaacacaaaagcug

SEQ ID NO: 530573 - RNA, 64 nt, hsa
cuuacaucucucuaugcuguucuacaagcaaacaaacaaaaauaggaguauaggaacugcuggc

SEQ ID NO: 530574 - RNA, 64 nt, hsa
gugacagagugaaacucguaucuccaaacaaacaaacaaaaaguccuuaaacauaugugaacaa

SEQ ID NO: 530575 - RNA, 64 nt, hsa
aaacaaacaaacaaaaaguccuuaaacauaugugaacaaaaauuuugugauggaaggauucuag

SEQ ID NO: 530576 - RNA, 64 nt, hsa
ugauuucaaguacccuguauucuggaugcuaaaaaacaaaaacaaacaaaaaaacaaaaacaaa

SEQ ID NO: 530577 - RNA, 64 nt, hsa
uacccuguauucuggaugcuaaaaaacaaaaacaaacaaaaaaacaaaaacaaaaaaacaaaac

SEQ ID NO: 530578 - RNA, 64 nt, hsa
auucuggaugcuaaaaaacaaaaacaaacaaaaaaacaaaaacaaaaaaacaaaaccagaauca

SEQ ID NO: 530579 - RNA, 64 nt, hsa
gaugcuaaaaaacaaaaacaaacaaaaaaacaaaaacaaaaaaacaaaaccagaaucagguaaa

SEQ ID NO: 530580 - RNA, 64 nt, hsa
guuuuaaccaguuguagucaaaaugcuacaauaaaacaaaaaagagaaagaaaaugaagagcau

SEQ ID NO: 530581 - RNA, 64 nt, hsa
ucuuccauucuuaacaguaugugcccauuugcaaaacaaaaaugcuaauaaucaguaauagucc

SEQ ID NO: 530582 - RNA, 64 nt, hsa
aauguuagaaaaagcagaucugucauugcaaaguaacaaaaauuuuaagcuuuuaaaaauguag

SEQ ID NO: 530583 - RNA, 64 nt, hsa
cugaauauauugguaguaauuacuguaauuauucaacaaaaagcauauccguucaaaaauuuuu

SEQ ID NO: 530584 - RNA, 64 nt, hsa
ucaagaccuaacugcagccgcuuugggaaaaaaaaacaaaaaacaaaaaacagaaaacaaaaaa

SEQ ID NO: 530585 - RNA, 64 nt, hsa
cuaacugcagccgcuuugggaaaaaaaaacaaaaaacaaaaaacagaaaacaaaaaaaaaaaaa

SEQ ID NO: 530586 - RNA, 64 nt, hsa
ucuguauauuuaugaccagagcaaaaauguaaaaaacaaaaaaaacaacaaaaaaaguuuguua

SEQ ID NO: 530587 - RNA, 64 nt, hsa
ugaccagagcaaaaauguaaaaaacaaaaaaaacaacaaaaaaaguuuguuacuuugaauaguc

SEQ ID NO: 530588 - RNA, 64 nt, hsa
acauuuuucaaguauuucuaaguauaaaaaacaaaacaaaaaucucuuaggaaaugucuagacc

SEQ ID NO: 530589 - RNA, 64 nt, hsa
cuugacaaaauuuaagcugagcuuaaaagcaaaaaacaaaaaguacacagaaauauuuauuaaa

SEQ ID NO: 530590 - RNA, 64 nt, hsa
ccuggggacagagcaagacucuugucucaaaaaaaacaaaaaaaacauauauacugcuguauca

SEQ ID NO: 530591 - RNA, 64 nt, hsa
gcuaugaaaaggcuuccaggaguuuccaugaaauaacaaaaaaaaauacaagcgccucaccuua

SEQ ID NO: 530592 - RNA, 64 nt, hsa
uguauaaaucccuaauauuuaaaaaaaaaaacaaaacaaaaaaagguuacaaaguuuguuaacu

SEQ ID NO: 530593 - RNA, 64 nt, hsa
ggauggaaaggacuagccucuacugaugcaaaaaaacaaaaagcaacacaaacguuuccuucuu

SEQ ID NO: 530594 - RNA, 64 nt, hsa
cacuccagccugagugacagagagagauucaaaaaacaaaaaaaaagcaaaaauauacuuugcu

SEQ ID NO: 530595 - RNA, 64 nt, hsa
guacaaccuugauaacaaaaccuaaaaaaaaaacaacaaaaaaacccauaaagcuauagaccaa

SEQ ID NO: 530596 - RNA, 64 nt, hsa
aacaaaacaaaacacaaaauccccuguucaaauaaacaaaaaauccaagauugauucaugaaau

SEQ ID NO: 530597 - RNA, 64 nt, hsa
acuuuacacauuucaguuucuaaaauuuuaaauuaacaaaaauuauuucuuguguuauucagag

SEQ ID NO: 530598 - RNA, 64 nt, hsa
cucaaugacaaagaccgagucuucuuuuuuuuuaaacaaaaacaaaaaaagcaaccagggcuau

SEQ ID NO: 530599 - RNA, 64 nt, hsa
gacaaagaccgagucuucuuuuuuuuuaaacaaaaacaaaaaaagcaaccagggcuauuuguac

SEQ ID NO: 530600 - RNA, 64 nt, hsa
auguguauuguuuuuauuuugcgaaacaaaacaaaacaaaaaaaaaagcuuggaacuccaucac

SEQ ID NO: 530601 - RNA, 64 nt, hsa
acagggagagguggagaaggaaaaaacccuacaaaacaaaaacaaaccgcauacacguucaccg

SEQ ID NO: 530602 - RNA, 64 nt, hsa
ucccccccaucuuuaaaaauaauuaguaauaaaaaacaaaaauuccauaucuagccccauccca

SEQ ID NO: 530603 - RNA, 64 nt, hsa
auuuuuuaaagucccaccuuucaauguuuaauaaaacaaaaagagaaauccuuaaucuaaaagc

SEQ ID NO: 530604 - RNA, 64 nt, hsa
ggccauuagguaccuagcagaugugcacaauauaaacaaaaagauaucuggccuaccuuacuac

SEQ ID NO: 530605 - RNA, 64 nt, hsa
agaaggcaaacccaucaacaaaaauugucccuuaaacaaaaauuaaaauccucaauccagcuau

SEQ ID NO: 530606 - RNA, 64 nt, hsa
aaauuggagcuucauggcagaaggcaaacccaucaacaaaaauugucccuuaaacaaaaauuaa

SEQ ID NO: 530607 - RNA, 64 nt, hsa
uaagacaacucuuguguacgcuauguugaagcucaacaaaaaagucaugggaccacuucuagaa

SEQ ID NO: 530608 - RNA, 64 nt, hsa
uuaagauuguuuaucuggagcccacauaguguggaacaaaaagucaccuagaaagcauccuugg

SEQ ID NO: 530609 - RNA, 64 nt, hsa
auguuugaauggaggacgccaguaaaaaaacaaaaacaaaaacaaaacaaaacauaaaauauaa

SEQ ID NO: 530610 - RNA, 64 nt, hsa
auguaaauguuugaauggaggacgccaguaaaaaaacaaaaacaaaaacaaaacaaaacauaaa

SEQ ID NO: 530611 - RNA, 64 nt, hsa
cucauucuucagugccucaugacugaaaacaaaaaacaaaaaaacgaaagcaucuucacaauga

SEQ ID NO: 530612 - RNA, 64 nt, hsa
agcacaacucauucuucagugccucaugacugaaaacaaaaaacaaaaaaacgaaagcaucuuc

SEQ ID NO: 530613 - RNA, 64 nt, hsa
gcuuauucuuuaacaaagagaaucuaaaaaaaaaaacaaaaaacuguugucuaauauaucuaca

SEQ ID NO: 530614 - RNA, 64 nt, hsa
uauuuucauaaucagucaaaauaauaaaacuaaaaacaaaaaguaaaaauuaguucccaaguaa

SEQ ID NO: 530615 - RNA, 64 nt, hsa
auacuuaucucuguuaagacuccauugaaaguuaaacaaaaagccgauauaauaguuuggguuu

SEQ ID NO: 530616 - RNA, 64 nt, hsa
aguuuuaauaaaacaugcugcaaccaugguauacaacaaaaauacauuucuuuggugauugaaa

SEQ ID NO: 530617 - RNA, 64 nt, hsa
uucuggcuuuuaauuuugccagcuaaggacauaaaacaaaaauaaacaaacaaaaacaaauagc

SEQ ID NO: 530618 - RNA, 64 nt, hsa
uuugccagcuaaggacauaaaacaaaaauaaacaaacaaaaacaaauagccaucugcuaucagc

SEQ ID NO: 530619 - RNA, 64 nt, hsa
gcccccaucagggaccagacuguuccaaaaaaaaaacaaaaaacaaaaacaaacaaaaaaacac

SEQ ID NO: 530620 - RNA, 64 nt, hsa
ucagggaccagacuguuccaaaaaaaaaacaaaaaacaaaaacaaacaaaaaaacacuuaaaag

SEQ ID NO: 530621 - RNA, 64 nt, hsa
gacuguuccaaaaaaaaaacaaaaaacaaaaacaaacaaaaaaacacuuaaaagcccaaggagu

SEQ ID NO: 530622 - RNA, 64 nt, hsa
agcauacugagacccugccuuuaaaaacaaacagaacaaaaacaaaacaccagggacacauuuc

SEQ ID NO: 530623 - RNA, 64 nt, hsa
auaaagaauucugugagaaaaaauuuaauaaagcaacaaaaauuacucuuauucuucauugcuu

SEQ ID NO: 530624 - RNA, 64 nt, hsa
gucuguaugacagccacuccuaaaaauaaacaacaacaaaaacaaaaaaagaagaaaacuaaau

SEQ ID NO: 530625 - RNA, 64 nt, hsa
augacagccacuccuaaaaauaaacaacaacaaaaacaaaaaaagaagaaaacuaaauaaaaau

SEQ ID NO: 530626 - RNA, 64 nt, hsa
ucucucuaugguaaagauauuauucaccauguaaaacaaaaaacaauauuuauuguauuuuagu

SEQ ID NO: 530627 - RNA, 64 nt, hsa
uggagaacagugauuuuuuuuuagaacagaaaacaacaaaaaauaaccccaaaaugaagauuau

SEQ ID NO: 530628 - RNA, 64 nt, hsa
augacuagaaagugaauaaaaauuaaggcaacugaacaaaaaaaugcucacacuccacaucccg

SEQ ID NO: 530629 - RNA, 64 nt, hsa
uuucagaaaacagaaaaaaaacacacacacacacaacaaaaauuugaaccaaaacauuccguuu

SEQ ID NO: 530630 - RNA, 64 nt, hsa
uagaacaagacccugucucaaaaaaaaaaaaaacaacaaaaacuuagaauugaggaguuguacc

SEQ ID NO: 530631 - RNA, 64 nt, hsa
ucaacacaaagacauggaagguuagagguuugucaacaaaaagacauggaagguuagguuuguc

SEQ ID NO: 530632 - RNA, 64 nt, hsa
gauugcaaacaaacagugaacacugucugaauuaaacaaaaagcugcccgacuugcaaucuaau

SEQ ID NO: 530633 - RNA, 64 nt, hsa
ugguuacaauucauaaugcagcaguuucuccaaaaacaaaaacaaaacacacaccacacacacg

SEQ ID NO: 530634 - RNA, 64 nt, hsa
agcauuacuuaacacaguauaaagaugaaaagacaacaaaaauaucuucauacuuccucauccc

SEQ ID NO: 530635 - RNA, 64 nt, hsa
uaaagcuuaccaacaaaagaacccucagcagaauaacaaaaacuuugcucaggacauuugaggu

SEQ ID NO: 530636 - RNA, 64 nt, hsa
uuuccagcacauuuuuuuuaaaaacucagguuagaacaaaaaugucauaaagggcacuaaaagu

SEQ ID NO: 530637 - RNA, 64 nt, hsa
uauuugguuuaguucuguguuucagugacugauaaacaaaaaugaagcuaaaaugaaucaacgg

SEQ ID NO: 530638 - RNA, 64 nt, hsa
gcaaggcucugucucaaaaaaaaacaaaaacaaaaacaaaaaagacugauaucgcaccuaaauu

SEQ ID NO: 530639 - RNA, 64 nt, hsa
gacagagcaaggcucugucucaaaaaaaaacaaaaacaaaaacaaaaaagacugauaucgcacc

SEQ ID NO: 530640 - RNA, 64 nt, hsa
cugggugacagagcaaggcucugucucaaaaaaaaacaaaaacaaaaacaaaaaagacugauau

SEQ ID NO: 530641 - RNA, 64 nt, hsa
auugacaaaauuugaagaaauauuaaacaaaaauaacaaaaaaagaaacaaccuuggccuuaau

SEQ ID NO: 530642 - RNA, 64 nt, hsa
gcuucagcaauugacaaaauuugaagaaauauuaaacaaaaauaacaaaaaaagaaacaaccuu

SEQ ID NO: 530643 - RNA, 64 nt, hsa
gggugacggcuucuggcacuuagaaaacaaaaagaacaaaaaaagagaaacccccaagccugga

SEQ ID NO: 530644 - RNA, 64 nt, hsa
agagaggaagggugacggcuucuggcacuuagaaaacaaaaagaacaaaaaaagagaaaccccc

SEQ ID NO: 530645 - RNA, 64 nt, hsa
ugaguauucuacauagacaaucauguugucugugaacaaaaacaguuuguuuucuuuccuaucu

SEQ ID NO: 530646 - RNA, 64 nt, hsa
auaaaaauacaauuaauuuuugaauauuaaucaaaacaaaaagcaaaacugcuacacucacuua

SEQ ID NO: 530647 - RNA, 64 nt, hsa
ugcugcucagaaugccagccuguugaagauaaacaacaaaaaugcauugguaaagcccaggugu

SEQ ID NO: 530648 - RNA, 64 nt, hsa
cucuuaaaauuauuauuuuaaguaaaagccaauaaacaaaaacgaaaaggcaaguuacgagacu

SEQ ID NO: 530649 - RNA, 64 nt, hsa
uuuauuuauacuaaauaacugucaaccauuuucuaacaaaaaguaagacugaauugacugauua

SEQ ID NO: 530650 - RNA, 64 nt, hsa
uuuaacuauuuaaaguuaugaaaaaauagacgucaacaaaaauguguaaggggauauuagguuu

SEQ ID NO: 530651 - RNA, 64 nt, hsa
uauuagguuugcuaaauucuuucacagacuauaaaacaaaaaauuuugaggaacaccucucauc

SEQ ID NO: 530652 - RNA, 64 nt, hsa
auaaugacaaaaagcacaugcagaguaauacacaaacaaaaaaagugacaguuacuuuuuugug

SEQ ID NO: 530653 - RNA, 64 nt, hsa
aucugucuauaucauucauuacguguaaguauuuaacaaaaaagcauucuugaccaugaaugaa

SEQ ID NO: 530654 - RNA, 64 nt, hsa
guuucuuucuuuccaaaaucagccuucugucuguaacaaaaauguacuuuauagagauggagga

SEQ ID NO: 530655 - RNA, 64 nt, hsa
agaaaguagcacauggaguagcugagguuaaacaaacaaaaaaaaauuuuaaacaaagaaagga

SEQ ID NO: 530656 - RNA, 64 nt, hsa
auuauuaauagcucagguuaaaaacacccauuuaaacaaaaacaagagcauuuguaauaggaag

SEQ ID NO: 530657 - RNA, 64 nt, hsa
uugauaaauauauaugaucauugaaauacuuuuuaacaaaaaacagauucuauauuauuauaua

SEQ ID NO: 530658 - RNA, 64 nt, hsa
agggaagcacaugaucaugggaaugauagcccagaacaaaaagaaaucuugucuuaccacagug

SEQ ID NO: 530659 - RNA, 64 nt, hsa
acaguauuguaaucccaucaaaagaugaaagaaaaacaaaaacaaaaaccaacaacaauuagcc

SEQ ID NO: 530660 - RNA, 64 nt, hsa
uuguaaucccaucaaaagaugaaagaaaaacaaaaacaaaaaccaacaacaauuagccauaguu

SEQ ID NO: 530661 - RNA, 64 nt, hsa
guuuugguuucuguauuuuucacaaugauuaaugaacaaaaacaaagagaaaaaaacacacauc

SEQ ID NO: 530662 - RNA, 64 nt, hsa
ugugaacgaaaggaaggaacaucuuucuauggcuaacaaaaacuaaaggggaagugaggaaaca

SEQ ID NO: 530663 - RNA, 64 nt, hsa
cacugaacuucaaaacaaaacaaaaaacaacaacaacaaaaaacaaguccaaacugauauaucc

SEQ ID NO: 530664 - RNA, 64 nt, hsa
acuguaaaaaaaagugcacugaacuucaaaacaaaacaaaaaacaacaacaacaaaaaacaagu

SEQ ID NO: 530665 - RNA, 64 nt, hsa
auagagaggggcuuuauuucaaucauagagcaacaacaaaaauaaugcuuauagcuaaacugcc

SEQ ID NO: 530666 - RNA, 64 nt, hsa
aaaaguaccaaacauuugcauucucagaacaucaaacaaaaaugcccugguggcaaagcuauca

SEQ ID NO: 530667 - RNA, 64 nt, hsa
acuuuucuaagauagcaauuuuugaagagacacgaacaaaaaucugaauuaguucaugagccuu

SEQ ID NO: 530668 - RNA, 64 nt, hsa
cucugucucaaaaaaaaaaaaacaaaaacaaacaaacaaaaaaaacaccucaccaugagugcua

SEQ ID NO: 530669 - RNA, 64 nt, hsa
gcaacagaguaagacucugucucaaaaaaaaaaaaacaaaaacaaacaaacaaaaaaaacaccu

SEQ ID NO: 530670 - RNA, 64 nt, hsa
guauguucugagauauaauguuaacauuguucauaacaaaaaaugcuaucaaucuuauaaauau

SEQ ID NO: 530671 - RNA, 64 nt, hsa
guuuggucuuuauuaaaaaucacaauauuccgaaaacaaaaaaaccuaggagauaaauguagag

SEQ ID NO: 530672 - RNA, 64 nt, hsa
ugcuuuguuuaaaaaaacgaaaaaaacaaaacaaaacaaaaaaacaugagcagugguguucuaa

SEQ ID NO: 530673 - RNA, 64 nt, hsa
uacaaaacguaacuccaguccuccacccucucccaacaaaaauaacaaugcuguugacagugga

SEQ ID NO: 530674 - RNA, 64 nt, hsa
uuccuugaaaauuuuauuaaaaaacaaacaaacaaacaaaaagccuguccacccuugagaaucc

SEQ ID NO: 530675 - RNA, 64 nt, hsa
cuauauuuuacauucuuggaaagucuauaugaaaaacaaaaauaacaucuucaguuuuucuccc

SEQ ID NO: 530676 - RNA, 64 nt, hsa
auucugcagaaaucagaacucuuaccaugguuugaacaaaaaaaggggaaauggggaggggaaa

SEQ ID NO: 530677 - RNA, 64 nt, hsa
aguucuuccaagagacuuccauguccugguuauuaacaaaaaaggaaaaauguaauaauugaua

SEQ ID NO: 530678 - RNA, 64 nt, hsa
auaaugcuaguccuagauuacuuauugauuuaaaaacaaaaaaaagauuacuuaauuuugauuu

SEQ ID NO: 530679 - RNA, 64 nt, hsa
aaacaaaaaaaagauuacuuaauuuugauuuaaaaacaaaaaaucguaaaauacaaaaaccagu

SEQ ID NO: 530680 - RNA, 64 nt, hsa
uaaacacaaggaacauuccauaucauuagucgaaaacaaaaacaaaaaaaaaaccuuuggucau

SEQ ID NO: 530681 - RNA, 64 nt, hsa
caaggaacauuccauaucauuagucgaaaacaaaaacaaaaaaaaaaccuuuggucauuuguaa

SEQ ID NO: 530682 - RNA, 64 nt, hsa
auuugacugugacuuuaaucuaaauuacuauguaaacaaaaaguagauaguuucacuuuuuaaa

SEQ ID NO: 530683 - RNA, 64 nt, hsa
augaauaaaucuuaaaugcuuuguuuaauuaaaaaacaaaaaucaccaauauccaagacaugaa

SEQ ID NO: 530684 - RNA, 64 nt, hsa
cacuccccuuaacugucuuugaacuuucucuuuuaacaaaaaugucaagucuuuauaguuguaa

SEQ ID NO: 530685 - RNA, 64 nt, hsa
uuucuauuaaaacuguuguuaaaauauuuuuuaaaacaaaaacauuauuugugcccucuuuuau

SEQ ID NO: 530686 - RNA, 64 nt, hsa
uuuccucuuuccuuuccaguuaaaaaaaaacaaaaacaaaaacaaaacccuuugcuguaucacu

SEQ ID NO: 530687 - RNA, 64 nt, hsa
cccuucuuuccucuuuccuuuccaguuaaaaaaaaacaaaaacaaaaacaaaacccuuugcugu

SEQ ID NO: 530688 - RNA, 64 nt, hsa
ugaguauaaaggaaaaacagcaaaacaaaaagcaaacaaaaaaaaacugcaaaagucuaaaaua

SEQ ID NO: 530689 - RNA, 64 nt, hsa
gcaagagucccugaguauaaaggaaaaacagcaaaacaaaaagcaaacaaaaaaaaacugcaaa

SEQ ID NO: 530690 - RNA, 64 nt, hsa
accaucaauuuaaaaguaaaaaaaacaaaaaaaaaacaaaaaauuuaaaaaaaagguuugcuaa

SEQ ID NO: 530691 - RNA, 64 nt, hsa
ugccacgguucaccaucaauuuaaaaguaaaaaaaacaaaaaaaaaacaaaaaauuuaaaaaaa

SEQ ID NO: 530692 - RNA, 64 nt, hsa
caucauccggauuucugguuguggcccagcaauuaacaaaaacagcuucaacuguucgaauuuu

SEQ ID NO: 530693 - RNA, 64 nt, hsa
uauuguaaauaaguaacuuugacuucugacaaaaaacaaaaagugcugcauggcucgcauggaa

SEQ ID NO: 530694 - RNA, 64 nt, hsa
uaugucaaccagugaggcugcccugaacaaaaaaaacaaaaagaaaaaaaaaaaaggaaagaaa

SEQ ID NO: 530695 - RNA, 64 nt, hsa
aaauguuauuaugucaaccagugaggcugcccugaacaaaaaaaacaaaaagaaaaaaaaaaaa

SEQ ID NO: 530696 - RNA, 64 nt, hsa
ggacuuuauuguccuguuucuaucaaauuggacuaacaaaaauugauauaauacauucaucaca

SEQ ID NO: 530697 - RNA, 64 nt, hsa
cauggugcaaccucgucuuuacuaaaaauacaaaaacaaaaauuagccagggguggugguaugc

SEQ ID NO: 530698 - RNA, 64 nt, hsa
cagccugggagacagagcaagacuccaucucaaaaacaaaaacaaaacaaaacaacaacaaaaa

SEQ ID NO: 530699 - RNA, 64 nt, hsa
cuccaucucaaaaacaaaaacaaaacaaaacaacaacaaaaaaagaaguuaaauaacuuguuua

SEQ ID NO: 530700 - RNA, 64 nt, hsa
guccuuaguuuaauucuauuguaucuguuuauuuaacaaaaaauucaucauaccaaaaagugua

SEQ ID NO: 530701 - RNA, 64 nt, hsa
caaaaaguguaagugaaaacccccuuuaaaacaaaacaaaaaaaugaaauaaaauuaggcaaau

SEQ ID NO: 530702 - RNA, 64 nt, hsa
uucuguuuaauuauguaaaaaacaaaacuacaacaacaaaaaaagaaaaaaguuaaaaaagaaa

SEQ ID NO: 530703 - RNA, 64 nt, hsa
aagaaaaaaguuaaaaaagaaaaaaacaccaaaaaacaaaaacaaacaaaaaaaaaaacccaca

SEQ ID NO: 530704 - RNA, 64 nt, hsa
uuaaaaaagaaaaaaacaccaaaaaacaaaaacaaacaaaaaaaaaaacccacaacccuuaucu

SEQ ID NO: 530705 - RNA, 64 nt, hsa
augagaauguuguuuuaaaagaaaauagcaaaacaacaaaaaagcaaaccuuaaaaugugaaga

SEQ ID NO: 530706 - RNA, 64 nt, hsa
augugauuguaauuaaaaauauuuugauuuaaauaacaaaaauaauaccagauuuuaagccgug

SEQ ID NO: 530707 - RNA, 64 nt, hsa
cagacauucuaguuuguggaggguuauuuaaaaaaacaaaaaaggaagauggucaaguuuguaa

SEQ ID NO: 530708 - RNA, 64 nt, hsa
uuuuaccaagauuauaaaaacacuuuuacaaaaaaacaaaaaccuguaaaaauaauuuugagcu

SEQ ID NO: 530709 - RNA, 64 nt, hsa
uuugcuuguuaccauggaaaccuaauggccugccaacaaaaaccucacuguaaacaggguacgu

SEQ ID NO: 530710 - RNA, 64 nt, hsa
aaaaaaaaaaaaaaaaaaauccuaaaaacaaacaaacaaaaaaaacaauucuucauucagaaaa

SEQ ID NO: 530711 - RNA, 64 nt, hsa
auugagggcaagcacccaggacugaugaggucuuaacaaaaaccaguguggcaaaaaaaaaaaa

SEQ ID NO: 530712 - RNA, 64 nt, hsa
uguuuaacuuuguauuuugauuguugagaacaaaaacaaaaaguaucaauguguauguggcugu

SEQ ID NO: 530713 - RNA, 64 nt, hsa
caauuguguuuaacuuuguauuuugauuguugagaacaaaaacaaaaaguaucaauguguaugu

SEQ ID NO: 530714 - RNA, 64 nt, hsa
uaugaucuuccauccaaguggagggaaacuuuaaaacaaaaacacccaguacuguggcucagga

SEQ ID NO: 530715 - RNA, 64 nt, hsa
uuguuagugaauuuggaaauaaaaagaaaaaaaaaacaaaaacaaacaggcugccauaauauau

SEQ ID NO: 530716 - RNA, 64 nt, hsa
aaguuacaaguugauaucguugaaugaaaagcaaaacaaaaacaauucaggaacaacggcuaau

SEQ ID NO: 530717 - RNA, 64 nt, hsa
uuauaaacuaauauaugugagagugcuuaguugaaacaaaaaggaguuuuaguagacaguauua

SEQ ID NO: 530718 - RNA, 64 nt, hsa
uauuggauuaaaucugauagguuuuccagaaaugaacaaaaaucagcucuaaaaccaaagcuga

SEQ ID NO: 530719 - RNA, 64 nt, hsa
uaaauccuuuccaauaauugacugguggaaggaaaacaaaaaacaaaaacuaaaaaccucuuag

SEQ ID NO: 530720 - RNA, 64 nt, hsa
uuuccaauaauugacugguggaaggaaaacaaaaaacaaaaacuaaaaaccucuuagcuuuucu

SEQ ID NO: 530721 - RNA, 64 nt, hsa
aagugauacucuuuauuacaagaaacaaggaauuaacaaaaauaaggaacuuguugcuaccuuu

SEQ ID NO: 530722 - RNA, 64 nt, hsa
ugauuaaaauccaaaacuuuagcuguauuucaguaacaaaaacauaccuuacuagacugugaug

SEQ ID NO: 530723 - RNA, 64 nt, hsa
ccuccuuuaacuccuccuaccccccaagguaagaaacaaaaaacaaacaaacaaacaaaaauag

SEQ ID NO: 530724 - RNA, 64 nt, hsa
ccccccaagguaagaaacaaaaaacaaacaaacaaacaaaaauagaagacaaaagaaagacaua

SEQ ID NO: 530725 - RNA, 64 nt, hsa
augggaaagggcuguugauauuaaaaacaaacaaaacaaaaaagccccacacauaacuguuuug

SEQ ID NO: 530726 - RNA, 64 nt, hsa
gguuuaacucuuuaguuuuauuuuaagaggggaaaacaaaaauaucuugcaagcagaaccuugg

SEQ ID NO: 530727 - RNA, 64 nt, hsa
acaaaguuaggaaguuuguuguuuguuuauuauaaacaaaaagcaugugaaagugcacuuaaga

SEQ ID NO: 530728 - RNA, 64 nt, hsa
ccucagaacuuuaguaacagcacaacaaauuaaaaacaaaaacaacucaugccacaguaugucg

SEQ ID NO: 530729 - RNA, 64 nt, hsa
uuggcaugcuguaaaacaaaacaaaacaaaauaaaacaaaaaaaaggaaggaaaaaaaaagaaa

SEQ ID NO: 530730 - RNA, 64 nt, hsa; identical to SEQ ID NO: 530718

SEQ ID NO: 530731 - RNA, 64 nt, hsa; identical to SEQ ID NO: 530717

SEQ ID NO: 530732 - RNA, 64 nt, hsa; identical to SEQ ID NO: 530720

SEQ ID NO: 530733 - RNA, 64 nt, hsa; identical to SEQ ID NO: 530719

SEQ ID NO: 530734 - RNA, 64 nt, hsa
ccugcuaaaaagacaaaaaacaaaaaacaaaaaaaacaaaaaaaaccucaugagugcauggauu

SEQ ID NO: 530735 - RNA, 64 nt, hsa
cccccucuuccugcuaaaaagacaaaaaacaaaaaacaaaaaaaacaaaaaaaaccucaugagu

SEQ ID NO: 530736 - RNA, 64 nt, hsa
auauucucccccucuuccugcuaaaaagacaaaaaacaaaaaacaaaaaaaacaaaaaaaaccu

SEQ ID NO: 530737 - RNA, 64 nt, hsa
aucauggaccagguccucuauaaaaugaagaacuaacaaaaauuagucuucagaaaugaaaauc

SEQ ID NO: 530738 - RNA, 64 nt, hsa
caggaaacagcucaucccagagaaggagaugcuuaacaaaaaaaaauugaaauuguuucccaug

SEQ ID NO: 530739 - RNA, 64 nt, hsa
uuguugcacuuuuaguuuuuuuaaaaaaaacaaaaacaaaaacauggcagaugcauauuguguc

SEQ ID NO: 530740 - RNA, 64 nt, hsa
cugacuuuguugcacuuuuaguuuuuuuaaaaaaaacaaaaacaaaaacauggcagaugcauau

SEQ ID NO: 530741 - RNA, 64 nt, hsa
cucauguggggauguuugugcugcagacaaaaagaacaaaaaaaaauuuuuaaauaccacaaga

SEQ ID NO: 530742 - RNA, 64 nt, hsa
aaaaauuuuuaaauaccacaagauggaaaaaaaaaacaaaaaaauuuaaaaagauggaauguag

SEQ ID NO: 530743 - RNA, 64 nt, hsa
ucuccucauccuaguucuuuaaaaaaaacaaaaaaacaaaaaaaacuuuuuuuaaucguuguaa

SEQ ID NO: 530744 - RNA, 62 nt, hsa
cggcucucuccucauccuaguucuuuaaaaaaaacaaaaaaacaaaaaaaacuuuuuuuaau

SEQ ID NO: 530745 - RNA, 64 nt, hsa
ccaucucuucagaccccuuugccuuuaaaaaaaaaacaaaaacaaaaacaaaaaaacccauaau

SEQ ID NO: 530746 - RNA, 64 nt, hsa
cuucagaccccuuugccuuuaaaaaaaaaacaaaaacaaaaacaaaaaaacccauaaugcccac

SEQ ID NO: 530747 - RNA, 64 nt, hsa
accccuuugccuuuaaaaaaaaaacaaaaacaaaaacaaaaaaacccauaaugcccacagaaug

SEQ ID NO: 530748 - RNA, 64 nt, hsa
acuuggaggguugguccucuugccuccuggaaaaaacaaaaacaaaaaacugcagugaaagaca

SEQ ID NO: 530749 - RNA, 64 nt, hsa
aggguugguccucuugccuccuggaaaaaacaaaaacaaaaaacugcagugaaagacaagcugc

SEQ ID NO: 530750 - RNA, 64 nt, hsa
auuuaacucugccucggccauucaaaagucuaauaacaaaaaauguaaaccuaauuuggcaguu

SEQ ID NO: 530751 - RNA, 64 nt, hsa
cuaauuguccaauucuacgugcucucuauaccaaaacaaaaaaaaaaagcuauccaccuuucca

SEQ ID NO: 530752 - RNA, 64 nt, hsa
cccuucugugugaccgaccccuuggccaaaaaaaaacaaaaagcaaaaaacaaaaaccuacccu

SEQ ID NO: 530753 - RNA, 64 nt, hsa
cgaccccuuggccaaaaaaaaacaaaaagcaaaaaacaaaaaccuacccuguucugguuuuuuu

SEQ ID NO: 530754 - RNA, 64 nt, hsa
ccccuuauucccgaggcccagaaaagaaaacaaaaacaaaaacccagcacauacaagaaacaua

SEQ ID NO: 530755 - RNA, 64 nt, hsa
ucuccuccccuuauucccgaggcccagaaaagaaaacaaaaacaaaaacccagcacauacaaga

SEQ ID NO: 530756 - RNA, 64 nt, hsa
aaauauuaaagauuuccuuggagucaaaguaaaaaacaaaaaauuguaauguugucuagggaug

SEQ ID NO: 530757 - RNA, 64 nt, hsa
agaacuuucaggcagaucccaccauuagccuguaaacaaaaaguuuggcaccagccaccuggga

SEQ ID NO: 530758 - RNA, 64 nt, hsa
gaauaacccuuuuagcauugaaaaaaaaaacaaaaacaaaaaauggaaaaaaaaaaccuuguau

SEQ ID NO: 530759 - RNA, 64 nt, hsa
aauucugaauaacccuuuuagcauugaaaaaaaaaacaaaaacaaaaaauggaaaaaaaaaacc

SEQ ID NO: 530760 - RNA, 64 nt, hsa
agggaaguaaaaaaacaaaacaaaaaacaaaaaaaacaaaaaaaaaacccuauuuaaaugaaag

SEQ ID NO: 530761 - RNA, 64 nt, hsa
aaaucgaauagggaaguaaaaaaacaaaacaaaaaacaaaaaaaacaaaaaaaaaacccuauuu

SEQ ID NO: 530762 - RNA, 64 nt, hsa
gaaacucaaaucgaauagggaaguaaaaaaacaaaacaaaaaacaaaaaaaacaaaaaaaaaac

SEQ ID NO: 530763 - RNA, 64 nt, hsa
uuucuaaaaaacaaacaaaaaaaaaaacacacaaaacaaaaacagaacaaaagaagagagaagg

SEQ ID NO: 530764 - RNA, 64 nt, hsa
auuucuucucccccaccccuuuuucuaaaaaacaaacaaaaaaaaaaacacacaaaacaaaaac

SEQ ID NO: 530765 - RNA, 64 nt, hsa
uuugguuuauuuagaaaaaggaagaaaaacaaaaaacaaaaaacuaaagggugagaauuugcuu

SEQ ID NO: 530766 - RNA, 64 nt, hsa
ccaagcauuugguuuauuuagaaaaaggaagaaaaacaaaaaacaaaaaacuaaagggugagaa

SEQ ID NO: 530767 - RNA, 64 nt, hsa
ccuccuucaccccuccucucacugccugccagaaaacaaaaacaccaagaaaccaagucaacuu

SEQ ID NO: 530768 - RNA, 64 nt, hsa
caaucugucuuuaaguagggauaaauuacucuaaaacaaaaaagaauccuagauaguuuucccu

SEQ ID NO: 530769 - RNA, 64 nt, hsa
auauuccaguaaguuauuuugcucucacuguuuuaacaaaaaaaaaaaacaacaacauaaaaau

SEQ ID NO: 530770 - RNA, 64 nt, hsa
guuguuuuuuuuuuaacaacugggaaaaaacaaaaacaaaaaacuauaguuagaaaaauggaag

SEQ ID NO: 530771 - RNA, 64 nt, hsa
cugugaguuguuuuuuuuuuaacaacugggaaaaaacaaaaacaaaaaacuauaguuagaaaaa

SEQ ID NO: 530772 - RNA, 64 nt, hsa
gagcaaaugcuagagcgauuucagcugauagaaaaacaaaaaugaaaaaaaaaacacaaaaaac

SEQ ID NO: 530773 - RNA, 64 nt, hsa
auagaaaaacaaaaaugaaaaaaaaaacacaaaaaacaaaaaacauggcacguugcuaguuuac

SEQ ID NO: 530774 - RNA, 64 nt, hsa
uucuuugauuuauuuuauugcaucaaugaauuaaaacaaaaaucuugggggaagaaauuggcaa

SEQ ID NO: 530775 - RNA, 64 nt, hsa
agauuaugaaaggaacaggcucuuuaaaaaagaaaacaaaaagccagaaucuuccuuuuuuugu

SEQ ID NO: 530776 - RNA, 64 nt, hsa
gauggaggaagaucuacgaagcaaauggaaaacaaacaaaaaaagaggcagggguugcaauccu

SEQ ID NO: 530777 - RNA, 64 nt, hsa
uuggaaguaaagcacuccucagcaaauguaaaggaacaaaaauuauaacaaacugucucucaga

SEQ ID NO: 530778 - RNA, 64 nt, hsa
aaccaaaaaaaaaaaaggaaaaaaaacacaaaacaacaaaaaccaaaaaaaaaaaaaaucacaa

SEQ ID NO: 530779 - RNA, 64 nt, hsa
aacaacaaaaaccaaaaaaaaaaaaaaucacaaaaacaaaaaaacuauaaaaaagaaagaauua

SEQ ID NO: 530780 - RNA, 64 nt, hsa
guuauggaagaaccgggacauuuuacagaaaaaaaacaaaaaacaacaaaaaauauacguggga

SEQ ID NO: 530781 - RNA, 64 nt, hsa
aaccgggacauuuuacagaaaaaaaacaaaaaacaacaaaaaauauacgugggaaaaaaaacga

SEQ ID NO: 530782 - RNA, 64 nt, hsa
accgagggaggcucugucucaaaagcaaagcaaaaacaaaaacaaaaacaccuaaaaaaccugc

SEQ ID NO: 530783 - RNA, 64 nt, hsa
ggaggcucugucucaaaagcaaagcaaaaacaaaaacaaaaacaccuaaaaaaccugcaguuuu

SEQ ID NO: 530784 - RNA, 64 nt, hsa
aauaaaugugauuuaucacauacacagaacuaaaaacaaaaaccacaugaccaugaucaucucu

SEQ ID NO: 530785 - RNA, 64 nt, hsa
aaagacuuaaugaugaacaccccaaagcaauugcaacaaaaacaaaaauugacaagugggaccu

SEQ ID NO: 530786 - RNA, 64 nt, hsa
uuaaugaugaacaccccaaagcaauugcaacaaaaacaaaaauugacaagugggaccuaauuaa

SEQ ID NO: 530787 - RNA, 64 nt, hsa
cuaaacccaagcacccaaugaugcaaaaaacaaaaacaaaaaaaaaccaccaaauccccaaauu

SEQ ID NO: 530788 - RNA, 64 nt, hsa
ccuucccuaaacccaagcacccaaugaugcaaaaaacaaaaacaaaaaaaaaccaccaaauccc

SEQ ID NO: 530789 - RNA, 64 nt, hsa
acaaaaaaacacaaacagaagaggaaaaaaaagcaacaaaaaaagaaaacacacagaagagauu

SEQ ID NO: 530790 - RNA, 64 nt, hsa
guuauuaaacgucuguggagcuucugcugcaaggaacaaaaaagaaaaaaaucaaaaaagcgac

SEQ ID NO: 530791 - RNA, 64 nt, hsa
cccccuuuuucuuguuaaaaaacaaaaaacaaaaaacaaaaaaccacacacacauuuuguacgg

SEQ ID NO: 530792 - RNA, 64 nt, hsa
gcuuuugcccccuuuuucuuguuaaaaaacaaaaaacaaaaaacaaaaaaccacacacacauuu

SEQ ID NO: 530793 - RNA, 64 nt, hsa
auuccuggcuuuugcccccuuuuucuuguuaaaaaacaaaaaacaaaaaacaaaaaaccacaca

SEQ ID NO: 530794 - RNA, 64 nt, hsa
auuuaacagcuugaguauugcauuuccuuggccaaacaaaaauagcuacaaauccacaaaaauu

SEQ ID NO: 530795 - RNA, 64 nt, hsa
ugaugccuuaggacauguuugaacugcagcaaaaaacaaaaacaaaaaacagugcauuagcaau

SEQ ID NO: 530796 - RNA, 64 nt, hsa
cuuaggacauguuugaacugcagcaaaaaacaaaaacaaaaaacagugcauuagcaauuucaua

SEQ ID NO: 530797 - RNA, 64 nt, hsa
ggcaacauagcgagaccucaucuccaaaaaagaaaacaaaaaacaaaaaaaggaaugauguucu

SEQ ID NO: 530798 - RNA, 64 nt, hsa
uagcgagaccucaucuccaaaaaagaaaacaaaaaacaaaaaaaggaaugauguucuguagaga

SEQ ID NO: 530799 - RNA, 64 nt, hsa
cacugauuuaaaacaaaccaaaaaaaaagaaaaaaacaaaaaaaaaaaucccuccuuucuagcu

SEQ ID NO: 530800 - RNA, 64 nt, hsa
aaaaacaaaaaaaaaaaucccuccuuucuagcugaacaaaaaugugcaguuaauacuuggcgcu

SEQ ID NO: 530801 - RNA, 64 nt, hsa
ugauuuaaauuuauaauuaaguaaauuacauuaaaacaaaaaaauuauacucaaaauucauuac

SEQ ID NO: 530802 - RNA, 64 nt, hsa
ucauuguuuuacuuuugucuuccucacuaguguaaacaaaaauuucaaccagcauucaugccga

SEQ ID NO: 530803 - RNA, 64 nt, hsa
cuggucugucuuuucuccauuuguuuaaaaaaaaaacaaaaacaaaaaacaacacuuuggugug

SEQ ID NO: 530804 - RNA, 64 nt, hsa
ugucuuuucuccauuuguuuaaaaaaaaaacaaaaacaaaaaacaacacuuuggugugguggua

SEQ ID NO: 530805 - RNA, 64 nt, hsa
ugacuuuccucagaacaugagacuguaaaacaaaaacaaaaaacuaugugaugccucuauuuuc

SEQ ID NO: 530806 - RNA, 64 nt, hsa
gacuuaugacuuuccucagaacaugagacuguaaaacaaaaacaaaaaacuaugugaugccucu

SEQ ID NO: 530807 - RNA, 64 nt, hsa
cuuaaaggaaauguuaaaaaaaaaaaaacaaaaaaacaaaaaaacaacuguucuuugccuaaua

SEQ ID NO: 530808 - RNA, 64 nt, hsa
ccaccuuccuuaaaggaaauguuaaaaaaaaaaaaacaaaaaaacaaaaaaacaacuguucuuu

SEQ ID NO: 530809 - RNA, 64 nt, hsa
aaaaacaaaaaacaaaaaaaacaaaaaaacaaaaaacaaaaaaacacacacacacaaaaaaaga

SEQ ID NO: 530810 - RNA, 64 nt, hsa
caaaagcaaaaacaaaaaacaaaaaaaacaaaaaaacaaaaaacaaaaaaacacacacacacaa

SEQ ID NO: 530811 - RNA, 64 nt, hsa
agaccuuccaaaagcaaaaacaaaaaacaaaaaaaacaaaaaaacaaaaaacaaaaaaacacac

SEQ ID NO: 530812 - RNA, 64 nt, hsa
uccgcugggagaccuuccaaaagcaaaaacaaaaaacaaaaaaaacaaaaaaacaaaaaacaaa

SEQ ID NO: 530813 - RNA, 64 nt, hsa
cagacccuccgcugggagaccuuccaaaagcaaaaacaaaaaacaaaaaaaacaaaaaaacaaa

SEQ ID NO: 530814 - RNA, 64 nt, hsa
uguuucacaaacaguuuuauuuaaaaaaacaaaaaacaaaaaaaaucaaaaaaucaaaaaaaua

SEQ ID NO: 530815 - RNA, 64 nt, hsa
aaauagcuguuucacaaacaguuuuauuuaaaaaaacaaaaaacaaaaaaaaucaaaaaaucaa

SEQ ID NO: 530816 - RNA, 64 nt, hsa
uggaaaggcggggaagaaggaugaaaccuuuaaaaacaaaaacaaaaacaucaaugaguaggca

SEQ ID NO: 530817 - RNA, 64 nt, hsa
ggcggggaagaaggaugaaaccuuuaaaaacaaaaacaaaaacaucaaugaguaggcauuuuau

SEQ ID NO: 530818 - RNA, 64 nt, hsa
ugcagucaacaagaaauaccaauaacacacacagaacaaaaaccaucaaaaucucauauaugaa

SEQ ID NO: 530819 - RNA, 64 nt, hsa
aaaagcaguucaaguugacaacagcagaaacaguaacaaaaaaaucugcucagaaaaauguaug

SEQ ID NO: 530820 - RNA, 64 nt, hsa
aaagcuauauaaagaaccaaagguuuagucaagaaacaaaaaucuuaaagauuauuauaaccca

SEQ ID NO: 530821 - RNA, 64 nt, hsa
gauuagacuacacaaaagcuuccuuccaguauuaaacaaaaagaauuaaacauaacuaugaaaa

SEQ ID NO: 530822 - RNA, 64 nt, hsa
caaccugggugacagagugagauuccaucugaaaaacaaaaacaaaaacagaaaacaaacaaac

SEQ ID NO: 530823 - RNA, 64 nt, hsa
gggugacagagugagauuccaucugaaaaacaaaaacaaaaacagaaaacaaacaaacaaaaaa

SEQ ID NO: 530824 - RNA, 64 nt, hsa
ucugaaaaacaaaaacaaaaacagaaaacaaacaaacaaaaaacaaaaaauccccacaacuuug

SEQ ID NO: 530825 - RNA, 64 nt, hsa
aacaaaaacaaaaacagaaaacaaacaaacaaaaaacaaaaaauccccacaacuuugucaaaua

SEQ ID NO: 530826 - RNA, 64 nt, hsa
ccuguuccaccaaaaccuauggaaauuuaaaaaaaacaaaaauaaaaagcaaaacaaaaauccc

SEQ ID NO: 530827 - RNA, 64 nt, hsa
auggaaauuuaaaaaaaacaaaaauaaaaagcaaaacaaaaaucccaaaaugaauuccauucac

SEQ ID NO: 530828 - RNA, 64 nt, hsa
uuuuuuaaauccccucuguuuaaaagguuuguaaaacaaaaacaaaaaacuaagucugcucagu

SEQ ID NO: 530829 - RNA, 64 nt, hsa
aaauccccucuguuuaaaagguuuguaaaacaaaaacaaaaaacuaagucugcucagugaaaug

SEQ ID NO: 530830 - RNA, 64 nt, hsa
agagacaugcacacacaaagaaucaguagggagaaacaaaaauacaagucccguucuguagcuc

SEQ ID NO: 530831 - RNA, 64 nt, hsa
guaaaaaagaaaaauguauauagcugugaguuuaaacaaaaaccacaaacagacaaacaagaaa

SEQ ID NO: 530832 - RNA, 64 nt, hsa
gagccacugcacccggccgguggaaagcauuuuuaacaaaaaauuuuuaggccaggcacagugg

SEQ ID NO: 530833 - RNA, 64 nt, hsa
ugaaccuaccauguugccucccaucuucugaaaaaacaaaaaaauuauaggcaugagccacugc

SEQ ID NO: 530834 - RNA, 64 nt, hsa
cauuagcucuggagugagucugucauaauauuugaacaaaaauugagagcuuuauugcugcauu

SEQ ID NO: 530835 - RNA, 64 nt, hsa
gguggauuagacagguuaaauauauaaacaaacaaacaaaaauugcucaaaaaagaggagaaaa

SEQ ID NO: 530836 - RNA, 64 nt, hsa
uucagcuagagaaguuaacaggaauaaauauaugaacaaaaaagcugcaaggauaaauguggag

SEQ ID NO: 530837 - RNA, 64 nt, hsa
agaugaaaagcgugcaauaugcuuuaaagcuaucaacaaaaacugaauauuauaagcaagcaau

SEQ ID NO: 530838 - RNA, 64 nt, hsa
guaaaacuccgacucuauuuaaaaaaaaaacaaaaacaaaaaaaccuuaaaugucaaaaaaaaa

SEQ ID NO: 530839 - RNA, 64 nt, hsa
aaugugguaaaacuccgacucuauuuaaaaaaaaaacaaaaacaaaaaaaccuuaaaugucaaa

SEQ ID NO: 530840 - RNA, 64 nt, hsa
aacaagugucaaaguuguguguuaaaaaauguuuaacaaaaaaaauguuguaaugacacaaagc

SEQ ID NO: 530841 - RNA, 64 nt, hsa
cacacauagcccuuuucauggauagaccuugaacaacaaaaaggguauaagggaauaaggauga

SEQ ID NO: 530842 - RNA, 64 nt, hsa
ugcagucaagaagaaauaccaauaacacacacagaacaaaaaccaucaaaaucucauauaugaa

SEQ ID NO: 530843 - RNA, 64 nt, hsa; identical to SEQ ID NO: 530819

SEQ ID NO: 530844 - RNA, 64 nt, hsa
guaaaaaauaaaaauguauauagcugugagcucaaacaaaaacugcagacaaacaaaaaagaga

SEQ ID NO: 530845 - RNA, 64 nt, hsa
auauagcugugagcucaaacaaaaacugcagacaaacaaaaaagagaaaagcuuuuauuugugu

SEQ ID NO: 530846 - RNA, 64 nt, hsa; identical to SEQ ID NO: 428416

SEQ ID NO: 530847 - RNA, 64 nt, hsa; identical to SEQ ID NO: 428417

SEQ ID NO: 530848 - RNA, 64 nt, hsa; identical to SEQ ID NO: 428418

SEQ ID NO: 530849 - RNA, 64 nt, hsa; identical to SEQ ID NO: 428419

SEQ ID NO: 530850 - RNA, 64 nt, hsa; identical to SEQ ID NO: 428420

SEQ ID NO: 530851 - RNA, 64 nt, hsa; identical to SEQ ID NO: 428421

SEQ ID NO: 530852 - RNA, 64 nt, hsa; identical to SEQ ID NO: 428422

SEQ ID NO: 530853 - RNA, 64 nt, hsa; identical to SEQ ID NO: 428423

SEQ ID NO: 530854 - RNA, 64 nt, hsa; identical to SEQ ID NO: 428424

SEQ ID NO: 530855 - RNA, 64 nt, hsa; identical to SEQ ID NO: 428425

SEQ ID NO: 530856 - RNA, 64 nt, hsa; identical to SEQ ID NO: 428426

SEQ ID NO: 530857 - RNA, 64 nt, hsa; identical to SEQ ID NO: 428427

SEQ ID NO: 530858 - RNA, 64 nt, hsa; identical to SEQ ID NO: 428428

SEQ ID NO: 530859 - RNA, 64 nt, hsa; identical to SEQ ID NO: 428429

SEQ ID NO: 530860 - RNA, 64 nt, hsa; identical to SEQ ID NO: 428430

SEQ ID NO: 530861 - RNA, 64 nt, hsa; identical to SEQ ID NO: 428431

SEQ ID NO: 530862 - RNA, 64 nt, hsa; identical to SEQ ID NO: 428432

SEQ ID NO: 530863 - RNA, 64 nt, hsa; identical to SEQ ID NO: 428433

SEQ ID NO: 530864 - RNA, 64 nt, hsa; identical to SEQ ID NO: 428434

SEQ ID NO: 530865 - RNA, 64 nt, hsa; identical to SEQ ID NO: 428435

SEQ ID NO: 530866 - RNA, 64 nt, hsa; identical to SEQ ID NO: 428436

SEQ ID NO: 530867 - RNA, 64 nt, hsa; identical to SEQ ID NO: 428437

SEQ ID NO: 530868 - RNA, 64 nt, hsa; identical to SEQ ID NO: 428438

SEQ ID NO: 530869 - RNA, 64 nt, hsa; identical to SEQ ID NO: 428439

SEQ ID NO: 530870 - RNA, 64 nt, hsa; identical to SEQ ID NO: 428440

SEQ ID NO: 530871 - RNA, 64 nt, hsa; identical to SEQ ID NO: 428441

SEQ ID NO: 530872 - RNA, 64 nt, hsa; identical to SEQ ID NO: 428442

SEQ ID NO: 530873 - RNA, 64 nt, hsa; identical to SEQ ID NO: 428443

SEQ ID NO: 530874 - RNA, 64 nt, hsa; identical to SEQ ID NO: 175479

SEQ ID NO: 530875 - RNA, 64 nt, hsa; identical to SEQ ID NO: 175480

SEQ ID NO: 530876 - RNA, 64 nt, hsa; identical to SEQ ID NO: 175481

SEQ ID NO: 530877 - RNA, 64 nt, hsa; identical to SEQ ID NO: 175482

SEQ ID NO: 530878 - RNA, 64 nt, hsa; identical to SEQ ID NO: 175483

SEQ ID NO: 530879 - RNA, 64 nt, hsa; identical to SEQ ID NO: 175484

SEQ ID NO: 530880 - RNA, 64 nt, hsa; identical to SEQ ID NO: 175485

SEQ ID NO: 530881 - RNA, 64 nt, hsa; identical to SEQ ID NO: 175486

SEQ ID NO: 530882 - RNA, 64 nt, hsa; identical to SEQ ID NO: 175487

SEQ ID NO: 530883 - RNA, 64 nt, hsa; identical to SEQ ID NO: 175488

SEQ ID NO: 530884 - RNA, 64 nt, hsa; identical to SEQ ID NO: 175489

SEQ ID NO: 530885 - RNA, 64 nt, hsa; identical to SEQ ID NO: 175490

SEQ ID NO: 530886 - RNA, 64 nt, hsa; identical to SEQ ID NO: 175491

SEQ ID NO: 530887 - RNA, 64 nt, hsa; identical to SEQ ID NO: 175492

SEQ ID NO: 530888 - RNA, 64 nt, hsa; identical to SEQ ID NO: 175493

SEQ ID NO: 530889 - RNA, 64 nt, hsa; identical to SEQ ID NO: 175494

SEQ ID NO: 530890 - RNA, 64 nt, hsa; identical to SEQ ID NO: 175495

SEQ ID NO: 530891 - RNA, 64 nt, hsa; identical to SEQ ID NO: 175496

SEQ ID NO: 530892 - RNA, 64 nt, hsa; identical to SEQ ID NO: 175497

SEQ ID NO: 530893 - RNA, 64 nt, hsa; identical to SEQ ID NO: 175498

SEQ ID NO: 530894 - RNA, 64 nt, hsa; identical to SEQ ID NO: 175499

SEQ ID NO: 530895 - RNA, 64 nt, hsa; identical to SEQ ID NO: 175500

SEQ ID NO: 530896 - RNA, 64 nt, hsa; identical to SEQ ID NO: 175501

SEQ ID NO: 530897 - RNA, 64 nt, hsa; identical to SEQ ID NO: 175502

SEQ ID NO: 530898 - RNA, 64 nt, hsa; identical to SEQ ID NO: 175503

SEQ ID NO: 530899 - RNA, 64 nt, hsa; identical to SEQ ID NO: 175504

SEQ ID NO: 530900 - RNA, 64 nt, hsa; identical to SEQ ID NO: 175505

SEQ ID NO: 530901 - RNA, 64 nt, hsa; identical to SEQ ID NO: 175506

SEQ ID NO: 530902 - RNA, 64 nt, hsa; identical to SEQ ID NO: 175507

SEQ ID NO: 530903 - RNA, 64 nt, hsa; identical to SEQ ID NO: 175508

SEQ ID NO: 530904 - RNA, 64 nt, hsa; identical to SEQ ID NO: 175509

SEQ ID NO: 530905 - RNA, 64 nt, hsa; identical to SEQ ID NO: 175510

SEQ ID NO: 530906 - RNA, 64 nt, hsa; identical to SEQ ID NO: 175511

SEQ ID NO: 530907 - RNA, 64 nt, hsa; identical to SEQ ID NO: 175512

SEQ ID NO: 530908 - RNA, 64 nt, hsa; identical to SEQ ID NO: 175513

SEQ ID NO: 530909 - RNA, 64 nt, hsa; identical to SEQ ID NO: 175514

SEQ ID NO: 530910 - RNA, 64 nt, hsa; identical to SEQ ID NO: 175515

SEQ ID NO: 530911 - RNA, 64 nt, hsa; identical to SEQ ID NO: 175516

SEQ ID NO: 530912 - RNA, 64 nt, hsa; identical to SEQ ID NO: 175517

SEQ ID NO: 530913 - RNA, 64 nt, hsa; identical to SEQ ID NO: 175518

SEQ ID NO: 530914 - RNA, 64 nt, hsa; identical to SEQ ID NO: 175519

SEQ ID NO: 530915 - RNA, 64 nt, hsa; identical to SEQ ID NO: 175520

SEQ ID NO: 530916 - RNA, 64 nt, hsa; identical to SEQ ID NO: 175521

SEQ ID NO: 530917 - RNA, 64 nt, hsa; identical to SEQ ID NO: 175522

SEQ ID NO: 530918 - RNA, 64 nt, hsa; identical to SEQ ID NO: 175523

SEQ ID NO: 530919 - RNA, 64 nt, hsa; identical to SEQ ID NO: 175524

SEQ ID NO: 530920 - RNA, 64 nt, hsa; identical to SEQ ID NO: 175525

SEQ ID NO: 530921 - RNA, 64 nt, hsa; identical to SEQ ID NO: 175526

SEQ ID NO: 530922 - RNA, 64 nt, hsa; identical to SEQ ID NO: 175527

SEQ ID NO: 530923 - RNA, 64 nt, hsa; identical to SEQ ID NO: 175528

SEQ ID NO: 530924 - RNA, 64 nt, hsa; identical to SEQ ID NO: 175529

SEQ ID NO: 530925 - RNA, 64 nt, hsa; identical to SEQ ID NO: 175530

SEQ ID NO: 530926 - RNA, 64 nt, hsa; identical to SEQ ID NO: 175531

SEQ ID NO: 530927 - RNA, 64 nt, hsa; identical to SEQ ID NO: 175532

SEQ ID NO: 530928 - RNA, 64 nt, hsa; identical to SEQ ID NO: 175533

SEQ ID NO: 530929 - RNA, 64 nt, hsa; identical to SEQ ID NO: 175534

SEQ ID NO: 530930 - RNA, 64 nt, hsa; identical to SEQ ID NO: 175535

SEQ ID NO: 530931 - RNA, 64 nt, hsa; identical to SEQ ID NO: 175536

SEQ ID NO: 530932 - RNA, 64 nt, hsa; identical to SEQ ID NO: 175537

SEQ ID NO: 530933 - RNA, 64 nt, hsa; identical to SEQ ID NO: 175538

SEQ ID NO: 530934 - RNA, 53 nt, hsa; identical to SEQ ID NO: 175539

SEQ ID NO: 530935 - RNA, 64 nt, hsa; identical to SEQ ID NO: 175540

SEQ ID NO: 530936 - RNA, 64 nt, hsa; identical to SEQ ID NO: 175541

SEQ ID NO: 530937 - RNA, 64 nt, hsa; identical to SEQ ID NO: 175542

SEQ ID NO: 530938 - RNA, 64 nt, hsa; identical to SEQ ID NO: 175543

SEQ ID NO: 530939 - RNA, 64 nt, hsa; identical to SEQ ID NO: 175544

SEQ ID NO: 530940 - RNA, 64 nt, hsa; identical to SEQ ID NO: 175545

SEQ ID NO: 530941 - RNA, 64 nt, hsa; identical to SEQ ID NO: 175546

SEQ ID NO: 530942 - RNA, 64 nt, hsa; identical to SEQ ID NO: 175547

SEQ ID NO: 530943 - RNA, 64 nt, hsa; identical to SEQ ID NO: 175548

SEQ ID NO: 530944 - RNA, 64 nt, hsa; identical to SEQ ID NO: 175549

SEQ ID NO: 530945 - RNA, 64 nt, hsa; identical to SEQ ID NO: 175550

SEQ ID NO: 530946 - RNA, 64 nt, hsa; identical to SEQ ID NO: 175551

SEQ ID NO: 530947 - RNA, 64 nt, hsa; identical to SEQ ID NO: 175552

SEQ ID NO: 530948 - RNA, 64 nt, hsa; identical to SEQ ID NO: 175553

SEQ ID NO: 530949 - RNA, 64 nt, hsa; identical to SEQ ID NO: 175554

SEQ ID NO: 530950 - RNA, 64 nt, hsa; identical to SEQ ID NO: 175555

SEQ ID NO: 530951 - RNA, 64 nt, hsa; identical to SEQ ID NO: 175556

SEQ ID NO: 530952 - RNA, 64 nt, hsa; identical to SEQ ID NO: 175557

SEQ ID NO: 530953 - RNA, 64 nt, hsa; identical to SEQ ID NO: 175558

SEQ ID NO: 530954 - RNA, 64 nt, hsa; identical to SEQ ID NO: 175559

SEQ ID NO: 530955 - RNA, 64 nt, hsa; identical to SEQ ID NO: 175560

SEQ ID NO: 530956 - RNA, 64 nt, hsa; identical to SEQ ID NO: 175561

SEQ ID NO: 530957 - RNA, 64 nt, hsa; identical to SEQ ID NO: 175562

SEQ ID NO: 530958 - RNA, 64 nt, hsa; identical to SEQ ID NO: 175563

SEQ ID NO: 530959 - RNA, 64 nt, hsa; identical to SEQ ID NO: 175564

SEQ ID NO: 530960 - RNA, 64 nt, hsa; identical to SEQ ID NO: 175565

SEQ ID NO: 530961 - RNA, 64 nt, hsa; identical to SEQ ID NO: 175566

SEQ ID NO: 530962 - RNA, 64 nt, hsa; identical to SEQ ID NO: 95478

SEQ ID NO: 530963 - RNA, 64 nt, hsa; identical to SEQ ID NO: 95479

SEQ ID NO: 530964 - RNA, 64 nt, hsa; identical to SEQ ID NO: 95480

SEQ ID NO: 530965 - RNA, 64 nt, hsa; identical to SEQ ID NO: 95481

SEQ ID NO: 530966 - RNA, 64 nt, hsa; identical to SEQ ID NO: 95482

SEQ ID NO: 530967 - RNA, 64 nt, hsa; identical to SEQ ID NO: 95483

SEQ ID NO: 530968 - RNA, 64 nt, hsa; identical to SEQ ID NO: 95484

SEQ ID NO: 530969 - RNA, 64 nt, hsa; identical to SEQ ID NO: 95485

SEQ ID NO: 530970 - RNA, 64 nt, hsa; identical to SEQ ID NO: 95486

SEQ ID NO: 530971 - RNA, 64 nt, hsa; identical to SEQ ID NO: 95487

SEQ ID NO: 530972 - RNA, 64 nt, hsa; identical to SEQ ID NO: 95488

SEQ ID NO: 530973 - RNA, 64 nt, hsa; identical to SEQ ID NO: 95489

SEQ ID NO: 530974 - RNA, 64 nt, hsa; identical to SEQ ID NO: 95490

SEQ ID NO: 530975 - RNA, 64 nt, hsa; identical to SEQ ID NO: 95491

SEQ ID NO: 530976 - RNA, 64 nt, hsa; identical to SEQ ID NO: 95492

SEQ ID NO: 530977 - RNA, 64 nt, hsa; identical to SEQ ID NO: 95493

SEQ ID NO: 530978 - RNA, 64 nt, hsa; identical to SEQ ID NO: 95494

SEQ ID NO: 530979 - RNA, 64 nt, hsa; identical to SEQ ID NO: 95495

SEQ ID NO: 530980 - RNA, 64 nt, hsa; identical to SEQ ID NO: 95496

SEQ ID NO: 530981 - RNA, 64 nt, hsa; identical to SEQ ID NO: 95497

SEQ ID NO: 530982 - RNA, 64 nt, hsa; identical to SEQ ID NO: 95498

SEQ ID NO: 530983 - RNA, 64 nt, hsa; identical to SEQ ID NO: 95499

SEQ ID NO: 530984 - RNA, 64 nt, hsa; identical to SEQ ID NO: 95500

SEQ ID NO: 530985 - RNA, 64 nt, hsa; identical to SEQ ID NO: 95501

SEQ ID NO: 530986 - RNA, 64 nt, hsa; identical to SEQ ID NO: 95502

SEQ ID NO: 530987 - RNA, 64 nt, hsa; identical to SEQ ID NO: 95503

SEQ ID NO: 530988 - RNA, 64 nt, hsa; identical to SEQ ID NO: 95504

SEQ ID NO: 530989 - RNA, 64 nt, hsa; identical to SEQ ID NO: 95505

SEQ ID NO: 530990 - RNA, 64 nt, hsa; identical to SEQ ID NO: 95506

SEQ ID NO: 530991 - RNA, 64 nt, hsa; identical to SEQ ID NO: 95507

SEQ ID NO: 530992 - RNA, 64 nt, hsa; identical to SEQ ID NO: 95508

SEQ ID NO: 530993 - RNA, 64 nt, hsa; identical to SEQ ID NO: 95509

SEQ ID NO: 530994 - RNA, 64 nt, hsa; identical to SEQ ID NO: 95510

SEQ ID NO: 530995 - RNA, 64 nt, hsa; identical to SEQ ID NO: 95511

SEQ ID NO: 530996 - RNA, 64 nt, hsa; identical to SEQ ID NO: 95512

SEQ ID NO: 530997 - RNA, 64 nt, hsa; identical to SEQ ID NO: 95513

SEQ ID NO: 530998 - RNA, 64 nt, hsa; identical to SEQ ID NO: 95514

SEQ ID NO: 530999 - RNA, 64 nt, hsa; identical to SEQ ID NO: 95515

SEQ ID NO: 531000 - RNA, 64 nt, hsa; identical to SEQ ID NO: 95516

SEQ ID NO: 531001 - RNA, 64 nt, hsa; identical to SEQ ID NO: 95517

SEQ ID NO: 531002 - RNA, 64 nt, hsa; identical to SEQ ID NO: 95518

SEQ ID NO: 531003 - RNA, 64 nt, hsa; identical to SEQ ID NO: 95519

SEQ ID NO: 531004 - RNA, 64 nt, hsa; identical to SEQ ID NO: 95520

SEQ ID NO: 531005 - RNA, 64 nt, hsa; identical to SEQ ID NO: 95521

SEQ ID NO: 531006 - RNA, 64 nt, hsa; identical to SEQ ID NO: 95522

SEQ ID NO: 531007 - RNA, 64 nt, hsa; identical to SEQ ID NO: 95523

SEQ ID NO: 531008 - RNA, 64 nt, hsa; identical to SEQ ID NO: 95524

SEQ ID NO: 531009 - RNA, 64 nt, hsa; identical to SEQ ID NO: 95525

SEQ ID NO: 531010 - RNA, 64 nt, hsa; identical to SEQ ID NO: 277303

SEQ ID NO: 531011 - RNA, 64 nt, hsa; identical to SEQ ID NO: 277304

SEQ ID NO: 531012 - RNA, 64 nt, hsa; identical to SEQ ID NO: 277305

SEQ ID NO: 531013 - RNA, 64 nt, hsa; identical to SEQ ID NO: 277306

SEQ ID NO: 531014 - RNA, 64 nt, hsa; identical to SEQ ID NO: 277307

SEQ ID NO: 531015 - RNA, 64 nt, hsa; identical to SEQ ID NO: 277308

SEQ ID NO: 531016 - RNA, 64 nt, hsa; identical to SEQ ID NO: 277309

SEQ ID NO: 531017 - RNA, 64 nt, hsa; identical to SEQ ID NO: 277310

SEQ ID NO: 531018 - RNA, 64 nt, hsa; identical to SEQ ID NO: 277311

SEQ ID NO: 531019 - RNA, 64 nt, hsa; identical to SEQ ID NO: 277312

SEQ ID NO: 531020 - RNA, 64 nt, hsa; identical to SEQ ID NO: 277313

SEQ ID NO: 531021 - RNA, 64 nt, hsa; identical to SEQ ID NO: 277314

SEQ ID NO: 531022 - RNA, 64 nt, hsa; identical to SEQ ID NO: 277315

SEQ ID NO: 531023 - RNA, 64 nt, hsa; identical to SEQ ID NO: 277316

SEQ ID NO: 531024 - RNA, 64 nt, hsa; identical to SEQ ID NO: 277317

SEQ ID NO: 531025 - RNA, 64 nt, hsa; identical to SEQ ID NO: 277318

SEQ ID NO: 531026 - RNA, 64 nt, hsa; identical to SEQ ID NO: 277319

SEQ ID NO: 531027 - RNA, 64 nt, hsa; identical to SEQ ID NO: 277320

SEQ ID NO: 531028 - RNA, 64 nt, hsa; identical to SEQ ID NO: 277321

SEQ ID NO: 531029 - RNA, 64 nt, hsa; identical to SEQ ID NO: 277322

SEQ ID NO: 531030 - RNA, 62 nt, hsa; identical to SEQ ID NO: 277323

SEQ ID NO: 531031 - RNA, 64 nt, hsa; identical to SEQ ID NO: 277324

SEQ ID NO: 531032 - RNA, 64 nt, hsa; identical to SEQ ID NO: 277325

SEQ ID NO: 531033 - RNA, 64 nt, hsa; identical to SEQ ID NO: 277326

SEQ ID NO: 531034 - RNA, 64 nt, hsa; identical to SEQ ID NO: 277327

SEQ ID NO: 531035 - RNA, 64 nt, hsa; identical to SEQ ID NO: 277328

SEQ ID NO: 531036 - RNA, 64 nt, hsa; identical to SEQ ID NO: 277329

SEQ ID NO: 531037 - RNA, 64 nt, hsa; identical to SEQ ID NO: 277330

SEQ ID NO: 531038 - RNA, 64 nt, hsa; identical to SEQ ID NO: 277331

SEQ ID NO: 531039 - RNA, 64 nt, hsa; identical to SEQ ID NO: 277332

SEQ ID NO: 531040 - RNA, 64 nt, hsa; identical to SEQ ID NO: 98595

SEQ ID NO: 531041 - RNA, 64 nt, hsa; identical to SEQ ID NO: 98596

SEQ ID NO: 531042 - RNA, 64 nt, hsa; identical to SEQ ID NO: 98597

SEQ ID NO: 531043 - RNA, 64 nt, hsa; identical to SEQ ID NO: 98598

SEQ ID NO: 531044 - RNA, 64 nt, hsa; identical to SEQ ID NO: 98599

SEQ ID NO: 531045 - RNA, 64 nt, hsa; identical to SEQ ID NO: 98600

SEQ ID NO: 531046 - RNA, 64 nt, hsa; identical to SEQ ID NO: 98601

SEQ ID NO: 531047 - RNA, 64 nt, hsa; identical to SEQ ID NO: 98602

SEQ ID NO: 531048 - RNA, 64 nt, hsa; identical to SEQ ID NO: 98603

SEQ ID NO: 531049 - RNA, 64 nt, hsa; identical to SEQ ID NO: 98604

SEQ ID NO: 531050 - RNA, 64 nt, hsa; identical to SEQ ID NO: 98605

SEQ ID NO: 531051 - RNA, 64 nt, hsa; identical to SEQ ID NO: 98606

SEQ ID NO: 531052 - RNA, 64 nt, hsa; identical to SEQ ID NO: 98607

SEQ ID NO: 531053 - RNA, 64 nt, hsa; identical to SEQ ID NO: 98608

SEQ ID NO: 531054 - RNA, 64 nt, hsa; identical to SEQ ID NO: 98609

SEQ ID NO: 531055 - RNA, 64 nt, hsa; identical to SEQ ID NO: 98610

SEQ ID NO: 531056 - RNA, 64 nt, hsa; identical to SEQ ID NO: 98611

SEQ ID NO: 531057 - RNA, 64 nt, hsa; identical to SEQ ID NO: 98612

SEQ ID NO: 531058 - RNA, 64 nt, hsa; identical to SEQ ID NO: 98613

SEQ ID NO: 531059 - RNA, 64 nt, hsa; identical to SEQ ID NO: 98614

SEQ ID NO: 531060 - RNA, 64 nt, hsa; identical to SEQ ID NO: 98615

SEQ ID NO: 531061 - RNA, 57 nt, hsa; identical to SEQ ID NO: 98616

SEQ ID NO: 531062 - RNA, 64 nt, hsa; identical to SEQ ID NO: 98617

SEQ ID NO: 531063 - RNA, 64 nt, hsa; identical to SEQ ID NO: 98618

SEQ ID NO: 531064 - RNA, 64 nt, hsa; identical to SEQ ID NO: 98619

SEQ ID NO: 531065 - RNA, 64 nt, hsa; identical to SEQ ID NO: 98620

SEQ ID NO: 531066 - RNA, 64 nt, hsa; identical to SEQ ID NO: 98621

SEQ ID NO: 531067 - RNA, 64 nt, hsa; identical to SEQ ID NO: 98622

SEQ ID NO: 531068 - RNA, 64 nt, hsa; identical to SEQ ID NO: 98623

SEQ ID NO: 531069 - RNA, 64 nt, hsa; identical to SEQ ID NO: 98624

SEQ ID NO: 531070 - RNA, 64 nt, hsa; identical to SEQ ID NO: 98625

SEQ ID NO: 531071 - RNA, 64 nt, hsa; identical to SEQ ID NO: 98626

SEQ ID NO: 531072 - RNA, 64 nt, hsa; identical to SEQ ID NO: 98627

SEQ ID NO: 531073 - RNA, 64 nt, hsa; identical to SEQ ID NO: 98628

SEQ ID NO: 531074 - RNA, 64 nt, hsa; identical to SEQ ID NO: 98629

SEQ ID NO: 531075 - RNA, 64 nt, hsa; identical to SEQ ID NO: 98630

SEQ ID NO: 531076 - RNA, 64 nt, hsa; identical to SEQ ID NO: 98631

SEQ ID NO: 531077 - RNA, 64 nt, hsa; identical to SEQ ID NO: 98632

SEQ ID NO: 531078 - RNA, 64 nt, hsa; identical to SEQ ID NO: 98633

SEQ ID NO: 531079 - RNA, 64 nt, hsa; identical to SEQ ID NO: 98634

SEQ ID NO: 531080 - RNA, 64 nt, hsa; identical to SEQ ID NO: 98635

SEQ ID NO: 531081 - RNA, 64 nt, hsa; identical to SEQ ID NO: 98636

SEQ ID NO: 531082 - RNA, 64 nt, hsa; identical to SEQ ID NO: 98637

SEQ ID NO: 531083 - RNA, 64 nt, hsa; identical to SEQ ID NO: 98638

SEQ ID NO: 531084 - RNA, 64 nt, hsa; identical to SEQ ID NO: 98639

SEQ ID NO: 531085 - RNA, 64 nt, hsa; identical to SEQ ID NO: 98640

SEQ ID NO: 531086 - RNA, 64 nt, hsa; identical to SEQ ID NO: 98641

SEQ ID NO: 531087 - RNA, 64 nt, hsa; identical to SEQ ID NO: 98642

SEQ ID NO: 531088 - RNA, 64 nt, hsa; identical to SEQ ID NO: 98643

SEQ ID NO: 531089 - RNA, 64 nt, hsa; identical to SEQ ID NO: 98644

SEQ ID NO: 531090 - RNA, 64 nt, hsa; identical to SEQ ID NO: 98645

SEQ ID NO: 531091 - RNA, 64 nt, hsa; identical to SEQ ID NO: 98646

SEQ ID NO: 531092 - RNA, 64 nt, hsa; identical to SEQ ID NO: 98647

SEQ ID NO: 531093 - RNA, 64 nt, hsa; identical to SEQ ID NO: 98648

SEQ ID NO: 531094 - RNA, 64 nt, hsa; identical to SEQ ID NO: 98649

SEQ ID NO: 531095 - RNA, 64 nt, hsa; identical to SEQ ID NO: 98650

SEQ ID NO: 531096 - RNA, 64 nt, hsa; identical to SEQ ID NO: 98651

SEQ ID NO: 531097 - RNA, 64 nt, hsa; identical to SEQ ID NO: 98652

SEQ ID NO: 531098 - RNA, 64 nt, hsa; identical to SEQ ID NO: 98653

SEQ ID NO: 531099 - RNA, 64 nt, hsa; identical to SEQ ID NO: 98654

SEQ ID NO: 531100 - RNA, 64 nt, hsa; identical to SEQ ID NO: 98655

SEQ ID NO: 531101 - RNA, 64 nt, hsa; identical to SEQ ID NO: 98656

SEQ ID NO: 531102 - RNA, 64 nt, hsa; identical to SEQ ID NO: 98657

SEQ ID NO: 531103 - RNA, 64 nt, hsa; identical to SEQ ID NO: 98658

SEQ ID NO: 531104 - RNA, 64 nt, hsa; identical to SEQ ID NO: 98659

SEQ ID NO: 531105 - RNA, 64 nt, hsa; identical to SEQ ID NO: 98660

SEQ ID NO: 531106 - RNA, 64 nt, hsa; identical to SEQ ID NO: 98661

SEQ ID NO: 531107 - RNA, 64 nt, hsa; identical to SEQ ID NO: 98662

SEQ ID NO: 531108 - RNA, 64 nt, hsa; identical to SEQ ID NO: 98663

SEQ ID NO: 531109 - RNA, 64 nt, hsa; identical to SEQ ID NO: 98664

SEQ ID NO: 531110 - RNA, 64 nt, hsa; identical to SEQ ID NO: 98665

SEQ ID NO: 531111 - RNA, 64 nt, hsa; identical to SEQ ID NO: 98666

SEQ ID NO: 531112 - RNA, 64 nt, hsa; identical to SEQ ID NO: 98667

SEQ ID NO: 531113 - RNA, 64 nt, hsa; identical to SEQ ID NO: 98668

SEQ ID NO: 531114 - RNA, 64 nt, hsa; identical to SEQ ID NO: 98669

SEQ ID NO: 531115 - RNA, 64 nt, hsa; identical to SEQ ID NO: 98670

SEQ ID NO: 531116 - RNA, 64 nt, hsa; identical to SEQ ID NO: 98671

SEQ ID NO: 531117 - RNA, 64 nt, hsa; identical to SEQ ID NO: 156691

SEQ ID NO: 531118 - RNA, 64 nt, hsa; identical to SEQ ID NO: 156692

SEQ ID NO: 531119 - RNA, 64 nt, hsa; identical to SEQ ID NO: 156693

SEQ ID NO: 531120 - RNA, 64 nt, hsa; identical to SEQ ID NO: 156694

SEQ ID NO: 531121 - RNA, 64 nt, hsa; identical to SEQ ID NO: 156695

SEQ ID NO: 531122 - RNA, 64 nt, hsa; identical to SEQ ID NO: 156696

SEQ ID NO: 531123 - RNA, 64 nt, hsa; identical to SEQ ID NO: 156697

SEQ ID NO: 531124 - RNA, 64 nt, hsa; identical to SEQ ID NO: 156698

SEQ ID NO: 531125 - RNA, 64 nt, hsa; identical to SEQ ID NO: 156699

SEQ ID NO: 531126 - RNA, 64 nt, hsa; identical to SEQ ID NO: 156700

SEQ ID NO: 531127 - RNA, 64 nt, hsa; identical to SEQ ID NO: 156701

SEQ ID NO: 531128 - RNA, 64 nt, hsa; identical to SEQ ID NO: 156702

SEQ ID NO: 531129 - RNA, 64 nt, hsa; identical to SEQ ID NO: 156703

SEQ ID NO: 531130 - RNA, 64 nt, hsa; identical to SEQ ID NO: 156704

SEQ ID NO: 531131 - RNA, 64 nt, hsa; identical to SEQ ID NO: 156705

SEQ ID NO: 531132 - RNA, 64 nt, hsa; identical to SEQ ID NO: 156706

SEQ ID NO: 531133 - RNA, 64 nt, hsa; identical to SEQ ID NO: 156707

SEQ ID NO: 531134 - RNA, 64 nt, hsa; identical to SEQ ID NO: 156708

SEQ ID NO: 531135 - RNA, 64 nt, hsa; identical to SEQ ID NO: 156709

SEQ ID NO: 531136 - RNA, 64 nt, hsa; identical to SEQ ID NO: 156710

SEQ ID NO: 531137 - RNA, 64 nt, hsa; identical to SEQ ID NO: 156711

SEQ ID NO: 531138 - RNA, 64 nt, hsa; identical to SEQ ID NO: 156712

SEQ ID NO: 531139 - RNA, 64 nt, hsa; identical to SEQ ID NO: 156713

SEQ ID NO: 531140 - RNA, 64 nt, hsa; identical to SEQ ID NO: 156714

SEQ ID NO: 531141 - RNA, 64 nt, hsa; identical to SEQ ID NO: 156715

SEQ ID NO: 531142 - RNA, 64 nt, hsa; identical to SEQ ID NO: 156716

SEQ ID NO: 531143 - RNA, 64 nt, hsa; identical to SEQ ID NO: 156717

SEQ ID NO: 531144 - RNA, 64 nt, hsa; identical to SEQ ID NO: 156718

SEQ ID NO: 531145 - RNA, 64 nt, hsa; identical to SEQ ID NO: 156719

SEQ ID NO: 531146 - RNA, 64 nt, hsa; identical to SEQ ID NO: 156720

SEQ ID NO: 531147 - RNA, 64 nt, hsa; identical to SEQ ID NO: 156721

SEQ ID NO: 531148 - RNA, 64 nt, hsa; identical to SEQ ID NO: 156722

SEQ ID NO: 531149 - RNA, 64 nt, hsa; identical to SEQ ID NO: 156723

SEQ ID NO: 531150 - RNA, 50 nt, hsa; identical to SEQ ID NO: 156724

SEQ ID NO: 531151 - RNA, 64 nt, hsa; identical to SEQ ID NO: 156725

SEQ ID NO: 531152 - RNA, 64 nt, hsa; identical to SEQ ID NO: 156726

SEQ ID NO: 531153 - RNA, 64 nt, hsa; identical to SEQ ID NO: 156727

SEQ ID NO: 531154 - RNA, 64 nt, hsa; identical to SEQ ID NO: 156728

SEQ ID NO: 531155 - RNA, 64 nt, hsa; identical to SEQ ID NO: 156729

SEQ ID NO: 531156 - RNA, 64 nt, hsa; identical to SEQ ID NO: 156730

SEQ ID NO: 531157 - RNA, 64 nt, hsa; identical to SEQ ID NO: 156731

SEQ ID NO: 531158 - RNA, 64 nt, hsa; identical to SEQ ID NO: 156732

SEQ ID NO: 531159 - RNA, 64 nt, hsa; identical to SEQ ID NO: 156733

SEQ ID NO: 531160 - RNA, 64 nt, hsa; identical to SEQ ID NO: 156734

SEQ ID NO: 531161 - RNA, 64 nt, hsa; identical to SEQ ID NO: 156735

SEQ ID NO: 531162 - RNA, 64 nt, hsa; identical to SEQ ID NO: 156736

SEQ ID NO: 531163 - RNA, 64 nt, hsa; identical to SEQ ID NO: 156737

SEQ ID NO: 531164 - RNA, 64 nt, hsa; identical to SEQ ID NO: 156738

SEQ ID NO: 531165 - RNA, 64 nt, hsa; identical to SEQ ID NO: 156991

SEQ ID NO: 531166 - RNA, 64 nt, hsa; identical to SEQ ID NO: 156992

SEQ ID NO: 531167 - RNA, 64 nt, hsa; identical to SEQ ID NO: 156993

SEQ ID NO: 531168 - RNA, 64 nt, hsa; identical to SEQ ID NO: 156994

SEQ ID NO: 531169 - RNA, 64 nt, hsa; identical to SEQ ID NO: 156995

SEQ ID NO: 531170 - RNA, 64 nt, hsa; identical to SEQ ID NO: 156996

SEQ ID NO: 531171 - RNA, 64 nt, hsa; identical to SEQ ID NO: 156997

SEQ ID NO: 531172 - RNA, 64 nt, hsa; identical to SEQ ID NO: 156998

SEQ ID NO: 531173 - RNA, 64 nt, hsa; identical to SEQ ID NO: 156999

SEQ ID NO: 531174 - RNA, 64 nt, hsa; identical to SEQ ID NO: 157000

SEQ ID NO: 531175 - RNA, 64 nt, hsa; identical to SEQ ID NO: 157001

SEQ ID NO: 531176 - RNA, 64 nt, hsa; identical to SEQ ID NO: 157002

SEQ ID NO: 531177 - RNA, 64 nt, hsa; identical to SEQ ID NO: 157003

SEQ ID NO: 531178 - RNA, 64 nt, hsa; identical to SEQ ID NO: 157004

SEQ ID NO: 531179 - RNA, 64 nt, hsa; identical to SEQ ID NO: 157005

SEQ ID NO: 531180 - RNA, 64 nt, hsa; identical to SEQ ID NO: 157006

SEQ ID NO: 531181 - RNA, 64 nt, hsa; identical to SEQ ID NO: 157007

SEQ ID NO: 531182 - RNA, 64 nt, hsa; identical to SEQ ID NO: 157008

SEQ ID NO: 531183 - RNA, 64 nt, hsa; identical to SEQ ID NO: 157009

SEQ ID NO: 531184 - RNA, 64 nt, hsa; identical to SEQ ID NO: 157010

SEQ ID NO: 531185 - RNA, 64 nt, hsa; identical to SEQ ID NO: 157011

SEQ ID NO: 531186 - RNA, 64 nt, hsa; identical to SEQ ID NO: 157012

SEQ ID NO: 531187 - RNA, 64 nt, hsa; identical to SEQ ID NO: 157013

SEQ ID NO: 531188 - RNA, 64 nt, hsa; identical to SEQ ID NO: 157014

SEQ ID NO: 531189 - RNA, 64 nt, hsa; identical to SEQ ID NO: 157015

SEQ ID NO: 531190 - RNA, 64 nt, hsa; identical to SEQ ID NO: 157016

SEQ ID NO: 531191 - RNA, 64 nt, hsa; identical to SEQ ID NO: 157017

SEQ ID NO: 531192 - RNA, 64 nt, hsa; identical to SEQ ID NO: 157018

SEQ ID NO: 531193 - RNA, 64 nt, hsa; identical to SEQ ID NO: 157019

SEQ ID NO: 531194 - RNA, 64 nt, hsa; identical to SEQ ID NO: 157020

SEQ ID NO: 531195 - RNA, 64 nt, hsa; identical to SEQ ID NO: 157021

SEQ ID NO: 531196 - RNA, 64 nt, hsa; identical to SEQ ID NO: 157022

SEQ ID NO: 531197 - RNA, 64 nt, hsa; identical to SEQ ID NO: 157023

SEQ ID NO: 531198 - RNA, 64 nt, hsa; identical to SEQ ID NO: 157024

SEQ ID NO: 531199 - RNA, 64 nt, hsa; identical to SEQ ID NO: 157025

SEQ ID NO: 531200 - RNA, 64 nt, hsa; identical to SEQ ID NO: 157026

SEQ ID NO: 531201 - RNA, 64 nt, hsa; identical to SEQ ID NO: 157027

SEQ ID NO: 531202 - RNA, 64 nt, hsa; identical to SEQ ID NO: 157028

SEQ ID NO: 531203 - RNA, 64 nt, hsa; identical to SEQ ID NO: 157029

SEQ ID NO: 531204 - RNA, 64 nt, hsa; identical to SEQ ID NO: 157030

SEQ ID NO: 531205 - RNA, 64 nt, hsa; identical to SEQ ID NO: 157031

SEQ ID NO: 531206 - RNA, 64 nt, hsa; identical to SEQ ID NO: 157032

SEQ ID NO: 531207 - RNA, 64 nt, hsa; identical to SEQ ID NO: 157033

SEQ ID NO: 531208 - RNA, 64 nt, hsa; identical to SEQ ID NO: 157034

SEQ ID NO: 531209 - RNA, 64 nt, hsa; identical to SEQ ID NO: 157035

SEQ ID NO: 531210 - RNA, 64 nt, hsa; identical to SEQ ID NO: 157036

SEQ ID NO: 531211 - RNA, 64 nt, hsa; identical to SEQ ID NO: 157037

SEQ ID NO: 531212 - RNA, 64 nt, hsa; identical to SEQ ID NO: 157038

SEQ ID NO: 531213 - RNA, 64 nt, hsa; identical to SEQ ID NO: 157039

SEQ ID NO: 531214 - RNA, 64 nt, hsa; identical to SEQ ID NO: 157040

SEQ ID NO: 531215 - RNA, 64 nt, hsa; identical to SEQ ID NO: 157041

SEQ ID NO: 531216 - RNA, 64 nt, hsa; identical to SEQ ID NO: 157042

SEQ ID NO: 531217 - RNA, 64 nt, hsa; identical to SEQ ID NO: 157043

SEQ ID NO: 531218 - RNA, 64 nt, hsa; identical to SEQ ID NO: 157044

SEQ ID NO: 531219 - RNA, 64 nt, hsa; identical to SEQ ID NO: 157045

SEQ ID NO: 531220 - RNA, 64 nt, hsa; identical to SEQ ID NO: 157046

SEQ ID NO: 531221 - RNA, 64 nt, hsa; identical to SEQ ID NO: 157047

SEQ ID NO: 531222 - RNA, 64 nt, hsa; identical to SEQ ID NO: 157048

SEQ ID NO: 531223 - RNA, 64 nt, hsa; identical to SEQ ID NO: 157049

SEQ ID NO: 531224 - RNA, 64 nt, hsa; identical to SEQ ID NO: 157050

SEQ ID NO: 531225 - RNA, 64 nt, hsa; identical to SEQ ID NO: 157051

SEQ ID NO: 531226 - RNA, 64 nt, hsa; identical to SEQ ID NO: 157052

SEQ ID NO: 531227 - RNA, 64 nt, hsa; identical to SEQ ID NO: 157053

SEQ ID NO: 531228 - RNA, 64 nt, hsa; identical to SEQ ID NO: 157054

SEQ ID NO: 531229 - RNA, 64 nt, hsa; identical to SEQ ID NO: 157055

SEQ ID NO: 531230 - RNA, 64 nt, hsa; identical to SEQ ID NO: 157056

SEQ ID NO: 531231 - RNA, 64 nt, hsa; identical to SEQ ID NO: 157057

SEQ ID NO: 531232 - RNA, 64 nt, hsa; identical to SEQ ID NO: 157058

SEQ ID NO: 531233 - RNA, 64 nt, hsa; identical to SEQ ID NO: 157059

SEQ ID NO: 531234 - RNA, 64 nt, hsa; identical to SEQ ID NO: 157060

SEQ ID NO: 531235 - RNA, 64 nt, hsa; identical to SEQ ID NO: 157061

SEQ ID NO: 531236 - RNA, 64 nt, hsa; identical to SEQ ID NO: 157062

SEQ ID NO: 531237 - RNA, 64 nt, hsa; identical to SEQ ID NO: 157063

SEQ ID NO: 531238 - RNA, 64 nt, hsa; identical to SEQ ID NO: 157064

SEQ ID NO: 531239 - RNA, 64 nt, hsa; identical to SEQ ID NO: 157065

SEQ ID NO: 531240 - RNA, 64 nt, hsa; identical to SEQ ID NO: 157066

SEQ ID NO: 531241 - RNA, 64 nt, hsa; identical to SEQ ID NO: 157067

SEQ ID NO: 531242 - RNA, 64 nt, hsa; identical to SEQ ID NO: 157068

SEQ ID NO: 531243 - RNA, 64 nt, hsa; identical to SEQ ID NO: 157069

SEQ ID NO: 531244 - RNA, 64 nt, hsa; identical to SEQ ID NO: 157070

SEQ ID NO: 531245 - RNA, 64 nt, hsa; identical to SEQ ID NO: 157071

SEQ ID NO: 531246 - RNA, 64 nt, hsa; identical to SEQ ID NO: 157072

SEQ ID NO: 531247 - RNA, 64 nt, hsa; identical to SEQ ID NO: 157073

SEQ ID NO: 531248 - RNA, 64 nt, hsa; identical to SEQ ID NO: 157074

SEQ ID NO: 531249 - RNA, 64 nt, hsa; identical to SEQ ID NO: 157075

SEQ ID NO: 531250 - RNA, 64 nt, hsa; identical to SEQ ID NO: 157076

SEQ ID NO: 531251 - RNA, 64 nt, hsa; identical to SEQ ID NO: 157077

SEQ ID NO: 531252 - RNA, 64 nt, hsa; identical to SEQ ID NO: 157078

SEQ ID NO: 531253 - RNA, 64 nt, hsa; identical to SEQ ID NO: 157079

SEQ ID NO: 531254 - RNA, 64 nt, hsa; identical to SEQ ID NO: 157080

SEQ ID NO: 531255 - RNA, 64 nt, hsa; identical to SEQ ID NO: 157081

SEQ ID NO: 531256 - RNA, 64 nt, hsa; identical to SEQ ID NO: 157082

SEQ ID NO: 531257 - RNA, 64 nt, hsa; identical to SEQ ID NO: 157083

SEQ ID NO: 531258 - RNA, 64 nt, hsa; identical to SEQ ID NO: 157084

SEQ ID NO: 531259 - RNA, 64 nt, hsa; identical to SEQ ID NO: 157085

SEQ ID NO: 531260 - RNA, 64 nt, hsa; identical to SEQ ID NO: 157086

SEQ ID NO: 531261 - RNA, 64 nt, hsa; identical to SEQ ID NO: 157087

SEQ ID NO: 531262 - RNA, 64 nt, hsa; identical to SEQ ID NO: 157088

SEQ ID NO: 531263 - RNA, 64 nt, hsa; identical to SEQ ID NO: 157089

SEQ ID NO: 531264 - RNA, 64 nt, hsa; identical to SEQ ID NO: 157090

SEQ ID NO: 531265 - RNA, 64 nt, hsa; identical to SEQ ID NO: 157091

SEQ ID NO: 531266 - RNA, 64 nt, hsa; identical to SEQ ID NO: 157092

SEQ ID NO: 531267 - RNA, 64 nt, hsa; identical to SEQ ID NO: 157093

SEQ ID NO: 531268 - RNA, 64 nt, hsa; identical to SEQ ID NO: 157094

SEQ ID NO: 531269 - RNA, 64 nt, hsa; identical to SEQ ID NO: 157095

SEQ ID NO: 531270 - RNA, 64 nt, hsa; identical to SEQ ID NO: 157096

SEQ ID NO: 531271 - RNA, 64 nt, hsa; identical to SEQ ID NO: 157097

SEQ ID NO: 531272 - RNA, 64 nt, hsa; identical to SEQ ID NO: 157098

SEQ ID NO: 531273 - RNA, 64 nt, hsa; identical to SEQ ID NO: 157099

SEQ ID NO: 531274 - RNA, 64 nt, hsa; identical to SEQ ID NO: 157100

SEQ ID NO: 531275 - RNA, 64 nt, hsa; identical to SEQ ID NO: 157101

SEQ ID NO: 531276 - RNA, 64 nt, hsa; identical to SEQ ID NO: 157102

SEQ ID NO: 531277 - RNA, 64 nt, hsa; identical to SEQ ID NO: 157103

SEQ ID NO: 531278 - RNA, 64 nt, hsa; identical to SEQ ID NO: 157104

SEQ ID NO: 531279 - RNA, 64 nt, hsa; identical to SEQ ID NO: 157105

SEQ ID NO: 531280 - RNA, 64 nt, hsa; identical to SEQ ID NO: 157106

SEQ ID NO: 531281 - RNA, 64 nt, hsa; identical to SEQ ID NO: 157107

SEQ ID NO: 531282 - RNA, 64 nt, hsa; identical to SEQ ID NO: 157108

SEQ ID NO: 531283 - RNA, 64 nt, hsa; identical to SEQ ID NO: 157109

SEQ ID NO: 531284 - RNA, 64 nt, hsa; identical to SEQ ID NO: 157110

SEQ ID NO: 531285 - RNA, 64 nt, hsa; identical to SEQ ID NO: 157111

SEQ ID NO: 531286 - RNA, 64 nt, hsa; identical to SEQ ID NO: 157112

SEQ ID NO: 531287 - RNA, 64 nt, hsa; identical to SEQ ID NO: 157113

SEQ ID NO: 531288 - RNA, 64 nt, hsa; identical to SEQ ID NO: 157114

SEQ ID NO: 531289 - RNA, 64 nt, hsa; identical to SEQ ID NO: 157115

SEQ ID NO: 531290 - RNA, 64 nt, hsa; identical to SEQ ID NO: 157116

SEQ ID NO: 531291 - RNA, 64 nt, hsa; identical to SEQ ID NO: 157117

SEQ ID NO: 531292 - RNA, 64 nt, hsa; identical to SEQ ID NO: 157118

SEQ ID NO: 531293 - RNA, 64 nt, hsa; identical to SEQ ID NO: 157119

SEQ ID NO: 531294 - RNA, 64 nt, hsa; identical to SEQ ID NO: 157120

SEQ ID NO: 531295 - RNA, 50 nt, hsa; identical to SEQ ID NO: 157121

SEQ ID NO: 531296 - RNA, 52 nt, hsa; identical to SEQ ID NO: 157122

SEQ ID NO: 531297 - RNA, 54 nt, hsa; identical to SEQ ID NO: 157123

SEQ ID NO: 531298 - RNA, 56 nt, hsa; identical to SEQ ID NO: 157124

SEQ ID NO: 531299 - RNA, 58 nt, hsa; identical to SEQ ID NO: 157125

SEQ ID NO: 531300 - RNA, 60 nt, hsa; identical to SEQ ID NO: 157126

SEQ ID NO: 531301 - RNA, 62 nt, hsa; identical to SEQ ID NO: 157127

SEQ ID NO: 531302 - RNA, 64 nt, hsa; identical to SEQ ID NO: 157128

SEQ ID NO: 531303 - RNA, 64 nt, hsa; identical to SEQ ID NO: 157129

SEQ ID NO: 531304 - RNA, 64 nt, hsa; identical to SEQ ID NO: 157130

SEQ ID NO: 531305 - RNA, 64 nt, hsa; identical to SEQ ID NO: 157131

SEQ ID NO: 531306 - RNA, 64 nt, hsa; identical to SEQ ID NO: 157132

SEQ ID NO: 531307 - RNA, 64 nt, hsa; identical to SEQ ID NO: 157133

SEQ ID NO: 531308 - RNA, 64 nt, hsa; identical to SEQ ID NO: 157134

SEQ ID NO: 531309 - RNA, 64 nt, hsa; identical to SEQ ID NO: 157135

SEQ ID NO: 531310 - RNA, 64 nt, hsa; identical to SEQ ID NO: 157136

SEQ ID NO: 531311 - RNA, 64 nt, hsa; identical to SEQ ID NO: 157137

SEQ ID NO: 531312 - RNA, 64 nt, hsa; identical to SEQ ID NO: 157138

SEQ ID NO: 531313 - RNA, 64 nt, hsa; identical to SEQ ID NO: 157139

SEQ ID NO: 531314 - RNA, 64 nt, hsa; identical to SEQ ID NO: 157140

SEQ ID NO: 531315 - RNA, 64 nt, hsa; identical to SEQ ID NO: 157141

SEQ ID NO: 531316 - RNA, 64 nt, hsa; identical to SEQ ID NO: 157142

SEQ ID NO: 531317 - RNA, 64 nt, hsa; identical to SEQ ID NO: 157143

SEQ ID NO: 531318 - RNA, 64 nt, hsa; identical to SEQ ID NO: 157144

SEQ ID NO: 531319 - RNA, 64 nt, hsa; identical to SEQ ID NO: 157145

SEQ ID NO: 531320 - RNA, 64 nt, hsa; identical to SEQ ID NO: 157146

SEQ ID NO: 531321 - RNA, 64 nt, hsa; identical to SEQ ID NO: 157147

SEQ ID NO: 531322 - RNA, 64 nt, hsa; identical to SEQ ID NO: 157148

SEQ ID NO: 531323 - RNA, 64 nt, hsa; identical to SEQ ID NO: 157149

SEQ ID NO: 531324 - RNA, 64 nt, hsa; identical to SEQ ID NO: 157150

SEQ ID NO: 531325 - RNA, 64 nt, hsa; identical to SEQ ID NO: 157151

SEQ ID NO: 531326 - RNA, 64 nt, hsa; identical to SEQ ID NO: 157152

SEQ ID NO: 531327 - RNA, 64 nt, hsa; identical to SEQ ID NO: 157153

SEQ ID NO: 531328 - RNA, 64 nt, hsa; identical to SEQ ID NO: 157154

SEQ ID NO: 531329 - RNA, 64 nt, hsa; identical to SEQ ID NO: 157155

SEQ ID NO: 531330 - RNA, 64 nt, hsa; identical to SEQ ID NO: 157156

SEQ ID NO: 531331 - RNA, 64 nt, hsa; identical to SEQ ID NO: 157157

SEQ ID NO: 531332 - RNA, 64 nt, hsa; identical to SEQ ID NO: 157158

SEQ ID NO: 531333 - RNA, 64 nt, hsa; identical to SEQ ID NO: 157159

SEQ ID NO: 531334 - RNA, 64 nt, hsa; identical to SEQ ID NO: 157160

SEQ ID NO: 531335 - RNA, 64 nt, hsa; identical to SEQ ID NO: 157161

SEQ ID NO: 531336 - RNA, 64 nt, hsa; identical to SEQ ID NO: 157162

SEQ ID NO: 531337 - RNA, 64 nt, hsa; identical to SEQ ID NO: 157163

SEQ ID NO: 531338 - RNA, 64 nt, hsa; identical to SEQ ID NO: 157164

SEQ ID NO: 531339 - RNA, 64 nt, hsa; identical to SEQ ID NO: 157165

SEQ ID NO: 531340 - RNA, 64 nt, hsa; identical to SEQ ID NO: 157166

SEQ ID NO: 531341 - RNA, 64 nt, hsa; identical to SEQ ID NO: 157167

SEQ ID NO: 531342 - RNA, 64 nt, hsa; identical to SEQ ID NO: 157168

SEQ ID NO: 531343 - RNA, 64 nt, hsa; identical to SEQ ID NO: 157169

SEQ ID NO: 531344 - RNA, 64 nt, hsa; identical to SEQ ID NO: 157170

SEQ ID NO: 531345 - RNA, 64 nt, hsa; identical to SEQ ID NO: 157171

SEQ ID NO: 531346 - RNA, 64 nt, hsa; identical to SEQ ID NO: 157172

SEQ ID NO: 531347 - RNA, 64 nt, hsa; identical to SEQ ID NO: 157173

SEQ ID NO: 531348 - RNA, 64 nt, hsa; identical to SEQ ID NO: 157174

SEQ ID NO: 531349 - RNA, 64 nt, hsa; identical to SEQ ID NO: 157175

SEQ ID NO: 531350 - RNA, 64 nt, hsa; identical to SEQ ID NO: 157176

SEQ ID NO: 531351 - RNA, 64 nt, hsa; identical to SEQ ID NO: 157177

SEQ ID NO: 531352 - RNA, 64 nt, hsa; identical to SEQ ID NO: 157178

SEQ ID NO: 531353 - RNA, 64 nt, hsa; identical to SEQ ID NO: 157179

SEQ ID NO: 531354 - RNA, 64 nt, hsa; identical to SEQ ID NO: 157180

SEQ ID NO: 531355 - RNA, 64 nt, hsa; identical to SEQ ID NO: 157181

SEQ ID NO: 531356 - RNA, 64 nt, hsa; identical to SEQ ID NO: 157182

SEQ ID NO: 531357 - RNA, 64 nt, hsa; identical to SEQ ID NO: 157183

SEQ ID NO: 531358 - RNA, 64 nt, hsa; identical to SEQ ID NO: 157184

SEQ ID NO: 531359 - RNA, 64 nt, hsa; identical to SEQ ID NO: 157185

SEQ ID NO: 531360 - RNA, 64 nt, hsa; identical to SEQ ID NO: 157186

SEQ ID NO: 531361 - RNA, 64 nt, hsa; identical to SEQ ID NO: 157187

SEQ ID NO: 531362 - RNA, 64 nt, hsa; identical to SEQ ID NO: 157188

SEQ ID NO: 531363 - RNA, 64 nt, hsa; identical to SEQ ID NO: 157189

SEQ ID NO: 531364 - RNA, 64 nt, hsa; identical to SEQ ID NO: 157190

SEQ ID NO: 531365 - RNA, 64 nt, hsa; identical to SEQ ID NO: 157191

SEQ ID NO: 531366 - RNA, 64 nt, hsa; identical to SEQ ID NO: 157192

SEQ ID NO: 531367 - RNA, 64 nt, hsa; identical to SEQ ID NO: 157193

SEQ ID NO: 531368 - RNA, 64 nt, hsa; identical to SEQ ID NO: 157194

SEQ ID NO: 531369 - RNA, 64 nt, hsa; identical to SEQ ID NO: 157195

SEQ ID NO: 531370 - RNA, 64 nt, hsa; identical to SEQ ID NO: 157196

SEQ ID NO: 531371 - RNA, 64 nt, hsa; identical to SEQ ID NO: 157197

SEQ ID NO: 531372 - RNA, 64 nt, hsa; identical to SEQ ID NO: 157198

SEQ ID NO: 531373 - RNA, 64 nt, hsa; identical to SEQ ID NO: 157199

SEQ ID NO: 531374 - RNA, 64 nt, hsa; identical to SEQ ID NO: 157200

SEQ ID NO: 531375 - RNA, 64 nt, hsa; identical to SEQ ID NO: 157201

SEQ ID NO: 531376 - RNA, 64 nt, hsa; identical to SEQ ID NO: 157202

SEQ ID NO: 531377 - RNA, 64 nt, hsa; identical to SEQ ID NO: 157203

SEQ ID NO: 531378 - RNA, 64 nt, hsa; identical to SEQ ID NO: 157204

SEQ ID NO: 531379 - RNA, 64 nt, hsa; identical to SEQ ID NO: 157205

SEQ ID NO: 531380 - RNA, 64 nt, hsa; identical to SEQ ID NO: 157206

SEQ ID NO: 531381 - RNA, 64 nt, hsa; identical to SEQ ID NO: 157207

SEQ ID NO: 531382 - RNA, 64 nt, hsa; identical to SEQ ID NO: 157208

SEQ ID NO: 531383 - RNA, 64 nt, hsa; identical to SEQ ID NO: 157209

SEQ ID NO: 531384 - RNA, 64 nt, hsa; identical to SEQ ID NO: 157210

SEQ ID NO: 531385 - RNA, 64 nt, hsa; identical to SEQ ID NO: 157211

SEQ ID NO: 531386 - RNA, 64 nt, hsa; identical to SEQ ID NO: 157212

SEQ ID NO: 531387 - RNA, 64 nt, hsa; identical to SEQ ID NO: 157213

SEQ ID NO: 531388 - RNA, 64 nt, hsa; identical to SEQ ID NO: 157214

SEQ ID NO: 531389 - RNA, 64 nt, hsa; identical to SEQ ID NO: 157215

SEQ ID NO: 531390 - RNA, 64 nt, hsa; identical to SEQ ID NO: 157216

SEQ ID NO: 531391 - RNA, 64 nt, hsa; identical to SEQ ID NO: 157217

SEQ ID NO: 531392 - RNA, 64 nt, hsa; identical to SEQ ID NO: 157218

SEQ ID NO: 531393 - RNA, 64 nt, hsa; identical to SEQ ID NO: 157219

SEQ ID NO: 531394 - RNA, 64 nt, hsa; identical to SEQ ID NO: 157220

SEQ ID NO: 531395 - RNA, 64 nt, hsa; identical to SEQ ID NO: 157221

SEQ ID NO: 531396 - RNA, 64 nt, hsa; identical to SEQ ID NO: 157222

SEQ ID NO: 531397 - RNA, 64 nt, hsa; identical to SEQ ID NO: 157223

SEQ ID NO: 531398 - RNA, 64 nt, hsa; identical to SEQ ID NO: 157224

SEQ ID NO: 531399 - RNA, 64 nt, hsa; identical to SEQ ID NO: 157225

SEQ ID NO: 531400 - RNA, 64 nt, hsa; identical to SEQ ID NO: 157226

SEQ ID NO: 531401 - RNA, 64 nt, hsa; identical to SEQ ID NO: 157227

SEQ ID NO: 531402 - RNA, 64 nt, hsa; identical to SEQ ID NO: 157228

SEQ ID NO: 531403 - RNA, 64 nt, hsa; identical to SEQ ID NO: 157229

SEQ ID NO: 531404 - RNA, 64 nt, hsa; identical to SEQ ID NO: 157230

SEQ ID NO: 531405 - RNA, 64 nt, hsa; identical to SEQ ID NO: 157231

SEQ ID NO: 531406 - RNA, 63 nt, hsa; identical to SEQ ID NO: 157232

SEQ ID NO: 531407 - RNA, 64 nt, hsa; identical to SEQ ID NO: 157233

SEQ ID NO: 531408 - RNA, 64 nt, hsa; identical to SEQ ID NO: 157234

SEQ ID NO: 531409 - RNA, 64 nt, hsa; identical to SEQ ID NO: 157235

SEQ ID NO: 531410 - RNA, 64 nt, hsa; identical to SEQ ID NO: 157236

SEQ ID NO: 531411 - RNA, 64 nt, hsa; identical to SEQ ID NO: 157237

SEQ ID NO: 531412 - RNA, 64 nt, hsa; identical to SEQ ID NO: 157238

SEQ ID NO: 531413 - RNA, 64 nt, hsa; identical to SEQ ID NO: 157239

SEQ ID NO: 531414 - RNA, 64 nt, hsa; identical to SEQ ID NO: 157240

SEQ ID NO: 531415 - RNA, 64 nt, hsa; identical to SEQ ID NO: 157241

SEQ ID NO: 531416 - RNA, 64 nt, hsa; identical to SEQ ID NO: 157242

SEQ ID NO: 531417 - RNA, 64 nt, hsa; identical to SEQ ID NO: 157243

SEQ ID NO: 531418 - RNA, 64 nt, hsa; identical to SEQ ID NO: 157244

SEQ ID NO: 531419 - RNA, 64 nt, hsa; identical to SEQ ID NO: 157245

SEQ ID NO: 531420 - RNA, 64 nt, hsa; identical to SEQ ID NO: 157246

SEQ ID NO: 531421 - RNA, 64 nt, hsa; identical to SEQ ID NO: 157247

SEQ ID NO: 531422 - RNA, 64 nt, hsa; identical to SEQ ID NO: 157248

SEQ ID NO: 531423 - RNA, 64 nt, hsa; identical to SEQ ID NO: 157249

SEQ ID NO: 531424 - RNA, 64 nt, hsa; identical to SEQ ID NO: 157250

SEQ ID NO: 531425 - RNA, 64 nt, hsa; identical to SEQ ID NO: 157251

SEQ ID NO: 531426 - RNA, 64 nt, hsa; identical to SEQ ID NO: 157252

SEQ ID NO: 531427 - RNA, 64 nt, hsa; identical to SEQ ID NO: 157253

SEQ ID NO: 531428 - RNA, 64 nt, hsa; identical to SEQ ID NO: 157254

SEQ ID NO: 531429 - RNA, 64 nt, hsa; identical to SEQ ID NO: 157255

SEQ ID NO: 531430 - RNA, 64 nt, hsa; identical to SEQ ID NO: 157256

SEQ ID NO: 531431 - RNA, 64 nt, hsa; identical to SEQ ID NO: 157257

SEQ ID NO: 531432 - RNA, 64 nt, hsa; identical to SEQ ID NO: 157258

SEQ ID NO: 531433 - RNA, 64 nt, hsa; identical to SEQ ID NO: 157259

SEQ ID NO: 531434 - RNA, 64 nt, hsa; identical to SEQ ID NO: 157260

SEQ ID NO: 531435 - RNA, 64 nt, hsa; identical to SEQ ID NO: 157261

SEQ ID NO: 531436 - RNA, 64 nt, hsa; identical to SEQ ID NO: 157262

SEQ ID NO: 531437 - RNA, 64 nt, hsa; identical to SEQ ID NO: 157263

SEQ ID NO: 531438 - RNA, 64 nt, hsa; identical to SEQ ID NO: 157264

SEQ ID NO: 531439 - RNA, 64 nt, hsa; identical to SEQ ID NO: 157265

SEQ ID NO: 531440 - RNA, 64 nt, hsa; identical to SEQ ID NO: 157266

SEQ ID NO: 531441 - RNA, 64 nt, hsa; identical to SEQ ID NO: 157267

SEQ ID NO: 531442 - RNA, 64 nt, hsa; identical to SEQ ID NO: 157268

SEQ ID NO: 531443 - RNA, 64 nt, hsa; identical to SEQ ID NO: 157269

SEQ ID NO: 531444 - RNA, 64 nt, hsa; identical to SEQ ID NO: 157270

SEQ ID NO: 531445 - RNA, 64 nt, hsa; identical to SEQ ID NO: 157271

SEQ ID NO: 531446 - RNA, 64 nt, hsa; identical to SEQ ID NO: 157272

SEQ ID NO: 531447 - RNA, 64 nt, hsa; identical to SEQ ID NO: 157273

SEQ ID NO: 531448 - RNA, 64 nt, hsa; identical to SEQ ID NO: 157274

SEQ ID NO: 531449 - RNA, 64 nt, hsa; identical to SEQ ID NO: 157275

SEQ ID NO: 531450 - RNA, 64 nt, hsa; identical to SEQ ID NO: 157276

SEQ ID NO: 531451 - RNA, 64 nt, hsa; identical to SEQ ID NO: 157277

SEQ ID NO: 531452 - RNA, 64 nt, hsa; identical to SEQ ID NO: 157278

SEQ ID NO: 531453 - RNA, 64 nt, hsa; identical to SEQ ID NO: 157279

SEQ ID NO: 531454 - RNA, 64 nt, hsa; identical to SEQ ID NO: 157280

SEQ ID NO: 531455 - RNA, 64 nt, hsa; identical to SEQ ID NO: 157281

SEQ ID NO: 531456 - RNA, 64 nt, hsa; identical to SEQ ID NO: 157282

SEQ ID NO: 531457 - RNA, 64 nt, hsa; identical to SEQ ID NO: 157283

SEQ ID NO: 531458 - RNA, 64 nt, hsa; identical to SEQ ID NO: 157284

SEQ ID NO: 531459 - RNA, 64 nt, hsa; identical to SEQ ID NO: 157285

SEQ ID NO: 531460 - RNA, 64 nt, hsa; identical to SEQ ID NO: 157286

SEQ ID NO: 531461 - RNA, 64 nt, hsa; identical to SEQ ID NO: 157287

SEQ ID NO: 531462 - RNA, 64 nt, hsa; identical to SEQ ID NO: 157288

SEQ ID NO: 531463 - RNA, 64 nt, hsa; identical to SEQ ID NO: 157289

SEQ ID NO: 531464 - RNA, 64 nt, hsa; identical to SEQ ID NO: 157290

SEQ ID NO: 531465 - RNA, 64 nt, hsa; identical to SEQ ID NO: 157291

SEQ ID NO: 531466 - RNA, 64 nt, hsa; identical to SEQ ID NO: 157292

SEQ ID NO: 531467 - RNA, 64 nt, hsa; identical to SEQ ID NO: 157293

SEQ ID NO: 531468 - RNA, 64 nt, hsa; identical to SEQ ID NO: 157294

SEQ ID NO: 531469 - RNA, 64 nt, hsa; identical to SEQ ID NO: 157295

SEQ ID NO: 531470 - RNA, 64 nt, hsa; identical to SEQ ID NO: 157296

SEQ ID NO: 531471 - RNA, 64 nt, hsa; identical to SEQ ID NO: 157297

SEQ ID NO: 531472 - RNA, 64 nt, hsa; identical to SEQ ID NO: 157298

SEQ ID NO: 531473 - RNA, 64 nt, hsa; identical to SEQ ID NO: 157299

SEQ ID NO: 531474 - RNA, 64 nt, hsa; identical to SEQ ID NO: 157300

SEQ ID NO: 531475 - RNA, 64 nt, hsa; identical to SEQ ID NO: 157301

SEQ ID NO: 531476 - RNA, 64 nt, hsa; identical to SEQ ID NO: 157302

SEQ ID NO: 531477 - RNA, 64 nt, hsa; identical to SEQ ID NO: 157303

SEQ ID NO: 531478 - RNA, 64 nt, hsa; identical to SEQ ID NO: 157304

SEQ ID NO: 531479 - RNA, 64 nt, hsa; identical to SEQ ID NO: 157305

SEQ ID NO: 531480 - RNA, 64 nt, hsa; identical to SEQ ID NO: 157306

SEQ ID NO: 531481 - RNA, 64 nt, hsa; identical to SEQ ID NO: 157307

SEQ ID NO: 531482 - RNA, 64 nt, hsa; identical to SEQ ID NO: 157308

SEQ ID NO: 531483 - RNA, 64 nt, hsa; identical to SEQ ID NO: 157309

SEQ ID NO: 531484 - RNA, 64 nt, hsa; identical to SEQ ID NO: 157310

SEQ ID NO: 531485 - RNA, 64 nt, hsa; identical to SEQ ID NO: 157311

SEQ ID NO: 531486 - RNA, 64 nt, hsa; identical to SEQ ID NO: 157312

SEQ ID NO: 531487 - RNA, 64 nt, hsa; identical to SEQ ID NO: 157313

SEQ ID NO: 531488 - RNA, 64 nt, hsa; identical to SEQ ID NO: 157314

SEQ ID NO: 531489 - RNA, 64 nt, hsa; identical to SEQ ID NO: 157315

SEQ ID NO: 531490 - RNA, 64 nt, hsa; identical to SEQ ID NO: 157316

SEQ ID NO: 531491 - RNA, 64 nt, hsa; identical to SEQ ID NO: 157317

SEQ ID NO: 531492 - RNA, 64 nt, hsa; identical to SEQ ID NO: 157318

SEQ ID NO: 531493 - RNA, 64 nt, hsa; identical to SEQ ID NO: 157319

SEQ ID NO: 531494 - RNA, 64 nt, hsa; identical to SEQ ID NO: 157320

SEQ ID NO: 531495 - RNA, 64 nt, hsa; identical to SEQ ID NO: 157321

SEQ ID NO: 531496 - RNA, 64 nt, hsa; identical to SEQ ID NO: 157322

SEQ ID NO: 531497 - RNA, 64 nt, hsa; identical to SEQ ID NO: 157323

SEQ ID NO: 531498 - RNA, 64 nt, hsa; identical to SEQ ID NO: 157324

SEQ ID NO: 531499 - RNA, 64 nt, hsa; identical to SEQ ID NO: 157325

SEQ ID NO: 531500 - RNA, 64 nt, hsa; identical to SEQ ID NO: 157326

SEQ ID NO: 531501 - RNA, 64 nt, hsa; identical to SEQ ID NO: 157327

SEQ ID NO: 531502 - RNA, 64 nt, hsa; identical to SEQ ID NO: 157328

SEQ ID NO: 531503 - RNA, 64 nt, hsa; identical to SEQ ID NO: 157329

SEQ ID NO: 531504 - RNA, 64 nt, hsa; identical to SEQ ID NO: 157330

SEQ ID NO: 531505 - RNA, 64 nt, hsa; identical to SEQ ID NO: 157331

SEQ ID NO: 531506 - RNA, 64 nt, hsa; identical to SEQ ID NO: 157332

SEQ ID NO: 531507 - RNA, 64 nt, hsa; identical to SEQ ID NO: 157333

SEQ ID NO: 531508 - RNA, 64 nt, hsa; identical to SEQ ID NO: 157334

SEQ ID NO: 531509 - RNA, 64 nt, hsa; identical to SEQ ID NO: 157335

SEQ ID NO: 531510 - RNA, 64 nt, hsa; identical to SEQ ID NO: 157336

SEQ ID NO: 531511 - RNA, 64 nt, hsa; identical to SEQ ID NO: 157337

SEQ ID NO: 531512 - RNA, 64 nt, hsa; identical to SEQ ID NO: 157338

SEQ ID NO: 531513 - RNA, 64 nt, hsa; identical to SEQ ID NO: 157339

SEQ ID NO: 531514 - RNA, 64 nt, hsa; identical to SEQ ID NO: 157340

SEQ ID NO: 531515 - RNA, 64 nt, hsa; identical to SEQ ID NO: 157341

SEQ ID NO: 531516 - RNA, 64 nt, hsa; identical to SEQ ID NO: 157342

SEQ ID NO: 531517 - RNA, 64 nt, hsa; identical to SEQ ID NO: 157343

SEQ ID NO: 531518 - RNA, 64 nt, hsa; identical to SEQ ID NO: 157344

SEQ ID NO: 531519 - RNA, 64 nt, hsa; identical to SEQ ID NO: 157345

SEQ ID NO: 531520 - RNA, 64 nt, hsa; identical to SEQ ID NO: 157346

SEQ ID NO: 531521 - RNA, 64 nt, hsa; identical to SEQ ID NO: 157347

SEQ ID NO: 531522 - RNA, 64 nt, hsa; identical to SEQ ID NO: 157348

SEQ ID NO: 531523 - RNA, 64 nt, hsa; identical to SEQ ID NO: 157349

SEQ ID NO: 531524 - RNA, 64 nt, hsa; identical to SEQ ID NO: 157350

SEQ ID NO: 531525 - RNA, 64 nt, hsa; identical to SEQ ID NO: 157351

SEQ ID NO: 531526 - RNA, 64 nt, hsa; identical to SEQ ID NO: 157352

SEQ ID NO: 531527 - RNA, 64 nt, hsa; identical to SEQ ID NO: 157353

SEQ ID NO: 531528 - RNA, 64 nt, hsa; identical to SEQ ID NO: 157354

SEQ ID NO: 531529 - RNA, 64 nt, hsa; identical to SEQ ID NO: 157355

SEQ ID NO: 531530 - RNA, 64 nt, hsa; identical to SEQ ID NO: 157356

SEQ ID NO: 531531 - RNA, 64 nt, hsa; identical to SEQ ID NO: 157357

SEQ ID NO: 531532 - RNA, 64 nt, hsa; identical to SEQ ID NO: 157358

SEQ ID NO: 531533 - RNA, 64 nt, hsa; identical to SEQ ID NO: 157359

SEQ ID NO: 531534 - RNA, 64 nt, hsa; identical to SEQ ID NO: 157360

SEQ ID NO: 531535 - RNA, 64 nt, hsa; identical to SEQ ID NO: 157361

SEQ ID NO: 531536 - RNA, 64 nt, hsa; identical to SEQ ID NO: 157362

SEQ ID NO: 531537 - RNA, 64 nt, hsa; identical to SEQ ID NO: 157363

SEQ ID NO: 531538 - RNA, 64 nt, hsa; identical to SEQ ID NO: 157364

SEQ ID NO: 531539 - RNA, 64 nt, hsa; identical to SEQ ID NO: 157365

SEQ ID NO: 531540 - RNA, 64 nt, hsa; identical to SEQ ID NO: 157366

SEQ ID NO: 531541 - RNA, 64 nt, hsa; identical to SEQ ID NO: 157367

SEQ ID NO: 531542 - RNA, 64 nt, hsa; identical to SEQ ID NO: 157368

SEQ ID NO: 531543 - RNA, 64 nt, hsa; identical to SEQ ID NO: 157369

SEQ ID NO: 531544 - RNA, 64 nt, hsa; identical to SEQ ID NO: 157370

SEQ ID NO: 531545 - RNA, 64 nt, hsa; identical to SEQ ID NO: 157371

SEQ ID NO: 531546 - RNA, 64 nt, hsa; identical to SEQ ID NO: 157372

SEQ ID NO: 531547 - RNA, 64 nt, hsa; identical to SEQ ID NO: 157373

SEQ ID NO: 531548 - RNA, 64 nt, hsa; identical to SEQ ID NO: 157374

SEQ ID NO: 531549 - RNA, 64 nt, hsa; identical to SEQ ID NO: 157375

SEQ ID NO: 531550 - RNA, 64 nt, hsa; identical to SEQ ID NO: 157376

SEQ ID NO: 531551 - RNA, 64 nt, hsa; identical to SEQ ID NO: 157377

SEQ ID NO: 531552 - RNA, 64 nt, hsa; identical to SEQ ID NO: 157378

SEQ ID NO: 531553 - RNA, 64 nt, hsa; identical to SEQ ID NO: 157379

SEQ ID NO: 531554 - RNA, 64 nt, hsa; identical to SEQ ID NO: 157380

SEQ ID NO: 531555 - RNA, 64 nt, hsa; identical to SEQ ID NO: 157381

SEQ ID NO: 531556 - RNA, 64 nt, hsa; identical to SEQ ID NO: 157382

SEQ ID NO: 531557 - RNA, 64 nt, hsa; identical to SEQ ID NO: 157383

SEQ ID NO: 531558 - RNA, 64 nt, hsa; identical to SEQ ID NO: 157384

SEQ ID NO: 531559 - RNA, 64 nt, hsa; identical to SEQ ID NO: 157385

SEQ ID NO: 531560 - RNA, 64 nt, hsa; identical to SEQ ID NO: 157386

SEQ ID NO: 531561 - RNA, 64 nt, hsa; identical to SEQ ID NO: 157387

SEQ ID NO: 531562 - RNA, 64 nt, hsa; identical to SEQ ID NO: 157388

SEQ ID NO: 531563 - RNA, 64 nt, hsa; identical to SEQ ID NO: 157389

SEQ ID NO: 531564 - RNA, 64 nt, hsa; identical to SEQ ID NO: 157390

SEQ ID NO: 531565 - RNA, 64 nt, hsa; identical to SEQ ID NO: 157391

SEQ ID NO: 531566 - RNA, 64 nt, hsa; identical to SEQ ID NO: 157392

SEQ ID NO: 531567 - RNA, 64 nt, hsa; identical to SEQ ID NO: 157393

SEQ ID NO: 531568 - RNA, 64 nt, hsa; identical to SEQ ID NO: 157394

SEQ ID NO: 531569 - RNA, 64 nt, hsa; identical to SEQ ID NO: 157395

SEQ ID NO: 531570 - RNA, 64 nt, hsa; identical to SEQ ID NO: 157396

SEQ ID NO: 531571 - RNA, 64 nt, hsa; identical to SEQ ID NO: 157397

SEQ ID NO: 531572 - RNA, 64 nt, hsa; identical to SEQ ID NO: 157398

SEQ ID NO: 531573 - RNA, 64 nt, hsa; identical to SEQ ID NO: 157399

SEQ ID NO: 531574 - RNA, 64 nt, hsa; identical to SEQ ID NO: 157400

SEQ ID NO: 531575 - RNA, 64 nt, hsa; identical to SEQ ID NO: 157401

SEQ ID NO: 531576 - RNA, 64 nt, hsa; identical to SEQ ID NO: 157402

SEQ ID NO: 531577 - RNA, 64 nt, hsa; identical to SEQ ID NO: 157403

SEQ ID NO: 531578 - RNA, 64 nt, hsa; identical to SEQ ID NO: 157404

SEQ ID NO: 531579 - RNA, 64 nt, hsa; identical to SEQ ID NO: 157405

SEQ ID NO: 531580 - RNA, 64 nt, hsa; identical to SEQ ID NO: 157406

SEQ ID NO: 531581 - RNA, 64 nt, hsa; identical to SEQ ID NO: 157407

SEQ ID NO: 531582 - RNA, 64 nt, hsa; identical to SEQ ID NO: 157408

SEQ ID NO: 531583 - RNA, 64 nt, hsa; identical to SEQ ID NO: 157409

SEQ ID NO: 531584 - RNA, 64 nt, hsa; identical to SEQ ID NO: 157410

SEQ ID NO: 531585 - RNA, 64 nt, hsa; identical to SEQ ID NO: 157411

SEQ ID NO: 531586 - RNA, 64 nt, hsa; identical to SEQ ID NO: 157412

SEQ ID NO: 531587 - RNA, 64 nt, hsa; identical to SEQ ID NO: 157413

SEQ ID NO: 531588 - RNA, 64 nt, hsa; identical to SEQ ID NO: 157414

SEQ ID NO: 531589 - RNA, 64 nt, hsa; identical to SEQ ID NO: 157415

SEQ ID NO: 531590 - RNA, 64 nt, hsa; identical to SEQ ID NO: 157416

SEQ ID NO: 531591 - RNA, 64 nt, hsa; identical to SEQ ID NO: 157417

SEQ ID NO: 531592 - RNA, 64 nt, hsa; identical to SEQ ID NO: 157418

SEQ ID NO: 531593 - RNA, 64 nt, hsa; identical to SEQ ID NO: 157419

SEQ ID NO: 531594 - RNA, 64 nt, hsa; identical to SEQ ID NO: 157420

SEQ ID NO: 531595 - RNA, 64 nt, hsa; identical to SEQ ID NO: 157421

SEQ ID NO: 531596 - RNA, 64 nt, hsa; identical to SEQ ID NO: 157422

SEQ ID NO: 531597 - RNA, 64 nt, hsa; identical to SEQ ID NO: 157423

SEQ ID NO: 531598 - RNA, 64 nt, hsa; identical to SEQ ID NO: 157424

SEQ ID NO: 531599 - RNA, 64 nt, hsa; identical to SEQ ID NO: 157425

SEQ ID NO: 531600 - RNA, 64 nt, hsa; identical to SEQ ID NO: 157426

SEQ ID NO: 531601 - RNA, 64 nt, hsa; identical to SEQ ID NO: 157427

SEQ ID NO: 531602 - RNA, 64 nt, hsa; identical to SEQ ID NO: 157428

SEQ ID NO: 531603 - RNA, 64 nt, hsa; identical to SEQ ID NO: 157429

SEQ ID NO: 531604 - RNA, 64 nt, hsa; identical to SEQ ID NO: 157430

SEQ ID NO: 531605 - RNA, 64 nt, hsa; identical to SEQ ID NO: 157431

SEQ ID NO: 531606 - RNA, 64 nt, hsa; identical to SEQ ID NO: 157432

SEQ ID NO: 531607 - RNA, 64 nt, hsa; identical to SEQ ID NO: 157433

SEQ ID NO: 531608 - RNA, 64 nt, hsa; identical to SEQ ID NO: 157434

SEQ ID NO: 531609 - RNA, 64 nt, hsa; identical to SEQ ID NO: 157435

SEQ ID NO: 531610 - RNA, 64 nt, hsa; identical to SEQ ID NO: 157436

SEQ ID NO: 531611 - RNA, 64 nt, hsa; identical to SEQ ID NO: 157437

SEQ ID NO: 531612 - RNA, 64 nt, hsa; identical to SEQ ID NO: 157438

SEQ ID NO: 531613 - RNA, 64 nt, hsa; identical to SEQ ID NO: 157439

SEQ ID NO: 531614 - RNA, 64 nt, hsa; identical to SEQ ID NO: 157440

SEQ ID NO: 531615 - RNA, 64 nt, hsa; identical to SEQ ID NO: 157441

SEQ ID NO: 531616 - RNA, 64 nt, hsa; identical to SEQ ID NO: 157442

SEQ ID NO: 531617 - RNA, 64 nt, hsa; identical to SEQ ID NO: 157443

SEQ ID NO: 531618 - RNA, 64 nt, hsa; identical to SEQ ID NO: 157444

SEQ ID NO: 531619 - RNA, 64 nt, hsa; identical to SEQ ID NO: 157445

SEQ ID NO: 531620 - RNA, 64 nt, hsa; identical to SEQ ID NO: 157446

SEQ ID NO: 531621 - RNA, 64 nt, hsa; identical to SEQ ID NO: 157447

SEQ ID NO: 531622 - RNA, 64 nt, hsa; identical to SEQ ID NO: 157448

SEQ ID NO: 531623 - RNA, 64 nt, hsa; identical to SEQ ID NO: 157449

SEQ ID NO: 531624 - RNA, 64 nt, hsa; identical to SEQ ID NO: 157450

SEQ ID NO: 531625 - RNA, 64 nt, hsa; identical to SEQ ID NO: 157451

SEQ ID NO: 531626 - RNA, 64 nt, hsa; identical to SEQ ID NO: 157452

SEQ ID NO: 531627 - RNA, 64 nt, hsa; identical to SEQ ID NO: 157453

SEQ ID NO: 531628 - RNA, 64 nt, hsa; identical to SEQ ID NO: 157454

SEQ ID NO: 531629 - RNA, 64 nt, hsa; identical to SEQ ID NO: 157455

SEQ ID NO: 531630 - RNA, 64 nt, hsa; identical to SEQ ID NO: 157456

SEQ ID NO: 531631 - RNA, 64 nt, hsa; identical to SEQ ID NO: 157457

SEQ ID NO: 531632 - RNA, 64 nt, hsa; identical to SEQ ID NO: 157458

SEQ ID NO: 531633 - RNA, 64 nt, hsa; identical to SEQ ID NO: 157459

SEQ ID NO: 531634 - RNA, 64 nt, hsa; identical to SEQ ID NO: 157460

SEQ ID NO: 531635 - RNA, 64 nt, hsa; identical to SEQ ID NO: 157461

SEQ ID NO: 531636 - RNA, 64 nt, hsa; identical to SEQ ID NO: 157462

SEQ ID NO: 531637 - RNA, 64 nt, hsa; identical to SEQ ID NO: 157463

SEQ ID NO: 531638 - RNA, 64 nt, hsa; identical to SEQ ID NO: 157464

SEQ ID NO: 531639 - RNA, 64 nt, hsa; identical to SEQ ID NO: 157465

SEQ ID NO: 531640 - RNA, 64 nt, hsa; identical to SEQ ID NO: 157466

SEQ ID NO: 531641 - RNA, 64 nt, hsa; identical to SEQ ID NO: 157467

SEQ ID NO: 531642 - RNA, 64 nt, hsa; identical to SEQ ID NO: 157468

SEQ ID NO: 531643 - RNA, 64 nt, hsa; identical to SEQ ID NO: 157469

SEQ ID NO: 531644 - RNA, 64 nt, hsa; identical to SEQ ID NO: 157470

SEQ ID NO: 531645 - RNA, 64 nt, hsa; identical to SEQ ID NO: 157471

SEQ ID NO: 531646 - RNA, 64 nt, hsa; identical to SEQ ID NO: 157472

SEQ ID NO: 531647 - RNA, 64 nt, hsa; identical to SEQ ID NO: 157473

SEQ ID NO: 531648 - RNA, 64 nt, hsa; identical to SEQ ID NO: 157474

SEQ ID NO: 531649 - RNA, 64 nt, hsa; identical to SEQ ID NO: 157475

SEQ ID NO: 531650 - RNA, 64 nt, hsa; identical to SEQ ID NO: 157476

SEQ ID NO: 531651 - RNA, 64 nt, hsa; identical to SEQ ID NO: 157477

SEQ ID NO: 531652 - RNA, 64 nt, hsa; identical to SEQ ID NO: 157478

SEQ ID NO: 531653 - RNA, 64 nt, hsa; identical to SEQ ID NO: 157479

SEQ ID NO: 531654 - RNA, 64 nt, hsa; identical to SEQ ID NO: 157480

SEQ ID NO: 531655 - RNA, 64 nt, hsa; identical to SEQ ID NO: 157481

SEQ ID NO: 531656 - RNA, 64 nt, hsa; identical to SEQ ID NO: 157482

SEQ ID NO: 531657 - RNA, 64 nt, hsa; identical to SEQ ID NO: 157483

SEQ ID NO: 531658 - RNA, 64 nt, hsa; identical to SEQ ID NO: 157484

SEQ ID NO: 531659 - RNA, 64 nt, hsa; identical to SEQ ID NO: 157485

SEQ ID NO: 531660 - RNA, 64 nt, hsa; identical to SEQ ID NO: 157486

SEQ ID NO: 531661 - RNA, 64 nt, hsa; identical to SEQ ID NO: 157487

SEQ ID NO: 531662 - RNA, 64 nt, hsa; identical to SEQ ID NO: 157488

SEQ ID NO: 531663 - RNA, 64 nt, hsa; identical to SEQ ID NO: 157489

SEQ ID NO: 531664 - RNA, 64 nt, hsa; identical to SEQ ID NO: 157490

SEQ ID NO: 531665 - RNA, 64 nt, hsa; identical to SEQ ID NO: 157491

SEQ ID NO: 531666 - RNA, 64 nt, hsa; identical to SEQ ID NO: 157492

SEQ ID NO: 531667 - RNA, 64 nt, hsa; identical to SEQ ID NO: 157493

SEQ ID NO: 531668 - RNA, 64 nt, hsa; identical to SEQ ID NO: 157494

SEQ ID NO: 531669 - RNA, 64 nt, hsa; identical to SEQ ID NO: 157495

SEQ ID NO: 531670 - RNA, 64 nt, hsa; identical to SEQ ID NO: 157496

SEQ ID NO: 531671 - RNA, 64 nt, hsa; identical to SEQ ID NO: 157497

SEQ ID NO: 531672 - RNA, 64 nt, hsa; identical to SEQ ID NO: 157498

SEQ ID NO: 531673 - RNA, 64 nt, hsa; identical to SEQ ID NO: 157499

SEQ ID NO: 531674 - RNA, 64 nt, hsa; identical to SEQ ID NO: 157500

SEQ ID NO: 531675 - RNA, 64 nt, hsa; identical to SEQ ID NO: 157501

SEQ ID NO: 531676 - RNA, 64 nt, hsa; identical to SEQ ID NO: 157502

SEQ ID NO: 531677 - RNA, 64 nt, hsa; identical to SEQ ID NO: 157503

SEQ ID NO: 531678 - RNA, 64 nt, hsa; identical to SEQ ID NO: 157504

SEQ ID NO: 531679 - RNA, 64 nt, hsa; identical to SEQ ID NO: 157505

SEQ ID NO: 531680 - RNA, 64 nt, hsa; identical to SEQ ID NO: 157506

SEQ ID NO: 531681 - RNA, 64 nt, hsa; identical to SEQ ID NO: 157507

SEQ ID NO: 531682 - RNA, 64 nt, hsa; identical to SEQ ID NO: 157508

SEQ ID NO: 531683 - RNA, 64 nt, hsa; identical to SEQ ID NO: 157509

SEQ ID NO: 531684 - RNA, 64 nt, hsa; identical to SEQ ID NO: 157510

SEQ ID NO: 531685 - RNA, 64 nt, hsa; identical to SEQ ID NO: 157511

SEQ ID NO: 531686 - RNA, 64 nt, hsa; identical to SEQ ID NO: 157512

SEQ ID NO: 531687 - RNA, 64 nt, hsa; identical to SEQ ID NO: 157513

SEQ ID NO: 531688 - RNA, 64 nt, hsa; identical to SEQ ID NO: 157514

SEQ ID NO: 531689 - RNA, 64 nt, hsa; identical to SEQ ID NO: 157515

SEQ ID NO: 531690 - RNA, 64 nt, hsa; identical to SEQ ID NO: 157516

SEQ ID NO: 531691 - RNA, 64 nt, hsa; identical to SEQ ID NO: 157517

SEQ ID NO: 531692 - RNA, 64 nt, hsa; identical to SEQ ID NO: 157518

SEQ ID NO: 531693 - RNA, 64 nt, hsa; identical to SEQ ID NO: 157519

SEQ ID NO: 531694 - RNA, 64 nt, hsa; identical to SEQ ID NO: 157520

SEQ ID NO: 531695 - RNA, 64 nt, hsa; identical to SEQ ID NO: 157521

SEQ ID NO: 531696 - RNA, 64 nt, hsa; identical to SEQ ID NO: 157522

SEQ ID NO: 531697 - RNA, 64 nt, hsa; identical to SEQ ID NO: 157523

SEQ ID NO: 531698 - RNA, 64 nt, hsa; identical to SEQ ID NO: 157524

SEQ ID NO: 531699 - RNA, 64 nt, hsa; identical to SEQ ID NO: 157525

SEQ ID NO: 531700 - RNA, 64 nt, hsa; identical to SEQ ID NO: 157526

SEQ ID NO: 531701 - RNA, 64 nt, hsa; identical to SEQ ID NO: 157527

SEQ ID NO: 531702 - RNA, 64 nt, hsa; identical to SEQ ID NO: 157528

SEQ ID NO: 531703 - RNA, 64 nt, hsa; identical to SEQ ID NO: 157529

SEQ ID NO: 531704 - RNA, 64 nt, hsa; identical to SEQ ID NO: 157530

SEQ ID NO: 531705 - RNA, 64 nt, hsa; identical to SEQ ID NO: 157531

SEQ ID NO: 531706 - RNA, 64 nt, hsa; identical to SEQ ID NO: 157532

SEQ ID NO: 531707 - RNA, 64 nt, hsa; identical to SEQ ID NO: 157533

SEQ ID NO: 531708 - RNA, 64 nt, hsa; identical to SEQ ID NO: 157534

SEQ ID NO: 531709 - RNA, 64 nt, hsa; identical to SEQ ID NO: 157535

SEQ ID NO: 531710 - RNA, 64 nt, hsa; identical to SEQ ID NO: 157536

SEQ ID NO: 531711 - RNA, 64 nt, hsa; identical to SEQ ID NO: 157537

SEQ ID NO: 531712 - RNA, 64 nt, hsa; identical to SEQ ID NO: 157538

SEQ ID NO: 531713 - RNA, 64 nt, hsa; identical to SEQ ID NO: 157539

SEQ ID NO: 531714 - RNA, 64 nt, hsa; identical to SEQ ID NO: 157540

SEQ ID NO: 531715 - RNA, 64 nt, hsa; identical to SEQ ID NO: 157541

SEQ ID NO: 531716 - RNA, 64 nt, hsa; identical to SEQ ID NO: 157542

SEQ ID NO: 531717 - RNA, 64 nt, hsa; identical to SEQ ID NO: 157543

SEQ ID NO: 531718 - RNA, 64 nt, hsa; identical to SEQ ID NO: 157544

SEQ ID NO: 531719 - RNA, 64 nt, hsa; identical to SEQ ID NO: 157545

SEQ ID NO: 531720 - RNA, 64 nt, hsa; identical to SEQ ID NO: 157546

SEQ ID NO: 531721 - RNA, 64 nt, hsa; identical to SEQ ID NO: 157547

SEQ ID NO: 531722 - RNA, 64 nt, hsa; identical to SEQ ID NO: 157548

SEQ ID NO: 531723 - RNA, 64 nt, hsa; identical to SEQ ID NO: 157549

SEQ ID NO: 531724 - RNA, 64 nt, hsa; identical to SEQ ID NO: 157550

SEQ ID NO: 531725 - RNA, 64 nt, hsa; identical to SEQ ID NO: 157551

SEQ ID NO: 531726 - RNA, 64 nt, hsa; identical to SEQ ID NO: 157552

SEQ ID NO: 531727 - RNA, 64 nt, hsa; identical to SEQ ID NO: 157553

SEQ ID NO: 531728 - RNA, 64 nt, hsa; identical to SEQ ID NO: 157554

SEQ ID NO: 531729 - RNA, 64 nt, hsa; identical to SEQ ID NO: 157555

SEQ ID NO: 531730 - RNA, 64 nt, hsa; identical to SEQ ID NO: 157556

SEQ ID NO: 531731 - RNA, 64 nt, hsa; identical to SEQ ID NO: 157557

SEQ ID NO: 531732 - RNA, 64 nt, hsa; identical to SEQ ID NO: 157558

SEQ ID NO: 531733 - RNA, 64 nt, hsa; identical to SEQ ID NO: 157559

SEQ ID NO: 531734 - RNA, 64 nt, hsa; identical to SEQ ID NO: 157560

SEQ ID NO: 531735 - RNA, 64 nt, hsa; identical to SEQ ID NO: 157561

SEQ ID NO: 531736 - RNA, 64 nt, hsa; identical to SEQ ID NO: 157562

SEQ ID NO: 531737 - RNA, 64 nt, hsa; identical to SEQ ID NO: 157563

SEQ ID NO: 531738 - RNA, 64 nt, hsa; identical to SEQ ID NO: 157564

SEQ ID NO: 531739 - RNA, 64 nt, hsa; identical to SEQ ID NO: 157565

SEQ ID NO: 531740 - RNA, 64 nt, hsa; identical to SEQ ID NO: 157566

SEQ ID NO: 531741 - RNA, 64 nt, hsa; identical to SEQ ID NO: 157567

SEQ ID NO: 531742 - RNA, 64 nt, hsa; identical to SEQ ID NO: 157568

SEQ ID NO: 531743 - RNA, 64 nt, hsa; identical to SEQ ID NO: 157569

SEQ ID NO: 531744 - RNA, 64 nt, hsa; identical to SEQ ID NO: 157570

SEQ ID NO: 531745 - RNA, 64 nt, hsa; identical to SEQ ID NO: 157571

SEQ ID NO: 531746 - RNA, 64 nt, hsa; identical to SEQ ID NO: 157572

SEQ ID NO: 531747 - RNA, 64 nt, hsa; identical to SEQ ID NO: 157573

SEQ ID NO: 531748 - RNA, 64 nt, hsa; identical to SEQ ID NO: 157574

SEQ ID NO: 531749 - RNA, 64 nt, hsa; identical to SEQ ID NO: 157575

SEQ ID NO: 531750 - RNA, 64 nt, hsa; identical to SEQ ID NO: 157576

SEQ ID NO: 531751 - RNA, 64 nt, hsa; identical to SEQ ID NO: 157577

SEQ ID NO: 531752 - RNA, 64 nt, hsa; identical to SEQ ID NO: 157578

SEQ ID NO: 531753 - RNA, 64 nt, hsa; identical to SEQ ID NO: 157579

SEQ ID NO: 531754 - RNA, 64 nt, hsa; identical to SEQ ID NO: 157580

SEQ ID NO: 531755 - RNA, 64 nt, hsa; identical to SEQ ID NO: 157581

SEQ ID NO: 531756 - RNA, 64 nt, hsa; identical to SEQ ID NO: 157582

SEQ ID NO: 531757 - RNA, 64 nt, hsa; identical to SEQ ID NO: 157583

SEQ ID NO: 531758 - RNA, 64 nt, hsa; identical to SEQ ID NO: 157584

SEQ ID NO: 531759 - RNA, 64 nt, hsa; identical to SEQ ID NO: 157585

SEQ ID NO: 531760 - RNA, 64 nt, hsa; identical to SEQ ID NO: 157586

SEQ ID NO: 531761 - RNA, 64 nt, hsa; identical to SEQ ID NO: 157587

SEQ ID NO: 531762 - RNA, 64 nt, hsa; identical to SEQ ID NO: 157588

SEQ ID NO: 531763 - RNA, 64 nt, hsa; identical to SEQ ID NO: 157589

SEQ ID NO: 531764 - RNA, 64 nt, hsa; identical to SEQ ID NO: 157590

SEQ ID NO: 531765 - RNA, 64 nt, hsa; identical to SEQ ID NO: 157591

SEQ ID NO: 531766 - RNA, 64 nt, hsa; identical to SEQ ID NO: 157592

SEQ ID NO: 531767 - RNA, 64 nt, hsa; identical to SEQ ID NO: 157593

SEQ ID NO: 531768 - RNA, 64 nt, hsa; identical to SEQ ID NO: 157594

SEQ ID NO: 531769 - RNA, 64 nt, hsa; identical to SEQ ID NO: 157595

SEQ ID NO: 531770 - RNA, 64 nt, hsa; identical to SEQ ID NO: 157596

SEQ ID NO: 531771 - RNA, 64 nt, hsa; identical to SEQ ID NO: 157597

SEQ ID NO: 531772 - RNA, 64 nt, hsa; identical to SEQ ID NO: 157598

SEQ ID NO: 531773 - RNA, 64 nt, hsa; identical to SEQ ID NO: 157599

SEQ ID NO: 531774 - RNA, 64 nt, hsa; identical to SEQ ID NO: 157600

SEQ ID NO: 531775 - RNA, 64 nt, hsa; identical to SEQ ID NO: 157601

SEQ ID NO: 531776 - RNA, 64 nt, hsa; identical to SEQ ID NO: 157602

SEQ ID NO: 531777 - RNA, 64 nt, hsa; identical to SEQ ID NO: 157603

SEQ ID NO: 531778 - RNA, 64 nt, hsa; identical to SEQ ID NO: 157604

SEQ ID NO: 531779 - RNA, 64 nt, hsa; identical to SEQ ID NO: 157605

SEQ ID NO: 531780 - RNA, 64 nt, hsa; identical to SEQ ID NO: 157606

SEQ ID NO: 531781 - RNA, 64 nt, hsa; identical to SEQ ID NO: 147132

SEQ ID NO: 531782 - RNA, 64 nt, hsa; identical to SEQ ID NO: 147133

SEQ ID NO: 531783 - RNA, 64 nt, hsa; identical to SEQ ID NO: 147134

SEQ ID NO: 531784 - RNA, 64 nt, hsa; identical to SEQ ID NO: 147135

SEQ ID NO: 531785 - RNA, 64 nt, hsa; identical to SEQ ID NO: 147136

SEQ ID NO: 531786 - RNA, 64 nt, hsa; identical to SEQ ID NO: 147137

SEQ ID NO: 531787 - RNA, 64 nt, hsa; identical to SEQ ID NO: 147138

SEQ ID NO: 531788 - RNA, 64 nt, hsa; identical to SEQ ID NO: 147139

SEQ ID NO: 531789 - RNA, 64 nt, hsa; identical to SEQ ID NO: 147140

SEQ ID NO: 531790 - RNA, 64 nt, hsa; identical to SEQ ID NO: 147141

SEQ ID NO: 531791 - RNA, 64 nt, hsa; identical to SEQ ID NO: 147142

SEQ ID NO: 531792 - RNA, 64 nt, hsa; identical to SEQ ID NO: 147143

SEQ ID NO: 531793 - RNA, 64 nt, hsa; identical to SEQ ID NO: 147144

SEQ ID NO: 531794 - RNA, 64 nt, hsa; identical to SEQ ID NO: 147145

SEQ ID NO: 531795 - RNA, 64 nt, hsa; identical to SEQ ID NO: 147146

SEQ ID NO: 531796 - RNA, 64 nt, hsa; identical to SEQ ID NO: 147147

SEQ ID NO: 531797 - RNA, 64 nt, hsa; identical to SEQ ID NO: 147148

SEQ ID NO: 531798 - RNA, 64 nt, hsa; identical to SEQ ID NO: 147149

SEQ ID NO: 531799 - RNA, 64 nt, hsa; identical to SEQ ID NO: 147150

SEQ ID NO: 531800 - RNA, 64 nt, hsa; identical to SEQ ID NO: 147151

SEQ ID NO: 531801 - RNA, 64 nt, hsa; identical to SEQ ID NO: 147152

SEQ ID NO: 531802 - RNA, 64 nt, hsa; identical to SEQ ID NO: 147153

SEQ ID NO: 531803 - RNA, 64 nt, hsa; identical to SEQ ID NO: 147154

SEQ ID NO: 531804 - RNA, 64 nt, hsa; identical to SEQ ID NO: 147155

SEQ ID NO: 531805 - RNA, 64 nt, hsa; identical to SEQ ID NO: 147156

SEQ ID NO: 531806 - RNA, 64 nt, hsa; identical to SEQ ID NO: 147157

SEQ ID NO: 531807 - RNA, 64 nt, hsa; identical to SEQ ID NO: 147158

SEQ ID NO: 531808 - RNA, 64 nt, hsa; identical to SEQ ID NO: 147159

SEQ ID NO: 531809 - RNA, 64 nt, hsa; identical to SEQ ID NO: 147160

SEQ ID NO: 531810 - RNA, 64 nt, hsa; identical to SEQ ID NO: 147161

SEQ ID NO: 531811 - RNA, 64 nt, hsa; identical to SEQ ID NO: 147162

SEQ ID NO: 531812 - RNA, 64 nt, hsa; identical to SEQ ID NO: 147163

SEQ ID NO: 531813 - RNA, 64 nt, hsa; identical to SEQ ID NO: 147164

SEQ ID NO: 531814 - RNA, 64 nt, hsa; identical to SEQ ID NO: 147165

SEQ ID NO: 531815 - RNA, 64 nt, hsa; identical to SEQ ID NO: 147166

SEQ ID NO: 531816 - RNA, 64 nt, hsa; identical to SEQ ID NO: 147167

SEQ ID NO: 531817 - RNA, 64 nt, hsa; identical to SEQ ID NO: 84335

SEQ ID NO: 531818 - RNA, 64 nt, hsa; identical to SEQ ID NO: 84336

SEQ ID NO: 531819 - RNA, 64 nt, hsa; identical to SEQ ID NO: 84337

SEQ ID NO: 531820 - RNA, 64 nt, hsa; identical to SEQ ID NO: 84338

SEQ ID NO: 531821 - RNA, 64 nt, hsa; identical to SEQ ID NO: 84339

SEQ ID NO: 531822 - RNA, 64 nt, hsa; identical to SEQ ID NO: 84340

SEQ ID NO: 531823 - RNA, 64 nt, hsa; identical to SEQ ID NO: 84341

SEQ ID NO: 531824 - RNA, 64 nt, hsa; identical to SEQ ID NO: 84342

SEQ ID NO: 531825 - RNA, 64 nt, hsa
cagacagcccugccuugaggauggcuugaccugggauugacaaaaugugucugcugaaaugcug

SEQ ID NO: 531826 - RNA, 64 nt, hsa
aucccuguccuuggguccuggguuaggcaccugagauugacaugaugggaucuagaucuuuccu

SEQ ID NO: 531827 - RNA, 64 nt, hsa
uuaaaucuuuuguggagacaggugcaaaucagaagauugacaaggaagaacuugagcuugcuaa

SEQ ID NO: 531828 - RNA, 64 nt, hsa
cagagaauguagugcuucauauauccaugaccaagauugacauguugcucacaacaugucacaa

SEQ ID NO: 531829 - RNA, 64 nt, hsa
acagauguaaacaucacuuguaggugauuaaaaagauugacagccgggccugaugucucaagcc

SEQ ID NO: 531830 - RNA, 64 nt, hsa
caagagugaaauuccaucucaaaaaacaaaaacagauugacaacaaagacaguuucagaaaaug

SEQ ID NO: 531831 - RNA, 64 nt, hsa; identical to SEQ ID NO: 154777

SEQ ID NO: 531832 - RNA, 64 nt, hsa; identical to SEQ ID NO: 154778

SEQ ID NO: 531833 - RNA, 64 nt, hsa; identical to SEQ ID NO: 154779

SEQ ID NO: 531834 - RNA, 64 nt, hsa; identical to SEQ ID NO: 154780

SEQ ID NO: 531835 - RNA, 64 nt, hsa; identical to SEQ ID NO: 154781

SEQ ID NO: 531836 - RNA, 64 nt, hsa; identical to SEQ ID NO: 154782

SEQ ID NO: 531837 - RNA, 64 nt, hsa; identical to SEQ ID NO: 154783

SEQ ID NO: 531838 - RNA, 64 nt, hsa; identical to SEQ ID NO: 154784

SEQ ID NO: 531839 - RNA, 64 nt, hsa; identical to SEQ ID NO: 154785

SEQ ID NO: 531840 - RNA, 64 nt, hsa; identical to SEQ ID NO: 154786

SEQ ID NO: 531841 - RNA, 64 nt, hsa; identical to SEQ ID NO: 154787

SEQ ID NO: 531842 - RNA, 64 nt, hsa; identical to SEQ ID NO: 154788

SEQ ID NO: 531843 - RNA, 64 nt, hsa; identical to SEQ ID NO: 154789

SEQ ID NO: 531844 - RNA, 64 nt, hsa; identical to SEQ ID NO: 154790

SEQ ID NO: 531845 - RNA, 64 nt, hsa; identical to SEQ ID NO: 154791

SEQ ID NO: 531846 - RNA, 64 nt, hsa; identical to SEQ ID NO: 154792

SEQ ID NO: 531847 - RNA, 64 nt, hsa; identical to SEQ ID NO: 154793

SEQ ID NO: 531848 - RNA, 64 nt, hsa; identical to SEQ ID NO: 154794

SEQ ID NO: 531849 - RNA, 64 nt, hsa; identical to SEQ ID NO: 154795

SEQ ID NO: 531850 - RNA, 64 nt, hsa; identical to SEQ ID NO: 154796

SEQ ID NO: 531851 - RNA, 64 nt, hsa; identical to SEQ ID NO: 154797

SEQ ID NO: 531852 - RNA, 64 nt, hsa; identical to SEQ ID NO: 154798

SEQ ID NO: 531853 - RNA, 64 nt, hsa; identical to SEQ ID NO: 154799

SEQ ID NO: 531854 - RNA, 64 nt, hsa; identical to SEQ ID NO: 154800

SEQ ID NO: 531855 - RNA, 64 nt, hsa; identical to SEQ ID NO: 218966

SEQ ID NO: 531856 - RNA, 64 nt, hsa; identical to SEQ ID NO: 218967

SEQ ID NO: 531857 - RNA, 64 nt, hsa; identical to SEQ ID NO: 218968

SEQ ID NO: 531858 - RNA, 64 nt, hsa; identical to SEQ ID NO: 218969

SEQ ID NO: 531859 - RNA, 64 nt, hsa; identical to SEQ ID NO: 218970

SEQ ID NO: 531860 - RNA, 64 nt, hsa; identical to SEQ ID NO: 218971

SEQ ID NO: 531861 - RNA, 64 nt, hsa; identical to SEQ ID NO: 218972

SEQ ID NO: 531862 - RNA, 64 nt, hsa; identical to SEQ ID NO: 218973

SEQ ID NO: 531863 - RNA, 64 nt, hsa; identical to SEQ ID NO: 218974

SEQ ID NO: 531864 - RNA, 64 nt, hsa; identical to SEQ ID NO: 218975

SEQ ID NO: 531865 - RNA, 64 nt, hsa; identical to SEQ ID NO: 218976

SEQ ID NO: 531866 - RNA, 64 nt, hsa; identical to SEQ ID NO: 218977

SEQ ID NO: 531867 - RNA, 64 nt, hsa; identical to SEQ ID NO: 218978

SEQ ID NO: 531868 - RNA, 64 nt, hsa; identical to SEQ ID NO: 218979

SEQ ID NO: 531869 - RNA, 64 nt, hsa; identical to SEQ ID NO: 218980

SEQ ID NO: 531870 - RNA, 64 nt, hsa; identical to SEQ ID NO: 218981

SEQ ID NO: 531871 - RNA, 64 nt, hsa; identical to SEQ ID NO: 218982

SEQ ID NO: 531872 - RNA, 64 nt, hsa; identical to SEQ ID NO: 218983

SEQ ID NO: 531873 - RNA, 64 nt, hsa; identical to SEQ ID NO: 218984

SEQ ID NO: 531874 - RNA, 64 nt, hsa; identical to SEQ ID NO: 218985

SEQ ID NO: 531875 - RNA, 64 nt, hsa; identical to SEQ ID NO: 218986

SEQ ID NO: 531876 - RNA, 64 nt, hsa; identical to SEQ ID NO: 218987

SEQ ID NO: 531877 - RNA, 64 nt, hsa; identical to SEQ ID NO: 218988

SEQ ID NO: 531878 - RNA, 64 nt, hsa; identical to SEQ ID NO: 218989

SEQ ID NO: 531879 - RNA, 64 nt, hsa; identical to SEQ ID NO: 218990

SEQ ID NO: 531880 - RNA, 64 nt, hsa; identical to SEQ ID NO: 218991

SEQ ID NO: 531881 - RNA, 64 nt, hsa; identical to SEQ ID NO: 218992

SEQ ID NO: 531882 - RNA, 64 nt, hsa; identical to SEQ ID NO: 218993

SEQ ID NO: 531883 - RNA, 64 nt, hsa; identical to SEQ ID NO: 218994

SEQ ID NO: 531884 - RNA, 64 nt, hsa; identical to SEQ ID NO: 218995

SEQ ID NO: 531885 - RNA, 64 nt, hsa; identical to SEQ ID NO: 218996

SEQ ID NO: 531886 - RNA, 64 nt, hsa
ggacuagaggugaagaggagauggacacugccucuggagccagccugacaccaaggacagcacu

SEQ ID NO: 531887 - RNA, 64 nt, hsa
accucaguguccacacacccaccaugcccagcccuggagccaucacuacucacaccgugguccu

SEQ ID NO: 531888 - RNA, 64 nt, hsa
gcuugauugggcccuggacguugagcccagauguuggagccacaccagccuggauuucaauccc

SEQ ID NO: 531889 - RNA, 64 nt, hsa
cuugggcucuugacuccucacuguugucuagagauggagccagcaggcugguagccuggcagcc

SEQ ID NO: 531890 - RNA, 64 nt, hsa
gagaaugggacguugcuguggacacccaagucgcuggagccauucacucuggagauucuagcaa

SEQ ID NO: 531891 - RNA, 64 nt, hsa
cacgugcagcguccuuggcaguuggcccaggaacuggagccacagagcuggugcugccgcugga

SEQ ID NO: 531892 - RNA, 64 nt, hsa
cagaaaggggagguggccugcuuggccgacgucauggagccagcugggagcagggcugagcguu

SEQ ID NO: 531893 - RNA, 64 nt, hsa
cugcuugugugcucaugaagacaugcccacgccauggagccaggggcuuauagagaggggcagu

SEQ ID NO: 531894 - RNA, 64 nt, hsa
uggagccaaaggugaccgcagggggccccagggcuggagccacaaggauacccucacuuugcau

SEQ ID NO: 531895 - RNA, 64 nt, hsa
aagcugucugcccuuggguucaagaaccagacuguggagccaaaggugaccgcagggggcccca

SEQ ID NO: 531896 - RNA, 64 nt, hsa
agcgggacucagugagcuggggccgucugugugguggagccagggccucucccuuuaguggagc

SEQ ID NO: 531897 - RNA, 64 nt, hsa
gucugugugguggagccagggccucucccuuuaguggagccagguugucgggccccgaauguca

SEQ ID NO: 531898 - RNA, 64 nt, hsa
caauucgugacccacucagccuuauccacggagcuggagccaaccuacgugccaggccccaugc

SEQ ID NO: 531899 - RNA, 64 nt, hsa
uucugcuuuuucaaauucuugcuggucuuagcaguggagccaugccuggguuucagagcagagc

SEQ ID NO: 531900 - RNA, 64 nt, hsa
agaauggugugaacccgggaggcggagcuugcaguggagccaagauugcgccacugcacuccag

SEQ ID NO: 531901 - RNA, 64 nt, hsa
guuugaaggcccagucuucucucccagccucaguuggagccaaagcuuuguccuuuagccagca

SEQ ID NO: 531902 - RNA, 64 nt, hsa
gccuuggucuaggucucuccaggccuuuccuuccuggagccacagugcuuagagacaggccacu

SEQ ID NO: 531903 - RNA, 64 nt, hsa
uccaacuuuaguuucugcaaagcuguugagagcauggagccaggcugcggggucuggguucaaa

SEQ ID NO: 531904 - RNA, 64 nt, hsa
ccaaggcucauacuguccuguccuuacccucagauggagccaggaagcucagugaaaggcuucc

SEQ ID NO: 531905 - RNA, 64 nt, hsa
cuaagcagcagacauccugaagaaaugguaaggguggagccaaaucucuagaaauaaguaguga

SEQ ID NO: 531906 - RNA, 64 nt, hsa
cucugaauauaugcaaaaagaaggccccauuuaguggagccagcaauccuguucagucaacaag

SEQ ID NO: 531907 - RNA, 64 nt, hsa
gguaauacgugaaagcaaaacaauaggggaagccuggagccaaagaugacacaaggggaagggu

SEQ ID NO: 531908 - RNA, 64 nt, hsa
aguugcacuaaauuccucucugaaucuuggcugcuggagccauucauucagcaaccuugucuaa

SEQ ID NO: 531909 - RNA, 64 nt, hsa
guuggauuggagaaguaauccuagggaagggugguggagccaguaaacagaggaguacagguga

SEQ ID NO: 531910 - RNA, 64 nt, hsa
acacaaacaauaguaauucucaggccaucaucaguggagccauguuaauguaaucugauggcuu

SEQ ID NO: 531911 - RNA, 64 nt, hsa
accuacaacucauggaagguaaagaaccugcaacuggagccaagaagaguaacaagccaaauga

SEQ ID NO: 531912 - RNA, 64 nt, hsa
aaguaucaggguaguucuguuucaaacuugcauguggagccauguggcacaaauacucaugcca

SEQ ID NO: 531913 - RNA, 64 nt, hsa
cccaagugcagagucaaggcagggagaggccggcuggagccaggcccccucgcacgcagccccc

SEQ ID NO: 531914 - RNA, 64 nt, hsa
gcuggaaccuuccaugggggucugggcuauuggcuggagccaggacaugagucaggggcaccau

SEQ ID NO: 531915 - RNA, 64 nt, hsa
agcugugccuggcacacaaugaaugcuaaauauauggagccauuauuauuuccugucucagaaa

SEQ ID NO: 531916 - RNA, 64 nt, hsa
gacucucuucccuuacuuucagaggcauaggaucuggagccagacugcuugggcucaaguccug

SEQ ID NO: 531917 - RNA, 64 nt, hsa
cagagucgccuuaguccagaaccugacaggccucuggagccaggcgacuucuugggaaacuguc

SEQ ID NO: 531918 - RNA, 64 nt, hsa
cguguaggaggaauacuucaggaugagugaaggcuggagccagggagcgcuggaggaaaccagc

SEQ ID NO: 531919 - RNA, 64 nt, hsa
ccccuggaguggcaggcccuguccuggguacagguggagccacccccaggaguugcguguguuu

SEQ ID NO: 531920 - RNA, 64 nt, hsa
ccugccacccccccugccugagcccaggacccacuggagccagccccacccuaggcaggaagac

SEQ ID NO: 531921 - RNA, 64 nt, hsa
gacgcggccgccauggaccccaugggagacacccuggagccacuguccacgauccaguacaacg

SEQ ID NO: 531922 - RNA, 64 nt, hsa
gccgcucucuccgcagguggaggcggaacgaggauggagccaucugcaggaagagcauaaagaa

SEQ ID NO: 531923 - RNA, 64 nt, hsa; identical to SEQ ID NO: 58780

SEQ ID NO: 531924 - RNA, 64 nt, hsa; identical to SEQ ID NO: 58781

SEQ ID NO: 531925 - RNA, 64 nt, hsa; identical to SEQ ID NO: 58782

SEQ ID NO: 531926 - RNA, 54 nt, hsa; identical to SEQ ID NO: 58783

SEQ ID NO: 531927 - RNA, 64 nt, hsa; identical to SEQ ID NO: 58784

SEQ ID NO: 531928 - RNA, 64 nt, hsa; identical to SEQ ID NO: 58785

SEQ ID NO: 531929 - RNA, 64 nt, hsa; identical to SEQ ID NO: 58786

SEQ ID NO: 531930 - RNA, 64 nt, hsa; identical to SEQ ID NO: 58787

SEQ ID NO: 531931 - RNA, 64 nt, hsa; identical to SEQ ID NO: 58788

SEQ ID NO: 531932 - RNA, 64 nt, hsa; identical to SEQ ID NO: 58788

SEQ ID NO: 531933 - RNA, 64 nt, hsa; identical to SEQ ID NO: 58790

SEQ ID NO: 531934 - RNA, 64 nt, hsa; identical to SEQ ID NO: 58791

SEQ ID NO: 531935 - RNA, 64 nt, hsa; identical to SEQ ID NO: 58792

SEQ ID NO: 531936 - RNA, 64 nt, hsa; identical to SEQ ID NO: 58793

SEQ ID NO: 531937 - RNA, 64 nt, hsa; identical to SEQ ID NO: 58794

SEQ ID NO: 531938 - RNA, 64 nt, hsa; identical to SEQ ID NO: 58795

SEQ ID NO: 531939 - RNA, 64 nt, hsa; identical to SEQ ID NO: 58796

SEQ ID NO: 531940 - RNA, 64 nt, hsa; identical to SEQ ID NO: 440913

SEQ ID NO: 531941 - RNA, 64 nt, hsa; identical to SEQ ID NO: 440914

SEQ ID NO: 531942 - RNA, 64 nt, hsa; identical to SEQ ID NO: 440915

SEQ ID NO: 531943 - RNA, 64 nt, hsa; identical to SEQ ID NO: 440916

SEQ ID NO: 531944 - RNA, 64 nt, hsa; identical to SEQ ID NO: 440917

SEQ ID NO: 531945 - RNA, 64 nt, hsa; identical to SEQ ID NO: 440918

SEQ ID NO: 531946 - RNA, 64 nt, hsa; identical to SEQ ID NO: 440919

SEQ ID NO: 531947 - RNA, 64 nt, hsa; identical to SEQ ID NO: 440920

SEQ ID NO: 531948 - RNA, 64 nt, hsa; identical to SEQ ID NO: 440921

SEQ ID NO: 531949 - RNA, 64 nt, hsa; identical to SEQ ID NO: 440922

SEQ ID NO: 531950 - RNA, 64 nt, hsa; identical to SEQ ID NO: 440923

SEQ ID NO: 531951 - RNA, 64 nt, hsa; identical to SEQ ID NO: 440924

SEQ ID NO: 531952 - RNA, 64 nt, hsa; identical to SEQ ID NO: 440925

SEQ ID NO: 531953 - RNA, 64 nt, hsa; identical to SEQ ID NO: 440926

SEQ ID NO: 531954 - RNA, 64 nt, hsa; identical to SEQ ID NO: 440927

SEQ ID NO: 531955 - RNA, 64 nt, hsa; identical to SEQ ID NO: 440928

SEQ ID NO: 531956 - RNA, 64 nt, hsa; identical to SEQ ID NO: 440929

SEQ ID NO: 531957 - RNA, 64 nt, hsa; identical to SEQ ID NO: 440930

SEQ ID NO: 531958 - RNA, 64 nt, hsa; identical to SEQ ID NO: 440931

SEQ ID NO: 531959 - RNA, 64 nt, hsa; identical to SEQ ID NO: 440932

SEQ ID NO: 531960 - RNA, 64 nt, hsa; identical to SEQ ID NO: 440933

SEQ ID NO: 531961 - RNA, 64 nt, hsa; identical to SEQ ID NO: 440934

SEQ ID NO: 531962 - RNA, 64 nt, hsa; identical to SEQ ID NO: 440935

SEQ ID NO: 531963 - RNA, 64 nt, hsa; identical to SEQ ID NO: 440936

SEQ ID NO: 531964 - RNA, 64 nt, hsa; identical to SEQ ID NO: 440937

SEQ ID NO: 531965 - RNA, 64 nt, hsa; identical to SEQ ID NO: 440938

SEQ ID NO: 531966 - RNA, 64 nt, hsa; identical to SEQ ID NO: 440939

SEQ ID NO: 531967 - RNA, 64 nt, hsa; identical to SEQ ID NO: 440940

SEQ ID NO: 531968 - RNA, 64 nt, hsa; identical to SEQ ID NO: 440941

SEQ ID NO: 531969 - RNA, 64 nt, hsa; identical to SEQ ID NO: 440942

SEQ ID NO: 531970 - RNA, 64 nt, hsa; identical to SEQ ID NO: 195045

SEQ ID NO: 531971 - RNA, 64 nt, hsa; identical to SEQ ID NO: 195046

SEQ ID NO: 531972 - RNA, 64 nt, hsa; identical to SEQ ID NO: 195047

SEQ ID NO: 531973 - RNA, 64 nt, hsa; identical to SEQ ID NO: 195048

SEQ ID NO: 531974 - RNA, 64 nt, hsa; identical to SEQ ID NO: 195049

SEQ ID NO: 531975 - RNA, 64 nt, hsa; identical to SEQ ID NO: 195050

SEQ ID NO: 531976 - RNA, 64 nt, hsa; identical to SEQ ID NO: 195051

SEQ ID NO: 531977 - RNA, 64 nt, hsa; identical to SEQ ID NO: 195052

SEQ ID NO: 531978 - RNA, 64 nt, hsa; identical to SEQ ID NO: 195053

SEQ ID NO: 531979 - RNA, 64 nt, hsa; identical to SEQ ID NO: 195054

SEQ ID NO: 531980 - RNA, 64 nt, hsa; identical to SEQ ID NO: 195055

SEQ ID NO: 531981 - RNA, 64 nt, hsa; identical to SEQ ID NO: 195056

SEQ ID NO: 531982 - RNA, 64 nt, hsa; identical to SEQ ID NO: 195057

SEQ ID NO: 531983 - RNA, 64 nt, hsa; identical to SEQ ID NO: 195058

SEQ ID NO: 531984 - RNA, 64 nt, hsa; identical to SEQ ID NO: 195059

SEQ ID NO: 531985 - RNA, 64 nt, hsa; identical to SEQ ID NO: 195060

SEQ ID NO: 531986 - RNA, 64 nt, hsa; identical to SEQ ID NO: 195061

SEQ ID NO: 531987 - RNA, 64 nt, hsa; identical to SEQ ID NO: 195062

SEQ ID NO: 531988 - RNA, 64 nt, hsa; identical to SEQ ID NO: 195063

SEQ ID NO: 531989 - RNA, 64 nt, hsa; identical to SEQ ID NO: 195064

SEQ ID NO: 531990 - RNA, 64 nt, hsa; identical to SEQ ID NO: 195065

SEQ ID NO: 531991 - RNA, 64 nt, hsa; identical to SEQ ID NO: 195066

SEQ ID NO: 531992 - RNA, 64 nt, hsa; identical to SEQ ID NO: 195067

SEQ ID NO: 531993 - RNA, 64 nt, hsa; identical to SEQ ID NO: 195068

SEQ ID NO: 531994 - RNA, 64 nt, hsa; identical to SEQ ID NO: 195069

SEQ ID NO: 531995 - RNA, 64 nt, hsa; identical to SEQ ID NO: 195070

SEQ ID NO: 531996 - RNA, 64 nt, hsa; identical to SEQ ID NO: 195071

SEQ ID NO: 531997 - RNA, 64 nt, hsa; identical to SEQ ID NO: 195072

SEQ ID NO: 531998 - RNA, 64 nt, hsa; identical to SEQ ID NO: 195073

SEQ ID NO: 531999 - RNA, 64 nt, hsa; identical to SEQ ID NO: 195074

SEQ ID NO: 532000 - RNA, 64 nt, hsa; identical to SEQ ID NO: 195075

SEQ ID NO: 532001 - RNA, 64 nt, hsa; identical to SEQ ID NO: 195076

SEQ ID NO: 532002 - RNA, 64 nt, hsa; identical to SEQ ID NO: 195077

SEQ ID NO: 532003 - RNA, 64 nt, hsa; identical to SEQ ID NO: 195078

SEQ ID NO: 532004 - RNA, 64 nt, hsa; identical to SEQ ID NO: 195079

SEQ ID NO: 532005 - RNA, 64 nt, hsa; identical to SEQ ID NO: 195080

SEQ ID NO: 532006 - RNA, 64 nt, hsa; identical to SEQ ID NO: 195081

SEQ ID NO: 532007 - RNA, 64 nt, hsa; identical to SEQ ID NO: 195082

SEQ ID NO: 532008 - RNA, 64 nt, hsa; identical to SEQ ID NO: 195083

SEQ ID NO: 532009 - RNA, 64 nt, hsa; identical to SEQ ID NO: 195084

SEQ ID NO: 532010 - RNA, 64 nt, hsa; identical to SEQ ID NO: 195085

SEQ ID NO: 532011 - RNA, 64 nt, hsa; identical to SEQ ID NO: 195086

SEQ ID NO: 532012 - RNA, 64 nt, hsa; identical to SEQ ID NO: 195087

SEQ ID NO: 532013 - RNA, 64 nt, hsa; identical to SEQ ID NO: 195088

SEQ ID NO: 532014 - RNA, 64 nt, hsa; identical to SEQ ID NO: 195089

SEQ ID NO: 532015 - RNA, 64 nt, hsa; identical to SEQ ID NO: 195090

SEQ ID NO: 532016 - RNA, 64 nt, hsa; identical to SEQ ID NO: 195091

SEQ ID NO: 532017 - RNA, 64 nt, hsa; identical to SEQ ID NO: 195092

SEQ ID NO: 532018 - RNA, 64 nt, hsa; identical to SEQ ID NO: 195093

SEQ ID NO: 532019 - RNA, 64 nt, hsa; identical to SEQ ID NO: 153150

SEQ ID NO: 532020 - RNA, 64 nt, hsa; identical to SEQ ID NO: 153151

SEQ ID NO: 532021 - RNA, 64 nt, hsa; identical to SEQ ID NO: 153152

SEQ ID NO: 532022 - RNA, 64 nt, hsa; identical to SEQ ID NO: 153153

SEQ ID NO: 532023 - RNA, 64 nt, hsa; identical to SEQ ID NO: 153154

SEQ ID NO: 532024 - RNA, 64 nt, hsa; identical to SEQ ID NO: 153155

SEQ ID NO: 532025 - RNA, 64 nt, hsa; identical to SEQ ID NO: 153156

SEQ ID NO: 532026 - RNA, 64 nt, hsa; identical to SEQ ID NO: 153157

SEQ ID NO: 532027 - RNA, 64 nt, hsa; identical to SEQ ID NO: 153158

SEQ ID NO: 532028 - RNA, 64 nt, hsa; identical to SEQ ID NO: 153159

SEQ ID NO: 532029 - RNA, 64 nt, hsa; identical to SEQ ID NO: 153160

SEQ ID NO: 532030 - RNA, 64 nt, hsa; identical to SEQ ID NO: 153161

SEQ ID NO: 532031 - RNA, 52 nt, hsa; identical to SEQ ID NO: 153162

SEQ ID NO: 532032 - RNA, 64 nt, hsa; identical to SEQ ID NO: 153163

SEQ ID NO: 532033 - RNA, 64 nt, hsa; identical to SEQ ID NO: 81134

SEQ ID NO: 532034 - RNA, 64 nt, hsa; identical to SEQ ID NO: 81135

SEQ ID NO: 532035 - RNA, 64 nt, hsa; identical to SEQ ID NO: 81136

SEQ ID NO: 532036 - RNA, 64 nt, hsa; identical to SEQ ID NO: 81137

SEQ ID NO: 532037 - RNA, 64 nt, hsa; identical to SEQ ID NO: 81138

SEQ ID NO: 532038 - RNA, 64 nt, hsa; identical to SEQ ID NO: 81139

SEQ ID NO: 532039 - RNA, 64 nt, hsa; identical to SEQ ID NO: 81140

SEQ ID NO: 532040 - RNA, 64 nt, hsa; identical to SEQ ID NO: 81141

SEQ ID NO: 532041 - RNA, 64 nt, hsa; identical to SEQ ID NO: 81142

SEQ ID NO: 532042 - RNA, 64 nt, hsa; identical to SEQ ID NO: 81143

SEQ ID NO: 532043 - RNA, 64 nt, hsa; identical to SEQ ID NO: 81144

SEQ ID NO: 532044 - RNA, 64 nt, hsa; identical to SEQ ID NO: 81145

SEQ ID NO: 532045 - RNA, 64 nt, hsa; identical to SEQ ID NO: 81146

SEQ ID NO: 532046 - RNA, 64 nt, hsa; identical to SEQ ID NO: 81147

SEQ ID NO: 532047 - RNA, 64 nt, hsa; identical to SEQ ID NO: 81148

SEQ ID NO: 532048 - RNA, 64 nt, hsa; identical to SEQ ID NO: 81149

SEQ ID NO: 532049 - RNA, 64 nt, hsa; identical to SEQ ID NO: 81150

SEQ ID NO: 532050 - RNA, 64 nt, hsa; identical to SEQ ID NO: 81151

SEQ ID NO: 532051 - RNA, 64 nt, hsa; identical to SEQ ID NO: 81152

SEQ ID NO: 532052 - RNA, 64 nt, hsa; identical to SEQ ID NO: 81153

SEQ ID NO: 532053 - RNA, 64 nt, hsa; identical to SEQ ID NO: 81154

SEQ ID NO: 532054 - RNA, 64 nt, hsa; identical to SEQ ID NO: 81155

SEQ ID NO: 532055 - RNA, 64 nt, hsa; identical to SEQ ID NO: 81156

SEQ ID NO: 532056 - RNA, 64 nt, hsa; identical to SEQ ID NO: 81157

SEQ ID NO: 532057 - RNA, 64 nt, hsa; identical to SEQ ID NO: 81158

SEQ ID NO: 532058 - RNA, 64 nt, hsa; identical to SEQ ID NO: 81159

SEQ ID NO: 532059 - RNA, 64 nt, hsa; identical to SEQ ID NO: 81160

SEQ ID NO: 532060 - RNA, 64 nt, hsa; identical to SEQ ID NO: 81161

SEQ ID NO: 532061 - RNA, 64 nt, hsa; identical to SEQ ID NO: 81162

SEQ ID NO: 532062 - RNA, 64 nt, hsa; identical to SEQ ID NO: 81163

SEQ ID NO: 532063 - RNA, 64 nt, hsa; identical to SEQ ID NO: 81164

SEQ ID NO: 532064 - RNA, 64 nt, hsa; identical to SEQ ID NO: 81165

SEQ ID NO: 532065 - RNA, 64 nt, hsa; identical to SEQ ID NO: 81166

SEQ ID NO: 532066 - RNA, 64 nt, hsa; identical to SEQ ID NO: 81167

SEQ ID NO: 532067 - RNA, 64 nt, hsa; identical to SEQ ID NO: 81168

SEQ ID NO: 532068 - RNA, 64 nt, hsa; identical to SEQ ID NO: 81169

SEQ ID NO: 532069 - RNA, 64 nt, hsa; identical to SEQ ID NO: 81170

SEQ ID NO: 532070 - RNA, 64 nt, hsa; identical to SEQ ID NO: 81171

SEQ ID NO: 532071 - RNA, 64 nt, hsa; identical to SEQ ID NO: 81172

SEQ ID NO: 532072 - RNA, 64 nt, hsa; identical to SEQ ID NO: 81173

SEQ ID NO: 532073 - RNA, 64 nt, hsa
uggugaaaagcuuuucacuaagugagguuccuucccugcaaaugcugaaucuagccuaauucgc

SEQ ID NO: 532074 - RNA, 64 nt, hsa
ccccuccaucaagaucuuugagggaccaccucacccugcaaaagagacagguccuccaguaccc

SEQ ID NO: 532075 - RNA, 64 nt, hsa
ugaucuucacuccagucacuagggacaauagaaaccugcaaaacacagauucauucguaaauau

SEQ ID NO: 532076 - RNA, 64 nt, hsa
gaaaagcagucaaguuccaaggaacugacagcaaccugcaaagaggaaaacagcaucuccucac

SEQ ID NO: 532077 - RNA, 64 nt, hsa
uuucaccuacaaaauuucaccugcaaaccuuaaaccugcaaaauuuuccuuuaauaaaauuugc

SEQ ID NO: 532078 - RNA, 64 nt, hsa
gugaaaaguaaaccuuuucaccuacaaaauuucaccugcaaaccuuaaaccugcaaaauuuucc

SEQ ID NO: 532079 - RNA, 64 nt, hsa
acacgccugcaaacgcugccugcccguaaacacgccugcaaacgcugccugcccacacagguuc

SEQ ID NO: 532080 - RNA, 64 nt, hsa
acacgccugcaaacgcugccugccgguaaacacgccugcaaacgcugccugcccguaaacacgc

SEQ ID NO: 532081 - RNA, 64 nt, hsa
gucucacauggugcuacgccugcauguaaacacgccugcaaacgcugccugccgguaaacacgc

SEQ ID NO: 532082 - RNA, 64 nt, hsa
gaagcgcggacccuucuggguccagggaggggucccugcaaaacuccaggcaggacuucucacc

SEQ ID NO: 532083 - RNA, 64 nt, hsa
accagaaagcuucauccacagccuugcagcggcuccugcaaaaggaggugaaaucccugccuca

SEQ ID NO: 532084 - RNA, 64 nt, hsa
acacguggaggaaugcucccccauccuccccuucccugcaaacaugggguuggcugggcccaga

SEQ ID NO: 532085 - RNA, 64 nt, hsa
ugaccuguggggauuucucccagcucuagacaacccugcaaaggacuguuuuuuccugagcuug

SEQ ID NO: 532086 - RNA, 64 nt, hsa
gagcaagaaugccagaaauagccuucauuucuacccugcaaaauaauccagaucugcuuucuaa

SEQ ID NO: 532087 - RNA, 64 nt, hsa
aaaauccuagaguugauucauuguuuuccuccauccugcaaaagaagaucccuuuguuaagcag

SEQ ID NO: 532088 - RNA, 64 nt, hsa
uggcaggggcaggcaacuuugggugcugcugaugccugcaaaagccauuuauggcuuguggugg

SEQ ID NO: 532089 - RNA, 64 nt, hsa
uuuugucuguucccuaagaaaauauauuuucauuccugcaaacacagugcucagccuucaguuc

SEQ ID NO: 532090 - RNA, 64 nt, hsa; identical to SEQ ID NO: 413193

SEQ ID NO: 532091 - RNA, 64 nt, hsa; identical to SEQ ID NO: 413194

SEQ ID NO: 532092 - RNA, 64 nt, hsa; identical to SEQ ID NO: 413195

SEQ ID NO: 532093 - RNA, 64 nt, hsa; identical to SEQ ID NO: 413196

SEQ ID NO: 532094 - RNA, 64 nt, hsa; identical to SEQ ID NO: 413197

SEQ ID NO: 532095 - RNA, 64 nt, hsa; identical to SEQ ID NO: 413198

SEQ ID NO: 532096 - RNA, 64 nt, hsa; identical to SEQ ID NO: 413199

SEQ ID NO: 532097 - RNA, 64 nt, hsa; identical to SEQ ID NO: 413200

SEQ ID NO: 532098 - RNA, 64 nt, hsa; identical to SEQ ID NO: 413201

SEQ ID NO: 532099 - RNA, 64 nt, hsa; identical to SEQ ID NO: 413202

SEQ ID NO: 532100 - RNA, 64 nt, hsa; identical to SEQ ID NO: 413203

SEQ ID NO: 532101 - RNA, 64 nt, hsa; identical to SEQ ID NO: 413204

SEQ ID NO: 532102 - RNA, 64 nt, hsa; identical to SEQ ID NO: 413205

SEQ ID NO: 532103 - RNA, 64 nt, hsa; identical to SEQ ID NO: 413206

SEQ ID NO: 532104 - RNA, 64 nt, hsa; identical to SEQ ID NO: 413207

SEQ ID NO: 532105 - RNA, 64 nt, hsa; identical to SEQ ID NO: 413208

SEQ ID NO: 532106 - RNA, 64 nt, hsa; identical to SEQ ID NO: 413209

SEQ ID NO: 532107 - RNA, 64 nt, hsa; identical to SEQ ID NO: 413210

SEQ ID NO: 532108 - RNA, 64 nt, hsa; identical to SEQ ID NO: 413211

SEQ ID NO: 532109 - RNA, 64 nt, hsa; identical to SEQ ID NO: 413212

SEQ ID NO: 532110 - RNA, 64 nt, hsa; identical to SEQ ID NO: 413213

SEQ ID NO: 532111 - RNA, 64 nt, hsa; identical to SEQ ID NO: 413214

SEQ ID NO: 532112 - RNA, 64 nt, hsa; identical to SEQ ID NO: 413215

SEQ ID NO: 532113 - RNA, 64 nt, hsa; identical to SEQ ID NO: 413216

SEQ ID NO: 532114 - RNA, 64 nt, hsa
cucuacuaaaaauacaaaaaauuagccaggcauggugccgcauaacuauaaucccagcuacuug

SEQ ID NO: 532115 - RNA, 64 nt, hsa
gcuuacauacagaggcccuucaggagggccuccugugccgcagggagggugcguggggaagaug

SEQ ID NO: 532116 - RNA, 64 nt, hsa
acggagucucacucugucaccaggcuggagugcagugccgcaaucucggcucacugcaaccucc

SEQ ID NO: 532117 - RNA, 64 nt, hsa
cgugucguguccuuuucucucuggcuaggcaggugugccgcaaauauuugacgaauagauggau

SEQ ID NO: 532118 - RNA, 64 nt, hsa
cuugauucugacauuuggcccagccuguacuggugugccgcaaugagagucaaucucuauugac

SEQ ID NO: 532119 - RNA, 64 nt, hsa
gagggcagcgggagccucccugccucaggccucugugccgcaccauugaacuguaccaugugcu

SEQ ID NO: 532120 - RNA, 64 nt, hsa
uagcuucugaucccuggguucugggagacugcaggugccgcacauugucaaguuagaaauacuc

SEQ ID NO: 532121 - RNA, 64 nt, hsa
uggaucccaguguugccuuaacagggugucugucgugccgcaguagagcacugcugcuuccucc

SEQ ID NO: 532122 - RNA, 64 nt, hsa
cuuggcgucugcccugcccucgcggcuucccgccgugccgcagcgugcccacgugcccacgccc

SEQ ID NO: 532123 - RNA, 64 nt, hsa
uuggguugguuccaagucuuugcuauugugaauagugccgcaauaaacauacgugugcaugugu

SEQ ID NO: 532124 - RNA, 64 nt, hsa
agcugagggaccaggcuggggucgcugcguugcugugccgcagagauccacucuguccguggag

SEQ ID NO: 532125 - RNA, 64 nt, hsa
gaaucaaaugggcaauauuuguccugggagaccugugccgcacccagguccccguguuaacgug

SEQ ID NO: 532126 - RNA, 64 nt, hsa
aggaacagcgggcccugagcagccccggaagcaagugccgcauucuucaggaaggaagagaccu

SEQ ID NO: 532127 - RNA, 64 nt, hsa
agcccaggcagggugagcagucccagugguccuagugccgcaucagauccaggugggugagggc

SEQ ID NO: 532128 - RNA, 64 nt, hsa
caguguaauuaucucugaaagagcaagucagcuugugccgcauccccaaccaauccacagccug

SEQ ID NO: 532129 - RNA, 64 nt, hsa
agugggcggcgugugcuagcaaggccugccgggugugccgcagucaccacaggguucugagaac

SEQ ID NO: 532130 - RNA, 64 nt, hsa
ccuguguaacuuguagcucuuccucuaugccuuggugccgcaguggcccaucuuuuaugggaag

SEQ ID NO: 532131 - RNA, 64 nt, hsa
gucugguguuggcgugugggagacaugugugcucgugccgcacauacacauccuggccgugcac

SEQ ID NO: 532132 - RNA, 64 nt, hsa
cuucuaccucccagcgagaccuggcccagaaagggugccgcagcaaggagugauaugguuuguc

SEQ ID NO: 532133 - RNA, 64 nt, hsa
gaggccacguccacaaggagcuuuucaugccccugugccgcauagccucaccucuuuccuccag

SEQ ID NO: 532134 - RNA, 64 nt, hsa
ucuucauguuccgaaguguagucuugaggcccuggugccgcacuucuagcauguuggucuccuu

SEQ ID NO: 532135 - RNA, 64 nt, hsa
ccucgugccucugucccucaccacgguguggacagugccgcacccucaacauaggccauguggg

SEQ ID NO: 532136 - RNA, 64 nt, hsa
cgaaugaggcucaugggagguuuggacgggugcugugccgcaugucgaggccgauugugugcca

SEQ ID NO: 532137 - RNA, 64 nt, hsa
gugcugaggcugcaucagacccugguagggaggggugccgcagccacuaacgguaugugcucuc

SEQ ID NO: 532138 - RNA, 64 nt, hsa
ccaggagagccccauucccagccccuggucucccgugccgcaguucuauauucugcuucaaauc

SEQ ID NO: 532139 - RNA, 64 nt, hsa
cccagaacacuuguauauuguuuguuugagguucgugccgcaguaacagacacaguauuuaauu

SEQ ID NO: 532140 - RNA, 64 nt, hsa
uuaauaaaauugugauaaucaguuaucaguacaagugccgcauagugcauaggcugaaaugucu

SEQ ID NO: 532141 - RNA, 64 nt, hsa
guuauauaauuguugaacagguguuuuuccacaagugccgcaaauuguaccuuuuuuguuuuuu

SEQ ID NO: 532142 - RNA, 64 nt, hsa
cacauuugugugggucucucauugucccuuaacagugccgcaucucagccuggaagucagcuuu

SEQ ID NO: 532143 - RNA, 64 nt, hsa
ugucacgacuggaagggcgugaggccucccagcagugccgcagcguuucgaggggcgugugcug

SEQ ID NO: 532144 - RNA, 64 nt, hsa
ccuguugacguaacuaagccuuacagcaaggcaugugccgcacgugcuccgugguacuuagagc

SEQ ID NO: 532145 - RNA, 64 nt, hsa
uccccagccacaggccugcuacgacccccacgaugugccgcaagcacugucucaccaucccgca

SEQ ID NO: 532146 - RNA, 64 nt, hsa
cgucucaccaggcagacagucugccuaggacccagugccgcaggccuggaucagaccccaggau

SEQ ID NO: 532147 - RNA, 64 nt, hsa
uuuuaucuuauaugccagaggcaccaggccagaugugccgcacagucauguaauucaaucaugu

SEQ ID NO: 532148 - RNA, 64 nt, hsa
ucacccauggugucccugucgcucccuucccugggugccgcacguccagccuguguccaggccu

SEQ ID NO: 532149 - RNA, 64 nt, hsa
gcaaggaugguggggcccccagcacccucuguuagugccgcaauaaaugcucaaucaugugcca

SEQ ID NO: 532150 - RNA, 64 nt, hsa
ccuuagccucccaaguagcugggauuacaggugugugccgcaaugcccagcuaauuuuuguguu

SEQ ID NO: 532151 - RNA, 64 nt, hsa
gcuccauuugguuccagcccacuccccucugcaagugccgcagcuucccucagagcauacucuc

SEQ ID NO: 532152 - RNA, 64 nt, hsa
cgggugguggcagagugagaaggccacugguucugugccgcagcacgcaaaauuuagaauucua

SEQ ID NO: 532153 - RNA, 64 nt, hsa
aacuucuguaaggggcagcaguugaggugggguagugccgcaguggggucaagcugagcuggcu

SEQ ID NO: 532154 - RNA, 64 nt, hsa
aacaucggauuuggggaacgcgugucaaucccuugugccgcagggcugggcgggagagacuguu

SEQ ID NO: 532155 - RNA, 64 nt, hsa
gguugugaccccaacccaaggucaccccccaggggugccgcauacaggaggugcuuaauaaacg

SEQ ID NO: 532156 - RNA, 64 nt, hsa
gaccccgacucacugccagccggggcggggcagggugccgcaggcugggcuugcuaauaaagac

SEQ ID NO: 532157 - RNA, 64 nt, hsa
uguuuuuauuucugacuuuuuuaaaauuccaggugugccgcacccacuuucucgcaguguuuua

SEQ ID NO: 532158 - RNA, 64 nt, hsa
gcaugggugucauagccaucacgagcaugucacagugccgcagagauuuuguuuaugggcaguu

SEQ ID NO: 532159 - RNA, 64 nt, hsa
caaugguaguuucugugguuggcugggaaaucgagugccgcaucucacagcuaugcaaaaagcu

SEQ ID NO: 532160 - RNA, 64 nt, hsa
ccaccagccugagcaagacgcccucucggggccugugccgcacuagccucccucuccucugucc

SEQ ID NO: 532161 - RNA, 64 nt, hsa
cugcuagcaggcccccuaggauucccccugcccugugccgcacucuggcgguggccacagcgug

SEQ ID NO: 532162 - RNA, 64 nt, hsa
cugccuuggugugcaguccagggcucucacccaggugccgcacccucuggggucuucuguccag

SEQ ID NO: 532163 - RNA, 64 nt, hsa
uuacccugagcaugacugggacacagccgcgcccgugccgcagaaggauuuagaaaucuucaag

SEQ ID NO: 532164 - RNA, 51 nt, hsa
caagaacuagaaauaaauaaggauggugauagagagguauaccuucauauu

SEQ ID NO: 532165 - RNA, 64 nt, hsa
gcagaaaagaucucaagaaccagaaauaaauaaggauggugauagagagguauaccuuuauauu

SEQ ID NO: 532166 - RNA, 64 nt, hsa
ccuagggaagcccauccaucuggaugguuucaaggauggugaggaauuuagaguugaccuccag

SEQ ID NO: 532167 - RNA, 64 nt, hsa
gcaggcagggcagggucugugaagcuuaagagcagauggugacaaguucucugggcagguggcc

SEQ ID NO: 532168 - RNA, 64 nt, hsa
aggaaacaauagauuauuuuauauuauuauuucugauggugacaaguuugucuugaggucacau

SEQ ID NO: 532169 - RNA, 64 nt, hsa
gcauacugaaaaaggaaugccaccugccacaguugauggugaggaagcuccuuugacguggugc

SEQ ID NO: 532170 - RNA, 64 nt, hsa
cauucuuuauggccagcagcccuugguuggugcagauggugauaggaccagugggucccacagc

SEQ ID NO: 532171 - RNA, 64 nt, hsa
accacuggcacuuucagcaccagggggucugaaggauggugacugcgccauggccuggaucugc

SEQ ID NO: 532172 - RNA, 64 nt, hsa
acacauuuagaguaguccuuggagauuuuauggagauggugagcacaagguaagucauaaagaa

SEQ ID NO: 532173 - RNA, 64 nt, hsa
uagacuucguuaguaauguucaacuuuucacaaagauggugagugccaucuuaaaacuuacugg

SEQ ID NO: 532174 - RNA, 64 nt, hsa
cccagcccagauucaucugugccuuggacauggugauggugauggguugccauccaagugaaag

SEQ ID NO: 532175 - RNA, 64 nt, hsa
ggacggguauuucauggcuuggugcuguuuucuugauggugaauuauugcaagauacggucauu

SEQ ID NO: 532176 - RNA, 64 nt, hsa
aacagacaagaaggagcgaaaguauauuuuauuugauggugauguggaugcucuauggguggaa

SEQ ID NO: 532177 - RNA, 64 nt, hsa
cccuuccauucugcagauuccagacgguggcccagauggugagagucuggaggaaugagugucu

SEQ ID NO: 532178 - RNA, 64 nt, hsa
agucacgcguagggauggugaggagacgcguagggauggugaggaggggagaggagggagaccu

SEQ ID NO: 532179 - RNA, 64 nt, hsa
cccauuuuuaucaggaaagucagucacgcguagggauggugaggagacgcguagggauggugag

SEQ ID NO: 532180 - RNA, 64 nt, hsa
uggcgacacggccucccgaggaagaggucugcuugauggugacucugcaggagacucugaagug

SEQ ID NO: 532181 - RNA, 64 nt, hsa
ccaucggacagagacuggagcccaggugacaggagauggugauaccagaagucaaggguugggg

SEQ ID NO: 532182 - RNA, 64 nt, hsa; identical to SEQ ID NO: 132737

SEQ ID NO: 532183 - RNA, 64 nt, hsa; identical to SEQ ID NO: 132738

SEQ ID NO: 532184 - RNA, 64 nt, hsa; identical to SEQ ID NO: 132739

SEQ ID NO: 532185 - RNA, 64 nt, hsa; identical to SEQ ID NO: 132740

SEQ ID NO: 532186 - RNA, 64 nt, hsa; identical to SEQ ID NO: 132741

SEQ ID NO: 532187 - RNA, 64 nt, hsa; identical to SEQ ID NO: 132742

SEQ ID NO: 532188 - RNA, 64 nt, hsa; identical to SEQ ID NO: 132743

SEQ ID NO: 532189 - RNA, 64 nt, hsa; identical to SEQ ID NO: 132744

SEQ ID NO: 532190 - RNA, 64 nt, hsa; identical to SEQ ID NO: 132745

SEQ ID NO: 532191 - RNA, 64 nt, hsa; identical to SEQ ID NO: 132746

SEQ ID NO: 532192 - RNA, 64 nt, hsa; identical to SEQ ID NO: 132747

SEQ ID NO: 532193 - RNA, 64 nt, hsa; identical to SEQ ID NO: 132748

SEQ ID NO: 532194 - RNA, 64 nt, hsa; identical to SEQ ID NO: 132749

SEQ ID NO: 532195 - RNA, 64 nt, hsa; identical to SEQ ID NO: 132750

SEQ ID NO: 532196 - RNA, 64 nt, hsa; identical to SEQ ID NO: 132751

SEQ ID NO: 532197 - RNA, 64 nt, hsa; identical to SEQ ID NO: 132752

SEQ ID NO: 532198 - RNA, 64 nt, hsa; identical to SEQ ID NO: 132753

SEQ ID NO: 532199 - RNA, 64 nt, hsa; identical to SEQ ID NO: 132754

SEQ ID NO: 532200 - RNA, 64 nt, hsa; identical to SEQ ID NO: 132755

SEQ ID NO: 532201 - RNA, 64 nt, hsa; identical to SEQ ID NO: 132756

SEQ ID NO: 532202 - RNA, 64 nt, hsa; identical to SEQ ID NO: 132757

SEQ ID NO: 532203 - RNA, 64 nt, hsa; identical to SEQ ID NO: 132758

SEQ ID NO: 532204 - RNA, 64 nt, hsa; identical to SEQ ID NO: 132759

SEQ ID NO: 532205 - RNA, 64 nt, hsa; identical to SEQ ID NO: 132760

SEQ ID NO: 532206 - RNA, 64 nt, hsa; identical to SEQ ID NO: 132761

SEQ ID NO: 532207 - RNA, 64 nt, hsa; identical to SEQ ID NO: 132762

SEQ ID NO: 532208 - RNA, 64 nt, hsa; identical to SEQ ID NO: 240322

SEQ ID NO: 532209 - RNA, 64 nt, hsa; identical to SEQ ID NO: 240323

SEQ ID NO: 532210 - RNA, 64 nt, hsa; identical to SEQ ID NO: 240324

SEQ ID NO: 532211 - RNA, 64 nt, hsa; identical to SEQ ID NO: 240325

SEQ ID NO: 532212 - RNA, 64 nt, hsa; identical to SEQ ID NO: 240326

SEQ ID NO: 532213 - RNA, 64 nt, hsa; identical to SEQ ID NO: 240327

SEQ ID NO: 532214 - RNA, 64 nt, hsa; identical to SEQ ID NO: 240328

SEQ ID NO: 532215 - RNA, 64 nt, hsa; identical to SEQ ID NO: 240329

SEQ ID NO: 532216 - RNA, 64 nt, hsa; identical to SEQ ID NO: 240330

SEQ ID NO: 532217 - RNA, 64 nt, hsa; identical to SEQ ID NO: 240331

SEQ ID NO: 532218 - RNA, 64 nt, hsa; identical to SEQ ID NO: 240332

SEQ ID NO: 532219 - RNA, 64 nt, hsa; identical to SEQ ID NO: 240333

SEQ ID NO: 532220 - RNA, 64 nt, hsa; identical to SEQ ID NO: 240334

SEQ ID NO: 532221 - RNA, 62 nt, hsa
gcauuggaaaaagccacuuggacuucacagagcugucagaagacuuaggaagcuuugccagu

SEQ ID NO: 532222 - RNA, 62 nt, hsa
ucucuggagauagcuaccuggacuuuacagagcugucagaagacuugggaagguuugccagc

SEQ ID NO: 532223 - RNA, 62 nt, hsa
ggauugagugcugucagaaaguggauugagugcugucagaaagugggagugauuuugcaacu

SEQ ID NO: 532224 - RNA, 62 nt, hsa
caagugagcaaggguuucuucuggauugagugcugucagaaaguggauugagugcugucaga

SEQ ID NO: 532225 - RNA, 62 nt, hsa
uguaaagugaaguaagauuggaggguggauggcugucagagcucuugcagauacuguguuca

SEQ ID NO: 532226 - RNA, 62 nt, hsa
acgggggcagcgugcagcccugcccugucaggcugucagacaagccccggggggcagcaggu

SEQ ID NO: 532227 - RNA, 62 nt, hsa
acugcccuucucucugccugccucaccuccagcugucagagggugagcagggcccuggaggc

SEQ ID NO: 532228 - RNA, 62 nt, hsa
cccagcccagccugcucugcggcccccugcggcugucagagagcggugagaccuggagcgag

SEQ ID NO: 532229 - RNA, 62 nt, hsa
augggacguuuuauuugugugcucucccuugacugucagauugaaguaagagcaguucucuc

SEQ ID NO: 532230 - RNA, 62 nt, hsa
cagagcuuccauuaguguagaccuguagccaccugucagaagguggguggcauauuggggac

SEQ ID NO: 532231 - RNA, 62 nt, hsa
gaggauuccuucaccacaguuucaccuuuacgcugucagacaacuuccugccacagaagaag

SEQ ID NO: 532232 - RNA, 62 nt, hsa
ucuuccguguucucagagguucuuuucagugucugucagaacuuggcauacuuucuccauag

SEQ ID NO: 532233 - RNA, 62 nt, hsa
uggcccgaggggcuguggaacgggucccggaacugucagacauguuugauuuuagcguuucc

SEQ ID NO: 532234 - RNA, 62 nt, hsa
caaaggucuugguucucccaggagcucagggccugucagaccuggugacaagugccaaaggc

SEQ ID NO: 532235 - RNA, 64 nt, hsa
ggcugccuuggaggguacaagauccacugaggguggccaccacagccuuggcuccaugguggcg

SEQ ID NO: 532236 - RNA, 64 nt, hsa
gaagaauggagggaggagcaggcuaggaagacggggccaccacccucuccuugcuuucagcccu

SEQ ID NO: 532237 - RNA, 64 nt, hsa
agccugcucaccccacuccagggccuuccccagcggccaccaacugaccuggggcgcugcuccc

SEQ ID NO: 532238 - RNA, 63 nt, hsa
agcgcuaccugcggaaauaacagccucagccggggccaccagcacugcugccacuucuuccag

SEQ ID NO: 532239 - RNA, 50 nt, hsa
gccgcgaaggcuuccucuagggccaccaggcugaggacucgcccaggaca

SEQ ID NO: 532240 - RNA, 64 nt, hsa
cgcccaggacauggacuggucucucagaccccugggccaccauguaggccaccacuccaggccg

SEQ ID NO: 532241 - RNA, 64 nt, hsa
ggacuggucucucagaccccugggccaccauguaggccaccacuccaggccguggacuuccccc

SEQ ID NO: 532242 - RNA, 61 nt, hsa
ucggggaggggugcuccugaaggccaggcauggccaccacgugacgcuguucuuaguucac

SEQ ID NO: 532243 - RNA, 64 nt, hsa
cagcguuuaccacugcugucaagccacagcccuuggccaccauacgggccauccucagugaggc

SEQ ID NO: 532244 - RNA, 64 nt, hsa
uuguaggaguguggguauuccagagcaagacuguggccaccaucuuccccucuugguguuuucc

SEQ ID NO: 532245 - RNA, 64 nt, hsa
uuucuagggugagaguucccaauuuggauagaacggccaccauauugguuacugaaucucucuc

SEQ ID NO: 532246 - RNA, 64 nt, hsa
ggauguuauuggcuaauccacugcaugguuugauggccaccaucucgguuggcccuuugggugu

SEQ ID NO: 532247 - RNA, 64 nt, hsa
uuuuugguguacuuggcacaguaggugccaaguuggccaccauucuguguaacaccuuuuuugg

SEQ ID NO: 532248 - RNA, 64 nt, hsa
uggacaucauacuggguaggugacaacgucagugggccaccaugugccaugauggcugcugcag

SEQ ID NO: 532249 - RNA, 64 nt, hsa
acugauucccucccgggugcugaguccccuccccggccaccauccugcgugaauauccugaaau

SEQ ID NO: 532250 - RNA, 64 nt, hsa
gguccugggaauggcggcgggcccguccagcgugggccaccacuggggccgggggccacgggcu

SEQ ID NO: 532251 - RNA, 64 nt, hsa
ugaggugacccugggccuugcccccagccaacugggccaccagcuucccucccuugacucuggg

SEQ ID NO: 532252 - RNA, 64 nt, hsa
ccagcucugauuccuucaaggcccggccuguccgggccaccauuccacaccuugcgguuugaaa

SEQ ID NO: 532253 - RNA, 64 nt, hsa
ggauguagugcuuuuuagaggagccacugggcaaggccaccaagaacaaaugcaugacauuuua

SEQ ID NO: 532254 - RNA, 64 nt, hsa
guuuggcauuuggggugacagggagugacccagaggccaccacugcuuuucaugcaggaguuac

SEQ ID NO: 532255 - RNA, 64 nt, hsa
ccagcaucagcccuggggagagaggcucccaaagggccaccaugagcccaagauauccuuccug

SEQ ID NO: 532256 - RNA, 64 nt, hsa
ccagcagcaggcgcggcugggggcccuggaucccggccaccagggggcuccuacucccaccccc

SEQ ID NO: 532257 - RNA, 64 nt, hsa; identical to SEQ ID NO: 385392

SEQ ID NO: 532258 - RNA, 64 nt, hsa; identical to SEQ ID NO: 385393

SEQ ID NO: 532259 - RNA, 64 nt, hsa; identical to SEQ ID NO: 385394

SEQ ID NO: 532260 - RNA, 64 nt, hsa; identical to SEQ ID NO: 385395

SEQ ID NO: 532261 - RNA, 64 nt, hsa; identical to SEQ ID NO: 385396

SEQ ID NO: 532262 - RNA, 64 nt, hsa; identical to SEQ ID NO: 385397

SEQ ID NO: 532263 - RNA, 64 nt, hsa; identical to SEQ ID NO: 385398

SEQ ID NO: 532264 - RNA, 64 nt, hsa; identical to SEQ ID NO: 385399

SEQ ID NO: 532265 - RNA, 64 nt, hsa; identical to SEQ ID NO: 385400

SEQ ID NO: 532266 - RNA, 64 nt, hsa; identical to SEQ ID NO: 385401

SEQ ID NO: 532267 - RNA, 64 nt, hsa; identical to SEQ ID NO: 385402

SEQ ID NO: 532268 - RNA, 64 nt, hsa; identical to SEQ ID NO: 385403

SEQ ID NO: 532269 - RNA, 64 nt, hsa; identical to SEQ ID NO: 385404

SEQ ID NO: 532270 - RNA, 64 nt, hsa; identical to SEQ ID NO: 385405

SEQ ID NO: 532271 - RNA, 64 nt, hsa; identical to SEQ ID NO: 385406

SEQ ID NO: 532272 - RNA, 64 nt, hsa; identical to SEQ ID NO: 385407

SEQ ID NO: 532273 - RNA, 64 nt, hsa; identical to SEQ ID NO: 385408

SEQ ID NO: 532274 - RNA, 64 nt, hsa; identical to SEQ ID NO: 385409

SEQ ID NO: 532275 - RNA, 64 nt, hsa; identical to SEQ ID NO: 385410

SEQ ID NO: 532276 - RNA, 64 nt, hsa; identical to SEQ ID NO: 385411

SEQ ID NO: 532277 - RNA, 64 nt, hsa; identical to SEQ ID NO: 385412

SEQ ID NO: 532278 - RNA, 64 nt, hsa; identical to SEQ ID NO: 385413

SEQ ID NO: 532279 - RNA, 62 nt, hsa; identical to SEQ ID NO: 385414

SEQ ID NO: 532280 - RNA, 64 nt, hsa; identical to SEQ ID NO: 385415

SEQ ID NO: 532281 - RNA, 64 nt, hsa; identical to SEQ ID NO: 385416

SEQ ID NO: 532282 - RNA, 64 nt, hsa; identical to SEQ ID NO: 385417

SEQ ID NO: 532283 - RNA, 64 nt, hsa; identical to SEQ ID NO: 385418

SEQ ID NO: 532284 - RNA, 64 nt, hsa; identical to SEQ ID NO: 385419

SEQ ID NO: 532285 - RNA, 64 nt, hsa; identical to SEQ ID NO: 385420

SEQ ID NO: 532286 - RNA, 64 nt, hsa; identical to SEQ ID NO: 385421

SEQ ID NO: 532287 - RNA, 64 nt, hsa; identical to SEQ ID NO: 385422

SEQ ID NO: 532288 - RNA, 64 nt, hsa; identical to SEQ ID NO: 385423

SEQ ID NO: 532289 - RNA, 64 nt, hsa; identical to SEQ ID NO: 385424

SEQ ID NO: 532290 - RNA, 64 nt, hsa; identical to SEQ ID NO: 385425

SEQ ID NO: 532291 - RNA, 64 nt, hsa; identical to SEQ ID NO: 120595

SEQ ID NO: 532292 - RNA, 64 nt, hsa; identical to SEQ ID NO: 120596

SEQ ID NO: 532293 - RNA, 64 nt, hsa; identical to SEQ ID NO: 120626

SEQ ID NO: 532294 - RNA, 64 nt, hsa; identical to SEQ ID NO: 120627

SEQ ID NO: 532295 - RNA, 64 nt, hsa; identical to SEQ ID NO: 120650

SEQ ID NO: 532296 - RNA, 64 nt, hsa; identical to SEQ ID NO: 120651

SEQ ID NO: 532297 - RNA, 64 nt, hsa; identical to SEQ ID NO: 120660

SEQ ID NO: 532298 - RNA, 64 nt, hsa; identical to SEQ ID NO: 120661

SEQ ID NO: 532299 - RNA, 64 nt, hsa; identical to SEQ ID NO: 120680

SEQ ID NO: 532300 - RNA, 64 nt, hsa; identical to SEQ ID NO: 120681

SEQ ID NO: 532301 - RNA, 64 nt, hsa; identical to SEQ ID NO: 120750

SEQ ID NO: 532302 - RNA, 64 nt, hsa; identical to SEQ ID NO: 120751

SEQ ID NO: 532303 - RNA, 64 nt, hsa; identical to SEQ ID NO: 120802

SEQ ID NO: 532304 - RNA, 64 nt, hsa; identical to SEQ ID NO: 120803

SEQ ID NO: 532305 - RNA, 64 nt, hsa
augucccagguccaggaaauccaauguuggugaaggcagccacucucuugcuuguccccaaauc

SEQ ID NO: 532306 - RNA, 64 nt, hsa
gugguggggugggcucucccuuaggcuugggcaaggcagccaccugcccuugcucucccuuagu

SEQ ID NO: 532307 - RNA, 64 nt, hsa
caugccaguaccugccuggggguggggggugccuggcagccaugaagcaggcugaaaggcagag

SEQ ID NO: 532308 - RNA, 64 nt, hsa
ucugccaacuguggaaacuucagucccucaggcuggcagccaugccaguaccugccugggggug

SEQ ID NO: 532309 - RNA, 64 nt, hsa
cagggcuccccaaccugaguuggguuacuucaagggcagccagcaggccuggauggaggccuag

SEQ ID NO: 532310 - RNA, 57 nt, hsa; identical to SEQ ID NO: 83127

SEQ ID NO: 532311 - RNA, 64 nt, hsa
ugaaaggaggaucagaaugcuuugggauuaauugggcagccaucgcagaauuguuugugggcaa

SEQ ID NO: 532312 - RNA, 64 nt, hsa
uggugccugaauucuuucuuuucgccgacacgauggcagccaaacugcagcuucaaacgcucac

SEQ ID NO: 532313 - RNA, 64 nt, hsa
cacuauggccccagugccuugaggcccaggccagggcagccaguggcucuagcucagggaaagc

SEQ ID NO: 532314 - RNA, 64 nt, hsa
gaagccaugaggaccuggccuucugcccgacccaggcagccauucaaguugagcaauggccacu

SEQ ID NO: 532315 - RNA, 64 nt, hsa
ccgcccccucuccccuucccuggcuguggacacuggcagccaauggggaggcggccucuccccu

SEQ ID NO: 532316 - RNA, 64 nt, hsa
gaacuagagccccaaccacagcagaugcuuccugggcagccacuggccaggccguuguauccau

SEQ ID NO: 532317 - RNA, 64 nt, hsa
cuggccuaggcgaggguuccagguuucagacacuggcagccaaugaagacugugcucgcugggu

SEQ ID NO: 532318 - RNA, 64 nt, hsa
gcuguccucccaucuccugugggcagccccucccggcagccagggcuuccuggaggcgaugcag

SEQ ID NO: 532319 - RNA, 59 nt, hsa; identical to SEQ ID NO: 83136

SEQ ID NO: 532320 - RNA, 64 nt, hsa
gcccucgaggcucgaugccugugccaaggccaggggcagccagagggcagcuggauggccacgu

SEQ ID NO: 532321 - RNA, 64 nt, hsa
cacgugggugucacgugucccagaugcaguauucggcagccagccggggagggcuaccuccucc

SEQ ID NO: 532322 - RNA, 64 nt, hsa
ugagugugcgucuguacgggaagaggcagagggaggcagccagcggggcgugaugcagugugca

SEQ ID NO: 532323 - RNA, 64 nt, hsa
cauucuucaucauggaaagccacaagccucagaaggcagccagaggacaggaagagucugugau

SEQ ID NO: 532324 - RNA, 64 nt, hsa
ucuguucguaggaugaugugcagccugucacaguggcagccacaggcauucaguuugugggcau

SEQ ID NO: 532325 - RNA, 64 nt, hsa
gagaggcagcccaggaagucucaucuggggagcaggcagccagcaucugggccuuggccuggag

SEQ ID NO: 532326 - RNA, 64 nt, hsa
uugugggccugggcuccuggaccccccuuucacaggcagccagugcccugagccagggucucca

SEQ ID NO: 532327 - RNA, 64 nt, hsa
cccuuccuucuuaauaaaggcugacaguucuguuggcagccaagaacccacaccaugaagacag

SEQ ID NO: 532328 - RNA, 64 nt, hsa
aaacucuuuccacugugacuuauuuucucucucaggcagccagccaccuggucccuugugcuga

SEQ ID NO: 532329 - RNA, 64 nt, hsa
cccuuuccacaccagacuggcagcacuucccccaggcagccaguggugggcccugagcccucag

SEQ ID NO: 532330 - RNA, 64 nt, hsa
gaacugaugaagucaccuggccuggaguguguugggcagccaguguccccagagcugcuugugg

SEQ ID NO: 532331 - RNA, 64 nt, hsa
cauacagacuggcacugggcagggccucucauguggcagccacauguggcguugugaggccacc

SEQ ID NO: 532332 - RNA, 64 nt, hsa
aggggaaaaaccccugcucacuuguuugcccucaggcagccaaagcacuuuaaccccugcauag

SEQ ID NO: 532333 - RNA, 64 nt, hsa
cucuggcucaggaggguugggucccugggaggccggcagccaggccacagaauccacacgugga

SEQ ID NO: 532334 - RNA, 64 nt, hsa
ccacacguggaccauugugggucccugggaggccggcagccaggccacggaauccacacgugga

SEQ ID NO: 532335 - RNA, 64 nt, hsa
aauggccgccuggggagccuguguggcugugccgggcagccauccugcauucccacccagcgcg

SEQ ID NO: 532336 - RNA, 64 nt, hsa
cagggucucgugcugcccuucccucccacagccuggcagccauccagaggaggggcucuaccag

SEQ ID NO: 532337 - RNA, 64 nt, hsa
uucuguagcagccaccccccugcccccacuccagggcagccaugaugugcuugggcccaccagg

SEQ ID NO: 532338 - RNA, 64 nt, hsa
cccggggugggaccagaggucauaggugcccaacggcagccaaaccaaagacacuggugugcau

SEQ ID NO: 532339 - RNA, 64 nt, hsa; identical to SEQ ID NO: 497550

SEQ ID NO: 532340 - RNA, 64 nt, hsa; identical to SEQ ID NO: 497551

SEQ ID NO: 532341 - RNA, 64 nt, hsa; identical to SEQ ID NO: 497552

SEQ ID NO: 532342 - RNA, 64 nt, hsa; identical to SEQ ID NO: 497553

SEQ ID NO: 532343 - RNA, 64 nt, hsa; identical to SEQ ID NO: 497554

SEQ ID NO: 532344 - RNA, 64 nt, hsa; identical to SEQ ID NO: 497555

SEQ ID NO: 532345 - RNA, 64 nt, hsa; identical to SEQ ID NO: 497556

SEQ ID NO: 532346 - RNA, 64 nt, hsa; identical to SEQ ID NO: 497557

SEQ ID NO: 532347 - RNA, 64 nt, hsa; identical to SEQ ID NO: 497558

SEQ ID NO: 532348 - RNA, 64 nt, hsa; identical to SEQ ID NO: 497559

SEQ ID NO: 532349 - RNA, 64 nt, hsa; identical to SEQ ID NO: 497560

SEQ ID NO: 532350 - RNA, 64 nt, hsa; identical to SEQ ID NO: 497561

SEQ ID NO: 532351 - RNA, 64 nt, hsa; identical to SEQ ID NO: 497562

SEQ ID NO: 532352 - RNA, 64 nt, hsa; identical to SEQ ID NO: 497563

SEQ ID NO: 532353 - RNA, 64 nt, hsa; identical to SEQ ID NO: 497564

SEQ ID NO: 532354 - RNA, 64 nt, hsa; identical to SEQ ID NO: 497565

SEQ ID NO: 532355 - RNA, 64 nt, hsa; identical to SEQ ID NO: 497566

SEQ ID NO: 532356 - RNA, 64 nt, hsa; identical to SEQ ID NO: 497567

SEQ ID NO: 532357 - RNA, 64 nt, hsa; identical to SEQ ID NO: 497568

SEQ ID NO: 532358 - RNA, 64 nt, hsa; identical to SEQ ID NO: 497569

SEQ ID NO: 532359 - RNA, 64 nt, hsa; identical to SEQ ID NO: 497570

SEQ ID NO: 532360 - RNA, 64 nt, hsa; identical to SEQ ID NO: 497571

SEQ ID NO: 532361 - RNA, 64 nt, hsa; identical to SEQ ID NO: 497572

SEQ ID NO: 532362 - RNA, 64 nt, hsa; identical to SEQ ID NO: 497573

SEQ ID NO: 532363 - RNA, 64 nt, hsa; identical to SEQ ID NO: 497574

SEQ ID NO: 532364 - RNA, 64 nt, hsa
uaagagaauuauuaguaauuugcucagaaucugguauguggaagagccaacauggggacccagc

SEQ ID NO: 532365 - RNA, 64 nt, hsa
uguucgaauagugaaacauacacaaaugguaaauuauguggaucuuuugcauauaauauaaaug

SEQ ID NO: 532366 - RNA, 64 nt, hsa
uuuggaauaauaucagucuuucuuuuuuguacauuauguggauauggauauucauggcaguuuu

SEQ ID NO: 532367 - RNA, 64 nt, hsa
gguguucucuuucuuguuugcauauggccuuacuuauguggaagauuaauacuguguuauaaua

SEQ ID NO: 532368 - RNA, 64 nt, hsa
cuuuuaaguugccuugcuggcugugagaauuuuauauguggauaacaaagauagauagauagca

SEQ ID NO: 532369 - RNA, 64 nt, hsa
cuguugguacuauguggaaaauauuagaaacuucuauguggaaaauauuagaaacuacagaguu

SEQ ID NO: 532370 - RNA, 64 nt, hsa
aucuuucauaucuuggauuugcagcuguugguacuauguggaaaauauuagaaacuucuaugug

SEQ ID NO: 532371 - RNA, 64 nt, hsa
acaauguagucacuugaagguuuuguguauaucuuauguggauuaccaauuuaaaaauauaugu

SEQ ID NO: 532372 - RNA, 64 nt, hsa
cuugugauuuauuagucaggcccuucaaagaugauauguggaggaauuaaauauaaaggaauug

SEQ ID NO: 532373 - RNA, 64 nt, hsa
gauuuguguguauguguaugucaauucaugacauuauguggaauccuaaaccuuugguggcugg

SEQ ID NO: 532374 - RNA, 64 nt, hsa
caauuauauuauguuuaauuauuuaagauuucuuuauguggaacaucuauagagauaaauagaa

SEQ ID NO: 532375 - RNA, 64 nt, hsa
uggcaucaauuuuauacagggauauaaaaaaguauauguggauaaauuuuuuguaaucuuuagg

SEQ ID NO: 532376 - RNA, 64 nt, hsa
aauuuuuuguaaucuuuagggauauaaaaaaguguauguggauaaauuuuuuguaaucuuuauu

SEQ ID NO: 532377 - RNA, 64 nt, hsa
gaaagucuuugggcauugccaagaaaucccggauuauguggaaaacccucacuuucucuucacg

SEQ ID NO: 532378 - RNA, 64 nt, hsa
aaagcagcaaaauaguacucuugccacggaauccuauguggagcagaguucuuuguauaacauc

SEQ ID NO: 532379 - RNA, 64 nt, hsa
uauguggaauauauacauauauuccacauguguguauguggaauauauuccacauguguauaua

SEQ ID NO: 532380 - RNA, 64 nt, hsa
aguuccauauauauacauauauuccacauguguguauguggaauauauacauauauuccacaug

SEQ ID NO: 532381 - RNA, 64 nt, hsa; identical to SEQ ID NO: 312464

SEQ ID NO: 532382 - RNA, 64 nt, hsa; identical to SEQ ID NO: 312465

SEQ ID NO: 532383 - RNA, 64 nt, hsa; identical to SEQ ID NO: 312466

SEQ ID NO: 532384 - RNA, 64 nt, hsa; identical to SEQ ID NO: 312467

SEQ ID NO: 532385 - RNA, 64 nt, hsa; identical to SEQ ID NO: 312468

SEQ ID NO: 532386 - RNA, 64 nt, hsa; identical to SEQ ID NO: 312469

SEQ ID NO: 532387 - RNA, 64 nt, hsa; identical to SEQ ID NO: 312470

SEQ ID NO: 532388 - RNA, 64 nt, hsa; identical to SEQ ID NO: 312471

SEQ ID NO: 532389 - RNA, 64 nt, hsa; identical to SEQ ID NO: 312472

SEQ ID NO: 532390 - RNA, 64 nt, hsa; identical to SEQ ID NO: 312473

SEQ ID NO: 532391 - RNA, 64 nt, hsa; identical to SEQ ID NO: 312474

SEQ ID NO: 532392 - RNA, 64 nt, hsa; identical to SEQ ID NO: 312475

SEQ ID NO: 532393 - RNA, 64 nt, hsa; identical to SEQ ID NO: 312476

SEQ ID NO: 532394 - RNA, 64 nt, hsa; identical to SEQ ID NO: 312477

SEQ ID NO: 532395 - RNA, 64 nt, hsa; identical to SEQ ID NO: 312478

SEQ ID NO: 532396 - RNA, 64 nt, hsa; identical to SEQ ID NO: 312479

SEQ ID NO: 532397 - RNA, 64 nt, hsa; identical to SEQ ID NO: 312480

SEQ ID NO: 532398 - RNA, 64 nt, hsa; identical to SEQ ID NO: 312481

SEQ ID NO: 532399 - RNA, 64 nt, hsa; identical to SEQ ID NO: 312482

SEQ ID NO: 532400 - RNA, 64 nt, hsa; identical to SEQ ID NO: 312483

SEQ ID NO: 532401 - RNA, 64 nt, hsa; identical to SEQ ID NO: 312484

SEQ ID NO: 532402 - RNA, 64 nt, hsa; identical to SEQ ID NO: 312485

SEQ ID NO: 532403 - RNA, 64 nt, hsa; identical to SEQ ID NO: 312486

SEQ ID NO: 532404 - RNA, 64 nt, hsa; identical to SEQ ID NO: 312487

SEQ ID NO: 532405 - RNA, 64 nt, hsa; identical to SEQ ID NO: 312488

SEQ ID NO: 532406 - RNA, 64 nt, hsa; identical to SEQ ID NO: 312489

SEQ ID NO: 532407 - RNA, 64 nt, hsa; identical to SEQ ID NO: 312490

SEQ ID NO: 532408 - RNA, 64 nt, hsa; identical to SEQ ID NO: 312491

SEQ ID NO: 532409 - RNA, 64 nt, hsa; identical to SEQ ID NO: 312492

SEQ ID NO: 532410 - RNA, 64 nt, hsa; identical to SEQ ID NO: 312493

SEQ ID NO: 532411 - RNA, 64 nt, hsa; identical to SEQ ID NO: 312494

SEQ ID NO: 532412 - RNA, 64 nt, hsa; identical to SEQ ID NO: 312495

SEQ ID NO: 532413 - RNA, 64 nt, hsa; identical to SEQ ID NO: 312496

SEQ ID NO: 532414 - RNA, 64 nt, hsa; identical to SEQ ID NO: 312497

SEQ ID NO: 532415 - RNA, 64 nt, hsa; identical to SEQ ID NO: 312498

SEQ ID NO: 532416 - RNA, 64 nt, hsa; identical to SEQ ID NO: 312499

SEQ ID NO: 532417 - RNA, 64 nt, hsa; identical to SEQ ID NO: 312500

SEQ ID NO: 532418 - RNA, 64 nt, hsa; identical to SEQ ID NO: 312501

SEQ ID NO: 532419 - RNA, 64 nt, hsa; identical to SEQ ID NO: 312502

SEQ ID NO: 532420 - RNA, 64 nt, hsa; identical to SEQ ID NO: 312503

SEQ ID NO: 532421 - RNA, 64 nt, hsa; identical to SEQ ID NO: 312504

SEQ ID NO: 532422 - RNA, 64 nt, hsa; identical to SEQ ID NO: 312505

SEQ ID NO: 532423 - RNA, 64 nt, hsa; identical to SEQ ID NO: 312506

SEQ ID NO: 532424 - RNA, 64 nt, hsa; identical to SEQ ID NO: 312507

SEQ ID NO: 532425 - RNA, 64 nt, hsa; identical to SEQ ID NO: 312508

SEQ ID NO: 532426 - RNA, 64 nt, hsa; identical to SEQ ID NO: 312509

SEQ ID NO: 532427 - RNA, 64 nt, hsa; identical to SEQ ID NO: 312510

SEQ ID NO: 532428 - RNA, 64 nt, hsa; identical to SEQ ID NO: 312511

SEQ ID NO: 532429 - RNA, 64 nt, hsa; identical to SEQ ID NO: 312512

SEQ ID NO: 532430 - RNA, 64 nt, hsa
cuuggugacagggacgcauucugauaaaugugucauuaggcaauugcauuguagugugauuauc

SEQ ID NO: 532431 - RNA, 64 nt, hsa
aaaugcauauuaaaacauuuucuuccuucaguauauuaggcaauaggaauuuuucaaguccacu

SEQ ID NO: 532432 - RNA, 64 nt, hsa
guacccuuagugguagccaugacacgauggccagaucauggacuccggaaagcuuucuguuuuu

SEQ ID NO: 532433 - RNA, 64 nt, hsa
cccuuccugcucuaacguccagugcuuccuugagaucauggaauucuggagaguuucuguggau

SEQ ID NO: 532434 - RNA, 64 nt, hsa
gugguggcuguuccucccugucaccugccuccucaucauggaagggggugggcuaugaaagccg

SEQ ID NO: 532435 - RNA, 64 nt, hsa
caauucagaaguaaagaagauacuaacguauuucaucauggaagguccuguggugaugguuuuc

SEQ ID NO: 532436 - RNA, 64 nt, hsa
guaugaagauauguguaaaauguuuuuacuauggaucauggauuuaagaaacuugaaaagcugg

SEQ ID NO: 532437 - RNA, 64 nt, hsa
aaaguuauaaauaaagagaaaaacucauucagaaaucauggauuuuaaaaauauuuuacugcag

SEQ ID NO: 532438 - RNA, 64 nt, hsa
aucccagauguguucugaauauccuucuucauaaaucauggaaaacucacugcugagauaguaa

SEQ ID NO: 532439 - RNA, 64 nt, hsa
acucccuuccccucucugguccucagcuuccuccaucauggaggagaugggaucauggauuuuc

SEQ ID NO: 532440 - RNA, 64 nt, hsa
gguccucagcuuccuccaucauggaggagaugggaucauggauuuucugggcauaaguggcugu

SEQ ID NO: 532441 - RNA, 64 nt, hsa
guagggcucugcaaauaaaauaauguaaccuauuaucauggaucuaauguacuguaacuuuauc

SEQ ID NO: 532442 - RNA, 64 nt, hsa
aaaaccaaacacucauuuaaaaguagguuaagugaucauggaucauuguuauuagcuuuguggc

SEQ ID NO: 532443 - RNA, 64 nt, hsa
acucacccaacucuaaauugugccgcuuagacuuagcugucagugugacuuccuuucccaccca

SEQ ID NO: 532444 - RNA, 64 nt, hsa
gcucagagucuuguucaagagaaagugaucaccgagcugucacaucagcaaauauguagucaag

SEQ ID NO: 532445 - RNA, 64 nt, hsa
uguucucaguaucagcccaugguuucaggaucaaagcugucauguuggagauugguaauggcuu

SEQ ID NO: 532446 - RNA, 64 nt, hsa
gccuguauaugauguaacuguaucaaaaauaaaaagcugucacauauuuuguaaauuuuuaccu

SEQ ID NO: 532447 - RNA, 64 nt, hsa
gccagcauuggaaaaagccacuuggacuucacagagcugucagaagacuuaggaagcuuugcca

SEQ ID NO: 532448 - RNA, 64 nt, hsa
cuacucucuggagauagcuaccuggacuuuacagagcugucagaagacuugggaagguuugcca

SEQ ID NO: 532449 - RNA, 64 nt, hsa
uucuauaaccuuguuuguauagcacuuucucaagagcugucagucccacauacagaaucauuuc

SEQ ID NO: 532450 - RNA, 64 nt, hsa
aauuacauugugcaaugcauuaagaaacccauccagcugucaugguauguuacaagguuuucag

SEQ ID NO: 532451 - RNA, 64 nt, hsa
aaaaaagucaugggaccacuucuagaaaucuuucagcugucaggccugucagucucaugacagu

SEQ ID NO: 532452 - RNA, 64 nt, hsa
ggcccagagaugcuuaaauccaaguuguuucuccagcugucaccucccccaggagaucaggauu

SEQ ID NO: 532453 - RNA, 64 nt, hsa
ccuaggaggcagucaauaaauacaugagaaauucagcugucauucaguuacucuuaauucuuua

SEQ ID NO: 532454 - RNA, 64 nt, hsa
gcugaaaagagaaaugauaaugcuuccaaacuguagcugucacagggcaauuucuuuauuuaua

SEQ ID NO: 532455 - RNA, 64 nt, hsa
ccaccaggccacggccgccugcuguacauagugaagcugucacucgccggggcacggggcgucg

SEQ ID NO: 532456 - RNA, 64 nt, hsa
ucucuggacuccaguuuuggccccucucacacagagcugucagcaggggccgcuguggcggugc

SEQ ID NO: 532457 - RNA, 64 nt, hsa
ccgcugcaggguaaaugggauuccuugccacccaagcugucagaacugccacugagcuaaagau

SEQ ID NO: 532458 - RNA, 64 nt, hsa
ucaaacaccaagcacucucagccuccccgccuucagcugucagcuuucuggggcuaacuucucu

SEQ ID NO: 532459 - RNA, 64 nt, hsa
uucucuuauuuauuccccagcccugggaaauaggagcugucauuauccuucucuuucugcacaa

SEQ ID NO: 532460 - RNA, 64 nt, hsa
auuuuagaugagcccagguaagaccucucugaagagcugucaugaaggagggagggagcacauu

SEQ ID NO: 532461 - RNA, 64 nt, hsa
gcccagcccaucucagccaacccuccuuagacugagcugucagagcaagcaauuaggggccagc

SEQ ID NO: 532462 - RNA, 64 nt, hsa
aauccuuagagucugaauuccuuuagcugggaacagcugucauggucaccccuggauaacauuu

SEQ ID NO: 532463 - RNA, 64 nt, hsa
uuccucuuugguuucuucagagcuuucccaagagagcugucaguuuucagcugucaguaacaca

SEQ ID NO: 532464 - RNA, 64 nt, hsa
cuucagagcuuucccaagagagcugucaguuuucagcugucaguaacacaaaugaguuuauggu

SEQ ID NO: 532465 - RNA, 63 nt, hsa
uggcaaaaaaaaaaacccacuguuaccaguguaggaaguuacaagaaggcacauacugaaugc

SEQ ID NO: 532466 - RNA, 63 nt, hsa
uauaugagccaaaccacauaccuuaaugauuugggaaguuaggcaaauaugagauauguagac

SEQ ID NO: 532467 - RNA, 63 nt, hsa
ugaauuuauuuuuaagaaagaaauacuguauugggaaguuacuguuacuugauaacaauguuu

SEQ ID NO: 532468 - RNA, 63 nt, hsa
acaauaaagcaauaagaacaaauacaauacauaggaaguuaaaagcacaaaggaaugaacuua

SEQ ID NO: 532469 - RNA, 63 nt, hsa
caguggugauuaacucaacuaaaacccacuguaggaaguuagcuuccccagacagcuaaugcc

SEQ ID NO: 532470 - RNA, 63 nt, hsa
cucugagggugcaggcuagaccgucuccugagaggaaguuaggaucagaaagaagaagcaagc

SEQ ID NO: 532471 - RNA, 63 nt, hsa
uuagagauaacauacauucccuuugguaucacaggaaguuacuggggauuacucgaccucauu

SEQ ID NO: 532472 - RNA, 63 nt, hsa
uuagagcuguauaacuauaguuugaacuagcaaggaaguuauuguuuugacaaccagaaauua

SEQ ID NO: 532473 - RNA, 63 nt, hsa
ggagcuuccccauccucccugccuuccccagugggaaguuagggaagcucaggagccugggac

SEQ ID NO: 532474 - RNA, 63 nt, hsa
caccugagaaaguugucauuugaggucgcacuuggaaguuacaucugugaaguuucugucauu

SEQ ID NO: 532475 - RNA, 63 nt, hsa
auuuucuuuaugaaaauaaaccaguucuuccaaggaaguuaaaaggcuugguauggauguugg

SEQ ID NO: 532476 - RNA, 63 nt, hsa
uucuacuucuggauccaaauguuaccucuuaggggaaguuaugcccccucaacuauugucuua

SEQ ID NO: 532477 - RNA, 64 nt, hsa
cagcuuucuuucccaggggugaaggauggcgcucgggggugacuccuaagcucagcguggaagc

SEQ ID NO: 532478 - RNA, 64 nt, hsa
guuuuuaacuuguuccucugucuacuguguguuugggggugacaucuaaauuccauuucuucuu

SEQ ID NO: 532479 - RNA, 64 nt, hsa
uguuuuuuguuuuuuaacagaauuauauaugucugggggugaaaaaacccuugcauuccaaagg

SEQ ID NO: 532480 - RNA, 64 nt, hsa
gccaucucgcccuugcugggggcacgggaguggggggggugacaugggcccuaggcagacugca

SEQ ID NO: 532481 - RNA, 64 nt, hsa
gaacgccagagcccuggcuggugaugugcuggcugggggugaaucccaaugagggucccucuca

SEQ ID NO: 532482 - RNA, 64 nt, hsa
gaacgccagagcccuggauggugaugcgcuggcugggggugaaucccaaugagggucccucuca

SEQ ID NO: 532483 - RNA, 64 nt, hsa
gaacgccagagcccuggcuggugacaugcuggcugggggugaauccgaaugacagugcagacgu

SEQ ID NO: 532484 - RNA, 64 nt, hsa
ggggugacaccaggagagagggacagguucuguugggggugacaccaggacacaggaauagguu

SEQ ID NO: 532485 - RNA, 64 nt, hsa
ggggugacaagaggagacagggacagguucugucgggggugacaccaggagagagggacagguu

SEQ ID NO: 532486 - RNA, 64 nt, hsa
ugggugacaccaggagagagggacagguucuguugggggugacaagaggagacagggacagguu

SEQ ID NO: 532487 - RNA, 64 nt, hsa
ggggugacaccaggacacagggacagguucugucgggggugacaccaggacacagggacagguu

SEQ ID NO: 532488 - RNA, 64 nt, hsa
gucuuuuuuuuuuuuuuuggagucugcuuucugugggggugaggccgggcugucucgugguggc

SEQ ID NO: 532489 - RNA, 64 nt, hsa
agaccaugguguuucucuauguuucucuaaguuggggggugagcgugugugacagucuacugga

SEQ ID NO: 532490 - RNA, 64 nt, hsa
uugacugcauuaacuuaacuuacggggugggggcgggggugaggguaggugcuuuuuucuuaug

SEQ ID NO: 532491 - RNA, 64 nt, hsa
gccggacguccuacucaggcugucggggcuuggugggggugacuuuuggcagcccgagacccag

SEQ ID NO: 532492 - RNA, 64 nt, hsa
acacccucucaugcuaccagcaccauaauccagugggggugacugggugcacaccugcccaggu

SEQ ID NO: 532493 - RNA, 64 nt, hsa
guccaaagagagucagagcuaagcauacaggcuugggggugagcccugcugugagaguucaggc

SEQ ID NO: 532494 - RNA, 64 nt, hsa
cuucuuccuccccucaacagugaguuagacucaagggggugacagaaccgagaagggggugaca

SEQ ID NO: 532495 - RNA, 64 nt, hsa
ugaguuagacucaagggggugacagaaccgagaagggggugacaguccuccauccacguggccu

SEQ ID NO: 532496 - RNA, 64 nt, hsa
gugcucaugcagacucuggggcugaggugccccggggggugaucucuggugcucacagccgagg

SEQ ID NO: 532497 - RNA, 64 nt, hsa
gugaggagaggacccaggagugugggggcauuuggggggugaaguggcccccgaagaauggaac

SEQ ID NO: 532498 - RNA, 64 nt, hsa
agcccuuuagauguuuauauucaccacgagaagccagucauaaagauaaaggaaauuugugcau

SEQ ID NO: 532499 - RNA, 64 nt, hsa
uauguaauugaagauuacuauuuuaagaagucaucagucauaucacucacacagaauuuuauuu

SEQ ID NO: 532500 - RNA, 64 nt, hsa
aaucguaugaauguaaugaguaugagggcaguuucagucauagcucagaucuuauccugcaaca

SEQ ID NO: 532501 - RNA, 64 nt, hsa
gaaaucauguauguacugcaugugguaaagccuucagucauagcucagccauugcucagcauca

SEQ ID NO: 532502 - RNA, 64 nt, hsa
aaauguaauaagcauguaugugugugaggagauucagucauaacccaacgcucauucaacauca

SEQ ID NO: 532503 - RNA, 64 nt, hsa
cuugggaaagucacuccuaguaucuauuucaccaucuacagaagagaaauacuucacagaauua

SEQ ID NO: 532504 - RNA, 64 nt, hsa
uguauuugcuaaugaucuucagauuuuaucuuugucuacagaacaauuaguaauacccaaguaa

SEQ ID NO: 532505 - RNA, 64 nt, hsa
uuucaagcuaguucucugaaaauuuugccauuuaucuacagaaauuugauuauaaauauguucc

SEQ ID NO: 532506 - RNA, 64 nt, hsa
acuguuauguugaauaauaauuagcauauaauugucuacagaagcaagagcaaucuggaaggaa

SEQ ID NO: 532507 - RNA, 64 nt, hsa
guucuuacgauggcacccagugagcacucccaagucuacagagugauagccuuccguaacccaa

SEQ ID NO: 532508 - RNA, 64 nt, hsa
gcuccuucucugaagggaaucccaaagccuugugucuacagagaaccuggaguuccugaaccug

SEQ ID NO: 532509 - RNA, 64 nt, hsa
uccuuaugaucaugcucagcccuuggugggacauucuacagaaccccuuucugccccuccacca

SEQ ID NO: 532510 - RNA, 64 nt, hsa
aaagaaaguacgaauuaaagaccgcaauaaacuuucuacagaggaacgccggaaguuguuugag

SEQ ID NO: 532511 - RNA, 64 nt, hsa
cauaaaacuccuuauuagagagucuacagauaaaucuacagagacaauuccucaaguggacuug

SEQ ID NO: 532512 - RNA, 54 nt, hsa
gccauaaaacuccuuauuagagagucuacagauaaaucuacagagacaauuccu

SEQ ID NO: 532513 - RNA, 61 nt, hsa
uuccugugcuuuuucucagaaacugggcgaaucuacagaacaaagaacggcaugugaauuc

SEQ ID NO: 532514 - RNA, 64 nt, hsa
uagguuugaguucaaauuuugcauugugugagcuucuacagauuuuagacaaggaccguuuuua

SEQ ID NO: 532515 - RNA, 64 nt, hsa
auacaaacauaaguuuauuuuauaugcccagaugucuacagagacccuuuuuguaaaugucaag

SEQ ID NO: 532516 - RNA, 64 nt, hsa
guauaaccauguagccaauuguggcccacuaaaaucuacagaaguuaaugugggucaccauuuu

SEQ ID NO: 532517 - RNA, 64 nt, hsa
aauaggaaaucugaagaaccugcuguguuuagaugucucugaaaacagguuggaaagacuuccu

SEQ ID NO: 532518 - RNA, 64 nt, hsa
ucgcuguggugcacuggagaacuugguaaaugaugucucugaugaagccuggaacgagcgugcu

SEQ ID NO: 532519 - RNA, 64 nt, hsa
cccagcccugucugucuccaccccauccccucuugucucugagaaccauucucccaccccaagu

SEQ ID NO: 532520 - RNA, 64 nt, hsa
aaguuccaccuucuauguuucuacucccucccuggucucugaaugccuucgccuguauaaagag

SEQ ID NO: 532521 - RNA, 64 nt, hsa
ggauaaauuuuguagcugguacacucuggccugggucucugaauucagccugucaccgauggcu

SEQ ID NO: 532522 - RNA, 64 nt, hsa
uagguccuugaucuuuucuuuagauugaaagucugucucugaacacaauuauuuguaaaaguua

SEQ ID NO: 532523 - RNA, 64 nt, hsa
ggggugcucucucugagggggugggggugccgcugucucugaggggugggggugccgcugucuc

SEQ ID NO: 532524 - RNA, 64 nt, hsa
ggugccgcugucucugaggggugggggugccgcugucucugaggggugggggugccgcucucuc

SEQ ID NO: 532525 - RNA, 64 nt, hsa
gggugcugcucucuccgagggguggaaugccgcugucucugaggggugggggugccgcucuaaa

SEQ ID NO: 532526 - RNA, 64 nt, hsa
aaaauuuguguaaauuuguauccacacaaauucagucucugaauacacaguauucagagucucu

SEQ ID NO: 532527 - RNA, 64 nt, hsa
cacaaauucagucucugaauacacaguauucagagucucugauacacaguaauugugacaauag

SEQ ID NO: 532528 - RNA, 64 nt, hsa
gaacuacugcuuuagaaugaagucguauaauaaagucucugaaaaggccuuauucagaauaagc

SEQ ID NO: 532529 - RNA, 64 nt, hsa
ucauauaucucuccagagaacucaccugacaaaugucucugagcacaggcugacaccaaagugg

SEQ ID NO: 532530 - RNA, 64 nt, hsa; identical to SEQ ID NO: 167088

SEQ ID NO: 532531 - RNA, 64 nt, hsa; identical to SEQ ID NO: 167089

SEQ ID NO: 532532 - RNA, 64 nt, hsa; identical to SEQ ID NO: 167090

SEQ ID NO: 532533 - RNA, 64 nt, hsa; identical to SEQ ID NO: 167091

SEQ ID NO: 532534 - RNA, 64 nt, hsa; identical to SEQ ID NO: 167092

SEQ ID NO: 532535 - RNA, 64 nt, hsa; identical to SEQ ID NO: 167093

SEQ ID NO: 532536 - RNA, 64 nt, hsa; identical to SEQ ID NO: 167094

SEQ ID NO: 532537 - RNA, 64 nt, hsa; identical to SEQ ID NO: 167095

SEQ ID NO: 532538 - RNA, 64 nt, hsa; identical to SEQ ID NO: 167096

SEQ ID NO: 532539 - RNA, 64 nt, hsa; identical to SEQ ID NO: 167097

SEQ ID NO: 532540 - RNA, 64 nt, hsa; identical to SEQ ID NO: 167098

SEQ ID NO: 532541 - RNA, 64 nt, hsa; identical to SEQ ID NO: 167099

SEQ ID NO: 532542 - RNA, 64 nt, hsa; identical to SEQ ID NO: 167100

SEQ ID NO: 532543 - RNA, 64 nt, hsa; identical to SEQ ID NO: 167101

SEQ ID NO: 532544 - RNA, 64 nt, hsa; identical to SEQ ID NO: 167102

SEQ ID NO: 532545 - RNA, 64 nt, hsa; identical to SEQ ID NO: 167103

SEQ ID NO: 532546 - RNA, 64 nt, hsa; identical to SEQ ID NO: 167104

SEQ ID NO: 532547 - RNA, 64 nt, hsa; identical to SEQ ID NO: 167105

SEQ ID NO: 532548 - RNA, 64 nt, hsa; identical to SEQ ID NO: 167106

SEQ ID NO: 532549 - RNA, 64 nt, hsa; identical to SEQ ID NO: 167107

SEQ ID NO: 532550 - RNA, 64 nt, hsa; identical to SEQ ID NO: 167108

SEQ ID NO: 532551 - RNA, 64 nt, hsa; identical to SEQ ID NO: 167109

SEQ ID NO: 532552 - RNA, 64 nt, hsa; identical to SEQ ID NO: 167110

SEQ ID NO: 532553 - RNA, 64 nt, hsa; identical to SEQ ID NO: 167111

SEQ ID NO: 532554 - RNA, 64 nt, hsa; identical to SEQ ID NO: 167112

SEQ ID NO: 532555 - RNA, 64 nt, hsa; identical to SEQ ID NO: 167113

SEQ ID NO: 532556 - RNA, 64 nt, hsa; identical to SEQ ID NO: 167114

SEQ ID NO: 532557 - RNA, 64 nt, hsa; identical to SEQ ID NO: 167115

SEQ ID NO: 532558 - RNA, 64 nt, hsa; identical to SEQ ID NO: 167116

SEQ ID NO: 532559 - RNA, 64 nt, hsa; identical to SEQ ID NO: 167117

SEQ ID NO: 532560 - RNA, 64 nt, hsa; identical to SEQ ID NO: 167118

SEQ ID NO: 532561 - RNA, 64 nt, hsa; identical to SEQ ID NO: 167119

SEQ ID NO: 532562 - RNA, 64 nt, hsa; identical to SEQ ID NO: 167120

SEQ ID NO: 532563 - RNA, 64 nt, hsa; identical to SEQ ID NO: 167121

SEQ ID NO: 532564 - RNA, 64 nt, hsa; identical to SEQ ID NO: 167122

SEQ ID NO: 532565 - RNA, 64 nt, hsa; identical to SEQ ID NO: 167123

SEQ ID NO: 532566 - RNA, 64 nt, hsa; identical to SEQ ID NO: 167124

SEQ ID NO: 532567 - RNA, 64 nt, hsa; identical to SEQ ID NO: 167125

SEQ ID NO: 532568 - RNA, 64 nt, hsa; identical to SEQ ID NO: 167126

SEQ ID NO: 532569 - RNA, 64 nt, hsa; identical to SEQ ID NO: 167127

SEQ ID NO: 532570 - RNA, 64 nt, hsa; identical to SEQ ID NO: 167128

SEQ ID NO: 532571 - RNA, 64 nt, hsa; identical to SEQ ID NO: 167129

SEQ ID NO: 532572 - RNA, 64 nt, hsa; identical to SEQ ID NO: 167130

SEQ ID NO: 532573 - RNA, 64 nt, hsa; identical to SEQ ID NO: 167131

SEQ ID NO: 532574 - RNA, 64 nt, hsa; identical to SEQ ID NO: 167132

SEQ ID NO: 532575 - RNA, 64 nt, hsa; identical to SEQ ID NO: 167133

SEQ ID NO: 532576 - RNA, 64 nt, hsa; identical to SEQ ID NO: 167134

SEQ ID NO: 532577 - RNA, 64 nt, hsa; identical to SEQ ID NO: 167135

SEQ ID NO: 532578 - RNA, 64 nt, hsa; identical to SEQ ID NO: 167136

SEQ ID NO: 532579 - RNA, 64 nt, hsa; identical to SEQ ID NO: 167137

SEQ ID NO: 532580 - RNA, 64 nt, hsa; identical to SEQ ID NO: 167138

SEQ ID NO: 532581 - RNA, 64 nt, hsa; identical to SEQ ID NO: 167139

SEQ ID NO: 532582 - RNA, 64 nt, hsa; identical to SEQ ID NO: 167140

SEQ ID NO: 532583 - RNA, 64 nt, hsa; identical to SEQ ID NO: 167141

SEQ ID NO: 532584 - RNA, 64 nt, hsa; identical to SEQ ID NO: 167142

SEQ ID NO: 532585 - RNA, 64 nt, hsa; identical to SEQ ID NO: 167143

SEQ ID NO: 532586 - RNA, 64 nt, hsa; identical to SEQ ID NO: 167144

SEQ ID NO: 532587 - RNA, 64 nt, hsa; identical to SEQ ID NO: 167145

SEQ ID NO: 532588 - RNA, 64 nt, hsa; identical to SEQ ID NO: 167146

SEQ ID NO: 532589 - RNA, 64 nt, hsa; identical to SEQ ID NO: 167147

SEQ ID NO: 532590 - RNA, 64 nt, hsa; identical to SEQ ID NO: 167148

SEQ ID NO: 532591 - RNA, 64 nt, hsa; identical to SEQ ID NO: 167149

SEQ ID NO: 532592 - RNA, 64 nt, hsa; identical to SEQ ID NO: 167150

SEQ ID NO: 532593 - RNA, 64 nt, hsa; identical to SEQ ID NO: 167151

SEQ ID NO: 532594 - RNA, 64 nt, hsa; identical to SEQ ID NO: 167152

SEQ ID NO: 532595 - RNA, 64 nt, hsa; identical to SEQ ID NO: 167153

SEQ ID NO: 532596 - RNA, 64 nt, hsa; identical to SEQ ID NO: 167154

SEQ ID NO: 532597 - RNA, 64 nt, hsa; identical to SEQ ID NO: 167155

SEQ ID NO: 532598 - RNA, 64 nt, hsa; identical to SEQ ID NO: 167156

SEQ ID NO: 532599 - RNA, 64 nt, hsa; identical to SEQ ID NO: 167157

SEQ ID NO: 532600 - RNA, 64 nt, hsa; identical to SEQ ID NO: 167158

SEQ ID NO: 532601 - RNA, 64 nt, hsa; identical to SEQ ID NO: 167159

SEQ ID NO: 532602 - RNA, 64 nt, hsa; identical to SEQ ID NO: 167160

SEQ ID NO: 532603 - RNA, 64 nt, hsa; identical to SEQ ID NO: 167161

SEQ ID NO: 532604 - RNA, 64 nt, hsa; identical to SEQ ID NO: 167162

SEQ ID NO: 532605 - RNA, 64 nt, hsa; identical to SEQ ID NO: 167163

SEQ ID NO: 532606 - RNA, 64 nt, hsa; identical to SEQ ID NO: 167164

SEQ ID NO: 532607 - RNA, 64 nt, hsa; identical to SEQ ID NO: 167165

SEQ ID NO: 532608 - RNA, 64 nt, hsa; identical to SEQ ID NO: 167166

SEQ ID NO: 532609 - RNA, 64 nt, hsa; identical to SEQ ID NO: 167167

SEQ ID NO: 532610 - RNA, 64 nt, hsa; identical to SEQ ID NO: 167168

SEQ ID NO: 532611 - RNA, 64 nt, hsa; identical to SEQ ID NO: 473932

SEQ ID NO: 532612 - RNA, 64 nt, hsa; identical to SEQ ID NO: 473933

SEQ ID NO: 532613 - RNA, 64 nt, hsa; identical to SEQ ID NO: 473934

SEQ ID NO: 532614 - RNA, 64 nt, hsa; identical to SEQ ID NO: 473935

SEQ ID NO: 532615 - RNA, 64 nt, hsa; identical to SEQ ID NO: 473936

SEQ ID NO: 532616 - RNA, 64 nt, hsa; identical to SEQ ID NO: 473937

SEQ ID NO: 532617 - RNA, 64 nt, hsa; identical to SEQ ID NO: 473938

SEQ ID NO: 532618 - RNA, 64 nt, hsa; identical to SEQ ID NO: 473939

SEQ ID NO: 532619 - RNA, 64 nt, hsa; identical to SEQ ID NO: 473940

SEQ ID NO: 532620 - RNA, 64 nt, hsa; identical to SEQ ID NO: 473941

SEQ ID NO: 532621 - RNA, 64 nt, hsa; identical to SEQ ID NO: 473942

SEQ ID NO: 532622 - RNA, 64 nt, hsa; identical to SEQ ID NO: 473943

SEQ ID NO: 532623 - RNA, 64 nt, hsa; identical to SEQ ID NO: 473944

SEQ ID NO: 532624 - RNA, 64 nt, hsa; identical to SEQ ID NO: 473945

SEQ ID NO: 532625 - RNA, 64 nt, hsa; identical to SEQ ID NO: 473946

SEQ ID NO: 532626 - RNA, 64 nt, hsa; identical to SEQ ID NO: 473947

SEQ ID NO: 532627 - RNA, 64 nt, hsa; identical to SEQ ID NO: 473948

SEQ ID NO: 532628 - RNA, 64 nt, hsa; identical to SEQ ID NO: 473949

SEQ ID NO: 532629 - RNA, 64 nt, hsa; identical to SEQ ID NO: 473950

SEQ ID NO: 532630 - RNA, 64 nt, hsa; identical to SEQ ID NO: 473951

SEQ ID NO: 532631 - RNA, 64 nt, hsa; identical to SEQ ID NO: 473952

SEQ ID NO: 532632 - RNA, 64 nt, hsa; identical to SEQ ID NO: 473953

SEQ ID NO: 532633 - RNA, 64 nt, hsa; identical to SEQ ID NO: 473954

SEQ ID NO: 532634 - RNA, 64 nt, hsa; identical to SEQ ID NO: 473955

SEQ ID NO: 532635 - RNA, 64 nt, hsa; identical to SEQ ID NO: 473956

SEQ ID NO: 532636 - RNA, 64 nt, hsa; identical to SEQ ID NO: 473957

SEQ ID NO: 532637 - RNA, 64 nt, hsa; identical to SEQ ID NO: 473958

SEQ ID NO: 532638 - RNA, 64 nt, hsa; identical to SEQ ID NO: 473959

SEQ ID NO: 532639 - RNA, 64 nt, hsa; identical to SEQ ID NO: 473960

SEQ ID NO: 532640 - RNA, 64 nt, hsa; identical to SEQ ID NO: 473961

SEQ ID NO: 532641 - RNA, 64 nt, hsa; identical to SEQ ID NO: 473962

SEQ ID NO: 532642 - RNA, 64 nt, hsa; identical to SEQ ID NO: 473963

SEQ ID NO: 532643 - RNA, 64 nt, hsa; identical to SEQ ID NO: 473964

SEQ ID NO: 532644 - RNA, 64 nt, hsa; identical to SEQ ID NO: 473965

SEQ ID NO: 532645 - RNA, 64 nt, hsa; identical to SEQ ID NO: 473966

SEQ ID NO: 532646 - RNA, 64 nt, hsa; identical to SEQ ID NO: 473967

SEQ ID NO: 532647 - RNA, 64 nt, hsa; identical to SEQ ID NO: 473968

SEQ ID NO: 532648 - RNA, 64 nt, hsa; identical to SEQ ID NO: 473969

SEQ ID NO: 532649 - RNA, 64 nt, hsa; identical to SEQ ID NO: 473970

SEQ ID NO: 532650 - RNA, 64 nt, hsa; identical to SEQ ID NO: 473971

SEQ ID NO: 532651 - RNA, 64 nt, hsa; identical to SEQ ID NO: 473972

SEQ ID NO: 532652 - RNA, 64 nt, hsa; identical to SEQ ID NO: 473973

SEQ ID NO: 532653 - RNA, 64 nt, hsa; identical to SEQ ID NO: 473974

SEQ ID NO: 532654 - RNA, 64 nt, hsa; identical to SEQ ID NO: 473975

SEQ ID NO: 532655 - RNA, 64 nt, hsa; identical to SEQ ID NO: 473976

SEQ ID NO: 532656 - RNA, 64 nt, hsa; identical to SEQ ID NO: 473977

SEQ ID NO: 532657 - RNA, 64 nt, hsa; identical to SEQ ID NO: 473978

SEQ ID NO: 532658 - RNA, 64 nt, hsa; identical to SEQ ID NO: 473979

SEQ ID NO: 532659 - RNA, 64 nt, hsa; identical to SEQ ID NO: 473980

SEQ ID NO: 532660 - RNA, 64 nt, hsa; identical to SEQ ID NO: 473981

SEQ ID NO: 532661 - RNA, 64 nt, hsa; identical to SEQ ID NO: 473982

SEQ ID NO: 532662 - RNA, 64 nt, hsa; identical to SEQ ID NO: 473983

SEQ ID NO: 532663 - RNA, 64 nt, hsa; identical to SEQ ID NO: 473984

SEQ ID NO: 532664 - RNA, 64 nt, hsa; identical to SEQ ID NO: 473985

SEQ ID NO: 532665 - RNA, 64 nt, hsa; identical to SEQ ID NO: 473986

SEQ ID NO: 532666 - RNA, 64 nt, hsa; identical to SEQ ID NO: 473987

SEQ ID NO: 532667 - RNA, 64 nt, hsa; identical to SEQ ID NO: 473988

SEQ ID NO: 532668 - RNA, 64 nt, hsa; identical to SEQ ID NO: 473989

SEQ ID NO: 532669 - RNA, 64 nt, hsa; identical to SEQ ID NO: 473990

SEQ ID NO: 532670 - RNA, 64 nt, hsa; identical to SEQ ID NO: 473991

SEQ ID NO: 532671 - RNA, 64 nt, hsa; identical to SEQ ID NO: 473992

SEQ ID NO: 532672 - RNA, 64 nt, hsa; identical to SEQ ID NO: 473993

SEQ ID NO: 532673 - RNA, 64 nt, hsa; identical to SEQ ID NO: 473994

SEQ ID NO: 532674 - RNA, 64 nt, hsa; identical to SEQ ID NO: 473995

SEQ ID NO: 532675 - RNA, 64 nt, hsa; identical to SEQ ID NO: 473996

SEQ ID NO: 532676 - RNA, 64 nt, hsa; identical to SEQ ID NO: 473997

SEQ ID NO: 532677 - RNA, 64 nt, hsa; identical to SEQ ID NO: 473998

SEQ ID NO: 532678 - RNA, 64 nt, hsa; identical to SEQ ID NO: 473999

SEQ ID NO: 532679 - RNA, 64 nt, hsa; identical to SEQ ID NO: 474000

SEQ ID NO: 532680 - RNA, 64 nt, hsa; identical to SEQ ID NO: 474001

SEQ ID NO: 532681 - RNA, 64 nt, hsa; identical to SEQ ID NO: 474002

SEQ ID NO: 532682 - RNA, 64 nt, hsa; identical to SEQ ID NO: 474003

SEQ ID NO: 532683 - RNA, 64 nt, hsa; identical to SEQ ID NO: 474004

SEQ ID NO: 532684 - RNA, 64 nt, hsa; identical to SEQ ID NO: 474005

SEQ ID NO: 532685 - RNA, 64 nt, hsa; identical to SEQ ID NO: 474006

SEQ ID NO: 532686 - RNA, 64 nt, hsa; identical to SEQ ID NO: 474007

SEQ ID NO: 532687 - RNA, 64 nt, hsa; identical to SEQ ID NO: 474008

SEQ ID NO: 532688 - RNA, 64 nt, hsa; identical to SEQ ID NO: 474009

SEQ ID NO: 532689 - RNA, 64 nt, hsa; identical to SEQ ID NO: 474010

SEQ ID NO: 532690 - RNA, 64 nt, hsa; identical to SEQ ID NO: 474011

SEQ ID NO: 532691 - RNA, 64 nt, hsa; identical to SEQ ID NO: 474012

SEQ ID NO: 532692 - RNA, 64 nt, hsa; identical to SEQ ID NO: 474013

SEQ ID NO: 532693 - RNA, 64 nt, hsa; identical to SEQ ID NO: 474014

SEQ ID NO: 532694 - RNA, 64 nt, hsa; identical to SEQ ID NO: 474015

SEQ ID NO: 532695 - RNA, 64 nt, hsa; identical to SEQ ID NO: 474016

SEQ ID NO: 532696 - RNA, 64 nt, hsa; identical to SEQ ID NO: 474017

SEQ ID NO: 532697 - RNA, 64 nt, hsa; identical to SEQ ID NO: 474018

SEQ ID NO: 532698 - RNA, 64 nt, hsa; identical to SEQ ID NO: 474019

SEQ ID NO: 532699 - RNA, 64 nt, hsa; identical to SEQ ID NO: 474020

SEQ ID NO: 532700 - RNA, 64 nt, hsa; identical to SEQ ID NO: 474021

SEQ ID NO: 532701 - RNA, 64 nt, hsa; identical to SEQ ID NO: 474022

SEQ ID NO: 532702 - RNA, 64 nt, hsa; identical to SEQ ID NO: 474023

SEQ ID NO: 532703 - RNA, 64 nt, hsa; identical to SEQ ID NO: 474024

SEQ ID NO: 532704 - RNA, 64 nt, hsa; identical to SEQ ID NO: 474025

SEQ ID NO: 532705 - RNA, 64 nt, hsa; identical to SEQ ID NO: 474026

SEQ ID NO: 532706 - RNA, 64 nt, hsa; identical to SEQ ID NO: 474027

SEQ ID NO: 532707 - RNA, 64 nt, hsa; identical to SEQ ID NO: 474028

SEQ ID NO: 532708 - RNA, 64 nt, hsa; identical to SEQ ID NO: 474029

SEQ ID NO: 532709 - RNA, 64 nt, hsa; identical to SEQ ID NO: 474030

SEQ ID NO: 532710 - RNA, 64 nt, hsa; identical to SEQ ID NO: 474031

SEQ ID NO: 532711 - RNA, 64 nt, hsa; identical to SEQ ID NO: 474032

SEQ ID NO: 532712 - RNA, 64 nt, hsa; identical to SEQ ID NO: 474033

SEQ ID NO: 532713 - RNA, 65 nt, hsa
gcaccugguaucucgagugccugcaguugcaaguauguuuacaccugguguccaauuuuguauuu

SEQ ID NO: 532714 - RNA, 65 nt, hsa
aaggcagaguaacauuacuuaaaaaaaaaaggauauguuuacauuuaauuuuggcuaccaggagu

SEQ ID NO: 532715 - RNA, 65 nt, hsa
gugaagagcuuuugcucuugcauuagauuugaagauguuuacauuguuguuauuguuauguauca

SEQ ID NO: 532716 - RNA, 65 nt, hsa
gcaccuaacgggaaagaaccgacauggcugccuuuuguuuacacugguuauuuauuuaugacuug

SEQ ID NO: 532717 - RNA, 65 nt, hsa
cagacuuccucuaggaguggugcugcuaccuuguauguuuacauaaugcuuuagcccaaggacac

SEQ ID NO: 532718 - RNA, 65 nt, hsa
ccuuccaugccaaagguuggagucugcuggugcgguguuuacacaccaggcagggcugucugcca

SEQ ID NO: 532719 - RNA, 65 nt, hsa
cugccgcugagaaggguugauccugcaucuggguuuguuuacagcaauuccuggacucgggggua

SEQ ID NO: 532720 - RNA, 65 nt, hsa
uuucuuugaaaauucuggcagaccaagguucuuuuuguuuacauaauacuugaaaaauaaaaaug

SEQ ID NO: 532721 - RNA, 65 nt, hsa
auguauuggucuuucuccguguucuuuggggguuuuguuuacaaacuucuuuuuguauugagaga

SEQ ID NO: 532722 - RNA, 65 nt, hsa
uagaagacuuuuuuuauuuuaaccaaaguuacuguuguuuacagugaguuuggggaaaaaaaaua

SEQ ID NO: 532723 - RNA, 65 nt, hsa
aauuuuuuuuaaaauuaugaaucauaucaaguaguuguuuacauuucuugaaaaaauaggaacuc

SEQ ID NO: 532724 - RNA, 65 nt, hsa; identical to SEQ ID NO: 420659

SEQ ID NO: 532725 - RNA, 65 nt, hsa; identical to SEQ ID NO: 420660

SEQ ID NO: 532726 - RNA, 65 nt, hsa
acaggcuggggaauuuugcugcucccuauugcuucuguuuacaaaaaugaauuuuuccugguuuc

SEQ ID NO: 532727 - RNA, 65 nt, hsa
guaaaacauaccauccuuuucuauuuucuugaugcuguuuacaacauaguuuggugauauccaga

SEQ ID NO: 532728 - RNA, 65 nt, hsa
ucuacuacagcacugugaugcuuuaugcaacuaacuguuuacauaucuguccccugcuacuagau

SEQ ID NO: 532729 - RNA, 65 nt, hsa
caccagacugaagcacauguaauauagaccguguauguuuacaauguuguguauaaaugggacaa

SEQ ID NO: 532730 - RNA, 65 nt, hsa
uccuuucucuuuugugaaucuuuccccccauuuccuguuuacauguaacccaacaaaaugcaauu

SEQ ID NO: 532731 - RNA, 65 nt, hsa
acagcuuuuuuuauuuugcauuuguuuuuucaauguguuuacauuguaugaauugagcuuuuugc

SEQ ID NO: 532732 - RNA, 65 nt, hsa; identical to SEQ ID NO: 420661

SEQ ID NO: 532733 - RNA, 65 nt, hsa; identical to SEQ ID NO: 420662

SEQ ID NO: 532734 - RNA, 65 nt, hsa
uuucuuuucuccuuaucugugcagaacagguugcuuguuuacaacugaagaucaugcuauauuuu

SEQ ID NO: 532735 - RNA, 65 nt, hsa
aaauuguuuguaacuuggaugcugccgcuacugaauguuuacaaauugcuugccugcuaaaguaa

SEQ ID NO: 532736 - RNA, 65 nt, hsa
acaaaguuucuggauguuuuauuaaauauuguacguguuuacaguugggaauuuaaaauaauaca

SEQ ID NO: 532737 - RNA, 65 nt, hsa; identical to SEQ ID NO: 420663

SEQ ID NO: 532738 - RNA, 65 nt, hsa; identical to SEQ ID NO: 420664

SEQ ID NO: 532739 - RNA, 65 nt, hsa
ugucauguugggguuuuuaaugugauuguguauucuguuuacauuaaaaagaagcaaaaauaauu

SEQ ID NO: 532740 - RNA, 65 nt, hsa
gauaugacaacugguaaugguggauucauuuacauuguuuacacuucuaugaccaggccuuaagg

SEQ ID NO: 532741 - RNA, 65 nt, hsa
agccucgaaauuccuguaaauuguuuacuuuaugauguuuacauacacguuucacuuugaaaaaa

SEQ ID NO: 532742 - RNA, 65 nt, hsa
aagcaguuccagaaggaccauucucaccuguguuuuguuuacauggaccacuacagaaauuaguu

SEQ ID NO: 532743 - RNA, 65 nt, hsa
ucaaugcaggacucaucacaucuauucggauauucuguuuacacacccaugucaucccagagagg

SEQ ID NO: 532744 - RNA, 65 nt, hsa
acagcauguccucuaccugugacuucucauuuuccuguuuacacuggggauuuggagggggcagg

SEQ ID NO: 532745 - RNA, 65 nt, hsa
ggcaaggggcagcacugccugcugcuuccuuccccuguuuacagcaauaagcacguccuccuccc

SEQ ID NO: 532746 - RNA, 65 nt, hsa; identical to SEQ ID NO: 420665

SEQ ID NO: 532747 - RNA, 65 nt, hsa; identical to SEQ ID NO: 420666

SEQ ID NO: 532748 - RNA, 65 nt, hsa
auguuuuaagaaacaaaacauaguaucuuauggauuguuuacaaucacaaggacauagauaccua

SEQ ID NO: 532749 - RNA, 65 nt, hsa
aaaacagauuugauaaucuuauucacaguuguuauuguuuacagaccauuuaauuaauauuuccu

SEQ ID NO: 532750 - RNA, 65 nt, hsa
guggauuuuguauuaaaauauauagaagcaauuucuguuuacauguccuugcuacuuuuaaaaac

SEQ ID NO: 532751 - RNA, 65 nt, hsa
cuguacuuucuguaguuucuguguaaacugccauauguuuacauggaaacuacaggaaaaaauug

SEQ ID NO: 532752 - RNA, 65 nt, hsa
aaaguauuaauacuuuaaagucaaauaagauauaguguuuacauucuuuagguccugaggggcag

SEQ ID NO: 532753 - RNA, 65 nt, hsa
ugaagccucggcuuucccucuggagccugggacccuguuuacaguugcacaucugggccccucac

SEQ ID NO: 532754 - RNA, 65 nt, hsa
gauaaugaugaguaacuuaaccagcacauuucuccuguuuacacucgggggauuuuuuuguuuuc

SEQ ID NO: 532755 - RNA, 65 nt, hsa
guuaucccgcaagguuuaguugagaagauacaaaauguuuacaguguuggcacuuagaguuuuua

SEQ ID NO: 532756 - RNA, 65 nt, hsa
gggugggccggggagggguccuuugcggugagcuauguuuacaugacacagugugccaaagugac

SEQ ID NO: 532757 - RNA, 65 nt, hsa
uugauaacuucgcuacauaacaaggaaaauauaaauguuuacaaacagcuuaaagauuugcaugu

SEQ ID NO: 532758 - RNA, 65 nt, hsa; identical to SEQ ID NO: 420667

SEQ ID NO: 532759 - RNA, 65 nt, hsa; identical to SEQ ID NO: 420668

SEQ ID NO: 532760 - RNA, 65 nt, hsa
caucaugagacaugcuucuuugguuuauaaugagauguuuacaguuaaauacagauggcaguuga

SEQ ID NO: 532761 - RNA, 65 nt, hsa
cauaagucgggguuuggucucagcauuuacaaauguguuuacagucagaaugaaacacauuccuu

SEQ ID NO: 532762 - RNA, 65 nt, hsa
agauuucaaggggaagggagucgucugccauucaauguuuacauuuauguucugcaagacgcugu

SEQ ID NO: 532763 - RNA, 65 nt, hsa
cauuacugcaauguucucuuaacaguuaaacaagcuguuuacaguuuaaacugcugaauauuauu

SEQ ID NO: 532764 - RNA, 65 nt, hsa
gacggaacaaguuuaguagcaguaauaguaaaucauguuuacauaugagauuuauagucguggga

SEQ ID NO: 532765 - RNA, 65 nt, hsa
uuuucagagcaaucuaaaagcgccaaaauucgcuauguuuacagugauacuauuaagaaaaugaa

SEQ ID NO: 532766 - RNA, 65 nt, hsa
guauaauaauuugccuuguguggucagcacuuaacuguuuacaaagcccuuucacgugcacagca

SEQ ID NO: 532767 - RNA, 65 nt, hsa; identical to SEQ ID NO: 420669

SEQ ID NO: 532768 - RNA, 65 nt, hsa; identical to SEQ ID NO: 420670

SEQ ID NO: 532769 - RNA, 65 nt, hsa
uugugugugaagauuccugacuuagggguggcuuuuguuuacaagaugcaagaggggaaaccugu

SEQ ID NO: 532770 - RNA, 65 nt, hsa
ucuaauaacauguauagaucuaaagcagguuguguuguuuacauguuucuacacauuucauccuu

SEQ ID NO: 532771 - RNA, 65 nt, hsa
ggggacuuuugccuuguuuguaauguuaaaguuuuuguuuacauugagaauauauucaaguuuuu

SEQ ID NO: 532772 - RNA, 65 nt, hsa
aaugcuuauuuuaaagguacuauuaaauaugugaauguuuacacuaauuuuaccgagugggacuu

SEQ ID NO: 532773 - RNA, 65 nt, hsa
uauuucaugccaguaaaauuuuuuuagugguauucuguuuacagauguauuaggaccauugaugc

SEQ ID NO: 532774 - RNA, 65 nt, hsa
agaauaugacuuuuuauaaaauggcuguaaucauuuguuuacauuugaugcaugucuuuuaaaau

SEQ ID NO: 532775 - RNA, 65 nt, hsa
uugacaaucuacugugccacugugcuacuaacucuuguuuacaaaauuugauucuaaguugaauu

SEQ ID NO: 532776 - RNA, 65 nt, hsa
uaauacaccaauuaaaauauuucuacauaugagaauguuuacaauuuaaauuuuagaacuuguuu

SEQ ID NO: 532777 - RNA, 65 nt, hsa
uuauuuuucaauuggcaauucaguuaauuuuuaaauguuuacauaauggccagaaggcuugcaaa

SEQ ID NO: 532778 - RNA, 65 nt, hsa
auccagggauauaacuccuuggucagugauuuuauuguuuacauccugagacuguucuacaguuu

SEQ ID NO: 532779 - RNA, 65 nt, hsa
aaggguaguugccaauaaccugaagaagcuggcauuguuuacagaaacagaucaagggcuauaau

SEQ ID NO: 532780 - RNA, 65 nt, hsa
uuuggauacucugugccaauuuauuuauagucaaguguuuacacuuuuuccuguggaauaauuau

SEQ ID NO: 532781 - RNA, 65 nt, hsa
cacgaggaaaagaccuuccccugaaccccuaaaaauguuuacagucucugcugguucccucugug

SEQ ID NO: 532782 - RNA, 65 nt, hsa
aagucuuuuucuuuaauaugccuuuaagucuuaccuguuuacagcccauucugauggguucuuug

SEQ ID NO: 532783 - RNA, 65 nt, hsa
uaggggcaucucugugucugagugugccugguguguguuuacaaagggagaguuggcugcuccag

SEQ ID NO: 532784 - RNA, 65 nt, hsa
cggcuccuuugaaaacaggucauauugugcucuucuguuuacaagaggaaacaagauggaauaaa

SEQ ID NO: 532785 - RNA, 65 nt, hsa
acauggccacgcuguggaaugaugugaauuggcccuguuuacagaggcaguacaacugaauguua

SEQ ID NO: 532786 - RNA, 65 nt, hsa
aaauugcugagguuuccuuaggcagcuuauuuauuuguuuacaguuagacuaucugaguaaaugg

SEQ ID NO: 532787 - RNA, 65 nt, hsa
caaauuuaugaaacuaaaagggugauugacauccauguuuacacuccgcucuaauguuugauaua

SEQ ID NO: 532788 - RNA, 65 nt, hsa
aaaauagcaguuuuaaaaguuuucuauuucaguuuuguuuacacuccuaauugcuuuaagcacuu

SEQ ID NO: 532789 - RNA, 65 nt, hsa
cucgggauuaguacacacuuguugauuaauggaaauguuuacagauccccaagccuggcaaggga

SEQ ID NO: 532790 - RNA, 65 nt, hsa
agaaacagagcuaucuguuccucauagugccaguguguuuacauuuauaggaccacauaucccug

SEQ ID NO: 532791 - RNA, 65 nt, hsa
guguucuuuacaaaggcuagcucaguccaacacuguguuuacauacacucgugcuuuuccuuauc

SEQ ID NO: 532792 - RNA, 65 nt, hsa
aacaucacuaaaugugggcauagaaacuccacagcuguuuacaaauuugguuacagugugcuacg

SEQ ID NO: 532793 - RNA, 65 nt, hsa
guuuguguuccagcugugucugggauaaccucggcuguuuacaguguggcccggagcgucuuggc

SEQ ID NO: 532794 - RNA, 65 nt, hsa
aaauauuaaagauucucuuuaaaaaagacugaacauguuuacagguuugaauuaggcuaaaaggu

SEQ ID NO: 532795 - RNA, 65 nt, hsa
cuugugcauuuguuauggaaauuuaauucauaugguguuuacaguacuacuuuuguaacuuccag

SEQ ID NO: 532796 - RNA, 65 nt, hsa
uacuagaaucuacucugcuuacauucuuguuuaaguguuuacacaguuugguucaauuauaaaca

SEQ ID NO: 532797 - RNA, 65 nt, hsa
auaaacugacaaaugacaaaauggugagcuuaugauguuuacauaaaaguucuauaagcugugua

SEQ ID NO: 532798 - RNA, 65 nt, hsa
uuuagaugaggaugauugaguccauauacuauguauguuuacauauacuauacaugcacauuagg

SEQ ID NO: 532799 - RNA, 65 nt, hsa
gaauauuaugcagaugccguuaauuuuuuacccuauguuuacaucuugaggcagcagagucuguc

SEQ ID NO: 532800 - RNA, 65 nt, hsa; identical to SEQ ID NO: 420671

SEQ ID NO: 532801 - RNA, 65 nt, hsa; identical to SEQ ID NO: 420672

SEQ ID NO: 532802 - RNA, 65 nt, hsa
auagauauuugcccuuaguuuacugguuaaaaguuuguuuacagaacuuuucucuggugcuuaaa

SEQ ID NO: 532803 - RNA, 65 nt, hsa
gauucuucuaaugauggucaacugcaaggagaaacuguuuacauccuucccacuacacaguugcu

SEQ ID NO: 532804 - RNA, 65 nt, hsa
cucuauguguauagguaucuguauaucuuuccuuuuguuuacaacuguuaaaaaaccucaaaaua

SEQ ID NO: 532805 - RNA, 65 nt, hsa
gcugacuuggcuggugugguacagagaagccagcuuguuuacaugcuuauuccaugacugcuugc

SEQ ID NO: 532806 - RNA, 65 nt, hsa
cuugugaggguacucugucuaauguauauuucuaguguuuacagacaguaaauguguauauguag

SEQ ID NO: 532807 - RNA, 65 nt, hsa
acucuuuucucaugcacauguuacguuggagaaaauguuuacaaaaaugguuuuguuacacuaau

SEQ ID NO: 532808 - RNA, 65 nt, hsa
gaagagacuuugaagucaccugacucagccccuuguguuuacagacaaggacauguaguccaagg

SEQ ID NO: 532809 - RNA, 65 nt, hsa
uuuguuaacccuuauccauuuguugacauguagacuguuuacaaaaaaaaaacacaugguuaaau

SEQ ID NO: 532810 - RNA, 65 nt, hsa
augguuuuuuggagcaggauuuuguguaagaaugguguuuacaugcaguguguuuucccccucac

SEQ ID NO: 532811 - RNA, 65 nt, hsa
cuaauacagcugcuaaaaugaucccugucuccucguguuuacauucuguguguguccccucccac

SEQ ID NO: 532812 - RNA, 65 nt, hsa
ucaaugauaaagggauaaaacaguauacugacaacuguuuacaagaaaguggagaaaaauguaca

SEQ ID NO: 532813 - RNA, 65 nt, hsa
gcugaugcaagccuuuuucaguucaagagaauaaauguuuacaaauauaggcucacuuugucuuu

SEQ ID NO: 532814 - RNA, 65 nt, hsa
uccugcaucacuuguuuuaacuauuuauuuugccauguuuacauuuuguaucuuguaaaaauaaa

SEQ ID NO: 532815 - RNA, 65 nt, hsa
auccaacacuagaaagcaaugacuaacauuuaauuuguuuacaaaaauguuuauugucuucagua

SEQ ID NO: 532816 - RNA, 65 nt, hsa
aaaauucuguauaaaacuguaauccuuuguauucauguuuacagugcuauuacuauaauucaaaa

SEQ ID NO: 532817 - RNA, 65 nt, hsa
aaaagaaaccaagaauuuuccauuuugugaucaauuguuuacagcccgugauggugauguguuug

SEQ ID NO: 532818 - RNA, 65 nt, hsa
ggcuucaagaaauccuuuggaaauaaaaaguuaaauguuuacauuucaugugguauuucaggucu

SEQ ID NO: 532819 - RNA, 65 nt, hsa
uuguacuuuggaauucuuagucacaaaauauauuuuguuuacaaaaauuucuguaaaacagguua

SEQ ID NO: 532820 - RNA, 65 nt, hsa
ucuguaauuucugaauguauauagaauaauauuuauguuuacaauguaacuuuucaaaauuuaca

SEQ ID NO: 532821 - RNA, 65 nt, hsa
agaucuauugaauuucagagaagagccuucuaacuuguuuacacaaaaacgaguaugauuuagca

SEQ ID NO: 532822 - RNA, 65 nt, hsa
agacucagguuguaguaaagaaauuuaaaagacacuguuuacaagaaaaaaugaauuuuguuugg

SEQ ID NO: 532823 - RNA, 65 nt, hsa
gacuguaggaagucaaaaacuuguacuguaucuuguguuuacaguucugauuuauuccuuugaaa

SEQ ID NO: 532824 - RNA, 65 nt, hsa
uaauuuguauuacuagucauaugcauguagcuuucuguuuacauccuaugccacauggucuucau

SEQ ID NO: 532825 - RNA, 65 nt, hsa
cuucucuuguggcacuuaucacacuguauuuuacuuguuuacauguuugucuccccuucuagacu

SEQ ID NO: 532826 - RNA, 65 nt, hsa
caaaaguuggggguggguaagagggauaguuaaaauguuuacaaaacuuuaggcucccucggaac

SEQ ID NO: 532827 - RNA, 65 nt, hsa
uaaaauuaauauguugucagugauuagaacaacacuguuuacauaaaaaccauuuuucuaauucu

SEQ ID NO: 532828 - RNA, 65 nt, hsa
aagaaaaucaguuucuagaagccgcuguuaccucuuguuuacaguuuauauauauaugauagaua

SEQ ID NO: 532829 - RNA, 65 nt, hsa
agcucucaaguucacccuuuagggaaaaguuauuuuguuuacauuauuauaagggauuugugaug

SEQ ID NO: 532830 - RNA, 65 nt, hsa
cuaggcacagaaaaaaauaggucagcuuaaaaauauguuuacauuggauaaaggauuaggcaaaa

SEQ ID NO: 532831 - RNA, 65 nt, hsa
guuuuggggggccaguaguucagugagaauguuuauguuuacaacuagccuucccaguaaaaaaa

SEQ ID NO: 532832 - RNA, 65 nt, hsa
aguuuugcauguagaucaauuuaaaauguaccucuuguuuacauaauuugcauaauuuuaaaaga

SEQ ID NO: 532833 - RNA, 65 nt, hsa
gaauguuuuuaauuugcugacuuacagacacaggcuguuuacaaaaugcuagcuggaaagucugu

SEQ ID NO: 532834 - RNA, 65 nt, hsa
uuguuuauaaaguuuuauggauuuuuacagugaaguguuuacaguuguuuaauaaagaacuguau

SEQ ID NO: 532835 - RNA, 65 nt, hsa
gaguuugcacuccaguagaagacagaaggaacguauguuuacaaaccacuucacuggaagacguc

SEQ ID NO: 532836 - RNA, 65 nt, hsa
gauggaaggaauacuucuauuaaccaaauagaaucuguuuacaaaaaugguucguguguguuacc

SEQ ID NO: 532837 - RNA, 65 nt, hsa
cugagcauguacugagccuuguaauucuaaaugaauguuuacacucuuuguaagaguggaaccaa

SEQ ID NO: 532838 - RNA, 65 nt, hsa
uaaccugggagacggaagaagcacgccaugggaaguguuuacacuuggggacaagugcuaaguau

SEQ ID NO: 532839 - RNA, 65 nt, hsa
cugauaaauucuuucuuugagaaagacaauuuuaauguuuacaacaauaaaccauguaaaugaac

SEQ ID NO: 532840 - RNA, 65 nt, hsa
uuauauuuccauaguaucacauacuauuauuuaguuguuuacaagacuccaauuugaauucagga

SEQ ID NO: 532841 - RNA, 65 nt, hsa
augucagacuuugcugcauuuuacacaugugcugauguuuacaaugaugccgaacauuaggaauu

SEQ ID NO: 532842 - RNA, 65 nt, hsa
aauguuuuaaaauauaaaacaaagccaaguuaaacuguuuacacugaugugcuauaaaagcacca

SEQ ID NO: 532843 - RNA, 65 nt, hsa
uauuuucuucuuauuuuggaugaaguaccccaaccuguuuacauuuagcgauaaaauuauuuuuc

SEQ ID NO: 532844 - RNA, 65 nt, hsa
aaaaagaugaggacucagaaguucaagcuaaauauuguuuacauuuucugguacucugugaaaga

SEQ ID NO: 532845 - RNA, 65 nt, hsa
guaaaaagaaacaaagaauuaucuuugugaucaauuguuuacagccuaugaagguaaaguauaug

SEQ ID NO: 532846 - RNA, 65 nt, hsa
gacuauuucaaaauguccagauguaggggaagagauguuuacaguaugaugaaaauaauuuucca

SEQ ID NO: 532847 - RNA, 65 nt, hsa
ggaaagcaaaaaauagagcuucauuuuugauauauuguuuacagccugugaaagugauuuauuug

SEQ ID NO: 532848 - RNA, 65 nt, hsa
ugcauacaauuuaauguaauuucauuccauucuauuguuuacacaacgauuacucgaagaugacu

SEQ ID NO: 532849 - RNA, 65 nt, hsa
gggaagagccagccuugccuuuucuuauaugauuuuguuuacaaaauuuuacugggacuuuuaaa

SEQ ID NO: 532850 - RNA, 65 nt, hsa
gagauauuuacaacugggagaaaugucuauuuagguguuuacauuaagcgguaugaaaguuguua

SEQ ID NO: 532851 - RNA, 65 nt, hsa
gggaaacgaacccacugugcuuacagugacugucguguuuacaaaaggcagcccuuuggguacua

SEQ ID NO: 532852 - RNA, 65 nt, hsa
uuuaauuaugucagagauugcaucauccuucugcuuguuuacaacuaugaucuucuaugaaaugg

SEQ ID NO: 532853 - RNA, 65 nt, hsa
uaccccagcugccacuccucuaguugaaaguguuguguuuacaucugacauuaaauuauuuuucc

SEQ ID NO: 532854 - RNA, 65 nt, hsa
ccccuauuuuuggcuuuaauuucuaauugcaaagauguuuacaucaaagcuucuucacagaauuu

SEQ ID NO: 532855 - RNA, 65 nt, hsa
gggccaaaugaacguuugcagagcagugggcacaauguuuacaauguauguguaugucacuuucg

SEQ ID NO: 532856 - RNA, 65 nt, hsa
uuguuaauuuauuuuauagugauuugguucaaagauguuuacaggacacacacacacacacacac

SEQ ID NO: 532857 - RNA, 65 nt, hsa; identical to SEQ ID NO: 420673

SEQ ID NO: 532858 - RNA, 65 nt, hsa; identical to SEQ ID NO: 420674

SEQ ID NO: 532859 - RNA, 65 nt, hsa
auuauuuaauuccuuaauuuggaaagcaguuuuaauguuuacaguuuaagauacucauuuucagu

SEQ ID NO: 532860 - RNA, 65 nt, hsa
uucccagaucauuugaaauuucuggcugccuuacuuguuuacagauaguuuaagacuauuuaaau

SEQ ID NO: 532861 - RNA, 65 nt, hsa; identical to SEQ ID NO: 420675

SEQ ID NO: 532862 - RNA, 65 nt, hsa; identical to SEQ ID NO: 420676

SEQ ID NO: 532863 - RNA, 65 nt, hsa
aaaguuuuuuugcuuaauuaugaaguagacaugcauguuuacauuuauguaaaauauuugcugug

SEQ ID NO: 532864 - RNA, 65 nt, hsa
cuaggggaaucucuauuacucuguacuuauacuaauguuuacaagaaugcaauauacugugaugc

SEQ ID NO: 532865 - RNA, 65 nt, hsa
ccaacuuuguaccuugauugccuuacaaaguuauuuguuuacaaacagcgaccauauaaaagccu

SEQ ID NO: 532866 - RNA, 65 nt, hsa
aaacuccauuauaaucuauauacauuuaaagaccguguuuacauaaucucuucuggguagaaaau

SEQ ID NO: 532867 - RNA, 65 nt, hsa
cucccacagcuuuaaauacugaggaaaauguggccuguuuacaaaacauucagcacguugaagaa

SEQ ID NO: 532868 - RNA, 65 nt, hsa
uguuuauacuccaguguacauaguguaauguagcguguuuacauguguagccuauguuguggucc

SEQ ID NO: 532869 - RNA, 65 nt, hsa; identical to SEQ ID NO: 420677

SEQ ID NO: 532870 - RNA, 65 nt, hsa; identical to SEQ ID NO: 420678

SEQ ID NO: 532871 - RNA, 65 nt, hsa
caagaccagggaggaaaguggcaagcuguagaaaauguuuacacgcauggaggggcauugcucua

SEQ ID NO: 532872 - RNA, 57 nt, hsa
gugcuccgaagaucggcugaagcuuccuguuuacacuuggagggaaaaguucuuuuu

SEQ ID NO: 532873 - RNA, 65 nt, hsa
ugauagaagagugggcuuuaacuggcaggccuguauguuuacagacuaccauacuguaaauauga

SEQ ID NO: 532874 - RNA, 65 nt, hsa
uggcugugucuaggcgcaagcacuuuagcaguaucuguuuacaugcgcaaggaucaagccgacua

SEQ ID NO: 532875 - RNA, 65 nt, hsa
gcuuauucuuuuuguucacuggagagagagagaacuguuuacaguuaaucugugucuaauuaucu

SEQ ID NO: 532876 - RNA, 65 nt, hsa
cuugguguauguaagcacauuuguuccuuuauaucuguuuacaaaacugugaaucaaaaagacaa

SEQ ID NO: 532877 - RNA, 65 nt, hsa
auguuaaugaaaucaaguuccaguaacccaaaucuuguuuacaaaauauucgugguaucugugaa

SEQ ID NO: 532878 - RNA, 65 nt, hsa
aagaauugagaaaacucugagcauuuuuaaaaguuuguuuacaauuccacaagcaaaagcucuaa

SEQ ID NO: 532879 - RNA, 65 nt, hsa; identical to SEQ ID NO: 420679

SEQ ID NO: 532880 - RNA, 65 nt, hsa; identical to SEQ ID NO: 420680

SEQ ID NO: 532881 - RNA, 65 nt, hsa; identical to SEQ ID NO: 420681

SEQ ID NO: 532882 - RNA, 65 nt, hsa
cuugcuuauuacauuuaaauccuuguguaacugaauguuuacaugucaagaggaaaagcuguaag

SEQ ID NO: 532883 - RNA, 65 nt, hsa
ugggggguggggggagaugaaagagagucgcguuuuguuuacaguuaaagacauccaauaucuua

SEQ ID NO: 532884 - RNA, 65 nt, hsa
uuaacuuauuuauguccuaaaagaagaauguaauuuguuuacaaaccuguagauaacgucuuugg

SEQ ID NO: 532885 - RNA, 65 nt, hsa
uuuucuccacccuaguuuauuuauuuauagauaucuguuuacaaagucuguaguaaauccugaug

SEQ ID NO: 532886 - RNA, 65 nt, hsa
aaugaaagcuaguagauguaaacauggaaaaauuguguuuacaauuuuauaaucucaguugauaa

SEQ ID NO: 532887 - RNA, 65 nt, hsa
gucauguacacaaagaccaucgagacggccauucuuguuuacaaaacacuuaccaagaaagcacu

SEQ ID NO: 532888 - RNA, 65 nt, hsa
gaguacauuaagaaguacaugcagaaguuuggggcuguuuacaaacccaaagaggacacugaauu

SEQ ID NO: 532889 - RNA, 65 nt, hsa
guucuuuuggucccagagaggcagccugggcagucuguuuacagcuggcaaacagacuggcuggc

SEQ ID NO: 532890 - RNA, 65 nt, hsa; identical to SEQ ID NO: 420682

SEQ ID NO: 532891 - RNA, 65 nt, hsa; identical to SEQ ID NO: 420683

SEQ ID NO: 532892 - RNA, 65 nt, hsa; identical to SEQ ID NO: 420684

SEQ ID NO: 532893 - RNA, 65 nt, hsa; identical to SEQ ID NO: 420685

SEQ ID NO: 532894 - RNA, 65 nt, hsa; identical to SEQ ID NO: 420686

SEQ ID NO: 532895 - RNA, 65 nt, hsa
aagugaauuauuuugauguaggcuuuuguauacuguguuuacacagguauaagucaguaauagca

SEQ ID NO: 532896 - RNA, 65 nt, hsa
ucauauccacugauuuccugauguccaugucuauauguuuacaagcaauauggagcaccauucuu

SEQ ID NO: 532897 - RNA, 65 nt, hsa
gugacaucucuuguacacugaacucacagaacauuuguuuacaauucugugugacugucugcuug

SEQ ID NO: 532898 - RNA, 65 nt, hsa
ucccuugaacuuugaaccugugaaaugcuuuaccuuguuuacaguuuggcaaaguugcaguuugu

SEQ ID NO: 532899 - RNA, 65 nt, hsa
guuaugugaguugaaucaagaggcucuaggccagauguuuacauaauuuuaaccuauaugauuuu

SEQ ID NO: 532900 - RNA, 65 nt, hsa; identical to SEQ ID NO: 420687

SEQ ID NO: 532901 - RNA, 65 nt, hsa; identical to SEQ ID NO: 420688

SEQ ID NO: 532902 - RNA, 65 nt, hsa
uuuauuguagaacuaaacuuagcauaguguucuguuguuuacaugaaguguguuuuucuuugguu

SEQ ID NO: 532903 - RNA, 65 nt, hsa
aguuuuucuguugaaacuagaggguuuuuuuuuucuguuuacauauacuuuuuuuuaauagcaau

SEQ ID NO: 532904 - RNA, 65 nt, hsa
aaguuuucuacaacaaaaaaagaguugagugaaucuguuuacauuuagaauaauguuuuuuucuu

SEQ ID NO: 532905 - RNA, 65 nt, hsa
uuuaaagcugaaaaauacauuugguucaugugcauuguuuacaaagcaaaaagaaaaaagaggaa

SEQ ID NO: 532906 - RNA, 65 nt, hsa
acugaguuagggugcaggcagaggcuggggcagaauguuuacagccagugccagcacaagguagu

SEQ ID NO: 532907 - RNA, 65 nt, hsa
aggaggaccacgaggaaauacccucaaaacuaacuuguuuacaacaaaauaaaguauucacuacc

SEQ ID NO: 532908 - RNA, 65 nt, hsa
ugcauuuaaaaaaaugccauaacuauuaaacaccuuguuuacagacagaugaaauaaauuuauuc

SEQ ID NO: 532909 - RNA, 65 nt, hsa
ugcauauauuaaagcaucaggacccuucgugacaauguuuacaaauuacguacuaaggauacagg

SEQ ID NO: 532910 - RNA, 65 nt, hsa
gaauccucuucccaggggauugaacagaagcuuaauguuuacaaguguuugaauuugugaucuga

SEQ ID NO: 532911 - RNA, 65 nt, hsa
auucauuuuuaacuugcuaccuacuuuuaaauaaauguuuacauuucuaaauaaugaaauguguu

SEQ ID NO: 532912 - RNA, 65 nt, hsa
gauaaauucauaaugcuuuuuuggguacacugaaauguuuacauacugaauucuguaauaugaac

SEQ ID NO: 532913 - RNA, 65 nt, hsa
agcuggagugggguacagaguucaguuuuccucucuguuuacagcuccuugacagucccacgccc

SEQ ID NO: 532914 - RNA, 65 nt, hsa; identical to SEQ ID NO: 420689

SEQ ID NO: 532915 - RNA, 65 nt, hsa; identical to SEQ ID NO: 420690

SEQ ID NO: 532916 - RNA, 65 nt, hsa
auguauuuuaauuggcaaauaauacuuguauauauuguuuacaacuuguuuuaaaguaugaauac

SEQ ID NO: 532917 - RNA, 65 nt, hsa
gcaguaucacaggccagauguuguuccuggcuagauguuuacauuuguaagaaauaacacuguga

SEQ ID NO: 532918 - RNA, 65 nt, hsa
aagccgagguggggggauauggggauucaggcaauuguuuacacacuuugaauaacugcaaagga

SEQ ID NO: 532919 - RNA, 65 nt, hsa
gguuaucagcucuuuaagagcucuauuaauugccauguuuacaaacaaacacaaagagagaaguu

SEQ ID NO: 532920 - RNA, 65 nt, hsa
guguuuuuugcaaauuagagcaggacaaacuuuuauguuuacagggcacgucuguuguaaugcaa

SEQ ID NO: 532921 - RNA, 65 nt, hsa
uauauuuuugacacaauuaaauauuacauagaguauguuuacaacaaauauccugucagccaaau

SEQ ID NO: 532922 - RNA, 65 nt, hsa
guauguucaacucucauccaaauggcauaugacccuguuuacacagccuaaagcuaaaaauauua

SEQ ID NO: 532923 - RNA, 65 nt, hsa
cuacaaaaaaacuuuuaaaacuuugccauuucaucuguuuacacucuuugccacugauuagcagu

SEQ ID NO: 532924 - RNA, 65 nt, hsa
ucuuuauuaugaaacuuuaucacauucgaaauguuuguuuacagugggauuuuaggggggauugu

SEQ ID NO: 532925 - RNA, 65 nt, hsa
guguaguaaugaaaauaccaaguugcaacauuacauguuuacaaaaaaaaaucuguguuuguagu

SEQ ID NO: 532926 - RNA, 65 nt, hsa
ggcaacagauuuugccuccccgaucagugugugccuguuuacagcacuaucuaucuuucucucuc

SEQ ID NO: 532927 - RNA, 65 nt, hsa
auucuauuuaagaaagcuaguggacaaucaguguauguuuacaauuguuuauacacuguucucca

SEQ ID NO: 532928 - RNA, 65 nt, hsa
aagucaacuaagcuacuuuuagauuuggaaauugcuguuuacagucuaacaacauuaaaaugaga

SEQ ID NO: 532929 - RNA, 65 nt, hsa
ggcccacagugacuuuugcugggcauuuucccagauguuuacagacugugaguacagcagaaaau

SEQ ID NO: 532930 - RNA, 65 nt, hsa
uuguuaaugcauuuuugaugggaagaaaagguacauguuuacaaagagguuuuaugaaaagaaua

SEQ ID NO: 532931 - RNA, 65 nt, hsa; identical to SEQ ID NO: 420691

SEQ ID NO: 532932 - RNA, 65 nt, hsa; identical to SEQ ID NO: 420692

SEQ ID NO: 532933 - RNA, 65 nt, hsa
uuuuuuuuuaauguaucuuaacuguugccugucaguguuuacaaacuagugcguugacggcaccg

SEQ ID NO: 532934 - RNA, 65 nt, hsa
acucacauuccuugaagcuaugagcauuuaaaaacuguuuacagccaccauagggauucaaaaga

SEQ ID NO: 532935 - RNA, 65 nt, hsa
gaucauguuccuaaaagaugcucauggggagaaaauguuuacagacaaauaauuuugggagcugc

SEQ ID NO: 532936 - RNA, 65 nt, hsa
guugauucaguuuguaauaacuaguaaugagcuucuguuuacaauaaaaauucuguaaauuguuu

SEQ ID NO: 532937 - RNA, 65 nt, hsa
accaugugcaaacugauccauccuguuuuuccuuuuguuuacaacacaguaguguucuguucacu

SEQ ID NO: 532938 - RNA, 65 nt, hsa
uccaucugggaaugauuaacacaaauguuggagcauguuuacauacaaacaaaguaggauuuaca

SEQ ID NO: 532939 - RNA, 65 nt, hsa
aagauacaaaaaaucuuguauuuuuuuuuuguguguguuuacaaguaguaaauuuauuuucagcu

SEQ ID NO: 532940 - RNA, 65 nt, hsa
uccugaaguuuuagaauggcaaauaaauguacaauuguuuacauaacagaaaaggcuaagcagaa

SEQ ID NO: 532941 - RNA, 65 nt, hsa
uauauauauggaguacaaugugauguuuugauauauguuuacaguguagaaugauuaaaucaaug

SEQ ID NO: 532942 - RNA, 65 nt, hsa
guccuugcucugaaaauugguaaaucaagcauguuuguuuacauuaaaaaguccagacacacugu

SEQ ID NO: 532943 - RNA, 65 nt, hsa
uaaacuuucuuaacaaacccaauuucuacaaauguuguuuacaucaaauuggacagggaugcaga

SEQ ID NO: 532944 - RNA, 65 nt, hsa
augcaucaucuuaucauauauuccuuccuauacauuguuuacacuucaacuacggggauguucca

SEQ ID NO: 532945 - RNA, 65 nt, hsa
uaaaacuuaacaggccaucacaagcaauugucuuuuguuuacaagauugauuuaauaugagagga

SEQ ID NO: 532946 - RNA, 65 nt, hsa
ccuaauguguuucuuuugacaccuuaguuccuuacuguuuacaguuuaggaguacugauaggggu

SEQ ID NO: 532947 - RNA, 65 nt, hsa
gaaaaacaaagugacaauuguagaguccucaauuguguuuacauuaauagugguguuuuuaccua

SEQ ID NO: 532948 - RNA, 65 nt, hsa
uuuuuuuuuuaagauauaugacuaaaauggacaauuguuuacaaggcuuaacuaauuuauuugcu

SEQ ID NO: 532949 - RNA, 65 nt, hsa
agcaguucuacauuaaaucaccuugucaagggcucuguuuacaucuauacauuuugaagaugaaa

SEQ ID NO: 532950 - RNA, 65 nt, hsa
uuucaucaggaaaucccaaaguuuccaaagcuuuuuguuuacagaauaaaacuucaaauaaaacc

SEQ ID NO: 532951 - RNA, 65 nt, hsa
aacauuuguguuucaacaagggacaguaaacuguguguuuacagccaaaagaaaugccucauagu

SEQ ID NO: 532952 - RNA, 65 nt, hsa
aguuuuccuuagaaaaagcuuuugcuaucuuauccuguuuacauuauuucuuuauuuuaauucug

SEQ ID NO: 532953 - RNA, 65 nt, hsa
cccauuauuauccacccugagccaccauaauaugcuguuuacauuuauuuucuucagccugugca

SEQ ID NO: 532954 - RNA, 65 nt, hsa
uagccacuagaaagagaaauaaacccaauggcauguguuuacaggaagaaagauuaccuucagau

SEQ ID NO: 532955 - RNA, 65 nt, hsa
gcaugucacuagguaacacagauccauccagaugguguuuacauuugauuuauuugggaucuuau

SEQ ID NO: 532956 - RNA, 65 nt, hsa
uaaaccccuuugauuuaaaaauguauuuuuaaaaauguuuacauugaugaugaguaauauugcau

SEQ ID NO: 532957 - RNA, 65 nt, hsa
aagacuguauuuagaucucauaaugcuuuguuaaauguuuacaaguaaauaguuugaauucagua

SEQ ID NO: 532958 - RNA, 65 nt, hsa
caacauuuuacuuuuuaucauugauguguucaaacuguuuacaaggagaugcuuauagaugauag

SEQ ID NO: 532959 - RNA, 65 nt, hsa
ucuuaagaccacucagcaugacgacugaguagacuuguuuacaucugaucaaagcacugggcuug

SEQ ID NO: 532960 - RNA, 65 nt, hsa
uuucaaccuuuuagggugauaaauacauguauaauuguuuacauacuuaaaaggaaaaaguugag

SEQ ID NO: 532961 - RNA, 65 nt, hsa
auuggcgcugagauccaggcuggauccauugcuuuuguuuacaauaggcacucucucuaccccac

SEQ ID NO: 532962 - RNA, 65 nt, hsa
guacugccaggcaugugggugugggugcauguggguguuuacacacaugccuacagguaugcgug

SEQ ID NO: 532963 - RNA, 65 nt, hsa
ggaaucccuugggggagauauuaggagugcucuguuguuuacaaacucagguacccgcagggccu

SEQ ID NO: 532964 - RNA, 65 nt, hsa; identical to SEQ ID NO: 420693

SEQ ID NO: 532965 - RNA, 65 nt, hsa; identical to SEQ ID NO: 420694

SEQ ID NO: 532966 - RNA, 65 nt, hsa
ucuacuaauauuuacuugugauugugugacaaguguguuuacagauuauugguuacacuucaauu

SEQ ID NO: 532967 - RNA, 65 nt, hsa
ccacuucauuugaaaauaaugaaaccauguaccacuguuuacaucaucuguagugauuucauaga

SEQ ID NO: 532968 - RNA, 65 nt, hsa
agcugcugcucucguacuaacugugccagugcccauguuuacagaagucaggggaaggaaggagc

SEQ ID NO: 532969 - RNA, 65 nt, hsa
acuuuuguuauacacauuugcuuuguguaaauaaauguuuacaauuuuauaugaaagauggaaua

SEQ ID NO: 532970 - RNA, 65 nt, hsa; identical to SEQ ID NO: 420695

SEQ ID NO: 532971 - RNA, 65 nt, hsa; identical to SEQ ID NO: 420696

SEQ ID NO: 532972 - RNA, 65 nt, hsa
aaccauuuaaagaaagaaugcauuccagaacaaauuguuuacauaaguuccuauaccuuacugac

SEQ ID NO: 532973 - RNA, 65 nt, hsa
auguaugguuagaguccaauugccauugccuuucuuguuuacagauagugcaauggcgcaauccu

SEQ ID NO: 532974 - RNA, 65 nt, hsa
uauuuuucuaauuauugcuuuuuaaauguauuguuuguuuacauuuaauuuuauaucaugucuuu

SEQ ID NO: 532975 - RNA, 65 nt, hsa
caaaugaccuuaccuguaauacagucuuguuugucuguuuacaaccauguauuuauugcaaugua

SEQ ID NO: 532976 - RNA, 65 nt, hsa
guguacuuuuucaugaaaaggaaaaaugguuaacauguuuacacaagaaaaaaagucaaaauuau

SEQ ID NO: 532977 - RNA, 65 nt, hsa
uucuuauuguugaauaaaaaagugcacagugugauuguuuacaaaaugauauuauaaauaaauaa

SEQ ID NO: 532978 - RNA, 65 nt, hsa
aggcgcuagaucaaggucacagcacugccuacaccuguuuacaaaaagaaucaaauaccacuaug

SEQ ID NO: 532979 - RNA, 65 nt, hsa
uuucaaagugcugccaguugaaaagggaagcauuauguuuacaaaucuguuuugaaauguuugcc

SEQ ID NO: 532980 - RNA, 65 nt, hsa
uacuaugcaauaauauaacuuagaguuccacgguuuguuuacacauuuccuguuguacauuuagg

SEQ ID NO: 532981 - RNA, 65 nt, hsa
aacacucaaggacuuuguucauuuccaaagcuacuuguuuacauuguacacugcgaccaccuugc

SEQ ID NO: 532982 - RNA, 65 nt, hsa
ccacuaagaauacaguuugaauguauaaucaguaguguuuacaagauccaacagugcacucauca

SEQ ID NO: 532983 - RNA, 65 nt, hsa
gugcccaacuuucagaagaggaaaaucacacauuauguuuacauaaguagcaaaaauauauuuau

SEQ ID NO: 532984 - RNA, 65 nt, hsa
agaaagaaaauuagaaaaucuguucauugaaauucuguuuacacuugucagaaauaagcauuucu

SEQ ID NO: 532985 - RNA, 65 nt, hsa
aaaguuaauauacuaaaggguuccuuuuuuuuuaauguuuacauuuaucucuauguuuaccuuuu

SEQ ID NO: 532986 - RNA, 65 nt, hsa
acuugaauaguucuacagucuuuuuuuuuuuuuaauguuuacaauuauccaguuuuagaagagag

SEQ ID NO: 532987 - RNA, 65 nt, hsa
gugagauguuucagugaaccaaaguucugauaccuuguuuacauguuuguuuuuauggcauuucu

SEQ ID NO: 532988 - RNA, 65 nt, hsa
cugcauauauaugaaugacuaggauuaaucugguguguuuacauaggauauacauaguugaaauc

SEQ ID NO: 532989 - RNA, 65 nt, hsa
cccacuuugcacacccgcucuccggcccgcgccccuguuuacagcgucccuguguauguuggacu

SEQ ID NO: 532990 - RNA, 65 nt, hsa
ccuuuggucaaucauaacaugcuguuuaaagcagcuguuuacaggauguguagugguaugccccu

SEQ ID NO: 532991 - RNA, 65 nt, hsa
aacugucauuguacuaauuaauguacuaaauccuauguuuacauuaauaugugaaaaaagauuua

SEQ ID NO: 532992 - RNA, 65 nt, hsa
cgucauucuguuuuaagcucauggaucaauggauuuguuuacaaugugauauuuucuauuaaauc

SEQ ID NO: 532993 - RNA, 65 nt, hsa
gacaagugcuucuaaaccuucaaagauggcaaaauuguuuacaccagugagagggagaucaaaag

SEQ ID NO: 532994 - RNA, 65 nt, hsa
gggauuuuguuuuuauuuugaaaugggagcuuuuuuguuuacaaguucauuaaaaacuaaaaacu

SEQ ID NO: 532995 - RNA, 65 nt, hsa
gaggaaaugggcauagaguagagaauagcuucauauguuuacacguuugcauagacuacacacau

SEQ ID NO: 532996 - RNA, 65 nt, hsa
gguggccagcuuguacaccagucccugaacugagcuguuuacaggacuggggaggcuccacccag

SEQ ID NO: 532997 - RNA, 65 nt, hsa
aaacagaucuucuucucucuuguccaccuauuaauuguuuacaauauuuguacaucuaugcaaaa

SEQ ID NO: 532998 - RNA, 65 nt, hsa
gugaaaauggaguucuggguuggaggcuuauuccauguuuacacaauuaaaauugcaguguuccu

SEQ ID NO: 532999 - RNA, 65 nt, hsa
uguguccugaagucgccagaggagaagggaaucauuguuuacacauggggaucagagcagacuuc

SEQ ID NO: 533000 - RNA, 65 nt, hsa
cauugaugaucacugugaaaauugaccaagugauguguuuacauuuacugaaaugcgcucuuuaa

SEQ ID NO: 533001 - RNA, 65 nt, hsa
uucucauguagaacaagaaaucuuucuggaauugauguuuacaugucuguuguuggucaucucuc

SEQ ID NO: 533002 - RNA, 65 nt, hsa
cacacaguuuaaaaaaucagccccuaauuucuccauguuuacacuucaaucugcaggcuucuuaa

SEQ ID NO: 533003 - RNA, 65 nt, hsa
cagaauguguaauagcucacaauaaguagguauuauguuuacauauuauguuuguauuuaugcua

SEQ ID NO: 533004 - RNA, 65 nt, hsa
ugaugucugggccuucggugugcugaugugggaaguguuuacacauggagagaugccccauggug

SEQ ID NO: 533005 - RNA, 65 nt, hsa
uugcccuuccccucccucgggaagccaccuaagaauguuuacaugccaaacagaauguaacaccc

SEQ ID NO: 533006 - RNA, 65 nt, hsa
auccaggccgggccuauacagaggugcuggcugcuuguuuacauucuccucuggggcucuaccuc

SEQ ID NO: 533007 - RNA, 65 nt, hsa
guuaacagcucauaucaggagcugugauaaguaaguguuuacauacacugucuagugcauaaaaa

SEQ ID NO: 533008 - RNA, 65 nt, hsa
guagggccuacaugguuauuugccugcucacuuuauguuuacaucucccacauucauaccaauau

SEQ ID NO: 533009 - RNA, 65 nt, hsa
ccuugaagguauaucuagguuuaugacaguaauuguguuuacauuuuauggugccuaguauugac

SEQ ID NO: 533010 - RNA, 65 nt, hsa; identical to SEQ ID NO: 420697

SEQ ID NO: 533011 - RNA, 65 nt, hsa; identical to SEQ ID NO: 420698

SEQ ID NO: 533012 - RNA, 65 nt, hsa
uagucacaauuggguagaugugacauccauauacuuguuuacauuuuaucuguucucaugucaaa

SEQ ID NO: 533013 - RNA, 65 nt, hsa
ggcuuuuuacuuugcuagaacaacaaacuaucuuauguuuacauacugguuuacaauguuauuua

SEQ ID NO: 533014 - RNA, 65 nt, hsa
aaagucaaauguguauguucuaccuccaacggaaauguuuacaaggucaagacuuaauucaauuc

SEQ ID NO: 533015 - RNA, 65 nt, hsa
uuucucauggauuuuuguggugugggccaauaugguguuuacauuauauaauuccugcuguggca

SEQ ID NO: 533016 - RNA, 65 nt, hsa
gaguggcaucagucucacucaucuuggugccccgguguuuacaagagccagauggugucagagga

SEQ ID NO: 533017 - RNA, 65 nt, hsa
aguggaaguuuucccuaugagccuacagucuguauuguuuacauuaagaaacucucuauuauugu

SEQ ID NO: 533018 - RNA, 65 nt, hsa
ggcuuuugucauuguugccaucauauggaagauaauguuuacauccuuuuaaacauuuuuauaug

SEQ ID NO: 533019 - RNA, 65 nt, hsa
agggugaaggaggucaggccccacuccuuccugauuguuuacagucauuggaauaaggcauggcu

SEQ ID NO: 533020 - RNA, 65 nt, hsa
uguauuccaagaaaaucaaagugguacaauuuguuuguuuacacuaugauacuuucuaaauaaac

SEQ ID NO: 533021 - RNA, 65 nt, hsa
gucuccaaauaaaaaggguuuuguucagauuaaaauguuuacaacaaaauguuaauuauauucua

SEQ ID NO: 533022 - RNA, 65 nt, hsa
aauuuuuaguuguauucuauucuuuuacuguacauuguuuacaucuggauuuuccuguaauaaac

SEQ ID NO: 533023 - RNA, 65 nt, hsa
aggaagccuucucugccagcgaucucgcagcacuguguuuacaggggggaggggagggguucgua

SEQ ID NO: 533024 - RNA, 65 nt, hsa
agaagaaccuggaggacggaggaaaccaggggcaauguuuacaagacugguggacaaguguaaau

SEQ ID NO: 533025 - RNA, 65 nt, hsa
cucacuggcaaguguuuguggaguuuccauggugauguuuacauccagggacaguuucgucuccc

SEQ ID NO: 533026 - RNA, 65 nt, hsa
ggcucuugguggaggcaggggaacccugagagugcuguuuacagagaaccucagcucccgucugc

SEQ ID NO: 533027 - RNA, 65 nt, hsa
guuugaaaugcagcgugaguagcucuuuuguuuacuguuuacaccccuuauuggcaugucaacuc

SEQ ID NO: 533028 - RNA, 65 nt, hsa
gagccuggaaaaaaaaauuaggaccacaugugagauguuuacaagacacccagaacagugguaaa

SEQ ID NO: 533029 - RNA, 65 nt, hsa
cauguauacaucauaguucaaaacccaguagucauuguuuacagcaaauaaagaaauauuuagua

SEQ ID NO: 533030 - RNA, 65 nt, hsa
uauuuguugggcagaggcuguuccauugagaggaauguuuacagcaguuucaaaaaugacaaagu

SEQ ID NO: 533031 - RNA, 65 nt, hsa
uguggguuuucuguuugaaaaggagucauggcaucuguuuacauuuaccuuaucaaaccuagaau

SEQ ID NO: 533032 - RNA, 65 nt, hsa
auuuuauaaugcccugcaacucuaaaccauccuuuuguuuacacauuuuuguaugguauuuuaag

SEQ ID NO: 533033 - RNA, 65 nt, hsa
uaauaauggcaguacuaagagauuuauaaucauaauguuuacaaugcagccuacuggauugucuc

SEQ ID NO: 533034 - RNA, 65 nt, hsa; identical to SEQ ID NO: 420699

SEQ ID NO: 533035 - RNA, 65 nt, hsa; identical to SEQ ID NO: 420700

SEQ ID NO: 533036 - RNA, 65 nt, hsa
gagcuaucaaucaaauuuuacaucucacaauguacuguuuacauggauauuggcugcuuuuuuua

SEQ ID NO: 533037 - RNA, 65 nt, hsa
aaccaccuuuaauauuacacugcuuauaauacuaauguuuacagauauguuucuguuuauaacca

SEQ ID NO: 533038 - RNA, 65 nt, hsa
caguaaacccaucuuuccuuaacgaaaauuuccuauguuuacagucugucuauugguaugcaauc

SEQ ID NO: 533039 - RNA, 65 nt, hsa
ccuguucaucugggcugccuggcagagagccuugcuguuuacaauuaaaauguuucugccacaaa

SEQ ID NO: 533040 - RNA, 65 nt, hsa
uuuccuuucucuguuucagccuaugacaaaauugauguuuacaggccugcuuuuugcuuauaauu

SEQ ID NO: 533041 - RNA, 65 nt, hsa
guucuagucccacuugucaaacagagcauucugaguguuuacaggcggaccuguucucuuccgac

SEQ ID NO: 533042 - RNA, 65 nt, hsa
uguaaacugucagggugauaaaauguuucucuugauguuuacaugcacaagcuuugcguucugac

SEQ ID NO: 533043 - RNA, 65 nt, hsa
cugacucagcacuuuguucacuggcucagcaguuauguuuacacaucauuuuuauguuccugcuu

SEQ ID NO: 533044 - RNA, 65 nt, hsa
uguuguaaaagccauauuucuaauggaaaaucagguguuuacaggaaagaucucagaggcuauga

SEQ ID NO: 533045 - RNA, 65 nt, hsa
uuuuguccuauggaaaauacuguaauucaggauuauguuuacaauugauccagguguuuguuucu

SEQ ID NO: 533046 - RNA, 65 nt, hsa; identical to SEQ ID NO: 420701

SEQ ID NO: 533047 - RNA, 65 nt, hsa; identical to SEQ ID NO: 420702

SEQ ID NO: 533048 - RNA, 65 nt, hsa
uagacauuguucaacuguauguuauuggcacguguuguuuacauuuugcugugacauuuaaaaau

SEQ ID NO: 533049 - RNA, 65 nt, hsa
aaguuauuuauaacagagaccucuagugcugcacuuguuuacacaccuuugaaaaucuggaaaug

SEQ ID NO: 533050 - RNA, 65 nt, hsa
aaauguaucuuaugaauagagacauauuaaaauaauguuuacaucuuagaaaaaacauagauagu

SEQ ID NO: 533051 - RNA, 65 nt, hsa
uuuacuguuguacaaucauguucuggugguuugauuguuuacaggauauuccaaaauaaaaggac

SEQ ID NO: 533052 - RNA, 65 nt, hsa
uuaauuaauaggcuuuauuuguaagagcaguuuuauguuuacagaaaaauuaggcacaaagggau

SEQ ID NO: 533053 - RNA, 65 nt, hsa
gguuuugaugugucugauuuugacuacucaagcucuguuuacagaagaaaauugaauggcgaggg

SEQ ID NO: 533054 - RNA, 65 nt, hsa
auauucuagaauagauacuguauuaaauauugccauguuuacaauauguaauauguuuuuagccg

SEQ ID NO: 533055 - RNA, 65 nt, hsa
aagcuaugcacccaguuggccuuagaaaaccacaauguuuacagcccugucuuagggccgcggcu

SEQ ID NO: 533056 - RNA, 65 nt, hsa
ucuuugcuucaggagucucagcuagggaguugaaguguuuacaucagacugucuugugcaauucu

SEQ ID NO: 533057 - RNA, 65 nt, hsa
uauuaacaauucccccagaacauggaaauaaccauuguuuacagagcugagcauuggugacaggg

SEQ ID NO: 533058 - RNA, 65 nt, hsa
auguauggaaauucuuaggauuuuuuuaccagcuuuguuuacagacccaaauguaaauauuaaaa

SEQ ID NO: 533059 - RNA, 57 nt, hsa
uaugggagacauccauuuaagaucaacuguuuacaugugauacaucgaaaacuguuu

SEQ ID NO: 533060 - RNA, 56 nt, hsa
agauauguucccaguuguagaauuacuguuuacacacauuuuuguucaauauugau

SEQ ID NO: 533061 - RNA, 65 nt, hsa
gcacuuauuuuuuaagagggaaaggacuuuggucauguuuacauuggccuuugguuuuuuuuuuu

SEQ ID NO: 533062 - RNA, 65 nt, hsa
cggguucaguaccauggacagcgcccucgacccgcuguuuacaaccaugaccccuuggacacugg

SEQ ID NO: 533063 - RNA, 65 nt, hsa
guuuuguauuuucuauacugguguuagaaaacauauguuuacauuugauuaacuguguugccuau

SEQ ID NO: 533064 - RNA, 65 nt, hsa
aauuauuaccaugaguauaauuuuaagaaugaaaauguuuacaguauuuucaguuuuauuauaaa

SEQ ID NO: 533065 - RNA, 65 nt, hsa
augcgaacagguaccuaucuguuucuaaauaaaacuguuuacauucauuaugggguauguaugac

SEQ ID NO: 533066 - RNA, 65 nt, hsa
uauugccaaaaucaaauaaauggcuucucagcugcuguuuacaacaaacuucccuaaccaaaaca

SEQ ID NO: 533067 - RNA, 65 nt, hsa
gcuucacggucacgcucguccguccugcaguggcguguuuacauggucacacguguguguaucac

SEQ ID NO: 533068 - RNA, 65 nt, hsa
ugcuauagagaacauucuuccaagauaaauauguguguuuacacauaugucugcaugcaugugaa

SEQ ID NO: 533069 - RNA, 65 nt, hsa
acgccauggggccgcugcugcuuaugugguuggauuguuuacaagccucauuauuaaaacugaag

SEQ ID NO: 533070 - RNA, 65 nt, hsa
ugaaauggccaggcacaaauuuagucuggucauuuuguuuacacauugggaaaaaaauuaguuua

SEQ ID NO: 533071 - RNA, 65 nt, hsa
ucaaaaagcaugaacucguuuucauucauuagcccuguuuacaauguggauuuugacauaaauga

SEQ ID NO: 533072 - RNA, 65 nt, hsa
gaguccaggagcucaggaagaagagaugcacuauauguuuacacaauuaauucaucccuuaauuu

SEQ ID NO: 533073 - RNA, 65 nt, hsa
gaaaagagaugaugaaaauauuuaaaggcccuaucuguuuacaguguuccgugguuaaacucgcu

SEQ ID NO: 533074 - RNA, 65 nt, hsa
guuauuuuccaaaggauuuuguaucuuuuugaaaauguuuacaucaucagaugauccacagaauu

SEQ ID NO: 533075 - RNA, 65 nt, hsa
aaagacuagcaguuaguguuggaaaaaccuggugguguuuacaauguugcuaaucauuacaaaac

SEQ ID NO: 533076 - RNA, 65 nt, hsa
agacagugcccugagaccucuagagaaaagauguuuguuuacauaagagaaagaggccagacaug

SEQ ID NO: 533077 - RNA, 65 nt, hsa
aauauacaugaacuuuuuucauggcauuauguggauguuuacaauggugggaaauucagcugagu

SEQ ID NO: 533078 - RNA, 65 nt, hsa
uccaaucacaguguuauguaguauuguucuauuuuuguuuacaaacauggaaaacagaguauuuc

SEQ ID NO: 533079 - RNA, 65 nt, hsa
auaauuuuuuucacuaagcuguuugccuuccaaaguguuuacaccuuaagccuuaacauguaucu

SEQ ID NO: 533080 - RNA, 65 nt, hsa
cuuccgcccggaggaaugaacaagugucagucgaguguuuacagauccggccaggaccccggccc

SEQ ID NO: 533081 - RNA, 65 nt, hsa
accagaggugugacaggcucuagucuccucccuguuguuuacagcauauuuaagucuugugaaac

SEQ ID NO: 533082 - RNA, 65 nt, hsa
auguaauuuuaugcuucagagaugaagauacuguuuguuuacaaagaguuuaguuuuuaagacau

SEQ ID NO: 533083 - RNA, 65 nt, hsa
uuuucagccagacagaggcauaauaaagugacugauguuuacagaacccaaaugaugucuuccuc

SEQ ID NO: 533084 - RNA, 65 nt, hsa
uaauuuauaauuagggauuguucaaacuucagaucuguuuacagguuguaaaaauaaacuucggu

SEQ ID NO: 533085 - RNA, 65 nt, hsa
aaauugugagguuaauguuuaaaaagcuuuacaccuguuuacaauuuggggacaaaaaggcaggc

SEQ ID NO: 533086 - RNA, 65 nt, hsa
uccuugcugacuuguguugcauuguauuccaaacguguuuacagguucucuuaagcaauguugua

SEQ ID NO: 533087 - RNA, 65 nt, hsa
ccccacacccuuauuuucagauucuggaucauucuuguuuacaacugaaauauauauaaccucag

SEQ ID NO: 533088 - RNA, 65 nt, hsa
aagcuuuguauuauucuuccacauaugcuggcugcuguuuacacacccugccaaugccuuagcac

SEQ ID NO: 533089 - RNA, 65 nt, hsa
ugaacuuucaaagcuugcuauuaaaucauuuagaauguuuacauuuacuaaggugugcuggguca

SEQ ID NO: 533090 - RNA, 65 nt, hsa
cuuguguguuacauguaacagacaugguaaauauuuguuuacagucuuuguuuaacaaaccaugc

SEQ ID NO: 533091 - RNA, 65 nt, hsa
ucuauucucuccaaaaaugcacccaacuagcucuauguuuacaaauggacauaggacucaaaguu

SEQ ID NO: 533092 - RNA, 65 nt, hsa
aaguguuuaaaacuuuugacaagugguaguccuacuguuuacacucacaguuaauguucauaccu

SEQ ID NO: 533093 - RNA, 65 nt, hsa
uuugaauaccuugauguuuugcauuacuucauuuauguuuacaucauguuuagaaauguuuucau

SEQ ID NO: 533094 - RNA, 65 nt, hsa
gaaauuggaaggauucauugagcagcauagaaguuuguuuacauguuacuuugagaugcuaggua

SEQ ID NO: 533095 - RNA, 65 nt, hsa
uaguuuaucaaaccaaauacugugaacguaccagguguuuacagauuuaaaugcauguuaccaua

SEQ ID NO: 533096 - RNA, 65 nt, hsa; identical to SEQ ID NO: 420703

SEQ ID NO: 533097 - RNA, 65 nt, hsa; identical to SEQ ID NO: 420704

SEQ ID NO: 533098 - RNA, 65 nt, hsa
uauguauacaucugaaugaaaagcaaagcuaaauauguuuacagaccaaagugugauuucacacu

SEQ ID NO: 533099 - RNA, 65 nt, hsa
agauuauaagccuaaugguguggagguuuugaugguguuuacaacacacugagaccuguuguuuu

SEQ ID NO: 533100 - RNA, 65 nt, hsa; identical to SEQ ID NO: 420705

SEQ ID NO: 533101 - RNA, 65 nt, hsa; identical to SEQ ID NO: 420706

SEQ ID NO: 533102 - RNA, 65 nt, hsa; identical to SEQ ID NO: 420707

SEQ ID NO: 533103 - RNA, 65 nt, hsa; identical to SEQ ID NO: 420708

SEQ ID NO: 533104 - RNA, 65 nt, hsa
aaaaagagcuggugguuugaucauuucugccaugauguuuacaagauggcgaccaccaaagucaa

SEQ ID NO: 533105 - RNA, 65 nt, hsa
aaacagaagagcagggacauaaaggaaaaugucaguguuuacaugggaccuauggaaacaaaggc

SEQ ID NO: 533106 - RNA, 65 nt, hsa
acaggcgguuugugcaggaaagcacagugccguguuguuuacagcuuuucuagagcagcugugcg

SEQ ID NO: 533107 - RNA, 65 nt, hsa
cauuucuauuuguuacuccuuuuuacuggacaugauguuuacaagauacaacuguguuacuguau

SEQ ID NO: 533108 - RNA, 65 nt, hsa; identical to SEQ ID NO: 420709

SEQ ID NO: 533109 - RNA, 65 nt, hsa; identical to SEQ ID NO: 420710

SEQ ID NO: 533110 - RNA, 65 nt, hsa
auauccccacaauuuccggaaccuacauguauagcuguuuacaaaaucuccaaguuaauuaaggg

SEQ ID NO: 533111 - RNA, 65 nt, hsa; identical to SEQ ID NO: 420711

SEQ ID NO: 533112 - RNA, 65 nt, hsa; identical to SEQ ID NO: 420712

SEQ ID NO: 533113 - RNA, 65 nt, hsa
cuauacauuuuuccaauccccaugcaaacuguuccuguuuacauaccuucucuguuguaucagua

SEQ ID NO: 533114 - RNA, 65 nt, hsa
ucaugucuuuuccagagugacagcauucuugugaauguuuacauccugcugcugauagguucaag

SEQ ID NO: 533115 - RNA, 53 nt, hsa
uagcugauguucaggcauaagguuguuuacaggugaauucaugacaccuuuga

SEQ ID NO: 533116 - RNA, 65 nt, hsa
uauuaucuugcagauaaagaaaaaaauuaagaguguguuuacaacuguuuucucuuuuuuacagu

SEQ ID NO: 533117 - RNA, 65 nt, hsa
uuugcacaauauuucuuuuguuguacuuuauaucuuguuuacaauaaagaauucccuuugguaua

SEQ ID NO: 533118 - RNA, 65 nt, hsa
aucaugcauuagagucaguucuggcucugccuagcuguuuacauuugcaaauguagcaaacaagg

SEQ ID NO: 533119 - RNA, 65 nt, hsa
gaacuaaggagcaguggcagaaggugggccccguguguuuacagcauuuccagguccagagaggu

SEQ ID NO: 533120 - RNA, 65 nt, hsa; identical to SEQ ID NO: 420713

SEQ ID NO: 533121 - RNA, 65 nt, hsa; identical to SEQ ID NO: 420714

SEQ ID NO: 533122 - RNA, 65 nt, hsa
uuuggaaucaaguaugaaaaucugcacaaaugcaauguuuacaagaacugguugauucugggagg

SEQ ID NO: 533123 - RNA, 65 nt, hsa
caucaucugagaccagccaguagucacagaacugcuguuuacacaguucucaggaggcugugguu

SEQ ID NO: 533124 - RNA, 65 nt, hsa
uuuugaaguauuuaagguucccguugcauuuguuuuguuuacagauaauuaccuacucuggcuag

SEQ ID NO: 533125 - RNA, 65 nt, hsa
acauguuaagaccauaauguaguuauaaauggaaauguuuacaccugaagugaguauuuucaaau

SEQ ID NO: 533126 - RNA, 51 nt, hsa
auuuuuuauuuuaguguuaaauguuuacaaaagacagugaaggauucuuau

SEQ ID NO: 533127 - RNA, 65 nt, hsa
guuaauauuauuguauuaacauuuuaaguauaugguguuuacauucuuauuucuuuugacauuuu

SEQ ID NO: 533128 - RNA, 65 nt, hsa
acagcaaaugaccaagcaugaacuaaagguaaagauguuuacagauuacuuuucuuacaaaaaaa

SEQ ID NO: 533129 - RNA, 65 nt, hsa
gagaagcuguacaaguauaggcagaguuauuuuccuguuuacauuuuuuuuuuguuuuggggaaa

SEQ ID NO: 533130 - RNA, 65 nt, hsa
auaccuggaauaucauguauguuucauuuacuggauguuuacauuuuaggaaggaaaauaguuuu

SEQ ID NO: 533131 - RNA, 65 nt, hsa
aaggagccugcacauuugggugagcagacccaagcuguuuacagcucuuucuuguccugccaucc

SEQ ID NO: 533132 - RNA, 65 nt, hsa
aaucuguccucuguaguauuuuuuaaauaaaucaguguuuacauuagaauucuuggcagauugcu

SEQ ID NO: 533133 - RNA, 65 nt, hsa
cugcccagauccccggcacacacucccccaccugcuguuuacaugacccagggggugcacacuac

SEQ ID NO: 533134 - RNA, 65 nt, hsa
augugacugaggcccaggagggaccugugagggucuguuuacagaggcugggcaggggccgcuug

SEQ ID NO: 533135 - RNA, 65 nt, hsa
acuccagaggccugaggcuccagggcuggcucugguguuuacaagcuggacucagggauccuccu

SEQ ID NO: 533136 - RNA, 65 nt, hsa
uggacugugccaucugugggaaaucccagggcaaauguuuacauuuuguauacccugaagaacuc

SEQ ID NO: 533137 - RNA, 65 nt, hsa
uucuccaaaccuuuuuuguuuuguuuuguuuccgauguuuacacauguugccugagcugguuaac

SEQ ID NO: 533138 - RNA, 65 nt, hsa
uuuuccuagauuuaugcuuuugggauacagaccuauguuuacaauauaauaaauauuauugcuau

SEQ ID NO: 533139 - RNA, 65 nt, hsa
gugggugucccugguagggaagugccuguguggucuguuuacagugcagaaggcggcucagcagu

SEQ ID NO: 533140 - RNA, 65 nt, hsa
gggcaggcccgcacauauccacuugcuggagcccauguuuacagacagggacauacaccaugcag

SEQ ID NO: 533141 - RNA, 65 nt, hsa
ccccagauugcaaugcuaccaauaaagccgccugguguuuacaacuaauugaucacaaccuguua

SEQ ID NO: 533142 - RNA, 65 nt, hsa; identical to SEQ ID NO: 533125

SEQ ID NO: 533143 - RNA, 65 nt, hsa
caaaugaggggagucagcagugaucaugggggaaauguuuacauuuuuuuuuucuucagaaguaa

SEQ ID NO: 533144 - RNA, 65 nt, hsa
aaaauguguagcacagaacugcacuaggauuaauuuguuuacaagaagaaauuuaaacucuacgu

SEQ ID NO: 533145 - RNA, 65 nt, hsa
gagguacuuugggccaguagaguauacuacaguuauguuuacaucugaaaguguaguagggauua

SEQ ID NO: 533146 - RNA, 65 nt, hsa
gcccuaaugggaaaugaaggggagcugggugugaguguuuacacugugcccuucacgggauacuu

SEQ ID NO: 533147 - RNA, 65 nt, hsa
caucacuaaguaauagacccacagcuuuauucuuguguuuacauuacccuugaaauguuuucagu

SEQ ID NO: 533148 - RNA, 65 nt, hsa
acuugcccuuuuuccugggauguaacuaucuuacauguuuacauaagaaauaauaaacuggaggu

SEQ ID NO: 533149 - RNA, 65 nt, hsa
uguaacugcaguauuuuguacaagugucuaaacauuguuuacaagacuaaggcccacuucccugc

SEQ ID NO: 533150 - RNA, 65 nt, hsa
gaaaaauguauccagucugaagauguuuguguaucuguuuacauccagaguucugugacacaugc

SEQ ID NO: 533151 - RNA, 65 nt, hsa
uaguguguaaggccguauuuuuagcaucugacagguguuuacaaaaaagugguugucgcacuggg

SEQ ID NO: 533152 - RNA, 65 nt, hsa
gacaacuucacucuuucauaauauauaggauaaauuguuuacaugauuggacccucagauucugu

SEQ ID NO: 533153 - RNA, 65 nt, hsa
ucuuuguguguuagaguauuuguuuuaguaagaaauguuuacacagcuuguggaauuauuucgug

SEQ ID NO: 533154 - RNA, 65 nt, hsa
uauaaucaagguaucuugaugguuauaugugguauuguuuacacuguuaauauccacauguaagg

SEQ ID NO: 533155 - RNA, 65 nt, hsa
uuuuugugcuuuuaauaguccgagcagucuuaccuuguuuacacauguauugacaccauuugcuu

SEQ ID NO: 533156 - RNA, 65 nt, hsa
auauuuuguacagaaaauaucaaccucuucccuuuuguuuacaagauguuuuguauaagccuaug

SEQ ID NO: 533157 - RNA, 65 nt, hsa
uggccugggucaagaugagggucuuucaguguuccuguuuacaacaugucaaagccauugguuca

SEQ ID NO: 533158 - RNA, 65 nt, hsa
cgggaggagugccaucugggucuuccaucuagaacuguuuacaugaagauaagauacucacuguu

SEQ ID NO: 533159 - RNA, 65 nt, hsa
gcaaacaucuucuggcauauggcuuguuaauguuguguuuacacuaacugccaaaaugugccugu

SEQ ID NO: 533160 - RNA, 65 nt, hsa
acaaaucuauuuagagaaacagcuggcccugcaaauguuuacagaaaugaaauucuuccuacuua

SEQ ID NO: 533161 - RNA, 65 nt, hsa
gaaacuuccaauuaugucuauaauuuauauucuuuuguuuacaugaugaaacuuuuuguuguugc

SEQ ID NO: 533162 - RNA, 65 nt, hsa
gaucuugagcaaguauuggucaugauacaguaauuuguuuacagaauccaaaaauacaauagaga

SEQ ID NO: 533163 - RNA, 65 nt, hsa
uuauucauguguacagaaacaacugccaaauaaaauguuuacauuuucuuucauaucccagaggu

SEQ ID NO: 533164 - RNA, 65 nt, hsa
cuaugggagagugucaaccagacagagggucacaguguuuacacuuuggaccuuacgaucaggca

SEQ ID NO: 533165 - RNA, 65 nt, hsa
cuuauuuugagauuugagauuuaaauuuuauguauuguuuacagucagaguaaaucacuggauuu

SEQ ID NO: 533166 - RNA, 65 nt, hsa
acugccaaagucaggggaggagggcagagacuuuguguuuacaucugcauuucuacauguuuuag

SEQ ID NO: 533167 - RNA, 65 nt, hsa
auucuuuggauuucuggaagguuaugacacuuuacuguuuacagcuaaugcauaguuacuugcau

SEQ ID NO: 533168 - RNA, 65 nt, hsa
auuuucuuuuguuacguaguggaaacauuuugcauuguuuacauaguucucauggaacauggaaa

SEQ ID NO: 533169 - RNA, 65 nt, hsa; identical to SEQ ID NO: 420715

SEQ ID NO: 533170 - RNA, 65 nt, hsa; identical to SEQ ID NO: 420716

SEQ ID NO: 533171 - RNA, 65 nt, hsa
auauguaauaaugacuccauccagcucuaucuuuguguuuacaucauggcaauggaaacacaauu

SEQ ID NO: 533172 - RNA, 65 nt, hsa
gaaugauacccugaauuuggccugcacuaauuugauguuuacagguggacacacaaggugcaaau

SEQ ID NO: 533173 - RNA, 65 nt, hsa
uauggcaaaaugaauccuucaugucuucuuguuauuguuuacacacuugcaguguagcccaguuu

SEQ ID NO: 533174 - RNA, 65 nt, hsa
agugaaguacucaucuugcaggaagcaaaccuccuuguuuacaucuucaggccaagaugacugau

SEQ ID NO: 533175 - RNA, 65 nt, hsa
cauaauuuggucauuuggcagccccuguuuucugcuguuuacaacaucaccagugccacgucaug

SEQ ID NO: 533176 - RNA, 65 nt, hsa
ucagugcugucuugguagcuuggacuuagugggaguguuuacaccauggaaauugacaaacuaua

SEQ ID NO: 533177 - RNA, 65 nt, hsa
aaaauauauuugauguuaaaucaaauagaugauucuguuuacauuguucauaugaauaauaaucu

SEQ ID NO: 533178 - RNA, 65 nt, hsa; identical to SEQ ID NO: 420717

SEQ ID NO: 533179 - RNA, 65 nt, hsa; identical to SEQ ID NO: 420718

SEQ ID NO: 533180 - RNA, 65 nt, hsa; identical to SEQ ID NO: 420719

SEQ ID NO: 533181 - RNA, 65 nt, hsa; identical to SEQ ID NO: 420720

SEQ ID NO: 533182 - RNA, 65 nt, hsa
uaaugauucuugggugcugugggucaccaacaggcuguuuacaaagcagaaaauaucaucaccau

SEQ ID NO: 533183 - RNA, 65 nt, hsa
cuucagccuuucugguuauguuacaccuagcugaauguuuacaaggucuggauccaucagcccuc

SEQ ID NO: 533184 - RNA, 65 nt, hsa; identical to SEQ ID NO: 420721

SEQ ID NO: 533185 - RNA, 65 nt, hsa; identical to SEQ ID NO: 420722

SEQ ID NO: 533186 - RNA, 65 nt, hsa
agcuguguuuuccuaagcugagaucuguugaauaauguuuacauucgucccccggggaaauguau

SEQ ID NO: 533187 - RNA, 65 nt, hsa
gagggagcuugcugccuccugccuugcuacacuaauguuuacagcaccuaagcuuagccuccagg

SEQ ID NO: 533188 - RNA, 65 nt, hsa
ccuccucacugccauuauaguuuauuguguggucauguuuacauugugacauccagccccaagga

SEQ ID NO: 533189 - RNA, 65 nt, hsa
aagugacucuuuacuguaggaaaaauauuacucuguguuuacagauucauugcuguggucaggcc

SEQ ID NO: 533190 - RNA, 65 nt, hsa
uggagggucauaggacuucgcuaaaauucugauacuguuuacaaagaaaaccggauuuucaguag

SEQ ID NO: 533191 - RNA, 65 nt, hsa
uccugcccaucagagaggccugauacaagcaaguuuguuuacaucccuggggaaucuuuuacauc

SEQ ID NO: 533192 - RNA, 65 nt, hsa
ugauuuuauuugacaaaauuuguugaaauuauguauguuuacauaucaccucauggccuauuaua

SEQ ID NO: 533193 - RNA, 65 nt, hsa; identical to SEQ ID NO: 420723

SEQ ID NO: 533194 - RNA, 65 nt, hsa; identical to SEQ ID NO: 420724

SEQ ID NO: 533195 - RNA, 65 nt, hsa
gccuggggguggggggcgggacucucacggugacauguuuacagcugggugugacucaguaaagu

SEQ ID NO: 533196 - RNA, 65 nt, hsa
ggugccccugccgagguggccugcagugcuguacauguuuacagaagcugcugggcuuggcucag

SEQ ID NO: 533197 - RNA, 65 nt, hsa
uagcacacaguaauguuaucuggaagcucuguuuuuguuuacauuucuguaucccuggguugacu

SEQ ID NO: 533198 - RNA, 65 nt, hsa
gccaugugccuacaaaugucaguugugauuuccacuguuuacaagugaguggagcuggagcuggg

SEQ ID NO: 533199 - RNA, 65 nt, hsa
ugcugucugccgaggagcgccaagaagaugucacuuguuuacacacgaacugccacauccccaag

SEQ ID NO: 533200 - RNA, 65 nt, hsa; identical to SEQ ID NO: 420725

SEQ ID NO: 533201 - RNA, 65 nt, hsa; identical to SEQ ID NO: 420726

SEQ ID NO: 533202 - RNA, 65 nt, hsa
gcaaccuuuuucccucuucccagaaaaccagucuguguuuacagacagaagagaaggaagccaua

SEQ ID NO: 533203 - RNA, 65 nt, hsa; identical to SEQ ID NO: 420727

SEQ ID NO: 533204 - RNA, 65 nt, hsa; identical to SEQ ID NO: 420728

SEQ ID NO: 533205 - RNA, 65 nt, hsa
ccuguuaaauuaagucauuggauuuuacucuguucuguuuacaguuuacuauuuaagguuuuaua

SEQ ID NO: 533206 - RNA, 65 nt, hsa
ucuuucuauacauucagucaggcacugggaucaucuguuuacaggcauuauauuuauuuggcacu

SEQ ID NO: 533207 - RNA, 65 nt, hsa
caugccacuugaagauuucucugagaucaugaguuuguuuacacuugucucaagccuaucuauag

SEQ ID NO: 533208 - RNA, 65 nt, hsa
gcacccauggcccccacccacggaaggacuugaguuguuuacaagcccugcacugaggcagauug

SEQ ID NO: 533209 - RNA, 65 nt, hsa
ucucaggccaugagcugcagugacugguagggcuguguuuacagucagggccaccccgucacaua

SEQ ID NO: 533210 - RNA, 65 nt, hsa
ucugccucagugacaaugucccagcgcuccuaucauguuuacagucacccuuggguccuaaauua

SEQ ID NO: 533211 - RNA, 65 nt, hsa
uuaccgcucauugccucucuaauccugccugauuguguuuacagaagcuucugauuugcauugaa

SEQ ID NO: 533212 - RNA, 65 nt, hsa
ugcucaaguacuuaaguagucuggcucaaguacuuuguuuacaauuaaaauggauauuauagcau

SEQ ID NO: 533213 - RNA, 65 nt, hsa
acauggauguugggucucugugcggacggugacaauguuuacaagcaccacauuuacacauccac

SEQ ID NO: 533214 - RNA, 65 nt, hsa
gugcauccacgcacacauggacacagacccacacauguuuacagaacuguuguuuacuuguugcu

SEQ ID NO: 533215 - RNA, 65 nt, hsa
cacuuuacuggcaagagacuuccuuugauuucuacuguuuacaaauaaaacucagccagucucau

SEQ ID NO: 533216 - RNA, 65 nt, hsa
auggaaaagccugcuguuguuccacaucucguugcuguuuacauuccuuuguggagccuacaucu

SEQ ID NO: 533217 - RNA, 65 nt, hsa
caauaaagucucauuggaacacagccaugcucauuuguuuacauguuguuuauggcgacugccau

SEQ ID NO: 533218 - RNA, 65 nt, hsa
cauucuuguugcauugucucugcagauucuauuuuuguuuacaauauuaaaauguauguuagcaa

SEQ ID NO: 533219 - RNA, 65 nt, hsa
auguucuuucuaugcuuuccucaccaucaucacaguguuuacaaacuuuugaaaauauuuagucu

SEQ ID NO: 533220 - RNA, 65 nt, hsa
aggggaauauaugaauuguuuaacaaauuagaauuuguuuacaacuacuugaauuuuuaaauuau

SEQ ID NO: 533221 - RNA, 65 nt, hsa
agacuugcuaaaauauaaaucagccucugcaaaacuguuuacauauuuauugguuuacauauuuu

SEQ ID NO: 533222 - RNA, 65 nt, hsa
accugcccuaccaccaccacgcgcucagccugauguguuuacaugguacuguauguaugggagag

SEQ ID NO: 533223 - RNA, 65 nt, hsa
accugggagcgcagguuggccccugaacuguucuuuguuuacaggacucugcuaacuucucacuu

SEQ ID NO: 533224 - RNA, 65 nt, hsa
auuuugcuuucccagcgggaggggaggaagaagaguguuuacaaaguccuguagcccccucaccu

SEQ ID NO: 533225 - RNA, 65 nt, hsa
uuuugcaugcuuucuuaauaaaaaaaaaaaaagaauguuuacaguuuuaucuuacugguaguggu

SEQ ID NO: 533226 - RNA, 65 nt, hsa; identical to SEQ ID NO: 420729

SEQ ID NO: 533227 - RNA, 65 nt, hsa; identical to SEQ ID NO: 420730

SEQ ID NO: 533228 - RNA, 65 nt, hsa; identical to SEQ ID NO: 420731

SEQ ID NO: 533229 - RNA, 65 nt, hsa; identical to SEQ ID NO: 420732

SEQ ID NO: 533230 - RNA, 65 nt, hsa
uuuaaaggcuuaauuugggaggggggacuuauuucuguuuacaguguauuaccuuccuucccucc

SEQ ID NO: 533231 - RNA, 65 nt, hsa
aauuuuuggguuugacaaccacuuauuuuuuccuuuguuuacaaucuacucaccaggcucauacc

SEQ ID NO: 533232 - RNA, 65 nt, hsa
guauuauacagaucuaaaacucgcaagugaaagauuguuuacaaacuuccugaauauuaucaaug

SEQ ID NO: 533233 - RNA, 65 nt, hsa
gacagacugucacugaucacuuccauuccuguugcuguuuacacagaauggacuuuaaaaaaauu

SEQ ID NO: 533234 - RNA, 65 nt, hsa
acuuuucaaaucucuuauuauauguuuccuuuuuuuguuuacauagggaacaauguuuauagucg

SEQ ID NO: 533235 - RNA, 65 nt, hsa
uggggcugauguguaaagcuguucaaguuauuugauguuuacaccucagggaaagucuuguguuc

SEQ ID NO: 533236 - RNA, 65 nt, hsa
caugguggacuacuagucacugcuuccauaaauauuguuuacagggugagauuugguuuauucau

SEQ ID NO: 533237 - RNA, 65 nt, hsa
cacuagcuaauucucauauccaugccuuuuuguccuguuuacagucuuaaaagagguaaaacagc

SEQ ID NO: 533238 - RNA, 65 nt, hsa
cuaauuccaugucaccaacaacacagacaagacccuguuuacaacuuuuucuuuccuuuuuuuua

SEQ ID NO: 533239 - RNA, 65 nt, hsa
gucauuuauguuauuuaaaugauguacuguacugcuguuuacauggacguuuugugcgggugcuu

SEQ ID NO: 533240 - RNA, 65 nt, hsa
uugugcccagcaacaugcuguaggaauuuaacucuuguuuacauccauuagccucaugguuuugc

SEQ ID NO: 533241 - RNA, 65 nt, hsa
cuuggcuucuucuuuaggauugugaugguucguucuguuuacaucaguuuuaacgagagguaugc

SEQ ID NO: 533242 - RNA, 65 nt, hsa
ugucuuaugaugugugccucucccucccccaaaccuguuuacagucaauuauaaccugacaaacg

SEQ ID NO: 533243 - RNA, 65 nt, hsa
guagguuucaucuauccaccuggcuuucuccuuauuguuuacagauguaguucuuguuagaggau

SEQ ID NO: 533244 - RNA, 65 nt, hsa
cuauaacucgaguuuauaggggaagaaaaagcuauuguuuacaauuauaucaccauuaaggcaac

SEQ ID NO: 533245 - RNA, 65 nt, hsa
cugcuauguguauaggaaagcagucucuguaucaauguuuacauguuacuacuuuuuaaauuuca

SEQ ID NO: 533246 - RNA, 65 nt, hsa
auaaaauauuuuuaugacuacagauuuugcauuuuuguuuacaacuauuuaaagaguuuuauguu

SEQ ID NO: 533247 - RNA, 65 nt, hsa
aaaguucauuauaagggcuuuauucaugccugauuuguuuacaugaggacuucugaaauuaaucc

SEQ ID NO: 533248 - RNA, 65 nt, hsa
gcuuucuuugcccauguaaaugagaacucaacugcuguuuacagugucagauuaacauuugaaag

SEQ ID NO: 533249 - RNA, 65 nt, hsa
uuuaaaauagaauuuagaguauuugggguuuuguuuguuuacaaauaaucagacuauaauauuua

SEQ ID NO: 533250 - RNA, 65 nt, hsa
acugucaucucauucuuguacaacguagaauuacuuguuuacauccaacaaaugguuagcuaggg

SEQ ID NO: 533251 - RNA, 65 nt, hsa
acacuuuccccaggcuccaguggccuggaugucaauguuuacaaaggggcaaggaccucucaugg

SEQ ID NO: 533252 - RNA, 65 nt, hsa; identical to SEQ ID NO: 420733

SEQ ID NO: 533253 - RNA, 65 nt, hsa; identical to SEQ ID NO: 420734

SEQ ID NO: 533254 - RNA, 65 nt, hsa
cuauaugaugaaauguuauuuugccauuaaaauuuuguuuacaaagauaauuuuuauugacauaa

SEQ ID NO: 533255 - RNA, 65 nt, hsa; identical to SEQ ID NO: 420735

SEQ ID NO: 533256 - RNA, 65 nt, hsa; identical to SEQ ID NO: 420736

SEQ ID NO: 533257 - RNA, 65 nt, hsa
accacuuagacugcacuuuucuguuccguuuacucuguuuacacauuuugcacuugggaggaggg

SEQ ID NO: 533258 - RNA, 65 nt, hsa
gggaucccucccccccaugcacugugaaggacccuuguuuacacauacccucuucauggaugggg

SEQ ID NO: 533259 - RNA, 65 nt, hsa
aguacauuuucucccuuaggaauauacauagucuuuguuuacaugaguucaaauacuuuugggau

SEQ ID NO: 533260 - RNA, 65 nt, hsa
gcugagaagauuuuuuuuuaaugacugagaaaacuuguuuacagcuccagcauauaaggaaagug

SEQ ID NO: 533261 - RNA, 65 nt, hsa
auuuggauuauuuauguuuauaaaugauacagaucuguuuacaagguuuguagauacuuuuuuug

SEQ ID NO: 533262 - RNA, 65 nt, hsa
uugucugcccuguuaaacuuggugcccauuaacaguguuuacacuguucaucgugccuguuaaug

SEQ ID NO: 533263 - RNA, 65 nt, hsa
uccagcucugaaauuaauuaggaaagaauauaggauguuuacagugaauaauuuuaaaaccacaa

SEQ ID NO: 533264 - RNA, 65 nt, hsa
acauggaaauuuagggguuucugaaucaagcuuaauguuuacaguuuccaaauagccauuuugca

SEQ ID NO: 533265 - RNA, 65 nt, hsa
uauuuaaaaaaggaaaggagaaaaaucacgacuacuguuuacagacugaaaaauuauugcuuuuu

SEQ ID NO: 533266 - RNA, 65 nt, hsa
ggcagcagugcuuagagcuucugcagggcuucucuuguuuacacagcugcaucagacaaugccau

SEQ ID NO: 533267 - RNA, 65 nt, hsa
acauugggaacauauuucuuaacaagcuaacuguguguuuacauagagagagcugcauauugcau

SEQ ID NO: 533268 - RNA, 65 nt, hsa
cuugagacuuuuuaaucgguucuucaaauauuucauguuuacauuaaaaauuuccagagaagcau

SEQ ID NO: 533269 - RNA, 65 nt, hsa
auaguuguuccagaaaucuucauuuuaaauagaaguguuuacaaugccuuuuuucccccaguauu

SEQ ID NO: 533270 - RNA, 65 nt, hsa
cgucauaggcuucugcacguuggaucaacuaauguuguuuacaauauagaugacauuuuaaaaau

SEQ ID NO: 533271 - RNA, 65 nt, hsa
gugguaagaaugaccugucacuauaauauacuguauguuuacauuuuauuuaaauuuaaucucuu

SEQ ID NO: 533272 - RNA, 65 nt, hsa; identical to SEQ ID NO: 420737

SEQ ID NO: 533273 - RNA, 65 nt, hsa; identical to SEQ ID NO: 420738

SEQ ID NO: 533274 - RNA, 65 nt, hsa
auaagucaugacacaguauucgcucuuuuucugaauguuuacauagagauucaucacugcagauu

SEQ ID NO: 533275 - RNA, 65 nt, hsa
aacucccuucccucugggcagaggcccaucugcucuguuuacacaccuggaccuggugugaaggg

SEQ ID NO: 533276 - RNA, 65 nt, hsa
cagaauuuuuuuuuuuuuuuuuuuuuuuuggcaaauguuuacauucaauuaaggggaaaaaguag

SEQ ID NO: 533277 - RNA, 65 nt, hsa
uacaggcagcguuuggaaaccuuuuauuauauaguuguuuacauacuuauaagucuaucauuuaa

SEQ ID NO: 533278 - RNA, 65 nt, hsa
uuacaucuuuauuuaaauuuuuuuuuaacaucuuauguuuacaggcuuccuguuugaugaagaua

SEQ ID NO: 533279 - RNA, 65 nt, hsa
aaauaacguuuuauuggagcauagcuguacccauuuguuuacauauuggcuauggcugcugucua

SEQ ID NO: 533280 - RNA, 65 nt, hsa
cuguuacuuacuguacuauggaagcuccuggugaauguuuacaauuaugggauguaguauuucua

SEQ ID NO: 533281 - RNA, 65 nt, hsa
aacuaauuuauaacuuguucuauauuguaaauagcuguuuacagguuuuuaaauuuaaauucaga

SEQ ID NO: 533282 - RNA, 65 nt, hsa
ugauugucaggggaaaaacuuacaaaaugcuacaguguuuacaaaugccaguuccaggugauuag

SEQ ID NO: 533283 - RNA, 65 nt, hsa
cuauaaauggcagcucuccuguuguauucagguguuguuuacagacuaacaaauguguuggcaaa

SEQ ID NO: 533284 - RNA, 65 nt, hsa
uguuuguggcuggagguggauuucaugcccugugguguuuacaguguauauaaugguuguguuuu

SEQ ID NO: 533285 - RNA, 65 nt, hsa
gcacaaaauuaugcaaauauuuuaauguuuauuaauguuuacaguggaauugugaauaaguuuuc

SEQ ID NO: 533286 - RNA, 65 nt, hsa
ugcuguuaaguuuguuauuuggguauaaaaccagauguuuacaccuguaaaucuugugcugguua

SEQ ID NO: 533287 - RNA, 65 nt, hsa
uccacagagccugggcugggcccgguggaggcuccuguuuacagcccucucuucuuuguacaguu

SEQ ID NO: 533288 - RNA, 65 nt, hsa
gcgcgggcgcccuuccaaagcacauacucaccgaauguuuacagacuggcuguccuggcagggcu

SEQ ID NO: 533289 - RNA, 65 nt, hsa
ugucaaagagaauuaaaaaaaaaaacuucagauuuuguuuacauauuuuacuacauuuuugcugg

SEQ ID NO: 533290 - RNA, 65 nt, hsa
gucucucacauuauauaguagauguuuguuuauaauguuuacaaaacauuuuggugaauuuccuc

SEQ ID NO: 533291 - RNA, 65 nt, hsa
cuuuauuuccuagagaauuuauuuuauaaauacuuuguuuacauuuuagauuguacuugucuuua

SEQ ID NO: 533292 - RNA, 65 nt, hsa
ugaaauuaccaggcacagauuuagucuugucauuuuguuuacacauuggggaaaacaauucaguu

SEQ ID NO: 533293 - RNA, 65 nt, hsa
ggagaaggggagaaauguacuuggaaauuaauguauguuuacaucucuuugcaaauuccuguaca

SEQ ID NO: 533294 - RNA, 65 nt, hsa
uauccauuucgauugugugacagauugaaauuuauuguuuacauuggggaauguaucucaaauuu

SEQ ID NO: 533295 - RNA, 65 nt, hsa
aggcccugucagcuggaacuggacagaccuugguuuguuuacauguccgaugggggcaggagcuc

SEQ ID NO: 533296 - RNA, 65 nt, hsa
guuguaagcuuggauuuuuaggucuagcaauacacuguuuacaagagcaucaccuaaaaugugac

SEQ ID NO: 533297 - RNA, 65 nt, hsa
ggggccaaggaggccucugucauuuuaaagacucguguuuacaguuuuguauccaaggccgcacu

SEQ ID NO: 533298 - RNA, 65 nt, hsa
ucccuuccccaucccaaccccuucuuucucuagauuguuuacauaugaagggcuuuucucucuca

SEQ ID NO: 533299 - RNA, 65 nt, hsa
uugcgugguuggauuuuuccacuaucuuuuuaguuuguuuacauuuuccugaacccuccugagcg

SEQ ID NO: 533300 - RNA, 65 nt, hsa
ucacuuuuaccuuuaaaguuuacuuguagcaaauauguuuacauugauaaagccagauauguuuu

SEQ ID NO: 533301 - RNA, 65 nt, hsa
uuuuuuuuauuuuauugcuuauaauuuauuaagaauguuuacaccuguauaaggauuucauauau

SEQ ID NO: 533302 - RNA, 65 nt, hsa
uucauaaaguuugauuggaacauaccaugcucauuuguuuacauaucaucugcagcuguuuuuug

SEQ ID NO: 533303 - RNA, 65 nt, hsa
aauugugagcaggguucaucuauuuuaaacacagauguuuacaaaauaaagauuauuucaaacca

SEQ ID NO: 533304 - RNA, 65 nt, hsa
ggaccuaugaauuuguacuuuuugccaucucacccuguuuacaugccauagguguucuggucugg

SEQ ID NO: 533305 - RNA, 65 nt, hsa
aacacccuuaacuuucucuuuacccuuagcugaaauguuuacauagcuucuggugauaucuuuuc

SEQ ID NO: 533306 - RNA, 65 nt, hsa
uucuuagucccuaaucauguuucucccauaggcuguguuuacauggagcuaucgguuuagccuuu

SEQ ID NO: 533307 - RNA, 65 nt, hsa
gcagagaacagaaugugucaaggagaagaaucauuuguuuacaaacugaugagcagaucccagac

SEQ ID NO: 533308 - RNA, 65 nt, hsa
ccaaaucguagcguuuguuaccagagguugugcacuguuuacagaaucuuccuuuuauuccucac

SEQ ID NO: 533309 - RNA, 65 nt, hsa; identical to SEQ ID NO: 420739

SEQ ID NO: 533310 - RNA, 65 nt, hsa; identical to SEQ ID NO: 420740

SEQ ID NO: 533311 - RNA, 65 nt, hsa
uguguugauccugguuucccagaucuguauuucaguguuuacaagggaggaaggaccuuuccuca

SEQ ID NO: 533312 - RNA, 65 nt, hsa
cugcucagccccgcggcuggaccuuccuucugcauuguuuacauugcauccuggaugggacguuu

SEQ ID NO: 533313 - RNA, 65 nt, hsa
uuaggugcccauugcaucuuuuugugcuauggaguuguuuacauuaagcaugaccgaacgagaga

SEQ ID NO: 533314 - RNA, 65 nt, hsa
uguuuguaacugugauuaugauagaggccuaucucuguuuacaugcauagcuuugaguuaggcua

SEQ ID NO: 533315 - RNA, 65 nt, hsa
uggguuauauaccauauguuaaauaugcaauaaaguguuuacaggaugcccuucugaaggguagu

SEQ ID NO: 533316 - RNA, 65 nt, hsa
gaggaaagggaaaggguaggccuguagacuaacgcuguuuacacccuuguucugucaaagcaauu

SEQ ID NO: 533317 - RNA, 65 nt, hsa
ugguucauuuuuguuuguuuuguuuuguuuuguuuuguuuacagaugaggucuuccuguguugcc

SEQ ID NO: 533318 - RNA, 65 nt, hsa
cucucgcccugaguacucuucuugggaguugcugcuguuuacagccacagucucaucuaucacua

SEQ ID NO: 533319 - RNA, 65 nt, hsa
accgcaggcaauuguaacacaguggugaguauuuguguuuacaaacauaggaaagguacaguaaa

SEQ ID NO: 533320 - RNA, 65 nt, hsa; identical to SEQ ID NO: 420741

SEQ ID NO: 533321 - RNA, 65 nt, hsa; identical to SEQ ID NO: 420742

SEQ ID NO: 533322 - RNA, 65 nt, hsa
uuugaaaaucaaggagaaguuuaugcaacuuaaaauguuuacacacuguggugcaaucuacuguu

SEQ ID NO: 533323 - RNA, 65 nt, hsa
accuucccucaucuuucaucaaucauuguacaguuuguuuacacacgugcaauuuguuugugcuu

SEQ ID NO: 533324 - RNA, 65 nt, hsa
ugauagauacacugcaucuuuggucaucuaagauuuguuuacaaaugugcaaauuauuuagagca

SEQ ID NO: 533325 - RNA, 65 nt, hsa
gccauaauuuucagaugaagauguuucccaaacacuguuuacagaaugagaugugacucuacaga

SEQ ID NO: 533326 - RNA, 64 nt, hsa
ucauuaaaucuuuaaaagaaaugaaauaaauuuauuguuuacagauguuuagugaguuuaauca

SEQ ID NO: 533327 - RNA, 65 nt, hsa; identical to SEQ ID NO: 420743

SEQ ID NO: 533328 - RNA, 65 nt, hsa; identical to SEQ ID NO: 420744

SEQ ID NO: 533329 - RNA, 65 nt, hsa
acuugcauaugagagaaauaaaacauuuggcacauuguuuacaggugugaaaacuuuguggguuu

SEQ ID NO: 533330 - RNA, 65 nt, hsa
gcccauagggcugccugguugacucuccuucccauuguuuacagugaaggugucauucacaaaaa

SEQ ID NO: 533331 - RNA, 65 nt, hsa
cauuuaaaaacaaaguguccaagcugucagugguguguuuacaaucucuccuggcagagguuggc

SEQ ID NO: 533332 - RNA, 65 nt, hsa
cugaaauuccagcugguuucucuagcaccuaguguuguuuacaagaaggccacggugcucuuagc

SEQ ID NO: 533333 - RNA, 65 nt, hsa
ccagagguuugcaagccucagacaaauaaaugugguguuuacaauguauaaaagagaagaagcca

SEQ ID NO: 533334 - RNA, 65 nt, hsa
uuugacuugaaaaauuauauuucauauugcaaagauguuuacaaguauuuuaauuuaaguucagu

SEQ ID NO: 533335 - RNA, 65 nt, hsa
aggaaaacuugcagaaaugugauuuuucccagauuuguuuacauguucccugggacagauccagg

SEQ ID NO: 533336 - RNA, 65 nt, hsa
caccugcaggcacguguguaugcacuccccgcuuguguuuacacaagcugugggguguuacgcau

SEQ ID NO: 533337 - RNA, 65 nt, hsa
augguauacuuggauuaaaauauuucauccagauuuguuuacaucuagagagaaccccuuguagg

SEQ ID NO: 533338 - RNA, 65 nt, hsa
aucgucaaaaggaagggauugguuuggcaagaacuuguuuacaacauuuuugcaaaucuaaaguu

SEQ ID NO: 533339 - RNA, 65 nt, hsa
aaucaauuugauaggauuaaucuccagugaagcuguguuuacagggcauuccaagugauucuuau

SEQ ID NO: 533340 - RNA, 65 nt, hsa
ccuagaccaauucuguguggauauuuaagugaacauguuuacaauuuuuguauauaucacucucu

SEQ ID NO: 533341 - RNA, 65 nt, hsa
gagcugaaggucugcgucacggugaaaauucgggauguuuacagagcaucacaaaugccucucuc

SEQ ID NO: 533342 - RNA, 65 nt, hsa; identical to SEQ ID NO: 420745

SEQ ID NO: 533343 - RNA, 65 nt, hsa; identical to SEQ ID NO: 420746

SEQ ID NO: 533344 - RNA, 65 nt, hsa
ugucuguacuucuguuugaacuuuccacguuguccuguuuacaaguuaacuuaaguugggguauc

SEQ ID NO: 533345 - RNA, 65 nt, hsa
cuuaaaugcaucuaacccuuuaacaaauguguacauguuuacaaguaauggaaaugcgucuauaa

SEQ ID NO: 533346 - RNA, 65 nt, hsa
cauuuuguuuuggagguucucacuuugaaccuucuuguuuacagauuuuuuuguuuguuuuuuga

SEQ ID NO: 533347 - RNA, 65 nt, hsa
agccuuuggucuccuggaugggccuuugagccugauguuuacagugucugugugugugugugcau

SEQ ID NO: 533348 - RNA, 65 nt, hsa
aaaaaaacaaaaaaauuuaaaaagauggaauguaguguuuacauuaaagccgccguuuucaugac

SEQ ID NO: 533349 - RNA, 65 nt, hsa
ccuggcuccuguguucccucuauccagccaaugccuguuuacacagacaccuggccucacugcca

SEQ ID NO: 533350 - RNA, 65 nt, hsa
ugaauuugguugguuuugguguuguacagcucacauguuuacacacucagugcccuaauuucccc

SEQ ID NO: 533351 - RNA, 65 nt, hsa
aggcugcauccucuucugucccuggcaccaggcuuuguuuacacuuggagccaccuugguguggg

SEQ ID NO: 533352 - RNA, 65 nt, hsa
uuuaguugaacugugcggaauugugguguugguuuuguuuacacagccagauuuuuccuucuuuu

SEQ ID NO: 533353 - RNA, 65 nt, hsa; identical to SEQ ID NO: 420747

SEQ ID NO: 533354 - RNA, 65 nt, hsa; identical to SEQ ID NO: 420748

SEQ ID NO: 533355 - RNA, 65 nt, hsa
gaacaugaguuauaaguuauuacuuuuccuuuacauguuuacacuuuuauaaaaaucagauuuuu

SEQ ID NO: 533356 - RNA, 65 nt, hsa
agcuccuuggaagaagggauggggggaugagaucauguuuacagaccuguuuugucauccugcug

SEQ ID NO: 533357 - RNA, 65 nt, hsa
ggccuuggcuucugauuauuugcagcugcgauggauguuuacaggaacccagccagaguuugccu

SEQ ID NO: 533358 - RNA, 65 nt, hsa
agccaggaccugaacucgcaccuccuaccucuucauguuuacauauacccaguaucuuugcacaa

SEQ ID NO: 533359 - RNA, 65 nt, hsa; identical to SEQ ID NO: 420749

SEQ ID NO: 533360 - RNA, 65 nt, hsa; identical to SEQ ID NO: 420750

SEQ ID NO: 533361 - RNA, 65 nt, hsa
aaaaaaaaaagauaacuagaacuucuagaacaucuuguuuacaguuagccagaaacuauacaagu

SEQ ID NO: 533362 - RNA, 65 nt, hsa
gggucuucccuugagcuccaggggguggaacccaauguuuacauucucuucugucucugccccca

SEQ ID NO: 533363 - RNA, 65 nt, hsa
ucuccuccuccauccccagacaucaccaggucuaauguuuacaaacggugccagcccggcucuga

SEQ ID NO: 533364 - RNA, 65 nt, hsa
gcccuggagggaggcucuucagugcgguagcuauuuguuuacaugcagauuuuuguaauaaaggc

SEQ ID NO: 533365 - RNA, 65 nt, hsa
ugauguuacgggcuaaaucaagagcagcuuaauccuguuuacaaugugagcuuuuugugcgucug

SEQ ID NO: 533366 - RNA, 65 nt, hsa
uuugcaaugaaauauucauagauauugaaagcuuguguuuacaugaaauauguuuauuaucaaga

SEQ ID NO: 533367 - RNA, 65 nt, hsa
ugugcauccuuugauuacucucaugcugcauuuacuguuuacauuuguuuuauuguacauagguu

SEQ ID NO: 533368 - RNA, 65 nt, hsa
uuuuauuaaaggcaugcagggauuaacaggacuucuguuuacaauggaaaucugaaauggaagaa

SEQ ID NO: 533369 - RNA, 65 nt, hsa
auaauuguuaucuccuuuuggcuuaugugauuuucuguuuacaaguagaauagccaauuauuuaa

SEQ ID NO: 533370 - RNA, 65 nt, hsa
ccacuggcuggaggaaguggggucuggccuguugauguuuacauggcgcccugccuccuggagga

SEQ ID NO: 533371 - RNA, 65 nt, hsa
aguuuuaauggauuauuuuuaaugaaauguuuuauuguuuacaaacgguauguugcuguguaccu

SEQ ID NO: 533372 - RNA, 65 nt, hsa
agccugugccacgauugcaggagucccugccaucauguuuacagaggacaguauuuguggggagg

SEQ ID NO: 533373 - RNA, 65 nt, hsa
gggggccagcggcagcgggucagucuggcucgagcuguuuacagugaugccgauauuuucuugcu

SEQ ID NO: 533374 - RNA, 65 nt, hsa
gugggcagaugaaaaugaugcauggccaaguucaguguuuacagauaaaacugcugugguucaag

SEQ ID NO: 533375 - RNA, 65 nt, hsa
ccuuuuucuuucucuuuuuuuuuuuuguauauuauuguuuacaauaaauauacauugcauuaaaa

SEQ ID NO: 533376 - RNA, 65 nt, hsa
auuuauucucuguauaggcauuaccuacguuccuguguuuacauacacaaguagcaaauucgagu

SEQ ID NO: 533377 - RNA, 65 nt, hsa
gaaucaccuccugccuuggcgaggcggcagcucauuguuuacaggcaagcccugcuccugggagg

SEQ ID NO: 533378 - RNA, 65 nt, hsa
augcauauguaccuguccgucaguguguggauguauguuuacaguucuacauaaaugggaucauu

SEQ ID NO: 533379 - RNA, 65 nt, hsa
augaagauuagaugaaauuggaaauaaaccaacauuguuuacauuccaggagacuuguagcucag

SEQ ID NO: 533380 - RNA, 65 nt, hsa
ccagggucccacccccaacccccagagguggcccuuguuuacagugaggacucggccacuguguc

SEQ ID NO: 533381 - RNA, 65 nt, hsa
cgggggggcgugggucaaaucauagccaagugacuuguuuacaugugagugaaacugcacaaagg

SEQ ID NO: 533382 - RNA, 65 nt, hsa
cacacagugagagucuuaaagauacaaaaugguauuguuuacauuacuagaaaauuauuaguuuu

SEQ ID NO: 533383 - RNA, 65 nt, hsa
cuuugacugauauuguaauuuucaaauguauaauauguuuacagaugugcccugcauuuagucug

SEQ ID NO: 533384 - RNA, 65 nt, hsa
auucuuuggcuuuuuuggacuauuuguggauacuuuguuuacauuuugaauauuaaaaugugcau

SEQ ID NO: 533385 - RNA, 65 nt, hsa
auaaagcaucuaaacuuuaauauguauuuuauguauguuuacacugucaaacaucuggaaaauaa

SEQ ID NO: 533386 - RNA, 65 nt, hsa
acucccagugaugaccaggcuuuaguggaagcccuuguuuacagaagagagggguaaaccuauga

SEQ ID NO: 533387 - RNA, 65 nt, hsa
uuacucacucaauuguuacccuuuugcuguugucguguuuacaguuugcauuuugaaugauuagu

SEQ ID NO: 533388 - RNA, 65 nt, hsa
uuuuaaauuaaauucggguaauauuaaacaguacauguuuacaauaccaaaaaagaaaaaaucca

SEQ ID NO: 533389 - RNA, 65 nt, hsa
cagagaggcagcuuaucaaacucagcccaaaacucuguuuacauggguggggagauggagcaggg

SEQ ID NO: 533390 - RNA, 65 nt, hsa
cuuucucuccuucuaucuccagggccccaccaaucuguuuacauauuuauuauccuaugggggcc

SEQ ID NO: 533391 - RNA, 65 nt, hsa
aucaugaaggacucugaauagacuuggccaacugauguuuacaaaccagacuuuuauauuuuaau

SEQ ID NO: 533392 - RNA, 65 nt, hsa
aagacauuuccgaaccaaaggcugcuggguuugcauguuuacagacucccccuggggcgaggguc

SEQ ID NO: 533393 - RNA, 65 nt, hsa
uaaagacacaugcacacguauguuuauugcagcacuguuuacaauagcaaagacuuggaaccaac

SEQ ID NO: 533394 - RNA, 65 nt, hsa
cucuauuuuuuuguuuguuucuuguuuuuuaauaauguuuacaaucugccucaaucacucugucu

SEQ ID NO: 533395 - RNA, 65 nt, hsa
ggguccagugugcccugcgaugggucccgugucacuguuuacaugaccuauuugugugguuauau

SEQ ID NO: 533396 - RNA, 65 nt, hsa
cugacugacuccugaauuggaagaggaagaacuucuguuuacagaaaacuguauuguuauauaug

SEQ ID NO: 533397 - RNA, 65 nt, hsa
aacucuuuccacaguguucagauuuguccuguguguguuuacaguauucaauuuauugcaguuau

SEQ ID NO: 533398 - RNA, 65 nt, hsa
aaacuuagugauugccacaagaguaggguaccgucuguuuacacguccaguuaggcuacaguucu

SEQ ID NO: 533399 - RNA, 65 nt, hsa
guaacacuuccaaauaugggaggaaaggacagauguguuuacaagggaggauuuuacaacauacu

SEQ ID NO: 533400 - RNA, 65 nt, hsa
gugaaacugcauaguaaugagacugugcacacugauguuuacaagauugaaagagucuuucuccg

SEQ ID NO: 533401 - RNA, 65 nt, hsa
ugcugcccaacuccugugagagaaaaaccaaucaauguuuacaaaauggaaaaggacacagcaug

SEQ ID NO: 533402 - RNA, 65 nt, hsa
uguuuuuguuuuuaccuuggcuuuuguuuuucucauguuuacagugcacggaguguggaaggggg

SEQ ID NO: 533403 - RNA, 65 nt, hsa
aauuaccuaaaauauuguuuaccaaaaagauucuguguuuacauguucuuuucuucuggugauug

SEQ ID NO: 533404 - RNA, 65 nt, hsa
aaauguaguuuucaugacaauuuuauauugauguguguuuacaaugagaaaauggcaugaaaaua

SEQ ID NO: 533405 - RNA, 65 nt, hsa
gugggccaccagagaacccuuauugauuacuuaaguguuuacauuauuuuaaagacuccuguuua

SEQ ID NO: 533406 - RNA, 65 nt, hsa
augauugauguauuuuaucuauaguuauuuagacauguuuacaugcagcagauaauuguucauag

SEQ ID NO: 533407 - RNA, 65 nt, hsa
ugcccuuuucucugagaagagccagcaguccacaguguuuacagagugggacuauauacagucac

SEQ ID NO: 533408 - RNA, 65 nt, hsa
uuuuugcggagacgguauugcuauguugccaagguuguuuacaugccaguacaauuuauaauaaa

SEQ ID NO: 533409 - RNA, 65 nt, hsa
cuagucugcagauugaguugguaggaggugugauuuguuuacaugcaccuuuguuccugcuggua

SEQ ID NO: 533410 - RNA, 65 nt, hsa
auagucugcucuccccgggaaucucuaacaugcucuguuuacaucgauaaaugcacuuaaggaaa

SEQ ID NO: 533411 - RNA, 65 nt, hsa
ggggucccggaagccccuucuggcugcaccugccauguuuacagagggccccugggcugcgcggc

SEQ ID NO: 533412 - RNA, 65 nt, hsa
guuuuuuuucucacaaaguaaauggugggcauccauguuuacauugcaccuucccgugcuguaau

SEQ ID NO: 533413 - RNA, 65 nt, hsa
aucuuuugccgugguucugagcauucaccucaccauguuuacaaagaacuguuuuguauauagac

SEQ ID NO: 533414 - RNA, 65 nt, hsa
aauuuauccauucugcuguugauggacuuuuacauuguuuacagcuuagggucauaauaaaucau

SEQ ID NO: 533415 - RNA, 65 nt, hsa
uggagacccuguuuuuuuaaaaaaagaaguggagguguuuacaccagcaaaauacucauuuuuua

SEQ ID NO: 533416 - RNA, 65 nt, hsa
ggccuuuuguauuuuuauuuuuguucaucugcugcuguuuacauucugggggguuagggggaguc

SEQ ID NO: 533417 - RNA, 65 nt, hsa
aagaagcuauuugcagacuacagaaugggagaaaauguuuacaaacugcaucugacaaagaucua

SEQ ID NO: 533418 - RNA, 65 nt, hsa
acuucgagugaguuuccuaaggccgacugaagcucuguuuacacauaagaguguuccccaaagug

SEQ ID NO: 533419 - RNA, 65 nt, hsa
ccugugagccuuuucauuuuguuaauuuuucccaguguuuacaaccaggaaauagcuugucaucu

SEQ ID NO: 533420 - RNA, 65 nt, hsa
accgugcugucucugccccacauuguccuuauguauguuuacauggaugucuccccagcagcuug

SEQ ID NO: 533421 - RNA, 65 nt, hsa
uacuacacuuuaucuuaauucuuaauuuaaaaacauguuuacaaguuacaaccaacuucuaugaa

SEQ ID NO: 533422 - RNA, 65 nt, hsa
gggugggggggcuuaucuggguggguggggaugccuguuuacacuagcgcugacucccaacggug

SEQ ID NO: 533423 - RNA, 65 nt, hsa
ugccucccccagcccccuccccaucaauaaaacucuguuuacaaccaccggcccccaugacucug

SEQ ID NO: 533424 - RNA, 65 nt, hsa
gcccuggcuuucaggguggucagaacuggauacgguguuuacaauuccaaucucucuauuucugg

SEQ ID NO: 533425 - RNA, 65 nt, hsa
aaaaaaucagggauauaguucauaucccacuucuuuguuuacaccgaugucccugaauaucagcc

SEQ ID NO: 533426 - RNA, 65 nt, hsa
cuguggagaaaaacuauuuugagccaugggguugguguuuacaagaacuuuccacuuuugccaaa

SEQ ID NO: 533427 - RNA, 65 nt, hsa
aaugagauuuuuguagagacugaagcaguuguuucuguuuacauguuguuuauugaggagguguu

SEQ ID NO: 533428 - RNA, 65 nt, hsa
auccauauuaaauuuauauggcuauaaauuucaucuguuuacauccugauuuguauacuauuuua

SEQ ID NO: 533429 - RNA, 65 nt, hsa
aguuuuuuucaugaguuucucauccuggcauguuuuguuuacaauagcuuuugauguuuguauua

SEQ ID NO: 533430 - RNA, 65 nt, hsa
cccuacagggacacuaucacucaugcugguggcauuguuuacagcuagaaagcugcacuggugcu

SEQ ID NO: 533431 - RNA, 65 nt, hsa
caccgucagcggggcgcgcacgcccccaaaccagcuguuuacauacaggaaucagguauuggggc

SEQ ID NO: 533432 - RNA, 65 nt, hsa
agggaguauacuaaauguuuacuuaagaaacacccuguuuacagccagaggagaaacacccaaca

SEQ ID NO: 533433 - RNA, 65 nt, hsa
gacugucucaacugugcaaaaaacaaaagauggaguguuuacaaguagacauucgucaucaguug

SEQ ID NO: 533434 - RNA, 65 nt, hsa
aauuuaguuaugacagugucacuguauccuaguuauguuuacagcacaaauaaauaaugacuguc

SEQ ID NO: 533435 - RNA, 65 nt, hsa
aagaguuuaauuuuugaaaacuggcuacugcucuguguuuacagacgugugcaguuguaggcaug

SEQ ID NO: 533436 - RNA, 65 nt, hsa
uuacucguucuaucugaugagaacucacacuagcuuguuuacaagaugacgacaguccaagggca

SEQ ID NO: 533437 - RNA, 65 nt, hsa
ccugagguguugagggugucacgagcccauucucauguuuacagggguugugggggcagaggggg

SEQ ID NO: 533438 - RNA, 65 nt, hsa
agacggcugcugcccuucucugggcauguucugaauguuuacacugguaccuucugguaucuucu

SEQ ID NO: 533439 - RNA, 65 nt, hsa
uucugggggcccgacaggugggccugggaggaagauguuuacauuuuuaaagguacacugguauu

SEQ ID NO: 533440 - RNA, 65 nt, hsa; identical to SEQ ID NO: 420751

SEQ ID NO: 533441 - RNA, 65 nt, hsa; identical to SEQ ID NO: 420752

SEQ ID NO: 533442 - RNA, 65 nt, hsa
cacacaaaaugucucucuagaguugacuuuaaaguuguuuacagaaauuuaaacucaauuccaga

SEQ ID NO: 533443 - RNA, 65 nt, hsa
guacaacuccacgaggugaaaaauauucaguaacuuguuuacauagcauuuguguaaagacuaug

SEQ ID NO: 533444 - RNA, 65 nt, hsa
aagauaaugaucucauuguuuauuaaccuguauucuguuuacaugucuuuaaaacagugguucuu

SEQ ID NO: 533445 - RNA, 65 nt, hsa
ugguuaaaucaucuuuacaaaaugugugcuuuaacuguuuacaaguaaaaccuaaaguugcagga

SEQ ID NO: 533446 - RNA, 65 nt, hsa
ugaaucagaacuuuuauauaaaacccaaacacugauguuuacacagaauuucauauucugcaaaa

SEQ ID NO: 533447 - RNA, 65 nt, hsa
uucugaaccuugggagagggcugaacucuacgccguguuuacagaauguuugcgcagcuucgcuu

SEQ ID NO: 533448 - RNA, 65 nt, hsa; identical to SEQ ID NO: 420753

SEQ ID NO: 533449 - RNA, 65 nt, hsa; identical to SEQ ID NO: 420754

SEQ ID NO: 533450 - RNA, 65 nt, hsa; identical to SEQ ID NO: 420755

SEQ ID NO: 533451 - RNA, 65 nt, hsa; identical to SEQ ID NO: 420756

SEQ ID NO: 533452 - RNA, 65 nt, hsa
uuaaagaugacccaaugugaaugucuguagucaguuguuuacaaacucccucuccugcacaauuc

SEQ ID NO: 533453 - RNA, 65 nt, hsa
ugacucuacuccuaaaagggaaaaaacaauauccuuguuuacagaagagaaacaaacaagcccca

SEQ ID NO: 533454 - RNA, 65 nt, hsa
gaaaugcaugcaauacuuauaagacuuaaaaauuguguuuacagaugguuuauuugugcauauuu

SEQ ID NO: 533455 - RNA, 65 nt, hsa
aacuugaauuccgucaucaaugcucaccgucaauauguuuacaaguuguagcaguugggggaaaa

SEQ ID NO: 533456 - RNA, 65 nt, hsa
ggaaauauauuuuuccaucuguugcuuauuaauacuguuuacacauugggccuugaucaggagcc

SEQ ID NO: 533457 - RNA, 65 nt, hsa
ucccaguauggggaccauaguaucauucagugcauuguuuacauauucaaaguggugcacuuuga

SEQ ID NO: 533458 - RNA, 65 nt, hsa
gaauguauagaagucucccugcaauuaauuuccaauguuuacauuuuuuaacuagacuguggaau

SEQ ID NO: 533459 - RNA, 65 nt, hsa
ucauaucaucugaaaugguauggcugaaguucauuuguuuacagggucgggaaugucuucaguuc

SEQ ID NO: 533460 - RNA, 65 nt, hsa
uauaggcacauuaccauucauaguaagaauucugguguuuacacaaccaaauuugaugcgaucug

SEQ ID NO: 533461 - RNA, 65 nt, hsa
gguuauuuaaaaacuaacauuugcuauggccaaaguguuuacaauaagcaauaaagugaaagaac

SEQ ID NO: 533462 - RNA, 65 nt, hsa
augaguaaugugaucgcuugguuauccagaaguauuguuuacauuaaacucccuuucauguuaau

SEQ ID NO: 533463 - RNA, 65 nt, hsa
uaauguggccuugaauuuuaacucuguaugcuuaauguuuacaauaugaaguuauuaguucuuag

SEQ ID NO: 533464 - RNA, 65 nt, hsa; identical to SEQ ID NO: 420757

SEQ ID NO: 533465 - RNA, 65 nt, hsa; identical to SEQ ID NO: 420758

SEQ ID NO: 533466 - RNA, 65 nt, hsa
gugucccuggcgcugugcuagcuuuccuuuacagcuguuuacagacaaggcaggccugaggcaga

SEQ ID NO: 533467 - RNA, 65 nt, hsa
ggcucagaaaaaagaugcuaauauauuuaucucauuguuuacauaagcuuuuacaguuucagacc

SEQ ID NO: 533468 - RNA, 65 nt, hsa
agaaggaauguauuuguugcuaaauuucguagcacuguuuacaguuuuccuccauguuauuuaug

SEQ ID NO: 533469 - RNA, 65 nt, hsa
uuuagccuuagggaagggaaaacacuaagugaaacuguuuacaauaaccucauacaaccuucugu

SEQ ID NO: 533470 - RNA, 65 nt, hsa
agugagccucaugguuuucagagaagucauuguucuguuuacauuuucauaaaaccuguuuaaaa

SEQ ID NO: 533471 - RNA, 65 nt, hsa
cucaugcucucagagcagggaacagcgggggaaaauguuuacacuccaugcacaaucugugcuuc

SEQ ID NO: 533472 - RNA, 65 nt, hsa
ugaaggugauuuaagggcccaggucagccacuguuuguuuacaaaaucagguaacuaacugcaua

SEQ ID NO: 533473 - RNA, 65 nt, hsa
gccugccgcccgccacccccaucuccaccccaucauguuuacaggguucggcggcagcguuuguu

SEQ ID NO: 533474 - RNA, 65 nt, hsa
ccucuauauauuuuuaaggcaaugucacuuuguuuuguuuacaaauauauugaauaugucaagau

SEQ ID NO: 533475 - RNA, 65 nt, hsa
uuacccauuuucuuuaaucuucaauauuaauauuguguuuacauugaugagaacaagaguuaaug

SEQ ID NO: 533476 - RNA, 65 nt, hsa
cuguguguacuuugauuuuauaacuuguaaucuuuuguuuacaaugaggggcuuucuguaacuug

SEQ ID NO: 533477 - RNA, 65 nt, hsa
ccgaccacuaggggugggcagggccgccccggccauguuuacagccccggcccucgacaguauug

SEQ ID NO: 533478 - RNA, 65 nt, hsa
ugcuuguuuguugcaggcuguaaggcauggcugcuuguuuacaaagcaucucauucauauuaccu

SEQ ID NO: 533479 - RNA, 65 nt, hsa
caagaaauggccuguggaauguuauuguucaacguuguuuacagcucuuaaaacauggugaggaa

SEQ ID NO: 533480 - RNA, 65 nt, hsa; identical to SEQ ID NO: 420759

SEQ ID NO: 533481 - RNA, 65 nt, hsa; identical to SEQ ID NO: 420760

SEQ ID NO: 533482 - RNA, 65 nt, hsa
ugacugacaagcauaaaaggcuaacuuguggauaguguuuacaaaaguacaaaaguacuacuucc

SEQ ID NO: 533483 - RNA, 65 nt, hsa
ucguauggcuagugagguuucagauuuauuccccauguuuacagauaccgcuaauaaauugcagu

SEQ ID NO: 533484 - RNA, 65 nt, hsa
gaugauccucauauggcccagugucaaguugugcuuguuuacagcacuacucugugccagccaca

SEQ ID NO: 533485 - RNA, 65 nt, hsa
uauauaugaaauuaauuaggcucuaguccaacaguuguuuacauuuuaaauaguccauauugaau

SEQ ID NO: 533486 - RNA, 65 nt, hsa
aagguacaaaaauggcuuuuauacuuaaauauuuuuguuuacauuuccagaauaguggggggaaa

SEQ ID NO: 533487 - RNA, 65 nt, hsa
caauaaugugauccuaaaacuggcuuauccuugaguguuuacaacucaaacaacuuuuugaaugc

SEQ ID NO: 533488 - RNA, 65 nt, hsa
gagucuucuuuuuuacaauaauguaaaaauuaaacuguuuacauuuuuuuaaagcauuguaguuu

SEQ ID NO: 533489 - RNA, 65 nt, hsa
guuguacuaaauaaugaugaccucugcuggauuucuguuuacauccagaaaacaauguuaaggau

SEQ ID NO: 533490 - RNA, 65 nt, hsa
ccuccugguuuucuuuuguuacaaccacccuugccuguuuacauuaauugcaaggagcauaacgu

SEQ ID NO: 533491 - RNA, 65 nt, hsa
agcacuuuuuaugcucccacugugguugagcuuuauguuuacagucucagcaacaacacuuaugc

SEQ ID NO: 533492 - RNA, 65 nt, hsa
aggagggcucagccuugcugagacacuuucuuuuguguuuacaucaugccaggggcuucauucag

SEQ ID NO: 533493 - RNA, 65 nt, hsa
aguuuuuaauguaacaccauuagacacucaccagauguuuacaaguuuucuuuaggggaacuaca

SEQ ID NO: 533494 - RNA, 65 nt, hsa; identical to SEQ ID NO: 420760

SEQ ID NO: 533495 - RNA, 65 nt, hsa
uuuuuuuuccuuccaauuuugugauaaauucaugauguuuacagcacagauaaaacuuugugcca

SEQ ID NO: 533496 - RNA, 65 nt, hsa
auucggggaaggcacuuggugauauaacuuuguuuuguuuacagaguaccugcucgggccaggua

SEQ ID NO: 533497 - RNA, 65 nt, hsa
aauuuugcccauacagucuuccuucuguagagggcuguuuacauauacagcacuuaaaauguuug

SEQ ID NO: 533498 - RNA, 65 nt, hsa
guuggugccaaaauauuuucaguuguacuguagauuguuuacaugugaagugccuguguaauuga

SEQ ID NO: 533499 - RNA, 65 nt, hsa
aucuguuucagaauuguaaaaaguacaucuagauguguuuacagaaagcaaguauccaguaugac

SEQ ID NO: 533500 - RNA, 65 nt, hsa
uguucaucuguuuuugaaguguuaccuuacuauuuuguuuacaagauagucuauuggguugauuc

SEQ ID NO: 533501 - RNA, 65 nt, hsa
guggcuugacagcaucuuccugguuguauguggccuguuuacaugauguauugaauaauguuguu

SEQ ID NO: 533502 - RNA, 65 nt, hsa
auguuaaucugagagcagugucgccauaguuguguuguuuacaauacucuauaaauggguuccug

SEQ ID NO: 533503 - RNA, 65 nt, hsa
ugcauaucuucaucauauugguauauccuuuucuguguuuacagagaugucucuuauaucuaaau

SEQ ID NO: 533504 - RNA, 65 nt, hsa
caccgaggcacccccccgucccccagaaucuuggcuguuuacaaaucacguguccaucgagcacg

SEQ ID NO: 533505 - RNA, 65 nt, hsa
agacaaaauguacuucccuuaacuuucauuaauaguguuuacaucuuuugucagcacagcaaacu

SEQ ID NO: 533506 - RNA, 65 nt, hsa
ugcuggguucuaauaagcccuacuuccaccuaaucuguuuacagucuuuugguauguuucaguua

SEQ ID NO: 533507 - RNA, 65 nt, hsa
gugugacuucugcgagguccagaucacugaauucauguuuacauucucgugcaagcagggaccuc

SEQ ID NO: 533508 - RNA, 64 nt, hsa; identical to SEQ ID NO: 109461

SEQ ID NO: 533509 - RNA, 64 nt, hsa; identical to SEQ ID NO: 109462

SEQ ID NO: 533510 - RNA, 64 nt, hsa; identical to SEQ ID NO: 109463

SEQ ID NO: 533511 - RNA, 64 nt, hsa; identical to SEQ ID NO: 109464

SEQ ID NO: 533512 - RNA, 64 nt, hsa; identical to SEQ ID NO: 109465

SEQ ID NO: 533513 - RNA, 64 nt, hsa; identical to SEQ ID NO: 109466

SEQ ID NO: 533514 - RNA, 64 nt, hsa; identical to SEQ ID NO: 109467

SEQ ID NO: 533515 - RNA, 64 nt, hsa; identical to SEQ ID NO: 109468

SEQ ID NO: 533516 - RNA, 64 nt, hsa; identical to SEQ ID NO: 109469

SEQ ID NO: 533517 - RNA, 64 nt, hsa; identical to SEQ ID NO: 109470

SEQ ID NO: 533518 - RNA, 64 nt, hsa
cggcuaagggcacgaagacgauaucugguagagagggccagagaugcccgcgugguagggcugc

SEQ ID NO: 533519 - RNA, 64 nt, hsa
gaccaggguuucucaaacucguacuugacauuuggggccagauaauucuuuguuguggggcugu

SEQ ID NO: 533520 - RNA, 64 nt, hsa
cucucucugcuccuccauucgcaagugucuuccugggccagacuccccuccaccucauguacuu

SEQ ID NO: 533521 - RNA, 64 nt, hsa
uccccacaaagccguucgcagcuuccgggagaaggggccagagcccgguggggccaguuucuca

SEQ ID NO: 533522 - RNA, 64 nt, hsa
cguggacauagcccugugauacugcaucucacuggggccagaggaagggagggagggugggggg

SEQ ID NO: 533523 - RNA, 64 nt, hsa
ucaaggucuccgccuuguaaaaccacuggacagagggccagaguggguaguggggaaugaaggg

SEQ ID NO: 533524 - RNA, 64 nt, hsa
gggaaggcgccgggcccgggacuguccguucucggggccagagcugcugggggaccgaguuugu

SEQ ID NO: 533525 - RNA, 64 nt, hsa
caggccgaacuccgcacucgcucucccggcagaggggccagaaucgcccggcccagcccuggag

SEQ ID NO: 533526 - RNA, 64 nt, hsa
cugaaaggucccucugacccaggucaccaaauuugggccagaacuggcacuuccgagugcccac

SEQ ID NO: 533527 - RNA, 64 nt, hsa
gcgccggacggcgcagcuggccaagaggcgggcggggccagaaauaccucaugccccugcacca

SEQ ID NO: 533528 - RNA, 64 nt, hsa
agcacgaacugcccgucagagaagugcacagccugggccagauacucccacaggugggugagug

SEQ ID NO: 533529 - RNA, 51 nt, hsa
ggggugccggccagagcugaggggccagagcugguccuuacucccugccau

SEQ ID NO: 533530 - RNA, 64 nt, hsa
uuccacacccuccucgguauccauggagagccuggggccagauaucuggcucaucucuggcauu

SEQ ID NO: 533531 - RNA, 64 nt, hsa
ggggauucaguaguccagaucucuggagcugaaggggccagagagugggcagagugcaucucgg

SEQ ID NO: 533532 - RNA, 64 nt, hsa
aagugucaagugggaggauacugcccccuugugggggccagacgggucggacacggcugugccc

SEQ ID NO: 533533 - RNA, 64 nt, hsa
gagaacagccaguagccuugguaauaugaagggugggccagaagaugauuucacuugcaaaaac

SEQ ID NO: 533534 - RNA, 64 nt, hsa
accccugucagucugcuccccaucccccagccuggggccagaacagccuaccccaggacaggag

SEQ ID NO: 533535 - RNA, 64 nt, hsa
ggggugauuggacaagagggucuggcugggaggugggccagaccuggcagcacugaaugugggc

SEQ ID NO: 533536 - RNA, 64 nt, hsa
uccucauugugccuucaucagagcuggugccuucgggccagaaagacucucguucuuucuagau

SEQ ID NO: 533537 - RNA, 64 nt, hsa
gaugugugugugacguguuuagaaaugcggugaagggccagacggugcugggaaggcaguuguu

SEQ ID NO: 533538 - RNA, 64 nt, hsa
uccccguuacucuuagagaaaggaguuggggugagggccagagcuggcaguggaaacuuguucu

SEQ ID NO: 533539 - RNA, 64 nt, hsa
cguaggaaaaaggaauagcaaucauuaaaaucuugggccagagaacacuauuuuuacauaacag

SEQ ID NO: 533540 - RNA, 64 nt, hsa
gagcccagcuccaaggggaaucagaacucaaauggggccagauccagccuggggucuggaguug

SEQ ID NO: 533541 - RNA, 64 nt, hsa
gaaagauaacuaggaaauccauucacaguucuuugggccagacaugccacaaggacuuccuguc

SEQ ID NO: 533542 - RNA, 64 nt, hsa
aagcuccucuccccagcccagagacauacuugaagggccagagccaggggggugaggagcuggg

SEQ ID NO: 533543 - RNA, 64 nt, hsa
uacacuuuggccuuccuuuccccagcgccccugagggccagaggcagaugugggcugcaggcug

SEQ ID NO: 533544 - RNA, 64 nt, hsa
cuacgccccaugucaucacagggccuucaugacagggccagagccagccagcuuugaagacgcg

SEQ ID NO: 533545 - RNA, 64 nt, hsa
ucauguggccaagcacaucuuugaccacgucaucgggccagaaggcgugcuggcaggcaaggug

SEQ ID NO: 533546 - RNA, 64 nt, hsa
uccagugcucagagggcggggagaaucucagcgugggccagaggcagcucgugugccuggcccg

SEQ ID NO: 533547 - RNA, 64 nt, hsa
cgcucucugcagcguggauuuccuuugcccauuugggccagaaggucaccaggaguucaucacu

SEQ ID NO: 533548 - RNA, 64 nt, hsa
agaauagccagcggagcauggacuguuccagcacgggccagauggccagcugucgagagcagcc

SEQ ID NO: 533549 - RNA, 64 nt, hsa
auaccaggagucacuggagaaaggggcugugcuggggccagacuggcacaaggcacucgugccc

SEQ ID NO: 533550 - RNA, 64 nt, hsa
gcagaggacuccagccuucucggggcccaggccugggccagaagcuguugaccauaccaggagu

SEQ ID NO: 533551 - RNA, 64 nt, hsa
ccggacacccauagacggugcggggggccuggcugggccagaccccaggaaggugggguagacu

SEQ ID NO: 533552 - RNA, 64 nt, hsa
gugccuuugcugccccuuagguugggacuuaggugggccagaggggcuaggaucccaaaggacu

SEQ ID NO: 533553 - RNA, 64 nt, hsa
cauguggaauaaaguaauagaguaacaaguggcagggccagaaccaggguccccaaaguccugg

SEQ ID NO: 533554 - RNA, 64 nt, hsa
gagagagcggaaggagcagcugaugcccagagcggggccagagcggcgggucuauguucacguc

SEQ ID NO: 533555 - RNA, 64 nt, hsa
uggcaauguuuugcuuuugcucgaugcagacagggggccagaacaccacacauuucacugucug

SEQ ID NO: 533556 - RNA, 64 nt, hsa
accgacaagcacagucagguugaagaccuaaccagggccagaaguagcuuugcacuuuucuaaa

SEQ ID NO: 533557 - RNA, 64 nt, hsa; identical to SEQ ID NO: 97587

SEQ ID NO: 533558 - RNA, 64 nt, hsa; identical to SEQ ID NO: 97588

SEQ ID NO: 533559 - RNA, 64 nt, hsa; identical to SEQ ID NO: 97589

SEQ ID NO: 533560 - RNA, 64 nt, hsa; identical to SEQ ID NO: 97590

SEQ ID NO: 533561 - RNA, 64 nt, hsa; identical to SEQ ID NO: 97591

SEQ ID NO: 533562 - RNA, 64 nt, hsa; identical to SEQ ID NO: 97592

SEQ ID NO: 533563 - RNA, 64 nt, hsa; identical to SEQ ID NO: 97593

SEQ ID NO: 533564 - RNA, 61 nt, hsa; identical to SEQ ID NO: 97594

SEQ ID NO: 533565 - RNA, 64 nt, hsa; identical to SEQ ID NO: 97595

SEQ ID NO: 533566 - RNA, 64 nt, hsa; identical to SEQ ID NO: 97596

SEQ ID NO: 533567 - RNA, 64 nt, hsa; identical to SEQ ID NO: 97597

SEQ ID NO: 533568 - RNA, 64 nt, hsa; identical to SEQ ID NO: 97598

SEQ ID NO: 533569 - RNA, 64 nt, hsa; identical to SEQ ID NO: 97599

SEQ ID NO: 533570 - RNA, 64 nt, hsa; identical to SEQ ID NO: 97600

SEQ ID NO: 533571 - RNA, 64 nt, hsa; identical to SEQ ID NO: 97601

SEQ ID NO: 533572 - RNA, 64 nt, hsa; identical to SEQ ID NO: 97602

SEQ ID NO: 533573 - RNA, 64 nt, hsa; identical to SEQ ID NO: 97603

SEQ ID NO: 533574 - RNA, 64 nt, hsa; identical to SEQ ID NO: 97604

SEQ ID NO: 533575 - RNA, 64 nt, hsa; identical to SEQ ID NO: 97605

SEQ ID NO: 533576 - RNA, 64 nt, hsa; identical to SEQ ID NO: 97606

SEQ ID NO: 533577 - RNA, 64 nt, hsa; identical to SEQ ID NO: 97607

SEQ ID NO: 533578 - RNA, 64 nt, hsa; identical to SEQ ID NO: 97608

SEQ ID NO: 533579 - RNA, 64 nt, hsa; identical to SEQ ID NO: 97609

SEQ ID NO: 533580 - RNA, 64 nt, hsa; identical to SEQ ID NO: 97610

SEQ ID NO: 533581 - RNA, 64 nt, hsa; identical to SEQ ID NO: 97611

SEQ ID NO: 533582 - RNA, 64 nt, hsa; identical to SEQ ID NO: 97612

SEQ ID NO: 533583 - RNA, 64 nt, hsa; identical to SEQ ID NO: 97613

SEQ ID NO: 533584 - RNA, 64 nt, hsa; identical to SEQ ID NO: 97614

SEQ ID NO: 533585 - RNA, 64 nt, hsa; identical to SEQ ID NO: 97615

SEQ ID NO: 533586 - RNA, 64 nt, hsa; identical to SEQ ID NO: 97616

SEQ ID NO: 533587 - RNA, 64 nt, hsa; identical to SEQ ID NO: 97617

SEQ ID NO: 533588 - RNA, 64 nt, hsa; identical to SEQ ID NO: 97618

SEQ ID NO: 533589 - RNA, 64 nt, hsa; identical to SEQ ID NO: 97619

SEQ ID NO: 533590 - RNA, 64 nt, hsa; identical to SEQ ID NO: 97620

SEQ ID NO: 533591 - RNA, 64 nt, hsa; identical to SEQ ID NO: 97621

SEQ ID NO: 533592 - RNA, 64 nt, hsa; identical to SEQ ID NO: 97622

SEQ ID NO: 533593 - RNA, 64 nt, hsa; identical to SEQ ID NO: 97623

SEQ ID NO: 533594 - RNA, 64 nt, hsa; identical to SEQ ID NO: 97624

SEQ ID NO: 533595 - RNA, 64 nt, hsa; identical to SEQ ID NO: 97625

SEQ ID NO: 533596 - RNA, 64 nt, hsa; identical to SEQ ID NO: 97626

SEQ ID NO: 533597 - RNA, 64 nt, hsa; identical to SEQ ID NO: 97627

SEQ ID NO: 533598 - RNA, 64 nt, hsa; identical to SEQ ID NO: 97628

SEQ ID NO: 533599 - RNA, 64 nt, hsa; identical to SEQ ID NO: 97629

SEQ ID NO: 533600 - RNA, 64 nt, hsa; identical to SEQ ID NO: 97630

SEQ ID NO: 533601 - RNA, 64 nt, hsa; identical to SEQ ID NO: 97631

SEQ ID NO: 533602 - RNA, 64 nt, hsa; identical to SEQ ID NO: 97632

SEQ ID NO: 533603 - RNA, 64 nt, hsa; identical to SEQ ID NO: 97633

SEQ ID NO: 533604 - RNA, 64 nt, hsa; identical to SEQ ID NO: 97634

SEQ ID NO: 533605 - RNA, 64 nt, hsa; identical to SEQ ID NO: 97635

SEQ ID NO: 533606 - RNA, 64 nt, hsa; identical to SEQ ID NO: 97636

SEQ ID NO: 533607 - RNA, 64 nt, hsa; identical to SEQ ID NO: 97637

SEQ ID NO: 533608 - RNA, 64 nt, hsa; identical to SEQ ID NO: 97638

SEQ ID NO: 533609 - RNA, 64 nt, hsa; identical to SEQ ID NO: 97639

SEQ ID NO: 533610 - RNA, 64 nt, hsa; identical to SEQ ID NO: 97640

SEQ ID NO: 533611 - RNA, 64 nt, hsa; identical to SEQ ID NO: 97641

SEQ ID NO: 533612 - RNA, 64 nt, hsa; identical to SEQ ID NO: 97642

SEQ ID NO: 533613 - RNA, 64 nt, hsa; identical to SEQ ID NO: 97643

SEQ ID NO: 533614 - RNA, 64 nt, hsa; identical to SEQ ID NO: 97644

SEQ ID NO: 533615 - RNA, 64 nt, hsa; identical to SEQ ID NO: 97645

SEQ ID NO: 533616 - RNA, 64 nt, hsa; identical to SEQ ID NO: 97646

SEQ ID NO: 533617 - RNA, 64 nt, hsa; identical to SEQ ID NO: 97647

SEQ ID NO: 533618 - RNA, 64 nt, hsa; identical to SEQ ID NO: 97648

SEQ ID NO: 533619 - RNA, 64 nt, hsa; identical to SEQ ID NO: 97649

SEQ ID NO: 533620 - RNA, 64 nt, hsa; identical to SEQ ID NO: 97650

SEQ ID NO: 533621 - RNA, 64 nt, hsa; identical to SEQ ID NO: 97651

SEQ ID NO: 533622 - RNA, 64 nt, hsa; identical to SEQ ID NO: 97652

SEQ ID NO: 533623 - RNA, 64 nt, hsa; identical to SEQ ID NO: 97653

SEQ ID NO: 533624 - RNA, 64 nt, hsa; identical to SEQ ID NO: 97654

SEQ ID NO: 533625 - RNA, 64 nt, hsa; identical to SEQ ID NO: 97655

SEQ ID NO: 533626 - RNA, 64 nt, hsa; identical to SEQ ID NO: 97656

SEQ ID NO: 533627 - RNA, 64 nt, hsa; identical to SEQ ID NO: 97657

SEQ ID NO: 533628 - RNA, 64 nt, hsa; identical to SEQ ID NO: 97658

SEQ ID NO: 533629 - RNA, 64 nt, hsa; identical to SEQ ID NO: 97659

SEQ ID NO: 533630 - RNA, 58 nt, hsa; identical to SEQ ID NO: 97660

SEQ ID NO: 533631 - RNA, 64 nt, hsa; identical to SEQ ID NO: 97661

SEQ ID NO: 533632 - RNA, 64 nt, hsa; identical to SEQ ID NO: 97662

SEQ ID NO: 533633 - RNA, 64 nt, hsa; identical to SEQ ID NO: 97663

SEQ ID NO: 533634 - RNA, 64 nt, hsa; identical to SEQ ID NO: 97664

SEQ ID NO: 533635 - RNA, 64 nt, hsa; identical to SEQ ID NO: 97665

SEQ ID NO: 533636 - RNA, 64 nt, hsa; identical to SEQ ID NO: 97666

SEQ ID NO: 533637 - RNA, 64 nt, hsa; identical to SEQ ID NO: 97667

SEQ ID NO: 533638 - RNA, 64 nt, hsa; identical to SEQ ID NO: 97668

SEQ ID NO: 533639 - RNA, 64 nt, hsa; identical to SEQ ID NO: 97669

SEQ ID NO: 533640 - RNA, 64 nt, hsa; identical to SEQ ID NO: 97670

SEQ ID NO: 533641 - RNA, 64 nt, hsa
uuuaucuuaguguuuuuaaacuugguuuugguuacuugaggaguuuuuuaauaauauugugugc

SEQ ID NO: 533642 - RNA, 64 nt, hsa
cuuuucccaccucuugauaucugugauacugaaacuugaggauguugaaauguauuacauuuug

SEQ ID NO: 533643 - RNA, 64 nt, hsa
caacugaauacccagaguaguggaaauuuuaggacuugaggacgugaacaacuugaaagagaaa

SEQ ID NO: 533644 - RNA, 64 nt, hsa
gacgugaacaacuugaaagagaaaauugauuccccuugaggaaagaauggcucaacguggauuu

SEQ ID NO: 533645 - RNA, 64 nt, hsa
aauacaagucacuaaucauacucugaugccugaacuugaggaggaaaauacauguauauuuuug

SEQ ID NO: 533646 - RNA, 64 nt, hsa
uguuucucaaaaucuccauagaucgccugcaucacuugaggagcuggugaaaaggcagauucuu

SEQ ID NO: 533647 - RNA, 64 nt, hsa
agugagaacgugcagggccugccuagcuugcgugcuugaggaagguggcauuccgugcuugccu

SEQ ID NO: 533648 - RNA, 64 nt, hsa
gugcuugaggaagguggcauuccgugcuugccuccuugaggaggguggcauucugugucuucug

SEQ ID NO: 533649 - RNA, 64 nt, hsa
cuccacucugacuggcacagucuuugcauggagacuugaggagggagggcuugagguuggugag

SEQ ID NO: 533650 - RNA, 64 nt, hsa
ccaucacgcggccgagacauggcuugccacagcucuugaggaugucaccaauuaaccagaaauc

SEQ ID NO: 533651 - RNA, 64 nt, hsa
acauguucuugcagcagcucugguggcagcuguccuugaggaaccuuugguguguggugggaag

SEQ ID NO: 533652 - RNA, 64 nt, hsa
aucuucuaaaaagaaauaauauuuuagucuucugcuugaggaacugacugugaagcgacgccca

SEQ ID NO: 533653 - RNA, 62 nt, hsa; identical to SEQ ID NO: 172166

SEQ ID NO: 533654 - RNA, 62 nt, hsa; identical to SEQ ID NO: 172167

SEQ ID NO: 533655 - RNA, 62 nt, hsa; identical to SEQ ID NO: 172168

SEQ ID NO: 533656 - RNA, 62 nt, hsa; identical to SEQ ID NO: 172169

SEQ ID NO: 533657 - RNA, 62 nt, hsa; identical to SEQ ID NO: 172170

SEQ ID NO: 533658 - RNA, 62 nt, hsa; identical to SEQ ID NO: 172171

SEQ ID NO: 533659 - RNA, 62 nt, hsa; identical to SEQ ID NO: 172172

SEQ ID NO: 533660 - RNA, 62 nt, hsa; identical to SEQ ID NO: 172173

SEQ ID NO: 533661 - RNA, 62 nt, hsa; identical to SEQ ID NO: 172174

SEQ ID NO: 533662 - RNA, 62 nt, hsa; identical to SEQ ID NO: 172175

SEQ ID NO: 533663 - RNA, 62 nt, hsa; identical to SEQ ID NO: 172176

SEQ ID NO: 533664 - RNA, 62 nt, hsa; identical to SEQ ID NO: 172177

SEQ ID NO: 533665 - RNA, 62 nt, hsa; identical to SEQ ID NO: 172178

SEQ ID NO: 533666 - RNA, 62 nt, hsa; identical to SEQ ID NO: 172179

SEQ ID NO: 533667 - RNA, 62 nt, hsa; identical to SEQ ID NO: 172180

SEQ ID NO: 533668 - RNA, 62 nt, hsa; identical to SEQ ID NO: 172181

SEQ ID NO: 533669 - RNA, 62 nt, hsa; identical to SEQ ID NO: 172182

SEQ ID NO: 533670 - RNA, 62 nt, hsa; identical to SEQ ID NO: 172183

SEQ ID NO: 533671 - RNA, 64 nt, hsa
ccuggguaacuagggaagauaauauuaaggaagacaaugugaaaagaaaaaugagccuggcaag

SEQ ID NO: 533672 - RNA, 64 nt, hsa
ucacuugaguccagaaguuugagaucagccugggcaaugugauaaaaccccaucucuacaaaaa

SEQ ID NO: 533673 - RNA, 64 nt, hsa
uaguauuucaaagaagcaauuauguaaaguuguucaaugugacauaauaguauuauaauugguu

SEQ ID NO: 533674 - RNA, 64 nt, hsa
auacagaauugaaaaagauaaacacucaaccaaacaaugugaaaacggguucuguaguauuugu

SEQ ID NO: 533675 - RNA, 64 nt, hsa
cccccaagcguuuuauauuuauguauuuuguauucaaugugaggcuuauuaaaaauagugauuc

SEQ ID NO: 533676 - RNA, 64 nt, hsa
cagauauuuguggauuacaauccucauuuacuuccaaugugacuaaaaagagaaaaaaaaucac

SEQ ID NO: 533677 - RNA, 64 nt, hsa
aacuuuaaugaaagguggaaaauaauuuaacuuacaaugugaaaauacaaugugaaauguacaa

SEQ ID NO: 533678 - RNA, 64 nt, hsa
gguggaaaauaauuuaacuuacaaugugaaaauacaaugugaaauguacaauaaaucauauuua

SEQ ID NO: 533679 - RNA, 64 nt, hsa
auaauuugccagacagagaucagaauugaaccgucaaugugaaauaaagaguucuccuuguacu

SEQ ID NO: 533680 - RNA, 64 nt, hsa
guuauguaaacaucauaaauaguaaauaaugauucaaugugaauuuuaaaaugcaaauauugcu

SEQ ID NO: 533681 - RNA, 64 nt, hsa
uucugaaaauuaaagaccauuauugcuaccaaaucaaugugacuauuucauaugcauuuugccu

SEQ ID NO: 533682 - RNA, 64 nt, hsa
aaaauuuuagccuuaucuuaaucugucccaacagcaaugugacggauuuuugcagauucaaaau

SEQ ID NO: 533683 - RNA, 64 nt, hsa
ccuaaaggggucucacuuuaccaauuguuacuuucaaugugaggaaugaaugauaaauuaagag

SEQ ID NO: 533684 - RNA, 64 nt, hsa
uugauaagcauaggagguucuguuauuaaagaaacaaugugaaauaauguggaaauuaauacug

SEQ ID NO: 533685 - RNA, 64 nt, hsa
cuuucuggcaaacguuucucaaaucugcuucauccaaugugaaguucaucuugcagcauuuacu

SEQ ID NO: 533686 - RNA, 64 nt, hsa
ugacauucggggugauccuguucugcgcuguguacaaugugagaucggugcguucuccugaugu

SEQ ID NO: 533687 - RNA, 64 nt, hsa
uagacuaagugaaaaucugagaaagaguuaauugcaaugugauaguggguagaaaggagagaaa

SEQ ID NO: 533688 - RNA, 64 nt, hsa
uuauaauaauuauaaaugguauaaaugcauucuacaaugugauuauuuucuguauuuuaguaua

SEQ ID NO: 533689 - RNA, 64 nt, hsa
gugaggagucuggguccauccuggucagcugccccaaugugaccuggggcagauaaaaugccag

SEQ ID NO: 533690 - RNA, 64 nt, hsa
cggcgccuuuuuggccugugauguuuuauccuuacaaugugaauaauggcacugaccggugcuu

SEQ ID NO: 533691 - RNA, 64 nt, hsa
gauuccaaucccgauccaaaucauaauuuguucuuaaguauacugggcagguccccuauuuuaa

SEQ ID NO: 533692 - RNA, 64 nt, hsa
uauuucucacagaugugcagugcacaugcaggccuaaguauauguuguguguguuguuugucuu

SEQ ID NO: 533693 - RNA, 64 nt, hsa
uucuaauagaaagaugugcuacacuguauuguaauaaguauacucuguuauagucaacaaaguu

SEQ ID NO: 533694 - RNA, 64 nt, hsa
acaguaguuaaauaggaaauaaacuaguuccauauaaguauacaccuagaguuuuaauuaccuu

SEQ ID NO: 533695 - RNA, 64 nt, hsa
cucuuuauauaaauacccauuugcuaaaaauaaauaaguauaauaucuguuguaaaaucagacu

SEQ ID NO: 533696 - RNA, 64 nt, hsa
auauacggcacuucacugggcuugcuacaaugguuaaguauacaaacacaaaugcauaucauug

SEQ ID NO: 533697 - RNA, 64 nt, hsa
uacaccacauuauccagucaucuggauauguauauaaguauauacaccacauuuucuuuaucca

SEQ ID NO: 533698 - RNA, 64 nt, hsa
uguguguaugcauauauguguauguguauguauauaaguauauacaccacauuauccagucauc

SEQ ID NO: 533699 - RNA, 64 nt, hsa
uuaaguaauauaugaaguguaaauacucgauauauaaguauagauuuuaaagauaugggacuuu

SEQ ID NO: 533700 - RNA, 64 nt, hsa
uuauaugaauauuauuauuuaaguuaaguuauuuuaaguauaugcauuuuuucugauuguugug

SEQ ID NO: 533701 - RNA, 64 nt, hsa
gaaaaaucacagaagagagaaugcaaauggccacuaaguauaugaaaaaagucguaucuuaaca

SEQ ID NO: 533702 - RNA, 64 nt, hsa
uugaaaaaaaaacacuaaaaaugaagaaaugcuauaaguauaaacuaugauuuuauuuauaaau

SEQ ID NO: 533703 - RNA, 64 nt, hsa
uugcgggugcuucaggacuuuuugcuucuauauuuaaguauauuguuuuuauagcaagaacaua

SEQ ID NO: 533704 - RNA, 64 nt, hsa
ggcaacuucgcauauuuucauugacaccaguguauaaguauaaauuuaaaugaacuaauuacuu

SEQ ID NO: 533705 - RNA, 64 nt, hsa
uugugguucauguauauuuugaccagaguauauuuaaguauauaauuucagcuuccuugauuua

SEQ ID NO: 533706 - RNA, 64 nt, hsa
guuuuuugccagaaauguacuguauacauaguuuuaaguauaacagauuuuacugauauguaaa

SEQ ID NO: 533707 - RNA, 64 nt, hsa
ggacauuuagauacauaauaaaauucgagcuacauaaguauauggaaaauaauguaccuugauu

SEQ ID NO: 533708 - RNA, 64 nt, hsa
uuauuucaacacauucuaagaagccuugacaaaguaaguauauuuuagagcugaaucaguaaga

SEQ ID NO: 533709 - RNA, 64 nt, hsa
gaaguuacuuauuucuagucuuguacuucuggcuuaaguauaaccauguaagaauuauaaauuu

SEQ ID NO: 533710 - RNA, 64 nt, hsa
ugaaaauggauauagauacagguuuuaaguauuuuaaguauauauuacuuauuuuaauuuucug

SEQ ID NO: 533711 - RNA, 64 nt, hsa
aggcacauuugugguaauuuauaugucuauagaguaaguauaagagauaauucauuaguaauag

SEQ ID NO: 533712 - RNA, 64 nt, hsa
uccuuaagauccuaaacaaaucaucuuugucaguuaaguauaguugcgcaaaaauuguuaaauc

SEQ ID NO: 533713 - RNA, 64 nt, hsa
ucauaggauuugagaaucuuaacacauguauaaauaaguauauauaaacuccaauuuuaaaucu

SEQ ID NO: 533714 - RNA, 64 nt, hsa
uuucauauaauuuuauuuauuaagaauuccaaucuaaguauaaagguacaagguagugagaagg

SEQ ID NO: 533715 - RNA, 64 nt, hsa
caguucuauuugcuaucugaacuaauucauuuauuaaguauauuuguaaaagcuaaggcucgag

SEQ ID NO: 533716 - RNA, 64 nt, hsa
aucucaaauacaguaguauaauguaugaauuuuguaaguauaagaaauuuuauuagacauucuc

SEQ ID NO: 533717 - RNA, 64 nt, hsa
uuucugcuuuuacagcagcuucucucccacaccacaacuuuauuaagguauaguggauaauuua

SEQ ID NO: 533718 - RNA, 64 nt, hsa
uccccaacuuguaaugauucaauuuaggguuuuucaacuuuacugucgguuuauugggguauua

SEQ ID NO: 533719 - RNA, 64 nt, hsa
uaaguuaugcuacaucuugacccacuagaauuagcaacuuuauuauagauuuaaacuuucuuca

SEQ ID NO: 533720 - RNA, 64 nt, hsa
cuuuacaguugacaggaaccuggaccccuuaccccaacuuuaugaguaaugcuuggaauaaaaa

SEQ ID NO: 533721 - RNA, 64 nt, hsa
uugaaagcuuuaaaggagauucuucucccacccccaacuuuauuugcaaugggauuuuuccuag

SEQ ID NO: 533722 - RNA, 64 nt, hsa
ccuuuaaguaugcuccucaauguguaaacaggaacaacuuuaugauuugaaagcuuuaaaggag

SEQ ID NO: 533723 - RNA, 64 nt, hsa
ccaagcaaaggggcugaaaaacugaauaaggaaacaacuuuauaagagaaacaguggucuucaa

SEQ ID NO: 533724 - RNA, 64 nt, hsa
cagcauaaugacuguguguucugagaaaugcaaacaacuuuaugaaaguguggucaucuugacc

SEQ ID NO: 533725 - RNA, 64 nt, hsa
ucaacuuuaaauguucacuaugucauuuaguguccaacuuuacggauagguugacuaucuaaau

SEQ ID NO: 533726 - RNA, 64 nt, hsa
aguuuuaggaaaauauuugguagacaaagaguuucaacuuuaaauguucacuaugucauuuagu

SEQ ID NO: 533727 - RNA, 64 nt, hsa
guggcaaagacaccagcucaacuuuagugcuucccaacuuuauuuagaaugacauggggugggu

SEQ ID NO: 533728 - RNA, 64 nt, hsa
gagucuggggacauccguggcaaagacaccagcucaacuuuagugcuucccaacuuuauuuaga

SEQ ID NO: 533729 - RNA, 64 nt, hsa
uuaaaacuagaaaccauuguucuaacaaagcaggcaacuuuauucuauaaacacaacuuuauua

SEQ ID NO: 533730 - RNA, 64 nt, hsa
uucuaacaaagcaggcaacuuuauucuauaaacacaacuuuauuaagcagaauacacuguagau

SEQ ID NO: 533731 - RNA, 64 nt, hsa
acugaaaaauggcucuucuugggucuugagcuugcuggcauauggacugaaagaaacuaugcua

SEQ ID NO: 533732 - RNA, 64 nt, hsa
gaaugaaugaggaagaaaacuguggguaaucaaacuggcauaaaauccagugcacucccuagga

SEQ ID NO: 533733 - RNA, 64 nt, hsa
aucugugucaaguucaaugugagcccuggcaaggcuggcauauuaacaccugccuucuggcuuc

SEQ ID NO: 533734 - RNA, 64 nt, hsa
guuugucacaugugaugaagacaaauauguauaccuggcauagagaaaaauauauaccugguac

SEQ ID NO: 533735 - RNA, 64 nt, hsa
gaguccucacuccuggccuuggauaccauggguccuggcauagagcagcucacucccagggauu

SEQ ID NO: 533736 - RNA, 64 nt, hsa
cuuaucccccucaucucuggggcccccuguggaucuggcauacccaaguucaguaaaugucuau

SEQ ID NO: 533737 - RNA, 64 nt, hsa
gagugggucucuguggcuuucacugauguucacucuggcauacuuucgcaauuuucuuuuucaa

SEQ ID NO: 533738 - RNA, 64 nt, hsa
guguucaucaggugccuauggauuaaaucacauacuggcauauuuaagcugaaugucaaucugg

SEQ ID NO: 533739 - RNA, 64 nt, hsa
agaggaauguuaaauaucuaacaguuuagaaucuuaugcuuacaguguuaucugugaaugcaca

SEQ ID NO: 533740 - RNA, 64 nt, hsa
aguugaaauguccccuuaacuugauauaauguguuaugcuuauggcgcuguggacaaucugauu

SEQ ID NO: 533741 - RNA, 64 nt, hsa
uugacauuuauuuauucuuuuauuuccauuugguuaugcuuauuuuuguuugaaauuuguuuuu

SEQ ID NO: 533742 - RNA, 64 nt, hsa
cacuugagggugauauguuuuaaaggaaagagguuaugcuuaucuucuuagcaguugauaaaau

SEQ ID NO: 533743 - RNA, 64 nt, hsa
uguauucugugcuuauuuuuuuugcucacgcauguaugcuuaguauaaaugugucacuucuaaa

SEQ ID NO: 533744 - RNA, 64 nt, hsa
aaguauugauaguaugucuuccagaauuucacaauaugcuuacaguaaauauuuccuagcuugu

SEQ ID NO: 533745 - RNA, 64 nt, hsa
acuuuccuuuuauuaauugucaauuuagagaaacuaugcuuaagcuggucuuuugcauugcuaa

SEQ ID NO: 533746 - RNA, 64 nt, hsa
auuuauaauugaugucaauauuaguaguccacuuuaugcuuaaaauaaaaucauaaaaaaucaa

SEQ ID NO: 533747 - RNA, 64 nt, hsa
auuuauuacuaaccuucuggcuuccuucucucaauaugcuuacaaagucuccagucaccuacaa

SEQ ID NO: 533748 - RNA, 64 nt, hsa
cugugucugaagugguuguuuugucaugaauucuuaugcuuauaauauccuuuguggcaccuuu

SEQ ID NO: 533749 - RNA, 64 nt, hsa
uuauggaguuugugggaaauagggcaagaauucuuaugcuuaugagagccaaguagucagugga

SEQ ID NO: 533750 - RNA, 64 nt, hsa
ggaaacagcuuguuguaccgaaucaacuggagucuaugcuuaaaaaaaaaaaauuuuuuuuuaa

SEQ ID NO: 533751 - RNA, 64 nt, hsa
uuuuaucuuaguaguaugcuuauggauuuaguaguaugcuuauggauuugauaaaucuuauacu

SEQ ID NO: 533752 - RNA, 64 nt, hsa
caucuuuuacucugacuugcuuuuaucuuaguaguaugcuuauggauuuaguaguaugcuuaug

SEQ ID NO: 533753 - RNA, 64 nt, hsa
ugguauuugugcaaaagagaugaagacuucucaauaugcuuauuuugcuuugcauaauuggcuc

SEQ ID NO: 533754 - RNA, 64 nt, hsa
agguaauauuuguacuuuaacauguugcauaauauaugcuuauguagcuuuccaggacuaacag

SEQ ID NO: 533755 - RNA, 64 nt, hsa
cucuacuauuauaaccaaaaaauauuucuuguaugucccauaaaaauauuuguguaauucuuau

SEQ ID NO: 533756 - RNA, 64 nt, hsa
agacuacugggauccuucagaaaagaaacacugggucccauagcuaaauucucaaccgccaggc

SEQ ID NO: 533757 - RNA, 64 nt, hsa
uuacaauuacugaccauccccaguagacuccccagucccauaauuguguaucuuccagccagga

SEQ ID NO: 533758 - RNA, 64 nt, hsa
ucuacauuucuagaaaguucuuaucagcaagauggucccauaagcaaauuucuugugguuugua

SEQ ID NO: 533759 - RNA, 64 nt, hsa
ggagagugcuggggcagguggaggccagggaauggucccauacaguuaucuccccugcccuggu

SEQ ID NO: 533760 - RNA, 64 nt, hsa
agggauagcacugagcaaagcauugagcaaaggggucccauagaggugagggaagccugaaaaa

SEQ ID NO: 533761 - RNA, 64 nt, hsa
agguccguggccauucacuucaauuuugaccucugucccauagugaagaacauuuaaaguaaua

SEQ ID NO: 533762 - RNA, 64 nt, hsa
acacagaggaccucuuuggggcaagauccagguggucccauaggucuugugaaaaggcuuuuuc

SEQ ID NO: 533763 - RNA, 64 nt, hsa
uauguuucacauauaguuuuauacaaaguagccagucccauaaugaaaugcuguauugccauag

SEQ ID NO: 533764 - RNA, 64 nt, hsa
gcagacaguguuuugcacaucauguaucuguuuugucccauaauaugcuuuuuacucccugauc

SEQ ID NO: 533765 - RNA, 64 nt, hsa
aguuauguacugcauaaugacauauacaauaguggucccauaaaauuauaauggagcagaaaau

SEQ ID NO: 533766 - RNA, 64 nt, hsa
ugguuucuggguucuccauuggucuacuugucuagucccauaccagacucacggucuccauuau

SEQ ID NO: 533767 - RNA, 64 nt, hsa
agggaacauuuugguuauuuaaauuguucauaaugucccauauuucaccuguucaguguauacu

SEQ ID NO: 533768 - RNA, 64 nt, hsa
aaaaagaaaugacaauauggaacaucccaaggcugucccauaggguuggaaguuguguagcauu

SEQ ID NO: 533769 - RNA, 64 nt, hsa
gaaaucaccaacaaagaagauguucaaaauaauagucccauaucuguaaucauaucuacaugca

SEQ ID NO: 533770 - RNA, 64 nt, hsa
aagcucuguguguaccuggucccuucuagguguggucccauaggagcagccuuagcauccccug

SEQ ID NO: 533771 - RNA, 64 nt, hsa
aucccaacuagauaggcuuuaugcucacaucauugucccauacccaccccuuucucauccccau

SEQ ID NO: 533772 - RNA, 64 nt, hsa
agcuauaugaagcacuuugcagugaauggcaggugucccauaucugguuauguuaaccuagaaa

SEQ ID NO: 533773 - RNA, 64 nt, hsa
ucaagaagccucuccacacucuguggcacuuccagucccauaaauccuguuucuuauccacuuu

SEQ ID NO: 533774 - RNA, 64 nt, hsa
ucuagguucaaaagaaguuguaguguuaucaggcgucccauaccuuguuuuuaaucuccuguuu

SEQ ID NO: 533775 - RNA, 64 nt, hsa
cugcagcaaccuggcucugugugguguuuucccagucccauauuauguccagucauacuucuuc

SEQ ID NO: 533776 - RNA, 64 nt, hsa
cucugcuuuuaaaaaaaccauugcaggugccagugucccauauguuccuccugacaguuugaug

SEQ ID NO: 533777 - RNA, 64 nt, hsa
auguguaaaaacaauugaccagcuaggcuauuuagucccauaguaguucagaucugcuuagaug

SEQ ID NO: 533778 - RNA, 64 nt, hsa
cccccuuacuuuaauucuugggccuccaauaagugucccauaggugucuggccaggcccaccug

SEQ ID NO: 533779 - RNA, 64 nt, hsa
ggaaaagguguucagggcacuucuuguccucucugucccauaaccuaccuccacccucccccua

SEQ ID NO: 533780 - RNA, 64 nt, hsa
cccacagcuugugcccuccacaguguggacucaggucccauagacaucaggcuggagucuucuc

SEQ ID NO: 533781 - RNA, 64 nt, hsa
cgcaaaacacauccuuauuguuccugaucucuuagucccauaaaugggaacaaauacagcuuuc

SEQ ID NO: 533782 - RNA, 64 nt, hsa
gugacauccgucccacaucagggcggccucccaggucccauaaggguagcccccucaucugcag

SEQ ID NO: 533783 - RNA, 64 nt, hsa
aagcaaagucauuggaugggaggaggaagaaaaagucccauaaaggaacuuuuguagucuuauc

SEQ ID NO: 533784 - RNA, 54 nt, hsa
ucaaagcuuccuucaaauaagauggucccauagucuguauccaaauaaugaauc

SEQ ID NO: 533785 - RNA, 64 nt, hsa
uacuaaaaaaaaauuuuauacuuuccuugcuaaggucccauauauugauuuguacagauccacu

SEQ ID NO: 533786 - RNA, 64 nt, hsa
cugaggaaaguccuguggggagauucugaccacugucccauaggauucugauuuuaggaugucc

SEQ ID NO: 533787 - RNA, 64 nt, hsa
uucaagagaugaaccuaaaugagauaggaagccugucccauagcagccuuccucucacuacuuu

SEQ ID NO: 533788 - RNA, 64 nt, hsa
ucauuuaaaaaauauauaaauacuaccuuguagugucccauacuguguuuuuuacaugguagau

SEQ ID NO: 533789 - RNA, 64 nt, hsa
gccgcuccuucuuucagcccaucaaccagcauuggucccauagggaagcacaggggacucaccc

SEQ ID NO: 533790 - RNA, 64 nt, hsa
ccccugagcaaugucugugcuagggaaacuucccgucccauauccugccucagcccgccaaggu

SEQ ID NO: 533791 - RNA, 64 nt, hsa
ugugcucaguuuggcagcuauagaaggaaaugcugucccauaaaaugccauuccuauuuucuaa

SEQ ID NO: 533792 - RNA, 64 nt, hsa
gaggaauuuaaaugagcuguggauuauucauuuugucccauaagaagauaauuaaaaaaugaca

SEQ ID NO: 533793 - RNA, 64 nt, hsa
gaaacaaauaucaaggaugagaauggcacuggcugucccauaugguauccaggagccaccaaug

SEQ ID NO: 533794 - RNA, 64 nt, hsa
augauaacacaaauucacauauaauuggggguuagucccauacucuauaacagacuuaguccug

SEQ ID NO: 533795 - RNA, 64 nt, hsa
agagcuuggcccucuuuccucuguggcaaagcgugucccauagaaaauuggguguguauacuug

SEQ ID NO: 533796 - RNA, 64 nt, hsa
uuagaaaaauuggccucagugugaaauuuuuccagucccauagcucauggaugccaccagcuug

SEQ ID NO: 533797 - RNA, 64 nt, hsa
ucaaaagauuguuuuauauguaguacuaacuaaggucccauaauaaaaagauaguaucuuuuaa

SEQ ID NO: 533798 - RNA, 64 nt, hsa
gucccuaagcuggggacagagaagguucugagcugucccauacucccacuuugugccaaaugac

SEQ ID NO: 533799 - RNA, 64 nt, hsa
uucuuuuaagggauaguuuguaauaguaagaacugucccauauguuaguaaauuacauauguac

SEQ ID NO: 533800 - RNA, 64 nt, hsa
ggaccccagcaagugguccuagaggcccuuugcugucccauagucccugccacgaauuucugug

SEQ ID NO: 533801 - RNA, 64 nt, hsa
accacacaaaagcaugaugaaaaggcuucuuguagucccauaauuucuugugaacuaauguugu

SEQ ID NO: 533802 - RNA, 64 nt, hsa
cucuaggggcuaggggggaguggggagccaagaggucccauauuccugagugcagggguagucc

SEQ ID NO: 533803 - RNA, 64 nt, hsa
guugcugucgcuccuguuuuuaaccauauguucugucccauagcagucauucacacaugugaag

SEQ ID NO: 533804 - RNA, 64 nt, hsa
aaucaguuacugagugaagaaagacgggaaugaugucccauacuucccagcucucuaaaguguu

SEQ ID NO: 533805 - RNA, 64 nt, hsa
aauuuuaaucuaacccuuauguguauaaauuggugucccauaccagcuuuuaaugguggaccua

SEQ ID NO: 533806 - RNA, 64 nt, hsa
uuuuaguaugaagcaaugaagucuauuauuuguugucccauaauugagaaagcuuaaauacacc

SEQ ID NO: 533807 - RNA, 64 nt, hsa
uauaguggaaugagugugagcaucgggcuuugcagucccauagaacagaaaugggaugcuagcg

SEQ ID NO: 533808 - RNA, 64 nt, hsa
uuguccuggugccuccaucagacucucccuacuugucccauauuugcaaggggaggggauuugg

SEQ ID NO: 533809 - RNA, 64 nt, hsa
auuuuauagcccacuuaccaugcauaacagacaagucccauauuuugucaguagaugccuuuuu

SEQ ID NO: 533810 - RNA, 64 nt, hsa
gggccaggagguucuggaggccccuucacuuccagucccauagcggggcucagcuauuuuucug

SEQ ID NO: 533811 - RNA, 64 nt, hsa
gugaaaaaaaaaaaaaaagauauaagaacucaaggucccauacucuguauucgggauccaucug

SEQ ID NO: 533812 - RNA, 64 nt, hsa
cuuucaaaacacccaccccucuugccauuaagaagucccauaacccccgguugguugccaguga

SEQ ID NO: 533813 - RNA, 64 nt, hsa
ugugaaaaguuguguuuguguguuuucuucuccugucccauauuuggguuaugaugacucaagu

SEQ ID NO: 533814 - RNA, 64 nt, hsa
cccaaauagguauauauagacugcagaagcuucagucccauauauaaacguucaugucauuuua

SEQ ID NO: 533815 - RNA, 64 nt, hsa
gcagucacguggaggagcagugcaggcacaguaugucccauaggcccagugagaugcauucuug

SEQ ID NO: 533816 - RNA, 64 nt, hsa
uauauuuuucauaugaaucacagcuguugacaaugucccauauauuuaagaaauuauaucauac

SEQ ID NO: 533817 - RNA, 64 nt, hsa
aggagcccugagcuuguuuuccugcaauuagacggucccauaugggagugaugggagacaguga

SEQ ID NO: 533818 - RNA, 64 nt, hsa
uaguuguuugguuuucuuuucuuuccccccuccggucccauacuucacagcacucuggugcggg

SEQ ID NO: 533819 - RNA, 60 nt, hsa
gcaccaaccccuuccucugagccccgccccgucccauaccggccugcgccugcgccggac

SEQ ID NO: 533820 - RNA, 64 nt, hsa
cucgcagcccagguccagagcccccggcgagccggucccauaaccggcccccugccccugcccc

SEQ ID NO: 533821 - RNA, 64 nt, hsa
agaagucauaauaucuggcacuaguaggucuacagucccauauguuggcagcuggagccgaaga

SEQ ID NO: 533822 - RNA, 64 nt, hsa
caaacaugcggacuguucaagagaauugaucugggucccauaagcaaaccucauccuuagaaau

SEQ ID NO: 533823 - RNA, 64 nt, hsa
cugcagggcccaugcaccagagccacugagcccagucccauaaaccuggcccucuuuggggaaa

SEQ ID NO: 533824 - RNA, 64 nt, hsa
ugacuuuccggaggccuugagggaaaugcacacugucccauagccucauugggcucccagacgu

SEQ ID NO: 533825 - RNA, 64 nt, hsa
cagcucccuccaggccugagcaccgguuccuuuugucccauacgucaugaagucacacuauugg

SEQ ID NO: 533826 - RNA, 64 nt, hsa
gauugcagcagcccuggacuauuuauuucuggaugucccauacaugaaaaauaugcacuucuua

SEQ ID NO: 533827 - RNA, 64 nt, hsa
cgucaucauuggguucuguuuugacagcucugcugucccauagggacugcgacugggaccaggu

SEQ ID NO: 533828 - RNA, 64 nt, hsa
cacugcuucuguuuauucauuuauaugcuuuugugucccauaaauuauuucagaaaaugcugau

SEQ ID NO: 533829 - RNA, 64 nt, hsa
aggauuacaggcgugagccaccguacccagccuggucccauaucauagugaaauggugccugua

SEQ ID NO: 533830 - RNA, 64 nt, hsa
uaacugccuccuggauugucaucuucccagaugugucccauaguguccaggugucacagagacg

SEQ ID NO: 533831 - RNA, 64 nt, hsa
ggccaucuagccucguaacuucacugucaccugugucccauagggugccuucugaauacuguua

SEQ ID NO: 533832 - RNA, 64 nt, hsa
cuuuagaguuacaagccccuggaaaagggagcaggucccauacaaucagccuuucuccucuucu

SEQ ID NO: 533833 - RNA, 64 nt, hsa
ucuuuuaagucagucuguuauaaauuuuuuuuuagucccauaagcaguagacucccacagaaaa

SEQ ID NO: 533834 - RNA, 64 nt, hsa
ugaguuugaggcacauucccagugaauaagcugagucccauaccacacucaaaagguuuuaaua

SEQ ID NO: 533835 - RNA, 64 nt, hsa
cuuuccucccagaacuauaucugacucucagucugucccauaaauuaauucagaaaccaucuuc

SEQ ID NO: 533836 - RNA, 64 nt, hsa
auuuuaguaaagggacccuuuccccuagccuagggucccauauugggucaagcugcuuaccugc

SEQ ID NO: 533837 - RNA, 64 nt, hsa
agcccuuuuuauuuuugguacugagagucucaaggucccauagcuacaugguacagggcuguug

SEQ ID NO: 533838 - RNA, 64 nt, hsa
ggggcucgaggaacguaguguucuuugcauuucugucccauaugggugauguagagauuuaccu

SEQ ID NO: 533839 - RNA, 64 nt, hsa
guuuagccuagucaugugccuugaacauauaugugucccauaaucuggcucaugguaccuguuc

SEQ ID NO: 533840 - RNA, 64 nt, hsa; identical to SEQ ID NO: 518339

SEQ ID NO: 533841 - RNA, 64 nt, hsa; identical to SEQ ID NO: 518340

SEQ ID NO: 533842 - RNA, 64 nt, hsa; identical to SEQ ID NO: 518341

SEQ ID NO: 533843 - RNA, 64 nt, hsa; identical to SEQ ID NO: 518342

SEQ ID NO: 533844 - RNA, 64 nt, hsa; identical to SEQ ID NO: 518343

SEQ ID NO: 533845 - RNA, 64 nt, hsa; identical to SEQ ID NO: 518344

SEQ ID NO: 533846 - RNA, 64 nt, hsa; identical to SEQ ID NO: 518345

SEQ ID NO: 533847 - RNA, 64 nt, hsa; identical to SEQ ID NO: 518346

SEQ ID NO: 533848 - RNA, 64 nt, hsa; identical to SEQ ID NO: 518347

SEQ ID NO: 533849 - RNA, 64 nt, hsa; identical to SEQ ID NO: 518348

SEQ ID NO: 533850 - RNA, 64 nt, hsa; identical to SEQ ID NO: 518349

SEQ ID NO: 533851 - RNA, 64 nt, hsa; identical to SEQ ID NO: 518350

SEQ ID NO: 533852 - RNA, 64 nt, hsa; identical to SEQ ID NO: 518351

SEQ ID NO: 533853 - RNA, 64 nt, hsa; identical to SEQ ID NO: 518352

SEQ ID NO: 533854 - RNA, 64 nt, hsa; identical to SEQ ID NO: 518353

SEQ ID NO: 533855 - RNA, 64 nt, hsa; identical to SEQ ID NO: 518354

SEQ ID NO: 533856 - RNA, 64 nt, hsa; identical to SEQ ID NO: 518355

SEQ ID NO: 533857 - RNA, 64 nt, hsa; identical to SEQ ID NO: 518356

SEQ ID NO: 533858 - RNA, 64 nt, hsa; identical to SEQ ID NO: 518357

SEQ ID NO: 533859 - RNA, 64 nt, hsa; identical to SEQ ID NO: 518358

SEQ ID NO: 533860 - RNA, 64 nt, hsa; identical to SEQ ID NO: 518359

SEQ ID NO: 533861 - RNA, 64 nt, hsa; identical to SEQ ID NO: 518360

SEQ ID NO: 533862 - RNA, 64 nt, hsa; identical to SEQ ID NO: 518361

SEQ ID NO: 533863 - RNA, 64 nt, hsa; identical to SEQ ID NO: 518362

SEQ ID NO: 533864 - RNA, 64 nt, hsa; identical to SEQ ID NO: 518363

SEQ ID NO: 533865 - RNA, 64 nt, hsa; identical to SEQ ID NO: 518364

SEQ ID NO: 533866 - RNA, 64 nt, hsa; identical to SEQ ID NO: 518365

SEQ ID NO: 533867 - RNA, 64 nt, hsa; identical to SEQ ID NO: 518366

SEQ ID NO: 533868 - RNA, 64 nt, hsa; identical to SEQ ID NO: 518367

SEQ ID NO: 533869 - RNA, 64 nt, hsa; identical to SEQ ID NO: 518368

SEQ ID NO: 533870 - RNA, 64 nt, hsa; identical to SEQ ID NO: 518369

SEQ ID NO: 533871 - RNA, 64 nt, hsa; identical to SEQ ID NO: 518370

SEQ ID NO: 533872 - RNA, 64 nt, hsa; identical to SEQ ID NO: 518371

SEQ ID NO: 533873 - RNA, 64 nt, hsa; identical to SEQ ID NO: 518372

SEQ ID NO: 533874 - RNA, 64 nt, hsa; identical to SEQ ID NO: 518373

SEQ ID NO: 533875 - RNA, 64 nt, hsa; identical to SEQ ID NO: 518374

SEQ ID NO: 533876 - RNA, 64 nt, hsa; identical to SEQ ID NO: 518375

SEQ ID NO: 533877 - RNA, 64 nt, hsa; identical to SEQ ID NO: 518376

SEQ ID NO: 533878 - RNA, 64 nt, hsa; identical to SEQ ID NO: 518377

SEQ ID NO: 533879 - RNA, 64 nt, hsa; identical to SEQ ID NO: 518378

SEQ ID NO: 533880 - RNA, 64 nt, hsa; identical to SEQ ID NO: 518379

SEQ ID NO: 533881 - RNA, 64 nt, hsa; identical to SEQ ID NO: 518380

SEQ ID NO: 533882 - RNA, 64 nt, hsa; identical to SEQ ID NO: 518381

SEQ ID NO: 533883 - RNA, 64 nt, hsa; identical to SEQ ID NO: 518382

SEQ ID NO: 533884 - RNA, 64 nt, hsa; identical to SEQ ID NO: 518383

SEQ ID NO: 533885 - RNA, 64 nt, hsa; identical to SEQ ID NO: 518384

SEQ ID NO: 533886 - RNA, 64 nt, hsa; identical to SEQ ID NO: 518385

SEQ ID NO: 533887 - RNA, 64 nt, hsa; identical to SEQ ID NO: 518386

SEQ ID NO: 533888 - RNA, 64 nt, hsa; identical to SEQ ID NO: 518387

SEQ ID NO: 533889 - RNA, 64 nt, hsa; identical to SEQ ID NO: 518388

SEQ ID NO: 533890 - RNA, 64 nt, hsa; identical to SEQ ID NO: 518389

SEQ ID NO: 533891 - RNA, 64 nt, hsa; identical to SEQ ID NO: 518390

SEQ ID NO: 533892 - RNA, 64 nt, hsa; identical to SEQ ID NO: 518391

SEQ ID NO: 533893 - RNA, 64 nt, hsa; identical to SEQ ID NO: 518392

SEQ ID NO: 533894 - RNA, 64 nt, hsa; identical to SEQ ID NO: 518393

SEQ ID NO: 533895 - RNA, 64 nt, hsa; identical to SEQ ID NO: 518394

SEQ ID NO: 533896 - RNA, 64 nt, hsa; identical to SEQ ID NO: 518395

SEQ ID NO: 533897 - RNA, 64 nt, hsa; identical to SEQ ID NO: 518396

SEQ ID NO: 533898 - RNA, 64 nt, hsa; identical to SEQ ID NO: 518397

SEQ ID NO: 533899 - RNA, 64 nt, hsa; identical to SEQ ID NO: 518398

SEQ ID NO: 533900 - RNA, 64 nt, hsa; identical to SEQ ID NO: 518399

SEQ ID NO: 533901 - RNA, 64 nt, hsa; identical to SEQ ID NO: 518400

SEQ ID NO: 533902 - RNA, 64 nt, hsa; identical to SEQ ID NO: 518401

SEQ ID NO: 533903 - RNA, 64 nt, hsa; identical to SEQ ID NO: 518402

SEQ ID NO: 533904 - RNA, 60 nt, hsa; identical to SEQ ID NO: 518403

SEQ ID NO: 533905 - RNA, 64 nt, hsa; identical to SEQ ID NO: 518404

SEQ ID NO: 533906 - RNA, 64 nt, hsa; identical to SEQ ID NO: 518405

SEQ ID NO: 533907 - RNA, 64 nt, hsa; identical to SEQ ID NO: 518406

SEQ ID NO: 533908 - RNA, 64 nt, hsa; identical to SEQ ID NO: 518407

SEQ ID NO: 533909 - RNA, 64 nt, hsa; identical to SEQ ID NO: 518408

SEQ ID NO: 533910 - RNA, 64 nt, hsa; identical to SEQ ID NO: 518409

SEQ ID NO: 533911 - RNA, 64 nt, hsa; identical to SEQ ID NO: 518410

SEQ ID NO: 533912 - RNA, 64 nt, hsa; identical to SEQ ID NO: 518411

SEQ ID NO: 533913 - RNA, 64 nt, hsa; identical to SEQ ID NO: 518412

SEQ ID NO: 533914 - RNA, 64 nt, hsa; identical to SEQ ID NO: 518413

SEQ ID NO: 533915 - RNA, 64 nt, hsa; identical to SEQ ID NO: 518414

SEQ ID NO: 533916 - RNA, 64 nt, hsa; identical to SEQ ID NO: 518415

SEQ ID NO: 533917 - RNA, 64 nt, hsa; identical to SEQ ID NO: 518416

SEQ ID NO: 533918 - RNA, 64 nt, hsa; identical to SEQ ID NO: 518417

SEQ ID NO: 533919 - RNA, 64 nt, hsa; identical to SEQ ID NO: 518418

SEQ ID NO: 533920 - RNA, 64 nt, hsa; identical to SEQ ID NO: 518419

SEQ ID NO: 533921 - RNA, 64 nt, hsa; identical to SEQ ID NO: 518420

SEQ ID NO: 533922 - RNA, 64 nt, hsa; identical to SEQ ID NO: 518421

SEQ ID NO: 533923 - RNA, 64 nt, hsa; identical to SEQ ID NO: 518422

SEQ ID NO: 533924 - RNA, 64 nt, hsa; identical to SEQ ID NO: 518423

SEQ ID NO: 533925 - RNA, 64 nt, hsa; identical to SEQ ID NO: 518424

SEQ ID NO: 533926 - RNA, 64 nt, hsa; identical to SEQ ID NO: 518425

SEQ ID NO: 533927 - RNA, 64 nt, hsa; identical to SEQ ID NO: 518426

SEQ ID NO: 533928 - RNA, 64 nt, hsa; identical to SEQ ID NO: 518427

SEQ ID NO: 533929 - RNA, 64 nt, hsa; identical to SEQ ID NO: 518428

SEQ ID NO: 533930 - RNA, 64 nt, hsa; identical to SEQ ID NO: 518429

SEQ ID NO: 533931 - RNA, 64 nt, hsa; identical to SEQ ID NO: 518430

SEQ ID NO: 533932 - RNA, 64 nt, hsa; identical to SEQ ID NO: 518431

SEQ ID NO: 533933 - RNA, 64 nt, hsa; identical to SEQ ID NO: 518432

SEQ ID NO: 533934 - RNA, 64 nt, hsa; identical to SEQ ID NO: 518433

SEQ ID NO: 533935 - RNA, 64 nt, hsa; identical to SEQ ID NO: 518434

SEQ ID NO: 533936 - RNA, 64 nt, hsa; identical to SEQ ID NO: 518435

SEQ ID NO: 533937 - RNA, 64 nt, hsa; identical to SEQ ID NO: 518436

SEQ ID NO: 533938 - RNA, 64 nt, hsa; identical to SEQ ID NO: 518437

SEQ ID NO: 533939 - RNA, 64 nt, hsa; identical to SEQ ID NO: 518438

SEQ ID NO: 533940 - RNA, 64 nt, hsa; identical to SEQ ID NO: 518439

SEQ ID NO: 533941 - RNA, 64 nt, hsa; identical to SEQ ID NO: 518440

SEQ ID NO: 533942 - RNA, 64 nt, hsa; identical to SEQ ID NO: 518441

SEQ ID NO: 533943 - RNA, 64 nt, hsa; identical to SEQ ID NO: 518442

SEQ ID NO: 533944 - RNA, 64 nt, hsa; identical to SEQ ID NO: 518443

SEQ ID NO: 533945 - RNA, 64 nt, hsa; identical to SEQ ID NO: 518444

SEQ ID NO: 533946 - RNA, 64 nt, hsa; identical to SEQ ID NO: 518445

SEQ ID NO: 533947 - RNA, 64 nt, hsa; identical to SEQ ID NO: 518446

SEQ ID NO: 533948 - RNA, 64 nt, hsa; identical to SEQ ID NO: 518447

SEQ ID NO: 533949 - RNA, 64 nt, hsa; identical to SEQ ID NO: 518448

SEQ ID NO: 533950 - RNA, 64 nt, hsa; identical to SEQ ID NO: 518449

SEQ ID NO: 533951 - RNA, 64 nt, hsa; identical to SEQ ID NO: 518450

SEQ ID NO: 533952 - RNA, 64 nt, hsa; identical to SEQ ID NO: 518451

SEQ ID NO: 533953 - RNA, 64 nt, hsa; identical to SEQ ID NO: 518452

SEQ ID NO: 533954 - RNA, 64 nt, hsa; identical to SEQ ID NO: 518453

SEQ ID NO: 533955 - RNA, 64 nt, hsa; identical to SEQ ID NO: 518454

SEQ ID NO: 533956 - RNA, 64 nt, hsa; identical to SEQ ID NO: 518455

SEQ ID NO: 533957 - RNA, 64 nt, hsa; identical to SEQ ID NO: 518456

SEQ ID NO: 533958 - RNA, 64 nt, hsa; identical to SEQ ID NO: 518457

SEQ ID NO: 533959 - RNA, 64 nt, hsa; identical to SEQ ID NO: 518458

SEQ ID NO: 533960 - RNA, 64 nt, hsa; identical to SEQ ID NO: 518459

SEQ ID NO: 533961 - RNA, 64 nt, hsa; identical to SEQ ID NO: 518460

SEQ ID NO: 533962 - RNA, 64 nt, hsa; identical to SEQ ID NO: 518461

SEQ ID NO: 533963 - RNA, 64 nt, hsa; identical to SEQ ID NO: 518462

SEQ ID NO: 533964 - RNA, 64 nt, hsa; identical to SEQ ID NO: 518463

SEQ ID NO: 533965 - RNA, 64 nt, hsa; identical to SEQ ID NO: 518464

SEQ ID NO: 533966 - RNA, 64 nt, hsa; identical to SEQ ID NO: 518465

SEQ ID NO: 533967 - RNA, 64 nt, hsa; identical to SEQ ID NO: 518466

SEQ ID NO: 533968 - RNA, 64 nt, hsa; identical to SEQ ID NO: 518467

SEQ ID NO: 533969 - RNA, 64 nt, hsa; identical to SEQ ID NO: 518468

SEQ ID NO: 533970 - RNA, 64 nt, hsa; identical to SEQ ID NO: 518469

SEQ ID NO: 533971 - RNA, 64 nt, hsa; identical to SEQ ID NO: 518470

SEQ ID NO: 533972 - RNA, 64 nt, hsa; identical to SEQ ID NO: 518471

SEQ ID NO: 533973 - RNA, 64 nt, hsa; identical to SEQ ID NO: 518472

SEQ ID NO: 533974 - RNA, 64 nt, hsa; identical to SEQ ID NO: 518473

SEQ ID NO: 533975 - RNA, 64 nt, hsa; identical to SEQ ID NO: 518474

SEQ ID NO: 533976 - RNA, 64 nt, hsa; identical to SEQ ID NO: 518475

SEQ ID NO: 533977 - RNA, 64 nt, hsa; identical to SEQ ID NO: 518476

SEQ ID NO: 533978 - RNA, 64 nt, hsa; identical to SEQ ID NO: 518477

SEQ ID NO: 533979 - RNA, 64 nt, hsa; identical to SEQ ID NO: 518478

SEQ ID NO: 533980 - RNA, 64 nt, hsa; identical to SEQ ID NO: 518479

SEQ ID NO: 533981 - RNA, 64 nt, hsa; identical to SEQ ID NO: 518480

SEQ ID NO: 533982 - RNA, 64 nt, hsa; identical to SEQ ID NO: 518481

SEQ ID NO: 533983 - RNA, 64 nt, hsa; identical to SEQ ID NO: 518482

SEQ ID NO: 533984 - RNA, 64 nt, hsa; identical to SEQ ID NO: 518483

SEQ ID NO: 533985 - RNA, 64 nt, hsa; identical to SEQ ID NO: 518484

SEQ ID NO: 533986 - RNA, 64 nt, hsa; identical to SEQ ID NO: 518485

SEQ ID NO: 533987 - RNA, 64 nt, hsa; identical to SEQ ID NO: 518486

SEQ ID NO: 533988 - RNA, 64 nt, hsa; identical to SEQ ID NO: 518487

SEQ ID NO: 533989 - RNA, 64 nt, hsa; identical to SEQ ID NO: 518488

SEQ ID NO: 533990 - RNA, 64 nt, hsa; identical to SEQ ID NO: 518489

SEQ ID NO: 533991 - RNA, 64 nt, hsa; identical to SEQ ID NO: 518490

SEQ ID NO: 533992 - RNA, 64 nt, hsa; identical to SEQ ID NO: 518491

SEQ ID NO: 533993 - RNA, 64 nt, hsa; identical to SEQ ID NO: 518492

SEQ ID NO: 533994 - RNA, 64 nt, hsa; identical to SEQ ID NO: 518493

SEQ ID NO: 533995 - RNA, 64 nt, hsa; identical to SEQ ID NO: 518494

SEQ ID NO: 533996 - RNA, 64 nt, hsa; identical to SEQ ID NO: 518495

SEQ ID NO: 533997 - RNA, 64 nt, hsa; identical to SEQ ID NO: 518496

SEQ ID NO: 533998 - RNA, 64 nt, hsa; identical to SEQ ID NO: 518497

SEQ ID NO: 533999 - RNA, 64 nt, hsa; identical to SEQ ID NO: 518498

SEQ ID NO: 534000 - RNA, 64 nt, hsa; identical to SEQ ID NO: 518499

SEQ ID NO: 534001 - RNA, 64 nt, hsa; identical to SEQ ID NO: 518500

SEQ ID NO: 534002 - RNA, 64 nt, hsa
cccucugaugggacgguacugagauaucucggcuuccgcucagcccgguuuugacugguugaaa

SEQ ID NO: 534003 - RNA, 64 nt, hsa
ucugucacccaggcuggaaugcaguggcgagaucuccgcucacuguagccuccucccccugggu

SEQ ID NO: 534004 - RNA, 64 nt, hsa
ucuguuacccaggcuagagugcaguggcgcgaucuccgcucacugcaagcucugccuccugggc

SEQ ID NO: 534005 - RNA, 64 nt, hsa
augggcugcuccucccagggcucaagggcugugguccgcucagggucucauuuccccaggccaa

SEQ ID NO: 534006 - RNA, 64 nt, hsa
ccugucgcccaggcuggagugcaaugccgugaucuccgcucacugccaccuccgccucucuagu

SEQ ID NO: 534007 - RNA, 64 nt, hsa
cuuuuaauuuaaaggaagcaguaaccacaaagcuuccgcucaggguuuuuucuuucuucaaguc

SEQ ID NO: 534008 - RNA, 64 nt, hsa
gaucgcuguuccuugagcaaggcgcuuacucuccuccgcucaggcccccaaggccgcccuuucc

SEQ ID NO: 534009 - RNA, 64 nt, hsa
gggagugagaugaggugggcuugaaaguaccuuguccgcucagaaggaccauucaagguucacu

SEQ ID NO: 534010 - RNA, 64 nt, hsa
augaugaaggugaaacgucagcccuggccauggcuccgcucagggccccggucaccuccgaguc

SEQ ID NO: 534011 - RNA, 64 nt, hsa
cuuucaucuuccuugggugguccucaugucgcuguccgcucauguuccugguguucuggcauca

SEQ ID NO: 534012 - RNA, 64 nt, hsa
uggugaccuggccaaggggauacagacccugcaguccgcucagggugggauggcagacauggca

SEQ ID NO: 534013 - RNA, 64 nt, hsa
ugcuguggauguaaggauaggaggugcccagugcuccgcucaaggaaggcuggaucugggcccc

SEQ ID NO: 534014 - RNA, 64 nt, hsa
uccuuuaagauuuggaaagccaggauccuucugcuccgcucaggacccccggagccccgcgaaa

SEQ ID NO: 534015 - RNA, 64 nt, hsa
ggaagcacacugcagggcugcuguggcccagucguccgcucagccaaggagucagauggcaaug

SEQ ID NO: 534016 - RNA, 64 nt, hsa
cugagauccgagaggagcuuggaaagcuguaguauccgcucauuuuuaaaauuuaauuuuuaag

SEQ ID NO: 534017 - RNA, 64 nt, hsa
accugucucaccuacccuccaguccccucccagcuccgcucacagggcucucauuucguccauc

SEQ ID NO: 534018 - RNA, 64 nt, hsa
ucgcccccuccagugcaugaggaacccucuuuccuccgcucagagaugcugcuucauuuaccca

SEQ ID NO: 534019 - RNA, 64 nt, hsa
uguggugugcggguuuccuugcugccgucaccucuccgcucauacaggaaugaagccuuagcca

SEQ ID NO: 534020 - RNA, 64 nt, hsa
aguggggaaugaggcugguccugcagccucucccuccgcucagggcuugaaggucgguggcgga

SEQ ID NO: 534021 - RNA, 64 nt, hsa
ucugucgcccaggcugaggugcaguagugcaaucuccgcucacuacaaccuccacucccugggg

SEQ ID NO: 534022 - RNA, 64 nt, hsa
uaaauggauucgagccacuuguaggcacauuagcuccgcucauguucccugagcacagauaaug

SEQ ID NO: 534023 - RNA, 64 nt, hsa
ccucuccccacaccacccacccagcugcugucauuccgcucacugagcucuucuucauucucac

SEQ ID NO: 534024 - RNA, 64 nt, hsa
agcaggaggugacacuagauggcugugaaugugauccgcucacugacacucuguaaaggccaau

SEQ ID NO: 534025 - RNA, 64 nt, hsa
ccgguaaggacagggacaggaccugcagacugcauccgcucauuuuuuguuguuuuugugacca

SEQ ID NO: 534026 - RNA, 64 nt, hsa
caggcagagcccccaccaggcagggcaaggagacuccgcucacuccccacggccagcgugggca

SEQ ID NO: 534027 - RNA, 64 nt, hsa
ugggaggugagacguugucccggagaucaaaacguccgcucaaaacguuacccugucgcucgaa

SEQ ID NO: 534028 - RNA, 64 nt, hsa
agacgucccgccacccaccaccccucacaggacguccgcucagcacacgccuuguuacgagcaa

SEQ ID NO: 534029 - RNA, 64 nt, hsa
agcucccagcccuuccccccagcccucagggagcuccgcucagccccggcggggaggagcgggu

SEQ ID NO: 534030 - RNA, 64 nt, hsa
ggcccugcagcuccagggcuggugcucuagcagauccgcucaggcacgguugggugaccguggg

SEQ ID NO: 534031 - RNA, 64 nt, hsa
cucuccucugcugacucugccguuucuccaggccuccgcucagugaugagaccaagagaucgga

SEQ ID NO: 534032 - RNA, 64 nt, hsa
gggcugagggugcccuuuuccagccucagccuacuccgcucacugaacuccuuccccacuucug

SEQ ID NO: 534033 - RNA, 64 nt, hsa
aacugucaucucccgacuccucccugagccagccuccgcucaguguggcuccucagcccacaga

SEQ ID NO: 534034 - RNA, 64 nt, hsa
agaggggcgaacuaaagaccuguccaccuguagcuccgcucauuucuuagaaaccaccugcuuc

SEQ ID NO: 534035 - RNA, 64 nt, hsa
cgccccgugugcucccgcccagccugcugaggccuccgcucaggucagaagcccagcugcugau

SEQ ID NO: 534036 - RNA, 64 nt, hsa
aagcucagagauuugcaccaggugccuuguugccuccgcucaggaugaaagaggagcugagaga

SEQ ID NO: 534037 - RNA, 64 nt, hsa
auucacauucaucugacuguaaaucccaagggccuccgcucaugcuaaauugagaaucuuaggg

SEQ ID NO: 534038 - RNA, 64 nt, hsa
ccccacaucuaaccaggcccugauguaggggucguccgcucaggcugcccccuugggcucuugc

SEQ ID NO: 534039 - RNA, 64 nt, hsa
ugaacacagugaaagcugcaaguaugccaguggguccgcucacgaccguccuguuucuugcucc

SEQ ID NO: 534040 - RNA, 64 nt, hsa
ugcuacucauucugaagggcccugacugcuccuuuccgcucacccauucccugccuucucuagg

SEQ ID NO: 534041 - RNA, 64 nt, hsa
cacuccagccugggcgacugagcgagacucuaucucaaaacaaucaaaacaaaaaagaccugug

SEQ ID NO: 534042 - RNA, 64 nt, hsa
cugggcgacugagcgagacucuaucucaaaacaaucaaaacaaaaaagaccuguggacucuagu

SEQ ID NO: 534043 - RNA, 64 nt, hsa
ucuuuucuucugguuuaauuuuaauuuucuauuuucaaaacaaauauuuacuucauuugccaau

SEQ ID NO: 534044 - RNA, 64 nt, hsa
auaaguggaagggcagcuauuaccauucgcuuagucaaaacauucgguuacugcccuuuaauac

SEQ ID NO: 534045 - RNA, 64 nt, hsa
ucauguaagauuucaauaaaacuaaaaaaucuauucaaaacauuaccuauuucaaauucaauug

SEQ ID NO: 534046 - RNA, 64 nt, hsa
caaugcuuuuaucguuucaggcuucauuuuagcuucaaaacaagcugggcacacuguuaaauca

SEQ ID NO: 534047 - RNA, 64 nt, hsa
accauagccagcaaaagaccuggcagguccugaaucaaaacaacagaguggcugaaagucacac

SEQ ID NO: 534048 - RNA, 64 nt, hsa
agaagagaugaagagggggagguacggucagcuuucaaaacaauaugccccccgcccaucccau

SEQ ID NO: 534049 - RNA, 64 nt, hsa
cacuccagccugggcgacagagcaagacucugucucaaaacaaacacaaauacaguauccaaac

SEQ ID NO: 534050 - RNA, 64 nt, hsa
aacccauucaauuucagucugcugcuuugcucuuucaaaacagaaccuccaggcugacgaggca

SEQ ID NO: 534051 - RNA, 64 nt, hsa
agacuaauccuuuuagauaguagcuuuuugaugcucaaaacaucacauuuaaauuuaguuuaaa

SEQ ID NO: 534052 - RNA, 64 nt, hsa
ugucccauuucauucagagcccuuauugcucuuaucaaaacagaagaaggcuacauuuguggga

SEQ ID NO: 534053 - RNA, 64 nt, hsa
gugaccaccaaauuguuauuugcacuaacaaagcucaaaacacgauaaguuuacuccuccaucu

SEQ ID NO: 534054 - RNA, 64 nt, hsa
agcuacuuuugccaaauucuauuugucuucuccuucaaaacauucuccuuugcaguuccucuuc

SEQ ID NO: 534055 - RNA, 64 nt, hsa
cuccaguuacuguauucuacaaauauuuuuauguucaaaacacacaguacagacagcauggaua

SEQ ID NO: 534056 - RNA, 64 nt, hsa
agugugcuuuauugaguguggauuuugcauacauucaaaacauuaaccacaaaauacagcaagu

SEQ ID NO: 534057 - RNA, 64 nt, hsa
acaugaacucacagggauccagagaugguaaaauucaaaacagccugucaaguucaaaacagag

SEQ ID NO: 534058 - RNA, 64 nt, hsa
cagagaugguaaaauucaaaacagccugucaaguucaaaacagagaggugaaagcagaagagac

SEQ ID NO: 534059 - RNA, 64 nt, hsa
caucacccucagacuuuaagacaagaagccaccaucaaaacaaaggaugggauacguauagaau

SEQ ID NO: 534060 - RNA, 64 nt, hsa
uguuugaguuccaaucuuacauuuuauaccaaguucaaaacacuuucagauagaagucuuucua

SEQ ID NO: 534061 - RNA, 64 nt, hsa
uauggaaauucugcucagauagaaugacaguccgucaaaacagauuguuugcaaaggggaggca

SEQ ID NO: 534062 - RNA, 64 nt, hsa
uuuuucuaacugggggaaaagauucccacccaauucaaaacauugugccaugucaaacaaauag

SEQ ID NO: 534063 - RNA, 64 nt, hsa
ugcaguacguuucuaauauaaguguagguggguaucaaaacaagacaaaugcuguucagggaaa

SEQ ID NO: 534064 - RNA, 64 nt, hsa
gaaauuuauaucuggcauacggauaggcuuauauucaaaacaucuuagucauacgaccauaaau

SEQ ID NO: 534065 - RNA, 64 nt, hsa
guagguagcuucaggaaauggcucagguuaauucucaaaacacaaauuguugcuggccaggcau

SEQ ID NO: 534066 - RNA, 64 nt, hsa
uugaagccccagucuuugauuuuacagguaacuuucaaaacaucaugaugcugccaaauguacu

SEQ ID NO: 534067 - RNA, 64 nt, hsa
aaauguguuuuuuacuugcuaaauugucauaacaucaaaacaagaaauuucuugauggaaugua

SEQ ID NO: 534068 - RNA, 64 nt, hsa
ugaguugggaaauucucuugacugaauuaauccuucaaaacaaucagauaauucacacaagagg

SEQ ID NO: 534069 - RNA, 64 nt, hsa
agggcaauagagguucugaaaggucugugucuugucaaaacaaguaaacgguggaacuacgacu

SEQ ID NO: 534070 - RNA, 64 nt, hsa
acacuccagccuggggacggagcaaaacuuugccucaaaacaaauuuuaaaaagaaagaaagaa

SEQ ID NO: 534071 - RNA, 64 nt, hsa
uacuccagcuugggcaacagagugagacuccaucucaaaacaaaacaaaacaaaacaaaacaaa

SEQ ID NO: 534072 - RNA, 64 nt, hsa
aacaggaaguugacuguaugucugcuaguuagauucaaaacaucauaaagaugauagcauguca

SEQ ID NO: 534073 - RNA, 64 nt, hsa
ccucaaaacuuuacuagggccaauaaacuuucuuucaaaacaauacguaacuuuguuguuguuu

SEQ ID NO: 534074 - RNA, 64 nt, hsa
aaagagacuaggacucagucugaacugaaaucugucaaaacaaagggggguggggcuuuaagag

SEQ ID NO: 534075 - RNA, 64 nt, hsa
uuguuuuuaguuuuuguugguagaaacaguacacucaaaacauccuugacuguccccugguaca

SEQ ID NO: 534076 - RNA, 64 nt, hsa
aaaacuaaaacuaagaauucucaaaaaaacuuguucaaaacagggaaagacugaugaaaaguaa

SEQ ID NO: 534077 - RNA, 64 nt, hsa
accaucuugaaccacagauuucugcuaugugucaucaaaacaucuaguucugaguaacauuuuc

SEQ ID NO: 534078 - RNA, 64 nt, hsa
ccauaugaaucagaauuauauugauucugugcaaucaaaacaaaaggcagaauagaaugcugag

SEQ ID NO: 534079 - RNA, 64 nt, hsa
ugaauggcugcagugacccagauauugcacuaggucaaaacauucagguauagcugacaucucc

SEQ ID NO: 534080 - RNA, 64 nt, hsa
gcuacuaauuauauaguauaccauacauuaucauucaaaacaaccauccugcucauaacaucuu

SEQ ID NO: 534081 - RNA, 64 nt, hsa
uauaagaauguaggccuuaacuauuucacaugagucaaaacaaagcagcuuuaaaaaaauaauu

SEQ ID NO: 534082 - RNA, 64 nt, hsa
acuccagccugggcgacaaaaacgaaacuccaucucaaaacaaaacaaaacaaaacaaacaaac

SEQ ID NO: 534083 - RNA, 64 nt, hsa; identical to SEQ ID NO: 495467

SEQ ID NO: 534084 - RNA, 64 nt, hsa; identical to SEQ ID NO: 495468

SEQ ID NO: 534085 - RNA, 64 nt, hsa; identical to SEQ ID NO: 495469

SEQ ID NO: 534086 - RNA, 64 nt, hsa; identical to SEQ ID NO: 495470

SEQ ID NO: 534087 - RNA, 64 nt, hsa; identical to SEQ ID NO: 495471

SEQ ID NO: 534088 - RNA, 64 nt, hsa; identical to SEQ ID NO: 495472

SEQ ID NO: 534089 - RNA, 64 nt, hsa; identical to SEQ ID NO: 495473

SEQ ID NO: 534090 - RNA, 64 nt, hsa; identical to SEQ ID NO: 495474

SEQ ID NO: 534091 - RNA, 64 nt, hsa; identical to SEQ ID NO: 495475

SEQ ID NO: 534092 - RNA, 64 nt, hsa; identical to SEQ ID NO: 495476

SEQ ID NO: 534093 - RNA, 64 nt, hsa; identical to SEQ ID NO: 495477

SEQ ID NO: 534094 - RNA, 64 nt, hsa; identical to SEQ ID NO: 495478

SEQ ID NO: 534095 - RNA, 64 nt, hsa; identical to SEQ ID NO: 495479

SEQ ID NO: 534096 - RNA, 64 nt, hsa; identical to SEQ ID NO: 495480

SEQ ID NO: 534097 - RNA, 64 nt, hsa; identical to SEQ ID NO: 495481

SEQ ID NO: 534098 - RNA, 64 nt, hsa; identical to SEQ ID NO: 495482

SEQ ID NO: 534099 - RNA, 64 nt, hsa; identical to SEQ ID NO: 495483

SEQ ID NO: 534100 - RNA, 64 nt, hsa; identical to SEQ ID NO: 495484

SEQ ID NO: 534101 - RNA, 64 nt, hsa; identical to SEQ ID NO: 495485

SEQ ID NO: 534102 - RNA, 64 nt, hsa; identical to SEQ ID NO: 495486

SEQ ID NO: 534103 - RNA, 64 nt, hsa; identical to SEQ ID NO: 495487

SEQ ID NO: 534104 - RNA, 64 nt, hsa; identical to SEQ ID NO: 495488

SEQ ID NO: 534105 - RNA, 64 nt, hsa; identical to SEQ ID NO: 495489

SEQ ID NO: 534106 - RNA, 64 nt, hsa; identical to SEQ ID NO: 495490

SEQ ID NO: 534107 - RNA, 64 nt, hsa; identical to SEQ ID NO: 495491

SEQ ID NO: 534108 - RNA, 64 nt, hsa; identical to SEQ ID NO: 495492

SEQ ID NO: 534109 - RNA, 64 nt, hsa; identical to SEQ ID NO: 495493

SEQ ID NO: 534110 - RNA, 64 nt, hsa; identical to SEQ ID NO: 495494

SEQ ID NO: 534111 - RNA, 64 nt, hsa; identical to SEQ ID NO: 495495

SEQ ID NO: 534112 - RNA, 64 nt, hsa; identical to SEQ ID NO: 495496

SEQ ID NO: 534113 - RNA, 64 nt, hsa; identical to SEQ ID NO: 495497

SEQ ID NO: 534114 - RNA, 64 nt, hsa; identical to SEQ ID NO: 495498

SEQ ID NO: 534115 - RNA, 64 nt, hsa; identical to SEQ ID NO: 495499

SEQ ID NO: 534116 - RNA, 64 nt, hsa; identical to SEQ ID NO: 170352

SEQ ID NO: 534117 - RNA, 64 nt, hsa; identical to SEQ ID NO: 170353

SEQ ID NO: 534118 - RNA, 64 nt, hsa; identical to SEQ ID NO: 170354

SEQ ID NO: 534119 - RNA, 64 nt, hsa; identical to SEQ ID NO: 170355

SEQ ID NO: 534120 - RNA, 64 nt, hsa; identical to SEQ ID NO: 170356

SEQ ID NO: 534121 - RNA, 64 nt, hsa; identical to SEQ ID NO: 170357

SEQ ID NO: 534122 - RNA, 64 nt, hsa; identical to SEQ ID NO: 170358

SEQ ID NO: 534123 - RNA, 64 nt, hsa; identical to SEQ ID NO: 170359

SEQ ID NO: 534124 - RNA, 64 nt, hsa; identical to SEQ ID NO: 170360

SEQ ID NO: 534125 - RNA, 64 nt, hsa; identical to SEQ ID NO: 170361

SEQ ID NO: 534126 - RNA, 64 nt, hsa; identical to SEQ ID NO: 170362

SEQ ID NO: 534127 - RNA, 64 nt, hsa; identical to SEQ ID NO: 170363

SEQ ID NO: 534128 - RNA, 64 nt, hsa; identical to SEQ ID NO: 170364

SEQ ID NO: 534129 - RNA, 64 nt, hsa; identical to SEQ ID NO: 170365

SEQ ID NO: 534130 - RNA, 64 nt, hsa; identical to SEQ ID NO: 170366

SEQ ID NO: 534131 - RNA, 64 nt, hsa; identical to SEQ ID NO: 170367

SEQ ID NO: 534132 - RNA, 64 nt, hsa; identical to SEQ ID NO: 170368

SEQ ID NO: 534133 - RNA, 64 nt, hsa; identical to SEQ ID NO: 170369

SEQ ID NO: 534134 - RNA, 64 nt, hsa; identical to SEQ ID NO: 170370

SEQ ID NO: 534135 - RNA, 64 nt, hsa; identical to SEQ ID NO: 170371

SEQ ID NO: 534136 - RNA, 64 nt, hsa; identical to SEQ ID NO: 170372

SEQ ID NO: 534137 - RNA, 64 nt, hsa; identical to SEQ ID NO: 170373

SEQ ID NO: 534138 - RNA, 64 nt, hsa; identical to SEQ ID NO: 170374

SEQ ID NO: 534139 - RNA, 64 nt, hsa; identical to SEQ ID NO: 170375

SEQ ID NO: 534140 - RNA, 64 nt, hsa; identical to SEQ ID NO: 170376

SEQ ID NO: 534141 - RNA, 64 nt, hsa; identical to SEQ ID NO: 170377

SEQ ID NO: 534142 - RNA, 64 nt, hsa; identical to SEQ ID NO: 170378

SEQ ID NO: 534143 - RNA, 64 nt, hsa; identical to SEQ ID NO: 170379

SEQ ID NO: 534144 - RNA, 64 nt, hsa; identical to SEQ ID NO: 114692

SEQ ID NO: 534145 - RNA, 64 nt, hsa; identical to SEQ ID NO: 114693

SEQ ID NO: 534146 - RNA, 64 nt, hsa; identical to SEQ ID NO: 114694

SEQ ID NO: 534147 - RNA, 64 nt, hsa; identical to SEQ ID NO: 114695

SEQ ID NO: 534148 - RNA, 64 nt, hsa; identical to SEQ ID NO: 114696

SEQ ID NO: 534149 - RNA, 64 nt, hsa; identical to SEQ ID NO: 114697

SEQ ID NO: 534150 - RNA, 64 nt, hsa; identical to SEQ ID NO: 114698

SEQ ID NO: 534151 - RNA, 64 nt, hsa; identical to SEQ ID NO: 114699

SEQ ID NO: 534152 - RNA, 64 nt, hsa
agaagcaagagaccuuaaaggcuuccuaucccaccaauuacagggaaaaaacgugugaugaucc

SEQ ID NO: 534153 - RNA, 64 nt, hsa
uuuacaacuucaaagcuguuuuauacauagaaaucaauuacaguuuuaauugaaaacuauaacc

SEQ ID NO: 534154 - RNA, 64 nt, hsa
guuuuaaaacauaaggcauuugucugccauuuuucaauuacaugcugacuucccuuacaauuga

SEQ ID NO: 534155 - RNA, 64 nt, hsa
uuauauauauuuggcuuggaaauguguuuuucuucaauuacaucuacaaguaaguacagcugaa

SEQ ID NO: 534156 - RNA, 64 nt, hsa
uuacuuucuuguuuuuggaaaaacaaaauuucuacaauuacaguucccaaagucaguuauucau

SEQ ID NO: 534157 - RNA, 64 nt, hsa
uuacuuucuuguucuuggauaaagaaaauuucuacaauuacaguucccaaagacacaguuguuc

SEQ ID NO: 534158 - RNA, 64 nt, hsa; identical to SEQ ID NO: 42310

SEQ ID NO: 534159 - RNA, 64 nt, hsa; identical to SEQ ID NO: 42311

SEQ ID NO: 534160 - RNA, 64 nt, hsa; identical to SEQ ID NO: 42312

SEQ ID NO: 534161 - RNA, 64 nt, hsa; identical to SEQ ID NO: 42313

SEQ ID NO: 534162 - RNA, 64 nt, hsa; identical to SEQ ID NO: 42314

SEQ ID NO: 534163 - RNA, 64 nt, hsa; identical to SEQ ID NO: 42315

SEQ ID NO: 534164 - RNA, 64 nt, hsa; identical to SEQ ID NO: 42316

SEQ ID NO: 534165 - RNA, 64 nt, hsa; identical to SEQ ID NO: 298158

SEQ ID NO: 534166 - RNA, 64 nt, hsa; identical to SEQ ID NO: 298159

SEQ ID NO: 534167 - RNA, 64 nt, hsa; identical to SEQ ID NO: 298160

SEQ ID NO: 534168 - RNA, 64 nt, hsa; identical to SEQ ID NO: 298161

SEQ ID NO: 534169 - RNA, 64 nt, hsa; identical to SEQ ID NO: 298162

SEQ ID NO: 534170 - RNA, 64 nt, hsa; identical to SEQ ID NO: 298163

SEQ ID NO: 534171 - RNA, 64 nt, hsa; identical to SEQ ID NO: 298164

SEQ ID NO: 534172 - RNA, 64 nt, hsa; identical to SEQ ID NO: 298165

SEQ ID NO: 534173 - RNA, 64 nt, hsa; identical to SEQ ID NO: 298166

SEQ ID NO: 534174 - RNA, 64 nt, hsa; identical to SEQ ID NO: 298167

SEQ ID NO: 534175 - RNA, 64 nt, hsa; identical to SEQ ID NO: 298168

SEQ ID NO: 534176 - RNA, 64 nt, hsa; identical to SEQ ID NO: 298169

SEQ ID NO: 534177 - RNA, 64 nt, hsa; identical to SEQ ID NO: 298170

SEQ ID NO: 534178 - RNA, 64 nt, hsa; identical to SEQ ID NO: 298171

SEQ ID NO: 534179 - RNA, 64 nt, hsa; identical to SEQ ID NO: 298172

SEQ ID NO: 534180 - RNA, 64 nt, hsa; identical to SEQ ID NO: 298173

SEQ ID NO: 534181 - RNA, 64 nt, hsa; identical to SEQ ID NO: 298174

SEQ ID NO: 534182 - RNA, 64 nt, hsa; identical to SEQ ID NO: 298175

SEQ ID NO: 534183 - RNA, 64 nt, hsa; identical to SEQ ID NO: 298176

SEQ ID NO: 534184 - RNA, 64 nt, hsa; identical to SEQ ID NO: 298177

SEQ ID NO: 534185 - RNA, 64 nt, hsa; identical to SEQ ID NO: 298178

SEQ ID NO: 534186 - RNA, 64 nt, hsa; identical to SEQ ID NO: 298179

SEQ ID NO: 534187 - RNA, 64 nt, hsa; identical to SEQ ID NO: 298180

SEQ ID NO: 534188 - RNA, 64 nt, hsa; identical to SEQ ID NO: 298181

SEQ ID NO: 534189 - RNA, 64 nt, hsa; identical to SEQ ID NO: 298182

SEQ ID NO: 534190 - RNA, 64 nt, hsa; identical to SEQ ID NO: 298183

SEQ ID NO: 534191 - RNA, 64 nt, hsa; identical to SEQ ID NO: 298184

SEQ ID NO: 534192 - RNA, 64 nt, hsa; identical to SEQ ID NO: 298185

SEQ ID NO: 534193 - RNA, 64 nt, hsa; identical to SEQ ID NO: 298186

SEQ ID NO: 534194 - RNA, 64 nt, hsa; identical to SEQ ID NO: 298187

SEQ ID NO: 534195 - RNA, 64 nt, hsa; identical to SEQ ID NO: 298188

SEQ ID NO: 534196 - RNA, 64 nt, hsa; identical to SEQ ID NO: 298189

SEQ ID NO: 534197 - RNA, 64 nt, hsa; identical to SEQ ID NO: 298190

SEQ ID NO: 534198 - RNA, 64 nt, hsa; identical to SEQ ID NO: 298191

SEQ ID NO: 534199 - RNA, 64 nt, hsa; identical to SEQ ID NO: 298192

SEQ ID NO: 534200 - RNA, 64 nt, hsa; identical to SEQ ID NO: 298193

SEQ ID NO: 534201 - RNA, 64 nt, hsa; identical to SEQ ID NO: 298194

SEQ ID NO: 534202 - RNA, 64 nt, hsa; identical to SEQ ID NO: 298195

SEQ ID NO: 534203 - RNA, 64 nt, hsa; identical to SEQ ID NO: 298196

SEQ ID NO: 534204 - RNA, 64 nt, hsa; identical to SEQ ID NO: 298197

SEQ ID NO: 534205 - RNA, 64 nt, hsa; identical to SEQ ID NO: 298198

SEQ ID NO: 534206 - RNA, 64 nt, hsa; identical to SEQ ID NO: 298199

SEQ ID NO: 534207 - RNA, 64 nt, hsa; identical to SEQ ID NO: 298200

SEQ ID NO: 534208 - RNA, 64 nt, hsa; identical to SEQ ID NO: 298201

SEQ ID NO: 534209 - RNA, 64 nt, hsa; identical to SEQ ID NO: 298202

SEQ ID NO: 534210 - RNA, 64 nt, hsa; identical to SEQ ID NO: 298203

SEQ ID NO: 534211 - RNA, 64 nt, hsa; identical to SEQ ID NO: 298204

SEQ ID NO: 534212 - RNA, 64 nt, hsa; identical to SEQ ID NO: 298205

SEQ ID NO: 534213 - RNA, 64 nt, hsa; identical to SEQ ID NO: 298206

SEQ ID NO: 534214 - RNA, 64 nt, hsa; identical to SEQ ID NO: 298207

SEQ ID NO: 534215 - RNA, 64 nt, hsa; identical to SEQ ID NO: 298208

SEQ ID NO: 534216 - RNA, 64 nt, hsa; identical to SEQ ID NO: 298209

SEQ ID NO: 534217 - RNA, 64 nt, hsa; identical to SEQ ID NO: 298210

SEQ ID NO: 534218 - RNA, 64 nt, hsa; identical to SEQ ID NO: 298211

SEQ ID NO: 534219 - RNA, 64 nt, hsa; identical to SEQ ID NO: 298212

SEQ ID NO: 534220 - RNA, 64 nt, hsa; identical to SEQ ID NO: 298213

SEQ ID NO: 534221 - RNA, 64 nt, hsa; identical to SEQ ID NO: 298214

SEQ ID NO: 534222 - RNA, 64 nt, hsa; identical to SEQ ID NO: 298215

SEQ ID NO: 534223 - RNA, 64 nt, hsa; identical to SEQ ID NO: 298216

SEQ ID NO: 534224 - RNA, 64 nt, hsa; identical to SEQ ID NO: 298217

SEQ ID NO: 534225 - RNA, 64 nt, hsa; identical to SEQ ID NO: 298218

SEQ ID NO: 534226 - RNA, 64 nt, hsa; identical to SEQ ID NO: 298219

SEQ ID NO: 534227 - RNA, 64 nt, hsa; identical to SEQ ID NO: 298220

SEQ ID NO: 534228 - RNA, 64 nt, hsa; identical to SEQ ID NO: 298221

SEQ ID NO: 534229 - RNA, 64 nt, hsa; identical to SEQ ID NO: 298222

SEQ ID NO: 534230 - RNA, 64 nt, hsa; identical to SEQ ID NO: 298223

SEQ ID NO: 534231 - RNA, 64 nt, hsa; identical to SEQ ID NO: 298224

SEQ ID NO: 534232 - RNA, 64 nt, hsa; identical to SEQ ID NO: 298225

SEQ ID NO: 534233 - RNA, 64 nt, hsa; identical to SEQ ID NO: 298226

SEQ ID NO: 534234 - RNA, 64 nt, hsa; identical to SEQ ID NO: 298227

SEQ ID NO: 534235 - RNA, 64 nt, hsa; identical to SEQ ID NO: 298228

SEQ ID NO: 534236 - RNA, 64 nt, hsa; identical to SEQ ID NO: 298229

SEQ ID NO: 534237 - RNA, 56 nt, hsa; identical to SEQ ID NO: 298230

SEQ ID NO: 534238 - RNA, 64 nt, hsa; identical to SEQ ID NO: 298231

SEQ ID NO: 534239 - RNA, 64 nt, hsa; identical to SEQ ID NO: 298232

SEQ ID NO: 534240 - RNA, 64 nt, hsa; identical to SEQ ID NO: 298233

SEQ ID NO: 534241 - RNA, 64 nt, hsa; identical to SEQ ID NO: 298234

SEQ ID NO: 534242 - RNA, 64 nt, hsa; identical to SEQ ID NO: 298235

SEQ ID NO: 534243 - RNA, 64 nt, hsa; identical to SEQ ID NO: 298236

SEQ ID NO: 534244 - RNA, 64 nt, hsa; identical to SEQ ID NO: 298237

SEQ ID NO: 534245 - RNA, 64 nt, hsa; identical to SEQ ID NO: 298238

SEQ ID NO: 534246 - RNA, 63 nt, hsa; identical to SEQ ID NO: 298239

SEQ ID NO: 534247 - RNA, 64 nt, hsa; identical to SEQ ID NO: 298240

SEQ ID NO: 534248 - RNA, 64 nt, hsa; identical to SEQ ID NO: 298241

SEQ ID NO: 534249 - RNA, 64 nt, hsa; identical to SEQ ID NO: 298242

SEQ ID NO: 534250 - RNA, 64 nt, hsa; identical to SEQ ID NO: 298243

SEQ ID NO: 534251 - RNA, 64 nt, hsa; identical to SEQ ID NO: 298244

SEQ ID NO: 534252 - RNA, 64 nt, hsa; identical to SEQ ID NO: 298245

SEQ ID NO: 534253 - RNA, 64 nt, hsa; identical to SEQ ID NO: 298246

SEQ ID NO: 534254 - RNA, 64 nt, hsa; identical to SEQ ID NO: 298247

SEQ ID NO: 534255 - RNA, 64 nt, hsa; identical to SEQ ID NO: 298248

SEQ ID NO: 534256 - RNA, 64 nt, hsa; identical to SEQ ID NO: 298249

SEQ ID NO: 534257 - RNA, 64 nt, hsa; identical to SEQ ID NO: 287439

SEQ ID NO: 534258 - RNA, 64 nt, hsa; identical to SEQ ID NO: 287440

SEQ ID NO: 534259 - RNA, 64 nt, hsa; identical to SEQ ID NO: 287441

SEQ ID NO: 534260 - RNA, 64 nt, hsa; identical to SEQ ID NO: 287442

SEQ ID NO: 534261 - RNA, 64 nt, hsa; identical to SEQ ID NO: 287443

SEQ ID NO: 534262 - RNA, 64 nt, hsa; identical to SEQ ID NO: 287444

SEQ ID NO: 534263 - RNA, 64 nt, hsa; identical to SEQ ID NO: 287445

SEQ ID NO: 534264 - RNA, 64 nt, hsa; identical to SEQ ID NO: 287446

SEQ ID NO: 534265 - RNA, 64 nt, hsa; identical to SEQ ID NO: 287447

SEQ ID NO: 534266 - RNA, 64 nt, hsa; identical to SEQ ID NO: 287448

SEQ ID NO: 534267 - RNA, 64 nt, hsa; identical to SEQ ID NO: 287449

SEQ ID NO: 534268 - RNA, 64 nt, hsa; identical to SEQ ID NO: 287450

SEQ ID NO: 534269 - RNA, 64 nt, hsa; identical to SEQ ID NO: 287451

SEQ ID NO: 534270 - RNA, 64 nt, hsa; identical to SEQ ID NO: 287452

SEQ ID NO: 534271 - RNA, 64 nt, hsa; identical to SEQ ID NO: 287453

SEQ ID NO: 534272 - RNA, 64 nt, hsa; identical to SEQ ID NO: 287454

SEQ ID NO: 534273 - RNA, 64 nt, hsa; identical to SEQ ID NO: 287455

SEQ ID NO: 534274 - RNA, 64 nt, hsa; identical to SEQ ID NO: 287456

SEQ ID NO: 534275 - RNA, 64 nt, hsa; identical to SEQ ID NO: 287457

SEQ ID NO: 534276 - RNA, 64 nt, hsa; identical to SEQ ID NO: 287458

SEQ ID NO: 534277 - RNA, 64 nt, hsa; identical to SEQ ID NO: 287459

SEQ ID NO: 534278 - RNA, 64 nt, hsa; identical to SEQ ID NO: 287460

SEQ ID NO: 534279 - RNA, 64 nt, hsa; identical to SEQ ID NO: 287461

SEQ ID NO: 534280 - RNA, 64 nt, hsa; identical to SEQ ID NO: 287462

SEQ ID NO: 534281 - RNA, 64 nt, hsa; identical to SEQ ID NO: 287463

SEQ ID NO: 534282 - RNA, 64 nt, hsa; identical to SEQ ID NO: 287464

SEQ ID NO: 534283 - RNA, 64 nt, hsa; identical to SEQ ID NO: 287465

SEQ ID NO: 534284 - RNA, 64 nt, hsa; identical to SEQ ID NO: 287466

SEQ ID NO: 534285 - RNA, 64 nt, hsa; identical to SEQ ID NO: 287467

SEQ ID NO: 534286 - RNA, 64 nt, hsa; identical to SEQ ID NO: 287468

SEQ ID NO: 534287 - RNA, 64 nt, hsa; identical to SEQ ID NO: 287469

SEQ ID NO: 534288 - RNA, 64 nt, hsa; identical to SEQ ID NO: 287470

SEQ ID NO: 534289 - RNA, 64 nt, hsa; identical to SEQ ID NO: 287471

SEQ ID NO: 534290 - RNA, 64 nt, hsa; identical to SEQ ID NO: 287472

SEQ ID NO: 534291 - RNA, 64 nt, hsa; identical to SEQ ID NO: 287473

SEQ ID NO: 534292 - RNA, 64 nt, hsa; identical to SEQ ID NO: 287474

SEQ ID NO: 534293 - RNA, 64 nt, hsa; identical to SEQ ID NO: 287475

SEQ ID NO: 534294 - RNA, 64 nt, hsa; identical to SEQ ID NO: 287476

SEQ ID NO: 534295 - RNA, 64 nt, hsa; identical to SEQ ID NO: 287477

SEQ ID NO: 534296 - RNA, 64 nt, hsa; identical to SEQ ID NO: 287478

SEQ ID NO: 534297 - RNA, 64 nt, hsa; identical to SEQ ID NO: 287479

SEQ ID NO: 534298 - RNA, 64 nt, hsa; identical to SEQ ID NO: 287480

SEQ ID NO: 534299 - RNA, 64 nt, hsa; identical to SEQ ID NO: 287481

SEQ ID NO: 534300 - RNA, 64 nt, hsa; identical to SEQ ID NO: 287482

SEQ ID NO: 534301 - RNA, 64 nt, hsa; identical to SEQ ID NO: 287483

SEQ ID NO: 534302 - RNA, 64 nt, hsa; identical to SEQ ID NO: 287484

SEQ ID NO: 534303 - RNA, 64 nt, hsa; identical to SEQ ID NO: 287485

SEQ ID NO: 534304 - RNA, 64 nt, hsa; identical to SEQ ID NO: 287486

SEQ ID NO: 534305 - RNA, 64 nt, hsa; identical to SEQ ID NO: 287487

SEQ ID NO: 534306 - RNA, 64 nt, hsa
cugcugggcgagcagggcaggugcaggccgccugccccgccacgcuccugggccaacucugcac

SEQ ID NO: 534307 - RNA, 64 nt, hsa
gaucugaccugggcccaccaagguggacgcugggccccgccaggcuggagcccggagggucugc

SEQ ID NO: 534308 - RNA, 64 nt, hsa
cuuuguggagagaauguguguguguggcagggggccccgccagggcuggggacagaggguguca

SEQ ID NO: 534309 - RNA, 64 nt, hsa
gcaccgccacgucccagcaucccuggagcaggagccccgccacagccuucggacagacauaugg

SEQ ID NO: 534310 - RNA, 64 nt, hsa
cucuucacguucaucccugucucucccgggcugcccccgccagcucuggcuguuuagcuugagg

SEQ ID NO: 534311 - RNA, 64 nt, hsa
cccugaaggagcugagagggagcucaacuccccaccccgccacguggggagacagcccuuccca

SEQ ID NO: 534312 - RNA, 64 nt, hsa
gugucuguguguugauggguggcccaugagugacccccgccaggggagaccaggcuggcuggau

SEQ ID NO: 534313 - RNA, 64 nt, hsa
acaccaaaguguccacauuguaccaaagacugacccccgccagcuggggugcccaggggcaggg

SEQ ID NO: 534314 - RNA, 64 nt, hsa
ucagucaccgaagguccuacagggccacaacugcccccgccacaacccaccccgcuuucguagu

SEQ ID NO: 534315 - RNA, 64 nt, hsa
ugcugcuccacggcgcggagcccaacugcgccgaccccgccacucucacccgacccgugcacga

SEQ ID NO: 534316 - RNA, 64 nt, hsa
aguguggcaguccccacagcuccacaaugggcucccccgccaacggggacgacagggaucuuca

SEQ ID NO: 534317 - RNA, 64 nt, hsa
ugagguccccuaaucuguggccaccaccccccccccccgccacgccuuagagcagagcagcccc

SEQ ID NO: 534318 - RNA, 64 nt, hsa
gacacacacagacacacaaucacacgcagccccuccccgccacagagacacaccauuacauaca

SEQ ID NO: 534319 - RNA, 64 nt, hsa
gaaagacacagacacaaaaucacacacacacccuccccgccacagagacacaccauuacauaca

SEQ ID NO: 534320 - RNA, 64 nt, hsa
gacacacacagacacaaaaucacacacacacccuccccgccacagagacaccauuacauacaca

SEQ ID NO: 534321 - RNA, 64 nt, hsa
gucaccagacccuauugcuucaacagugcuuggcccccgccagcuugucccagccacucuagcu

SEQ ID NO: 534322 - RNA, 64 nt, hsa
aaggggcugcagcccuguugcaauuccaugcuucccccgccaaccagcuccugcugccaucccc

SEQ ID NO: 534323 - RNA, 64 nt, hsa
gucuuccuuccacccugcagcccguguccaggagccccgccaggugcccgcgccaggcccucag

SEQ ID NO: 534324 - RNA, 64 nt, hsa
gaccagcuggcggguguggagaccaggcuccugaccccgccaugcaugcagcgccaccuggaag

SEQ ID NO: 534325 - RNA, 64 nt, hsa
aggacagagagauggacaugcguccccucccuccccccgccaagugcucacacacaaccucacg

SEQ ID NO: 534326 - RNA, 64 nt, hsa
acacacgcagauggaggcgccucacugggaggugccccgccagcccugggcagugucaggcagg

SEQ ID NO: 534327 - RNA, 64 nt, hsa
gcagcgagauugcucugcagccagugagggagguccccgccaugccggcuggaagaagaaccuc

SEQ ID NO: 534328 - RNA, 64 nt, hsa
ucuguucagaugacagcgaccgccuuuucauuccccccgccaccuguacucacccucacgcucu

SEQ ID NO: 534329 - RNA, 64 nt, hsa
augugcuuuuccaguucuucuggaauugggggacccccgccaaagacugagcccccugucuccu

SEQ ID NO: 534330 - RNA, 64 nt, hsa
ccauguggauuuuggggggucccuuuugugucucccccgccauucaaggacuccucucuuucuu

SEQ ID NO: 534331 - RNA, 64 nt, hsa
gaagugcccccgccaucccgccaccaggacugcuccccgccagcacguccagagcaacuuaccc

SEQ ID NO: 534332 - RNA, 64 nt, hsa
cccggaucccgugcacccugggacccagaagugcccccgccaucccgccaccaggacugcuccc

SEQ ID NO: 534333 - RNA, 64 nt, hsa
gggcacugcccucccucacccauauugcaugcccccccgccauucccuuacaccuaccccaccu

SEQ ID NO: 534334 - RNA, 64 nt, hsa
cugcaugcccaguauugccaaggaccgggcccugccccgccacccuaccucccaccccagcagc

SEQ ID NO: 534335 - RNA, 64 nt, hsa; identical to SEQ ID NO: 138011

SEQ ID NO: 534336 - RNA, 64 nt, hsa; identical to SEQ ID NO: 138012

SEQ ID NO: 534337 - RNA, 64 nt, hsa; identical to SEQ ID NO: 138013

SEQ ID NO: 534338 - RNA, 64 nt, hsa; identical to SEQ ID NO: 138014

SEQ ID NO: 534339 - RNA, 64 nt, hsa; identical to SEQ ID NO: 138015

SEQ ID NO: 534340 - RNA, 59 nt, hsa; identical to SEQ ID NO: 138016

SEQ ID NO: 534341 - RNA, 64 nt, hsa; identical to SEQ ID NO: 138017

SEQ ID NO: 534342 - RNA, 64 nt, hsa; identical to SEQ ID NO: 138018

SEQ ID NO: 534343 - RNA, 64 nt, hsa; identical to SEQ ID NO: 138019

SEQ ID NO: 534344 - RNA, 64 nt, hsa; identical to SEQ ID NO: 138020

SEQ ID NO: 534345 - RNA, 64 nt, hsa; identical to SEQ ID NO: 138021

SEQ ID NO: 534346 - RNA, 64 nt, hsa; identical to SEQ ID NO: 138022

SEQ ID NO: 534347 - RNA, 64 nt, hsa; identical to SEQ ID NO: 138023

SEQ ID NO: 534348 - RNA, 64 nt, hsa; identical to SEQ ID NO: 138024

SEQ ID NO: 534349 - RNA, 64 nt, hsa; identical to SEQ ID NO: 138025

SEQ ID NO: 534350 - RNA, 64 nt, hsa; identical to SEQ ID NO: 138026

SEQ ID NO: 534351 - RNA, 64 nt, hsa; identical to SEQ ID NO: 138027

SEQ ID NO: 534352 - RNA, 64 nt, hsa; identical to SEQ ID NO: 138028

SEQ ID NO: 534353 - RNA, 64 nt, hsa; identical to SEQ ID NO: 138029

SEQ ID NO: 534354 - RNA, 64 nt, hsa; identical to SEQ ID NO: 138030

SEQ ID NO: 534355 - RNA, 64 nt, hsa; identical to SEQ ID NO: 138031

SEQ ID NO: 534356 - RNA, 64 nt, hsa; identical to SEQ ID NO: 138032

SEQ ID NO: 534357 - RNA, 64 nt, hsa; identical to SEQ ID NO: 138033

SEQ ID NO: 534358 - RNA, 64 nt, hsa; identical to SEQ ID NO: 138034

SEQ ID NO: 534359 - RNA, 64 nt, hsa; identical to SEQ ID NO: 138035

SEQ ID NO: 534360 - RNA, 64 nt, hsa; identical to SEQ ID NO: 138036

SEQ ID NO: 534361 - RNA, 64 nt, hsa; identical to SEQ ID NO: 138037

SEQ ID NO: 534362 - RNA, 64 nt, hsa; identical to SEQ ID NO: 138038

SEQ ID NO: 534363 - RNA, 64 nt, hsa; identical to SEQ ID NO: 138039

SEQ ID NO: 534364 - RNA, 64 nt, hsa; identical to SEQ ID NO: 138040

SEQ ID NO: 534365 - RNA, 64 nt, hsa; identical to SEQ ID NO: 138041

SEQ ID NO: 534366 - RNA, 64 nt, hsa; identical to SEQ ID NO: 138042

SEQ ID NO: 534367 - RNA, 64 nt, hsa; identical to SEQ ID NO: 138043

SEQ ID NO: 534368 - RNA, 64 nt, hsa; identical to SEQ ID NO: 138044

SEQ ID NO: 534369 - RNA, 64 nt, hsa; identical to SEQ ID NO: 138045

SEQ ID NO: 534370 - RNA, 64 nt, hsa; identical to SEQ ID NO: 138046

SEQ ID NO: 534371 - RNA, 64 nt, hsa; identical to SEQ ID NO: 138047

SEQ ID NO: 534372 - RNA, 64 nt, hsa; identical to SEQ ID NO: 138048

SEQ ID NO: 534373 - RNA, 64 nt, hsa; identical to SEQ ID NO: 138049

SEQ ID NO: 534374 - RNA, 64 nt, hsa; identical to SEQ ID NO: 138050

SEQ ID NO: 534375 - RNA, 64 nt, hsa; identical to SEQ ID NO: 138051

SEQ ID NO: 534376 - RNA, 64 nt, hsa; identical to SEQ ID NO: 138052

SEQ ID NO: 534377 - RNA, 64 nt, hsa; identical to SEQ ID NO: 138053

SEQ ID NO: 534378 - RNA, 64 nt, hsa; identical to SEQ ID NO: 138054

SEQ ID NO: 534379 - RNA, 64 nt, hsa; identical to SEQ ID NO: 138055

SEQ ID NO: 534380 - RNA, 64 nt, hsa; identical to SEQ ID NO: 138056

SEQ ID NO: 534381 - RNA, 64 nt, hsa; identical to SEQ ID NO: 138057

SEQ ID NO: 534382 - RNA, 64 nt, hsa; identical to SEQ ID NO: 138058

SEQ ID NO: 534383 - RNA, 64 nt, hsa; identical to SEQ ID NO: 138059

SEQ ID NO: 534384 - RNA, 64 nt, hsa; identical to SEQ ID NO: 138060

SEQ ID NO: 534385 - RNA, 64 nt, hsa; identical to SEQ ID NO: 138061

SEQ ID NO: 534386 - RNA, 64 nt, hsa; identical to SEQ ID NO: 138062

SEQ ID NO: 534387 - RNA, 64 nt, hsa; identical to SEQ ID NO: 138063

SEQ ID NO: 534388 - RNA, 64 nt, hsa; identical to SEQ ID NO: 138064

SEQ ID NO: 534389 - RNA, 64 nt, hsa; identical to SEQ ID NO: 138065

SEQ ID NO: 534390 - RNA, 64 nt, hsa; identical to SEQ ID NO: 138066

SEQ ID NO: 534391 - RNA, 64 nt, hsa; identical to SEQ ID NO: 369644

SEQ ID NO: 534392 - RNA, 64 nt, hsa; identical to SEQ ID NO: 369645

SEQ ID NO: 534393 - RNA, 64 nt, hsa; identical to SEQ ID NO: 369646

SEQ ID NO: 534394 - RNA, 64 nt, hsa; identical to SEQ ID NO: 369647

SEQ ID NO: 534395 - RNA, 64 nt, hsa; identical to SEQ ID NO: 369648

SEQ ID NO: 534396 - RNA, 64 nt, hsa; identical to SEQ ID NO: 369649

SEQ ID NO: 534397 - RNA, 64 nt, hsa; identical to SEQ ID NO: 369650

SEQ ID NO: 534398 - RNA, 64 nt, hsa; identical to SEQ ID NO: 369651

SEQ ID NO: 534399 - RNA, 64 nt, hsa; identical to SEQ ID NO: 390131

SEQ ID NO: 534400 - RNA, 64 nt, hsa; identical to SEQ ID NO: 390132

SEQ ID NO: 534401 - RNA, 64 nt, hsa; identical to SEQ ID NO: 390133

SEQ ID NO: 534402 - RNA, 64 nt, hsa; identical to SEQ ID NO: 390134

SEQ ID NO: 534403 - RNA, 64 nt, hsa; identical to SEQ ID NO: 390135

SEQ ID NO: 534404 - RNA, 64 nt, hsa; identical to SEQ ID NO: 390136

SEQ ID NO: 534405 - RNA, 64 nt, hsa; identical to SEQ ID NO: 390137

SEQ ID NO: 534406 - RNA, 64 nt, hsa; identical to SEQ ID NO: 390138

SEQ ID NO: 534407 - RNA, 64 nt, hsa; identical to SEQ ID NO: 390139

SEQ ID NO: 534408 - RNA, 64 nt, hsa; identical to SEQ ID NO: 390140

SEQ ID NO: 534409 - RNA, 64 nt, hsa; identical to SEQ ID NO: 390141

SEQ ID NO: 534410 - RNA, 64 nt, hsa; identical to SEQ ID NO: 390142

SEQ ID NO: 534411 - RNA, 64 nt, hsa; identical to SEQ ID NO: 390143

SEQ ID NO: 534412 - RNA, 57 nt, hsa; identical to SEQ ID NO: 390144

SEQ ID NO: 534413 - RNA, 64 nt, hsa; identical to SEQ ID NO: 390145

SEQ ID NO: 534414 - RNA, 64 nt, hsa; identical to SEQ ID NO: 390146

SEQ ID NO: 534415 - RNA, 64 nt, hsa; identical to SEQ ID NO: 390147

SEQ ID NO: 534416 - RNA, 64 nt, hsa; identical to SEQ ID NO: 390148

SEQ ID NO: 534417 - RNA, 64 nt, hsa; identical to SEQ ID NO: 390149

SEQ ID NO: 534418 - RNA, 64 nt, hsa; identical to SEQ ID NO: 390150

SEQ ID NO: 534419 - RNA, 64 nt, hsa; identical to SEQ ID NO: 390151

SEQ ID NO: 534420 - RNA, 64 nt, hsa; identical to SEQ ID NO: 390152

SEQ ID NO: 534421 - RNA, 64 nt, hsa; identical to SEQ ID NO: 390153

SEQ ID NO: 534422 - RNA, 64 nt, hsa; identical to SEQ ID NO: 390154

SEQ ID NO: 534423 - RNA, 64 nt, hsa; identical to SEQ ID NO: 390155

SEQ ID NO: 534424 - RNA, 64 nt, hsa; identical to SEQ ID NO: 390156

SEQ ID NO: 534425 - RNA, 64 nt, hsa; identical to SEQ ID NO: 390157

SEQ ID NO: 534426 - RNA, 64 nt, hsa; identical to SEQ ID NO: 390158

SEQ ID NO: 534427 - RNA, 64 nt, hsa; identical to SEQ ID NO: 390159

SEQ ID NO: 534428 - RNA, 64 nt, hsa; identical to SEQ ID NO: 390160

SEQ ID NO: 534429 - RNA, 64 nt, hsa; identical to SEQ ID NO: 390161

SEQ ID NO: 534430 - RNA, 64 nt, hsa; identical to SEQ ID NO: 390162

SEQ ID NO: 534431 - RNA, 64 nt, hsa; identical to SEQ ID NO: 390163

SEQ ID NO: 534432 - RNA, 64 nt, hsa; identical to SEQ ID NO: 390164

SEQ ID NO: 534433 - RNA, 64 nt, hsa; identical to SEQ ID NO: 390165

SEQ ID NO: 534434 - RNA, 64 nt, hsa; identical to SEQ ID NO: 390166

SEQ ID NO: 534435 - RNA, 64 nt, hsa; identical to SEQ ID NO: 390167

SEQ ID NO: 534436 - RNA, 64 nt, hsa; identical to SEQ ID NO: 390168

SEQ ID NO: 534437 - RNA, 64 nt, hsa; identical to SEQ ID NO: 390169

SEQ ID NO: 534438 - RNA, 64 nt, hsa; identical to SEQ ID NO: 390170

SEQ ID NO: 534439 - RNA, 64 nt, hsa; identical to SEQ ID NO: 390171

SEQ ID NO: 534440 - RNA, 64 nt, hsa; identical to SEQ ID NO: 390172

SEQ ID NO: 534441 - RNA, 64 nt, hsa; identical to SEQ ID NO: 390173

SEQ ID NO: 534442 - RNA, 64 nt, hsa; identical to SEQ ID NO: 390174

SEQ ID NO: 534443 - RNA, 64 nt, hsa; identical to SEQ ID NO: 390175

SEQ ID NO: 534444 - RNA, 64 nt, hsa; identical to SEQ ID NO: 390176

SEQ ID NO: 534445 - RNA, 64 nt, hsa; identical to SEQ ID NO: 390177

SEQ ID NO: 534446 - RNA, 64 nt, hsa; identical to SEQ ID NO: 390178

SEQ ID NO: 534447 - RNA, 64 nt, hsa; identical to SEQ ID NO: 390179

SEQ ID NO: 534448 - RNA, 64 nt, hsa; identical to SEQ ID NO: 390180

SEQ ID NO: 534449 - RNA, 64 nt, hsa; identical to SEQ ID NO: 390181

SEQ ID NO: 534450 - RNA, 64 nt, hsa; identical to SEQ ID NO: 390182

SEQ ID NO: 534451 - RNA, 64 nt, hsa; identical to SEQ ID NO: 390183

SEQ ID NO: 534452 - RNA, 64 nt, hsa; identical to SEQ ID NO: 390184

SEQ ID NO: 534453 - RNA, 64 nt, hsa; identical to SEQ ID NO: 390185

SEQ ID NO: 534454 - RNA, 64 nt, hsa; identical to SEQ ID NO: 390186

SEQ ID NO: 534455 - RNA, 64 nt, hsa; identical to SEQ ID NO: 390187

SEQ ID NO: 534456 - RNA, 64 nt, hsa; identical to SEQ ID NO: 390188

SEQ ID NO: 534457 - RNA, 64 nt, hsa; identical to SEQ ID NO: 390189

SEQ ID NO: 534458 - RNA, 64 nt, hsa; identical to SEQ ID NO: 390190

SEQ ID NO: 534459 - RNA, 64 nt, hsa; identical to SEQ ID NO: 390191

SEQ ID NO: 534460 - RNA, 64 nt, hsa; identical to SEQ ID NO: 390192

SEQ ID NO: 534461 - RNA, 64 nt, hsa; identical to SEQ ID NO: 390193

SEQ ID NO: 534462 - RNA, 64 nt, hsa; identical to SEQ ID NO: 390194

SEQ ID NO: 534463 - RNA, 64 nt, hsa; identical to SEQ ID NO: 390195

SEQ ID NO: 534464 - RNA, 64 nt, hsa; identical to SEQ ID NO: 390196

SEQ ID NO: 534465 - RNA, 64 nt, hsa; identical to SEQ ID NO: 390197

SEQ ID NO: 534466 - RNA, 64 nt, hsa; identical to SEQ ID NO: 390198

SEQ ID NO: 534467 - RNA, 64 nt, hsa; identical to SEQ ID NO: 390199

SEQ ID NO: 534468 - RNA, 64 nt, hsa; identical to SEQ ID NO: 390200

SEQ ID NO: 534469 - RNA, 64 nt, hsa; identical to SEQ ID NO: 390201

SEQ ID NO: 534470 - RNA, 64 nt, hsa; identical to SEQ ID NO: 390202

SEQ ID NO: 534471 - RNA, 64 nt, hsa; identical to SEQ ID NO: 390203

SEQ ID NO: 534472 - RNA, 64 nt, hsa; identical to SEQ ID NO: 390204

SEQ ID NO: 534473 - RNA, 60 nt, hsa; identical to SEQ ID NO: 390205

SEQ ID NO: 534474 - RNA, 64 nt, hsa; identical to SEQ ID NO: 390206

SEQ ID NO: 534475 - RNA, 64 nt, hsa; identical to SEQ ID NO: 390207

SEQ ID NO: 534476 - RNA, 64 nt, hsa; identical to SEQ ID NO: 390208

SEQ ID NO: 534477 - RNA, 64 nt, hsa; identical to SEQ ID NO: 390209

SEQ ID NO: 534478 - RNA, 64 nt, hsa; identical to SEQ ID NO: 390210

SEQ ID NO: 534479 - RNA, 64 nt, hsa; identical to SEQ ID NO: 390211

SEQ ID NO: 534480 - RNA, 64 nt, hsa; identical to SEQ ID NO: 390212

SEQ ID NO: 534481 - RNA, 64 nt, hsa; identical to SEQ ID NO: 390213

SEQ ID NO: 534482 - RNA, 64 nt, hsa; identical to SEQ ID NO: 390214

SEQ ID NO: 534483 - RNA, 64 nt, hsa; identical to SEQ ID NO: 390215

SEQ ID NO: 534484 - RNA, 64 nt, hsa; identical to SEQ ID NO: 390216

SEQ ID NO: 534485 - RNA, 64 nt, hsa; identical to SEQ ID NO: 390217

SEQ ID NO: 534486 - RNA, 64 nt, hsa; identical to SEQ ID NO: 390218

SEQ ID NO: 534487 - RNA, 64 nt, hsa; identical to SEQ ID NO: 390219

SEQ ID NO: 534488 - RNA, 64 nt, hsa; identical to SEQ ID NO: 390220

SEQ ID NO: 534489 - RNA, 64 nt, hsa; identical to SEQ ID NO: 390221

SEQ ID NO: 534490 - RNA, 64 nt, hsa; identical to SEQ ID NO: 390222

SEQ ID NO: 534491 - RNA, 64 nt, hsa; identical to SEQ ID NO: 390223

SEQ ID NO: 534492 - RNA, 64 nt, hsa; identical to SEQ ID NO: 390224

SEQ ID NO: 534493 - RNA, 64 nt, hsa; identical to SEQ ID NO: 390225

SEQ ID NO: 534494 - RNA, 64 nt, hsa; identical to SEQ ID NO: 390226

SEQ ID NO: 534495 - RNA, 64 nt, hsa; identical to SEQ ID NO: 390227

SEQ ID NO: 534496 - RNA, 64 nt, hsa; identical to SEQ ID NO: 390228

SEQ ID NO: 534497 - RNA, 64 nt, hsa; identical to SEQ ID NO: 390229

SEQ ID NO: 534498 - RNA, 64 nt, hsa; identical to SEQ ID NO: 390230

SEQ ID NO: 534499 - RNA, 64 nt, hsa; identical to SEQ ID NO: 390231

SEQ ID NO: 534500 - RNA, 64 nt, hsa; identical to SEQ ID NO: 390232

SEQ ID NO: 534501 - RNA, 64 nt, hsa; identical to SEQ ID NO: 390233

SEQ ID NO: 534502 - RNA, 64 nt, hsa; identical to SEQ ID NO: 390234

SEQ ID NO: 534503 - RNA, 64 nt, hsa; identical to SEQ ID NO: 390235

SEQ ID NO: 534504 - RNA, 64 nt, hsa; identical to SEQ ID NO: 390236

SEQ ID NO: 534505 - RNA, 64 nt, hsa; identical to SEQ ID NO: 390237

SEQ ID NO: 534506 - RNA, 64 nt, hsa; identical to SEQ ID NO: 390238

SEQ ID NO: 534507 - RNA, 64 nt, hsa; identical to SEQ ID NO: 390239

SEQ ID NO: 534508 - RNA, 64 nt, hsa; identical to SEQ ID NO: 390240

SEQ ID NO: 534509 - RNA, 64 nt, hsa; identical to SEQ ID NO: 390241

SEQ ID NO: 534510 - RNA, 64 nt, hsa; identical to SEQ ID NO: 390242

SEQ ID NO: 534511 - RNA, 64 nt, hsa; identical to SEQ ID NO: 390243

SEQ ID NO: 534512 - RNA, 64 nt, hsa; identical to SEQ ID NO: 390244

SEQ ID NO: 534513 - RNA, 64 nt, hsa; identical to SEQ ID NO: 390245

SEQ ID NO: 534514 - RNA, 64 nt, hsa; identical to SEQ ID NO: 390246

SEQ ID NO: 534515 - RNA, 64 nt, hsa; identical to SEQ ID NO: 390247

SEQ ID NO: 534516 - RNA, 64 nt, hsa; identical to SEQ ID NO: 390248

SEQ ID NO: 534517 - RNA, 64 nt, hsa; identical to SEQ ID NO: 390249

SEQ ID NO: 534518 - RNA, 64 nt, hsa; identical to SEQ ID NO: 390250

SEQ ID NO: 534519 - RNA, 64 nt, hsa; identical to SEQ ID NO: 390251

SEQ ID NO: 534520 - RNA, 64 nt, hsa; identical to SEQ ID NO: 390252

SEQ ID NO: 534521 - RNA, 64 nt, hsa; identical to SEQ ID NO: 390253

SEQ ID NO: 534522 - RNA, 64 nt, hsa; identical to SEQ ID NO: 390254

SEQ ID NO: 534523 - RNA, 64 nt, hsa; identical to SEQ ID NO: 390255

SEQ ID NO: 534524 - RNA, 64 nt, hsa; identical to SEQ ID NO: 390256

SEQ ID NO: 534525 - RNA, 64 nt, hsa; identical to SEQ ID NO: 390257

SEQ ID NO: 534526 - RNA, 64 nt, hsa; identical to SEQ ID NO: 390258

SEQ ID NO: 534527 - RNA, 64 nt, hsa; identical to SEQ ID NO: 390259

SEQ ID NO: 534528 - RNA, 64 nt, hsa; identical to SEQ ID NO: 163578

SEQ ID NO: 534529 - RNA, 64 nt, hsa; identical to SEQ ID NO: 163579

SEQ ID NO: 534530 - RNA, 64 nt, hsa; identical to SEQ ID NO: 163580

SEQ ID NO: 534531 - RNA, 64 nt, hsa; identical to SEQ ID NO: 163581

SEQ ID NO: 534532 - RNA, 64 nt, hsa; identical to SEQ ID NO: 163582

SEQ ID NO: 534533 - RNA, 64 nt, hsa; identical to SEQ ID NO: 163583

SEQ ID NO: 534534 - RNA, 64 nt, hsa; identical to SEQ ID NO: 163584

SEQ ID NO: 534535 - RNA, 64 nt, hsa; identical to SEQ ID NO: 163585

SEQ ID NO: 534536 - RNA, 64 nt, hsa; identical to SEQ ID NO: 163586

SEQ ID NO: 534537 - RNA, 64 nt, hsa; identical to SEQ ID NO: 163587

SEQ ID NO: 534538 - RNA, 64 nt, hsa; identical to SEQ ID NO: 163588

SEQ ID NO: 534539 - RNA, 64 nt, hsa; identical to SEQ ID NO: 163589

SEQ ID NO: 534540 - RNA, 64 nt, hsa; identical to SEQ ID NO: 163590

SEQ ID NO: 534541 - RNA, 64 nt, hsa; identical to SEQ ID NO: 163591

SEQ ID NO: 534542 - RNA, 64 nt, hsa; identical to SEQ ID NO: 163592

SEQ ID NO: 534543 - RNA, 64 nt, hsa; identical to SEQ ID NO: 163593

SEQ ID NO: 534544 - RNA, 64 nt, hsa; identical to SEQ ID NO: 163594

SEQ ID NO: 534545 - RNA, 64 nt, hsa; identical to SEQ ID NO: 163595

SEQ ID NO: 534546 - RNA, 64 nt, hsa; identical to SEQ ID NO: 163596

SEQ ID NO: 534547 - RNA, 64 nt, hsa; identical to SEQ ID NO: 163597

SEQ ID NO: 534548 - RNA, 64 nt, hsa; identical to SEQ ID NO: 163598

SEQ ID NO: 534549 - RNA, 64 nt, hsa; identical to SEQ ID NO: 163599

SEQ ID NO: 534550 - RNA, 64 nt, hsa; identical to SEQ ID NO: 163600

SEQ ID NO: 534551 - RNA, 64 nt, hsa; identical to SEQ ID NO: 163601

SEQ ID NO: 534552 - RNA, 54 nt, hsa; identical to SEQ ID NO: 163602

SEQ ID NO: 534553 - RNA, 64 nt, hsa; identical to SEQ ID NO: 163603

SEQ ID NO: 534554 - RNA, 64 nt, hsa; identical to SEQ ID NO: 163604

SEQ ID NO: 534555 - RNA, 64 nt, hsa; identical to SEQ ID NO: 163605

SEQ ID NO: 534556 - RNA, 64 nt, hsa; identical to SEQ ID NO: 163606

SEQ ID NO: 534557 - RNA, 64 nt, hsa; identical to SEQ ID NO: 163607

SEQ ID NO: 534558 - RNA, 64 nt, hsa; identical to SEQ ID NO: 163608

SEQ ID NO: 534559 - RNA, 64 nt, hsa; identical to SEQ ID NO: 163609

SEQ ID NO: 534560 - RNA, 64 nt, hsa; identical to SEQ ID NO: 163610

SEQ ID NO: 534561 - RNA, 64 nt, hsa; identical to SEQ ID NO: 163611

SEQ ID NO: 534562 - RNA, 63 nt, hsa; identical to SEQ ID NO: 163612

SEQ ID NO: 534563 - RNA, 64 nt, hsa; identical to SEQ ID NO: 163613

SEQ ID NO: 534564 - RNA, 64 nt, hsa; identical to SEQ ID NO: 163614

SEQ ID NO: 534565 - RNA, 64 nt, hsa; identical to SEQ ID NO: 163615

SEQ ID NO: 534566 - RNA, 64 nt, hsa; identical to SEQ ID NO: 163616

SEQ ID NO: 534567 - RNA, 64 nt, hsa; identical to SEQ ID NO: 163617

SEQ ID NO: 534568 - RNA, 64 nt, hsa; identical to SEQ ID NO: 163618

SEQ ID NO: 534569 - RNA, 64 nt, hsa; identical to SEQ ID NO: 163619

SEQ ID NO: 534570 - RNA, 64 nt, hsa; identical to SEQ ID NO: 163620

SEQ ID NO: 534571 - RNA, 64 nt, hsa; identical to SEQ ID NO: 163621

SEQ ID NO: 534572 - RNA, 64 nt, hsa; identical to SEQ ID NO: 474151

SEQ ID NO: 534573 - RNA, 64 nt, hsa; identical to SEQ ID NO: 474152

SEQ ID NO: 534574 - RNA, 64 nt, hsa; identical to SEQ ID NO: 474153

SEQ ID NO: 534575 - RNA, 64 nt, hsa; identical to SEQ ID NO: 474154

SEQ ID NO: 534576 - RNA, 64 nt, hsa; identical to SEQ ID NO: 474155

SEQ ID NO: 534577 - RNA, 64 nt, hsa; identical to SEQ ID NO: 474156

SEQ ID NO: 534578 - RNA, 64 nt, hsa; identical to SEQ ID NO: 474157

SEQ ID NO: 534579 - RNA, 64 nt, hsa; identical to SEQ ID NO: 474158

SEQ ID NO: 534580 - RNA, 64 nt, hsa; identical to SEQ ID NO: 474159

SEQ ID NO: 534581 - RNA, 64 nt, hsa; identical to SEQ ID NO: 474160

SEQ ID NO: 534582 - RNA, 64 nt, hsa
ggagaauuucaggucuccacgucugcccaggaaagaacuucagcugacuccacggggaucugga

SEQ ID NO: 534583 - RNA, 64 nt, hsa
aauucuccaucaacaucacagucagcuggcagcugaacuucagaaucucacuuacagcaggcga

SEQ ID NO: 534584 - RNA, 64 nt, hsa
augauuauguguccuuucuugauggcuguaaugagaacuucaaucacuguagucuaagaccuga

SEQ ID NO: 534585 - RNA, 64 nt, hsa
ggcagcaguuccaugaagacacgcuuaaaaccuagaacuucaaaauguucguauucuauucaaa

SEQ ID NO: 534586 - RNA, 64 nt, hsa
ucauaauguuccagggauucagaagcaacgcuaugaacuucagcugacuuguuacuuaaaaauu

SEQ ID NO: 534587 - RNA, 64 nt, hsa
augguaauaggaaaacaaaacccaaagcuuuucagaacuucagugugagguuuccuauuuugac

SEQ ID NO: 534588 - RNA, 64 nt, hsa
gauacccacuuuucaggaugggacaguaucagaugaacuucaacccauggagaacaagccucaa

SEQ ID NO: 534589 - RNA, 64 nt, hsa
agacaggaaacgaauauggacguaauugcagaaggaacuucaaggagaugaaugaaugcuaaaa

SEQ ID NO: 534590 - RNA, 64 nt, hsa
uacuuguucuagguccaucuaaauggucuacagagaacuucaguugaaucauagcuggaaacag

SEQ ID NO: 534591 - RNA, 64 nt, hsa
ccaaaccuaagauuuuagccucaacuucuuuucugaacuucaaaucuuaauuuccaaguuauac

SEQ ID NO: 534592 - RNA, 64 nt, hsa
ugaccuuuacuuuucucuaguuucaguccagaaagaacuucauauuuagagcuaaggccacuga

SEQ ID NO: 534593 - RNA, 64 nt, hsa
ucagagcagaucucccuuacugucaggggauauggaacuucaaaggcccacauggcaagccagg

SEQ ID NO: 534594 - RNA, 64 nt, hsa
cuaccaugcccuugauauaucuuuugcaccugcugaacuucauuucuguaucaccugaccucug

SEQ ID NO: 534595 - RNA, 64 nt, hsa
ugccaaacacuguugugccauguggaacugagaagaacuucacaaauggaaugguuaaugguca

SEQ ID NO: 534596 - RNA, 64 nt, hsa
caagugguacuguuauaaugacagcagcugugaggaacuucacccugaugaaauugacaccgac

SEQ ID NO: 534597 - RNA, 64 nt, hsa
gcccucaccauuugccuaaggagguagcagcaaucccuaauauauauauauagugagaacuaaa

SEQ ID NO: 534598 - RNA, 64 nt, hsa
uugccaagcaauuagccuuaaguugugcuagcaacccuaauaggugaugcagauaauagccuac

SEQ ID NO: 534599 - RNA, 64 nt, hsa
uucauuugaaaucuaggagucaaauggaaagauccccuaauaauacaccuauuucacuaacuug

SEQ ID NO: 534600 - RNA, 64 nt, hsa
ucggcugcagccaucccccucauuuuaaauguugcccuaauaaucaaugcaguuaacaaguaua

SEQ ID NO: 534601 - RNA, 64 nt, hsa
ggugauuucccgugugacauauuuucuucauagucccuaauauagucauccucuacagaguugg

SEQ ID NO: 534602 - RNA, 64 nt, hsa
uagacagcucuccccuacuagguugggucauuuccccuaauaacuauagagagacuguguuuca

SEQ ID NO: 534603 - RNA, 64 nt, hsa; identical to SEQ ID NO: 21758

SEQ ID NO: 534604 - RNA, 64 nt, hsa; identical to SEQ ID NO: 21759

SEQ ID NO: 534605 - RNA, 64 nt, hsa; identical to SEQ ID NO: 21760

SEQ ID NO: 534606 - RNA, 64 nt, hsa; identical to SEQ ID NO: 21761

SEQ ID NO: 534607 - RNA, 64 nt, hsa; identical to SEQ ID NO: 21762

SEQ ID NO: 534608 - RNA, 64 nt, hsa; identical to SEQ ID NO: 21763

SEQ ID NO: 534609 - RNA, 64 nt, hsa; identical to SEQ ID NO: 21764

SEQ ID NO: 534610 - RNA, 64 nt, hsa; identical to SEQ ID NO: 21765

SEQ ID NO: 534611 - RNA, 64 nt, hsa; identical to SEQ ID NO: 21766

SEQ ID NO: 534612 - RNA, 64 nt, hsa; identical to SEQ ID NO: 21767

SEQ ID NO: 534613 - RNA, 64 nt, hsa; identical to SEQ ID NO: 21768

SEQ ID NO: 534614 - RNA, 64 nt, hsa; identical to SEQ ID NO: 21769

SEQ ID NO: 534615 - RNA, 64 nt, hsa; identical to SEQ ID NO: 21770

SEQ ID NO: 534616 - RNA, 64 nt, hsa; identical to SEQ ID NO: 21771

SEQ ID NO: 534617 - RNA, 64 nt, hsa; identical to SEQ ID NO: 21772

SEQ ID NO: 534618 - RNA, 64 nt, hsa; identical to SEQ ID NO: 21773

SEQ ID NO: 534619 - RNA, 64 nt, hsa; identical to SEQ ID NO: 21774

SEQ ID NO: 534620 - RNA, 64 nt, hsa; identical to SEQ ID NO: 21775

SEQ ID NO: 534621 - RNA, 64 nt, hsa; identical to SEQ ID NO: 21775

SEQ ID NO: 534622 - RNA, 64 nt, hsa; identical to SEQ ID NO: 21777

SEQ ID NO: 534623 - RNA, 64 nt, hsa; identical to SEQ ID NO: 21778

SEQ ID NO: 534624 - RNA, 64 nt, hsa; identical to SEQ ID NO: 21779

SEQ ID NO: 534625 - RNA, 64 nt, hsa; identical to SEQ ID NO: 21780

SEQ ID NO: 534626 - RNA, 64 nt, hsa; identical to SEQ ID NO: 21781

SEQ ID NO: 534627 - RNA, 64 nt, hsa
cuaccaucagggacaggaugaccuggauaacuuagguggcaagcugugacuucuccaggucuca

SEQ ID NO: 534628 - RNA, 64 nt, hsa
cuucuccaggucucacgggcaugggcacucccuugguggcaagagcccccuugacaccggggug

SEQ ID NO: 534629 - RNA, 64 nt, hsa
ucuuguaauuuuuauuuaggaaguguugaagggagguggcaagaguguggaggcugacguguga

SEQ ID NO: 534630 - RNA, 64 nt, hsa
ccuggauguuguguguaucgagaggccaaaggcugguggcaagugcacggggcacagcggaguc

SEQ ID NO: 534631 - RNA, 64 nt, hsa
aagcaaaauaucacaucucuagaaguguugggaaaaauauaauuucuuucuuuacuuauauuca

SEQ ID NO: 534632 - RNA, 64 nt, hsa
uaaaguaguggauuuuucugaguaaauuugcugaaaauauaagagagaagcuaucuaauaccuu

SEQ ID NO: 534633 - RNA, 64 nt, hsa
caaaucuuaauuuggauuuaaggaagaaaucaauaaauauaaaauauaagcacauauuuauuau

SEQ ID NO: 534634 - RNA, 64 nt, hsa
uaauuuggauuuaaggaagaaaucaauaaauauaaaauauaagcacauauuuauuauauaucua

SEQ ID NO: 534635 - RNA, 64 nt, hsa
uuacaaaaugaacucauuuuauuuucccaccuucaaauauaaguauuaucaucuaucuguuuau

SEQ ID NO: 534636 - RNA, 64 nt, hsa
uauggacuuucucagauuaggaaauaccaauuaaaaauauaauaaauagcuacauugauuucug

SEQ ID NO: 534637 - RNA, 64 nt, hsa
auuuccucuguaauuucaacagagaucagcaaauaaauauaaccaaagauuguccauuacuccc

SEQ ID NO: 534638 - RNA, 64 nt, hsa
uuaaauguuuauguuuuaagaaugaacacuuuucaaauauaaaacuauauaauaauuauaaucc

SEQ ID NO: 534639 - RNA, 64 nt, hsa
cuuuuuaaaauaauuauacuugcacaugaaaauaaaauauaaagucaauaauaguccuuguagc

SEQ ID NO: 534640 - RNA, 64 nt, hsa
aaugcaaaucaugcagaauuugaguuauaaauuuaaauauaaauugaccauugaugauauccag

SEQ ID NO: 534641 - RNA, 64 nt, hsa
aauaugccugcaucguguuggggaaauguuugggaaauauaagccagcauaacguguaaagcuc

SEQ ID NO: 534642 - RNA, 64 nt, hsa
auucuaaauccuaguaaaauugacagugauuuuuaaauauaaugcaucuuccuuugucugcuua

SEQ ID NO: 534643 - RNA, 64 nt, hsa
auuuucuucguuuuaauagaauauuauaaacucaaaauauaaauuuuuuucaaauuuggaguuu

SEQ ID NO: 534644 - RNA, 64 nt, hsa
aauuuauaaaguaaaaagauuuuauaaggaaaacaaauauaauaaccagugcugugaaaugcag

SEQ ID NO: 534645 - RNA, 64 nt, hsa
uauuauacucuugauuuuucuaaauuugugugugaaauauaacauugauugaauugcaguuaca

SEQ ID NO: 534646 - RNA, 64 nt, hsa
gauugacuuugggaauuugaauuuucaucagugcaaauauaaauuucucuauccugcucugagg

SEQ ID NO: 534647 - RNA, 64 nt, hsa
cacaauaagcuggaaguuuguuguaguaugccucaaauauaacugacuguauacuauaguggua

SEQ ID NO: 534648 - RNA, 64 nt, hsa
uuacuuugguuccuguugugcucuuguaaaagaaaaauauaauuuccugaagaauaaaauagau

SEQ ID NO: 534649 - RNA, 64 nt, hsa
cugugaacauaaguguuuauuaaaaauggcaauuaaauauaaauuacuuuugugggggaaugcc

SEQ ID NO: 534650 - RNA, 64 nt, hsa
ccuagcaauaaaaucuaauuuuuaaaaaguauauaaauauaaaauguauaaaugauggauagau

SEQ ID NO: 534651 - RNA, 64 nt, hsa
caugcuguauuauuacuucucauucaagauugaaaaauauaaagguauccaaacucugucuuaa

SEQ ID NO: 534652 - RNA, 64 nt, hsa
gagguagcugcucuccccacugagagcugagccgaaauauaagaauaauauauuugugcuucga

SEQ ID NO: 534653 - RNA, 64 nt, hsa
gcaauaguuauauuuaggugguagaacauagcaaaaauauaaccgaaaguuggccgacugcacu

SEQ ID NO: 534654 - RNA, 64 nt, hsa
cagugauaucuuuuauaugcuguauaaauguauaaaauauaaggauuacuuuuguauguuccaa

SEQ ID NO: 534655 - RNA, 64 nt, hsa
auuuuuuuaauuccugcugcacuaaagcuauuacaaauauaacauggacuuuguucuuuuuagc

SEQ ID NO: 534656 - RNA, 64 nt, hsa
augucuaaaacuuguuuaaauauaaauaauguaaaaauauaaucaacuuuauuugucagcauuu

SEQ ID NO: 534657 - RNA, 64 nt, hsa
cauauuuugcuaaaaauaugucuaaaacuuguuuaaauauaaauaauguaaaaauauaaucaac

SEQ ID NO: 534658 - RNA, 64 nt, hsa
auaagauagcacauugacuuuuaaagggaaaaguaaauauaacuuagcauguaaacucauuucg

SEQ ID NO: 534659 - RNA, 64 nt, hsa
accugcucucucuauagagaaggaaauaaaauauaaauauaagauuaacacaguggaaggacaa

SEQ ID NO: 534660 - RNA, 64 nt, hsa
guuuuuaccugcucucucuauagagaaggaaauaaaauauaaauauaagauuaacacaguggaa

SEQ ID NO: 534661 - RNA, 64 nt, hsa
ccugaccaacauggugaaaugccaucuccacuaaaaauauaaaaauuagccaggcaugguggug

SEQ ID NO: 534662 - RNA, 64 nt, hsa
cccagguacuauugaaguaauaagaaauaugauaaaauauaauacuuuaaagucccaguagaaa

SEQ ID NO: 534663 - RNA, 64 nt, hsa
cauagagagguaagcauuaguggcacagcugagaaaauauaaaagguaguucugucucuauccu

SEQ ID NO: 534664 - RNA, 64 nt, hsa
cuauuucuuguuguaaaacagauguuuguuucuaaaauauaaugaauuaaugauuaucaaagua

SEQ ID NO: 534665 - RNA, 64 nt, hsa
gagccuuggauguuccuguggaccugacaguuaaaaauauaaagaaccuaggauucaauuccaa

SEQ ID NO: 534666 - RNA, 64 nt, hsa
aaugacaggagucaaucagccuuuacagcuaucaaaauauaaugagaucccaaugaugauucuu

SEQ ID NO: 534667 - RNA, 64 nt, hsa
auguggaacaccaaacaggaaagaacuaugucugaaauauaaaaaauaaaaauaaaaaaacaac

SEQ ID NO: 534668 - RNA, 64 nt, hsa
auguucuuuucaaucccaucuagauaauuuauagaaauauaacccuaauuggacaugugguaca

SEQ ID NO: 534669 - RNA, 64 nt, hsa
ucucuaagguuuacaauaggaguggugauuugaaaaauauaaaauuaugagauugguuuuccug

SEQ ID NO: 534670 - RNA, 64 nt, hsa
aaacauguuaaugacaauauuccagaucuuucagaaauauaacacauuuuuuugcaugcaugca

SEQ ID NO: 534671 - RNA, 64 nt, hsa
uaacauauauauauauauacauauauauaaauauaaauauaaauauaucucauugcagccagug

SEQ ID NO: 534672 - RNA, 64 nt, hsa
uguacauaacauauauauauauauacauauauauaaauauaaauauaaauauaucucauugcag

SEQ ID NO: 534673 - RNA, 64 nt, hsa
uuugcuuuauuauuguuuucuucugguaaauaauaaauauaacagaaguguuaacuauuguauu

SEQ ID NO: 534674 - RNA, 64 nt, hsa
aaguaggggcugaagaggaagguggaaggagauaaaauauaauauuuagaggcaauauuuucua

SEQ ID NO: 534675 - RNA, 64 nt, hsa
uacaggauggaaaaaggucauauccuuugucaggaaauauaaacuugaaaguauguagucagcu

SEQ ID NO: 534676 - RNA, 64 nt, hsa
gucaggcccuucaaagaugauauguggaggaauuaaauauaaaggaauuggagguuuuugcuaa

SEQ ID NO: 534677 - RNA, 64 nt, hsa
aacugcauuaccgcguuguaaaauauagcuguacaaauauaagaauaaaauguugaaaagucaa

SEQ ID NO: 534678 - RNA, 64 nt, hsa
auaaauauauauaaaccuaaaaaagauauauuaaaaauauaaaacugcguuaaaggcucgauuu

SEQ ID NO: 534679 - RNA, 64 nt, hsa
uggcaaagcauuuaauugguccucaaugcuuaauaaauauaauucaugcuggagagaaacuuca

SEQ ID NO: 534680 - RNA, 64 nt, hsa
gugacaaagcuugcaaccacacucaaucuauucuaaauauaagagaaaugauauuggugagaag

SEQ ID NO: 534681 - RNA, 64 nt, hsa
acaugauauccuuuauauucgagaaaaguuauagaaauauaaaaaauauagaaaagucauaucu

SEQ ID NO: 534682 - RNA, 64 nt, hsa
uccauuuucaaggugcagaacaaggagugaaagaaaauauaagaagaaaaaaauccccuacauu

SEQ ID NO: 534683 - RNA, 64 nt, hsa
acauuguuacugaggaugucaacauauaacaauaaaauauaaaucacccauuugcuugacauua

SEQ ID NO: 534684 - RNA, 64 nt, hsa
uugguucccaugaaaguuaguaagaugcccuuuuaaauauaaggaucagugcuuuguucugcag

SEQ ID NO: 534685 - RNA, 64 nt, hsa
ugguuuucuuauccuuugauaaaagcaucccauaaaauauaaaguaguaaguuaacauaguauu

SEQ ID NO: 534686 - RNA, 64 nt, hsa
uauuugaaucuacaaaaaacaacaaauaauuuuuaaauauaaggauuuuccuagauauugcacg

SEQ ID NO: 534687 - RNA, 64 nt, hsa
cuccaaauuuuuuuuacuguuucugauuguauggaaauauaaaaguaaauaugaaacauuuaaa

SEQ ID NO: 534688 - RNA, 64 nt, hsa
guauggaaauauaaaaguaaauaugaaacauuuaaaauauaauuuguugucaaaguaaucaagu

SEQ ID NO: 534689 - RNA, 64 nt, hsa
cuuacuucuucucauacuauuuaagagaacaagcaaauauaaacagcaacuuguguuccuaaca

SEQ ID NO: 534690 - RNA, 64 nt, hsa
ucaaaguuaagaaucuuuauaguucuacuccauuaaauauaaagcaagauaauaaaaauuguug

SEQ ID NO: 534691 - RNA, 64 nt, hsa
guggcugggauaugauggguuagaagcaaggagaaaauauaaggacuuuuugauggaauuaaau

SEQ ID NO: 534692 - RNA, 64 nt, hsa
uaauuaaaugaacuuauguacagaaaacauguauaaauauaagucuauacuaaugcuuacaacu

SEQ ID NO: 534693 - RNA, 64 nt, hsa
acacaaacuaauauaaaguuauaguuauaucuuaaaauauaauugaagaagcauaugacauaua

SEQ ID NO: 534694 - RNA, 64 nt, hsa
guuaaguagaaaaauuuuaaaaauuugcuuaugaaaauauaacccccagaaaguaacaaugaca

SEQ ID NO: 534695 - RNA, 64 nt, hsa
uacucuugugacauuuuuuugguuaucaacaacuaaauauaaauuacuuuggaaaaaguaaggc

SEQ ID NO: 534696 - RNA, 64 nt, hsa
aaaauaaaaguugaacuugaguuacauuuaauuuaaauauaaaugcauuuugagaaauguuaag

SEQ ID NO: 534697 - RNA, 64 nt, hsa
caugucuuucucauauuucagaggaaagauuauaaaauauaaaauuucuuagagaacaccucuu

SEQ ID NO: 534698 - RNA, 64 nt, hsa
uugaaagcuaaaaauagguucuaaaguaauguaaaaauauaaagcacaaauauacuugaauauu

SEQ ID NO: 534699 - RNA, 64 nt, hsa
accuuaauuuguuuuccagaaucaaaagaaaauaaaauauaaauuuugaaacuaugagaacaua

SEQ ID NO: 534700 - RNA, 64 nt, hsa
auuguugguaaacuaaucauuuuauuauauauaaaaauauaaaugucuuuauuaauauuuuauu

SEQ ID NO: 534701 - RNA, 64 nt, hsa
cagagaugguaaucuacagcucaccucugaaggcaaauauaagcugggaaaaaaguuuugauga

SEQ ID NO: 534702 - RNA, 64 nt, hsa
ccgcaggcuauuuguucagagaggccuuuuguuuaaauauaaauguuuaaauauaaauguuugu

SEQ ID NO: 534703 - RNA, 64 nt, hsa
uucagagaggccuuuuguuuaaauauaaauguuuaaauauaaauguuugucuggauuggcuaua

SEQ ID NO: 534704 - RNA, 64 nt, hsa
ugaugaggcauuucuuacuagaaucccauaagugaaauauaauauuuuucaaaguugauaucau

SEQ ID NO: 534705 - RNA, 64 nt, hsa
uucuaguuucccggcauugauaguucccuauuugaaauauaauguuucucuuguaagugauaug

SEQ ID NO: 534706 - RNA, 64 nt, hsa
uaagagcaaaacuccaucaaaauaaaauaaaauaaaauauaaaauaacuuaaaaagaacuuuga

SEQ ID NO: 534707 - RNA, 64 nt, hsa
uuauaauuaacauaauuuaaauuugaugcaauuuaaauauaacaggagacuuaaaauauuuuau

SEQ ID NO: 534708 - RNA, 64 nt, hsa
uuuccccaaugguaaccuuaccuuggaaacuaucaaauauaaauauacuuuaacuaagccagug

SEQ ID NO: 534709 - RNA, 64 nt, hsa
gcauugcuagucuagaauagucuauuccuugugaaaauauaaauuuaauuuucaggaauccagu

SEQ ID NO: 534710 - RNA, 64 nt, hsa
agacaacauuauaacuaaaagucgaaagcacacaaaauauaaauaauaguguaugcaaguuaau

SEQ ID NO: 534711 - RNA, 64 nt, hsa
aaguacagugaauuuugcuuuauugcaaagcuuuaaauauaaauuucagagugcuucaguaaaa

SEQ ID NO: 534712 - RNA, 64 nt, hsa
acauguacagaagaaauagaauacauguucaugcaaauauaaauuauguauucuaauauaggug

SEQ ID NO: 534713 - RNA, 64 nt, hsa
aguaauuauuuaccaaacuuaaaaacauuucuauaaauauaaagcuuuucuuuauauuuaagac

SEQ ID NO: 534714 - RNA, 64 nt, hsa
uauaaauauaaagcuuuucuuuauauuuaagacaaaauauaaaggcuagaauuugguuccuucu

SEQ ID NO: 534715 - RNA, 64 nt, hsa
aagagagccuaaauaaaauuaucaucaagguauuaaauauaagacguuaaauauaauaaagugg

SEQ ID NO: 534716 - RNA, 64 nt, hsa
aaaauuaucaucaagguauuaaauauaagacguuaaauauaauaaaguggggauauauagaaaa

SEQ ID NO: 534717 - RNA, 64 nt, hsa
gggauggauuaugaugaaaucauuuucaaucuuaaaauauaauacaacaaucuugcaaaauuau

SEQ ID NO: 534718 - RNA, 64 nt, hsa
cccagccccauucauaaugaauaagucacccuuuaaauauaagacacaaauucuacaguauuga

SEQ ID NO: 534719 - RNA, 64 nt, hsa
ugucuagagggaaaaucuggcugauuugggaauaaaauauaaucgaauauucaacaccaugaag

SEQ ID NO: 534720 - RNA, 64 nt, hsa
uccuguucacugaauauuccggguaauugaaagaaaauauaauggaugggcuccauuaaaacca

SEQ ID NO: 534721 - RNA, 64 nt, hsa
gaacacuauuuuaagcaucaaaugcaaucaucuaaaauauaaaggucaaucauuuauaauagaa

SEQ ID NO: 534722 - RNA, 64 nt, hsa
gcugccauguguguacuguauuauuuucagaaaaaaauauaauagucugaguccaaguuaucuu

SEQ ID NO: 534723 - RNA, 64 nt, hsa
auaauuuaaucuguuuaaaucaucaggucuuauaaaauauaauguacuuagagcuggauucaug

SEQ ID NO: 534724 - RNA, 64 nt, hsa
aauuaaaaaaauauuucaaaaugcaaugcauauuaaauauaauacacacagaaaaacuggcauu

SEQ ID NO: 534725 - RNA, 64 nt, hsa
aguuuagguccccauaauccucaaaaauagucacaaauauaacaaaguucauuguuuuaggguu

SEQ ID NO: 534726 - RNA, 64 nt, hsa
uccuuguauauaaugacuuuugcuggcagaacugaaauauaaacuguaaggggauuucgucagu

SEQ ID NO: 534727 - RNA, 64 nt, hsa
uccauauugccuuaugucccaaagccaaauauaaaaauauaaaugaugcuuuguauaauucauu

SEQ ID NO: 534728 - RNA, 64 nt, hsa
auaaguucuccauauugccuuaugucccaaagccaaauauaaaaauauaaaugaugcuuuguau

SEQ ID NO: 534729 - RNA, 64 nt, hsa
uauaaaugcaauuuuugucaagagaucuuucagaaaauauaagccuuuaaagugaagaagagga

SEQ ID NO: 534730 - RNA, 64 nt, hsa
gccucauacuaaaauauauuuuugcaagugaaguaaauauaaaaauaauuuaauccaaaauuaa

SEQ ID NO: 534731 - RNA, 64 nt, hsa
auaauaccuuuaacugcaaagaaaaggcaguuucaaauauaagaaauuuauuucagguaagggu

SEQ ID NO: 534732 - RNA, 64 nt, hsa
gauauuagacaguuuuuuuaguccaugggauuguaaauauaaacauuaacuuuccuauaagaau

SEQ ID NO: 534733 - RNA, 64 nt, hsa
uauauugcaaagucuguauuccagcucuuaagaaaaauauaagcauguuaaauaccauauuuac

SEQ ID NO: 534734 - RNA, 64 nt, hsa
acaugaaaucaucuuccuugucucaugaaaaccuaaauauaaaaaaaaggaaaauacuggaguu

SEQ ID NO: 534735 - RNA, 64 nt, hsa
cauuuuauugaaaaaaaaaccuuuuuuuuugccuaaauauaaguuugguagcuugguuucuuuu

SEQ ID NO: 534736 - RNA, 64 nt, hsa
uagcuugguuucuuuuuuuuauuaaauagugugaaaauauaaugggcauuuugaaaacuuuuag

SEQ ID NO: 534737 - RNA, 64 nt, hsa
uagcuguauuuguagcaauuaucagguuugcuagaaauauaacuuuuaauacaguagccuguaa

SEQ ID NO: 534738 - RNA, 64 nt, hsa
uucaaaugguuuuuauccaaggaauugcaaaaauaaauauaaauauugccauuaauuuguguuu

SEQ ID NO: 534739 - RNA, 64 nt, hsa
gaaaccagccugggcaaaacccugucucuacuaaaaauauaaaaauuagccaggcaugauggca

SEQ ID NO: 534740 - RNA, 64 nt, hsa
ccuggccaacauggcaaaaccccgucucuaugaaaaauauaaaaauuagcugggcaugguggca

SEQ ID NO: 534741 - RNA, 64 nt, hsa
uauuuucuuugccuaaauacaugugagaggaguuaaauauaaauguacagagaggaaaguugag

SEQ ID NO: 534742 - RNA, 64 nt, hsa
uugcaauguuagugauguuuuaaaaugugaucgaaaauauaaugcuucuaagaaggaacaguag

SEQ ID NO: 534743 - RNA, 64 nt, hsa
gagcucacgacgugugaccauuucgucauauuuaaaauauaacuucaagaaaagaguaaacauc

SEQ ID NO: 534744 - RNA, 64 nt, hsa
caagcacuuaauggaaagguaaauggucagauaaaaauauaauuaccuguaagguuaucugguu

SEQ ID NO: 534745 - RNA, 64 nt, hsa
uuggcucuauugauuuguccauuauguguuaggcaaauauaacuuaaguggagggggaaguuua

SEQ ID NO: 534746 - RNA, 64 nt, hsa
cugaacccugcuuuagagcuguguguugagcuaaaaauauaauuuuuuaaaaauugacuagcaa

SEQ ID NO: 534747 - RNA, 64 nt, hsa
augaauugauuaguucucuccaagccauugcuuaaaauauaacauguuuuggauccaauacaca

SEQ ID NO: 534748 - RNA, 64 nt, hsa
aaaguguguugaugccagaauguucagcuucaguaaauauaauaagcucuugugccuuguaugc

SEQ ID NO: 534749 - RNA, 64 nt, hsa
gccucuaucacacaucuguuuuucucgaagaaaaaaauauaauuaauaaaaauguuuuacucuu

SEQ ID NO: 534750 - RNA, 64 nt, hsa
ugguuuggguuuuuguuuuguuauuuuccauuagaaauauaaagaugucaagaagcuuuuaaag

SEQ ID NO: 534751 - RNA, 64 nt, hsa
uacugguuuaaauaaguuuaccuuuuccuccaggaaauauaaugauuucugggaacaugggcau

SEQ ID NO: 534752 - RNA, 64 nt, hsa
ucccaccuuuccaugcuuaagacaaaaaugucuuaaauauaaagcugugauuauaucaaaaauc

SEQ ID NO: 534753 - RNA, 64 nt, hsa
uacaaguuuauuuauaauuuaacaacucagcugaaaauauaacggguauauuuguuauucuaac

SEQ ID NO: 534754 - RNA, 64 nt, hsa
aaaaauaaaauuuuaacccaaaugaauaacuaagaaauauaaaacaagcacaaaaucuuaggga

SEQ ID NO: 534755 - RNA, 64 nt, hsa
aaaggaagauugaacuaauaaaauuuuauuucuuaaauauaaauuugaccuaaaauauuuucuc

SEQ ID NO: 534756 - RNA, 64 nt, hsa
ucuuauaugcuguugcagauauauguauaugcuaaaauauaacuugcaaagauguucuaaauac

SEQ ID NO: 534757 - RNA, 64 nt, hsa
aaguaugaauuuaauucauauauaagaucuauuuaaauauaagaguagcaauacugcaccuggu

SEQ ID NO: 534758 - RNA, 64 nt, hsa
cuaaagugcuguuccgaagaauaggcugaaacaaaaauauaagaauuauuagcuacuuuguugg

SEQ ID NO: 534759 - RNA, 64 nt, hsa
aauuagcuuuaaacacuaaaaucagauuucuucaaaauauaaauuuguuuugauucuuuauauu

SEQ ID NO: 534760 - RNA, 64 nt, hsa
ugcauuacuuugaguuaaauuugaauagaguauuaaauauaaaguuguagauucuuauguguuu

SEQ ID NO: 534761 - RNA, 64 nt, hsa
agaaagaacccuguuagaucuugguuugugauaaaaauauaaagacagaagacaugaggaaaaa

SEQ ID NO: 534762 - RNA, 64 nt, hsa
auaauacaacuuguuauaaaauuuauuccucaauaaauauaauuucucuacuaugcaaaaauua

SEQ ID NO: 534763 - RNA, 64 nt, hsa
agacagauaauuuauagacagguaaaugugaguuaaauauaacucacaucccacucaagacaca

SEQ ID NO: 534764 - RNA, 64 nt, hsa
ugauuuaaaaacaaaaaaacacaaaaaaauaguaaaauauaaaaacaaauuaauguuuuauaga

SEQ ID NO: 534765 - RNA, 64 nt, hsa
aaaaacuuaaauauuauggaaaaaaaacauugcaaaauauaaaauaaauaaaaaaaggaaagga

SEQ ID NO: 534766 - RNA, 64 nt, hsa
caguuuucauguagacuuaggacucaugugcaguaaauauaaauaaguguagcaucagaagcag

SEQ ID NO: 534767 - RNA, 64 nt, hsa
cccauuggcaacugcagcugagaucuuagagaggaaauauaaccggugugagaucuagcaaugc

SEQ ID NO: 534768 - RNA, 64 nt, hsa
gauuguuuuagaaguuaaagucaauauugauuuuaaauauaaguaaugaaggcauauuuccaau

SEQ ID NO: 534769 - RNA, 64 nt, hsa
caaauuuuucaucucuucaaucacuagucaagaaaaauauaaaaacaacaaauacuuccauaug

SEQ ID NO: 534770 - RNA, 64 nt, hsa
gcuauuuaaaacuuguaauuuuuuuaauuuacaaaaauauaaaauaugaagacauaaacccagu

SEQ ID NO: 534771 - RNA, 63 nt, hsa
ccauuaaugaauuagucuaaucauguuuucugaaaauauaaccagccauuggcuauuuaaaac

SEQ ID NO: 534772 - RNA, 64 nt, hsa
caaacuucagcuguacuucgucuucuaauuucaaaaauauaacuuaaaaauguaaauauucuau

SEQ ID NO: 534773 - RNA, 64 nt, hsa
auaacuuaaaaauguaaauauucuauaugaauuuaaauauaauucuguaaauguguguaggucu

SEQ ID NO: 534774 - RNA, 64 nt, hsa
cuugugauaagcugcugcuccuauauuuuuuaagaaauauaauaaagcacuuagggcaggggaa

SEQ ID NO: 534775 - RNA, 64 nt, hsa
ccuuauuaagaacacuacuacaguucugaaggggaaauauaacaucuaugguuauauauuuuaa

SEQ ID NO: 534776 - RNA, 64 nt, hsa
uguuucugauuugaagaaacugacauuccuuuaaaaauauaaauauaaauacauacauacauag

SEQ ID NO: 534777 - RNA, 64 nt, hsa
ugauuugaagaaacugacauuccuuuaaaaauauaaauauaaauacauacauacauagauauau

SEQ ID NO: 534778 - RNA, 64 nt, hsa
uucuuguuuuaagauacaaguaaaauuaaucuuuaaauauaaauguaaauuaguacacaaaacu

SEQ ID NO: 534779 - RNA, 64 nt, hsa
accccuuauccuuaacauauauaguauauuuaaaaaauauaaaauuguauuguacuaaugugau

SEQ ID NO: 534780 - RNA, 64 nt, hsa
uuucauguagcguaucacauaacuuuuuugcaaaaaauauaaaaagaaauaaacuucaauguau

SEQ ID NO: 534781 - RNA, 64 nt, hsa
guacugugcuagugacuggaggcccugcuacugcaaauauaaaacauaaaguuuguuuaaaaaa

SEQ ID NO: 534782 - RNA, 64 nt, hsa
aaguuaacaaagggguacacaguauggucuuuggaaauauaauaaaacaucaacuaacuuggac

SEQ ID NO: 534783 - RNA, 64 nt, hsa
ggaaugccaucagggaauucaccuuuuauuaggaaaauauaaaauauguauguaugugcagaua

SEQ ID NO: 534784 - RNA, 64 nt, hsa
cauaaauguaauuacuauugaaagaccuuucaugaaauauaagucuccagagcacacaagagua

SEQ ID NO: 534785 - RNA, 63 nt, hsa
augaaagcauucauacuugagaaaaaaauaaacaaauauaaaaauaggcaaagccguuaguau

SEQ ID NO: 534786 - RNA, 64 nt, hsa
uaaguguaugauagauguuugauuuguaaauuacaaauauaaauuaucacccccauuuccauuu

SEQ ID NO: 534787 - RNA, 64 nt, hsa
uuaagugacaaauguuagaagaugauggauugaaaaauauaaguaauuuggcauauugacccua

SEQ ID NO: 534788 - RNA, 64 nt, hsa
auauaaaaauuucuuuugguuuuuuaugaugagcaaauauaaguuaaugccaaacguuauguua

SEQ ID NO: 534789 - RNA, 64 nt, hsa
gguaaaaaguaguauuuuguauauuuuuguaacaaaauauaaaugaagauauuuuaccaugaag

SEQ ID NO: 534790 - RNA, 64 nt, hsa
augaagagauugcacuuauccuugagaacagucuaaauauaaaugaagauauuuuaccaugaag

SEQ ID NO: 534791 - RNA, 64 nt, hsa
ggaaugaaguucugaaaauggugaauauguggguaaauauaaaagauauuucucucuuuuuaaa

SEQ ID NO: 534792 - RNA, 64 nt, hsa
aauuaguagacaaggauauuaaaagagcuauuguaaauauaaaguagaggaaaacauaagauug

SEQ ID NO: 534793 - RNA, 64 nt, hsa
gaacugguacaauguggucccucucaauauuuaaaaauauaauuuguaacagugcuuaccauuc

SEQ ID NO: 534794 - RNA, 64 nt, hsa
gaaucugugggaaauaggcagauauagcuuuuuaaaauauaaaguacuugggauuuugcauuau

SEQ ID NO: 534795 - RNA, 64 nt, hsa
gcaaaaauaucccuuccggagucuuugaagcugaaaauauaaaacaaauaaaaaauaaaaaaau

SEQ ID NO: 534796 - RNA, 64 nt, hsa
auuucuugugauguuuugagaguaaugcauacagaaauauaauaaaauguguugaaacugcaug

SEQ ID NO: 534797 - RNA, 64 nt, hsa
gaguuacuggguaguuguaaguauuauuuuuauuaaauauaauguaaaauaaaauguuaagaua

SEQ ID NO: 534798 - RNA, 64 nt, hsa
aaguaguaccaggaaguaggacaaguaauuucaaaaauauaaagguguuugcuacucagaugag

SEQ ID NO: 534799 - RNA, 64 nt, hsa
cuaauucauuaaauacuaauugauuguuuaaaagaaauauaaaugugacaaguggacauuauuu

SEQ ID NO: 534800 - RNA, 64 nt, hsa
uguaacagacuggcacaugugccagcugaauuuaaaauauaauacuuuuaaaaagaaaauuauu

SEQ ID NO: 534801 - RNA, 64 nt, hsa
gugaucucaagaccuccagccagaagucccuuccaaauauaagaguacucauguuuauuuauuu

SEQ ID NO: 534802 - RNA, 64 nt, hsa
ccaguuaauuugaaaaggccccagaugaaucaauaaauauaauuuuauaguauuuugcagagga

SEQ ID NO: 534803 - RNA, 64 nt, hsa
cugccagaaaaacuuacauguaucagauuuuuaaaaauauaaauagagaacauuuugcaaaugc

SEQ ID NO: 534804 - RNA, 64 nt, hsa
auggaaaaccagauaaaacaauguuacaaaaggcaaauauaaagaguauguuuucuuuuuagug

SEQ ID NO: 534805 - RNA, 64 nt, hsa
cuaugaaggcuuucauuuguacaucccuuugaaaaaauauaacagauuuaaaauguuuugaauu

SEQ ID NO: 534806 - RNA, 64 nt, hsa
uguaaaggcuacaaaucacaaucugauuccucccaaauauaaaggcauauggaacauaauguau

SEQ ID NO: 534807 - RNA, 64 nt, hsa
uuuuucaucagucaucacucucaaauauaaauuaaaauauaacacuccugaaugccugaggcac

SEQ ID NO: 534808 - RNA, 64 nt, hsa
uucaugcaaauauuuuucaucagucaucacucucaaauauaaauuaaaauauaacacuccugaa

SEQ ID NO: 534809 - RNA, 64 nt, hsa
ugucucaguauuuuagggucaaugagagccauaaaaauauaacauaaucacaaguaaaggagau

SEQ ID NO: 534810 - RNA, 64 nt, hsa
gaaaucuuucaacuuauuucugaaaaagagaaaaaaauauaaaauuucuggugcacagguuugu

SEQ ID NO: 534811 - RNA, 64 nt, hsa
auacuauccauguaauaagcacuugccuggaauaaaauauaaaacugaaauaaaccugcacuga

SEQ ID NO: 534812 - RNA, 64 nt, hsa
agugaggacucggccacugugucucuguuuccugaaauauaaacuguagcgaccccagacugua

SEQ ID NO: 534813 - RNA, 64 nt, hsa
uuaagaccuaauccccaccucccuucuucuaacuaaauauaaaaagauccaggggacauaaaug

SEQ ID NO: 534814 - RNA, 64 nt, hsa
gagaacuuccaaauguuaauuuuuuuuuuuuugaaaauauaaauaauuacuauuuuguacugug

SEQ ID NO: 534815 - RNA, 64 nt, hsa
auuuguccagugucuuacuuaccuucauauaugcaaauauaauuuuaaaaaauuuuuuaauuaa

SEQ ID NO: 534816 - RNA, 64 nt, hsa
ugucaguuaaggacauagcuauuccaaauaaacuaaauauaauauugagcugcauuucucaaag

SEQ ID NO: 534817 - RNA, 64 nt, hsa
ugguauuauggaaggcuuauugggggaacaagaaaaauauaaaaagugaucucugcccacggaa

SEQ ID NO: 534818 - RNA, 64 nt, hsa
augggccucuguguggcugaacaguauauuuuguaaauauaaguacuaguccuaauugcagaaa

SEQ ID NO: 534819 - RNA, 64 nt, hsa
uauaaaagcugcuuuuuugcagaacauuccuugaaaauauaagguuuugaaaagacauaauuuu

SEQ ID NO: 534820 - RNA, 64 nt, hsa
cuagaauguauaugagaaacccccacucuacuaaaaauauaagaaauuagccggacaugguggc

SEQ ID NO: 534821 - RNA, 64 nt, hsa
guuugcucaacaugguuuacuacuaacauuuuaaaaauauaaauacuuuagcaaaaacauucac

SEQ ID NO: 534822 - RNA, 64 nt, hsa
cccccuaagguuacaugugagucaaaauuuuguaaaauauaaccucacauaagaaccauggccu

SEQ ID NO: 534823 - RNA, 64 nt, hsa
uuaucaaagggcugaguugagaacacuguggcugaaauauaauuuuucuccccccuaagguuac

SEQ ID NO: 534824 - RNA, 64 nt, hsa
auaaaagugauggaauuaaugugaaauaaaacaaaaauauaauggcuagaauacaaagcuaaua

SEQ ID NO: 534825 - RNA, 64 nt, hsa
gaagcaagugguaugugacaaggacuccacuuauaaauauaacuguuuuuauguuccacugaau

SEQ ID NO: 534826 - RNA, 64 nt, hsa
gacuuauuaauuuugcugacaaaagugaaguaacaaauauaaugauaauuggcuuuuuaaauuu

SEQ ID NO: 534827 - RNA, 64 nt, hsa
gacuuuaaaagccuccuugaaguuuuuuacuuagaaauauaaggaauaagucuuugaacaaucu

SEQ ID NO: 534828 - RNA, 64 nt, hsa
gugggccccuugcuaauuaacuuccauuuuguaaaaauauaaacacauggggcuaugacuuucc

SEQ ID NO: 534829 - RNA, 64 nt, hsa
ccuggccaacauggugaaauccccucucuacuaaaaauauaaaaauuagccaaguuugguggca

SEQ ID NO: 534830 - RNA, 64 nt, hsa
cuaggaaagcauuuauacuugagauaaauuauacaaauauaaagacugugaaaaagccaucauu

SEQ ID NO: 534831 - RNA, 64 nt, hsa
uauaagugcaauuacugucaaaagaucuuucagaaaauauaagcuuuuuuagugaagaguauuu

SEQ ID NO: 534832 - RNA, 64 nt, hsa
agugaagaguauuuauuuugaaguugaacaucacaaauauaaaaaggguuguagugccuuuacu

SEQ ID NO: 534833 - RNA, 64 nt, hsa
ucaacaucagggaauuuauauugaaaaauugugcaaauauaauaaauuuggaaaaacaauuuuu

SEQ ID NO: 534834 - RNA, 64 nt, hsa
uuucaucaguuugugagauuucucuauuuuuuuuaaauauaauuuuauuucuuucaacaaauau

SEQ ID NO: 534835 - RNA, 64 nt, hsa
uauuuuuuuuaaauauaauuuuauuucuuucaacaaauauaaaauaaaaaacaacuuuggaaca

SEQ ID NO: 534836 - RNA, 64 nt, hsa
cauaagugcaacuacugucaaaauaucuuuaagaaaauauaagcuuuuaaagugaagaguauuu

SEQ ID NO: 534837 - RNA, 64 nt, hsa
acaggaaagcauuuauacuugagaaauauuguacaaauauaaagacugugaaaaagccauuaau

SEQ ID NO: 534838 - RNA, 64 nt, hsa
uaccagauauguuugugcaugcagugauuuugaaaaauauaauacaugaauuaugcuuuccuuc

SEQ ID NO: 534839 - RNA, 64 nt, hsa
guguguguauaaaauauauauuugccuuaaauggaaauauaaacaaaauuuaccaacuacaguu

SEQ ID NO: 534840 - RNA, 64 nt, hsa
ugcauguuuuaugugcacucauaugaguaucuuuaaauauaaucccuuuacaucuguguucuau

SEQ ID NO: 534841 - RNA, 64 nt, hsa
gcuuucguagccccugcuaaguguugacuuuuuaaaauauaaguuuauuguaaaagugacauga

SEQ ID NO: 534842 - RNA, 64 nt, hsa
gccaagauaauucacucuacucagccggcguggcaaauauaaaacuuacagagcguggcugugc

SEQ ID NO: 534843 - RNA, 64 nt, hsa
cuguauaaacauuaaaugucuuauauagcagcaaaaauauaaaauaguuguccauauuuucaca

SEQ ID NO: 534844 - RNA, 64 nt, hsa
uguacugugggacauguuaauaagugcuauaaagaaauauaaaggguuugggagcaaaaagagg

SEQ ID NO: 534845 - RNA, 64 nt, hsa
caaacacuuaaaacuuuuuguuauggaagaauucaaauauaaauaaaaaauugugaguaauaaa

SEQ ID NO: 534846 - RNA, 64 nt, hsa
agaaccuuggaguucauauuucacaaauauuaauaaauauaaguccaagagcugucagccuaau

SEQ ID NO: 534847 - RNA, 64 nt, hsa
gugagauuuguuauguucuggcuuuuaaaagguaaaauauaaauaaauuucauaacuuaaucua

SEQ ID NO: 534848 - RNA, 64 nt, hsa
ucucuaggaaacagucuggcuuaacuauuuuugaaaauauaacuguuuccccucucugcugcuu

SEQ ID NO: 534849 - RNA, 64 nt, hsa
caguuaucagaaagguaguuuuuuucuucuauuaaaauauaacauugugaaagaaaauaaaauu

SEQ ID NO: 534850 - RNA, 64 nt, hsa
ggaacaaagaagcaaaacaacaggaaaugugggaaaauauaaacgagggaagaaaacaaacuuu

SEQ ID NO: 534851 - RNA, 64 nt, hsa
aaaacauaacaaguaaauuuuaaaaaaaagaacaaaauauaagaggaacaaagaagcaaaacaa

SEQ ID NO: 534852 - RNA, 64 nt, hsa
ugagccauauauuagugaaauguuuuauuuuguaaaauauaaauggauuauuugccaucauuag

SEQ ID NO: 534853 - RNA, 64 nt, hsa
auaaauuuauaacuuuguuauuacauuguguaacaaauauaagguuuacgagcuaugagaauug

SEQ ID NO: 534854 - RNA, 64 nt, hsa
cugccaaacaucagucaauugcuugagcaugcccaaauauaacaugaaagucaagucuaccugc

SEQ ID NO: 534855 - RNA, 64 nt, hsa
ggcaagcucauagcacauguuuuacaaagaaacaaaauauaaaucacagauuuccaaaaguacu

SEQ ID NO: 534856 - RNA, 64 nt, hsa
aucugauuuuaucucugcguuucagugaccuaccuuaaaacaacacacgagaagaguuaaacug

SEQ ID NO: 534857 - RNA, 64 nt, hsa
uguguaacaaaggcauaucgucauguuaauaaauuuaaaacaucauucguauaaaauauuuuaa

SEQ ID NO: 534858 - RNA, 64 nt, hsa
auuaacuagauacagaauaauggagaacaaguuguuaaaacauuuaauauuauauaggauauug

SEQ ID NO: 534859 - RNA, 64 nt, hsa
uguaucacaccuaaucuucccaauguuugggauauuaaaacacaaaguccuuaacaugccaggc

SEQ ID NO: 534860 - RNA, 64 nt, hsa
ucuucacagaaaauaaaagguguuaauuugcuuuuuaaaacaaauuuaauuaucacauuuuaaa

SEQ ID NO: 534861 - RNA, 64 nt, hsa
uugcaaauucaucuguuacacagaaaauuuugacuuaaaacaucugcugaauuccaaauuucug

SEQ ID NO: 534862 - RNA, 64 nt, hsa
uuugaaaucuaugauuuacugcaguaguaugugcuuaaaacaacuguugaggucuuuuaagcag

SEQ ID NO: 534863 - RNA, 64 nt, hsa
auuugauggacuugguucaacaacaagaacuuacuuaaaacaauguacuguggugaugaguccc

SEQ ID NO: 534864 - RNA, 64 nt, hsa
aauuugauccaaauuugaacuggccaaccagucuuuaaaacacuggacuagaagagauaaugau

SEQ ID NO: 534865 - RNA, 64 nt, hsa
gugccuugaguaccauuaugugcaagcuacauaauuaaaacauuuuucuuaguuucccugggaa

SEQ ID NO: 534866 - RNA, 64 nt, hsa
guagaucaugcccugaccuccaauaaaaaccucuuuaaaacaaugcugauuuuugaauucauga

SEQ ID NO: 534867 - RNA, 64 nt, hsa
uccuuuaaucgaugaauugauuaaauuuagacaauuaaaacauuucuaaagugagacugaaaau

SEQ ID NO: 534868 - RNA, 64 nt, hsa
ucauuuuuagugauugacaagcaaacggguucauuuaaaacagguuccucuuuuguuaguuaca

SEQ ID NO: 534869 - RNA, 64 nt, hsa
uaaguuuacuuucuucaaagaguugauaggauguuuaaaacaucaacacauugcuuaaaaugau

SEQ ID NO: 534870 - RNA, 64 nt, hsa
agaaaaugccugccaaguauaaaugacucucaucuuaaaacaagguucuucagguuucugcuug

SEQ ID NO: 534871 - RNA, 64 nt, hsa
caaacugguacacauuagacucacccgaggaauuuuaaaacagccuauaugcccagggccuaac

SEQ ID NO: 534872 - RNA, 64 nt, hsa
uucuuuuauacugcuggauuuuguugugcaucauuuaaaacauuuuguauguuucuucuuaucu

SEQ ID NO: 534873 - RNA, 64 nt, hsa
auaaauaugauaaugagaagacaaaguauuuauauuaaaacaguuuaguagccuucaguuuugu

SEQ ID NO: 534874 - RNA, 64 nt, hsa
ucugcaaaguauuucuaaccuuuaauucccaguuuuaaaacagauauaauaauagcauuuaauu

SEQ ID NO: 534875 - RNA, 64 nt, hsa
caagcuuacuguauuagucauuuuuagcccauaauuaaaacaugaucacuuuuacacaggugua

SEQ ID NO: 534876 - RNA, 64 nt, hsa
gggggaaaaaaugggagccuugcucuccaaauccuuaaaacaugcuauuaagcaaccuuucuga

SEQ ID NO: 534877 - RNA, 64 nt, hsa
auuuuguuuagaaugggcuauaugacccagaaucuuaaaacagaguuagcuuuauuuuaguauu

SEQ ID NO: 534878 - RNA, 64 nt, hsa
gggaguagaaaacaacaaagaauggaauggacucuuaaaacaaugaaagagcauuuaucguuug

SEQ ID NO: 534879 - RNA, 64 nt, hsa
ccaagacauuagucuuacauuuaaacuuuuuucuuuaaaacaugguuuuggugguuaacuuuua

SEQ ID NO: 534880 - RNA, 64 nt, hsa
uuaauggaauauuuuuaaaucccacauucagaguuuaaaacacugguuuucaauguguuuuuua

SEQ ID NO: 534881 - RNA, 64 nt, hsa
uauuuuucuucugucaguacccuuaggauacacuuuaaaacaccuuaaggucugauguuauggc

SEQ ID NO: 534882 - RNA, 64 nt, hsa
acuuauaaauaacauauuucuucagacuaacaucuuaaaacacugaccucuaugagguauuuac

SEQ ID NO: 534883 - RNA, 64 nt, hsa
ucacacaaaggcugauuucuaaaauauauauauauuaaaacaauaaaguauuuauuuugccuaa

SEQ ID NO: 534884 - RNA, 64 nt, hsa
cugauaaucaguuuggaccaguuucuuaaggucauuaaaacagaagcaaauuaagacagguuug

SEQ ID NO: 534885 - RNA, 64 nt, hsa
uaacugaauaguuuacuauuucauucaagcauguuuaaaacaaauaauuuccuuucaccaguuu

SEQ ID NO: 534886 - RNA, 64 nt, hsa
uuuuguguggagauauucauaauucugcaauacuuuaaaacauuuagaaaacaccccaggguag

SEQ ID NO: 534887 - RNA, 64 nt, hsa
acucccugauggcaggucuguguuuauuacuacauuaaaacaaagucucugacuuauaaagcga

SEQ ID NO: 534888 - RNA, 64 nt, hsa
uugcauaguauuuugcauucuguaaauacgaauguuaaaacauuucaggucagcaaaauuagaa

SEQ ID NO: 534889 - RNA, 64 nt, hsa
gagcacagguuugauauuuaugcuucuaaauacauuaaaacauuucugaauugcaguugaaugg

SEQ ID NO: 534890 - RNA, 64 nt, hsa
uauuuaaaauguaaaaaggaauaugaaagucuuauuaaaacacuucauugaaaauauacagucu

SEQ ID NO: 534891 - RNA, 64 nt, hsa
auaaugagaaauguuggugugcuuuucuaagcauuuaaaacauaauugccaauugaaacccuaa

SEQ ID NO: 534892 - RNA, 64 nt, hsa
gacauuuggguucaguugcuuguagucuguaaauuuaaaacagcuuaauuugguacagguuaca

SEQ ID NO: 534893 - RNA, 64 nt, hsa
auguaaagucccucuaagacuacauacuuuuuguuuaaaacaaaauuggaauuuguuuucccuu

SEQ ID NO: 534894 - RNA, 64 nt, hsa
uuuaaacugugaagaacuuuaucauacaggaaacuuaaaacaagaggugucaaaagacccaaau

SEQ ID NO: 534895 - RNA, 64 nt, hsa
gccuuuugcauaagccucuuuauaacauguaucuuuaaaacaauuaagucuuuaggaaugugua

SEQ ID NO: 534896 - RNA, 64 nt, hsa
ggacaaacagaaccauuuucuuccucuuuaccucuuaaaacagcagaaguacaagaauacagcu

SEQ ID NO: 534897 - RNA, 64 nt, hsa
gaagcaccuaaaaacacugcuugauauuauaaauuuaaaacacaagugaaaguuuagccauggu

SEQ ID NO: 534898 - RNA, 64 nt, hsa
uaggcaccagaagaacaguaggugacacuauaguuuaaaacacauugccuaacuacuaguuuuu

SEQ ID NO: 534899 - RNA, 64 nt, hsa
auaaaaagccacuagacucuucacuguuagcuuuuuaaaacauuaggcucccaucccuauggag

SEQ ID NO: 534900 - RNA, 64 nt, hsa
uugcuucuuugcccagacauuuacaaaguuguuuuuaaaacacacucauaaguaaguuuggcaa

SEQ ID NO: 534901 - RNA, 64 nt, hsa
uugcugcagaauuuggguugacuccugagcauauuuaaaacaaagaagcuagaaauuuagcagu

SEQ ID NO: 534902 - RNA, 64 nt, hsa
ugcuuacauucucuaagccuugguuuccugaaccuuaaaacaggauaacauaguaccugcuucg

SEQ ID NO: 534903 - RNA, 64 nt, hsa
uuaauugaaugucugugcuuaugagaggcagugguuaaaacaggggcuggcgaguugacaacug

SEQ ID NO: 534904 - RNA, 64 nt, hsa
aauaaacagccacacacacauuuuuuuuuuuccuuuaaaacaguaacuuggaaauaugaaaagg

SEQ ID NO: 534905 - RNA, 64 nt, hsa
aauuccaucugagugauugucaguguaaggccuuuuaaaacaaaagcaaguucuuuguuaggaa

SEQ ID NO: 534906 - RNA, 64 nt, hsa
uuuuucccaaaagguaaaaauauagauugaaaaguuaaaacauuuugcauggcugcaguuccuu

SEQ ID NO: 534907 - RNA, 64 nt, hsa
gcuauggaaagaugcauagaaagaguauaauguuuuaaaacauaaggcauuugucugccauuuu

SEQ ID NO: 534908 - RNA, 64 nt, hsa
cuaguagaugauaagccuaaaaaaagcacaauuauuaaaacaaacagauccauguuaggacauu

SEQ ID NO: 534909 - RNA, 64 nt, hsa
uucaguccuucucccaacccccugcaaauugucuuuaaaacaacaacacauaaggaaucugaag

SEQ ID NO: 534910 - RNA, 64 nt, hsa
uggguugaagcuuuucugauaauuauuacacaauuuaaaacaacauauauauuuaaaauaaaua

SEQ ID NO: 534911 - RNA, 64 nt, hsa
auugucuuccuccaaggaguuagaauuucccaguuuaaaacaaaaagggaaauguccuagguuu

SEQ ID NO: 534912 - RNA, 64 nt, hsa
auacauauauauauaucauauagcuuaagcugauuuaaaacaaaggccuuagacuaauuuucga

SEQ ID NO: 534913 - RNA, 64 nt, hsa
caagggaagucaucaagaaaagucaaagaagacuuuaaaacauuuuuaaugcauauacaaaaac

SEQ ID NO: 534914 - RNA, 64 nt, hsa
uuuauuuuuuuguuuguuuuauuuauagucugauuuaaaacaaucagauucaaguugguuaauu

SEQ ID NO: 534915 - RNA, 64 nt, hsa
gugcaaagcuuauuuucuuuuaucugggcaaaaauuaaaacacauuccuuggaacagagcuauu

SEQ ID NO: 534916 - RNA, 64 nt, hsa
uuguaaaaacacuuuuuugguuuaauauauauuuuuaaaacauuucacuagugauugaauucua

SEQ ID NO: 534917 - RNA, 64 nt, hsa
uucuacuuuugccaucugaauugacuugaaugucuuaaaacagguaaauacuguaaagugugua

SEQ ID NO: 534918 - RNA, 64 nt, hsa
uuauuuuuauauggaauugcauaaugugugccuuuuaaaacaauaacaaaaaccagagaugugc

SEQ ID NO: 534919 - RNA, 64 nt, hsa
acuugacauuaaccucaucaaaagugugugaauuuuaaaacaaauucuaaaaaaacuauagugc

SEQ ID NO: 534920 - RNA, 64 nt, hsa
aaaguuguacugcaucuuaguuuacuggauaaauuuaaaacacaguauuguagaaagcuaauac

SEQ ID NO: 534921 - RNA, 64 nt, hsa
uucuguugaaccaccuguguagucucucuaguaguuaaaacagcuauuuuaguaaccccaagag

SEQ ID NO: 534922 - RNA, 64 nt, hsa
acuucgaguucuuuugaaauucagagucuguaacuuaaaacauuacccuuaugaauuuagauga

SEQ ID NO: 534923 - RNA, 64 nt, hsa
caaaaauaacuaugaaaaugccaguaacguuuauuuaaaacaaaauauuuuaauuuuuaaauuu

SEQ ID NO: 534924 - RNA, 64 nt, hsa
uuaaaacaaaauauuuuaauuuuuaaauuuucccuuaaaacacacuuuuggaauaugcuacaau

SEQ ID NO: 534925 - RNA, 64 nt, hsa
caaaaaauuauuuuaggcaaaguccauacuccuuuuaaaacaauauuuauguccuauguuugug

SEQ ID NO: 534926 - RNA, 64 nt, hsa
uacauuguaguuaaacaaagcaauuucuccagacuuaaaacaugaugaguugagcucuaucuuc

SEQ ID NO: 534927 - RNA, 64 nt, hsa
uaagcaagaaaaauaucuuuuaaauacuuugccuuuaaaacacuuuuuuauuuuguuuuucuau

SEQ ID NO: 534928 - RNA, 64 nt, hsa
uagugauauucucaugccuggacaaaaucuuuaauuaaaacagugaagacuucucuauaauuuc

SEQ ID NO: 534929 - RNA, 64 nt, hsa
gguuacuaaggugccugcuagccauuguauaaaauuaaaacaugaagaauauuuuuuuuuugag

SEQ ID NO: 534930 - RNA, 64 nt, hsa
aagaauauuuuuuuuuugagcauggcuaguggauuuaaaacaacacauaccugucacugcugga

SEQ ID NO: 534931 - RNA, 64 nt, hsa
uagaguguuuuugcacauuugggcgcuaaagggauuaaaacaacugaugccacaaugacuauug

SEQ ID NO: 534932 - RNA, 64 nt, hsa
uauuuuuagagguacauguuuuaaguaaauguauuuaaaacaaauuuucauggucugaauugua

SEQ ID NO: 534933 - RNA, 64 nt, hsa
uuaccucagugguaucagcacauuguaaauuacguuaaaacacacaacucacugugaucuaugg

SEQ ID NO: 534934 - RNA, 64 nt, hsa
gcagcuucccaaguauucgauuucauucaugugauuaaaacaaguugccauauuucaaagccuu

SEQ ID NO: 534935 - RNA, 64 nt, hsa
cagaaguuauuagaugaaagcagcgagugaaucuuuaaaacagacuugaucacgcacacacaau

SEQ ID NO: 534936 - RNA, 64 nt, hsa
aaaauauuuugcuuuauguauauuacaguucuuuuuaaaacacuggaagacucauguuaaacuc

SEQ ID NO: 534937 - RNA, 64 nt, hsa
uccaauuagggauguuuguuacuacucauauugauuaaaacaguuaacaaacuuuuuucuuuuu

SEQ ID NO: 534938 - RNA, 64 nt, hsa
acuuuguacaguacaaaauaaagucuacauuuguuuaaaacacugaaccuuuugcugauguguu

SEQ ID NO: 534939 - RNA, 64 nt, hsa
gcuacauaaguacuuugauacugcucaugcugacuuaaaacacuagcaguaaaacgcuguaaac

SEQ ID NO: 534940 - RNA, 64 nt, hsa
uuacauuuuuaaaaaaucuguacgugacagaauauuaaaacauggaauauuuuugcuucaagug

SEQ ID NO: 534941 - RNA, 64 nt, hsa
cgaaagaaguaagagauuugaaaagacgauagaguuaaaacaauauuuaaaaaacauuucuauu

SEQ ID NO: 534942 - RNA, 64 nt, hsa
cacugcauaacaaaccacaccaaaacucagugguuuaaaacaaggacuuuuauuauuuuucacg

SEQ ID NO: 534943 - RNA, 64 nt, hsa
gagugaagauaguacuagcaaguauacuuauuuuuuaaaacaggcuagaaucucauguuuuaua

SEQ ID NO: 534944 - RNA, 64 nt, hsa
aaaucuccuaaaaccagucuaugaacucagggcuuuaaaacauuuuuaauuuauuuggucauuc

SEQ ID NO: 534945 - RNA, 64 nt, hsa
gaaauaugguuugcuaaaaucuauaagcugcuuauuaaaacagagucccguguguccuaaaaau

SEQ ID NO: 534946 - RNA, 64 nt, hsa
auuuguuucaaauugcaguuuuuauaaaacauuuuuaaaacacaaauggcauguaugcuaauga

SEQ ID NO: 534947 - RNA, 64 nt, hsa
uaguuuugaacuaauguaacaugauuuuucuuuuuuaaaacagccugaaaauguacuaguguuu

SEQ ID NO: 534948 - RNA, 64 nt, hsa
ugucccgauuguuaaaaaguuggcucaauuauuuuuaaaacauuuuguaagccaacaaaagucu

SEQ ID NO: 534949 - RNA, 64 nt, hsa
aaagucugugggcugccaguuuauuacuuuugucuuaaaacaugaucauuguucucucacggua

SEQ ID NO: 534950 - RNA, 64 nt, hsa
ucuuaaaugauggaaguauaggacguugcuuauuuuaaaacaagggaaggacacaaaauggaau

SEQ ID NO: 534951 - RNA, 64 nt, hsa
auggaaugacugcuuaguccuuucucagauacucuuaaaacaauuuuuuauuguuaaauuugug

SEQ ID NO: 534952 - RNA, 64 nt, hsa
aauggcuucugaaugacuguucuaauaaaugaucuuaaaacaguccauaggcugguuucaguuu

SEQ ID NO: 534953 - RNA, 64 nt, hsa
guuauccucaaaaacaucagcgaugucugaaccuuuaaaacaucuguuagagcaaaauuaaaag

SEQ ID NO: 534954 - RNA, 64 nt, hsa
gcuuucauuucuuccauuaauuacauguguaaaauuaaaacacuacuguaauguuaauuuccug

SEQ ID NO: 534955 - RNA, 64 nt, hsa
gcaggcagaauuuaugaauaaguguuguuuauuauuaaaacaauaauuuguuaauuucuuauaa

SEQ ID NO: 534956 - RNA, 64 nt, hsa
gcucauuuaggguagauuuauuuaucucauuaacuuaaaacagcuauguguaugaaauagguca

SEQ ID NO: 534957 - RNA, 63 nt, hsa
uuuuuacaauuugauuuuaacuuuuaaaauaaauuuaaaacauaauugucacuucuuaguuuu

SEQ ID NO: 534958 - RNA, 64 nt, hsa
uuuuaggguuuuuuuuucuucuuuaauuuuuugauuaaaacauacacacagcuguuagcauaaa

SEQ ID NO: 534959 - RNA, 64 nt, hsa
cuaucgauuuaguuaccucuugaaagcacaaaaauuaaaacauugccauauguugaauuuuuaa

SEQ ID NO: 534960 - RNA, 64 nt, hsa
cuccagccuaggcaacagagcaagacccugucucuuaaaacaaaaaaccucacacauaccuaaa

SEQ ID NO: 534961 - RNA, 64 nt, hsa
aguucccccaaaugugauguuucaguguauuuauuuaaaacauaaaguagaccaggugcaguag

SEQ ID NO: 534962 - RNA, 64 nt, hsa
ucaacuuuaugcagcuuccuuuugagggacaaauuuaaaacaaacaaccccccaucacaaacuu

SEQ ID NO: 534963 - RNA, 64 nt, hsa
guuuuacugcuuuuaacuucugauagcguuggaauuaaaacaaugucaaggugcuguugucauu

SEQ ID NO: 534964 - RNA, 64 nt, hsa
uuggacuuuuagcuguuaaaugguaucucauuuuuuaaaacacauuucacauuuaaagucauac

SEQ ID NO: 534965 - RNA, 64 nt, hsa
aacaguaauaacuauaaaucucacuuuaaauaauuuaaaacaaauuaaagugauauaugaguua

SEQ ID NO: 534966 - RNA, 64 nt, hsa
agauacuuaccacucucucuucucuuucccaugguuaaaacaggaguuguguucucugucgcug

SEQ ID NO: 534967 - RNA, 64 nt, hsa
gucacuuuugaagcauguuaauaaaugucacugauuaaaacagcuggagcauuuccuucccuuu

SEQ ID NO: 534968 - RNA, 64 nt, hsa
aaugucucugguguuuagagcuuuauuuuuuucuuuaaaacauuaaaacagcugagaaucaguu

SEQ ID NO: 534969 - RNA, 64 nt, hsa
ugguguuuagagcuuuauuuuuuucuuuaaaacauuaaaacagcugagaaucaguuaaauggaa

SEQ ID NO: 534970 - RNA, 64 nt, hsa
uucaauggaauaccagcuaaccagauauguuccuuuaaaacaugaauuuuuuugucuuauucug

SEQ ID NO: 534971 - RNA, 64 nt, hsa
aauacaauuaauugcauacaguaaaagucugugauuaaaacauuuauauaccucauucuuuagu

SEQ ID NO: 534972 - RNA, 64 nt, hsa
aaacuuauccagggccauagaaguaugaaucuaauuaaaacagaaaugggaauuauugcacaga

SEQ ID NO: 534973 - RNA, 64 nt, hsa
uuuuuguaaauguuaaaacaucuauauuuaaauguuaaaacacuaaauauagagaggggcuuua

SEQ ID NO: 534974 - RNA, 64 nt, hsa
ugugacuucuauauucaauagauuuuuguaaauguuaaaacaucuauauuuaaauguuaaaaca

SEQ ID NO: 534975 - RNA, 64 nt, hsa
caacuacauccuuaugauguuuuuaacaauaaaauuaaaacaacuguuaaacuaaaaaccacac

SEQ ID NO: 534976 - RNA, 64 nt, hsa
uugguccauugaaaguuacauggauugccaauuuuuaaaacacuaaaguugaauaaaaugcaug

SEQ ID NO: 534977 - RNA, 64 nt, hsa
aaucuuuuauguuucauuuaccuuaugaaaaguguuaaaacauugccaacucaaaauaacauua

SEQ ID NO: 534978 - RNA, 64 nt, hsa
agcacuuacagaagaguauccuaaugaaaacacuuuaaaacagauugggaaaacugagcaugug

SEQ ID NO: 534979 - RNA, 64 nt, hsa
gcuuaaauuacucaauuuaaaauuuuaaaauccuuuaaaacaacuuuucaauuaauauuaucac

SEQ ID NO: 534980 - RNA, 64 nt, hsa
uguauuucauuuucuuuauauuggaccgaagucauuaaaacaaaaugaaacauuugccaaaaca

SEQ ID NO: 534981 - RNA, 64 nt, hsa
ucauguuucugcuucauauuuugaaaaauaacaauuaaaacagacagcuguacugagguaagau

SEQ ID NO: 534982 - RNA, 64 nt, hsa
cucaauaucaacuccaguuuaaaaaguguuauuuuuaaaacauuugaaaccaaguacuguuuaa

SEQ ID NO: 534983 - RNA, 64 nt, hsa
ucuuucuuuucccuaauuugcuuuggugggguccuuaaaacauuucccaacuaaagaauagaau

SEQ ID NO: 534984 - RNA, 64 nt, hsa
ucaucauaccaaaaaguguaagugaaaacccccuuuaaaacaaaacaaaaaaaugaaauaaaau

SEQ ID NO: 534985 - RNA, 64 nt, hsa
auagguauuuuaaaacauuguuuaaaacagaauguuaaaacacuguuguuuaagcauguuuaaa

SEQ ID NO: 534986 - RNA, 64 nt, hsa
uguaagauaauaaauagguauuuuaaaacauuguuuaaaacagaauguuaaaacacuguuguuu

SEQ ID NO: 534987 - RNA, 64 nt, hsa
aucucauauugcuguaagauaauaaauagguauuuuaaaacauuguuuaaaacagaauguuaaa

SEQ ID NO: 534988 - RNA, 64 nt, hsa
agucuuucaacuguuucagaaaacauaauauagcuuaaaacacuucuaauucugugauuaaaau

SEQ ID NO: 534989 - RNA, 64 nt, hsa
gcugaauuuacaguaguuaaccuuuuacaagugguuaaaacauagcuuucuucccguaaaaacu

SEQ ID NO: 534990 - RNA, 64 nt, hsa
ucaucuucauaaagcaagacaacauuaugacacuuuaaaacaguagcaaagaagucuauuuauu

SEQ ID NO: 534991 - RNA, 64 nt, hsa
agaaauuuucuaaauuuuaguaagagagaagcuuuuaaaacaguacauuccugaauaaaacaac

SEQ ID NO: 534992 - RNA, 64 nt, hsa
uuuuucuuuaucaagagaacaaaaugccagaauguuaaaacaguuaacucaaaaucuagucauc

SEQ ID NO: 534993 - RNA, 64 nt, hsa
uugucugaugugacguagcaacacccaggucuucuuaaaacaaagucaucagcuuugccagguu

SEQ ID NO: 534994 - RNA, 64 nt, hsa
uugauauagaccaaagaugguguacucuaauuuuuuaaaacaguaauggaacacaauuuuuuuc

SEQ ID NO: 534995 - RNA, 64 nt, hsa
ugcacagaccugaggaacuuuacacugaccagcuuuaaaacaguacuuuaaaaggaaaagccug

SEQ ID NO: 534996 - RNA, 64 nt, hsa
guguauuccuaacagucuuuuguugucguuguuuuuaaaacaaagguacggaccaugugcuaua

SEQ ID NO: 534997 - RNA, 64 nt, hsa
aaugcacauuuaaagagaagcaucuaccacggcuuuaaaacaaaacaacucugagaugaacaau

SEQ ID NO: 534998 - RNA, 64 nt, hsa
uuauguauuuuuugaaguuaugaacuauaaaauguuaaaacauuuuuugcugggacaaaauguu

SEQ ID NO: 534999 - RNA, 64 nt, hsa
ugcuuuuuuccucugcucuucccuucuguaaauuuuaaaacauuuuccuccccucuggccagug

SEQ ID NO: 535000 - RNA, 64 nt, hsa
auuuggaaaauauagacauauuucuuuugcuuucuuaaaacagcuuaaaaugaugaacuuuuau

SEQ ID NO: 535001 - RNA, 64 nt, hsa
ggccucuuaaucccuuaccugagaaugaagggauuuaaaacacugauuuaacauugaaaggccu

SEQ ID NO: 535002 - RNA, 64 nt, hsa
uuuagucugaugcuguuguauuuuuucauuuuauuuaaaacacuacuuacuucuuauucucuua

SEQ ID NO: 535003 - RNA, 64 nt, hsa
agaauuaauguuuucaaaugugcaacucuaguuuuuaaaacaaaauuugguucuuuacauucau

SEQ ID NO: 535004 - RNA, 64 nt, hsa
uuugcugccuugcuccuagcagacagaaacuggauuaaaacaauuuuuuuuuuccucuucagaa

SEQ ID NO: 535005 - RNA, 64 nt, hsa
uuuccuucauucauagggaaagguuuuguauuuuuuaaaacacuaaaagcagcgucacucuacc

SEQ ID NO: 535006 - RNA, 64 nt, hsa
uccuucaccucgucguauauauccucgauaaguauuaaaacaguauuugaguuuaaaagaguuu

SEQ ID NO: 535007 - RNA, 64 nt, hsa
uuuggguuagaauuuuucuuuuuguacuguuucuuuaaaacagaguucuuaguaacaggggcag

SEQ ID NO: 535008 - RNA, 64 nt, hsa
auauccagugcaaucaacugucauuucuuuuuccuuaaaacauaugaguauauagaaagaaaag

SEQ ID NO: 535009 - RNA, 64 nt, hsa
cgucauuucuguguccucaauuuuaucugaaagauuaaaacaaaauauauuaugucacuauuca

SEQ ID NO: 535010 - RNA, 64 nt, hsa
uacugagauauauuuuugcagaugcaguauauauuuaaaacauuuaauccaaaauaagucuaug

SEQ ID NO: 535011 - RNA, 64 nt, hsa
ugugucaaauccuuuaguguauuuucaacuuuuauuaaaacacaagauaauucauacuggagag

SEQ ID NO: 535012 - RNA, 64 nt, hsa
gguugcuaaauauugaagugguuguaacaauuuguuaaaacaacaaugaaauuuaccacauuaa

SEQ ID NO: 535013 - RNA, 64 nt, hsa
guuaugucuaggaaacaaggcacauacuuuaauuuuaaaacacuugaugcuggcuggguggggu

SEQ ID NO: 535014 - RNA, 64 nt, hsa
uguucagaugcaucuggcaccaauuagguauuucuuaaaacaggacucaucugucagagugcac

SEQ ID NO: 535015 - RNA, 64 nt, hsa
gguagugacugagauguaaaaauagauuuuagaauuaaaacaaaauccaaguccucacaccccu

SEQ ID NO: 535016 - RNA, 64 nt, hsa
cgucagauguuuaaaacaccuucuauagcaucacuuaaaacacguuuuaaggacugacugaggc

SEQ ID NO: 535017 - RNA, 64 nt, hsa
uacugauggaauuuuuuuguacgacgucagauguuuaaaacaccuucuauagcaucacuuaaaa

SEQ ID NO: 535018 - RNA, 64 nt, hsa
aagccaaaauuaagguguuugaaaauaguuuauuuuaaaacaauaggaugggcuucugugccca

SEQ ID NO: 535019 - RNA, 64 nt, hsa
uauauuugauuuauuaacuuaauaaucaagagccuuaaaacaucauuccuuuuuauuuauaugu

SEQ ID NO: 535020 - RNA, 64 nt, hsa
aagcauguauuuuauaaucaaaaauaauuaagauuuaaaacaauguauuugacuacuaaaaagc

SEQ ID NO: 535021 - RNA, 64 nt, hsa
gggcaacacagcaagaccccaucucuacaaaauauuaaaacauuagcuaggcaugguggugcac

SEQ ID NO: 535022 - RNA, 64 nt, hsa
aauuuaucucaaaaucuccauauauaggaucagcuuaaaacauaaagaaaaccuugaauuucuc

SEQ ID NO: 535023 - RNA, 64 nt, hsa
aucuaaaaaaaaauucuuagcaaugaaauugcuguuaaaacacaaauuucaaucaaauacuuuu

SEQ ID NO: 535024 - RNA, 64 nt, hsa
uuuggcugcaggcagcaaaaacagcuggacuuauuuaaaacaacuuguuuuugaguuuucuuau

SEQ ID NO: 535025 - RNA, 64 nt, hsa
aggcucaacaagggucucauaucuaacuuccuccuuaaaacagagaaggucaaucuaguuccag

SEQ ID NO: 535026 - RNA, 64 nt, hsa
gcaagcagaugacaaaaaggugcagaaggcaaucuuaaaacagaaaggugcaggagguaccuua

SEQ ID NO: 535027 - RNA, 64 nt, hsa
uuauuggaaggcaagucauuauuacugguauuaguuaaaacacauaucaaaugcuugcucuuca

SEQ ID NO: 535028 - RNA, 64 nt, hsa
gaguauuuuuggaaaaaaaaauaauauuuuuauguuaaaacaauuuuaaaaucuuaaaauggcc

SEQ ID NO: 535029 - RNA, 64 nt, hsa
guggaauguuauuguucaacguuguuuacagcucuuaaaacauggugaggaaugccuaagucuu

SEQ ID NO: 535030 - RNA, 64 nt, hsa
gauauguugaugaaauucuggaucaggagggguguuaaaacaucaaaaugauggcgacuuguau

SEQ ID NO: 535031 - RNA, 64 nt, hsa
gauugucaaauacagcauuucuuuggaaaccaccuuaaaacauuagugcuaugguuaugagugu

SEQ ID NO: 535032 - RNA, 64 nt, hsa
acgcuuuuuagcuaaauauauacucuucucuaguuuaaaacauuugaacuugccuaguuagugu

SEQ ID NO: 535033 - RNA, 64 nt, hsa
uaaauauccaaagaugccuuuugaauuucaaagauuaaaacacagcuagaguaguaguauugua

SEQ ID NO: 535034 - RNA, 64 nt, hsa
acuucauuuuauguccuuucacaaauaaauuaguuuaaaacagaaaguggcuacuugccauuuu

SEQ ID NO: 535035 - RNA, 64 nt, hsa
cucauuuugcgaggcuuaggcagcuagacaucguuuaaaacaaaauauuaacuuauauuacaug

SEQ ID NO: 535036 - RNA, 64 nt, hsa
auguuuucaagaaauguacacugugguaaaugauuuaaaacacuaguauaguguuguguagcuu

SEQ ID NO: 535037 - RNA, 64 nt, hsa
agccuuguguucuguauuuuucuuguaguguuaguuaaaacauauguuucaaaaauauaagaaa

SEQ ID NO: 535038 - RNA, 64 nt, hsa
uucacauuucuaaauuuaacagagaugcuguagcuuaaaacauguuuugauaaguaauuacacu

SEQ ID NO: 535039 - RNA, 64 nt, hsa
ccugguaauacagcucagugucauuuuccuauuuuuaaaacaugcucuacaugccuaauguuuu

SEQ ID NO: 535040 - RNA, 64 nt, hsa
gugucuucucaagcuuucuuuacugaggaauucagcuugugacacagauacaucccacuagcuu

SEQ ID NO: 535041 - RNA, 64 nt, hsa
ggaauucagcuugugacacagauacaucccacuagcuugugagguggaacuaguaauaaagacc

SEQ ID NO: 535042 - RNA, 64 nt, hsa
ucaagcuuuacugugaaucagaaacauccaguaagcuugugacaaaugcagacuccuagggaaa

SEQ ID NO: 535043 - RNA, 64 nt, hsa
ucugacauuauuaguggaauuccacaccaacagggcuugugagcuuccauuucaucuuacugua

SEQ ID NO: 535044 - RNA, 64 nt, hsa
agcaggagaucaugagauuucaucacucaggauggcuugugauuuauuuuauuuuauucuuuuu

SEQ ID NO: 535045 - RNA, 64 nt, hsa
uauuuuaggaauuaugacaagcuaauugaauuaggcuugugacaauuagaguaauuuacaugac

SEQ ID NO: 535046 - RNA, 64 nt, hsa
acuagugagccacacgccacagucagcgucugcugcuugugaagaaauagccuaccagguacag

SEQ ID NO: 535047 - RNA, 64 nt, hsa
uuuuuaagaaaaagaaaagccuuauuugacuuaugcuugugauacuggacuucuuaccaauccg

SEQ ID NO: 535048 - RNA, 64 nt, hsa
aggcagaacaguaucaaaagaagaaucggaagaugcuugugauuuuaauauuauuugucaucau

SEQ ID NO: 535049 - RNA, 64 nt, hsa
uucguuuugggggugguggugcuggcugggccaugcuugugaagugaugugugucucugauuua

SEQ ID NO: 535050 - RNA, 64 nt, hsa; identical to SEQ ID NO: 476364

SEQ ID NO: 535051 - RNA, 64 nt, hsa; identical to SEQ ID NO: 476365

SEQ ID NO: 535052 - RNA, 64 nt, hsa; identical to SEQ ID NO: 476366

SEQ ID NO: 535053 - RNA, 64 nt, hsa; identical to SEQ ID NO: 476367

SEQ ID NO: 535054 - RNA, 64 nt, hsa; identical to SEQ ID NO: 476368

SEQ ID NO: 535055 - RNA, 64 nt, hsa; identical to SEQ ID NO: 476369

SEQ ID NO: 535056 - RNA, 64 nt, hsa; identical to SEQ ID NO: 476370

SEQ ID NO: 535057 - RNA, 64 nt, hsa; identical to SEQ ID NO: 476371

SEQ ID NO: 535058 - RNA, 64 nt, hsa; identical to SEQ ID NO: 476372

SEQ ID NO: 535059 - RNA, 64 nt, hsa; identical to SEQ ID NO: 476373

SEQ ID NO: 535060 - RNA, 64 nt, hsa; identical to SEQ ID NO: 476374

SEQ ID NO: 535061 - RNA, 64 nt, hsa; identical to SEQ ID NO: 476375

SEQ ID NO: 535062 - RNA, 64 nt, hsa; identical to SEQ ID NO: 476376

SEQ ID NO: 535063 - RNA, 64 nt, hsa; identical to SEQ ID NO: 476377

SEQ ID NO: 535064 - RNA, 64 nt, hsa; identical to SEQ ID NO: 476378

SEQ ID NO: 535065 - RNA, 64 nt, hsa; identical to SEQ ID NO: 476379

SEQ ID NO: 535066 - RNA, 64 nt, hsa; identical to SEQ ID NO: 476380

SEQ ID NO: 535067 - RNA, 64 nt, hsa; identical to SEQ ID NO: 476381

SEQ ID NO: 535068 - RNA, 64 nt, hsa; identical to SEQ ID NO: 476382

SEQ ID NO: 535069 - RNA, 64 nt, hsa; identical to SEQ ID NO: 476383

SEQ ID NO: 535070 - RNA, 64 nt, hsa
gcagcagcauggaggagggugcugaaccucgggaacgagcuauccuagcuucugaauccagguu

SEQ ID NO: 535071 - RNA, 64 nt, hsa
ugaugauucuacuugcuguagaugaaugguuaacacgagcuaguuaaacagugccauuguuuug

SEQ ID NO: 535072 - RNA, 64 nt, hsa
augaugacuacgucccgugucuccaggggaucacacgagcuagcuucugcaauguuuaucuaga

SEQ ID NO: 535073 - RNA, 64 nt, hsa
ugaauuagaagccccuauuacaaauaagagcaccacgagcuaaaauuuaccaacccauuuauca

SEQ ID NO: 535074 - RNA, 64 nt, hsa
ccucauagugcaguaauaaguaaguugauuauauacgagcuauguaacuuauauuuuuuaaugg

SEQ ID NO: 535075 - RNA, 64 nt, hsa
ucacugauuaacguugcuaaacucuuggugaggcacgagcuaccagccaauugcucuucaucac

SEQ ID NO: 535076 - RNA, 64 nt, hsa
ucgaaguggagaaaaugaggauauauucuugcagacgagcuauaggucauacaugaaugucuag

SEQ ID NO: 535077 - RNA, 64 nt, hsa
uucugaauuauuuuaucuuaaauugugauuuuaaacgagcuauuaugguacggaacuuuuuuua

SEQ ID NO: 535078 - RNA, 64 nt, hsa
accuugaaguagcacagcccguccuugcaugugcacgagcuaucauuugaguaaaaguauacau

SEQ ID NO: 535079 - RNA, 64 nt, hsa
auauauacauauauagacagacaggaacgcguccacgagcuauauaucuauauauuucucucac

SEQ ID NO: 535080 - RNA, 64 nt, hsa
uagaaaacuuuuaaaaaaauuaauauggcagaauacgagcuauuaauaguaucagauacagaac

SEQ ID NO: 535081 - RNA, 64 nt, hsa
ucccauauccagggcuccggguacuggcagugggacgagcuagcccgaacugacuucagcagcu

SEQ ID NO: 535082 - RNA, 64 nt, hsa
guaagaaaaugaaaauuuaauuuuuuuuucuaggacgagcuauagaaaagcuauugagaguauc

SEQ ID NO: 535083 - RNA, 64 nt, hsa
gcugaugacgaacuaucucuaacuggucuugaccacgagcuaguucugaauugcaggggccuca

SEQ ID NO: 535084 - RNA, 64 nt, hsa
auaacuguuugguauuugaugcagaugagagagcacgagcuaaaguaaaauaucuaacagguga

SEQ ID NO: 535085 - RNA, 64 nt, hsa
agagcggaaaaaaaaaaaagaggucaggguuuuaacgagcuaugcaaucuuuuuccaaaaccca

SEQ ID NO: 535086 - RNA, 64 nt, hsa
acacaucuaccauauauacagauauauucuauauacgagcuauauauaaauauauauauacaua

SEQ ID NO: 535087 - RNA, 51 nt, hsa
augguggcccaugccuguaguacgagcuacucaggagguugaggcagggga

SEQ ID NO: 535088 - RNA, 64 nt, hsa
aauuguguucuuuuggaaucaucccaauuauaacacgagcuauugcauaauacaaauaacccuc

SEQ ID NO: 535089 - RNA, 64 nt, hsa
guaaggauggcuugcauggagaugguccucgcgaacgagcuacagcuaccgugccugacagcag

SEQ ID NO: 535090 - RNA, 64 nt, hsa
caagaacagcgacagcccuucucgagcagaugacacgagcuaguccacguugacagcuuaagac

SEQ ID NO: 535091 - RNA, 64 nt, hsa
agguguaccucccccugccuuccaaccccuuuccacgagcuauauuuauuucuccgaauaaacg

SEQ ID NO: 535092 - RNA, 64 nt, hsa
gcaucugaugcuggggccagggacucucccacgcacgagcuagugaguggcacaccagagccau

SEQ ID NO: 535093 - RNA, 64 nt, hsa
cucaaaucuuguuuccugcuggccuggucugcccacgagcuagagcggggaaauguugagcuca

SEQ ID NO: 535094 - RNA, 64 nt, hsa
uuuguuauuacauuguguaacaaauauaagguuuacgagcuaugagaauuggugcuaucaccau

SEQ ID NO: 535095 - RNA, 63 nt, hsa; identical to SEQ ID NO: 252244

SEQ ID NO: 535096 - RNA, 63 nt, hsa; identical to SEQ ID NO: 252245

SEQ ID NO: 535097 - RNA, 63 nt, hsa; identical to SEQ ID NO: 252246

SEQ ID NO: 535098 - RNA, 63 nt, hsa; identical to SEQ ID NO: 252247

SEQ ID NO: 535099 - RNA, 63 nt, hsa; identical to SEQ ID NO: 252248

SEQ ID NO: 535100 - RNA, 63 nt, hsa; identical to SEQ ID NO: 252249

SEQ ID NO: 535101 - RNA, 63 nt, hsa; identical to SEQ ID NO: 252250

SEQ ID NO: 535102 - RNA, 63 nt, hsa; identical to SEQ ID NO: 252251

SEQ ID NO: 535103 - RNA, 63 nt, hsa; identical to SEQ ID NO: 252252

SEQ ID NO: 535104 - RNA, 63 nt, hsa; identical to SEQ ID NO: 252253

SEQ ID NO: 535105 - RNA, 63 nt, hsa; identical to SEQ ID NO: 252254

SEQ ID NO: 535106 - RNA, 63 nt, hsa; identical to SEQ ID NO: 252255

SEQ ID NO: 535107 - RNA, 63 nt, hsa; identical to SEQ ID NO: 252256

SEQ ID NO: 535108 - RNA, 63 nt, hsa; identical to SEQ ID NO: 252257

SEQ ID NO: 535109 - RNA, 63 nt, hsa; identical to SEQ ID NO: 252258

SEQ ID NO: 535110 - RNA, 63 nt, hsa; identical to SEQ ID NO: 252259

SEQ ID NO: 535111 - RNA, 63 nt, hsa; identical to SEQ ID NO: 252260

SEQ ID NO: 535112 - RNA, 63 nt, hsa; identical to SEQ ID NO: 252261

SEQ ID NO: 535113 - RNA, 63 nt, hsa; identical to SEQ ID NO: 252262

SEQ ID NO: 535114 - RNA, 63 nt, hsa; identical to SEQ ID NO: 252263

SEQ ID NO: 535115 - RNA, 63 nt, hsa; identical to SEQ ID NO: 252264

SEQ ID NO: 535116 - RNA, 65 nt, hsa; identical to SEQ ID NO: 252265

SEQ ID NO: 535117 - RNA, 65 nt, hsa; identical to SEQ ID NO: 252266

SEQ ID NO: 535118 - RNA, 65 nt, hsa; identical to SEQ ID NO: 252267

SEQ ID NO: 535119 - RNA, 65 nt, hsa; identical to SEQ ID NO: 252268

SEQ ID NO: 535120 - RNA, 65 nt, hsa; identical to SEQ ID NO: 252269

SEQ ID NO: 535121 - RNA, 65 nt, hsa; identical to SEQ ID NO: 252270

SEQ ID NO: 535122 - RNA, 65 nt, hsa; identical to SEQ ID NO: 252271

SEQ ID NO: 535123 - RNA, 65 nt, hsa; identical to SEQ ID NO: 252272

SEQ ID NO: 535124 - RNA, 65 nt, hsa; identical to SEQ ID NO: 252273

SEQ ID NO: 535125 - RNA, 65 nt, hsa; identical to SEQ ID NO: 252274

SEQ ID NO: 535126 - RNA, 65 nt, hsa; identical to SEQ ID NO: 252275

SEQ ID NO: 535127 - RNA, 65 nt, hsa; identical to SEQ ID NO: 252276

SEQ ID NO: 535128 - RNA, 65 nt, hsa; identical to SEQ ID NO: 252277

SEQ ID NO: 535129 - RNA, 65 nt, hsa; identical to SEQ ID NO: 252278

SEQ ID NO: 535130 - RNA, 65 nt, hsa; identical to SEQ ID NO: 252279

SEQ ID NO: 535131 - RNA, 65 nt, hsa; identical to SEQ ID NO: 252280

SEQ ID NO: 535132 - RNA, 65 nt, hsa; identical to SEQ ID NO: 252281

SEQ ID NO: 535133 - RNA, 65 nt, hsa; identical to SEQ ID NO: 252282

SEQ ID NO: 535134 - RNA, 65 nt, hsa; identical to SEQ ID NO: 252283

SEQ ID NO: 535135 - RNA, 65 nt, hsa; identical to SEQ ID NO: 252284

SEQ ID NO: 535136 - RNA, 65 nt, hsa; identical to SEQ ID NO: 252285

SEQ ID NO: 535137 - RNA, 65 nt, hsa; identical to SEQ ID NO: 252286

SEQ ID NO: 535138 - RNA, 65 nt, hsa; identical to SEQ ID NO: 252287

SEQ ID NO: 535139 - RNA, 65 nt, hsa; identical to SEQ ID NO: 252288

SEQ ID NO: 535140 - RNA, 65 nt, hsa; identical to SEQ ID NO: 252289

SEQ ID NO: 535141 - RNA, 65 nt, hsa; identical to SEQ ID NO: 252290

SEQ ID NO: 535142 - RNA, 65 nt, hsa; identical to SEQ ID NO: 252291

SEQ ID NO: 535143 - RNA, 65 nt, hsa; identical to SEQ ID NO: 252292

SEQ ID NO: 535144 - RNA, 65 nt, hsa; identical to SEQ ID NO: 252293

SEQ ID NO: 535145 - RNA, 65 nt, hsa; identical to SEQ ID NO: 252294

SEQ ID NO: 535146 - RNA, 65 nt, hsa; identical to SEQ ID NO: 252295

SEQ ID NO: 535147 - RNA, 65 nt, hsa; identical to SEQ ID NO: 252296

SEQ ID NO: 535148 - RNA, 65 nt, hsa; identical to SEQ ID NO: 252297

SEQ ID NO: 535149 - RNA, 65 nt, hsa; identical to SEQ ID NO: 252298

SEQ ID NO: 535150 - RNA, 59 nt, hsa
ccaagccuguggcuggagcugguguguguuuaucuaauaaagucccacaggugccucac

SEQ ID NO: 535151 - RNA, 59 nt, hsa
uaauaugguuguugaaaaugugaucaccuuuaucuaaagugggagaagauacauacaca

SEQ ID NO: 535152 - RNA, 59 nt, hsa
cauccagaaguuccucaagggccaggacuuuaucuaauaccucugugugcuccuccuug

SEQ ID NO: 535153 - RNA, 59 nt, hsa
ggguuuaauauuacccuuuccuauguguuuuaucuaauuauuuugguuguuaauauggu

SEQ ID NO: 535154 - RNA, 59 nt, hsa
aagccgaaaucugcauaaggaagcccacuuuaucuaaaugauauuagccaggauccuug

SEQ ID NO: 535155 - RNA, 59 nt, hsa
guccaugcacaucccugacaccucacaccuuaucuaagucugaagcuggggagaaaggg

SEQ ID NO: 535156 - RNA, 59 nt, hsa
aaguuucucugguuaccccucuucccuuguuaucuaagcuuuccucaguugucaucucu

SEQ ID NO: 535157 - RNA, 59 nt, hsa
aggcagcuuucaucacacccuuuuaacauuuaucuaaaagaauuuaaauucuuuuucaa

SEQ ID NO: 535158 - RNA, 59 nt, hsa
agccaguccacagguuugcauccuggacuuuaucuaaauagugccaagacacaucacua

SEQ ID NO: 535159 - RNA, 59 nt, hsa
ugcuggugaaccaauaccauaagcauguauuaucuaagcacuugaucaagaaauauaca

SEQ ID NO: 535160 - RNA, 59 nt, hsa
auaugguuggcauuaaauuuagcauuucauuaucuaacaaaauuaauauaaauuccagg

SEQ ID NO: 535161 - RNA, 59 nt, hsa
uaaacauccugaaucgggaacaaaggguuuuaucuaauaaagugucucuuccauucacg

SEQ ID NO: 535162 - RNA, 59 nt, hsa
aucugcuuuugguuauaauguguuuuuaauuaucuaaaguaugaagcauuuucuggggu

SEQ ID NO: 535163 - RNA, 59 nt, hsa
uugucaugacauuuccaacacugugugaauuaucuaaaugcgucuaccauuuugcacua

SEQ ID NO: 535164 - RNA, 59 nt, hsa
uauuucauaaaauaagaauuuguucuguguuaucuaaagauguaucaguauauugucac

SEQ ID NO: 535165 - RNA, 59 nt, hsa
gaacuuauaguaaggaaacucacuugauuuuaucuaaccucaaacuuuccaaguuuaau

SEQ ID NO: 535166 - RNA, 59 nt, hsa
aggggaagugaggagaauuucuuucaagauuaucuaaacauuagaaacaugacauuuaa

SEQ ID NO: 535167 - RNA, 59 nt, hsa
aaguuuuaugucccugacucuggcuaaaauuaucuaauuuccagaugcuuuuguagaug

SEQ ID NO: 535168 - RNA, 59 nt, hsa
ucagggucaaaucauguacauuacagauauuaucuaaauucuucuagaauuuauuuuuc

SEQ ID NO: 535169 - RNA, 59 nt, hsa
gcuaagacuuuuuuuccuguggcuuuuauuuaucuaagaggucuuugcauauagaugaa

SEQ ID NO: 535170 - RNA, 59 nt, hsa
uacaggaucuuucagaucaugugcaauuuuuaucuaaccaaucagaaauacuaguuuaa

SEQ ID NO: 535171 - RNA, 59 nt, hsa
aaauaaccaauacuccacugcucauauuuuuaucuaauucagauggaucuuccuuacaa

SEQ ID NO: 535172 - RNA, 59 nt, hsa
uuggccuggcccagcccaagaucccagcguuaucuaacuccuggaggguggacucuguc

SEQ ID NO: 535173 - RNA, 59 nt, hsa
auuauacggcuacauuuacacauuuacacuuaucuaauaaaucagauuucacagucuca

SEQ ID NO: 535174 - RNA, 59 nt, hsa
gaaauuaggauaugacauauaugaaagguuuaucuaagaagaaagaaacagagauaaua

SEQ ID NO: 535175 - RNA, 59 nt, hsa
cuucaauuuggagugacuaacacaaguuguuaucuaaaccuuuaaaccuaucuuccagg

SEQ ID NO: 535176 - RNA, 59 nt, hsa
agauuggauagcaaggcugcuguucuggauuaucuaaugcuccacuucuucuugugaug

SEQ ID NO: 535177 - RNA, 59 nt, hsa
cuccauggacauugcugcucuuggugguguuaucuaauuuuugugauagggaaacaaau

SEQ ID NO: 535178 - RNA, 59 nt, hsa
accagguauggaagccuacgugcucacaguuaucuaaugagguuauuucaaaguuugca

SEQ ID NO: 535179 - RNA, 59 nt, hsa
ugggauaauuuuucuauauuagguacaauuuaucuaaacugaauugagaaaaaauuaca

SEQ ID NO: 535180 - RNA, 59 nt, hsa
aucuuuuuuuaaaaaccgaauuucaucauuuaucuaaagagaaaauaugcagaauaacu

SEQ ID NO: 535181 - RNA, 59 nt, hsa
uuaacacccuuuugugaagaucacagcauuuaucuaagaaacugugaggcuuucugguu

SEQ ID NO: 535182 - RNA, 59 nt, hsa
uuuauauauguauugauuggcaaccagauuuaucuaaguagaacugaauuggcuaggaa

SEQ ID NO: 535183 - RNA, 59 nt, hsa
aguaacuugugaauguuaaguaucaucucuuaucuaaauauuaaaagauaagucaaaca

SEQ ID NO: 535184 - RNA, 59 nt, hsa
cacaaugucaguauuucaguguaguuaauuuaucuaaauuaaagccuuuaguaucagug

SEQ ID NO: 535185 - RNA, 59 nt, hsa
uuauuuuguauaauuuuuaugcucuuugauuaucuaauaaggccaguauuucaaaagcu

SEQ ID NO: 535186 - RNA, 59 nt, hsa
cccauuauuaaaucaaccugagccacauguuaucuaaaggaacugauucacaacuuucu

SEQ ID NO: 535187 - RNA, 59 nt, hsa
ucuaguguacaucuagcuaaaagugugguuuaucuaaaccguuuuaauaagcaagauga

SEQ ID NO: 535188 - RNA, 59 nt, hsa
ucacuugcacaucauggaggguuuagugcuuaucuaauuugugccucacuggacuuguc

SEQ ID NO: 535189 - RNA, 59 nt, hsa
aguuuagaaauauccuaaucuauuuuuauuuaucuaaaaguaaguguuuuccggcugau

SEQ ID NO: 535190 - RNA, 59 nt, hsa
caguaugcccauuuguuuuuauggcuuucuuaucuaaacugcacugaugaacuagauua

SEQ ID NO: 535191 - RNA, 59 nt, hsa
ccugcuucugauaugcaguuuuccuuaaauuaucuaaaaucugcuagggaauaucaaua

SEQ ID NO: 535192 - RNA, 59 nt, hsa
accuuccaagugaauaugauuauugaggauuaucuaauuauuaucuacguuucucucua

SEQ ID NO: 535193 - RNA, 59 nt, hsa
uuauugugacaacucuagaccugccugcuuuaucuaauguaaucaugcucaaugucuac

SEQ ID NO: 535194 - RNA, 59 nt, hsa
aaagaaguaugucaguuauaauaaccugguuaucuaaccuguuccauuccauggaacca

SEQ ID NO: 535195 - RNA, 59 nt, hsa
accagcacuagcuuguuccaagcuggaauuuaucuaaucuauuuuuguguuuaaaaaag

SEQ ID NO: 535196 - RNA, 59 nt, hsa
uucaggggcuagagugauuuuuuuccagauuaucuaaaguuggaugcccacacuaugaa

SEQ ID NO: 535197 - RNA, 59 nt, hsa
ggcuagcaaucugccuguaucucucacuauuaucuaaaagaaaccuuccaaugcuucug

SEQ ID NO: 535198 - RNA, 59 nt, hsa
uguuaaaaggcauuuauaauuauuuuuaauuaucuaaguuuuaauacaagaacgauuuc

SEQ ID NO: 535199 - RNA, 59 nt, hsa
uguccuuguuaagaauuucuugaagugauuuaucuaaaauaaagguuggcaaacuuuuu

SEQ ID NO: 535200 - RNA, 59 nt, hsa
cauuuauuguuuaggaguauaauuuuauuuuaucuaaaauaauagucuauuuuuucuuu

SEQ ID NO: 535201 - RNA, 59 nt, hsa
augaaaagggacuuaaaaaguaaacaugauuaucuaaauuacuuaaaauuuuuuaaucu

SEQ ID NO: 535202 - RNA, 59 nt, hsa
uuucaauaugcaaguuaggcuuaauuuuuuuaucuaaugaucaucaugaaaugaauaag

SEQ ID NO: 535203 - RNA, 59 nt, hsa
gcuuguaaacagaugugauagagauaaaguuaucuaacaaauugguuauauucuaagau

SEQ ID NO: 535204 - RNA, 59 nt, hsa
aauauauaguuagcuuuauugaagucuucuuaucuaaacccagcaaaacagauucaaag

SEQ ID NO: 535205 - RNA, 59 nt, hsa
uucaagcaaaagaauuauuaacucuguguuuaucuaaaauguugaauccauucugguuu

SEQ ID NO: 535206 - RNA, 59 nt, hsa
uguuuuuaguaguuucccaacuuuaagacuuaucuaauuuaacugagaaagaaagccuu

SEQ ID NO: 535207 - RNA, 59 nt, hsa
cuuuuuaauuuuaguaauuuuuacaaagguuaucuaaugucuuuuauuucuuguuuucu

SEQ ID NO: 535208 - RNA, 59 nt, hsa
ggagugaugaaucaucaccgguuguccccuuaucuaacuccauaaaagugggaauuuca

SEQ ID NO: 535209 - RNA, 59 nt, hsa
uacaggauuuuggcucgauaccucaagauuuaucuaacagugcaguuucauuuagauaa

SEQ ID NO: 535210 - RNA, 59 nt, hsa
ucuccagaagaggggagcagaguccgagcuuaucuaaauaugaauguggccacaaagcu

SEQ ID NO: 535211 - RNA, 59 nt, hsa
auuuacaauuuauguauucccuaauccaauuaucuaaaucuuccuuuucuuucagaaau

SEQ ID NO: 535212 - RNA, 59 nt, hsa
gagcuaagacaaacaaaacaaaacacagcuuaucuaaucuaaugagaaacucagaaaaa

SEQ ID NO: 535213 - RNA, 59 nt, hsa
uaaaugugaauaugcuuuuacauuugggcuuaucuaauuugcaauaagagagccucucu

SEQ ID NO: 535214 - RNA, 59 nt, hsa
ggaaacugagggcagagagguuaacagauuuaucuaagguccccagcagaauugacagu

SEQ ID NO: 535215 - RNA, 59 nt, hsa
ucguguucuguguauaccaaaugauucuguuaucuaaagaagcuuuuugcugggaaaac

SEQ ID NO: 535216 - RNA, 59 nt, hsa
accuggcucucucucuguccugccucccauuaucuaacacauuuuuuacauguacauuu

SEQ ID NO: 535217 - RNA, 59 nt, hsa
gauuugaucuuuuuucaguuucacauaccuuaucuaagguuucccaggauuuaaacaga

SEQ ID NO: 535218 - RNA, 59 nt, hsa
auaauuuuaaaaaaucccuuguaggauuauuaucuaaauuuauaugucuaacuucuacu

SEQ ID NO: 535219 - RNA, 59 nt, hsa
uuuggucuuggcuuguucucauaagucauuuaucuaaguuuguguuucugugugugugu

SEQ ID NO: 535220 - RNA, 59 nt, hsa
guccccaucugucaaaugagaagauuggauuaucuaaucuuuuagauccuuaacaacuc

SEQ ID NO: 535221 - RNA, 59 nt, hsa
gcuggugcuaaauaacagucuuuauuauauuaucuaauuuugacuaaagaaauacuuuu

SEQ ID NO: 535222 - RNA, 59 nt, hsa
uucauuugugaguuuggauauagagcacauuaucuaaaccauuuuguaguuccaaaaac

SEQ ID NO: 535223 - RNA, 59 nt, hsa
gaaaaaaugaaagcuauuucaugcaaacauuaucuaauuuagcuuaaaagugaaagugg

SEQ ID NO: 535224 - RNA, 59 nt, hsa
aagcuugugaauauguaaauuuuaaacuauuaucuaacuaaguguacugaauugucguu

SEQ ID NO: 535225 - RNA, 59 nt, hsa
cuuucuauuacuuuuuaggcuuuaguauauuaucuaaaguuuggcuuuugauguggaug

SEQ ID NO: 535226 - RNA, 59 nt, hsa
cuguccgguggagaucccacccgaacgucuuaucuaaucaugaaacucccuaguuccuu

SEQ ID NO: 535227 - RNA, 59 nt, hsa
uacugcuuagcauuuugcauguuuuacuuuuaucuaaaguuuuguuuuguuuuauuauu

SEQ ID NO: 535228 - RNA, 59 nt, hsa
uuucauuucugguuuuuacuauacaaugguuaucuaacauacuaaguugguacccuacc

SEQ ID NO: 535229 - RNA, 59 nt, hsa
auuuuguacugagaucauacacuauuucauuaucuaaguguauuaauuguuugguugcu

SEQ ID NO: 535230 - RNA, 59 nt, hsa
auuuuguauucaauguguaaauacuuuuauuaucuaauacuaucuuacgucuaauuagu

SEQ ID NO: 535231 - RNA, 59 nt, hsa
gaguauuuauugucaguuuuguucacuuguuaucuaauacaaaauuauaaagccuucag

SEQ ID NO: 535232 - RNA, 59 nt, hsa
ggauucauaaggagcuuaucugaacagauuuaucuaagaaaaaaaaaaaacgacauaaa

SEQ ID NO: 535233 - RNA, 59 nt, hsa
ugaaaguauucuaagccaaguuuuaaauauuaucuaacagacaagagugguauauacaa

SEQ ID NO: 535234 - RNA, 59 nt, hsa
uuuuccugcggcaucagaugaauuguuaauuaucuaauuucugaaaugugcagcuccca

SEQ ID NO: 535235 - RNA, 59 nt, hsa
uagacuaauauggguaauuacccuuugguuuaucuaaaguguguucaugaugacugagg

SEQ ID NO: 535236 - RNA, 59 nt, hsa
caaugccuuuauuuaaaaaaauugucuacuuaucuaaauauucauaccacaauuucaaa

SEQ ID NO: 535237 - RNA, 59 nt, hsa
uaagugauaugagaaaucuuuaaccagccuuaucuaaaaauaaaaagagaagccauugu

SEQ ID NO: 535238 - RNA, 59 nt, hsa
ccugccaauguuuaacuuuuaaaagcaucuuaucuaaaagaaaggcuauccaguagagc

SEQ ID NO: 535239 - RNA, 59 nt, hsa
gagguugauaaaguauuacugauaaaaaauuaucuaaggaaaaaaacagaaaauuauuu

SEQ ID NO: 535240 - RNA, 59 nt, hsa
auuugcuguuaaauucugugaaguuucaguuaucuaaaauaaauauacacaaauaugaa

SEQ ID NO: 535241 - RNA, 59 nt, hsa
ucaagaccuauuggggguuuuguuuuauuuuaucuaauuuuuuuuuuuuuuugguauac

SEQ ID NO: 535242 - RNA, 59 nt, hsa
uguguacauaguuaccuuuaacucagugguuaucuaauagcucuaaacucauuaaaaaa

SEQ ID NO: 535243 - RNA, 59 nt, hsa
caauuaugaaagugaaaugcaaaugucuguuaucuaacuacaaauugucagauuucuua

SEQ ID NO: 535244 - RNA, 59 nt, hsa
uuugaaauuguagugcaaaauggucaguauuaucuaaaugaaugagccaaaaugacuuu

SEQ ID NO: 535245 - RNA, 59 nt, hsa
auuuccccaagccccauuuuuucuugucuuuaucuaauaaacucaauauuaagauguua

SEQ ID NO: 535246 - RNA, 59 nt, hsa
cugaacugcuagcccucccuuuugucuguuuaucuaauucucagguaugaggcuuuagu

SEQ ID NO: 535247 - RNA, 59 nt, hsa
gaagaaucuguacuuuguauguauagaauuuaucuaauaaaucauucauagaucauuuu

SEQ ID NO: 535248 - RNA, 59 nt, hsa
ugugguccauuuuauuuucuaauauugguuuaucuaauguuuucugcguggugcugucu

SEQ ID NO: 535249 - RNA, 59 nt, hsa
ggcaugagcccuugaauuucaggcaccuuuuaucuaaugagaguuuuuacagcucauca

SEQ ID NO: 535250 - RNA, 59 nt, hsa
guagcguaauuaaccucucacaaagaugcuuaucuaaccuccccagcagucauggguuu

SEQ ID NO: 535251 - RNA, 59 nt, hsa
cacucagcuaccuaauuccucaaugaccuuuaucuaaaaucuccauggaagcaauaaau

SEQ ID NO: 535252 - RNA, 59 nt, hsa
gagcugucauuguccuuuauucaacuaguuuaucuaaauuugugauugcuuaggguuuu

SEQ ID NO: 535253 - RNA, 59 nt, hsa
acuuauuucagguaauagcuuggggauauuuaucuaaagguacccccaacaaaucuucu

SEQ ID NO: 535254 - RNA, 59 nt, hsa
guguguccaguagugcaggaaaugaugucuuaucuaaugauuugcuucucuagaggaga

SEQ ID NO: 535255 - RNA, 59 nt, hsa
uauuugccuuaauauaagcuuuuaagcaguuaucuaacuaguguccacaacccuguaac

SEQ ID NO: 535256 - RNA, 59 nt, hsa
acguggaauuguacuuguauaugauuaccuuaucuaaaaugaauaagaggugauggacc

SEQ ID NO: 535257 - RNA, 59 nt, hsa
cauuugugagcugugggacuuuaggcaaguuaucuaaaugcugcuaugcuauagucucc

SEQ ID NO: 535258 - RNA, 59 nt, hsa
uauuucccagcagugacaaucuacacccuuuaucuaaauaaauauugagaugugcuuuu

SEQ ID NO: 535259 - RNA, 59 nt, hsa
auucauuucuguauuauauucucaacucguuaucuaaagcaucagaacauguguuuuca

SEQ ID NO: 535260 - RNA, 59 nt, hsa
caagucucugaaagcagaacuauccaguguuaucuaaaaauuaaucugagcacaucaag

SEQ ID NO: 535261 - RNA, 59 nt, hsa
uguguguguauauauauauauauguacaguuaucuaaguuaauuuaaaguuguuugugc

SEQ ID NO: 535262 - RNA, 59 nt, hsa
aacugcuccugguauuauauauuugcuaguuaucuaauguuuuaaaagaaaauauaccu

SEQ ID NO: 535263 - RNA, 59 nt, hsa
auaaaaagcucuauaaggaggaaaggccuuuaucuaauucuuaucuacagacacuuacu

SEQ ID NO: 535264 - RNA, 59 nt, hsa
uguagccuaaguacguaaacaaauuaauguuaucuaaguuuuucauauuucauggacaa

SEQ ID NO: 535265 - RNA, 59 nt, hsa
gcaugauuuuuauauaacuaguuucaguuuuaucuaauaacuuacuuuuuaaaucaaua

SEQ ID NO: 535266 - RNA, 59 nt, hsa
ccccugagagaugcucaccaagcuucuauuuaucuaauuuaaaacuugaaaguaaagcc

SEQ ID NO: 535267 - RNA, 59 nt, hsa
cucacccaucuaaguugauaucuaaaauuuuaucuaaguugguaucuaaaauuuuucau

SEQ ID NO: 535268 - RNA, 59 nt, hsa
gguggagaaccugacagaggacuaagaaguuaucuaauguaaaagaccucaggcaccac

SEQ ID NO: 535269 - RNA, 59 nt, hsa
aaacaugccagaaggaaucuucucaucuuuuaucuaacuauauguacagcucuccccuc

SEQ ID NO: 535270 - RNA, 59 nt, hsa
guguaaucaugagaguauaagaaucuggauuaucuaacauuguuagcccuguguaugua

SEQ ID NO: 535271 - RNA, 59 nt, hsa
aucacucuguucauuccuccagguauucguuaucuaauagggcaauuaauuccuucagc

SEQ ID NO: 535272 - RNA, 59 nt, hsa
gcaauaaagucuccuugguacugaaaucauuaucuaaaauaaaggaaauguuaucaaaa

SEQ ID NO: 535273 - RNA, 59 nt, hsa
auuuguaaaccaagaaauuaauccuguguuuaucuaacuucauaauagcaauuauugcc

SEQ ID NO: 535274 - RNA, 59 nt, hsa
gaguuaaaguuuuauauuuuccugcucaguuaucuaaugucuuagaucaguggucccca

SEQ ID NO: 535275 - RNA, 59 nt, hsa
acguuaauuuucaguuuuaaauaaucaguuuaucuaagaaaagggaauuuuaacuuuuc

SEQ ID NO: 535276 - RNA, 59 nt, hsa
gauuuuguauguuagacuuuuuacauuguuuaucuaauauuauuuaugacaguaauuuu

SEQ ID NO: 535277 - RNA, 59 nt, hsa
guaauucuaggagacacguguugaucuaguuaucuaacauuguuguuauaagaaaauga

SEQ ID NO: 535278 - RNA, 59 nt, hsa
caacauuuguuuagcuugcuuggcuuuaauuaucuaaagccaaugaaagacuucuuugu

SEQ ID NO: 535279 - RNA, 59 nt, hsa
aauagccccaaacugcaauuccauaugacuuaucuaacaucuuggggggaaagaauauu

SEQ ID NO: 535280 - RNA, 59 nt, hsa
gacgccauuuucuguuauaaucauuuuuguuaucuaauuuggggaaacuauucaucugu

SEQ ID NO: 535281 - RNA, 59 nt, hsa
uggcuagcuauugggcaccaguuuuucuguuaucuaaaauuucacacaacuucauuguu

SEQ ID NO: 535282 - RNA, 59 nt, hsa
uuaugguuccaagugcaaaacagguguucuuaucuaaaacgucaauuagaaaauuaucu

SEQ ID NO: 535283 - RNA, 59 nt, hsa
uuauauuuuuaucauuccuuuuucuucauuuaucuaaccccaaagcccugauaugccac

SEQ ID NO: 535284 - RNA, 59 nt, hsa
augauccgugcuuaaugaucaaguguuacuuaucuaauaauccucuagaaagaacccug

SEQ ID NO: 535285 - RNA, 59 nt, hsa
uaaucugaaggaugauacuguaacuugauuuaucuaauuagcuuuuaauuaucuacagc

SEQ ID NO: 535286 - RNA, 59 nt, hsa
gguguguauucaaauaauacuugaccagcuuaucuaaaauguacauaauuuugagguag

SEQ ID NO: 535287 - RNA, 59 nt, hsa
uaaaccuugugauucugcuuauaagucauuuaucuaaucuauaugauaugcagccgcug

SEQ ID NO: 535288 - RNA, 59 nt, hsa
uaaaaugauuacuuuaaaaauaauaaaauuuaucuaauuuaaaguugauauuauuuuug

SEQ ID NO: 535289 - RNA, 59 nt, hsa
gacucucccagcauguuucuaccaaagcuuuaucuaagcuucucagaacacucuccuaa

SEQ ID NO: 535290 - RNA, 59 nt, hsa
uugaugaucguagagaaagacuugguaauuuaucuaaguaucuuuaauaaaucuuucag

SEQ ID NO: 535291 - RNA, 59 nt, hsa
aggauugaaaaauguauaucacucaauuuuuaucuaagaaggauagguuauaaagggag

SEQ ID NO: 535292 - RNA, 59 nt, hsa
aaucuagcuuuuuuguacagacuuagaaauuaucuaaagauuucaucuuuuuaccucau

SEQ ID NO: 535293 - RNA, 59 nt, hsa
uuuaguucuaacauugaguuuggacaauuuuaucuaauuguaauucucuagggugccag

SEQ ID NO: 535294 - RNA, 59 nt, hsa
gaagauggucacuuuaaccuuguaaauauuuaucuaaaaugauauuuacaaaacuguaa

SEQ ID NO: 535295 - RNA, 59 nt, hsa
aaaacaaaggcaaacuuuguacuauccaguuaucuaaggaacaauaaaaacauuaggag

SEQ ID NO: 535296 - RNA, 59 nt, hsa
cagguguuuaaaaagaaagaaaaguuguuuuaucuaauacuguaaguaguugucauauu

SEQ ID NO: 535297 - RNA, 59 nt, hsa
cugguaaugucuucaguaaaauauuuucuuuaucuaaauauuaacauucuaagucuacc

SEQ ID NO: 535298 - RNA, 59 nt, hsa
auucuacucucagaggugcaaaaagauacuuaucuaacuggacacuuuuacuguuuucu

SEQ ID NO: 535299 - RNA, 59 nt, hsa
ucccucaaaauuuucauggacaugcaaucuuaucuaaaagccugcuucagggcugggcg

SEQ ID NO: 535300 - RNA, 59 nt, hsa
cucuugccuuuuuuuuuuuaaauuuuaaauuaucuaaauuuauuguuuguugugguguc

SEQ ID NO: 535301 - RNA, 59 nt, hsa
uuuccuguggccguuugaacuuugagcauuuaucuaaauuaaauuggcccaggguuggc

SEQ ID NO: 535302 - RNA, 59 nt, hsa
uuugcauggaaauuaaguaggcuguuuauuuaucuaaaggaaucaaguccacucuucug

SEQ ID NO: 535303 - RNA, 59 nt, hsa
aaaccagcagguugcuaaaagaaggcauuuuaucuaaaguuauuuuaauaggugguaua

SEQ ID NO: 535304 - RNA, 59 nt, hsa
auuuaaaagguauaaaucaaaauaacaaauuaucuaaaaaaaaucuauccuguacaugu

SEQ ID NO: 535305 - RNA, 59 nt, hsa
uaguuagaugaugugacaaccucuaauauuuaucuaauaaauauguauucagaugaaac

SEQ ID NO: 535306 - RNA, 59 nt, hsa
uaucacccucauugauauuaucauuggaauuaucuaaggugagccccaguuuccagggc

SEQ ID NO: 535307 - RNA, 59 nt, hsa
uaugccaaauuuuauaugaauuuuucagauuaucuaagcuuccagguuuuauaauuaga

SEQ ID NO: 535308 - RNA, 59 nt, hsa
gaguuuacaauacugcaaacuguguuauuuuaucuaauccauugcuuaaugaguguguu

SEQ ID NO: 535309 - RNA, 59 nt, hsa
auccuauuuagagggugguuuuuuuuaauuuaucuaauggcuacgauauagccagauuc

SEQ ID NO: 535310 - RNA, 59 nt, hsa
cugagaacugucacucuaaccucuccagcuuaucuaacaugucauaaacauaauaaauc

SEQ ID NO: 535311 - RNA, 52 nt, hsa; identical to SEQ ID NO: 252460

SEQ ID NO: 535312 - RNA, 59 nt, hsa
uugcauugacugucacauaaugcucauacuuaucuaauguugaguuauuaauauguuau

SEQ ID NO: 535313 - RNA, 59 nt, hsa
acugcaguccuggagcaaucacagaugaguuaucuaagaauacagcuuucugaccuuca

SEQ ID NO: 535314 - RNA, 59 nt, hsa
uaagcuaccuuuuguaagugccauguuuauuaucuaaucauuccaaguuuugcauugau

SEQ ID NO: 535315 - RNA, 59 nt, hsa
acauuuugguaguauacuucagagugauguuaucuaaguuuaaguaguuuaaguauguu

SEQ ID NO: 535316 - RNA, 59 nt, hsa
uguuaacauucuugguaucuuuuugugccuuaucuaaaacauuucucgaucacugguuu

SEQ ID NO: 535317 - RNA, 59 nt, hsa
acuuucuccauggccuaugauccaaauuguuaucuaaagaugauucuagguguugcugg

SEQ ID NO: 535318 - RNA, 59 nt, hsa
acacaugguaauggugaugcugugccuuguuaucuaagaacaugauuguauaauuuguu

SEQ ID NO: 535319 - RNA, 59 nt, hsa
guggucccucaaggucuucgaauagauguuuaucuaaccugacaguugcaguuuucacc

SEQ ID NO: 535320 - RNA, 59 nt, hsa
auuuuuuaaaaaauaauacuguguuguguuuaucuaaauacguaaacucaagcuaccaa

SEQ ID NO: 535321 - RNA, 59 nt, hsa
guaguacagauaaccccucauaaagaugcuuaucuaaccuccccaguguucagguguuu

SEQ ID NO: 535322 - RNA, 59 nt, hsa
cacuuauuaccuguaugaacaugggcaaauuaucuaaucucucugaucuauuuuuccuc

SEQ ID NO: 535323 - RNA, 59 nt, hsa
gaugggaguggguaaagaguuugggaagguuaucuaacugaaucacuacugaguugaau

SEQ ID NO: 535324 - RNA, 59 nt, hsa
uuuauaauuugaugucucaaauguagagauuaucuaaaaaucguaacuugaauaccuug

SEQ ID NO: 535325 - RNA, 59 nt, hsa
uaagacaaggucacugugcugauugauuuuuaucuaaaaaaauucauuuuuauaucgaa

SEQ ID NO: 535326 - RNA, 59 nt, hsa
gcuuggaccucgugcuuuaagugccuacauuaucuaacugugcucaagagguucucgac

SEQ ID NO: 535327 - RNA, 59 nt, hsa
aagcagcccaacacaaaacgaguguggauuuaucuaaauggaggcagaccugaagaugg

SEQ ID NO: 535328 - RNA, 59 nt, hsa
uauaaaauuuuuguaauggauaaucuuauuuaucuaaacuaaagcuuccuguuuauaca

SEQ ID NO: 535329 - RNA, 59 nt, hsa
auggauccaggguauaccucuaauaaccuuuaucuaaauagaauacauuuaaccuguca

SEQ ID NO: 535330 - RNA, 59 nt, hsa
gugaacaacgugaugacaacaagcaacauuuaucuaaugaacuacagcuaucuuaauuu

SEQ ID NO: 535331 - RNA, 59 nt, hsa
ugauaacugggaaauguuuuucuuccucuuuaucuaacuauauuacacuuauccaucag

SEQ ID NO: 535332 - RNA, 59 nt, hsa
auuagaugacguauuuauugguggccuucuuaucuaagcacaugaguaguuggcucuga

SEQ ID NO: 535333 - RNA, 59 nt, hsa
aucaaucuauaauauauuagacugaugcuuuaucuaaaaugcuuugaguuuguauaaua

SEQ ID NO: 535334 - RNA, 59 nt, hsa
uguacauaugcccccauccauguuaauuauuaucuaauuccauuaggguucacgucuuu

SEQ ID NO: 535335 - RNA, 59 nt, hsa
uaaccuauuuuuguucugguuugguucgguuaucuaauggaaagguaacuggcaaugca

SEQ ID NO: 535336 - RNA, 59 nt, hsa
gcccuacaaggauauguuuuccugugaaauuaucuaagagguagguuuagacaucugcu

SEQ ID NO: 535337 - RNA, 59 nt, hsa
cuuauguguaucugcaacacccugaaaaauuaucuaauaaaaaggcacaaagaaaaagc

SEQ ID NO: 535338 - RNA, 59 nt, hsa
aguugaauuucuuuaaaaaguuuucuauuuuaucuaaaaucuuuccauuauaucuaaau

SEQ ID NO: 535339 - RNA, 59 nt, hsa
gcuuuaaaaagucccacugucagauuauauuaucuaacaauugaauauuguaaauauac

SEQ ID NO: 535340 - RNA, 59 nt, hsa
uuuuaaauauuuguugaguacuuacguguuuaucuaacaguucacuuccauuuuucuag

SEQ ID NO: 535341 - RNA, 59 nt, hsa
uuuuucaucuguuguacauaguuguauuuuuaucuaaugccauuuuagaauuuucuaag

SEQ ID NO: 535342 - RNA, 59 nt, hsa
cuucuugcuuuaaguccucacccuuuacauuaucuaauucuucaguuuugaugcugaua

SEQ ID NO: 535343 - RNA, 59 nt, hsa
gggguggguaggcacccuccuuccuguuuuuaucuaauaaaaugcuaaccugcccugag

SEQ ID NO: 535344 - RNA, 59 nt, hsa
ccuuugacccugcuuauuugucucacugguuaucuaaugaggaacaaacacuaaccuaa

SEQ ID NO: 535345 - RNA, 59 nt, hsa
uuaaagaauggccaauuagcugagaagaauuaucuaaucaauuagugaugucugccaug

SEQ ID NO: 535346 - RNA, 59 nt, hsa
acucuaggaaucuuaggcagaaagggauuuuaucuaaaucacuggaaaggcuggaggag

SEQ ID NO: 535347 - RNA, 59 nt, hsa
cugggagaggauuuuuuucugagcgauuauuaucuaaaguguguuguugcuuuaggcuc

SEQ ID NO: 535348 - RNA, 59 nt, hsa
aaacuaccuguuguaaccuaaaaccaguuuuaucuaacagcuauuaaaacaaccuacug

SEQ ID NO: 535349 - RNA, 59 nt, hsa
guuucuguuugaagugaggauuuucugaauuaucuaauaucaucuagguuuucuuuaaa

SEQ ID NO: 535350 - RNA, 59 nt, hsa
cugugaguuaaaauuguauccuuugugguuuaucuaaggaaagucaaaucuugacagaa

SEQ ID NO: 535351 - RNA, 59 nt, hsa
ggggaaaaagggcuauugcuaagugagcuuuaucuaauauccuccuaagaguuuuacua

SEQ ID NO: 535352 - RNA, 59 nt, hsa
uuuauuuaauaguaguauuuccuucccuuuuaucuaauuuuuuauaugcugcuaaauau

SEQ ID NO: 535353 - RNA, 59 nt, hsa
uagugugaagcacucauuucuaaaccuuauuaucuaagguaauauaugcaccuuucaga

SEQ ID NO: 535354 - RNA, 59 nt, hsa
cuuacccauucucuauuuauucccuuauuuuaucuaacaccauuucaaaacaaaacugu

SEQ ID NO: 535355 - RNA, 59 nt, hsa
acuuuauauuaugcauaaauauuuauauuuuaucuaaauaacugcgcuguaacaaacuu

SEQ ID NO: 535356 - RNA, 59 nt, hsa
agaugauaccugaagcugucaccucuugauuaucuaaacuaagcgcucauucuauuuua

SEQ ID NO: 535357 - RNA, 59 nt, hsa
acauauagaaauguuugaaugcaugggucuuaucuaacuuaucucuucuggacccaugu

SEQ ID NO: 535358 - RNA, 59 nt, hsa
aaguacuguucuccuucaguggcauguaguuaucuaaucaagacaccucauucaaacaa

SEQ ID NO: 535359 - RNA, 59 nt, hsa
auguuaagguacaacuguguuuuucucgauuaucuaaaaaccauaguacuuaaauugaa

SEQ ID NO: 535360 - RNA, 59 nt, hsa
ugauuggugaaaugcaggguauguggaaguuaucuaauuaaccucaguuguauaugaau

SEQ ID NO: 535361 - RNA, 59 nt, hsa
aaauguauacauuucggaacaacuccauuuuaucuaaaaaaguucuugugauugccagu

SEQ ID NO: 535362 - RNA, 59 nt, hsa
uggcagugacaaagugcuagcauuuauuguuaucuaauaaagaccuuggagcauaugug

SEQ ID NO: 535363 - RNA, 59 nt, hsa
cauguaauacacagugagacacaguaauuuuaucuaaauuacagugcaguuuaguuaau

SEQ ID NO: 535364 - RNA, 59 nt, hsa
uccccagcaauuaagauuucgagcagaauuuaucuaaauguguuucaaggaaacacaau

SEQ ID NO: 535365 - RNA, 59 nt, hsa
ccuucugauuuaaguacagcuggaaaguauuaucuaauuaaguucaugauagugcuuuu

SEQ ID NO: 535366 - RNA, 59 nt, hsa
aagaucccucugccaaaaauauagcucacuuaucuaaaggugagagcugcauagaucca

SEQ ID NO: 535367 - RNA, 59 nt, hsa
aaaugcuggcuauagaugucuuuucccauuuaucuaaauauggacugcucaggaaacga

SEQ ID NO: 535368 - RNA, 59 nt, hsa
agggaggaaaacucaacuguuucucuuuguuaucuaaauguuucagaauucaaucguga

SEQ ID NO: 535369 - RNA, 59 nt, hsa
acaggcuugucuuucuaagugacauauucuuaucuaauucucagaucagguuuugaaag

SEQ ID NO: 535370 - RNA, 59 nt, hsa
ucagugaacuuucaaaaccauaaacaccauuaucuaacuucaugaaccagaaugaauca

SEQ ID NO: 535371 - RNA, 59 nt, hsa
ggaauguuguuuucugacuaggcugaucauuaucuaaagaaucuaauucuguugauuuu

SEQ ID NO: 535372 - RNA, 59 nt, hsa
gaguaagguaagaaaaauggaacaaauuuuuaucuaaaaauuccugucaccacaagagg

SEQ ID NO: 535373 - RNA, 59 nt, hsa
gcuagaacucuaccuguguuucauuaguauuaucuaauguacuuuuacauauuuguaaa

SEQ ID NO: 535374 - RNA, 59 nt, hsa
cuaaaaagucaaaacguuaacaauaguuuuuaucuaauaaaagcacugcaagaaaauag

SEQ ID NO: 535375 - RNA, 59 nt, hsa
uaauacauuccgaggggcucaguucugccuuaucuaaaucaccagagaccaaacaagga

SEQ ID NO: 535376 - RNA, 59 nt, hsa
auuaaacauucauaaucaugauuuaaguguuaucuaaauuuaccuuauuaguguuacca

SEQ ID NO: 535377 - RNA, 59 nt, hsa
uugauuauauuuuaaagauaaccaggauauuaucuaauggugaauuguagaauuuugau

SEQ ID NO: 535378 - RNA, 59 nt, hsa
acaagugugguaaaugccauguuuguacuuuaucuaacaucuucucuuucaguagucuu

SEQ ID NO: 535379 - RNA, 59 nt, hsa
cuaauguguguggaaagagguguuccucauuaucuaauauuucaauguguuaagaguuu

SEQ ID NO: 535380 - RNA, 59 nt, hsa
uccugacuguaacauauucuguaugaacuuuaucuaaagaaaaauaaaucuguucuggg

SEQ ID NO: 535381 - RNA, 59 nt, hsa
aggcauagguacuguuguaccaaggucacuuaucuaacaaaauaacccuucauguauuu

SEQ ID NO: 535382 - RNA, 59 nt, hsa
aauuuauuugacaagucugcagacaauccuuaucuaaccagcuauuuucuuaauugcua

SEQ ID NO: 535383 - RNA, 59 nt, hsa
ggaacauugguuugugaaggaaaaacagauuaucuaaagccaucucuauguuucuguuc

SEQ ID NO: 535384 - RNA, 59 nt, hsa
ugaacuaaggcuaccaaauacauucccuguuaucuaaauuauaacauacaauuauuuua

SEQ ID NO: 535385 - RNA, 59 nt, hsa
uaaaaguuaauugauauuauacuuugguuuuaucuaaaaaguaaauguauuugccuuug

SEQ ID NO: 535386 - RNA, 59 nt, hsa
ccacccacaaagaaacaaagcaaauuucauuaucuaaugaguugcuggaaaaucauauu

SEQ ID NO: 535387 - RNA, 59 nt, hsa
uuguaaugauugauuaaaugcaagauaguuuaucuaacuucgugcggaaucagcuucua

SEQ ID NO: 535388 - RNA, 59 nt, hsa
uuauauguucaccaaugggaggucaauauuuaucuaauuuaaaagguaugcuaaccacu

SEQ ID NO: 535389 - RNA, 59 nt, hsa
gcaaggcaaaaauguaugccacaucucaguuaucuaaacuagauuagauccaagccaag

SEQ ID NO: 535390 - RNA, 59 nt, hsa
uaacaauucacaaggcacuuucacacccauuaucuaauuuaauccucauaaugacuaug

SEQ ID NO: 535391 - RNA, 59 nt, hsa
uuguccaagagcacacugaaaguugaauguuaucuaaugcauuccucuaccuuucagaa

SEQ ID NO: 535392 - RNA, 59 nt, hsa
uagaauuugaauaugacccaagcugaguauuaucuaaacagguugguggaaugaaugcg

SEQ ID NO: 535393 - RNA, 59 nt, hsa
uccagcuuugcuggaaaagacguuuuuaauuaucuaauuuauuuuucaaaaauuuuuug

SEQ ID NO: 535394 - RNA, 59 nt, hsa
uuaccauuuugggguacccacugcucugguuaucuaauauguaacaagccaccccaaau

SEQ ID NO: 535395 - RNA, 59 nt, hsa
aacuuaugaccucuuccuuuaggagggaguuaucuaaaagaaaugucuauuaaggugau

SEQ ID NO: 535396 - RNA, 59 nt, hsa
aaaaaacacuauuuuacuuaaacuguuucuuaucuaaauucuugcagagugucaauguu

SEQ ID NO: 535397 - RNA, 59 nt, hsa
gucaauauucauuucaguagaagauaaucuuaucuaauuuuugagaccagaauaagccu

SEQ ID NO: 535398 - RNA, 59 nt, hsa
uuccugcgguuuauucuauguuuuauauauuaucuaaauauauguauaugcugugucau

SEQ ID NO: 535399 - RNA, 59 nt, hsa
aguacaguuucauauuugaguuugcagaauuaucuaauagucuuuuuuuggcuaauauu

SEQ ID NO: 535400 - RNA, 59 nt, hsa
guauucagggaaccugucuuaaauugugcuuaucuaaaucuuggaacuuugagcuaggg

SEQ ID NO: 535401 - RNA, 59 nt, hsa
uacuuuuagaguugaaacagaguaauaacuuaucuaacccucuuuuccuacaaaggaga

SEQ ID NO: 535402 - RNA, 59 nt, hsa
accacucuuauacaggaaaacuguccaaauuaucuaaagauccuccugagaagcuuaaa

SEQ ID NO: 535403 - RNA, 59 nt, hsa
aucaggugcagugucaguuucaaaucaaauuaucuaagaaaacaagaaaacaaaggcag

SEQ ID NO: 535404 - RNA, 59 nt, hsa
ggucaugacaaggaaaaaaaacaccacauuuaucuaagaagugauuuuggcugcaggac

SEQ ID NO: 535405 - RNA, 59 nt, hsa
auuagcuuuguccuaccaacuucuggaauuuaucuaauuauuguuuuucaaaguuucuu

SEQ ID NO: 535406 - RNA, 59 nt, hsa
ucagguguacagguuauucuggguuaauuuuaucuaaugaagcccauuccuuuuuguac

SEQ ID NO: 535407 - RNA, 59 nt, hsa
cuuaaacccauauuguaaaacagguagaauuaucuaauuuauaaaaagguguuuugaug

SEQ ID NO: 535408 - RNA, 51 nt, hsa; identical to SEQ ID NO: 252557

SEQ ID NO: 535409 - RNA, 59 nt, hsa
uaauugcaaauagguaggaguggccuaaauuaucuaauguaauaaagucagacaaaaug

SEQ ID NO: 535410 - RNA, 59 nt, hsa
ugguauuuaaucccaaaguguuguucugauuaucuaaaauuugacaugguagaccuugc

SEQ ID NO: 535411 - RNA, 59 nt, hsa
uauggagcuauuccauuuuaaacaaauauuuaucuaaauaaaucuuaaauaaauuuuca

SEQ ID NO: 535412 - RNA, 59 nt, hsa
agaaaugagugaaugugggugaucugcuuuuaucuaaaugcaaauaaggauguguucuc

SEQ ID NO: 535413 - RNA, 59 nt, hsa
caccauucuguagccacccauccuuugccuuaucuaacaaacauuuuuccaggaaggug

SEQ ID NO: 535414 - RNA, 59 nt, hsa
aaugcuacaauaguuuuuuaucuauaaaauuaucuaaagaaucauugucuuucagagac

SEQ ID NO: 535415 - RNA, 59 nt, hsa
aaauuuccugcuguauccagaagccaguuuuaucuaacggcuacugaaacacccacugu

SEQ ID NO: 535416 - RNA, 59 nt, hsa
gcaaaaauaauacauggaauuguaugauuuuaucuaaaguaaaauucuagacugcuuuc

SEQ ID NO: 535417 - RNA, 59 nt, hsa
ugugaauucucugaauacugucaacacucuuaucuaaguuugccuuuaugaugcagugg

SEQ ID NO: 535418 - RNA, 59 nt, hsa
uccuucaggggagccucaguuuugcccauuuaucuaauugaaucaguuuuuuacccaau

SEQ ID NO: 535419 - RNA, 59 nt, hsa
aaucccccgauuuuguaggauaaucucccuuaucuaaagucaacugauuauggacuuua

SEQ ID NO: 535420 - RNA, 59 nt, hsa
ugaauuggagguuuauuuuuuaauauauauuaucuaagaagagaucugugugugugaug

SEQ ID NO: 535421 - RNA, 59 nt, hsa
ucuuugggacaaaacagaaguccauggaguuaucuaagcucuuguaagugaguuaauuu

SEQ ID NO: 535422 - RNA, 59 nt, hsa
uguucuaaagccuuucauuuuuacaguucuuaucuaagacaugaaagaacacguacugg

SEQ ID NO: 535423 - RNA, 59 nt, hsa
uugaauagcgucuuuuuauuuaacaauccuuaucuaacaucaccaaauucacauugcag

SEQ ID NO: 535424 - RNA, 59 nt, hsa
gucaguuuauagacugaacaauacuguuuuuaucuaaugugacccugcaauuuacauga

SEQ ID NO: 535425 - RNA, 59 nt, hsa
aaaccaucaucagagucacaauaaugaauuuaucuaaucuaucaccuuuguauucaccu

SEQ ID NO: 535426 - RNA, 59 nt, hsa
guaucuauguugguacgacuccuggccuuuuaucuaaaggacuuuggcuuuuguaaauc

SEQ ID NO: 535427 - RNA, 59 nt, hsa
uauagaaaucuuggucagggcuggauagauuaucuaagucaagcuugagaaugaaugua

SEQ ID NO: 535428 - RNA, 59 nt, hsa
gugugaaaucuaguuuuuaucaccauacuuuaucuaauuauuauucucuguauauaacu

SEQ ID NO: 535429 - RNA, 59 nt, hsa
aaaaugauaauuaaaaugcuguaaccaacuuaucuaauaaaauuggcaaccagccacua

SEQ ID NO: 535430 - RNA, 59 nt, hsa
gaguaacuguaauuggauguuuauuguuuuuaucuaaaguaagguguauguguuugaga

SEQ ID NO: 535431 - RNA, 59 nt, hsa
gauuagacacuucagugucagggcacagauuaucuaaaauuagccagcucuuccuguca

SEQ ID NO: 535432 - RNA, 59 nt, hsa
aggguuaacucuuuauuuuuguaguuuuauuaucuaaggcacagccauucuguucucac

SEQ ID NO: 535433 - RNA, 59 nt, hsa
ucguucaacagugugagcauuugucucuguuaucuaaugauguucucugacccagcaga

SEQ ID NO: 535434 - RNA, 59 nt, hsa
cuugguuauaauuuauaacuuacuuauuuuuaucuaauaauuguagauucaguguauuu

SEQ ID NO: 535435 - RNA, 59 nt, hsa
uagaauuaauuuaaagccuuaaacaaaauuuaucuaaagaaauaacuucuauuacuguc

SEQ ID NO: 535436 - RNA, 59 nt, hsa
uuacuuuuuauucaucuuuguguuuuuauuuaucuaaaauggguauugauuuuuaggac

SEQ ID NO: 535437 - RNA, 59 nt, hsa
augucaaucgauaaacccuacuuuccaaauuaucuaaaagauuaccauuuggggcccuu

SEQ ID NO: 535438 - RNA, 59 nt, hsa
gauuaccauuuggggcccuuguuuucaaguuaucuaacugaaauauuauuaauuuuuuu

SEQ ID NO: 535439 - RNA, 59 nt, hsa
auauaccuauauauguuuguaucuaugacuuaucuaaucugccuaucaaucuaucuagu

SEQ ID NO: 535440 - RNA, 59 nt, hsa
uuucuaaaacaacuugaaguauaguuuuguuaucuaagcaauuuuuguuuuaaguaagu

SEQ ID NO: 535441 - RNA, 59 nt, hsa
agccuggaaaacuuuuguguauucucagcuuaucuaaaccuaaugaaauuccuuuuaua

SEQ ID NO: 535442 - RNA, 59 nt, hsa
uaaauuaggguugguauuucauuuuuuucuuaucuaaaucuuaguuuccuggaauaaua

SEQ ID NO: 535443 - RNA, 59 nt, hsa
cuaagaguacaaagccaagagagugugguuuaucuaaauguccugaaauccacuuguca

SEQ ID NO: 535444 - RNA, 59 nt, hsa
agacaagcugaaacaacacaaaacuguuuuuaucuaagauauuugacuuaaaaauaucg

SEQ ID NO: 535445 - RNA, 59 nt, hsa
auucuucaaaauauguaagcuguugucaauuaucuaaagcauguuaguuuggugcuaca

SEQ ID NO: 535446 - RNA, 59 nt, hsa
gagacuuguuggagaggcgggacucugaguuaucuaaugucagacaucuaguggggcag

SEQ ID NO: 535447 - RNA, 59 nt, hsa
cuucugccugaaaugugcuuagagcucaguuaucuaaggauucucugacacuagugcau

SEQ ID NO: 535448 - RNA, 64 nt, hsa; identical to SEQ ID NO: 478274

SEQ ID NO: 535449 - RNA, 64 nt, hsa; identical to SEQ ID NO: 478275

SEQ ID NO: 535450 - RNA, 64 nt, hsa; identical to SEQ ID NO: 478276

SEQ ID NO: 535451 - RNA, 64 nt, hsa; identical to SEQ ID NO: 478277

SEQ ID NO: 535452 - RNA, 64 nt, hsa; identical to SEQ ID NO: 478278

SEQ ID NO: 535453 - RNA, 64 nt, hsa; identical to SEQ ID NO: 478279

SEQ ID NO: 535454 - RNA, 64 nt, hsa; identical to SEQ ID NO: 478280

SEQ ID NO: 535455 - RNA, 64 nt, hsa; identical to SEQ ID NO: 478281

SEQ ID NO: 535456 - RNA, 64 nt, hsa; identical to SEQ ID NO: 478282

SEQ ID NO: 535457 - RNA, 64 nt, hsa; identical to SEQ ID NO: 478283

SEQ ID NO: 535458 - RNA, 64 nt, hsa; identical to SEQ ID NO: 478284

SEQ ID NO: 535459 - RNA, 64 nt, hsa; identical to SEQ ID NO: 478285

SEQ ID NO: 535460 - RNA, 64 nt, hsa; identical to SEQ ID NO: 478286

SEQ ID NO: 535461 - RNA, 64 nt, hsa; identical to SEQ ID NO: 478287

SEQ ID NO: 535462 - RNA, 64 nt, hsa; identical to SEQ ID NO: 478288

SEQ ID NO: 535463 - RNA, 64 nt, hsa; identical to SEQ ID NO: 478289

SEQ ID NO: 535464 - RNA, 64 nt, hsa; identical to SEQ ID NO: 478290

SEQ ID NO: 535465 - RNA, 64 nt, hsa; identical to SEQ ID NO: 478291

SEQ ID NO: 535466 - RNA, 64 nt, hsa; identical to SEQ ID NO: 478292

SEQ ID NO: 535467 - RNA, 64 nt, hsa; identical to SEQ ID NO: 478293

SEQ ID NO: 535468 - RNA, 64 nt, hsa; identical to SEQ ID NO: 478294

SEQ ID NO: 535469 - RNA, 64 nt, hsa; identical to SEQ ID NO: 478295

SEQ ID NO: 535470 - RNA, 64 nt, hsa; identical to SEQ ID NO: 478296

SEQ ID NO: 535471 - RNA, 64 nt, hsa; identical to SEQ ID NO: 478297

SEQ ID NO: 535472 - RNA, 64 nt, hsa
cuguguaagucuuugcauuuaagacauccaaucaauaaugaaggaaauuuuuuucugaauguag

SEQ ID NO: 535473 - RNA, 64 nt, hsa
uuuauuguuggggauauuaacaaaugugauuuguauaaugaaaugcauuucauuuggaagaauu

SEQ ID NO: 535474 - RNA, 64 nt, hsa
uucauaugauugugcagaaaacuugccucuauuuauaaugaagauaacuuaaacagaaauaucc

SEQ ID NO: 535475 - RNA, 64 nt, hsa
auaacccauguuacaaggaaguuaaacaauuguaauaaugaaaugagcuuucucuauagccaua

SEQ ID NO: 535476 - RNA, 64 nt, hsa
uuuccuauucuaaaauaucaaauuuaaaauaaagauaaugaaagaaaacauaagagaacuauug

SEQ ID NO: 535477 - RNA, 64 nt, hsa
ugagcauaaucauuccuuggaguuauacuaacuaauaaugaauauuaaaugauuuuucuucagu

SEQ ID NO: 535478 - RNA, 64 nt, hsa
uauuuuaagucuacaaaaagguauaaauaauaauauaaugaauuccuauauaccuaauacccag

SEQ ID NO: 535479 - RNA, 64 nt, hsa
aaaucucuuuuuaagauagacuuauucuuuuauaauaaugaaugugcacucauacauauguaga

SEQ ID NO: 535480 - RNA, 55 nt, hsa
caucuuugaaaaauguaugaaaggaauaaugaaaaggguaaaaagaacaaggggu

SEQ ID NO: 535481 - RNA, 64 nt, hsa
gaaaagauaaucaaggccuacauuuuagcugaggauaaugaacuuuuuuccucauucggcugua

SEQ ID NO: 535482 - RNA, 64 nt, hsa
ccuauuaguggaggagggagaaccauauuuauuuauaaugaagacaucuaagaucccuaugaug

SEQ ID NO: 535483 - RNA, 64 nt, hsa
uucugugaauuauugaauuuaagagcccugcuaaauaaugaaaaaacacuuuacuaaaauuuau

SEQ ID NO: 535484 - RNA, 64 nt, hsa
gacuaauauucagauuccauuuucaauaagguaaauaaugaaagaucucacaaaggaaucauug

SEQ ID NO: 535485 - RNA, 64 nt, hsa
aguuaaaaugcuuuuuacucugguguauuauagaauaaugaacacauuuuuauauauguuaaag

SEQ ID NO: 535486 - RNA, 64 nt, hsa
auucuuuuucuuuuaaauuuguugcuaaucucugauaaugaagauucuuacucugauucucagc

SEQ ID NO: 535487 - RNA, 64 nt, hsa
aaugaauugcucugugcugaaauuugaagaccagauaaugaaacugaaaagcaaacaauuuuac

SEQ ID NO: 535488 - RNA, 64 nt, hsa
aguuauugacuuuauauucaauuauuuacaucaaauaaugaaauaacugaaauguacaaauguc

SEQ ID NO: 535489 - RNA, 64 nt, hsa
gaauauuguauguugcauuccacuucauuugaaaauaaugaaaccauguaccacuguuuacauc

SEQ ID NO: 535490 - RNA, 64 nt, hsa
uuuccaaaaugacuucuuaaacaaaacaaauauuauaaugaauugucuggagaggaccucuuca

SEQ ID NO: 535491 - RNA, 64 nt, hsa
ucccagacuucacaggaagauagauauucuugagauaaugaaaagugauaucuucgcauacgaa

SEQ ID NO: 535492 - RNA, 64 nt, hsa
uuuccugaugagucauauuacugugauuuucauaauaaugaagacaccaugaauauacuuuuuu

SEQ ID NO: 535493 - RNA, 64 nt, hsa
uguucaaacugaaggaaauuucuaauaaucccgaauaaugaacguagaaaucuaucuccauaaa

SEQ ID NO: 535494 - RNA, 64 nt, hsa
agucugucuauugguaugcaaucuuguaacuuugauaaugaacagugagagauuuuuaaauaaa

SEQ ID NO: 535495 - RNA, 64 nt, hsa
gacuuaccggaccacugaaggucuucuguaaaauauaaugaagcugaaaccuuuggccuaagaa

SEQ ID NO: 535496 - RNA, 64 nt, hsa
gggguguugguuuaugcgugcugcagcagugggcauaaugaauauaauuuacccaguggacaaa

SEQ ID NO: 535497 - RNA, 64 nt, hsa
uuuuuaaaaaagaaaaacaaacuauugauuguagauaaugaaaagcuaggguuugcccucuuca

SEQ ID NO: 535498 - RNA, 64 nt, hsa
cauauguaugugugguuacuuuuuauaaugugaaauaaugaauaaugaauuuacucaaaauaaa

SEQ ID NO: 535499 - RNA, 64 nt, hsa
augugugguuacuuuuuauaaugugaaauaaugaauaaugaauuuacucaaaauaaaacauagg

SEQ ID NO: 535500 - RNA, 64 nt, hsa
augaaaauuaaguacagaggcugcgaucuuagaaauaaugaaggugccauuuggcugcuccuua

SEQ ID NO: 535501 - RNA, 64 nt, hsa
uacuuuuaucaguagaaugauuucauuuagauguauaaugaaaaaggauaaugcaaaaauuaug

SEQ ID NO: 535502 - RNA, 64 nt, hsa
uuuuucuuacacacuaaauggguauuuguucaaaauaaugaaguuauggcuucacauucauugc

SEQ ID NO: 535503 - RNA, 64 nt, hsa
cacuucaguccuuuucugaagaguuugacuuagaauaaugaagguaacuagaaagugaguuaau

SEQ ID NO: 535504 - RNA, 64 nt, hsa
aaagcauacagucuaaauaauaaacaguuguaaaauaaugaagguagaaauuauaacacuaggg

SEQ ID NO: 535505 - RNA, 64 nt, hsa
caugugauguuuauagucuguauuacuucuccaaauaaugaacuaccugauucauugucccuuu

SEQ ID NO: 535506 - RNA, 64 nt, hsa
cuuggcuuuaguuuuauaucauauuuagaaaauaauaaugaaaagcauccccaaaauuucaaug

SEQ ID NO: 535507 - RNA, 64 nt, hsa
ugucuaccaagaacaauugaguuuucuaaaaguaauaaugaagauuaugcaauucuaacuguag

SEQ ID NO: 535508 - RNA, 64 nt, hsa
agagaauuugcaugagaggagaguacuuaugaguauaaugaauauugagaaaucuuuuaucaac

SEQ ID NO: 535509 - RNA, 64 nt, hsa
uccaagaugacuugguuggggggcacuguaugccauaaugaaugugagaaagcugucauuuaaa

SEQ ID NO: 535510 - RNA, 64 nt, hsa
ggggguggggcugggaccggguggcuuuauauugauaaugaaauauuccagagcaaaacacauu

SEQ ID NO: 535511 - RNA, 64 nt, hsa
uuagguaggggagaacauuucugaaaaagaacuuauaaugaagcuacaaauccauccuuauuuc

SEQ ID NO: 535512 - RNA, 64 nt, hsa
gacuauucuuucccccacucuuaaacagugugauguguguuauccuaggaaaugagaguuggca

SEQ ID NO: 535513 - RNA, 64 nt, hsa
guugaaauggcuuuagaaucauuuggguuugaggguguguuauuuugagucaugaauguacaag

SEQ ID NO: 535514 - RNA, 64 nt, hsa
aggauaucccucaccuguuccugaugaauaaaaaguguguuaaagaccaaaauucuuggcauaa

SEQ ID NO: 535515 - RNA, 64 nt, hsa
guguaguuuuaauuaugcugcaauguauaaucugguguguuauuuaaacagcacuaguacugua

SEQ ID NO: 535516 - RNA, 64 nt, hsa
cuccaguuuucgggggaagcugguauuugacauaguguguuaaacagcuccugagaaccuuugg

SEQ ID NO: 535517 - RNA, 64 nt, hsa
ucauuuagucguguacguaaaaacucuccuuuuaguguguuauuuucuuggccuucccuuuuaa

SEQ ID NO: 535518 - RNA, 64 nt, hsa
aaagggaccauaagcauuuuggcugcuuauggcuguguguuacuacuuacaagagucuugaaaa

SEQ ID NO: 535519 - RNA, 64 nt, hsa
caagaacacaugaaauucuuuuaacaccagauuaguguguuaccccaaaugaacgguucuagcc

SEQ ID NO: 535520 - RNA, 64 nt, hsa
uguguguguguguuauguguguuugcacacacgcguguguuauuguagcaauaacaaaaaguag

SEQ ID NO: 535521 - RNA, 64 nt, hsa
uguggaggagugaaauggagcuuuaaguguguguguguguuauguguguuugcacacacgcgug

SEQ ID NO: 535522 - RNA, 64 nt, hsa; identical to SEQ ID NO: 115405

SEQ ID NO: 535523 - RNA, 64 nt, hsa; identical to SEQ ID NO: 115406

SEQ ID NO: 535524 - RNA, 64 nt, hsa; identical to SEQ ID NO: 115407

SEQ ID NO: 535525 - RNA, 64 nt, hsa; identical to SEQ ID NO: 115408

SEQ ID NO: 535526 - RNA, 64 nt, hsa; identical to SEQ ID NO: 115409

SEQ ID NO: 535527 - RNA, 64 nt, hsa; identical to SEQ ID NO: 115410

SEQ ID NO: 535528 - RNA, 64 nt, hsa; identical to SEQ ID NO: 115411

SEQ ID NO: 535529 - RNA, 64 nt, hsa; identical to SEQ ID NO: 115412

SEQ ID NO: 535530 - RNA, 64 nt, hsa; identical to SEQ ID NO: 115413

SEQ ID NO: 535531 - RNA, 64 nt, hsa; identical to SEQ ID NO: 115414

SEQ ID NO: 535532 - RNA, 64 nt, hsa; identical to SEQ ID NO: 115415

SEQ ID NO: 535533 - RNA, 64 nt, hsa; identical to SEQ ID NO: 115416

SEQ ID NO: 535534 - RNA, 64 nt, hsa; identical to SEQ ID NO: 115417

SEQ ID NO: 535535 - RNA, 64 nt, hsa; identical to SEQ ID NO: 115418

SEQ ID NO: 535536 - RNA, 64 nt, hsa; identical to SEQ ID NO: 115419

SEQ ID NO: 535537 - RNA, 64 nt, hsa; identical to SEQ ID NO: 115420

SEQ ID NO: 535538 - RNA, 64 nt, hsa; identical to SEQ ID NO: 115421

SEQ ID NO: 535539 - RNA, 64 nt, hsa; identical to SEQ ID NO: 115422

SEQ ID NO: 535540 - RNA, 64 nt, hsa; identical to SEQ ID NO: 115423

SEQ ID NO: 535541 - RNA, 64 nt, hsa; identical to SEQ ID NO: 115424

SEQ ID NO: 535542 - RNA, 64 nt, hsa; identical to SEQ ID NO: 115425

SEQ ID NO: 535543 - RNA, 64 nt, hsa; identical to SEQ ID NO: 115426

SEQ ID NO: 535544 - RNA, 64 nt, hsa; identical to SEQ ID NO: 115427

SEQ ID NO: 535545 - RNA, 64 nt, hsa; identical to SEQ ID NO: 115428

SEQ ID NO: 535546 - RNA, 64 nt, hsa; identical to SEQ ID NO: 115429

SEQ ID NO: 535547 - RNA, 64 nt, hsa; identical to SEQ ID NO: 115430

SEQ ID NO: 535548 - RNA, 64 nt, hsa; identical to SEQ ID NO: 115431

SEQ ID NO: 535549 - RNA, 64 nt, hsa; identical to SEQ ID NO: 115432

SEQ ID NO: 535550 - RNA, 64 nt, hsa; identical to SEQ ID NO: 115433

SEQ ID NO: 535551 - RNA, 64 nt, hsa; identical to SEQ ID NO: 115434

SEQ ID NO: 535552 - RNA, 64 nt, hsa; identical to SEQ ID NO: 115435

SEQ ID NO: 535553 - RNA, 64 nt, hsa; identical to SEQ ID NO: 115436

SEQ ID NO: 535554 - RNA, 64 nt, hsa; identical to SEQ ID NO: 115437

SEQ ID NO: 535555 - RNA, 64 nt, hsa; identical to SEQ ID NO: 115438

SEQ ID NO: 535556 - RNA, 64 nt, hsa; identical to SEQ ID NO: 115439

SEQ ID NO: 535557 - RNA, 64 nt, hsa; identical to SEQ ID NO: 115440

SEQ ID NO: 535558 - RNA, 55 nt, hsa; identical to SEQ ID NO: 115441

SEQ ID NO: 535559 - RNA, 64 nt, hsa; identical to SEQ ID NO: 115442

SEQ ID NO: 535560 - RNA, 64 nt, hsa; identical to SEQ ID NO: 115443

SEQ ID NO: 535561 - RNA, 64 nt, hsa; identical to SEQ ID NO: 115444

SEQ ID NO: 535562 - RNA, 64 nt, hsa; identical to SEQ ID NO: 115445

SEQ ID NO: 535563 - RNA, 64 nt, hsa; identical to SEQ ID NO: 115446

SEQ ID NO: 535564 - RNA, 64 nt, hsa; identical to SEQ ID NO: 115447

SEQ ID NO: 535565 - RNA, 64 nt, hsa; identical to SEQ ID NO: 115448

SEQ ID NO: 535566 - RNA, 64 nt, hsa; identical to SEQ ID NO: 115449

SEQ ID NO: 535567 - RNA, 64 nt, hsa; identical to SEQ ID NO: 115450

SEQ ID NO: 535568 - RNA, 64 nt, hsa; identical to SEQ ID NO: 115451

SEQ ID NO: 535569 - RNA, 64 nt, hsa; identical to SEQ ID NO: 115452

SEQ ID NO: 535570 - RNA, 64 nt, hsa; identical to SEQ ID NO: 115453

SEQ ID NO: 535571 - RNA, 64 nt, hsa; identical to SEQ ID NO: 115454

SEQ ID NO: 535572 - RNA, 64 nt, hsa; identical to SEQ ID NO: 115455

SEQ ID NO: 535573 - RNA, 64 nt, hsa; identical to SEQ ID NO: 115456

SEQ ID NO: 535574 - RNA, 64 nt, hsa; identical to SEQ ID NO: 115457

SEQ ID NO: 535575 - RNA, 64 nt, hsa; identical to SEQ ID NO: 115458

SEQ ID NO: 535576 - RNA, 57 nt, hsa; identical to SEQ ID NO: 115459

SEQ ID NO: 535577 - RNA, 64 nt, hsa; identical to SEQ ID NO: 115460

SEQ ID NO: 535578 - RNA, 64 nt, hsa; identical to SEQ ID NO: 115461

SEQ ID NO: 535579 - RNA, 64 nt, hsa; identical to SEQ ID NO: 115462

SEQ ID NO: 535580 - RNA, 64 nt, hsa; identical to SEQ ID NO: 115463

SEQ ID NO: 535581 - RNA, 64 nt, hsa; identical to SEQ ID NO: 115464

SEQ ID NO: 535582 - RNA, 64 nt, hsa; identical to SEQ ID NO: 115465

SEQ ID NO: 535583 - RNA, 64 nt, hsa; identical to SEQ ID NO: 115466

SEQ ID NO: 535584 - RNA, 64 nt, hsa; identical to SEQ ID NO: 115467

SEQ ID NO: 535585 - RNA, 64 nt, hsa; identical to SEQ ID NO: 115468

SEQ ID NO: 535586 - RNA, 64 nt, hsa; identical to SEQ ID NO: 115469

SEQ ID NO: 535587 - RNA, 64 nt, hsa; identical to SEQ ID NO: 115470

SEQ ID NO: 535588 - RNA, 64 nt, hsa; identical to SEQ ID NO: 115471

SEQ ID NO: 535589 - RNA, 64 nt, hsa; identical to SEQ ID NO: 115472

SEQ ID NO: 535590 - RNA, 64 nt, hsa; identical to SEQ ID NO: 115473

SEQ ID NO: 535591 - RNA, 64 nt, hsa; identical to SEQ ID NO: 115474

SEQ ID NO: 535592 - RNA, 64 nt, hsa; identical to SEQ ID NO: 115475

SEQ ID NO: 535593 - RNA, 59 nt, hsa; identical to SEQ ID NO: 115476

SEQ ID NO: 535594 - RNA, 64 nt, hsa; identical to SEQ ID NO: 115477

SEQ ID NO: 535595 - RNA, 64 nt, hsa; identical to SEQ ID NO: 115478

SEQ ID NO: 535596 - RNA, 64 nt, hsa; identical to SEQ ID NO: 115479

SEQ ID NO: 535597 - RNA, 64 nt, hsa; identical to SEQ ID NO: 115480

SEQ ID NO: 535598 - RNA, 64 nt, hsa; identical to SEQ ID NO: 115481

SEQ ID NO: 535599 - RNA, 64 nt, hsa; identical to SEQ ID NO: 115482

SEQ ID NO: 535600 - RNA, 64 nt, hsa; identical to SEQ ID NO: 115483

SEQ ID NO: 535601 - RNA, 64 nt, hsa; identical to SEQ ID NO: 115484

SEQ ID NO: 535602 - RNA, 64 nt, hsa; identical to SEQ ID NO: 115485

SEQ ID NO: 535603 - RNA, 64 nt, hsa; identical to SEQ ID NO: 115486

SEQ ID NO: 535604 - RNA, 64 nt, hsa; identical to SEQ ID NO: 115487

SEQ ID NO: 535605 - RNA, 64 nt, hsa; identical to SEQ ID NO: 115488

SEQ ID NO: 535606 - RNA, 64 nt, hsa; identical to SEQ ID NO: 115489

SEQ ID NO: 535607 - RNA, 62 nt, hsa; identical to SEQ ID NO: 115490

SEQ ID NO: 535608 - RNA, 64 nt, hsa; identical to SEQ ID NO: 115491

SEQ ID NO: 535609 - RNA, 64 nt, hsa; identical to SEQ ID NO: 115492

SEQ ID NO: 535610 - RNA, 64 nt, hsa; identical to SEQ ID NO: 115493

SEQ ID NO: 535611 - RNA, 64 nt, hsa; identical to SEQ ID NO: 115494

SEQ ID NO: 535612 - RNA, 64 nt, hsa; identical to SEQ ID NO: 115495

SEQ ID NO: 535613 - RNA, 64 nt, hsa; identical to SEQ ID NO: 115496

SEQ ID NO: 535614 - RNA, 64 nt, hsa; identical to SEQ ID NO: 115497

SEQ ID NO: 535615 - RNA, 64 nt, hsa; identical to SEQ ID NO: 115498

SEQ ID NO: 535616 - RNA, 64 nt, hsa; identical to SEQ ID NO: 115499

SEQ ID NO: 535617 - RNA, 64 nt, hsa; identical to SEQ ID NO: 115500

SEQ ID NO: 535618 - RNA, 64 nt, hsa; identical to SEQ ID NO: 115501

SEQ ID NO: 535619 - RNA, 64 nt, hsa; identical to SEQ ID NO: 115502

SEQ ID NO: 535620 - RNA, 64 nt, hsa; identical to SEQ ID NO: 115503

SEQ ID NO: 535621 - RNA, 64 nt, hsa; identical to SEQ ID NO: 115504

SEQ ID NO: 535622 - RNA, 64 nt, hsa; identical to SEQ ID NO: 115505

SEQ ID NO: 535623 - RNA, 64 nt, hsa; identical to SEQ ID NO: 115506

SEQ ID NO: 535624 - RNA, 64 nt, hsa; identical to SEQ ID NO: 115507

SEQ ID NO: 535625 - RNA, 64 nt, hsa; identical to SEQ ID NO: 115508

SEQ ID NO: 535626 - RNA, 64 nt, hsa; identical to SEQ ID NO: 115509

SEQ ID NO: 535627 - RNA, 64 nt, hsa; identical to SEQ ID NO: 115510

SEQ ID NO: 535628 - RNA, 64 nt, hsa; identical to SEQ ID NO: 115511

SEQ ID NO: 535629 - RNA, 64 nt, hsa; identical to SEQ ID NO: 115512

SEQ ID NO: 535630 - RNA, 64 nt, hsa; identical to SEQ ID NO: 115513

SEQ ID NO: 535631 - RNA, 64 nt, hsa; identical to SEQ ID NO: 115514

SEQ ID NO: 535632 - RNA, 52 nt, hsa; identical to SEQ ID NO: 115515

SEQ ID NO: 535633 - RNA, 64 nt, hsa; identical to SEQ ID NO: 115516

SEQ ID NO: 535634 - RNA, 64 nt, hsa; identical to SEQ ID NO: 115517

SEQ ID NO: 535635 - RNA, 64 nt, hsa; identical to SEQ ID NO: 115518

SEQ ID NO: 535636 - RNA, 64 nt, hsa; identical to SEQ ID NO: 115519

SEQ ID NO: 535637 - RNA, 64 nt, hsa; identical to SEQ ID NO: 115520

SEQ ID NO: 535638 - RNA, 64 nt, hsa; identical to SEQ ID NO: 115521

SEQ ID NO: 535639 - RNA, 64 nt, hsa; identical to SEQ ID NO: 115522

SEQ ID NO: 535640 - RNA, 64 nt, hsa; identical to SEQ ID NO: 115523

SEQ ID NO: 535641 - RNA, 64 nt, hsa; identical to SEQ ID NO: 115524

SEQ ID NO: 535642 - RNA, 64 nt, hsa; identical to SEQ ID NO: 115525

SEQ ID NO: 535643 - RNA, 64 nt, hsa; identical to SEQ ID NO: 115526

SEQ ID NO: 535644 - RNA, 64 nt, hsa; identical to SEQ ID NO: 115527

SEQ ID NO: 535645 - RNA, 64 nt, hsa; identical to SEQ ID NO: 115528

SEQ ID NO: 535646 - RNA, 64 nt, hsa; identical to SEQ ID NO: 115529

SEQ ID NO: 535647 - RNA, 64 nt, hsa; identical to SEQ ID NO: 115530

SEQ ID NO: 535648 - RNA, 64 nt, hsa; identical to SEQ ID NO: 115531

SEQ ID NO: 535649 - RNA, 64 nt, hsa; identical to SEQ ID NO: 115532

SEQ ID NO: 535650 - RNA, 64 nt, hsa; identical to SEQ ID NO: 115533

SEQ ID NO: 535651 - RNA, 64 nt, hsa; identical to SEQ ID NO: 115534

SEQ ID NO: 535652 - RNA, 64 nt, hsa; identical to SEQ ID NO: 115535

SEQ ID NO: 535653 - RNA, 64 nt, hsa; identical to SEQ ID NO: 115536

SEQ ID NO: 535654 - RNA, 64 nt, hsa; identical to SEQ ID NO: 115537

SEQ ID NO: 535655 - RNA, 64 nt, hsa; identical to SEQ ID NO: 115538

SEQ ID NO: 535656 - RNA, 64 nt, hsa; identical to SEQ ID NO: 115539

SEQ ID NO: 535657 - RNA, 64 nt, hsa; identical to SEQ ID NO: 115540

SEQ ID NO: 535658 - RNA, 64 nt, hsa; identical to SEQ ID NO: 115541

SEQ ID NO: 535659 - RNA, 64 nt, hsa; identical to SEQ ID NO: 115542

SEQ ID NO: 535660 - RNA, 64 nt, hsa; identical to SEQ ID NO: 115543

SEQ ID NO: 535661 - RNA, 64 nt, hsa; identical to SEQ ID NO: 115544

SEQ ID NO: 535662 - RNA, 64 nt, hsa; identical to SEQ ID NO: 115545

SEQ ID NO: 535663 - RNA, 64 nt, hsa; identical to SEQ ID NO: 115546

SEQ ID NO: 535664 - RNA, 64 nt, hsa; identical to SEQ ID NO: 115547

SEQ ID NO: 535665 - RNA, 64 nt, hsa; identical to SEQ ID NO: 115548

SEQ ID NO: 535666 - RNA, 64 nt, hsa; identical to SEQ ID NO: 115549

SEQ ID NO: 535667 - RNA, 64 nt, hsa; identical to SEQ ID NO: 115550

SEQ ID NO: 535668 - RNA, 64 nt, hsa; identical to SEQ ID NO: 115551

SEQ ID NO: 535669 - RNA, 64 nt, hsa; identical to SEQ ID NO: 115552

SEQ ID NO: 535670 - RNA, 64 nt, hsa; identical to SEQ ID NO: 115553

SEQ ID NO: 535671 - RNA, 64 nt, hsa; identical to SEQ ID NO: 115554

SEQ ID NO: 535672 - RNA, 64 nt, hsa; identical to SEQ ID NO: 115555

SEQ ID NO: 535673 - RNA, 64 nt, hsa; identical to SEQ ID NO: 115556

SEQ ID NO: 535674 - RNA, 64 nt, hsa; identical to SEQ ID NO: 115557

SEQ ID NO: 535675 - RNA, 64 nt, hsa; identical to SEQ ID NO: 115558

SEQ ID NO: 535676 - RNA, 64 nt, hsa; identical to SEQ ID NO: 115559

SEQ ID NO: 535677 - RNA, 64 nt, hsa; identical to SEQ ID NO: 115560

SEQ ID NO: 535678 - RNA, 64 nt, hsa; identical to SEQ ID NO: 115561

SEQ ID NO: 535679 - RNA, 64 nt, hsa; identical to SEQ ID NO: 115562

SEQ ID NO: 535680 - RNA, 64 nt, hsa; identical to SEQ ID NO: 115563

SEQ ID NO: 535681 - RNA, 64 nt, hsa; identical to SEQ ID NO: 115564

SEQ ID NO: 535682 - RNA, 64 nt, hsa; identical to SEQ ID NO: 115565

SEQ ID NO: 535683 - RNA, 64 nt, hsa; identical to SEQ ID NO: 115566

SEQ ID NO: 535684 - RNA, 64 nt, hsa; identical to SEQ ID NO: 115567

SEQ ID NO: 535685 - RNA, 64 nt, hsa; identical to SEQ ID NO: 115568

SEQ ID NO: 535686 - RNA, 64 nt, hsa; identical to SEQ ID NO: 115569

SEQ ID NO: 535687 - RNA, 64 nt, hsa; identical to SEQ ID NO: 115570

SEQ ID NO: 535688 - RNA, 64 nt, hsa; identical to SEQ ID NO: 115571

SEQ ID NO: 535689 - RNA, 64 nt, hsa; identical to SEQ ID NO: 115572

SEQ ID NO: 535690 - RNA, 64 nt, hsa; identical to SEQ ID NO: 115573

SEQ ID NO: 535691 - RNA, 64 nt, hsa; identical to SEQ ID NO: 115574

SEQ ID NO: 535692 - RNA, 64 nt, hsa; identical to SEQ ID NO: 115575

SEQ ID NO: 535693 - RNA, 66 nt, hsa
auugcucccccuucauucugaugccucccuggggaacaaggauaaugacuuugcaucugcaccugg

SEQ ID NO: 535694 - RNA, 66 nt, hsa
auuuugcacgaacaugcaguuauugaagauuaggaucaaggauagacaagguauaguaguuaucuu

SEQ ID NO: 535695 - RNA, 66 nt, hsa
uugggcaugugguauacugaagcaauacccguuagacaaggauauuuuacuucuuccagacaccag

SEQ ID NO: 535696 - RNA, 66 nt, hsa
uccacugccaaguagaagugacucaaaacccucugacaaggauauucccuuggcuaugguccugcc

SEQ ID NO: 535697 - RNA, 66 nt, hsa
gccauccagcaguuccuuaaauaaggucaccaaggacaaggauaucaaauaacuacuguucaaucu

SEQ ID NO: 535698 - RNA, 66 nt, hsa
ucccaaauggugcuuaucuugauugaacauucagaacaaggauauuauuuucagugauuuugugag

SEQ ID NO: 535699 - RNA, 66 nt, hsa
cugccuaguaggcugaagcuucaggacucugcaggucaaggauaugugaugagcaccggccuaagu

SEQ ID NO: 535700 - RNA, 66 nt, hsa
ccaaccaaaaggcuuucagaggugugaauggaucuccaaggauaaguguaacaguuggcaacaucc

SEQ ID NO: 535701 - RNA, 66 nt, hsa
ccguccucaugcuccucaguguccacacuucaaggccaaggauaguuucuuccucugacaugggga

SEQ ID NO: 535702 - RNA, 66 nt, hsa
uuuaaaugaauacuuuuacaaagucuacuuuuuguucaaggauaugcugacccauauaguuuacuc

SEQ ID NO: 535703 - RNA, 66 nt, hsa
aaauccuaaguguaaaucaguuauucuacccccuaccaaggauaucagccuguuuuuucccuuuuu

SEQ ID NO: 535704 - RNA, 66 nt, hsa
cuuauuaaaauuuacaaaaugucuuuuugaauguaucaaggauauauuuaguuugaguggaauuug

SEQ ID NO: 535705 - RNA, 66 nt, hsa
uuauuucauguaguauggcuaauacuauaguugaaccaaggauaugcauugauucuuugcuucgua

SEQ ID NO: 535706 - RNA, 66 nt, hsa
uuagccauugcccuggagaugaaauuaauggaggcucaaggauagaugagcucugaguuucucagu

SEQ ID NO: 535707 - RNA, 66 nt, hsa
acuauuuucuccuuaaagcuccagccaaaaacuggacaaggauagagaggaggagggaagaacaaa

SEQ ID NO: 535708 - RNA, 66 nt, hsa
gcauggaaguuuaaauuuucucuaaaauuaaaaugccaaggauaaagcuggcugcuuccaggaggg

SEQ ID NO: 535709 - RNA, 66 nt, hsa
guguauaauacgguauuauacccgcaugugcucuagcaaggauaccaaggcaagcauacauguagc

SEQ ID NO: 535710 - RNA, 66 nt, hsa
aaaucaaaugagccaucagugaggcagcaguuacuucaaggauaugauauguuaaugaauccaaag

SEQ ID NO: 535711 - RNA, 66 nt, hsa
aagcuacaaguuagcucaagcaaugugacauuauuucaaggauaugugccagggaauucaggaacc

SEQ ID NO: 535712 - RNA, 66 nt, hsa
uaaagagaaaaaauauguguauaucauggaaaaagacaaggauauuuuaauaaaacauuacuuauu

SEQ ID NO: 535713 - RNA, 66 nt, hsa
acgaagaaagaauaaauuucggcuguuuuaagccaccaaggauaauugguuacagcagcucuagga

SEQ ID NO: 535714 - RNA, 66 nt, hsa
ggguucuucagugaaaagcaggagaagagcccacugcaaggauagcucauuaggcacaugaccgau

SEQ ID NO: 535715 - RNA, 66 nt, hsa
aguagauacaggcacugcucugaaaaccuggcuagccaaggauauucucagaauguuaucaccugu

SEQ ID NO: 535716 - RNA, 66 nt, hsa
aaccccagaauauuuccucuugacuucuuuuuguaacaaggauaauuuagggauuuauaaaguugu

SEQ ID NO: 535717 - RNA, 66 nt, hsa
uggcugagaaaauucuggaacuauggaucuugaccccaaggauauauuauuuuauuccaagaaaga

SEQ ID NO: 535718 - RNA, 66 nt, hsa
ccagcagacugguggcaugcccaguggcuuugggggcaaggauagaaaugccaucaggaaauagcu

SEQ ID NO: 535719 - RNA, 66 nt, hsa
ugauuaaaagguauacuuuaguagacauuuauaacucaaggauaccuucuuauuuaaucuuuucuu

SEQ ID NO: 535720 - RNA, 66 nt, hsa
gaauuuuuugauguuuauauuaguaacaaaauuauacaaggauagaaucucaucuagaaaaugcaa

SEQ ID NO: 535721 - RNA, 66 nt, hsa
uuuuuuuaaaugguugaaacuugaaggaaguucauucaaggauaaguuggaauaaagcacuauguu

SEQ ID NO: 535722 - RNA, 66 nt, hsa
ugccuuuguggcuucgcugauuaaagagaguggcaccaaggauagcaaugucuggauuggccucca

SEQ ID NO: 535723 - RNA, 66 nt, hsa
caaacuugacuuugaaauauuccuguuggucaugaucaaggauauuugaaaucacuacuguguuuu

SEQ ID NO: 535724 - RNA, 66 nt, hsa
cuaggucuacagguuuacauuuuucuguguuacacucaaggauaaaggcaaaaucaauuuuguaau

SEQ ID NO: 535725 - RNA, 66 nt, hsa
ucagucugucgggugggggcagaaaucaaaucagcccaaggauauaguuaggauuaauuacuuaau

SEQ ID NO: 535726 - RNA, 66 nt, hsa
aggacaguuagaccccugggugggcccugccgugggcaaggauacccgguggcuucuggcaccugg

SEQ ID NO: 535727 - RNA, 66 nt, hsa
agccuuuccaauagccccaugaaaagaagcaucacccaaggauauuguaaaaaggauguaacaagg

SEQ ID NO: 535728 - RNA, 66 nt, hsa
cucugaaguuauguaaaauaaaagcaucugauccuucaaggauaaaguugaggaucacaugguacg

SEQ ID NO: 535729 - RNA, 55 nt, hsa; identical to SEQ ID NO: 115441

SEQ ID NO: 535730 - RNA, 66 nt, hsa
ccagagcaaucuagaaucuuugagugcuuggcuuuccaaggauacugcggagacucuggccaagcu

SEQ ID NO: 535731 - RNA, 66 nt, hsa
uaaaaacaagguauauacuuuauuauuuuuugaaaacaaggauauugugaucaauuuuacccugua

SEQ ID NO: 535732 - RNA, 66 nt, hsa
cugguugcauggcccacuuggagcugaggucucauacaaggauauuuggagugaaaugcuggccag

SEQ ID NO: 535733 - RNA, 66 nt, hsa
gauaccuucuuuacaggagaggaaaggucuaaaucacaaggauagacauuuaucaaagaaguuaaa

SEQ ID NO: 535734 - RNA, 66 nt, hsa
cuuuucacuuuuguuauauagguuuaauccccaagccaaggauaguacuuaguauuucacuacacu

SEQ ID NO: 535735 - RNA, 66 nt, hsa
gacuggaaacaguuugaacagaauucaaaguaugagcaaggauaccaaaaaucacauccuacuaua

SEQ ID NO: 535736 - RNA, 66 nt, hsa
aaagagaaguuuccagcaaaacccucaucagcauuacaaggauauuugaacuccaugcuugauggu

SEQ ID NO: 535737 - RNA, 66 nt, hsa
uuuccuagaggagagauuaguaccuauucauuaacacaaggauacauaagagacuugccccuuuug

SEQ ID NO: 535738 - RNA, 66 nt, hsa
uuaugugugucauucaugaaucucuauaaucaaggacaaggauaauucagucaugaaccuguuuuc

SEQ ID NO: 535739 - RNA, 66 nt, hsa
acuggauuauauugcagcauauuuuacauuugaauacaaggauaauggguuuuaucaaaacaaaau

SEQ ID NO: 535740 - RNA, 66 nt, hsa
gcccuggaucauauuccggggaucaucacaucaguccaaggauauaaaaaaauggaagauuaaaaa

SEQ ID NO: 535741 - RNA, 66 nt, hsa
ucuccauaucuugauggcuuuugggagcauuucacacaaggauauaaaaugcgguuuucuuaaaug

SEQ ID NO: 535742 - RNA, 66 nt, hsa
agucaguuuguaucaguuaauaggauguucauauuccaaggauauuaguuguuuuuuuaaucaucc

SEQ ID NO: 535743 - RNA, 66 nt, hsa
ugcacuggagccguaggaggcucuucaguugggccccaaggauaaggcuacugauuugauacuaaa

SEQ ID NO: 535744 - RNA, 66 nt, hsa
gugucgcauaaccacuucuucuauccccuguacuuucaaggauaauuuaggcuacaugagauuuug

SEQ ID NO: 535745 - RNA, 66 nt, hsa
ugacguuaaaaaacaacaacagaucuagagauaccucaaggauaucauuuuugauuuuguguuaca

SEQ ID NO: 535746 - RNA, 66 nt, hsa
guuuucuuuuuucacacaguaaaaauucuuaucauucaaggauauuggaaccacaggacuauuugg

SEQ ID NO: 535747 - RNA, 57 nt, hsa; identical to SEQ ID NO: 115459

SEQ ID NO: 535748 - RNA, 66 nt, hsa
uugagaucgcugauuggugacacaacuggcagaaaacaaggauaugcuuuggcaggggugugugug

SEQ ID NO: 535749 - RNA, 66 nt, hsa
ugggcugaaggacaaauugaaauugucugccaauaccaaggauauucuuguauauuugaaaaauaa

SEQ ID NO: 535750 - RNA, 66 nt, hsa
gccugacaaugguaccuauuagggaugagauacagacaaggauagcuaucugggacauuauuggca

SEQ ID NO: 535751 - RNA, 66 nt, hsa
gguggagagcacuagaagugguuuccugauaacaagcaaggauaucagagcugggaaauucaugug

SEQ ID NO: 535752 - RNA, 66 nt, hsa
caaaggugaccgcagggggccccagggcuggagccacaaggauacccucacuuugcaugaggagcu

SEQ ID NO: 535753 - RNA, 66 nt, hsa
uuuuaaggcauuggcuuuuaaauuaauacauauauccaaggauauguuauagcugcaguguuugaa

SEQ ID NO: 535754 - RNA, 66 nt, hsa
accacuucaaaacugguagaauauuuauucauaugacaaggauaccugaguaaaacuauccuuuuu

SEQ ID NO: 535755 - RNA, 66 nt, hsa
aucugcgugacagaaacaccagcauauuugcaacgccaaggauauuggucuuaagugcaagagcac

SEQ ID NO: 535756 - RNA, 66 nt, hsa
aguagguacucuugagagcaauucaaaucaugcugacaaggauacugauagaaaaagugauuucuu

SEQ ID NO: 535757 - RNA, 66 nt, hsa
cuuggagaauugugaauguauguacuguauugucaucaaggauacugucccuuauuugaaggcauc

SEQ ID NO: 535758 - RNA, 66 nt, hsa
guacccuagauagugucacaugacaccguugucauccaaggauaauacagaccaacuaggcuacau

SEQ ID NO: 535759 - RNA, 66 nt, hsa
cucuccuuuuccuuaccauaccacuuugacacgcuucaaggauauacugcagcuuuacugccuucc

SEQ ID NO: 535760 - RNA, 66 nt, hsa
gcaagacucccguuucucuuaaaauaaguaaaauuccaaggauauaugccccaacgaaugcugcug

SEQ ID NO: 535761 - RNA, 66 nt, hsa
auagugaacauuucuccuaagauuauaaaaauaagacaaggauaucugcugucaaugauuuuauuc

SEQ ID NO: 535762 - RNA, 66 nt, hsa
acaaaucuuuugguacuaccauuuggggaagccaagcaaggauaguaaauugaccagaacacaguu

SEQ ID NO: 535763 - RNA, 66 nt, hsa
aggaauaaaaccuugucuuccauuacaauuaacagucaaggauaaaacaagcacgcgcacaaucaa

SEQ ID NO: 535764 - RNA, 59 nt, hsa; identical to SEQ ID NO: 115476

SEQ ID NO: 535765 - RNA, 66 nt, hsa
accuuuuccauauuacugugaacuuucaacuacuaucaaggauaauaaauuugacauuauuucuuu

SEQ ID NO: 535766 - RNA, 66 nt, hsa
gagagagaaagacgaagggagagagaaagcaguuuccaaggauauguuucaugucccaccauuuuc

SEQ ID NO: 535767 - RNA, 66 nt, hsa
guauuuuaaaauacauuauccuuguaauguauuuuacaaggauaauguauuuuaaaaugggaguug

SEQ ID NO: 535768 - RNA, 66 nt, hsa
auccacauuuggguuaacuccucagauuuggaguggcaaggauaaaagugagggcagaaguagcug

SEQ ID NO: 535769 - RNA, 66 nt, hsa
acaagucguccaguagaaaugcaucuaugaggucagcaaggauaugaugagauuuugcucacaguc

SEQ ID NO: 535770 - RNA, 66 nt, hsa
gcaaaccuucuaccuccuaccuacuuuucucugggacaaggauaaaggaauaugauuuuccagagc

SEQ ID NO: 535771 - RNA, 66 nt, hsa
caauacugcguuccuuauaggucuuacaugcauaugcaaggauauuuuaucuuauucauucauuuc

SEQ ID NO: 535772 - RNA, 66 nt, hsa
uucauucagaccuguugcuaacaaauuuauauuugccaaggauauuaggcaaaagaggcuacuuga

SEQ ID NO: 535773 - RNA, 66 nt, hsa
gguucgcaccaacucaaugaacaagcugaagaaauccaaggauacagucucagaggacaccauuag

SEQ ID NO: 535774 - RNA, 66 nt, hsa
auauaacuucucuuuggcuuuucuucaucuguaaaacaaggauaauacugaacuguaaggguuagu

SEQ ID NO: 535775 - RNA, 66 nt, hsa
caaaaaguauuucucugucaguuccccacucuauaccaaggauauuauuaaaacuagaaaugacug

SEQ ID NO: 535776 - RNA, 66 nt, hsa
ccaccucaaaaaaaaaaaaaagaauccaauacugcccaaggauagguauuuuauagaugggcaacu

SEQ ID NO: 535777 - RNA, 66 nt, hsa
ugugcacuuugcucaaaauuuuaaaaauaccaaucacaaggauaauagaguagccuaaaauuacua

SEQ ID NO: 535778 - RNA, 62 nt, hsa; identical to SEQ ID NO: 115490

SEQ ID NO: 535779 - RNA, 66 nt, hsa
guauaugcaaauugcaagauuuaaaccauucugaugcaaggauaaaccuuuacuuugacuaccagc

SEQ ID NO: 535780 - RNA, 66 nt, hsa
gcuguugugcaaaguucaguuucuucucagcaacaucaaggauauaugaagaaaaggaaauaaaaa

SEQ ID NO: 535781 - RNA, 66 nt, hsa
uaaaaauagauaaaguauaaaguaguacggcuguugcaaggauauuuuuaaaugcuuucaaaucug

SEQ ID NO: 535782 - RNA, 66 nt, hsa
aacauguucguggugcugaaugccucucagcaucaucaaggauaacugaaacugggucucccuggg

SEQ ID NO: 535783 - RNA, 66 nt, hsa
cacacacacacacacacaccccuucuugaauggcuccaaggauacccuuuuaacuucuucccuuca

SEQ ID NO: 535784 - RNA, 66 nt, hsa
acaucuuccuaaucuguuaauggucagugguguccccaaggauagugcuggcuuccauggaaaccc

SEQ ID NO: 535785 - RNA, 66 nt, hsa
auaccacugagcucacugcccaugauucagagcuuucaaggauaggcuuuauucugcaagcaauac

SEQ ID NO: 535786 - RNA, 66 nt, hsa
auaccacugagcucacugcccaugaugcagagcuuucaaggauaggcuuuauucugcaagcaauca

SEQ ID NO: 535787 - RNA, 66 nt, hsa
gggaacuguuuugaauaaggauuuaaaauaccugcacaaggauagagagaaacuaugugacucauu

SEQ ID NO: 535788 - RNA, 66 nt, hsa
cucaggaacucugcuuccuggcccagcgcucgugaccaaggauacaccaaagcccuuaagaccuca

SEQ ID NO: 535789 - RNA, 66 nt, hsa
aaaauaguucuggccagaaucaaagauucagcccuacaaggauauguuuuccugugaaauuaucua

SEQ ID NO: 535790 - RNA, 66 nt, hsa
ggccucuacuagguggcugugauuaaaugucccaagcaaggauagggaaggggaaugguugagccu

SEQ ID NO: 535791 - RNA, 66 nt, hsa
ucaaaacugaagcuuuuuauuuaggcuuuuccaaaucaaggauaaauaucuuacgcacgauaucua

SEQ ID NO: 535792 - RNA, 66 nt, hsa
gucuaacagacggucacaaccagugccauggaaaaccaaggauauuagcaaaagcagaaguugcua

SEQ ID NO: 535793 - RNA, 66 nt, hsa
caggggagcacacagggcccggcagcccccaggaaucaaggauagggcuaagguuuucaccuuaac

SEQ ID NO: 535794 - RNA, 66 nt, hsa
augaagcuggaaaccaucauucugagcaaacuaucgcaaggauagaaaaccaaacacugcauauuc

SEQ ID NO: 535795 - RNA, 66 nt, hsa
auaaaugguuucugaaaauguuuaaguauuaacuuacaaggauauagguuuuucucauguaucuuu

SEQ ID NO: 535796 - RNA, 66 nt, hsa
ugcccaagggccagcucaguuuauccuucggagagacaaggauaugcaugauucuuaaccaggcua

SEQ ID NO: 535797 - RNA, 66 nt, hsa
auggugccccaggaccagcucaggacagaugccacacaaggauagaugcuggcccagggcccagag

SEQ ID NO: 535798 - RNA, 66 nt, hsa
aaccauggccuuuccucaguguuguaaggccuaugccaaggauaaaggaaggguaugccuuugggu

SEQ ID NO: 535799 - RNA, 66 nt, hsa
uugcuaaugguuguuuucugugaguccuauaaaaagcaaggauaugcaugauucagggaaugaaga

SEQ ID NO: 535800 - RNA, 66 nt, hsa
gaaccccucaauggacucucucaacccagggacacccaaggauaugucuucugaagaucaaggcaa

SEQ ID NO: 535801 - RNA, 66 nt, hsa
uguaacaaaauauguauguccgaagggaaaaagcugcaaggauauauauaagaccacugcuuaucu

SEQ ID NO: 535802 - RNA, 66 nt, hsa
aggauuagauguggaagggaaggauaagaaacagaccaaggauaacuuucaaauguaugcuuaagc

SEQ ID NO: 535803 - RNA, 52 nt, hsa; identical to SEQ ID NO: 115515

SEQ ID NO: 535804 - RNA, 66 nt, hsa
aaacccagaaaagacagaggugauggaauuaguagacaaggauauuaaaagagcuauuguaaauau

SEQ ID NO: 535805 - RNA, 66 nt, hsa
cgugggauagauaacugagaggcucagaaucuuuaccaaggauauuuuuuaggauaagguagcugc

SEQ ID NO: 535806 - RNA, 66 nt, hsa
uguagucucuuguuuaaaaaaucuggagcgggaaugcaaggauacaaaacuuuagcaugcuuugag

SEQ ID NO: 535807 - RNA, 66 nt, hsa
uugguuucagucaucaacuacccaugaauuccugcccaaggauacuuaaucaggauuaaauuuucu

SEQ ID NO: 535808 - RNA, 66 nt, hsa
ggaacacauagaacugauggaggcuuuuccuaaggccaaggauaauguacuaguuguuaaaaugga

SEQ ID NO: 535809 - RNA, 66 nt, hsa
uauuuuccagguacccuucucgcuuuugccauuagccaaggauagaagcugcagugguauuaauuu

SEQ ID NO: 535810 - RNA, 66 nt, hsa
gagaaggcauuaaaaagaagugcaauuccuuuuuagcaaggauaaaaucauugccuuguguuacag

SEQ ID NO: 535811 - RNA, 66 nt, hsa
agcccgacauggugcuaguuuccucucuuggagagccaaggauaagugacucuccaauagguucuu

SEQ ID NO: 535812 - RNA, 66 nt, hsa
aaaacguuuugauuuauaguaccaagugcuuaaacacaaggauaguguuagauuuucgagugacuu

SEQ ID NO: 535813 - RNA, 66 nt, hsa
uuuuuucuuuucuuaguucauauuugcauuuucguucaaggauaugcuuagcaauaaaauguucuu

SEQ ID NO: 535814 - RNA, 66 nt, hsa
uccccagcaaauccuagaaguggagucuggauacuucaaggauagaaguguuggcacgcacagcca

SEQ ID NO: 535815 - RNA, 66 nt, hsa
gaaagaguuggauuggacccuacuugccuucccgggcaaggauaggaccuuucacgcaagugccau

SEQ ID NO: 535816 - RNA, 66 nt, hsa
ccuuuguggucuucugugauuauuuaugcugccucccaaggauagaauugaaauaaaauguuuuca

SEQ ID NO: 535817 - RNA, 66 nt, hsa
gaaaagaucgucugagaaaucugaaaaaaaagaaagcaaggauacuaagaaaauagaagguaaaga

SEQ ID NO: 535818 - RNA, 66 nt, hsa
uuuuaaguuucuaagggucuaguuguucagaauccccaaggauauuucccuaaccucacucaguca

SEQ ID NO: 535819 - RNA, 66 nt, hsa
aaauuuuuuguaugaucaguuuuugaaguccguauacaaggauauauuuuacaagugguuuucuua

SEQ ID NO: 535820 - RNA, 66 nt, hsa
acugcagagcccagagcccuucaucucucugagggucaaggauaccaggggucccaagucacagau

SEQ ID NO: 535821 - RNA, 66 nt, hsa
gggccuggccuguccucuaagucaaguuuaggaaaacaaggauaagauucugucauaggcauagag

SEQ ID NO: 535822 - RNA, 66 nt, hsa
auugagaauguaaauaaaugugucuucuuuauggaccaaggauaugaaaucauuuuucuuuuguag

SEQ ID NO: 535823 - RNA, 66 nt, hsa
cucagaggaguuuaacgcgaucuucacauuuuacgacaaggauagaagcggcuacauugacgagca

SEQ ID NO: 535824 - RNA, 66 nt, hsa
aaaaaaacuacauaaaaggccuaaaaguaagacccacaaggauauuccuuugcccuucuuguacuu

SEQ ID NO: 535825 - RNA, 66 nt, hsa
ucuuuaucuuuucuuugaauaagaaaaaguaucuagcaaggauauuacuugugccuugaggcuagc

SEQ ID NO: 535826 - RNA, 66 nt, hsa
aagauuuggcccucauuuucccucagaaccccacggcaaggauauauguccccuuguucucucugc

SEQ ID NO: 535827 - RNA, 66 nt, hsa
gugggguuuccccucaggaauuugucuaacacauuucaaggauagaaaauacuucacugccgggca

SEQ ID NO: 535828 - RNA, 66 nt, hsa
uguuccaaccuccugcucugggacguggacaugccucaaggauacagggagccggcggccucucga

SEQ ID NO: 535829 - RNA, 66 nt, hsa
aagcauacuugugaacuaccuugcuagcuagccagccaaggauaccggacacaccucugcuccaaa

SEQ ID NO: 535830 - RNA, 66 nt, hsa
ugggaaaaaacccaaagaaccaaaaacaaaccaccccaaggauaauaauagcuacacugcuagcuu

SEQ ID NO: 535831 - RNA, 66 nt, hsa
caaacaggcacuguuagaugaaguaaaugauuucaacaaggauauuuguaucaggguucuacuuca

SEQ ID NO: 535832 - RNA, 66 nt, hsa
gacguugcugaacaagcgugugaaaucauuucagaucaaggauaagccaguguguacauauguuca

SEQ ID NO: 535833 - RNA, 66 nt, hsa
uguuauugggcauuugaugagguuuggcauggacuucaaggauaaaugaaugaaaacuuugcacca

SEQ ID NO: 535834 - RNA, 66 nt, hsa
ucucuuguguggucccagaaggagaagugaguuugccaaggauauggggcaggaggcucccucugc

SEQ ID NO: 535835 - RNA, 66 nt, hsa
cuuucagauugccauggggauuccucuauauagaaucaaggauauccguaugauguaugggguauc

SEQ ID NO: 535836 - RNA, 66 nt, hsa
uugauaaaaccuuuuuaauaagugaugcagagcagccaaggauauguugacccagaugucaaccag

SEQ ID NO: 535837 - RNA, 66 nt, hsa
aauaucaggggcauaaaaggcuaucuauucuuaauucaaggauaaaacagaagaagcuugugguau

SEQ ID NO: 535838 - RNA, 66 nt, hsa
cacugucaacauuagaucaaugagacagaaaguuaacaaggauauccaggaauugaacacagcucu

SEQ ID NO: 535839 - RNA, 66 nt, hsa
auuugcaacagcuacagucuaaaauugcuucuuuaccaaggauauuuacagaaaagacucugacca

SEQ ID NO: 535840 - RNA, 66 nt, hsa
gguuuuuuguuauccuuugauuuuguuuaugaaaagcaaggauagcuuaauuuucaaaaacucaau

SEQ ID NO: 535841 - RNA, 66 nt, hsa
guuuuacuuauuugcuccuuguagagcugccuuuuccaaggauaccauaaacuccugagagcaggg

SEQ ID NO: 535842 - RNA, 66 nt, hsa
ccuugauccuggcauucuggaagacacgaaagcaagcaaggauauauaaggcacuguggugguuau

SEQ ID NO: 535843 - RNA, 66 nt, hsa
aggccccgaguuagaaaaaguagcuauggaggacuacaaggauaacccagcauuugcgugaguauc

SEQ ID NO: 535844 - RNA, 66 nt, hsa
gacagcccccaggccugggggcacagauccccccagcaaggauaacauucaaaggagcucacauuu

SEQ ID NO: 535845 - RNA, 66 nt, hsa
ggguucagguccgcccauuacuccuugucgugcggucaaggauacaccuuggccccgauuccggau

SEQ ID NO: 535846 - RNA, 66 nt, hsa
ccucucagggguagugaagcugcagacugacaguuucaaggauacccaaauuccccuaaagguucc

SEQ ID NO: 535847 - RNA, 66 nt, hsa
ucaaacggcagucauuuguucuccucggcucuguggcaaggauagcccuuuggagggggacucuug

SEQ ID NO: 535848 - RNA, 66 nt, hsa
ugucaccagccuguuguuuuaagagagaaaaaaaaucaaggauaucugauuggagcaaaccacuuc

SEQ ID NO: 535849 - RNA, 66 nt, hsa
gguuauauuguacaggaucaauauuuugcuuuuuaacaaggauauuuauguaauaagaaacuuugc

SEQ ID NO: 535850 - RNA, 66 nt, hsa
uauuguuuuaugaaacuuucacguguauauauagaccaaggauaugugcugaguuuugaugucaaa

SEQ ID NO: 535851 - RNA, 66 nt, hsa
aucauugcaaccucugugcuuuuauaauucaaagaacaaggauagcuuucuucgguaucuuuuaau

SEQ ID NO: 535852 - RNA, 66 nt, hsa
ugggcuguuuucugucuuauuucucaguugagugagcaaggauacgaaaacaguguguuugaaaac

SEQ ID NO: 535853 - RNA, 66 nt, hsa
uuugauuuuggaauucaggugcacucuauucaagugcaaggauaucagaaguuuuuuuuuauuuaa

SEQ ID NO: 535854 - RNA, 66 nt, hsa
gaggggcacggggccuccgagcuccagcuccguucccaaggauacucgugaagaccccaucugugu

SEQ ID NO: 535855 - RNA, 66 nt, hsa
auucacucagcaaccaugcccuuagucugaagauaacaaggauacuuuaauauccagugccgguuc

SEQ ID NO: 535856 - RNA, 66 nt, hsa
gccaaauuagaaaauccuauguccuaguuuccuuaccaaggauaauuaaauauaucacuaagagcu

SEQ ID NO: 535857 - RNA, 66 nt, hsa
ucacaugguuagaaauuuaaagcaagaucauuuacccaaggauagguguuugguaauguugaagga

SEQ ID NO: 535858 - RNA, 66 nt, hsa
aaauguaaaugucuguugaauuucugaaguugaaaacaaggauauaucauuggagcaaguguugga

SEQ ID NO: 535859 - RNA, 66 nt, hsa
aaguuaacaggaauaaauauaugaacaaaaaagcugcaaggauaaauguggagaaaaugaugagaa

SEQ ID NO: 535860 - RNA, 66 nt, hsa
cucuuuuucuccuaggagcaacuugugcaaguacuucaaggauagcaggaauauaaaaauucucaa

SEQ ID NO: 535861 - RNA, 66 nt, hsa
gggagggugauucccagugguggggaaaacauuaaucaaggauacuugcauuuagccuggagcccc

SEQ ID NO: 535862 - RNA, 66 nt, hsa
uacacagaaucuccugauaguaaagggggcuggagacaaggauaaguuauagagcaguuggaggaa

SEQ ID NO: 535863 - RNA, 66 nt, hsa
gugugaagaaauaggaaagaagaaguuaccauuaaccaaggauaugagagaacaaggaguuaaaag

SEQ ID NO: 535864 - RNA, 64 nt, hsa
aguccuuccuuccuaaucucuaauccccugaagccuaacacaguuccuaauguguuuugccuua

SEQ ID NO: 535865 - RNA, 64 nt, hsa
ggcugugguuuacuccugucuaaaccccugaagccuaacacaguuccuggcacacaacaggugu

SEQ ID NO: 535866 - RNA, 64 nt, hsa
uggccuuguuggagggggccaggcucuagaacgucuaacacaguggagaaccgaaacccccccc

SEQ ID NO: 535867 - RNA, 64 nt, hsa
ucccucccccagucucucuucucaaucccccuuucuaacacacacacacacacacacacacaca

SEQ ID NO: 535868 - RNA, 64 nt, hsa
cacaagcagugacaccucggguccuuuccguugcuauggugaaaauuccuggauggaauggauc

SEQ ID NO: 535869 - RNA, 64 nt, hsa
acuguuccuucuauggggcucuugcucuagugucuauggugagaacacaggccccgccccuucc

SEQ ID NO: 535870 - RNA, 64 nt, hsa
ccuggggucaggaguucgagaccagccugaccaauauggugaaaccccaucucuacuaaaaaua

SEQ ID NO: 535871 - RNA, 64 nt, hsa
augaagucaagaguucgagaccagcaauggccaguauggugaaacccugucucuccuaaaaaua

SEQ ID NO: 535872 - RNA, 64 nt, hsa
auucaaaaugaauacaaaauuaaaauuugaacauuauggugauuauggugaggagaaugggaua

SEQ ID NO: 535873 - RNA, 64 nt, hsa
gaauacaaaauuaaaauuugaacauuauggugauuauggugaggagaaugggauauuaacauaa

SEQ ID NO: 535874 - RNA, 64 nt, hsa; identical to SEQ ID NO: 294005

SEQ ID NO: 535875 - RNA, 64 nt, hsa; identical to SEQ ID NO: 294006

SEQ ID NO: 535876 - RNA, 64 nt, hsa; identical to SEQ ID NO: 294007

SEQ ID NO: 535877 - RNA, 64 nt, hsa; identical to SEQ ID NO: 294008

SEQ ID NO: 535878 - RNA, 64 nt, hsa; identical to SEQ ID NO: 294009

SEQ ID NO: 535879 - RNA, 64 nt, hsa; identical to SEQ ID NO: 294010

SEQ ID NO: 535880 - RNA, 64 nt, hsa; identical to SEQ ID NO: 294011

SEQ ID NO: 535881 - RNA, 64 nt, hsa; identical to SEQ ID NO: 294012

SEQ ID NO: 535882 - RNA, 64 nt, hsa; identical to SEQ ID NO: 294013

SEQ ID NO: 535883 - RNA, 64 nt, hsa; identical to SEQ ID NO: 294014

SEQ ID NO: 535884 - RNA, 64 nt, hsa; identical to SEQ ID NO: 294015

SEQ ID NO: 535885 - RNA, 64 nt, hsa; identical to SEQ ID NO: 294016

SEQ ID NO: 535886 - RNA, 64 nt, hsa; identical to SEQ ID NO: 294017

SEQ ID NO: 535887 - RNA, 64 nt, hsa; identical to SEQ ID NO: 294018

SEQ ID NO: 535888 - RNA, 64 nt, hsa; identical to SEQ ID NO: 294019

SEQ ID NO: 535889 - RNA, 64 nt, hsa; identical to SEQ ID NO: 294020

SEQ ID NO: 535890 - RNA, 64 nt, hsa; identical to SEQ ID NO: 294021

SEQ ID NO: 535891 - RNA, 64 nt, hsa; identical to SEQ ID NO: 294022

SEQ ID NO: 535892 - RNA, 64 nt, hsa; identical to SEQ ID NO: 294023

SEQ ID NO: 535893 - RNA, 64 nt, hsa; identical to SEQ ID NO: 294024

SEQ ID NO: 535894 - RNA, 64 nt, hsa
uguuccauugcuagcuguccugcuguuuaacacaguguuguauuuuuuuucuaaauguacauaa

SEQ ID NO: 535895 - RNA, 64 nt, hsa
ccgcuuaaccaagcuguugugguuuuucagcauaguguuguauguuccauugcuagcuguccug

SEQ ID NO: 535896 - RNA, 64 nt, hsa
ucuccugccucagccuccugaguagcugggcacgguguuguaccucuagucccagcuacuuggg

SEQ ID NO: 535897 - RNA, 64 nt, hsa
uuacugaauuuaguucugugcucuuccuuauuuaguguuguaucauaaauacuuugauguuuca

SEQ ID NO: 535898 - RNA, 64 nt, hsa
aaguacuuucagugcucaaaaaaaugcaaucacuguguuguauauaauaguucauagguugauc

SEQ ID NO: 535899 - RNA, 64 nt, hsa
accccucaacuuuaauuugcccaguuauaccucaguguuguagcaguacugugauaccuggcac

SEQ ID NO: 535900 - RNA, 64 nt, hsa
aaucccaguaggcuuuuaccauuagcauaauuuuguguuguacaauuaaguuacaauuacaucu

SEQ ID NO: 535901 - RNA, 64 nt, hsa
aagcuccucacugguauacuaucauccuggagggguguuguauggcugagcaagagagagagag

SEQ ID NO: 535902 - RNA, 64 nt, hsa
uacauucuauuccuguaauuauugugcccuuuaaguguuguaaaaucguuuuggaauuugugcc

SEQ ID NO: 535903 - RNA, 64 nt, hsa
uauagggaaaagaaaucaccuacucccugacacuguguuguacccuucauccaaaagucagcuu

SEQ ID NO: 535904 - RNA, 64 nt, hsa
cacuguguuccuauaaaggcccuuuucuuucuuaguguuguaaguuacauuuucauuaugcccc

SEQ ID NO: 535905 - RNA, 64 nt, hsa
cauuccguuugaauuccuucuaacuggaacauuuguguuguaucuguaacacuggcacugaaau

SEQ ID NO: 535906 - RNA, 64 nt, hsa; identical to SEQ ID NO: 145890

SEQ ID NO: 535907 - RNA, 64 nt, hsa; identical to SEQ ID NO: 145891

SEQ ID NO: 535908 - RNA, 64 nt, hsa; identical to SEQ ID NO: 145892

SEQ ID NO: 535909 - RNA, 64 nt, hsa; identical to SEQ ID NO: 145893

SEQ ID NO: 535910 - RNA, 64 nt, hsa; identical to SEQ ID NO: 145894

SEQ ID NO: 535911 - RNA, 64 nt, hsa; identical to SEQ ID NO: 145895

SEQ ID NO: 535912 - RNA, 64 nt, hsa; identical to SEQ ID NO: 145896

SEQ ID NO: 535913 - RNA, 64 nt, hsa; identical to SEQ ID NO: 145897

SEQ ID NO: 535914 - RNA, 64 nt, hsa; identical to SEQ ID NO: 145898

SEQ ID NO: 535915 - RNA, 64 nt, hsa; identical to SEQ ID NO: 145899

SEQ ID NO: 535916 - RNA, 64 nt, hsa; identical to SEQ ID NO: 145900

SEQ ID NO: 535917 - RNA, 64 nt, hsa; identical to SEQ ID NO: 145901

SEQ ID NO: 535918 - RNA, 64 nt, hsa; identical to SEQ ID NO: 145902

SEQ ID NO: 535919 - RNA, 64 nt, hsa; identical to SEQ ID NO: 145903

SEQ ID NO: 535920 - RNA, 64 nt, hsa; identical to SEQ ID NO: 145904

SEQ ID NO: 535921 - RNA, 64 nt, hsa; identical to SEQ ID NO: 145905

SEQ ID NO: 535922 - RNA, 64 nt, hsa; identical to SEQ ID NO: 145906

SEQ ID NO: 535923 - RNA, 64 nt, hsa; identical to SEQ ID NO: 145907

SEQ ID NO: 535924 - RNA, 62 nt, hsa; identical to SEQ ID NO: 145908

SEQ ID NO: 535925 - RNA, 64 nt, hsa; identical to SEQ ID NO: 145909

SEQ ID NO: 535926 - RNA, 64 nt, hsa; identical to SEQ ID NO: 145910

SEQ ID NO: 535927 - RNA, 64 nt, hsa; identical to SEQ ID NO: 145911

SEQ ID NO: 535928 - RNA, 64 nt, hsa; identical to SEQ ID NO: 145912

SEQ ID NO: 535929 - RNA, 64 nt, hsa; identical to SEQ ID NO: 145913

SEQ ID NO: 535930 - RNA, 64 nt, hsa; identical to SEQ ID NO: 145914

SEQ ID NO: 535931 - RNA, 64 nt, hsa; identical to SEQ ID NO: 145915

SEQ ID NO: 535932 - RNA, 64 nt, hsa; identical to SEQ ID NO: 145916

SEQ ID NO: 535933 - RNA, 64 nt, hsa; identical to SEQ ID NO: 145917

SEQ ID NO: 535934 - RNA, 64 nt, hsa; identical to SEQ ID NO: 145918

SEQ ID NO: 535935 - RNA, 64 nt, hsa; identical to SEQ ID NO: 145919

SEQ ID NO: 535936 - RNA, 64 nt, hsa; identical to SEQ ID NO: 145920

SEQ ID NO: 535937 - RNA, 64 nt, hsa; identical to SEQ ID NO: 145921

SEQ ID NO: 535938 - RNA, 64 nt, hsa; identical to SEQ ID NO: 145922

SEQ ID NO: 535939 - RNA, 64 nt, hsa; identical to SEQ ID NO: 145923

SEQ ID NO: 535940 - RNA, 64 nt, hsa; identical to SEQ ID NO: 145924

SEQ ID NO: 535941 - RNA, 64 nt, hsa; identical to SEQ ID NO: 145925

SEQ ID NO: 535942 - RNA, 64 nt, hsa; identical to SEQ ID NO: 145926

SEQ ID NO: 535943 - RNA, 64 nt, hsa; identical to SEQ ID NO: 145927

SEQ ID NO: 535944 - RNA, 64 nt, hsa; identical to SEQ ID NO: 145928

SEQ ID NO: 535945 - RNA, 64 nt, hsa; identical to SEQ ID NO: 145929

SEQ ID NO: 535946 - RNA, 64 nt, hsa; identical to SEQ ID NO: 145930

SEQ ID NO: 535947 - RNA, 64 nt, hsa; identical to SEQ ID NO: 145931

SEQ ID NO: 535948 - RNA, 64 nt, hsa; identical to SEQ ID NO: 145932

SEQ ID NO: 535949 - RNA, 64 nt, hsa; identical to SEQ ID NO: 145933

SEQ ID NO: 535950 - RNA, 64 nt, hsa; identical to SEQ ID NO: 145934

SEQ ID NO: 535951 - RNA, 64 nt, hsa; identical to SEQ ID NO: 145935

SEQ ID NO: 535952 - RNA, 64 nt, hsa; identical to SEQ ID NO: 145936

SEQ ID NO: 535953 - RNA, 64 nt, hsa; identical to SEQ ID NO: 145937

SEQ ID NO: 535954 - RNA, 64 nt, hsa; identical to SEQ ID NO: 145938

SEQ ID NO: 535955 - RNA, 64 nt, hsa; identical to SEQ ID NO: 145939

SEQ ID NO: 535956 - RNA, 64 nt, hsa; identical to SEQ ID NO: 145940

SEQ ID NO: 535957 - RNA, 64 nt, hsa; identical to SEQ ID NO: 145941

SEQ ID NO: 535958 - RNA, 64 nt, hsa; identical to SEQ ID NO: 145942

SEQ ID NO: 535959 - RNA, 64 nt, hsa; identical to SEQ ID NO: 145943

SEQ ID NO: 535960 - RNA, 64 nt, hsa; identical to SEQ ID NO: 145944

SEQ ID NO: 535961 - RNA, 64 nt, hsa; identical to SEQ ID NO: 145945

SEQ ID NO: 535962 - RNA, 64 nt, hsa; identical to SEQ ID NO: 145946

SEQ ID NO: 535963 - RNA, 64 nt, hsa; identical to SEQ ID NO: 145947

SEQ ID NO: 535964 - RNA, 64 nt, hsa; identical to SEQ ID NO: 145948

SEQ ID NO: 535965 - RNA, 64 nt, hsa; identical to SEQ ID NO: 145949

SEQ ID NO: 535966 - RNA, 64 nt, hsa; identical to SEQ ID NO: 145950

SEQ ID NO: 535967 - RNA, 64 nt, hsa; identical to SEQ ID NO: 145951

SEQ ID NO: 535968 - RNA, 64 nt, hsa; identical to SEQ ID NO: 145952

SEQ ID NO: 535969 - RNA, 64 nt, hsa; identical to SEQ ID NO: 145953

SEQ ID NO: 535970 - RNA, 64 nt, hsa; identical to SEQ ID NO: 145954

SEQ ID NO: 535971 - RNA, 64 nt, hsa; identical to SEQ ID NO: 145955

SEQ ID NO: 535972 - RNA, 64 nt, hsa; identical to SEQ ID NO: 145956

SEQ ID NO: 535973 - RNA, 64 nt, hsa; identical to SEQ ID NO: 145957

SEQ ID NO: 535974 - RNA, 64 nt, hsa; identical to SEQ ID NO: 145958

SEQ ID NO: 535975 - RNA, 64 nt, hsa; identical to SEQ ID NO: 145959

SEQ ID NO: 535976 - RNA, 64 nt, hsa; identical to SEQ ID NO: 145960

SEQ ID NO: 535977 - RNA, 64 nt, hsa; identical to SEQ ID NO: 145961

SEQ ID NO: 535978 - RNA, 64 nt, hsa; identical to SEQ ID NO: 145962

SEQ ID NO: 535979 - RNA, 64 nt, hsa; identical to SEQ ID NO: 145963

SEQ ID NO: 535980 - RNA, 64 nt, hsa; identical to SEQ ID NO: 145964

SEQ ID NO: 535981 - RNA, 64 nt, hsa; identical to SEQ ID NO: 145965

SEQ ID NO: 535982 - RNA, 64 nt, hsa; identical to SEQ ID NO: 145966

SEQ ID NO: 535983 - RNA, 64 nt, hsa; identical to SEQ ID NO: 145967

SEQ ID NO: 535984 - RNA, 64 nt, hsa; identical to SEQ ID NO: 145968

SEQ ID NO: 535985 - RNA, 64 nt, hsa; identical to SEQ ID NO: 145969

SEQ ID NO: 535986 - RNA, 64 nt, hsa; identical to SEQ ID NO: 145970

SEQ ID NO: 535987 - RNA, 64 nt, hsa; identical to SEQ ID NO: 145971

SEQ ID NO: 535988 - RNA, 64 nt, hsa; identical to SEQ ID NO: 145972

SEQ ID NO: 535989 - RNA, 64 nt, hsa; identical to SEQ ID NO: 145973

SEQ ID NO: 535990 - RNA, 64 nt, hsa; identical to SEQ ID NO: 145974

SEQ ID NO: 535991 - RNA, 64 nt, hsa; identical to SEQ ID NO: 145975

SEQ ID NO: 535992 - RNA, 64 nt, hsa; identical to SEQ ID NO: 145976

SEQ ID NO: 535993 - RNA, 64 nt, hsa; identical to SEQ ID NO: 145977

SEQ ID NO: 535994 - RNA, 64 nt, hsa; identical to SEQ ID NO: 145978

SEQ ID NO: 535995 - RNA, 64 nt, hsa; identical to SEQ ID NO: 145979

SEQ ID NO: 535996 - RNA, 64 nt, hsa; identical to SEQ ID NO: 145980

SEQ ID NO: 535997 - RNA, 64 nt, hsa; identical to SEQ ID NO: 145981

SEQ ID NO: 535998 - RNA, 64 nt, hsa; identical to SEQ ID NO: 145982

SEQ ID NO: 535999 - RNA, 64 nt, hsa; identical to SEQ ID NO: 145983

SEQ ID NO: 536000 - RNA, 64 nt, hsa; identical to SEQ ID NO: 145984

SEQ ID NO: 536001 - RNA, 64 nt, hsa; identical to SEQ ID NO: 145985

SEQ ID NO: 536002 - RNA, 64 nt, hsa; identical to SEQ ID NO: 145986

SEQ ID NO: 536003 - RNA, 64 nt, hsa; identical to SEQ ID NO: 145987

SEQ ID NO: 536004 - RNA, 64 nt, hsa; identical to SEQ ID NO: 145988

SEQ ID NO: 536005 - RNA, 64 nt, hsa; identical to SEQ ID NO: 145989

SEQ ID NO: 536006 - RNA, 64 nt, hsa; identical to SEQ ID NO: 145990

SEQ ID NO: 536007 - RNA, 64 nt, hsa; identical to SEQ ID NO: 145991

SEQ ID NO: 536008 - RNA, 64 nt, hsa; identical to SEQ ID NO: 145992

SEQ ID NO: 536009 - RNA, 64 nt, hsa; identical to SEQ ID NO: 145993

SEQ ID NO: 536010 - RNA, 64 nt, hsa; identical to SEQ ID NO: 145994

SEQ ID NO: 536011 - RNA, 64 nt, hsa; identical to SEQ ID NO: 145995

SEQ ID NO: 536012 - RNA, 64 nt, hsa; identical to SEQ ID NO: 145996

SEQ ID NO: 536013 - RNA, 64 nt, hsa; identical to SEQ ID NO: 145997

SEQ ID NO: 536014 - RNA, 64 nt, hsa; identical to SEQ ID NO: 145998

SEQ ID NO: 536015 - RNA, 64 nt, hsa
uuuugucauguaaaaaagguuacucaaguuguacuacccacauaacugaaaauauuggccauuu

SEQ ID NO: 536016 - RNA, 64 nt, hsa
caaaucacauuacuggguaauuuuuaagacuauguacccacaccauacauacauacauauauau

SEQ ID NO: 536017 - RNA, 64 nt, hsa
uguaucuguuucuccuccuuuacgcccauuuuccuacccacagcagcaaaugacaacgugucug

SEQ ID NO: 536018 - RNA, 64 nt, hsa
ccaacccucuuaaaugucaaagacccuuuuugauuacccacacuggugguuauuacagcauggu

SEQ ID NO: 536019 - RNA, 64 nt, hsa
gauccccaaagaagcugcgccccaccuuuccagauacccacaaagcccccagacagaaucuagc

SEQ ID NO: 536020 - RNA, 64 nt, hsa
ggggaggggacugggacuggcggugagguuuugauacccacacccagccaucuggagucaugga

SEQ ID NO: 536021 - RNA, 64 nt, hsa
ucuccccucacauccuccugcccagcuccucacauacccacacauuccagggcuggggugagcc

SEQ ID NO: 536022 - RNA, 64 nt, hsa
ccugccauuggccucuugucccuuggcacacuuguacccacaggugaggggcaggaccugaagg

SEQ ID NO: 536023 - RNA, 64 nt, hsa; identical to SEQ ID NO: 210736

SEQ ID NO: 536024 - RNA, 64 nt, hsa; identical to SEQ ID NO: 210737

SEQ ID NO: 536025 - RNA, 64 nt, hsa; identical to SEQ ID NO: 210738

SEQ ID NO: 536026 - RNA, 64 nt, hsa; identical to SEQ ID NO: 210739

SEQ ID NO: 536027 - RNA, 64 nt, hsa; identical to SEQ ID NO: 210740

SEQ ID NO: 536028 - RNA, 64 nt, hsa; identical to SEQ ID NO: 210741

SEQ ID NO: 536029 - RNA, 64 nt, hsa; identical to SEQ ID NO: 210742

SEQ ID NO: 536030 - RNA, 64 nt, hsa; identical to SEQ ID NO: 210743

SEQ ID NO: 536031 - RNA, 64 nt, hsa; identical to SEQ ID NO: 210744

SEQ ID NO: 536032 - RNA, 64 nt, hsa; identical to SEQ ID NO: 210745

SEQ ID NO: 536033 - RNA, 64 nt, hsa; identical to SEQ ID NO: 210746

SEQ ID NO: 536034 - RNA, 64 nt, hsa; identical to SEQ ID NO: 210747

SEQ ID NO: 536035 - RNA, 64 nt, hsa; identical to SEQ ID NO: 210748

SEQ ID NO: 536036 - RNA, 64 nt, hsa; identical to SEQ ID NO: 210749

SEQ ID NO: 536037 - RNA, 64 nt, hsa; identical to SEQ ID NO: 210750

SEQ ID NO: 536038 - RNA, 64 nt, hsa; identical to SEQ ID NO: 210751

SEQ ID NO: 536039 - RNA, 64 nt, hsa; identical to SEQ ID NO: 210752

SEQ ID NO: 536040 - RNA, 64 nt, hsa; identical to SEQ ID NO: 210753

SEQ ID NO: 536041 - RNA, 64 nt, hsa; identical to SEQ ID NO: 210754

SEQ ID NO: 536042 - RNA, 64 nt, hsa; identical to SEQ ID NO: 210755

SEQ ID NO: 536043 - RNA, 64 nt, hsa; identical to SEQ ID NO: 210756

SEQ ID NO: 536044 - RNA, 64 nt, hsa; identical to SEQ ID NO: 210757

SEQ ID NO: 536045 - RNA, 64 nt, hsa; identical to SEQ ID NO: 210758

SEQ ID NO: 536046 - RNA, 64 nt, hsa; identical to SEQ ID NO: 210759

SEQ ID NO: 536047 - RNA, 64 nt, hsa; identical to SEQ ID NO: 210760

SEQ ID NO: 536048 - RNA, 64 nt, hsa; identical to SEQ ID NO: 210761

SEQ ID NO: 536049 - RNA, 64 nt, hsa; identical to SEQ ID NO: 210762

SEQ ID NO: 536050 - RNA, 64 nt, hsa; identical to SEQ ID NO: 210763

SEQ ID NO: 536051 - RNA, 64 nt, hsa; identical to SEQ ID NO: 210764

SEQ ID NO: 536052 - RNA, 64 nt, hsa; identical to SEQ ID NO: 210765

SEQ ID NO: 536053 - RNA, 64 nt, hsa; identical to SEQ ID NO: 210766

SEQ ID NO: 536054 - RNA, 64 nt, hsa; identical to SEQ ID NO: 210767

SEQ ID NO: 536055 - RNA, 64 nt, hsa; identical to SEQ ID NO: 210768

SEQ ID NO: 536056 - RNA, 64 nt, hsa; identical to SEQ ID NO: 210769

SEQ ID NO: 536057 - RNA, 64 nt, hsa; identical to SEQ ID NO: 210770

SEQ ID NO: 536058 - RNA, 64 nt, hsa; identical to SEQ ID NO: 210771

SEQ ID NO: 536059 - RNA, 64 nt, hsa; identical to SEQ ID NO: 210772

SEQ ID NO: 536060 - RNA, 64 nt, hsa; identical to SEQ ID NO: 210773

SEQ ID NO: 536061 - RNA, 64 nt, hsa; identical to SEQ ID NO: 210774

SEQ ID NO: 536062 - RNA, 64 nt, hsa; identical to SEQ ID NO: 210775

SEQ ID NO: 536063 - RNA, 64 nt, hsa; identical to SEQ ID NO: 210776

SEQ ID NO: 536064 - RNA, 64 nt, hsa; identical to SEQ ID NO: 210777

SEQ ID NO: 536065 - RNA, 64 nt, hsa; identical to SEQ ID NO: 210778

SEQ ID NO: 536066 - RNA, 64 nt, hsa; identical to SEQ ID NO: 210779

SEQ ID NO: 536067 - RNA, 64 nt, hsa; identical to SEQ ID NO: 210780

SEQ ID NO: 536068 - RNA, 64 nt, hsa; identical to SEQ ID NO: 210781

SEQ ID NO: 536069 - RNA, 64 nt, hsa; identical to SEQ ID NO: 210782

SEQ ID NO: 536070 - RNA, 64 nt, hsa; identical to SEQ ID NO: 210783

SEQ ID NO: 536071 - RNA, 64 nt, hsa; identical to SEQ ID NO: 210784

SEQ ID NO: 536072 - RNA, 64 nt, hsa; identical to SEQ ID NO: 210785

SEQ ID NO: 536073 - RNA, 64 nt, hsa; identical to SEQ ID NO: 210786

SEQ ID NO: 536074 - RNA, 64 nt, hsa; identical to SEQ ID NO: 210787

SEQ ID NO: 536075 - RNA, 64 nt, hsa; identical to SEQ ID NO: 210788

SEQ ID NO: 536076 - RNA, 64 nt, hsa; identical to SEQ ID NO: 210789

SEQ ID NO: 536077 - RNA, 64 nt, hsa; identical to SEQ ID NO: 210790

SEQ ID NO: 536078 - RNA, 64 nt, hsa; identical to SEQ ID NO: 210791

SEQ ID NO: 536079 - RNA, 64 nt, hsa; identical to SEQ ID NO: 210792

SEQ ID NO: 536080 - RNA, 64 nt, hsa; identical to SEQ ID NO: 210793

SEQ ID NO: 536081 - RNA, 64 nt, hsa; identical to SEQ ID NO: 210794

SEQ ID NO: 536082 - RNA, 64 nt, hsa; identical to SEQ ID NO: 210795

SEQ ID NO: 536083 - RNA, 64 nt, hsa; identical to SEQ ID NO: 210796

SEQ ID NO: 536084 - RNA, 64 nt, hsa; identical to SEQ ID NO: 210797

SEQ ID NO: 536085 - RNA, 64 nt, hsa; identical to SEQ ID NO: 210798

SEQ ID NO: 536086 - RNA, 64 nt, hsa; identical to SEQ ID NO: 210799

SEQ ID NO: 536087 - RNA, 64 nt, hsa; identical to SEQ ID NO: 210800

SEQ ID NO: 536088 - RNA, 64 nt, hsa; identical to SEQ ID NO: 210801

SEQ ID NO: 536089 - RNA, 64 nt, hsa; identical to SEQ ID NO: 210802

SEQ ID NO: 536090 - RNA, 64 nt, hsa; identical to SEQ ID NO: 210803

SEQ ID NO: 536091 - RNA, 64 nt, hsa; identical to SEQ ID NO: 210804

SEQ ID NO: 536092 - RNA, 64 nt, hsa; identical to SEQ ID NO: 210805

SEQ ID NO: 536093 - RNA, 64 nt, hsa; identical to SEQ ID NO: 210806

SEQ ID NO: 536094 - RNA, 64 nt, hsa; identical to SEQ ID NO: 210807

SEQ ID NO: 536095 - RNA, 64 nt, hsa; identical to SEQ ID NO: 210808

SEQ ID NO: 536096 - RNA, 64 nt, hsa; identical to SEQ ID NO: 210809

SEQ ID NO: 536097 - RNA, 64 nt, hsa; identical to SEQ ID NO: 271003

SEQ ID NO: 536098 - RNA, 64 nt, hsa; identical to SEQ ID NO: 271004

SEQ ID NO: 536099 - RNA, 64 nt, hsa; identical to SEQ ID NO: 271005

SEQ ID NO: 536100 - RNA, 64 nt, hsa; identical to SEQ ID NO: 271006

SEQ ID NO: 536101 - RNA, 64 nt, hsa; identical to SEQ ID NO: 271007

SEQ ID NO: 536102 - RNA, 64 nt, hsa; identical to SEQ ID NO: 271008

SEQ ID NO: 536103 - RNA, 64 nt, hsa; identical to SEQ ID NO: 271009

SEQ ID NO: 536104 - RNA, 64 nt, hsa; identical to SEQ ID NO: 271010

SEQ ID NO: 536105 - RNA, 64 nt, hsa; identical to SEQ ID NO: 271011

SEQ ID NO: 536106 - RNA, 64 nt, hsa; identical to SEQ ID NO: 271012

SEQ ID NO: 536107 - RNA, 64 nt, hsa; identical to SEQ ID NO: 271013

SEQ ID NO: 536108 - RNA, 64 nt, hsa; identical to SEQ ID NO: 271014

SEQ ID NO: 536109 - RNA, 64 nt, hsa; identical to SEQ ID NO: 311803

SEQ ID NO: 536110 - RNA, 64 nt, hsa; identical to SEQ ID NO: 311804

SEQ ID NO: 536111 - RNA, 64 nt, hsa; identical to SEQ ID NO: 311805

SEQ ID NO: 536112 - RNA, 64 nt, hsa; identical to SEQ ID NO: 311806

SEQ ID NO: 536113 - RNA, 64 nt, hsa; identical to SEQ ID NO: 311807

SEQ ID NO: 536114 - RNA, 64 nt, hsa; identical to SEQ ID NO: 311808

SEQ ID NO: 536115 - RNA, 64 nt, hsa; identical to SEQ ID NO: 311809

SEQ ID NO: 536116 - RNA, 64 nt, hsa; identical to SEQ ID NO: 311810

SEQ ID NO: 536117 - RNA, 64 nt, hsa; identical to SEQ ID NO: 311811

SEQ ID NO: 536118 - RNA, 64 nt, hsa; identical to SEQ ID NO: 311812

SEQ ID NO: 536119 - RNA, 64 nt, hsa; identical to SEQ ID NO: 311813

SEQ ID NO: 536120 - RNA, 64 nt, hsa; identical to SEQ ID NO: 311814

SEQ ID NO: 536121 - RNA, 64 nt, hsa; identical to SEQ ID NO: 311815

SEQ ID NO: 536122 - RNA, 64 nt, hsa; identical to SEQ ID NO: 311816

SEQ ID NO: 536123 - RNA, 64 nt, hsa; identical to SEQ ID NO: 311817

SEQ ID NO: 536124 - RNA, 64 nt, hsa; identical to SEQ ID NO: 311818

SEQ ID NO: 536125 - RNA, 64 nt, hsa; identical to SEQ ID NO: 311819

SEQ ID NO: 536126 - RNA, 64 nt, hsa; identical to SEQ ID NO: 311820

SEQ ID NO: 536127 - RNA, 64 nt, hsa; identical to SEQ ID NO: 311821

SEQ ID NO: 536128 - RNA, 64 nt, hsa; identical to SEQ ID NO: 311822

SEQ ID NO: 536129 - RNA, 64 nt, hsa; identical to SEQ ID NO: 311823

SEQ ID NO: 536130 - RNA, 64 nt, hsa; identical to SEQ ID NO: 311824

SEQ ID NO: 536131 - RNA, 64 nt, hsa; identical to SEQ ID NO: 311825

SEQ ID NO: 536132 - RNA, 64 nt, hsa; identical to SEQ ID NO: 311824

SEQ ID NO: 536133 - RNA, 64 nt, hsa; identical to SEQ ID NO: 311824

SEQ ID NO: 536134 - RNA, 64 nt, hsa; identical to SEQ ID NO: 311828

SEQ ID NO: 536135 - RNA, 64 nt, hsa; identical to SEQ ID NO: 311829

SEQ ID NO: 536136 - RNA, 64 nt, hsa; identical to SEQ ID NO: 311830

SEQ ID NO: 536137 - RNA, 64 nt, hsa; identical to SEQ ID NO: 311831

SEQ ID NO: 536138 - RNA, 64 nt, hsa; identical to SEQ ID NO: 311832

SEQ ID NO: 536139 - RNA, 64 nt, hsa; identical to SEQ ID NO: 311833

SEQ ID NO: 536140 - RNA, 64 nt, hsa; identical to SEQ ID NO: 311834

SEQ ID NO: 536141 - RNA, 64 nt, hsa; identical to SEQ ID NO: 311835

SEQ ID NO: 536142 - RNA, 64 nt, hsa; identical to SEQ ID NO: 311836

SEQ ID NO: 536143 - RNA, 64 nt, hsa; identical to SEQ ID NO: 311837

SEQ ID NO: 536144 - RNA, 64 nt, hsa; identical to SEQ ID NO: 311838

SEQ ID NO: 536145 - RNA, 64 nt, hsa; identical to SEQ ID NO: 311839

SEQ ID NO: 536146 - RNA, 64 nt, hsa; identical to SEQ ID NO: 311840

SEQ ID NO: 536147 - RNA, 64 nt, hsa; identical to SEQ ID NO: 311841

SEQ ID NO: 536148 - RNA, 64 nt, hsa; identical to SEQ ID NO: 311842

SEQ ID NO: 536149 - RNA, 64 nt, hsa; identical to SEQ ID NO: 311843

SEQ ID NO: 536150 - RNA, 64 nt, hsa; identical to SEQ ID NO: 311844

SEQ ID NO: 536151 - RNA, 64 nt, hsa; identical to SEQ ID NO: 311845

SEQ ID NO: 536152 - RNA, 64 nt, hsa; identical to SEQ ID NO: 311846

SEQ ID NO: 536153 - RNA, 64 nt, hsa
caaccgacccuggcucaggagguugaugccaugggaaccugaaccugaaacacuucaugguagu

SEQ ID NO: 536154 - RNA, 64 nt, hsa
acccuggcucaggagguugaugccaugggaaccugaaccugaaacacuucaugguaguaauuuc

SEQ ID NO: 536155 - RNA, 64 nt, hsa
aguaaaaguugugccucaaauuagaauagaacuugaaccugaagacaaugauuauuucuggagg

SEQ ID NO: 536156 - RNA, 64 nt, hsa
auccuuuucauacuacuuaaugauuuuggugcaggaaccugagauuuucugauuuauauuucau

SEQ ID NO: 536157 - RNA, 64 nt, hsa
ccucuccucaccuccuuuucucucagugacucuggaaccugaaugcagcuuacaagacaagccu

SEQ ID NO: 536158 - RNA, 64 nt, hsa
agucuguuuaauugccuauuacuucucucaaagagaaccugaagucagaacacaugagcagggu

SEQ ID NO: 536159 - RNA, 64 nt, hsa
acaucugacacccuaaaagccauccacagcuauggaaccugagcgacaccuugauuuguguugu

SEQ ID NO: 536160 - RNA, 64 nt, hsa
cccacacuuaccuuccgguggguugcugaugagagaaccugaaaaaaccuacaccucuacagca

SEQ ID NO: 536161 - RNA, 64 nt, hsa
gacaaguccugcuuggccugaugggugggagaaggaaccugagccuggcugagauggcuaggcg

SEQ ID NO: 536162 - RNA, 64 nt, hsa
aggauguagaagcuuagcugccucagagaagagagaaccugaagaucugaggcaagcuggacag

SEQ ID NO: 536163 - RNA, 64 nt, hsa
ccgauuugugggaguuuauguaauugcgugcaaugaaccugaaauuguguaaaggacaaaagac

SEQ ID NO: 536164 - RNA, 64 nt, hsa
cugcccucuugagaggucauuucucacguccuaagaaccugaucagaaauuuuggaaggguucu

SEQ ID NO: 536165 - RNA, 64 nt, hsa; identical to SEQ ID NO: 99218

SEQ ID NO: 536166 - RNA, 64 nt, hsa; identical to SEQ ID NO: 99219

SEQ ID NO: 536167 - RNA, 64 nt, hsa; identical to SEQ ID NO: 99220

SEQ ID NO: 536168 - RNA, 64 nt, hsa; identical to SEQ ID NO: 99221

SEQ ID NO: 536169 - RNA, 64 nt, hsa; identical to SEQ ID NO: 99222

SEQ ID NO: 536170 - RNA, 64 nt, hsa; identical to SEQ ID NO: 99223

SEQ ID NO: 536171 - RNA, 64 nt, hsa; identical to SEQ ID NO: 99224

SEQ ID NO: 536172 - RNA, 64 nt, hsa; identical to SEQ ID NO: 99225

SEQ ID NO: 536173 - RNA, 64 nt, hsa; identical to SEQ ID NO: 99226

SEQ ID NO: 536174 - RNA, 64 nt, hsa; identical to SEQ ID NO: 99227

SEQ ID NO: 536175 - RNA, 64 nt, hsa; identical to SEQ ID NO: 99228

SEQ ID NO: 536176 - RNA, 64 nt, hsa; identical to SEQ ID NO: 99229

SEQ ID NO: 536177 - RNA, 64 nt, hsa; identical to SEQ ID NO: 99230

SEQ ID NO: 536178 - RNA, 64 nt, hsa; identical to SEQ ID NO: 99231

SEQ ID NO: 536179 - RNA, 64 nt, hsa; identical to SEQ ID NO: 99232

SEQ ID NO: 536180 - RNA, 64 nt, hsa; identical to SEQ ID NO: 99233

SEQ ID NO: 536181 - RNA, 64 nt, hsa; identical to SEQ ID NO: 99234

SEQ ID NO: 536182 - RNA, 64 nt, hsa; identical to SEQ ID NO: 99235

SEQ ID NO: 536183 - RNA, 64 nt, hsa; identical to SEQ ID NO: 99236

SEQ ID NO: 536184 - RNA, 64 nt, hsa; identical to SEQ ID NO: 99237

SEQ ID NO: 536185 - RNA, 64 nt, hsa; identical to SEQ ID NO: 99238

SEQ ID NO: 536186 - RNA, 64 nt, hsa; identical to SEQ ID NO: 99239

SEQ ID NO: 536187 - RNA, 64 nt, hsa; identical to SEQ ID NO: 99240

SEQ ID NO: 536188 - RNA, 64 nt, hsa; identical to SEQ ID NO: 99241

SEQ ID NO: 536189 - RNA, 64 nt, hsa
ggacguucuaggagcaauuggggcaagaagaggacagugauauuuuaaaacaaaguguguuaca

SEQ ID NO: 536190 - RNA, 64 nt, hsa
ggguaaguucuccuccacuguuugaccaaauucucagugauaaauaugugugcagaucccuaga

SEQ ID NO: 536191 - RNA, 64 nt, hsa
auaauaugaugccacuuugcagcuaaaauaagcucagugauaccuccuuguuaaaaaaaaaaaa

SEQ ID NO: 536192 - RNA, 64 nt, hsa
gaaauucaguuauaaagucaaggacgaauuugcacagugauauauuucuauguguaugcaagua

SEQ ID NO: 536193 - RNA, 64 nt, hsa
accuucugguugcuucagaccugacaccgucccucagugauacguacagccaaaaaggaccaac

SEQ ID NO: 536194 - RNA, 64 nt, hsa
uuugggccaagguguuuccauuucucaaucagugcagugauacauguacuccagagggacaggg

SEQ ID NO: 536195 - RNA, 64 nt, hsa
cccauuucacugugcaagacaccucacuagucaccagugauacagaaaugacuuuuaagcaguu

SEQ ID NO: 536196 - RNA, 64 nt, hsa
aucgaucuacauacaauagaugaauaaauguuuucagugauaugaaaagguuaaguaugccagu

SEQ ID NO: 536197 - RNA, 64 nt, hsa
gguacuguauuuuuuuauauugaucugcugauaccagugauaggcuuaaagauuguauuuucac

SEQ ID NO: 536198 - RNA, 64 nt, hsa
aguggacugaaaacuaaugcaaggacuauggucucagugauaaguauauuuugaaguucuuaau

SEQ ID NO: 536199 - RNA, 64 nt, hsa
auccggcaacagucugaaaguacguggaggacgggaccggaagacgagagagggcuggacaucc

SEQ ID NO: 536200 - RNA, 64 nt, hsa
cagagauaguccuggaagacacguggcgccuguggaccggaagcaccaaaugcuggugcugcuu

SEQ ID NO: 536201 - RNA, 64 nt, hsa
agguauagggaagggcauucguugggaaauugaugaccggaaacuagaaagccccuauaaugug

SEQ ID NO: 536202 - RNA, 64 nt, hsa
gccgggaacuguccgaggugcugagcuggggcgggaccggaauccucccgguaggguaccaggg

SEQ ID NO: 536203 - RNA, 64 nt, hsa
caggggagagacccagcggcacugaucgccuugugaccggaagagugaccuguuaaaagccacg

SEQ ID NO: 536204 - RNA, 51 nt, hsa
uugagcucuuuggccccugaugaccggaacacagcugaggacccuuguccu

SEQ ID NO: 536205 - RNA, 64 nt, hsa
uuuuuuuuaaaugaucauaagauggcccauuuuggaccggaacugucauugccagacagaauug

SEQ ID NO: 536206 - RNA, 64 nt, hsa
cgaaucccccaugugucucuuucagagcuggccagaccggaaauaaaucauucucauaaauuca

SEQ ID NO: 536207 - RNA, 64 nt, hsa
gaacgaggccauugguacccucaccgccaggggggaccggaaugccuggguccccaccaugcuc

SEQ ID NO: 536208 - RNA, 64 nt, hsa
acuccuuuuuuucccauuguucuaucaucucuaggaccggaacuaccuucucuucugucaugac

SEQ ID NO: 536209 - RNA, 64 nt, hsa
accaagaaucuaacaucacucucaguaauauagagaccggaauacaugguuuauaggaaaugau

SEQ ID NO: 536210 - RNA, 64 nt, hsa
cucugcccuggccacguucacagauccuucucuugaccggaaacccugggacccuaagaacccc

SEQ ID NO: 536211 - RNA, 64 nt, hsa
uacacuuaaacuugcacauuugaauucauuugcugaccggaauggucaaaucucuccaccucua

SEQ ID NO: 536212 - RNA, 64 nt, hsa
ggcucuuccucccagagcagccggcagcuaccuggaccggaaauguccucauccccucccuggg

SEQ ID NO: 536213 - RNA, 64 nt, hsa
cacccuggacugaaguucugcaaaguccuccgaggaccggaacacguuucugcgacccggggcu

SEQ ID NO: 536214 - RNA, 64 nt, hsa
aggaagagcugaggcugccugggaggcccggggcgaccggaaaagggcucucucaaguucugaa

SEQ ID NO: 536215 - RNA, 64 nt, hsa
uggcauuuucggcacuuuucauuacuuucugcuugaccggaaguugaggcuuagcuauguuucc

SEQ ID NO: 536216 - RNA, 64 nt, hsa
guuuuggucauuuuuaaaaauaccuaaagugccagaccggaaccuauagcuacugcuagaaguc

SEQ ID NO: 536217 - RNA, 52 nt, hsa
ccccugcucccacacagugacagaccggaaagugaagagucagaacuaacuu

SEQ ID NO: 536218 - RNA, 64 nt, hsa
ugugugagggcaguucuggagaugagcagagagagaccggaauaaacucaaucuuuucuuuccc

SEQ ID NO: 536219 - RNA, 64 nt, hsa
gaggguuguuuugguuucggacgacccuugcucugaccggaagagaagucccuaucccacaccu

SEQ ID NO: 536220 - RNA, 64 nt, hsa
gugacgcuguggugugagguguucugagcucacugaccggaagguccaggugaaucucgucaua

SEQ ID NO: 536221 - RNA, 64 nt, hsa
caccaugcuucacagagaccauucuguagcaagagaccggaacauugugacuuggaccuuuuca

SEQ ID NO: 536222 - RNA, 64 nt, hsa
ucgagucucgagagggccacggggugguuuuuaugaccggaaucccgcuuccucccucacgucu

SEQ ID NO: 536223 - RNA, 64 nt, hsa
ccugguggcccugaugcagaagaaccggcggaaggaccggaagcuaggggccagucucuucacc

SEQ ID NO: 536224 - RNA, 64 nt, hsa
ugcagaacaggaccuuggcucuaaauuaaugguugaccggaagggauuggaggcggcagaacca

SEQ ID NO: 536225 - RNA, 64 nt, hsa
auggacuuggucugaugcugaaugggccacuugggaccggaagugacuugcuccagacaagagg

SEQ ID NO: 536226 - RNA, 64 nt, hsa
gugaaagugucaucuucacugccaaucaggcaaagaccggaaagauuugcauuuuauuaugucu

SEQ ID NO: 536227 - RNA, 64 nt, hsa
uccccagcccacuggaucagaaagaguucaguaagaccggaagcuccugguauggguuucuccc

SEQ ID NO: 536228 - RNA, 64 nt, hsa
accugagaaugcguguggccugcuguccucgauagaccggaaugggguuuucccacagaucccc

SEQ ID NO: 536229 - RNA, 64 nt, hsa
ugucaauagccucuuccucacugaucuguaccgggaccggaaacuucuuggugcugaagguaag

SEQ ID NO: 536230 - RNA, 64 nt, hsa
gagcgcgccugcuuuagagacacaggaugauucagaccggaaacagaccucguggguguaagag

SEQ ID NO: 536231 - RNA, 64 nt, hsa
gcgcuccagggagcggagcaaggacaaggaccgggaccggaagcggcgaagcagccggagucgg

SEQ ID NO: 536232 - RNA, 64 nt, hsa
gacccacacuacccucccuugaccagcugucugggaccggaaaccagcuuugucuccagguaga

SEQ ID NO: 536233 - RNA, 64 nt, hsa
ugagggagcucagggcaaaggccaggcuagcgcggaccggaaggggccgaggcugcacgggccu

SEQ ID NO: 536234 - RNA, 64 nt, hsa
uuucucuagguugguaccugcuuaguggcauauggaccggaaaggguuaauuuaaaggggggga

SEQ ID NO: 536235 - RNA, 64 nt, hsa
gggaggggacggggaaggaagaaagaauuuaaaggaccggaaugcgagaguccagguggccuug

SEQ ID NO: 536236 - RNA, 64 nt, hsa; identical to SEQ ID NO: 297017

SEQ ID NO: 536237 - RNA, 64 nt, hsa; identical to SEQ ID NO: 297018

SEQ ID NO: 536238 - RNA, 64 nt, hsa; identical to SEQ ID NO: 297019

SEQ ID NO: 536239 - RNA, 64 nt, hsa; identical to SEQ ID NO: 297020

SEQ ID NO: 536240 - RNA, 64 nt, hsa; identical to SEQ ID NO: 297021

SEQ ID NO: 536241 - RNA, 64 nt, hsa; identical to SEQ ID NO: 297022

SEQ ID NO: 536242 - RNA, 64 nt, hsa; identical to SEQ ID NO: 297023

SEQ ID NO: 536243 - RNA, 64 nt, hsa; identical to SEQ ID NO: 297024

SEQ ID NO: 536244 - RNA, 64 nt, hsa; identical to SEQ ID NO: 297025

SEQ ID NO: 536245 - RNA, 64 nt, hsa; identical to SEQ ID NO: 297026

SEQ ID NO: 536246 - RNA, 64 nt, hsa; identical to SEQ ID NO: 297027

SEQ ID NO: 536247 - RNA, 64 nt, hsa; identical to SEQ ID NO: 297028

SEQ ID NO: 536248 - RNA, 64 nt, hsa; identical to SEQ ID NO: 297029

SEQ ID NO: 536249 - RNA, 64 nt, hsa; identical to SEQ ID NO: 297030

SEQ ID NO: 536250 - RNA, 64 nt, hsa; identical to SEQ ID NO: 297031

SEQ ID NO: 536251 - RNA, 64 nt, hsa; identical to SEQ ID NO: 297032

SEQ ID NO: 536252 - RNA, 64 nt, hsa; identical to SEQ ID NO: 297033

SEQ ID NO: 536253 - RNA, 64 nt, hsa; identical to SEQ ID NO: 297034

SEQ ID NO: 536254 - RNA, 64 nt, hsa; identical to SEQ ID NO: 297035

SEQ ID NO: 536255 - RNA, 64 nt, hsa; identical to SEQ ID NO: 297036

SEQ ID NO: 536256 - RNA, 62 nt, hsa
gccauuccgaggccgggccuucuucugacacgggcuccaaccccaccugaccaagcccggga

SEQ ID NO: 536257 - RNA, 62 nt, hsa
ugucagagucuggggacucggcgugcagggcgggcuccaagcgcuuugcuuccggaacuccg

SEQ ID NO: 536258 - RNA, 64 nt, hsa; identical to SEQ ID NO: 300664

SEQ ID NO: 536259 - RNA, 64 nt, hsa; identical to SEQ ID NO: 300665

SEQ ID NO: 536260 - RNA, 64 nt, hsa; identical to SEQ ID NO: 300666

SEQ ID NO: 536261 - RNA, 64 nt, hsa; identical to SEQ ID NO: 300667

SEQ ID NO: 536262 - RNA, 64 nt, hsa; identical to SEQ ID NO: 300668

SEQ ID NO: 536263 - RNA, 64 nt, hsa; identical to SEQ ID NO: 300669

SEQ ID NO: 536264 - RNA, 64 nt, hsa; identical to SEQ ID NO: 300670

SEQ ID NO: 536265 - RNA, 64 nt, hsa; identical to SEQ ID NO: 300671

SEQ ID NO: 536266 - RNA, 64 nt, hsa; identical to SEQ ID NO: 300672

SEQ ID NO: 536267 - RNA, 64 nt, hsa; identical to SEQ ID NO: 300673

SEQ ID NO: 536268 - RNA, 64 nt, hsa; identical to SEQ ID NO: 300674

SEQ ID NO: 536269 - RNA, 64 nt, hsa; identical to SEQ ID NO: 300675

SEQ ID NO: 536270 - RNA, 64 nt, hsa; identical to SEQ ID NO: 300676

SEQ ID NO: 536271 - RNA, 64 nt, hsa; identical to SEQ ID NO: 300677

SEQ ID NO: 536272 - RNA, 64 nt, hsa; identical to SEQ ID NO: 300678

SEQ ID NO: 536273 - RNA, 64 nt, hsa; identical to SEQ ID NO: 300679

SEQ ID NO: 536274 - RNA, 64 nt, hsa; identical to SEQ ID NO: 300680

SEQ ID NO: 536275 - RNA, 64 nt, hsa; identical to SEQ ID NO: 300681

SEQ ID NO: 536276 - RNA, 64 nt, hsa; identical to SEQ ID NO: 300682

SEQ ID NO: 536277 - RNA, 64 nt, hsa; identical to SEQ ID NO: 300683

SEQ ID NO: 536278 - RNA, 64 nt, hsa; identical to SEQ ID NO: 300684

SEQ ID NO: 536279 - RNA, 64 nt, hsa; identical to SEQ ID NO: 300685

SEQ ID NO: 536280 - RNA, 64 nt, hsa; identical to SEQ ID NO: 300686

SEQ ID NO: 536281 - RNA, 64 nt, hsa; identical to SEQ ID NO: 300687

SEQ ID NO: 536282 - RNA, 64 nt, hsa; identical to SEQ ID NO: 300688

SEQ ID NO: 536283 - RNA, 64 nt, hsa; identical to SEQ ID NO: 300689

SEQ ID NO: 536284 - RNA, 64 nt, hsa; identical to SEQ ID NO: 300690

SEQ ID NO: 536285 - RNA, 64 nt, hsa; identical to SEQ ID NO: 300691

SEQ ID NO: 536286 - RNA, 64 nt, hsa; identical to SEQ ID NO: 300692

SEQ ID NO: 536287 - RNA, 64 nt, hsa; identical to SEQ ID NO: 300693

SEQ ID NO: 536288 - RNA, 64 nt, hsa; identical to SEQ ID NO: 225411

SEQ ID NO: 536289 - RNA, 64 nt, hsa; identical to SEQ ID NO: 225412

SEQ ID NO: 536290 - RNA, 64 nt, hsa; identical to SEQ ID NO: 225413

SEQ ID NO: 536291 - RNA, 64 nt, hsa; identical to SEQ ID NO: 225414

SEQ ID NO: 536292 - RNA, 64 nt, hsa; identical to SEQ ID NO: 225415

SEQ ID NO: 536293 - RNA, 64 nt, hsa; identical to SEQ ID NO: 225416

SEQ ID NO: 536294 - RNA, 64 nt, hsa; identical to SEQ ID NO: 225417

SEQ ID NO: 536295 - RNA, 64 nt, hsa; identical to SEQ ID NO: 225418

SEQ ID NO: 536296 - RNA, 64 nt, hsa; identical to SEQ ID NO: 225419

SEQ ID NO: 536297 - RNA, 64 nt, hsa; identical to SEQ ID NO: 225420

SEQ ID NO: 536298 - RNA, 64 nt, hsa; identical to SEQ ID NO: 225421

SEQ ID NO: 536299 - RNA, 64 nt, hsa; identical to SEQ ID NO: 225422

SEQ ID NO: 536300 - RNA, 64 nt, hsa; identical to SEQ ID NO: 225423

SEQ ID NO: 536301 - RNA, 64 nt, hsa; identical to SEQ ID NO: 225424

SEQ ID NO: 536302 - RNA, 64 nt, hsa; identical to SEQ ID NO: 225425

SEQ ID NO: 536303 - RNA, 64 nt, hsa; identical to SEQ ID NO: 225426

SEQ ID NO: 536304 - RNA, 64 nt, hsa; identical to SEQ ID NO: 225427

SEQ ID NO: 536305 - RNA, 64 nt, hsa; identical to SEQ ID NO: 164780

SEQ ID NO: 536306 - RNA, 64 nt, hsa; identical to SEQ ID NO: 164781

SEQ ID NO: 536307 - RNA, 64 nt, hsa; identical to SEQ ID NO: 164782

SEQ ID NO: 536308 - RNA, 64 nt, hsa; identical to SEQ ID NO: 164783

SEQ ID NO: 536309 - RNA, 64 nt, hsa; identical to SEQ ID NO: 164784

SEQ ID NO: 536310 - RNA, 64 nt, hsa; identical to SEQ ID NO: 164785

SEQ ID NO: 536311 - RNA, 64 nt, hsa; identical to SEQ ID NO: 164786

SEQ ID NO: 536312 - RNA, 64 nt, hsa; identical to SEQ ID NO: 164787

SEQ ID NO: 536313 - RNA, 64 nt, hsa; identical to SEQ ID NO: 164788

SEQ ID NO: 536314 - RNA, 64 nt, hsa; identical to SEQ ID NO: 164789

SEQ ID NO: 536315 - RNA, 64 nt, hsa; identical to SEQ ID NO: 164790

SEQ ID NO: 536316 - RNA, 64 nt, hsa; identical to SEQ ID NO: 164791

SEQ ID NO: 536317 - RNA, 64 nt, hsa; identical to SEQ ID NO: 164792

SEQ ID NO: 536318 - RNA, 64 nt, hsa; identical to SEQ ID NO: 164793

SEQ ID NO: 536319 - RNA, 64 nt, hsa; identical to SEQ ID NO: 83158

SEQ ID NO: 536320 - RNA, 64 nt, hsa; identical to SEQ ID NO: 83159

SEQ ID NO: 536321 - RNA, 64 nt, hsa; identical to SEQ ID NO: 83160

SEQ ID NO: 536322 - RNA, 64 nt, hsa; identical to SEQ ID NO: 83161

SEQ ID NO: 536323 - RNA, 64 nt, hsa
agcuacuuaucaaccagacugaccacaagaacugucaucucaucaaugaaggaguaacugauca

SEQ ID NO: 536324 - RNA, 64 nt, hsa
caaagcugacauuuagaagagaugcuggugauagucaucucauccuacucaauuuuucaaaggc

SEQ ID NO: 536325 - RNA, 64 nt, hsa
gauguuguuaugaucgccuguggauuuuguccauucaucucaugcucucugaacagaagguaua

SEQ ID NO: 536326 - RNA, 64 nt, hsa
cuuguuugaguuuauggccaccuggaauuuucagucaucucaugauacaggcgggaggggcaga

SEQ ID NO: 536327 - RNA, 64 nt, hsa
uuguggggcauguuaaguuacaguuugcacaaguucaucucauuuguauuccauugauuuuuuu

SEQ ID NO: 536328 - RNA, 64 nt, hsa
ucacuuacuauccauuucuucauguuaaaagaagucaucucaaacucuuaguuuuuuuuuuuua

SEQ ID NO: 536329 - RNA, 64 nt, hsa
ccugagccaagcacagguguuugaggacuacaguucaucucaggguuucuuggaguacaagacc

SEQ ID NO: 536330 - RNA, 64 nt, hsa
cacugcacuccagacugggugacacagcgagacuucaucucaaaaaaaaaaagaaaagaaaagc

SEQ ID NO: 536331 - RNA, 64 nt, hsa
uuacauuuuggucuaaaaagcucuuggauucaucucaucucauggaaugauccugucggaugac

SEQ ID NO: 536332 - RNA, 64 nt, hsa
aguuuuuacauuuuggucuaaaaagcucuuggauucaucucaucucauggaaugauccugucgg

SEQ ID NO: 536333 - RNA, 64 nt, hsa
ggaagggagaccacugugucaccuggaggagaagucaucucaugacaacagaagggagguggcc

SEQ ID NO: 536334 - RNA, 64 nt, hsa
ccuuacacagugcauuuuagaaucuuccagucugucaucucagcucuuuuguaacaugcuuccc

SEQ ID NO: 536335 - RNA, 64 nt, hsa
aggcagcagucacagugucuccugggcuguggucucaucucaacguucaaccggggaugggucg

SEQ ID NO: 536336 - RNA, 64 nt, hsa
agcaaacugagcaccuuaggacuacagacguuuaucaucucacaguuucugugagucagggguc

SEQ ID NO: 536337 - RNA, 64 nt, hsa
cccaguccacuccuaacacuagcaucagucccacucaucucaggcugagccacaucucacuuuu

SEQ ID NO: 536338 - RNA, 64 nt, hsa
uguauacacauggcaaaaugugaagaaacuccuuucaucucagcagguagaggaggacugauga

SEQ ID NO: 536339 - RNA, 64 nt, hsa; identical to SEQ ID NO: 313115

SEQ ID NO: 536340 - RNA, 64 nt, hsa; identical to SEQ ID NO: 313116

SEQ ID NO: 536341 - RNA, 64 nt, hsa; identical to SEQ ID NO: 313117

SEQ ID NO: 536342 - RNA, 64 nt, hsa; identical to SEQ ID NO: 313118

SEQ ID NO: 536343 - RNA, 64 nt, hsa; identical to SEQ ID NO: 313119

SEQ ID NO: 536344 - RNA, 64 nt, hsa; identical to SEQ ID NO: 313120

SEQ ID NO: 536345 - RNA, 64 nt, hsa; identical to SEQ ID NO: 313121

SEQ ID NO: 536346 - RNA, 64 nt, hsa; identical to SEQ ID NO: 313122

SEQ ID NO: 536347 - RNA, 64 nt, hsa; identical to SEQ ID NO: 313123

SEQ ID NO: 536348 - RNA, 64 nt, hsa; identical to SEQ ID NO: 313124

SEQ ID NO: 536349 - RNA, 64 nt, hsa
cccgccuugcacugcgccugccccacgguguccccgccgggaagcagccccggcuccugaauca

SEQ ID NO: 536350 - RNA, 64 nt, hsa
ggaagcguccuguuuggagagagccagagagcaccgccgggaggcgcucgcgcaaggccacggu

SEQ ID NO: 536351 - RNA, 64 nt, hsa
uuccaguaucaaugcuacacaguguugucccgagcgccgggaggcguugggcagaaacccucgg

SEQ ID NO: 536352 - RNA, 64 nt, hsa
ugcugcauguacauauuuucuguaaauauacaugcgccgggagcuucuugcaggaauacugcuc

SEQ ID NO: 536353 - RNA, 64 nt, hsa
aaccccaccgacccagaccaagaccgcgccgagccgccgggacucagcgccuucggguggcggc

SEQ ID NO: 536354 - RNA, 64 nt, hsa
gaaaaucuucucaguucuccuugcagaggacuggcgccgggacgcgaagagcaacgggcgcugc

SEQ ID NO: 536355 - RNA, 64 nt, hsa
cuggauagcuacuuccaucccccggggacucccgcgccgggacgcggggugggaccaggcgcgg

SEQ ID NO: 536356 - RNA, 64 nt, hsa
gcagcgcaacgcacuggugaccagacuguccccacgccgggaaccaagcaggagacgacaggcg

SEQ ID NO: 536357 - RNA, 63 nt, hsa
caguggaccggcccgugugagccgcacccacagcgccgggauccuaggaccuugccggauggg

SEQ ID NO: 536358 - RNA, 64 nt, hsa
acgaauuuggccgauggcagauguuuugggggaacgccgggacugagagacuccacgcaggcga

SEQ ID NO: 536359 - RNA, 64 nt, hsa
cuuuuaaaggcaaaucauucccaccaucacuuaacgccgggauuauacacauucuagaaaugau

SEQ ID NO: 536360 - RNA, 64 nt, hsa
ucgcccgcuccugugguuuuucugagcgugcgggcgccgggaggggaugcugaggcugauggag

SEQ ID NO: 536361 - RNA, 64 nt, hsa
ccuugcagaggcgccucucaaggccccaucagcucgccgggaccucugugaagccucucuguca

SEQ ID NO: 536362 - RNA, 64 nt, hsa
guuccaaguacucacaggggcucugggugcccaucgccgggaguaugguucagcugccaccggc

SEQ ID NO: 536363 - RNA, 64 nt, hsa
aagccacuacuuccagaagcaucuccucauuccccgccgggagcaacaucucucuucucgagac

SEQ ID NO: 536364 - RNA, 64 nt, hsa
caacugauccaccugccucagccucccaaagugccgccgggauuacaggcgugagccaccaugc

SEQ ID NO: 536365 - RNA, 64 nt, hsa
cugcauggcaucagacuagccacuccugccaggccgccgggaugguucuucuccaguuagaaug

SEQ ID NO: 536366 - RNA, 64 nt, hsa
gagcagugggcagguggccgccccugaggcuucacgccgggagaagccaccuucccaccccuuc

SEQ ID NO: 536367 - RNA, 57 nt, hsa
accgggaagagaagaccuaggagcagacgccgggauccaggagaaugcucgaggggc

SEQ ID NO: 536368 - RNA, 64 nt, hsa
aaacuguccuguugucgaagcuucuccccugggccgccgggagccccguggagcgcggccugca

SEQ ID NO: 536369 - RNA, 64 nt, hsa
cuuagugaugugugugugucuccaugcacaugcacgccgggauuccucugcugccauuugaauu

SEQ ID NO: 536370 - RNA, 64 nt, hsa
agauggcacugaucacugagcaggagaggagugucgccgggaggccuucagggugggggggaag

SEQ ID NO: 536371 - RNA, 64 nt, hsa
accccucgggcccacccguacagaggcugguggucgccgggauaauuaaugaccaccgccaauu

SEQ ID NO: 536372 - RNA, 64 nt, hsa
ccgcugcucccgccgccgccucagcgccacacaucgccgggacacccgcgccgggcagccccgc

SEQ ID NO: 536373 - RNA, 64 nt, hsa
ggugacucggacugaauuccccauacuguuuccacgccgggacaccauguucuccaucaagcua

SEQ ID NO: 536374 - RNA, 64 nt, hsa
gugcccagagugggcgguggccugucuagaaugccgccgggaguccgggcauggugggcacagu

SEQ ID NO: 536375 - RNA, 64 nt, hsa
ugcaggccaggcugccacuccgggaacgccuuugcgccgggacuuuuuguuucugaaggcaguc

SEQ ID NO: 536376 - RNA, 64 nt, hsa
aacacggggugagacagcaggaaggggcccugcacgccgggacgccaccuccgccagccgccuc

SEQ ID NO: 536377 - RNA, 64 nt, hsa
aauguccuacugcccgggcagccccagcccagcccgccgggagcaaggauggugcuaggucauu

SEQ ID NO: 536378 - RNA, 64 nt, hsa
ugagaaaggguccgcccgguggccuggaggcaggcgccgggagcgcaguagcacguggacuggg

SEQ ID NO: 536379 - RNA, 64 nt, hsa
ugaggucgcauaacgccccauggcucaaggaagccgccgggagcugcccgcaggcccugggccg

SEQ ID NO: 536380 - RNA, 64 nt, hsa
cgcggcgacuggaggcuggauucgaggccggaaacgccgggaccccuggacccggccugguggg

SEQ ID NO: 536381 - RNA, 64 nt, hsa
cucuggaggggguuugcuggggaacuggcgccaucgccgggacuccagaaccgcagaagccucc

SEQ ID NO: 536382 - RNA, 64 nt, hsa
cugaucuugucaaacccagccugaccgcuucugacgccgggauggccucguuacuagacuuuuc

SEQ ID NO: 536383 - RNA, 64 nt, hsa
ugguguaagcacacaugcacgauuaaagaggagacgccgggacccccugcccgaucgcgcgcgg

SEQ ID NO: 536384 - RNA, 64 nt, hsa
aggaccggguggaggcgguggggacccagccgcgcgccgggagcgcuccccggaaugagccgcc

SEQ ID NO: 536385 - RNA, 64 nt, hsa
ccgccuccccuuccccguccccuccucccgaagacgccgggacagucggguguccgcccucagc

SEQ ID NO: 536386 - RNA, 64 nt, hsa
gcgacggcggagccaccggagcgagcgcgagcggcgccgggaccgggaucgugaccgugaccgu

SEQ ID NO: 536387 - RNA, 64 nt, hsa
gcaucuaacugcaggaacccagagugucccagcacgccgggaggggcaaccaggccucccagcg

SEQ ID NO: 536388 - RNA, 64 nt, hsa
guccccaagaacgugacguucgugauguccugcccgccgggagucuuuccccacaccccagcca

SEQ ID NO: 536389 - RNA, 64 nt, hsa
gccgguucccccggucauguggcgccuguuucgacgccgggacccccaggagaccaggucuggc

SEQ ID NO: 536390 - RNA, 64 nt, hsa
ggccguccccaccuucuagcgacuucgggccucccgccgggaucugaugccgcggggugggggc

SEQ ID NO: 536391 - RNA, 64 nt, hsa
cacuguaaccacaagauguuauuuauugagcuggcgccgggacuugggcggggccugcccuaca

SEQ ID NO: 536392 - RNA, 64 nt, hsa
ggagucgaguugacucucggcuccacuagggaggcgccgggagguugccugcgucuccuuggag

SEQ ID NO: 536393 - RNA, 53 nt, hsa
agcccgacacggaggacugaggucgccgggaccacccugagccggccccaggc

SEQ ID NO: 536394 - RNA, 64 nt, hsa
uccgggcgcgcgggccuccuguucgcgacaagcccgccgggaucccgggcccugggcccggcca

SEQ ID NO: 536395 - RNA, 64 nt, hsa
ugcccacacccagcuggccauauccaccccucgacgccgggaugagccggcucugccuguguca

SEQ ID NO: 536396 - RNA, 64 nt, hsa
caccugcgggaggcagcgacggcccccacgcagacgccgggaacgcaggccgcuuuauuccucu

SEQ ID NO: 536397 - RNA, 64 nt, hsa
cggaggucucuguaaaagcagacccaccucccagcgccgggaagcccgucuuggguccucgcug

SEQ ID NO: 536398 - RNA, 64 nt, hsa
acuugaaagacacugucggaggugagcaucugggcgccgggacgcugcagugauccccgccaga

SEQ ID NO: 536399 - RNA, 64 nt, hsa
uucaggugauccgcgggaggggccuccacgccagcgccgggaaggcugcuggggccuccacacc

SEQ ID NO: 536400 - RNA, 64 nt, hsa
gggucgggacaggagcacguggcucagacaccgacgccgggaggccgcagaccccggacguguc

SEQ ID NO: 536401 - RNA, 64 nt, hsa; identical to SEQ ID NO: 226314

SEQ ID NO: 536402 - RNA, 64 nt, hsa; identical to SEQ ID NO: 226315

SEQ ID NO: 536403 - RNA, 64 nt, hsa; identical to SEQ ID NO: 226316

SEQ ID NO: 536404 - RNA, 64 nt, hsa; identical to SEQ ID NO: 226317

SEQ ID NO: 536405 - RNA, 64 nt, hsa; identical to SEQ ID NO: 226318

SEQ ID NO: 536406 - RNA, 64 nt, hsa; identical to SEQ ID NO: 226319

SEQ ID NO: 536407 - RNA, 64 nt, hsa; identical to SEQ ID NO: 226320

SEQ ID NO: 536408 - RNA, 64 nt, hsa; identical to SEQ ID NO: 226321

SEQ ID NO: 536409 - RNA, 64 nt, hsa; identical to SEQ ID NO: 226322

SEQ ID NO: 536410 - RNA, 64 nt, hsa; identical to SEQ ID NO: 226323

SEQ ID NO: 536411 - RNA, 64 nt, hsa; identical to SEQ ID NO: 226324

SEQ ID NO: 536412 - RNA, 64 nt, hsa; identical to SEQ ID NO: 226325

SEQ ID NO: 536413 - RNA, 64 nt, hsa; identical to SEQ ID NO: 226326

SEQ ID NO: 536414 - RNA, 64 nt, hsa; identical to SEQ ID NO: 226327

SEQ ID NO: 536415 - RNA, 64 nt, hsa; identical to SEQ ID NO: 226328

SEQ ID NO: 536416 - RNA, 64 nt, hsa; identical to SEQ ID NO: 226329

SEQ ID NO: 536417 - RNA, 64 nt, hsa; identical to SEQ ID NO: 226330

SEQ ID NO: 536418 - RNA, 64 nt, hsa; identical to SEQ ID NO: 226331

SEQ ID NO: 536419 - RNA, 64 nt, hsa; identical to SEQ ID NO: 226332

SEQ ID NO: 536420 - RNA, 64 nt, hsa; identical to SEQ ID NO: 226333

SEQ ID NO: 536421 - RNA, 64 nt, hsa; identical to SEQ ID NO: 226334

SEQ ID NO: 536422 - RNA, 64 nt, hsa; identical to SEQ ID NO: 226335

SEQ ID NO: 536423 - RNA, 64 nt, hsa; identical to SEQ ID NO: 226336

SEQ ID NO: 536424 - RNA, 64 nt, hsa; identical to SEQ ID NO: 226337

SEQ ID NO: 536425 - RNA, 64 nt, hsa; identical to SEQ ID NO: 226338

SEQ ID NO: 536426 - RNA, 64 nt, hsa; identical to SEQ ID NO: 226339

SEQ ID NO: 536427 - RNA, 64 nt, hsa; identical to SEQ ID NO: 226340

SEQ ID NO: 536428 - RNA, 64 nt, hsa; identical to SEQ ID NO: 226341

SEQ ID NO: 536429 - RNA, 64 nt, hsa
gauguuguuccuuuuuugaaguugucauuaaaguaggugcaacaaccaagaaagugucucuucc

SEQ ID NO: 536430 - RNA, 64 nt, hsa
ccagugauguuuuguuuuuguuuggucaagggguaggugcaacccaauggaccacuuaugcaaa

SEQ ID NO: 536431 - RNA, 64 nt, hsa
guccauucacuguguauagauggcagaacuuuugaggugcaauguuuaauuguuaaaaauagua

SEQ ID NO: 536432 - RNA, 64 nt, hsa
ugggccuggauggggaggcucuagcaucucucauaggugcaaccugagagugggggagcuaagc

SEQ ID NO: 536433 - RNA, 64 nt, hsa
uaaugcaaacaaaccgaagcuacaugccaaugauaggugcaaagaauauuggcaaaaggugcuu

SEQ ID NO: 536434 - RNA, 64 nt, hsa
acgcagcuggggccaggagggucagaguggugccaggugcaaguuaggcuaaagaagccaccac

SEQ ID NO: 536435 - RNA, 64 nt, hsa
guucuggaaagccucacuuccuuuucuguggagaaggugcaaagcuguuaaaugagcucagagu

SEQ ID NO: 536436 - RNA, 64 nt, hsa
aaaaucagccagugccaacauugcuugcccugcaaggugcaacugagcccacauagcgcauuca

SEQ ID NO: 536437 - RNA, 64 nt, hsa
cagcucucucugcucaccuuccaaaggcaccuggaggugcaagccucaugcaucuccuuuccug

SEQ ID NO: 536438 - RNA, 64 nt, hsa
gucagggucugguuggcuccccauugccugcccgaggugcaaggugggguauaaaacuggauaa

SEQ ID NO: 536439 - RNA, 64 nt, hsa
aaaccuuuguaacuuguuuguaugaguaaagaaaaggugcaaugcagugcuuuuagauggcuug

SEQ ID NO: 536440 - RNA, 64 nt, hsa
aggaauguggguguggccgaggugauggcaagaaaggugcaagaaagugagcagucugccugug

SEQ ID NO: 536441 - RNA, 64 nt, hsa
ugcaucccuaauauaugauauagucucaacuaauaggugcaauuugggaaaaucagguuuauuu

SEQ ID NO: 536442 - RNA, 64 nt, hsa
cgggcagaggggcagauggaaaggagccuaggccaggugcaaccagggagcugcaggggcaugg

SEQ ID NO: 536443 - RNA, 64 nt, hsa
guucauuuucuuuaaaaaaaaguauuuugagaaaaggugcaaaauauucuugaaagucucuagg

SEQ ID NO: 536444 - RNA, 64 nt, hsa
uuguugaaagaaaaugaaggaacagggggaaaaaaggugcaaaaugcuaaauuucuaaaaaugg

SEQ ID NO: 536445 - RNA, 63 nt, hsa
cuguggugacuacagacuagaggaaugcucuacaggugcaacagguucagguguuugcugacg

SEQ ID NO: 536446 - RNA, 64 nt, hsa
uuuagucuaugaaagaauaauuauaauaauguccaggugcaauacucuguaagucuauugguuc

SEQ ID NO: 536447 - RNA, 64 nt, hsa
aaggacacucugacauucggcuugauccauguccaggugcaacuguguguacaccagggaucug

SEQ ID NO: 536448 - RNA, 64 nt, hsa
gauccuugacauuugucaccccacuggccuucucaggugcaaucaguaaaaaugcugagaacuc

SEQ ID NO: 536449 - RNA, 64 nt, hsa
uaugauaguguuauaaauacuguaaaagcauggaaggugcaaaacucaguauuucuacaauugc

SEQ ID NO: 536450 - RNA, 64 nt, hsa
uacaaguuucauucucccuuucacuaaaacacacaggugcaacagacuugaaugcuaguuauac

SEQ ID NO: 536451 - RNA, 64 nt, hsa
aaguaaugugugggccgcaugcauaaaguaaguaaggugcaaugaagaaguguugauugccaaa

SEQ ID NO: 536452 - RNA, 64 nt, hsa
ucaugagcacuugaaguacaaggugucucccccuaggugcaauuagguuguuucuuuguuuuua

SEQ ID NO: 536453 - RNA, 64 nt, hsa
caucuggacgugaugccgcgccugccguguaagaaggugcaauccuagauaacacagcuagcca

SEQ ID NO: 536454 - RNA, 64 nt, hsa
guugcuucuuugcuaaaaaauuaaaugaccuagaaggugcaaguugacuguacaucauagauau

SEQ ID NO: 536455 - RNA, 64 nt, hsa
caaaugcuacaggucuuacuauggacaccaggucaggugcaaccacacaaaacaaagccaguuc

SEQ ID NO: 536456 - RNA, 64 nt, hsa
caggccuacccuacugcccgcugcguccugcuggaggugcaagugccugcugcccuugugcagu

SEQ ID NO: 536457 - RNA, 64 nt, hsa
uaauugagggaccaucagauaacuguauuuugucaggugcaauaaaaacaaaauuaaaacccaa

SEQ ID NO: 536458 - RNA, 64 nt, hsa
uuaguuuuagucaugggcuuucuucaccugcucuaggugcaaaggcauguugggaaagagaugg

SEQ ID NO: 536459 - RNA, 64 nt, hsa
gaauuugaggccagccugaggaacugcaggacucaggugcaaugugccagccacuuggaacugc

SEQ ID NO: 536460 - RNA, 64 nt, hsa
gacuaggggaugcccuugauaaugacgguuuccuaggugcaagaucagagcaugugccuacacc

SEQ ID NO: 536461 - RNA, 64 nt, hsa
uuguucagggggcugagaagauccugaguacacuaggugcaaaccagaacucuugguggaacag

SEQ ID NO: 536462 - RNA, 64 nt, hsa
ucugccuccaugcugcaguguucgaguggauuguaggugcaagauggaaaggauuguaggugca

SEQ ID NO: 536463 - RNA, 64 nt, hsa
gaguggauuguaggugcaagauggaaaggauuguaggugcaagcuguccagagaaaagaguccu

SEQ ID NO: 536464 - RNA, 64 nt, hsa
auguucgaguaccucagggacauuuaagaguuggaggugcaaauauauuccaaaagggugcaac

SEQ ID NO: 536465 - RNA, 64 nt, hsa
cucacgcugcuaggaaauggcucccugaucuaucaggugcaagugguagggacaagcagugagg

SEQ ID NO: 536466 - RNA, 64 nt, hsa
augagccuugaaaacuugcuaagugaaagaagccaggugcaaaagcccacauauugucugacug

SEQ ID NO: 536467 - RNA, 64 nt, hsa
ggggcccauguucacacuggcucucagucuagucaggugcaauguucuugagagguggggaccu

SEQ ID NO: 536468 - RNA, 64 nt, hsa
agcaguaguaguugcuauguacugauuuaccucaaggugcaaaauaauuaaaccuguacauauu

SEQ ID NO: 536469 - RNA, 64 nt, hsa
ugugagcuguuggcaugugguuagaagccaucagaggugcaagggcuuagaaaagacccuggcc

SEQ ID NO: 536470 - RNA, 64 nt, hsa
ccaaauacuuuuuuuuucuuuuccacuguuuguaaggugcaacaauuuaauauuuuuaagggac

SEQ ID NO: 536471 - RNA, 64 nt, hsa
ggucagggcuuugccaccguugaagcccugcagaaggugcaauguagggguucuggggccacag

SEQ ID NO: 536472 - RNA, 64 nt, hsa
caagugcuuuaccuucuaaaacaugcuucucuauaggugcaaaguuauaagauauguagaagaa

SEQ ID NO: 536473 - RNA, 64 nt, hsa
uauguuuuuaagugccuuggcaggcucacuucugaggugcaaaacauagauauagaacugaaca

SEQ ID NO: 536474 - RNA, 64 nt, hsa
guugggcuucugugaaauacacagguggaaacagaggugcaagccagaggcaauguaauaugcu

SEQ ID NO: 536475 - RNA, 64 nt, hsa
gcugcuaugaccuguguucacucugguuacagggaggugcaaaccauucugucucccagccuuu

SEQ ID NO: 536476 - RNA, 64 nt, hsa
gucaagacgugggaucagaaucuuccaacuuuagaggugcaauggaagacacuacgcuacuugg

SEQ ID NO: 536477 - RNA, 64 nt, hsa
ucuuucuggacguguuuagauaguuuccaccaugaggugcaaaacgagacagaagagugagaag

SEQ ID NO: 536478 - RNA, 64 nt, hsa
cagcuuugcaaaaugagacuuucuaaaucaaaccaggugcaauuauuucuuuauuuucuucucc

SEQ ID NO: 536479 - RNA, 64 nt, hsa
uuaaaaauagcucacuuuaaagcuaguuuugaauaggugcaacugugacuugggucugguuggu

SEQ ID NO: 536480 - RNA, 64 nt, hsa
ucacucuugcaucacuaauugcacaagugauuucaggugcaauucugauuagccugcguccaca

SEQ ID NO: 536481 - RNA, 64 nt, hsa
acuguaggcccugguucauguuuucaucaaucuaaggugcaauuucuaaauuuguaagaguagg

SEQ ID NO: 536482 - RNA, 64 nt, hsa
guuuugggcugcugagaauaauugaugcugauuaaggugcaaaucaugacuaaagacuuuucuu

SEQ ID NO: 536483 - RNA, 64 nt, hsa
aagcaugauauguacuauagugauucuguuuuugaggugcaaaaaacauacauauauaccaguu

SEQ ID NO: 536484 - RNA, 64 nt, hsa
gagaaggggccacccacugggcaccuaacaggacaggugcaaaguggggugcuuauuaagauuc

SEQ ID NO: 536485 - RNA, 61 nt, hsa
uuaguaauggggaacauuaagauacucugugaggugcaagacuucaggguggggugggcau

SEQ ID NO: 536486 - RNA, 64 nt, hsa
caacuaaugaaccagcuacguauacugguauuuuaggugcaaguuguaaagcaaaauaucugug

SEQ ID NO: 536487 - RNA, 64 nt, hsa
ggaauuguauuuguugccuuuuuuauauuagaugaggugcaaaaauuuuaaugcuagucaguau

SEQ ID NO: 536488 - RNA, 64 nt, hsa
uuacaugauuuuccuacacucuguaauuuugcugaggugcaauuuggaacucugcaagaccuac

SEQ ID NO: 536489 - RNA, 64 nt, hsa
aaaagccuuacauuaauuuaauguuugcacucugaggugcaacuuaacagggagggccugagaa

SEQ ID NO: 536490 - RNA, 64 nt, hsa
ggaaacuuaaccaccuacaaggagauaagaaagcaggugcaacacucaagucuauugaauaaug

SEQ ID NO: 536491 - RNA, 64 nt, hsa
uggcuguaggacucgaauuuacagaaagccacagaggugcaacuugaggcucugcuagcaagcc

SEQ ID NO: 536492 - RNA, 64 nt, hsa
aauucaaaccaauucacccagaaaaaagaccaauaggugcaaaaauaaaaggaaaaccagugaa

SEQ ID NO: 536493 - RNA, 64 nt, hsa
aaaaauguaucaaauguauuauagauaagguguuaggugcaaaggaugucuaauaaucccugca

SEQ ID NO: 536494 - RNA, 51 nt, hsa
acucuucgaagagggauuaaaaggugcaaaaagacaacuaaaauacccauu

SEQ ID NO: 536495 - RNA, 64 nt, hsa
gcuuauaguaucuauaaauuaacaagaaguaugcaggugcaaaaaagugguggaacaaauacca

SEQ ID NO: 536496 - RNA, 64 nt, hsa
cuagucuacuucaaaauuuuuuacacguuugcagaggugcaaucaaauggaauuaagucucucg

SEQ ID NO: 536497 - RNA, 64 nt, hsa
cacuaauauagccuguuaaaucuuuuguggagacaggugcaaaucagaagauugacaaggaaga

SEQ ID NO: 536498 - RNA, 64 nt, hsa
aacauuucuuccugauugacaacaguguuagacaaggugcaaagcgaaacugguugcucaaguu

SEQ ID NO: 536499 - RNA, 64 nt, hsa
aguggcuugugauucugggauggacccucgcagcaggugcaagagacagagcccccaagccucu

SEQ ID NO: 536500 - RNA, 64 nt, hsa
gcccugagccauggcugcugacugacuccagccaaggugcaaagacgagauuaugagacagguc

SEQ ID NO: 536501 - RNA, 64 nt, hsa
acuuugucccuccuuugaaguggaugggaacucaaggugcaaagaaccuguuuuggaagaaagc

SEQ ID NO: 536502 - RNA, 64 nt, hsa
uuaugguuggaaaacugaggaaucuucugguugcaggugcaaagugacuuuguuuauucuuguc

SEQ ID NO: 536503 - RNA, 64 nt, hsa
ccagcgaaugacgucuguggccaagcgaggucucaggugcaaagcaaaaggaccauuuaaagua

SEQ ID NO: 536504 - RNA, 64 nt, hsa
cucucccuccaccuccucuccaccugcuggugagaggugcaaagaggcagaucuuugcugccag

SEQ ID NO: 536505 - RNA, 64 nt, hsa
auuuugcuauccacacuugaugcaauugaauucaaggugcaaagucuuguacugaagcagucuc

SEQ ID NO: 536506 - RNA, 64 nt, hsa
ucuagacaugcuaccagacauggggaaccauuagaggugcaaucuacauugggcaucuggucau

SEQ ID NO: 536507 - RNA, 64 nt, hsa
ucauaguguuaacacugguucugcaauaucucugaggugcaaagaaugcacuuuucccuauggg

SEQ ID NO: 536508 - RNA, 64 nt, hsa
cuaugaagccuugaauuuugaaaaaaagacaagaaggugcaaaagguaagacauuugaguguuu

SEQ ID NO: 536509 - RNA, 64 nt, hsa
gggucaggggacugguagucacccaaucuuggagaggugcaaaaagcacugggggcuacccguu

SEQ ID NO: 536510 - RNA, 64 nt, hsa
uuuuuaaaucuccaacuugcuguuuccaaaaagaaggugcaauaucauauaucaucaguuagca

SEQ ID NO: 536511 - RNA, 64 nt, hsa
cuccuuccuguguuccuacaaaacucccacucucaggugcaagaguuauguagaaggaaaggga

SEQ ID NO: 536512 - RNA, 64 nt, hsa
auucugucauauuuacuucuaauucuacucucagaggugcaaaaagauacuuaucuaacuggac

SEQ ID NO: 536513 - RNA, 64 nt, hsa
uggacacgcccguugcccacugcaaguucucuccaggugcaauugaagccucucagcaggugcg

SEQ ID NO: 536514 - RNA, 64 nt, hsa
auagaaaaagucgcugagucguuucuaguugugaaggugcaaaagaugcaguuaucccuuaugg

SEQ ID NO: 536515 - RNA, 64 nt, hsa
guagcaaucacaaacuaaagacugcggcuuguugaggugcaauacccugacucccaaaguuagu

SEQ ID NO: 536516 - RNA, 64 nt, hsa
acuggaucucugguuuuucuccugaaguuggggcaggugcaauuccaagcauaaccaccagaug

SEQ ID NO: 536517 - RNA, 64 nt, hsa
acccgcugccacacacuacaggagucaauaaacaaggugcaauauuuucaaaucguuggccggc

SEQ ID NO: 536518 - RNA, 64 nt, hsa
ggcagcugugugagcugccaagcuagugggcuucaggugcaaggguaccugugccacaccaacc

SEQ ID NO: 536519 - RNA, 64 nt, hsa
agccucucugcuuuagcuaaagacgacugagaagaggugcaaggaagcgggcuccaggagcaag

SEQ ID NO: 536520 - RNA, 64 nt, hsa
cugcacuaauuugauguuuacagguggacacacaaggugcaaaucaaugcguacguuuccugag

SEQ ID NO: 536521 - RNA, 64 nt, hsa
ucuucccaaccucagcugccuguauucaugccagaggugcaaaggcugccagccagugcugcug

SEQ ID NO: 536522 - RNA, 64 nt, hsa
uucucuuaaaauagaguuugaacaaauauuuuaaaggugcaaaauaccauuagaaaauacuauu

SEQ ID NO: 536523 - RNA, 64 nt, hsa
aagcgggaugcuauuaaaaacuacauggggaaacaggugcaaacccuggagauggauuguaaga

SEQ ID NO: 536524 - RNA, 64 nt, hsa
uuaagcaaauagagccgucugggauuuguaacugaggugcaacugucaugaggcccaggcagcu

SEQ ID NO: 536525 - RNA, 64 nt, hsa
cuguguauguugagccacuguugucaugccagccaggugcaaaggcagcuuagcuacugaggua

SEQ ID NO: 536526 - RNA, 64 nt, hsa
agaguucucuucuucagcccgccagagacagcucaggugcaaggagaugagacuauacaucagg

SEQ ID NO: 536527 - RNA, 64 nt, hsa
gagggaccuaagugccuaccuacucgcuaaucgcaggugcaaacacacaaggaguuuggugggc

SEQ ID NO: 536528 - RNA, 64 nt, hsa
agcuguugagugagcugcuaugacuuugguagagaggugcaauauguuuuuugaaccagcuaua

SEQ ID NO: 536529 - RNA, 64 nt, hsa
ggcuguuaccuaaugguccucucugucccauuauaggugcaaggcaccccauccacacauuugc

SEQ ID NO: 536530 - RNA, 64 nt, hsa
uccuucugggggcuucgcuuccuuagccuugcucaggugcaagugccccagggggcggggugca

SEQ ID NO: 536531 - RNA, 64 nt, hsa
agugaucuuggagcacacaugaauaacuuucugaaggugcaaccaaauccauuuuuauuucugc

SEQ ID NO: 536532 - RNA, 64 nt, hsa
ccucuccauuccccaggcuccacccgugcugcucaggugcaaauggacuugagagcaucuaugu

SEQ ID NO: 536533 - RNA, 64 nt, hsa
uuggagacacggcuuguuccagaugaggaaacugaggugcaaagcaguuaagcaacugguccaa

SEQ ID NO: 536534 - RNA, 64 nt, hsa
uccugcucuucgaagacagcaaugaggaguuggaaggugcaaagucaguagagaagggaaugua

SEQ ID NO: 536535 - RNA, 64 nt, hsa
guucuugggaaucuuggagccuaaagagaaaccgaggugcaaauucauuucauggugacugacc

SEQ ID NO: 536536 - RNA, 64 nt, hsa
cauauuaaauauuuuaucugcuuuuacaagcgcaaggugcaaaaauauauacaauagucucauu

SEQ ID NO: 536537 - RNA, 64 nt, hsa
cuuuaaagcuaaagacaagaauaucaugcuauacaggugcaacucaauccccguuaauaaaaac

SEQ ID NO: 536538 - RNA, 64 nt, hsa
ccuccccgucccguugucccauuuugcucugugaaggugcaaaucccuuucuucccuucccauc

SEQ ID NO: 536539 - RNA, 64 nt, hsa
aggcugaauggugcagccgcuggaccugauaguaaggugcaaagguccaaaccugggcuugucu

SEQ ID NO: 536540 - RNA, 64 nt, hsa
gcuucaggaugggcuauuaaugugggauaagcccaggugcaaggggaggagggcaggcugggaa

SEQ ID NO: 536541 - RNA, 64 nt, hsa
guacaaaagauuauuaaaaauauucccaaaaggcaggugcaaugaugcacacuuauacccccag

SEQ ID NO: 536542 - RNA, 64 nt, hsa
uuauagaguagaagauuugaugcuggagagguuaaggugcaauaagaauuuagggagaaauguu

SEQ ID NO: 536543 - RNA, 64 nt, hsa
gaucuuucaagucugggagacagauaaggaggccaggugcaaggcagggaggcagagagaaugu

SEQ ID NO: 536544 - RNA, 64 nt, hsa
aauggguaaaacaccaaacuugaaaucagaacauaggugcaaauggccacuccuguaguuucuu

SEQ ID NO: 536545 - RNA, 64 nt, hsa
uucuuucuuuuuuuuuuuuuuuguguagaaaaauaggugcaauaaugaucaaaguuuugauguc

SEQ ID NO: 536546 - RNA, 64 nt, hsa
gaaucuacuguugcuauguuagugugaauguugaaggugcaauuaucacauuguuuauuaauug

SEQ ID NO: 536547 - RNA, 64 nt, hsa
aaaccguguauuuauuacauugcugccuuuguugaggugcaaggaguguaaaauguauauuuuu

SEQ ID NO: 536548 - RNA, 64 nt, hsa
aaaccaccugcguccacacccucacugcagccaaaggugcaauuacuugaccugcagccccagc

SEQ ID NO: 536549 - RNA, 64 nt, hsa
ccacaguaagcaccauggucagggagguggcaggaggugcaaagacagaaguauugagagaaac

SEQ ID NO: 536550 - RNA, 64 nt, hsa
aggagcagaguugcaaauuaacaacuugcaaaugaggugcaaauaaaaugcagaugauugcgcg

SEQ ID NO: 536551 - RNA, 64 nt, hsa; identical to SEQ ID NO: 536550

SEQ ID NO: 536552 - RNA, 64 nt, hsa
guuuauuauucuaacaagguguggagugucagcgaggugcaauguggggagaauacauuguaga

SEQ ID NO: 536553 - RNA, 64 nt, hsa
ucuauuaacuuuuuuccuuuuaccaauaacuuugaggugcaaaacucaaacuuaugugggucuu

SEQ ID NO: 536554 - RNA, 64 nt, hsa
gaguuccuuuguaucugacaaucucaggacuccaaggugcaaagccugcugcauuugcgugauc

SEQ ID NO: 536555 - RNA, 64 nt, hsa
guuggaagucuuugguauaugcaaaugaaaggagaggugcaacaacuuaguuuaauuauaaaag

SEQ ID NO: 536556 - RNA, 64 nt, hsa
ugaggucauuugugagcacaagaucucauagggcaggugcaaaauaggaauguuguucucaagu

SEQ ID NO: 536557 - RNA, 64 nt, hsa
gcuacagaguucuuuucuugggaccuagacugggaggugcaaugucaggaccuccaggugaaug

SEQ ID NO: 536558 - RNA, 64 nt, hsa
guauauuuucugaguucagcauuuuuagggaccuaggugcaagugcaaaggaaauuucccuguu

SEQ ID NO: 536559 - RNA, 64 nt, hsa
agcugcuuguggguuucugggguggaaggcagggaggugcaacuggcagggccugaucagaggc

SEQ ID NO: 536560 - RNA, 64 nt, hsa
uuccucccaaaguaggugagcuauagugaagaauaggugcaaacaaacaagcuuacuuccauug

SEQ ID NO: 536561 - RNA, 64 nt, hsa
uuuguuggaagcagaucagagcacacguacgaaaaggugcaauugcuuuucucaugacaaaaga

SEQ ID NO: 536562 - RNA, 64 nt, hsa
cagaucucauugaaguaucagcuuguuugguacuaggugcaaguguagcaugucacaugugacc

SEQ ID NO: 536563 - RNA, 64 nt, hsa
uauagugguaaagaaacagguuguucacuugcugaggugcaaaaauucuuaagacuucuguuug

SEQ ID NO: 536564 - RNA, 64 nt, hsa
uaaagacagaucagacugauaaccuuaacaccauaggugcaaaaugaguuguucugagguuuuu

SEQ ID NO: 536565 - RNA, 64 nt, hsa
ggggucugaauuuuugggagcaggcaauaucugaaggugcaaacaggcccuacggcuguucccu

SEQ ID NO: 536566 - RNA, 64 nt, hsa
guaacauacucuuuguauauauuuauuauaugaaaggugcaauauuuuauuuuguacaguaugu

SEQ ID NO: 536567 - RNA, 64 nt, hsa
aauaggaucuuuagcaacuuuuucacaucauagaaggugcaaucgcucacuugggaacacuacu

SEQ ID NO: 536568 - RNA, 64 nt, hsa
caagggcuguucaugaaaagggagacuuacugggaggugcaagacaguggcauuucuccucucc

SEQ ID NO: 536569 - RNA, 64 nt, hsa
cucacuucaaauuauguuuggacuugacaaaaauaggugcaaaugauggggggcaauagaagaa

SEQ ID NO: 536570 - RNA, 64 nt, hsa
acuucugaaaacuauauuuaucugagugaguccaaggugcaacuccuaaaugaauuguguugca

SEQ ID NO: 536571 - RNA, 64 nt, hsa
guggcuggucucgucugccgggggaaggguggggaggugcaaugggaugggaggcaggaugcuu

SEQ ID NO: 536572 - RNA, 64 nt, hsa
acccuaccacagcgucccgcguagcugggacuacaggugcaagccacuauguccagcuagccaa

SEQ ID NO: 536573 - RNA, 64 nt, hsa
gggagggagccaacgccucagguggagugggcagaggugcaagagagggauguacugaagcuuc

SEQ ID NO: 536574 - RNA, 64 nt, hsa
uuuagguuuacuuucacuuguuauuugacuuagcaggugcaacaaaaacaagaaacaaaugugc

SEQ ID NO: 536575 - RNA, 64 nt, hsa
aaguuacacauuauagccagaaucuguaucacagaggugcaagcugacagcagagcucaguccc

SEQ ID NO: 536576 - RNA, 64 nt, hsa
ucugguguuuuuaacuugaucaugaucagcucugaggugcaacuucuucacauacuguacauac

SEQ ID NO: 536577 - RNA, 64 nt, hsa
aggagagaccuuccucuccugcggacuucauugcaggugcaaguugccuacacccaauaccagg

SEQ ID NO: 536578 - RNA, 64 nt, hsa
caggacccuaagaugaagcugagcuuuugaugccaggugcaaucuacuggaaauguagcacuua

SEQ ID NO: 536579 - RNA, 64 nt, hsa
cuaagauucuaaagguccacaggucuagacuauuaggugcaauuucaagguucuaacccuauac

SEQ ID NO: 536580 - RNA, 64 nt, hsa
cccucccugugccagaccucaaaacgacgggggcaggugcaaguucauaggucuccaagaccac

SEQ ID NO: 536581 - RNA, 64 nt, hsa
aauauguugaaucucaugaccugauguauaucaaaggugcaacggcuuguaaaugaccaguuuu

SEQ ID NO: 536582 - RNA, 64 nt, hsa
aauguggucaggcaaccugaguccaguggaaugcaggugcaacuucuaagaguuuuccuguaag

SEQ ID NO: 536583 - RNA, 64 nt, hsa
cucaugccuauagucccagcacuuugggaggccaaggugcaaggcaggcagaucauuugagguc

SEQ ID NO: 536584 - RNA, 64 nt, hsa
caggagcuccacuacgcuguccuacacuuccacaaggugcaaccucaggaaccaaaggucaccg

SEQ ID NO: 536585 - RNA, 64 nt, hsa
cuuacugucuaauauaggaaaaacacaugagaacaggugcaauauauugacuuaaacuuguuua

SEQ ID NO: 536586 - RNA, 64 nt, hsa
ccucugagcaacuugcucugaccuauaaugucuuaggugcaacacggaccccaccagagcucuu

SEQ ID NO: 536587 - RNA, 64 nt, hsa
cugccuggucugucuggaucccgagguauggcagaggugcaagaccuaguccccuuuccucuaa

SEQ ID NO: 536588 - RNA, 64 nt, hsa
gcuguguuugugagaagaguaggaucacacacacaggugcaaucuugaccacacuuaccugcaa

SEQ ID NO: 536589 - RNA, 64 nt, hsa
ugcuccauggggcccugcuggcuccauggggcccaggugcaaaggguuucugaaaaacagcagg

SEQ ID NO: 536590 - RNA, 64 nt, hsa
acauuugcugucagccacauauugagaugacacuaggugcaauagcagggauagauuuuguugg

SEQ ID NO: 536591 - RNA, 64 nt, hsa
acaggccgcccugcgggugaacaaagcagccacgaggugcaacaagguccucugucagucacag

SEQ ID NO: 536592 - RNA, 64 nt, hsa
aacuaaguaggcagguaggaucugaagaaggcacaggugcaaguaaaauucgucaauuaaacca

SEQ ID NO: 536593 - RNA, 64 nt, hsa
cucaggccucugagggcaccaggcccuggagaagaggugcaauucaggguguguguguguuuuu

SEQ ID NO: 536594 - RNA, 64 nt, hsa
agauacuuuuauauauuuguaugggacucugaggaggugcaaccuguauauauauugcauucgu

SEQ ID NO: 536595 - RNA, 64 nt, hsa
gcauucaauacuacaaaaucaacaugauuucauaaggugcaaauaaaaguuggugacagauuua

SEQ ID NO: 536596 - RNA, 64 nt, hsa
cauuccugcauggaccuuucccaagcgcuagcacaggugcaaaauccaucagagccauuguuuu

SEQ ID NO: 536597 - RNA, 64 nt, hsa
gauguuugcgcucgcauuacagggaccucaaccuaggugcaauccugucaugugagguuucagc

SEQ ID NO: 536598 - RNA, 64 nt, hsa
auuuuuuugugugaaguaaauuaaucaacuagagaggugcaaaacguucucaguugauaucuga

SEQ ID NO: 536599 - RNA, 64 nt, hsa
caggagauuucagagugagagugcucaaggcugcaggugcaagacagcacugguaaggacucuu

SEQ ID NO: 536600 - RNA, 64 nt, hsa
cugucacaguauagucacaauccacaaaugaugcaggugcaaaugguuuauagcccugugaagu

SEQ ID NO: 536601 - RNA, 64 nt, hsa
uuaucacaacgaccuuuucaaguaggcauuaucaccaugcgacagguugaggaccgugaggcac

SEQ ID NO: 536602 - RNA, 64 nt, hsa
ccccauccugucaggcacaggugacgggggcagcccaugcgagcccuucuccugcugcucuggg

SEQ ID NO: 536603 - RNA, 64 nt, hsa
uauccuuguuugcacaggacugguggaaaaucucccaugcgacccucggggcccagagccaucu

SEQ ID NO: 536604 - RNA, 64 nt, hsa
ucagagugggacaguagugaacagagcugggauuccaugcgacagcuugaaugcugaccuucag

SEQ ID NO: 536605 - RNA, 64 nt, hsa
aucaccccaaaaccaccaucucugacguaagcuuccaugcgacagccugauccguuucccugga

SEQ ID NO: 536606 - RNA, 64 nt, hsa
augucaaggccagcaagcugaugugacucuugccccaugcgagauauuuauaccucaaacacug

SEQ ID NO: 536607 - RNA, 64 nt, hsa
gcucauaaaagcagaaggugugcuauucacaguaccaugcgaguagcccacaguuaauucccgg

SEQ ID NO: 536608 - RNA, 64 nt, hsa
uugcuaacucauggaacugcagacagaaagcacuccaugcgaaaacagccauugccuuuuuuaa

SEQ ID NO: 536609 - RNA, 64 nt, hsa
ccuccgucugccuaaaucacuuuucucgcagaagccaugcgacucccacacgacacgggcagcu

SEQ ID NO: 536610 - RNA, 64 nt, hsa
uuguggagaaaguaauuauuccaacacccaucugccaugcgauguuaaaaaaaaaaaaaaggaa

SEQ ID NO: 536611 - RNA, 64 nt, hsa
accggcgacgccgauacgguuccuccaccgaggcccaugcgaagcuuuccacuauggcuuccag

SEQ ID NO: 536612 - RNA, 64 nt, hsa
agcuuaccugagaaagcuuuaaaugagaaaaggaccaugcgauuggugcuguguuacauacaca

SEQ ID NO: 536613 - RNA, 64 nt, hsa
ucauauauacucucugugccuaccgcauuuggaaccaugcgagugauaccuauuuauaaaauaa

SEQ ID NO: 536614 - RNA, 64 nt, hsa
guguuaucacucugccuguguauagucagauaguccaugcgaaggcuguauauauugaacauua

SEQ ID NO: 536615 - RNA, 64 nt, hsa
aggagacaggcagagcugcuccccucugcacggaccaugcgacacugggaggccagugagccac

SEQ ID NO: 536616 - RNA, 64 nt, hsa
ugacguguggaaagucuaggggguuccauucuggccaugcgagcccagcuccuaccaacgucgg

SEQ ID NO: 536617 - RNA, 64 nt, hsa
caaccaccccacuccacaugcaacuguccccaacccaugcgauucauccuuucccugaaggcuu

SEQ ID NO: 536618 - RNA, 64 nt, hsa
gaguggcugccccugccucagggucauucuccugccaugcgagggcacucgccuucugccuucu

SEQ ID NO: 536619 - RNA, 64 nt, hsa
cuggugauuguuccuucccucccuuccucucccaccaugcgaugagcauccuuucaggccagug

SEQ ID NO: 536620 - RNA, 64 nt, hsa
ucucaugaccauauugaaauguacggaauuugauccaugcgauacuaugugugcauuauuugaa

SEQ ID NO: 536621 - RNA, 64 nt, hsa
auauuuaacucaucuaguuaauaauguuuuuauuccaugcgaaugauuugauauuuucauccuu

SEQ ID NO: 536622 - RNA, 64 nt, hsa
ccucuaaccaucugacagagacucggccuggacaccaugcgaugcacucuggcaccaaggcuuu

SEQ ID NO: 536623 - RNA, 64 nt, hsa
cuggagcugaggcugugggcggcugucccagcaaccaugcgagggguugccccaguugcucaua

SEQ ID NO: 536624 - RNA, 64 nt, hsa
uggcggcagcccaccuugguaagggccccagggcccaugcgagagcugccugauggccucuugu

SEQ ID NO: 536625 - RNA, 64 nt, hsa
acccgacaucaaagcuggcgugugaccuuuccagccaugcgauauuccccuuggaagaugcuuc

SEQ ID NO: 536626 - RNA, 64 nt, hsa
aagccccaugugccuuguccaggaacugccugggccaugcgaggggccagcagagggcgccacc

SEQ ID NO: 536627 - RNA, 64 nt, hsa
cccagcgacaaucacugaacgccgaagccugcagccaugcgaccccacgccaccccgugccucc

SEQ ID NO: 536628 - RNA, 64 nt, hsa
ucgucgaagcgggcuccgaugcagggcagcucccccaugcgaggauccgggucugccuccuccu

SEQ ID NO: 536629 - RNA, 64 nt, hsa
ccucucagaagggagagagguuuucaggcuggugccaugcgauuggaauaaagcaggaggcuca

SEQ ID NO: 536630 - RNA, 64 nt, hsa
ggcagaccaacgaaaccagaugagaccaacgacaccaugcgagacacgcuugcagacacuguug

SEQ ID NO: 536631 - RNA, 64 nt, hsa
ccagcucugggggcuccagcguggccuccgugacccaugcgauucaagucgcggcugcaggauc

SEQ ID NO: 536632 - RNA, 64 nt, hsa
cuggggccucgcaauucuugcuucaggaucucucccaugcgagcugcccggagggugucagcag

SEQ ID NO: 536633 - RNA, 64 nt, hsa
cugggcuauuggccaaaggcuauacucauguaagccaugcgagccucucccacaaggcagcuug

SEQ ID NO: 536634 - RNA, 64 nt, hsa
aguauaagcaucucccaucugcuuuucuccauugccaugcgaccuggucaagccccccucacuc

SEQ ID NO: 536635 - RNA, 64 nt, hsa; identical to SEQ ID NO: 296587

SEQ ID NO: 536636 - RNA, 64 nt, hsa; identical to SEQ ID NO: 296588

SEQ ID NO: 536637 - RNA, 64 nt, hsa; identical to SEQ ID NO: 172974

SEQ ID NO: 536638 - RNA, 64 nt, hsa; identical to SEQ ID NO: 172975

SEQ ID NO: 536639 - RNA, 64 nt, hsa; identical to SEQ ID NO: 172976

SEQ ID NO: 536640 - RNA, 64 nt, hsa; identical to SEQ ID NO: 172977

SEQ ID NO: 536641 - RNA, 64 nt, hsa; identical to SEQ ID NO: 172978

SEQ ID NO: 536642 - RNA, 64 nt, hsa; identical to SEQ ID NO: 172979

SEQ ID NO: 536643 - RNA, 64 nt, hsa; identical to SEQ ID NO: 172980

SEQ ID NO: 536644 - RNA, 64 nt, hsa; identical to SEQ ID NO: 172981

SEQ ID NO: 536645 - RNA, 64 nt, hsa; identical to SEQ ID NO: 172982

SEQ ID NO: 536646 - RNA, 64 nt, hsa; identical to SEQ ID NO: 172983

SEQ ID NO: 536647 - RNA, 64 nt, hsa; identical to SEQ ID NO: 172984

SEQ ID NO: 536648 - RNA, 64 nt, hsa; identical to SEQ ID NO: 172985

SEQ ID NO: 536649 - RNA, 64 nt, hsa; identical to SEQ ID NO: 172986

SEQ ID NO: 536650 - RNA, 64 nt, hsa; identical to SEQ ID NO: 172987

SEQ ID NO: 536651 - RNA, 64 nt, hsa; identical to SEQ ID NO: 172988

SEQ ID NO: 536652 - RNA, 54 nt, hsa; identical to SEQ ID NO: 172989

SEQ ID NO: 536653 - RNA, 64 nt, hsa; identical to SEQ ID NO: 172990

SEQ ID NO: 536654 - RNA, 64 nt, hsa; identical to SEQ ID NO: 172991

SEQ ID NO: 536655 - RNA, 64 nt, hsa; identical to SEQ ID NO: 172992

SEQ ID NO: 536656 - RNA, 64 nt, hsa; identical to SEQ ID NO: 172993

SEQ ID NO: 536657 - RNA, 64 nt, hsa; identical to SEQ ID NO: 172994

SEQ ID NO: 536658 - RNA, 64 nt, hsa; identical to SEQ ID NO: 172995

SEQ ID NO: 536659 - RNA, 64 nt, hsa; identical to SEQ ID NO: 172996

SEQ ID NO: 536660 - RNA, 64 nt, hsa; identical to SEQ ID NO: 172997

SEQ ID NO: 536661 - RNA, 64 nt, hsa; identical to SEQ ID NO: 172998

SEQ ID NO: 536662 - RNA, 64 nt, hsa; identical to SEQ ID NO: 172999

SEQ ID NO: 536663 - RNA, 64 nt, hsa; identical to SEQ ID NO: 173000

SEQ ID NO: 536664 - RNA, 64 nt, hsa; identical to SEQ ID NO: 173001

SEQ ID NO: 536665 - RNA, 64 nt, hsa; identical to SEQ ID NO: 173002

SEQ ID NO: 536666 - RNA, 64 nt, hsa; identical to SEQ ID NO: 173003

SEQ ID NO: 536667 - RNA, 64 nt, hsa; identical to SEQ ID NO: 173004

SEQ ID NO: 536668 - RNA, 61 nt, hsa; identical to SEQ ID NO: 173005

SEQ ID NO: 536669 - RNA, 64 nt, hsa; identical to SEQ ID NO: 173006

SEQ ID NO: 536670 - RNA, 64 nt, hsa; identical to SEQ ID NO: 173007

SEQ ID NO: 536671 - RNA, 64 nt, hsa; identical to SEQ ID NO: 173008

SEQ ID NO: 536672 - RNA, 64 nt, hsa; identical to SEQ ID NO: 173009

SEQ ID NO: 536673 - RNA, 64 nt, hsa; identical to SEQ ID NO: 275791

SEQ ID NO: 536674 - RNA, 64 nt, hsa; identical to SEQ ID NO: 275792

SEQ ID NO: 536675 - RNA, 64 nt, hsa; identical to SEQ ID NO: 275793

SEQ ID NO: 536676 - RNA, 64 nt, hsa; identical to SEQ ID NO: 275794

SEQ ID NO: 536677 - RNA, 64 nt, hsa; identical to SEQ ID NO: 275795

SEQ ID NO: 536678 - RNA, 64 nt, hsa; identical to SEQ ID NO: 275796

SEQ ID NO: 536679 - RNA, 64 nt, hsa; identical to SEQ ID NO: 275797

SEQ ID NO: 536680 - RNA, 64 nt, hsa; identical to SEQ ID NO: 275798

SEQ ID NO: 536681 - RNA, 64 nt, hsa; identical to SEQ ID NO: 275799

SEQ ID NO: 536682 - RNA, 64 nt, hsa; identical to SEQ ID NO: 275800

SEQ ID NO: 536683 - RNA, 64 nt, hsa; identical to SEQ ID NO: 275801

SEQ ID NO: 536684 - RNA, 64 nt, hsa; identical to SEQ ID NO: 275802

SEQ ID NO: 536685 - RNA, 64 nt, hsa; identical to SEQ ID NO: 275803

SEQ ID NO: 536686 - RNA, 64 nt, hsa; identical to SEQ ID NO: 275804

SEQ ID NO: 536687 - RNA, 64 nt, hsa; identical to SEQ ID NO: 275805

SEQ ID NO: 536688 - RNA, 64 nt, hsa; identical to SEQ ID NO: 275806

SEQ ID NO: 536689 - RNA, 64 nt, hsa; identical to SEQ ID NO: 275807

SEQ ID NO: 536690 - RNA, 64 nt, hsa; identical to SEQ ID NO: 275808

SEQ ID NO: 536691 - RNA, 64 nt, hsa; identical to SEQ ID NO: 275809

SEQ ID NO: 536692 - RNA, 64 nt, hsa; identical to SEQ ID NO: 275810

SEQ ID NO: 536693 - RNA, 64 nt, hsa; identical to SEQ ID NO: 275811

SEQ ID NO: 536694 - RNA, 64 nt, hsa; identical to SEQ ID NO: 275812

SEQ ID NO: 536695 - RNA, 64 nt, hsa; identical to SEQ ID NO: 275813

SEQ ID NO: 536696 - RNA, 64 nt, hsa; identical to SEQ ID NO: 275814

SEQ ID NO: 536697 - RNA, 64 nt, hsa; identical to SEQ ID NO: 275815

SEQ ID NO: 536698 - RNA, 64 nt, hsa; identical to SEQ ID NO: 275816

SEQ ID NO: 536699 - RNA, 64 nt, hsa; identical to SEQ ID NO: 275817

SEQ ID NO: 536700 - RNA, 64 nt, hsa; identical to SEQ ID NO: 275818

SEQ ID NO: 536701 - RNA, 64 nt, hsa; identical to SEQ ID NO: 275819

SEQ ID NO: 536702 - RNA, 64 nt, hsa; identical to SEQ ID NO: 275820

SEQ ID NO: 536703 - RNA, 64 nt, hsa; identical to SEQ ID NO: 275821

SEQ ID NO: 536704 - RNA, 64 nt, hsa; identical to SEQ ID NO: 275822

SEQ ID NO: 536705 - RNA, 64 nt, hsa; identical to SEQ ID NO: 275823

SEQ ID NO: 536706 - RNA, 64 nt, hsa; identical to SEQ ID NO: 275824

SEQ ID NO: 536707 - RNA, 64 nt, hsa; identical to SEQ ID NO: 275825

SEQ ID NO: 536708 - RNA, 64 nt, hsa; identical to SEQ ID NO: 275826

SEQ ID NO: 536709 - RNA, 64 nt, hsa; identical to SEQ ID NO: 275827

SEQ ID NO: 536710 - RNA, 64 nt, hsa; identical to SEQ ID NO: 275828

SEQ ID NO: 536711 - RNA, 64 nt, hsa; identical to SEQ ID NO: 275829

SEQ ID NO: 536712 - RNA, 64 nt, hsa; identical to SEQ ID NO: 275830

SEQ ID NO: 536713 - RNA, 64 nt, hsa; identical to SEQ ID NO: 275831

SEQ ID NO: 536714 - RNA, 64 nt, hsa; identical to SEQ ID NO: 275832

SEQ ID NO: 536715 - RNA, 64 nt, hsa; identical to SEQ ID NO: 275833

SEQ ID NO: 536716 - RNA, 64 nt, hsa; identical to SEQ ID NO: 275834

SEQ ID NO: 536717 - RNA, 64 nt, hsa; identical to SEQ ID NO: 275835

SEQ ID NO: 536718 - RNA, 64 nt, hsa; identical to SEQ ID NO: 275836

SEQ ID NO: 536719 - RNA, 64 nt, hsa; identical to SEQ ID NO: 275837

SEQ ID NO: 536720 - RNA, 64 nt, hsa; identical to SEQ ID NO: 275838

SEQ ID NO: 536721 - RNA, 64 nt, hsa; identical to SEQ ID NO: 275839

SEQ ID NO: 536722 - RNA, 64 nt, hsa; identical to SEQ ID NO: 275840

SEQ ID NO: 536723 - RNA, 64 nt, hsa; identical to SEQ ID NO: 243256

SEQ ID NO: 536724 - RNA, 64 nt, hsa; identical to SEQ ID NO: 243257

SEQ ID NO: 536725 - RNA, 64 nt, hsa; identical to SEQ ID NO: 243258

SEQ ID NO: 536726 - RNA, 64 nt, hsa; identical to SEQ ID NO: 243259

SEQ ID NO: 536727 - RNA, 64 nt, hsa; identical to SEQ ID NO: 243260

SEQ ID NO: 536728 - RNA, 64 nt, hsa; identical to SEQ ID NO: 243261

SEQ ID NO: 536729 - RNA, 64 nt, hsa
agcuuugcuaaacuaaccuaauuuguccaaaucaccccaaaaccaccaucucugacguaagcuu

SEQ ID NO: 536730 - RNA, 64 nt, hsa
uaaguuuuuucuuucuuccucuccugaauacacuccccaaaacaccccuuuccaguuacaauua

SEQ ID NO: 536731 - RNA, 64 nt, hsa
uuccucugaauuuugauguaagaucuauauaggcccccaaaaugaucguaguacaugccaguca

SEQ ID NO: 536732 - RNA, 64 nt, hsa
cucacacucuuggaauuuccagguauggggguagccccaaaaggaggaaucuccuauggccaau

SEQ ID NO: 536733 - RNA, 64 nt, hsa
acaggcuguugagaauucuuugccacuuuucccaccccaaaacagcauggggccugacaucuuc

SEQ ID NO: 536734 - RNA, 64 nt, hsa
cuacaucuucccuaagcacugccucucucucaccccccaaaacaaguugacgaaaggguuuuau

SEQ ID NO: 536735 - RNA, 64 nt, hsa
uuuguaaggcugggcuucaaaaucaaaacaaaaaccccaaaaacagcaggcaaaugcuuuuuaa

SEQ ID NO: 536736 - RNA, 64 nt, hsa
agucagcuacuucacacuugucaaggcuguuuuaccccaaaacucagacaggacuuucuaugca

SEQ ID NO: 536737 - RNA, 64 nt, hsa
uucuucuaagccuguguguuauaauuuaccaguuccccaaaaugccauuuuuaacgccgaacug

SEQ ID NO: 536738 - RNA, 64 nt, hsa
uaaauaaaauaaaaaauauuugucuccaccuuuuccccaaaagcaacagcaagacauauuuugu

SEQ ID NO: 536739 - RNA, 64 nt, hsa
uccuauagcaagacauaguuucauuuuagaggacccccaaaaucccgugaauucucuggugaug

SEQ ID NO: 536740 - RNA, 64 nt, hsa
auggggaaaacaauauguacuaccuuauacccuuccccaaaaacaaagggauuaaagaccuaaa

SEQ ID NO: 536741 - RNA, 64 nt, hsa
uucaugcuaauuuaaagauugcaagagguuucuuccccaaaauauaucauggacucaagguguu

SEQ ID NO: 536742 - RNA, 64 nt, hsa
aagauacauauacuuaaauagaagugugacuuucccccaaaaguauuucaauucuacuucauua

SEQ ID NO: 536743 - RNA, 64 nt, hsa
uucaucccuuaauguucucaaggaggcccaggauccccaaaauauuauaagcauugcagucaga

SEQ ID NO: 536744 - RNA, 64 nt, hsa
aauauaugauccauauucaaaauucuccaguuguccccaaaauauccuuuauagcuguuuauuu

SEQ ID NO: 536745 - RNA, 64 nt, hsa
uuuuaaaaauugcucugugauacuuaauuuuuuuccccaaaauuuguaauguguugcuucuaca

SEQ ID NO: 536746 - RNA, 64 nt, hsa
ggaggagcagcuguguguccccggcaccucacucccccaaaaugacacccaccgucgucagggu

SEQ ID NO: 536747 - RNA, 64 nt, hsa
auuacaaaauuauguucuauuuuaaaguccacucccccaaaauacugauuucuuccauggauua

SEQ ID NO: 536748 - RNA, 64 nt, hsa
uauauauuauucuagcaucaaaguuuuucucuuuccccaaaagugaugaucucaaguccuuuuu

SEQ ID NO: 536749 - RNA, 64 nt, hsa
uauuuugucaucagauuacuuguggguauaccuaccccaaaauuguuuucucauucacagcauu

SEQ ID NO: 536750 - RNA, 64 nt, hsa
uaaaaauauuauugguauuaaagaaauccauucaccccaaaacuuguuuuacaggauuacaauu

SEQ ID NO: 536751 - RNA, 64 nt, hsa
acaaccuuuuccuuaaggucuuuuaccaccucccccccaaaaaaaucccccaaaacugauucag

SEQ ID NO: 536752 - RNA, 64 nt, hsa
uaaggucuuuuaccaccucccccccaaaaaaaucccccaaaacugauucagauuuucauacuuu

SEQ ID NO: 536753 - RNA, 64 nt, hsa
uauaucauauuuagaaaauaauaaugaaaagcauccccaaaauuucaaugaugugaauuuuuaa

SEQ ID NO: 536754 - RNA, 64 nt, hsa
ggggugacagaugagguccucuguuuaccuccccccccaaaaaaaaaauucaguaggaauuccu

SEQ ID NO: 536755 - RNA, 64 nt, hsa
aaaacccaccacaaacguagaauccacuucuguuccccaaaaagcgagaagggggguucaggag

SEQ ID NO: 536756 - RNA, 64 nt, hsa
gacagagagagagaaaaaaaaucacccaccacccccccaaaaacacaaaaaaagaaaaucuauc

SEQ ID NO: 536757 - RNA, 64 nt, hsa
aagcaacuggggccaucccccccauuagaggggcccccaaaacuugguuggagagcugaacagg

SEQ ID NO: 536758 - RNA, 57 nt, hsa
accgccuggucagggacugaagggggaccccaaaacuggcucaccccccagaacacc

SEQ ID NO: 536759 - RNA, 64 nt, hsa
ggcuccucuuuauggggcagauaucuauagccaaccccaaaacuucugucuucuaucauucugu

SEQ ID NO: 536760 - RNA, 64 nt, hsa
gcagacagaauacauagccaccauugguaguacaccccaaaagcaaggauggcaugaugcuggu

SEQ ID NO: 536761 - RNA, 64 nt, hsa
caacaaaaaaaaaaguuucccauacacuggccugccccaaaacccacuaacaauuuuagcaaaa

SEQ ID NO: 536762 - RNA, 64 nt, hsa
ugggcccucuggaauugugcuccucacaaaguuuccccaaaagguucuucuaagccuuuauugu

SEQ ID NO: 536763 - RNA, 64 nt, hsa
gugagccaaacagcccugagaaaagcuggggaaacagucugagcuggaguccgagagugguugg

SEQ ID NO: 536764 - RNA, 64 nt, hsa
ccccucacuuaggcaaagcauuauucauucccaucagucugaagcccgaaggacuguuuuguau

SEQ ID NO: 536765 - RNA, 64 nt, hsa
ucacaucuccuggccgagagcagccacugccacucagucugacagcuugcgacugcaucuguau

SEQ ID NO: 536766 - RNA, 64 nt, hsa
ccaacagcuuuggcuucugguguggucaauauuucagucugacauagguuuuguuuguagugaa

SEQ ID NO: 536767 - RNA, 64 nt, hsa
ggguuccucugccugcuaacaagcccacguggaccagucugaaugucuuuccuuuacaccuaug

SEQ ID NO: 536768 - RNA, 64 nt, hsa
aucccaucuaaaaacucuucaaacuccacuuguucagucugaaaugcagcucccuguccaagug

SEQ ID NO: 536769 - RNA, 64 nt, hsa
aggaugcgcugggacggcccaucuuggcaagguucagucugaauggcauggagaccgggagaua

SEQ ID NO: 536770 - RNA, 64 nt, hsa
aagcuguuuuuccguggauuuggcgagaccagagcagucugaaggauuccccaccuccaauccc

SEQ ID NO: 536771 - RNA, 64 nt, hsa
cuccggggacccagacugccuucaucucugauggcagucugaucacuguggccacugugcgagc

SEQ ID NO: 536772 - RNA, 64 nt, hsa
ucuuccugguuuccuagccguuccccuucugccccagucugagccagugagggguagcuuuuua

SEQ ID NO: 536773 - RNA, 64 nt, hsa
ccugcuccauucuccagucugaacaguucagcuacagucugacucuggacaggggguuucuguu

SEQ ID NO: 536774 - RNA, 64 nt, hsa
gaccaggggugcgcccacagccugcuccauucuccagucugaacaguucagcuacagucugacu

SEQ ID NO: 536775 - RNA, 64 nt, hsa
uucauuuuuuggcacuaggucauuaaguagcacacagucugaaugcccuuuucuggaguggcca

SEQ ID NO: 536776 - RNA, 64 nt, hsa
aucaucgcacugacuguggcgcacuggggaauaacagucugagcuagcaccacccucagccagg

SEQ ID NO: 536777 - RNA, 64 nt, hsa
cuugccagcuagaaggagggucagggauuuuuuacagucugagaaugagugugugugagugagg

SEQ ID NO: 536778 - RNA, 64 nt, hsa
caaagaaaacgcccucuccugacuuguauuguggcagucugaacgcccccagaaaauugugcca

SEQ ID NO: 536779 - RNA, 64 nt, hsa
aagcuagagacucaggaaagacaguggcauaaugcagucugaguccaaaggccagguaaccuug

SEQ ID NO: 536780 - RNA, 64 nt, hsa
cuuaggaacaaaguaaaguaggguaagggaaugccagucugaggaguuagaaguuaccguuuua

SEQ ID NO: 536781 - RNA, 64 nt, hsa
gcuucugugauacuggccuugcugaaacgcaucucacugucauucuauuguuuauauuguuaaa

SEQ ID NO: 536782 - RNA, 64 nt, hsa
aacuuacagaagacacaacuccuuccccagugaucacugucauaaccagugcucuaccguaucc

SEQ ID NO: 536783 - RNA, 64 nt, hsa
gcuaaggccagcuagagcuuccacugucagcccucacugucagucccacugcaccccccugugc

SEQ ID NO: 536784 - RNA, 64 nt, hsa
gguaugagcuggagcuaaggccagcuagagcuuccacugucagcccucacugucagucccacug

SEQ ID NO: 536785 - RNA, 64 nt, hsa
cuuacucagaaaaaaaaaugccuggucagcaauucacugucaugcaccuauuuuuagauugggc

SEQ ID NO: 536786 - RNA, 64 nt, hsa
cgccgccgccgccucugucccugcccuccgagcccacugucacgcugccugguguucccccuca

SEQ ID NO: 536787 - RNA, 64 nt, hsa
gcgugucugguaccuuggauguucaaacagggaacacugucagggcugaggagaacagaagcuc

SEQ ID NO: 536788 - RNA, 64 nt, hsa
uccacuaccccuaaccugccaggaugcucaaguccacugucacaaucccuuucagaaaacauua

SEQ ID NO: 536789 - RNA, 64 nt, hsa
agcagcagggcacgccuggcuuuccuuggauacccacugucaccugcacuaugaagugcugcug

SEQ ID NO: 536790 - RNA, 64 nt, hsa
ugcugcuggcugggcuugguggcucagaacaaggcacugucacugcccaccuccuugggccucc

SEQ ID NO: 536791 - RNA, 64 nt, hsa
uuagaaagacccccaaaggcuuugugauuguaagcacugucaugaucacagaaugcaagcuucu

SEQ ID NO: 536792 - RNA, 64 nt, hsa
ccucaguuucaguucuuuccaguguuuuguagcucacugucacucacugaauagagaaacgugu

SEQ ID NO: 536793 - RNA, 64 nt, hsa
cuuguuuagaacuguugauuuugaacacaacauacacugucaaacuuuacaucagggauccaac

SEQ ID NO: 536794 - RNA, 64 nt, hsa
uucuguaaauugaauauagagguucucccuuggccacugucagcuuuucuugacuggccaaaac

SEQ ID NO: 536795 - RNA, 64 nt, hsa
guaauggacagaguuaucaaggcacauucuccaccacugucacaggaaggacaugucaaucuug

SEQ ID NO: 536796 - RNA, 64 nt, hsa
guaauggacagaguuaucgaggcacauacuucaccacugucacaggaagaaccugccaagcuug

SEQ ID NO: 536797 - RNA, 64 nt, hsa
ccggguggugacaaggagaaaagccuucuagggucacugucauucccuggccauguugcaaaca

SEQ ID NO: 536798 - RNA, 64 nt, hsa
caaaaacaugucccuggagaguagccugcucccacacugucacuggaugucauggggccaauaa

SEQ ID NO: 536799 - RNA, 64 nt, hsa
acagaaaucuuguuuacuguaugauauucuaaaacacugucaaauaaaauauauauccaaaaau

SEQ ID NO: 536800 - RNA, 64 nt, hsa
uuagguuccgucucacggcguuuuaauuuauuuucacugucacacgcauagauccacgaggcac

SEQ ID NO: 536801 - RNA, 64 nt, hsa
ucauuuugcauuuuacauuuaaauaugcuaacaucacugucauagaauucccaaauuucauuug

SEQ ID NO: 536802 - RNA, 64 nt, hsa
aaaaggagcaggccauaacuuuauuuguuagauacacugucagaaacuugagaucuuuuggccu

SEQ ID NO: 536803 - RNA, 64 nt, hsa
aagaaagucaggauaaaaauuuuaaaaagcaggccacugucagcaaagccuggagaaguggggc

SEQ ID NO: 536804 - RNA, 64 nt, hsa
aacggggguagacaggugcagaugaggugaagaucacugucaucuaaaagcuggccacuaaauu

SEQ ID NO: 536805 - RNA, 64 nt, hsa
caagccagugucguuuuugcacugguuuccaccucacugucagauauuguucuuuugauaugca

SEQ ID NO: 536806 - RNA, 64 nt, hsa
uucuguuugucgucuuguugauuugcugccuccacacugucagcuccuugggaacagagauugg

SEQ ID NO: 536807 - RNA, 64 nt, hsa
uagugagggagacaggugcagaugaggugaagaucacugucaucuaaaagcaggccaccaaauu

SEQ ID NO: 536808 - RNA, 64 nt, hsa
gcaagaugaagguaacaaucaucuaaaagccagccacugucagcaaagccuggagaaaugggac

SEQ ID NO: 536809 - RNA, 64 nt, hsa
acggagagaacaaagcccauucauccauuggauucacugucaguggagauacuaccucucgugg

SEQ ID NO: 536810 - RNA, 64 nt, hsa
uucagcucaggcacagcaacuugcccaggacugacacugucacccugacugcaggaggcacagg

SEQ ID NO: 536811 - RNA, 64 nt, hsa
gaaucaugucaggccugugugugaaaggaagcuccacugucacccuccaccucuucacccccca

SEQ ID NO: 536812 - RNA, 64 nt, hsa
caccucuucaccccccacucaccaguguccccuccacugucacauuguaacugaacuucaggau

SEQ ID NO: 536813 - RNA, 64 nt, hsa
cuuggagucaggccucagguggagagccgcaugucacugucagagaugagcccacccccacccu

SEQ ID NO: 536814 - RNA, 64 nt, hsa
cccauuaggagaaggagaaaugacuggaaaccagcacugucagcacuuugagcccuccucgguu

SEQ ID NO: 536815 - RNA, 64 nt, hsa
uuguuuuuguuuuuguuuuuuugagauggagucucacugucaccaggcuggagugcaguggugc

SEQ ID NO: 536816 - RNA, 64 nt, hsa
augguuaccuguaaucuuaccaaucauagauaaucacugucaaacuuuuggagcaaauccuuua

SEQ ID NO: 536817 - RNA, 64 nt, hsa
acucacacacacccucaugugugaagggcagagacacugucacaaacaggcaugccccuuagaa

SEQ ID NO: 536818 - RNA, 64 nt, hsa
cuuucucuuugcgcgcgucacacuugcuuggagacacugucaugaacgagcaugacacccugcu

SEQ ID NO: 536819 - RNA, 64 nt, hsa
acacgcuuaagacaccucugcaugcagucaaagccacugucacaagccggcaggcacuggugag

SEQ ID NO: 536820 - RNA, 64 nt, hsa
ugccgggguccauggugucauaugcagugacacacacugucaagcgccauuucccucaccccug

SEQ ID NO: 536821 - RNA, 64 nt, hsa
cucuccacuguccccuuguggaccagcuuccacucacugucacguccccccuccugcgucuuca

SEQ ID NO: 536822 - RNA, 64 nt, hsa
uggagugccacauggccgcugcccacgucccgggcacugucaugcccagcuuggagugccacgu

SEQ ID NO: 536823 - RNA, 64 nt, hsa
uggagugccacguggccgcugcccacgucccgggcacugucaugcccagcuuggagugccacau

SEQ ID NO: 536824 - RNA, 64 nt, hsa
cugugggcugggccuguggugccugccgaguggucacugucagugggaaacccguuguuccucc

SEQ ID NO: 536825 - RNA, 64 nt, hsa
gauucuaaagagagccugguuuguuaaaagaaaacacugucaugcugucaguucccaauugaca

SEQ ID NO: 536826 - RNA, 64 nt, hsa
uucucugagaaccaaaagaugccuugaauauuuauucagugacuucuggcuuaugcucagaagc

SEQ ID NO: 536827 - RNA, 64 nt, hsa
cugggggcauccugcuuccugaaagcuguuggauuucagugauuuuuccccccaccccccagca

SEQ ID NO: 536828 - RNA, 64 nt, hsa
uggcucuuagagaaaucuggagaacuauaccugcuucagugaaauaauuacagaauauacuuag

SEQ ID NO: 536829 - RNA, 64 nt, hsa
cagcuaauuggacuuuuauggcucuaucuuuuccuucagugaagaacccuauuuaaaacugggu

SEQ ID NO: 536830 - RNA, 64 nt, hsa
uuagauaccugcagaaacccccaguccuguuauuuucagugauuuuccauuuaucuuuaauucg

SEQ ID NO: 536831 - RNA, 64 nt, hsa
gaaaauggaaauaguauuucgcuguccugaaacuuucagugaaagagaucacccaacaucaaua

SEQ ID NO: 536832 - RNA, 64 nt, hsa
ucaugaugccaguagccauauaugauaaauuauguucagugauaacuuaguuaucagaaaucag

SEQ ID NO: 536833 - RNA, 64 nt, hsa
acaauaccuccacugguuuccuguuguaaaaaccuucagugaguuugaccauugugcucuuggc

SEQ ID NO: 536834 - RNA, 64 nt, hsa
ucccucauucauucagcaaaucucuauugaguucuucagugagaaggagcaggcacugggccug

SEQ ID NO: 536835 - RNA, 64 nt, hsa
uaaccuaaauauaccauugaugauucuucuuccauucagugacauccacagauuaugcagcuau

SEQ ID NO: 536836 - RNA, 64 nt, hsa
cuguuaugcccacugugcucaauuugaagcagaauucagugaaaaauuauuuuuccacauugaa

SEQ ID NO: 536837 - RNA, 64 nt, hsa
ucuuuucuacauuaagaaauauauucucaacauuuucagugagaauuucuuguaauggcaccuc

SEQ ID NO: 536838 - RNA, 64 nt, hsa
uaagaguuaucuuucagugaaauuuuauaacaguuucagugaauagagaaaaaauucugaacug

SEQ ID NO: 536839 - RNA, 64 nt, hsa
acaggugucagaucagaauuuuuaagaguuaucuuucagugaaauuuuauaacaguuucaguga

SEQ ID NO: 536840 - RNA, 64 nt, hsa
uaauaauuauguauguuauggcuuaaaagcaaguuucagugaaggucaccuggccugguugugu

SEQ ID NO: 536841 - RNA, 58 nt, hsa
ugacauaugaaaaaaugugauuuuuuaguucagugaccuguuuuauagaauuuuauau

SEQ ID NO: 536842 - RNA, 64 nt, hsa
uauguuugucaggauaaucaaaugaaaauacuaguucagugaucagcauugaaugguuguuagg

SEQ ID NO: 536843 - RNA, 64 nt, hsa
uuguuuagauuaagaguaaagaucauuuguacaguucagugaucuaguuugguguguccucuua

SEQ ID NO: 536844 - RNA, 64 nt, hsa
auguaguaggugcacauuugccuaacaggauaaauucagugauagcccaagcuggucaggagag

SEQ ID NO: 536845 - RNA, 64 nt, hsa
augaaaaacagguauauuugguuuaguucuguguuucagugacugauaaacaaaaaugaagcua

SEQ ID NO: 536846 - RNA, 64 nt, hsa
uauugccuugaaaguuaaaaggaaagcagauuucuucagugacuuugugguccuacuaacuaca

SEQ ID NO: 536847 - RNA, 64 nt, hsa
caugggcauucuguaugaaccuuuccagaugguguucagugaaagauguggguaguugagaacu

SEQ ID NO: 536848 - RNA, 64 nt, hsa
aaacauuaauugcuaacaauuguuagcaaacuauuucagugauaauguucauuuugaaaauaug

SEQ ID NO: 536849 - RNA, 64 nt, hsa
uaaaauuucuugcugcagugcaacaggaggcuuuuucagugaucuucacuguauauguaaauua

SEQ ID NO: 536850 - RNA, 64 nt, hsa
guaucaugguccagcaguacuguuuaaugggguauucagugacuaaggucugcuauuuaugcaa

SEQ ID NO: 536851 - RNA, 64 nt, hsa
aaauucuguuuaucccguguuaccaaauuaccauuucagugagaagcuuuugaaaagucuucug

SEQ ID NO: 536852 - RNA, 64 nt, hsa
ucuucuagaucugcuucacccagcauauuuucuauucagugauauaaagcauauuuuauucuau

SEQ ID NO: 536853 - RNA, 64 nt, hsa
auugcaaagauguuuacaaguauuuuaauuuaaguucagugaacuuuuuuguagcuggguuaaa

SEQ ID NO: 536854 - RNA, 64 nt, hsa
gcugaaccuguuuaucucugucauccugguggccuucagugaggagcaaaaauacuaucaggug

SEQ ID NO: 536855 - RNA, 64 nt, hsa
gcgcugccggaaccacagggaggaaggcaucagcuucagugagacagcagcagccgaugccgcc

SEQ ID NO: 536856 - RNA, 64 nt, hsa
ucuuuuucaucaggggggauagucucuaggauuuuucagugaggacccuugggcuuuggaugca

SEQ ID NO: 536857 - RNA, 64 nt, hsa
cagcuugaaccaagaaaacgaggagggaaagggauucagugaacuauuccucagugggaucggu

SEQ ID NO: 536858 - RNA, 64 nt, hsa
auguaccucucuagucaaagugguauuacagacauucagugacaaugaaucaguguuaauucua

SEQ ID NO: 536859 - RNA, 64 nt, hsa
ucucucauuuccuucaaauaaugaucaaugcuauuucagugagcaaacugugaaaggggcuuug

SEQ ID NO: 536860 - RNA, 64 nt, hsa
caaaaccuaugaguauauuaauauuggaaaauuuuucagugauucuucucuuucuuguauauga

SEQ ID NO: 536861 - RNA, 64 nt, hsa
gagaaacuugaaauauaaagaagaagagaaagccuucagugaugccucuguguuagggaaaaua

SEQ ID NO: 536862 - RNA, 64 nt, hsa
cuaagggagaaaaccugugaaggucucagaaggcuucagugacagucaucccuuaagacgcacu

SEQ ID NO: 536863 - RNA, 64 nt, hsa
cauguucagugaggaaaaaacauucagacaaauguucagugaggaaaaaaaggggaaguugggg

SEQ ID NO: 536864 - RNA, 64 nt, hsa
cagacaaauguucagugugagugaggaaaacauguucagugaggaaaaaacauucagacaaaug

SEQ ID NO: 536865 - RNA, 64 nt, hsa
auugauaccucugauaauauuuuauucuuaaaucuucagugauuccuuuuacuauagauucaug

SEQ ID NO: 536866 - RNA, 64 nt, hsa
ugacacuuuuauuuuauuagucaccggggaacuuuucagugaugaaaauacacaggguaauaaa

SEQ ID NO: 536867 - RNA, 64 nt, hsa; identical to SEQ ID NO: 226901

SEQ ID NO: 536868 - RNA, 64 nt, hsa; identical to SEQ ID NO: 226902

SEQ ID NO: 536869 - RNA, 64 nt, hsa; identical to SEQ ID NO: 226903

SEQ ID NO: 536870 - RNA, 64 nt, hsa; identical to SEQ ID NO: 226904

SEQ ID NO: 536871 - RNA, 64 nt, hsa; identical to SEQ ID NO: 226905

SEQ ID NO: 536872 - RNA, 64 nt, hsa; identical to SEQ ID NO: 226906

SEQ ID NO: 536873 - RNA, 64 nt, hsa; identical to SEQ ID NO: 226907

SEQ ID NO: 536874 - RNA, 64 nt, hsa; identical to SEQ ID NO: 226908

SEQ ID NO: 536875 - RNA, 64 nt, hsa; identical to SEQ ID NO: 226909

SEQ ID NO: 536876 - RNA, 64 nt, hsa; identical to SEQ ID NO: 226910

SEQ ID NO: 536877 - RNA, 64 nt, hsa; identical to SEQ ID NO: 226911

SEQ ID NO: 536878 - RNA, 64 nt, hsa; identical to SEQ ID NO: 226912

SEQ ID NO: 536879 - RNA, 64 nt, hsa
gcucauuguuugaagaaaaaccaaaacauuuuauggcuaguaauauuuauguaauuuuuaaaau

SEQ ID NO: 536880 - RNA, 64 nt, hsa
augucaccucuaaaacacuuaaauugccaaauuuggcuaguaguuuuguuucaguggcauuagc

SEQ ID NO: 536881 - RNA, 64 nt, hsa
ugcuuccggaaagcgcgguaggguucguagguagggcuaguagguaggguuaguagguagggcu

SEQ ID NO: 536882 - RNA, 64 nt, hsa
guagguagggcuaguagguaggguuaguagguagggcuaguagguagggcuaguagguaggguu

SEQ ID NO: 536883 - RNA, 64 nt, hsa
guagguaggguuaguagguagggcuaguagguagggcuaguagguaggguucguagguaggguu

SEQ ID NO: 536884 - RNA, 64 nt, hsa
guagguagggcugguagguaggguuaguagguagggcuaguagguaggguuaguagguaggguu

SEQ ID NO: 536885 - RNA, 64 nt, hsa
guagguaggguucguagguaggguucguagguagggcuaguagguaggguuaguagguaggguu

SEQ ID NO: 536886 - RNA, 64 nt, hsa
guagguaggguucguagguaggguucguagguagggcuaguagguaggguuaguagguagggcu

SEQ ID NO: 536887 - RNA, 64 nt, hsa; identical to SEQ ID NO: 536882

SEQ ID NO: 536888 - RNA, 64 nt, hsa
guagguaggguuaguagguagggcuaguagguagggcuaguagguaggguuaguagguagggcu

SEQ ID NO: 536889 - RNA, 64 nt, hsa
guagguagggcuaguagguaggguuaguagguagggcuaguagguaggguucguagguaggguu

SEQ ID NO: 536890 - RNA, 64 nt, hsa
guagguaggguucguagguaggguuaguagguagggcuaguagguaggguucguagguaggguu

SEQ ID NO: 536891 - RNA, 64 nt, hsa; identical to SEQ ID NO: 536886

SEQ ID NO: 536892 - RNA, 64 nt, hsa; identical to SEQ ID NO: 536882

SEQ ID NO: 536893 - RNA, 64 nt, hsa; identical to SEQ ID NO: 536883

SEQ ID NO: 536894 - RNA, 64 nt, hsa
guagguaggguuaguagguaggguucguagguagggcuaguagguagggcuaguagguagggcu

SEQ ID NO: 536895 - RNA, 64 nt, hsa
guagguaggguucguagguagggcuaguagguagggcuaguagguagggcuaguagguaggguu

SEQ ID NO: 536896 - RNA, 64 nt, hsa
guagguagggcuaguagguagggcuaguagguagggcuaguagguaggguuaguagguagggcu

SEQ ID NO: 536897 - RNA, 64 nt, hsa
guagguagggcuaguagguaggguuaguagguagggcuaguagguagggcuaguagguagggcu

SEQ ID NO: 536898 - RNA, 64 nt, hsa
guagguaggguuaguagguagggcuaguagguagggcuaguagguagggcuaguagguagggcu

SEQ ID NO: 536899 - RNA, 64 nt, hsa
guagguagggcuaguagguagggcuaguagguagggcuaguagguagggcuaguagguaggguu

SEQ ID NO: 536900 - RNA, 64 nt, hsa
guagguagggcuaguagguagggcuaguagguagggcuaguagguaggguucguagguaggguu

SEQ ID NO: 536901 - RNA, 64 nt, hsa
guuaagucuuuccucuaccuacauuuguuuucuuggcuaguaauaguaguagauacuucugaaa

SEQ ID NO: 536902 - RNA, 64 nt, hsa
uuuccugauuacacagguguugaauggggaaaggggcuaguauaucaguaggauauacuauggg

SEQ ID NO: 536903 - RNA, 64 nt, hsa; identical to SEQ ID NO: 223145

SEQ ID NO: 536904 - RNA, 64 nt, hsa; identical to SEQ ID NO: 223146

SEQ ID NO: 536905 - RNA, 64 nt, hsa; identical to SEQ ID NO: 223147

SEQ ID NO: 536906 - RNA, 64 nt, hsa; identical to SEQ ID NO: 223148

SEQ ID NO: 536907 - RNA, 64 nt, hsa; identical to SEQ ID NO: 223149

SEQ ID NO: 536908 - RNA, 64 nt, hsa; identical to SEQ ID NO: 223150

SEQ ID NO: 536909 - RNA, 64 nt, hsa; identical to SEQ ID NO: 223151

SEQ ID NO: 536910 - RNA, 64 nt, hsa; identical to SEQ ID NO: 223152

SEQ ID NO: 536911 - RNA, 64 nt, hsa; identical to SEQ ID NO: 223153

SEQ ID NO: 536912 - RNA, 64 nt, hsa; identical to SEQ ID NO: 223154

SEQ ID NO: 536913 - RNA, 64 nt, hsa; identical to SEQ ID NO: 223155

SEQ ID NO: 536914 - RNA, 64 nt, hsa; identical to SEQ ID NO: 223156

SEQ ID NO: 536915 - RNA, 64 nt, hsa; identical to SEQ ID NO: 223157

SEQ ID NO: 536916 - RNA, 64 nt, hsa; identical to SEQ ID NO: 223158

SEQ ID NO: 536917 - RNA, 64 nt, hsa; identical to SEQ ID NO: 223159

SEQ ID NO: 536918 - RNA, 64 nt, hsa; identical to SEQ ID NO: 223160

SEQ ID NO: 536919 - RNA, 64 nt, hsa; identical to SEQ ID NO: 223161

SEQ ID NO: 536920 - RNA, 64 nt, hsa; identical to SEQ ID NO: 223162

SEQ ID NO: 536921 - RNA, 64 nt, hsa; identical to SEQ ID NO: 223163

SEQ ID NO: 536922 - RNA, 64 nt, hsa; identical to SEQ ID NO: 223164

SEQ ID NO: 536923 - RNA, 64 nt, hsa; identical to SEQ ID NO: 223165

SEQ ID NO: 536924 - RNA, 64 nt, hsa; identical to SEQ ID NO: 223166

SEQ ID NO: 536925 - RNA, 64 nt, hsa; identical to SEQ ID NO: 223167

SEQ ID NO: 536926 - RNA, 64 nt, hsa; identical to SEQ ID NO: 223168

SEQ ID NO: 536927 - RNA, 64 nt, hsa; identical to SEQ ID NO: 223169

SEQ ID NO: 536928 - RNA, 64 nt, hsa; identical to SEQ ID NO: 223170

SEQ ID NO: 536929 - RNA, 64 nt, hsa; identical to SEQ ID NO: 223171

SEQ ID NO: 536930 - RNA, 64 nt, hsa; identical to SEQ ID NO: 223172

SEQ ID NO: 536931 - RNA, 64 nt, hsa; identical to SEQ ID NO: 223173

SEQ ID NO: 536932 - RNA, 64 nt, hsa; identical to SEQ ID NO: 223174

SEQ ID NO: 536933 - RNA, 64 nt, hsa; identical to SEQ ID NO: 223175

SEQ ID NO: 536934 - RNA, 64 nt, hsa; identical to SEQ ID NO: 223176

SEQ ID NO: 536935 - RNA, 64 nt, hsa; identical to SEQ ID NO: 223177

SEQ ID NO: 536936 - RNA, 64 nt, hsa; identical to SEQ ID NO: 223178

SEQ ID NO: 536937 - RNA, 64 nt, hsa; identical to SEQ ID NO: 223179

SEQ ID NO: 536938 - RNA, 64 nt, hsa; identical to SEQ ID NO: 223180

SEQ ID NO: 536939 - RNA, 64 nt, hsa; identical to SEQ ID NO: 223181

SEQ ID NO: 536940 - RNA, 64 nt, hsa; identical to SEQ ID NO: 223182

SEQ ID NO: 536941 - RNA, 64 nt, hsa; identical to SEQ ID NO: 223183

SEQ ID NO: 536942 - RNA, 64 nt, hsa; identical to SEQ ID NO: 223184

SEQ ID NO: 536943 - RNA, 64 nt, hsa; identical to SEQ ID NO: 223185

SEQ ID NO: 536944 - RNA, 64 nt, hsa; identical to SEQ ID NO: 223186

SEQ ID NO: 536945 - RNA, 64 nt, hsa; identical to SEQ ID NO: 223187

SEQ ID NO: 536946 - RNA, 64 nt, hsa; identical to SEQ ID NO: 223188

SEQ ID NO: 536947 - RNA, 64 nt, hsa; identical to SEQ ID NO: 223189

SEQ ID NO: 536948 - RNA, 64 nt, hsa; identical to SEQ ID NO: 223190

SEQ ID NO: 536949 - RNA, 64 nt, hsa; identical to SEQ ID NO: 223191

SEQ ID NO: 536950 - RNA, 64 nt, hsa; identical to SEQ ID NO: 223192

SEQ ID NO: 536951 - RNA, 64 nt, hsa; identical to SEQ ID NO: 223193

SEQ ID NO: 536952 - RNA, 64 nt, hsa; identical to SEQ ID NO: 223194

SEQ ID NO: 536953 - RNA, 64 nt, hsa; identical to SEQ ID NO: 223195

SEQ ID NO: 536954 - RNA, 57 nt, hsa; identical to SEQ ID NO: 223196

SEQ ID NO: 536955 - RNA, 64 nt, hsa; identical to SEQ ID NO: 223197

SEQ ID NO: 536956 - RNA, 54 nt, hsa; identical to SEQ ID NO: 223198

SEQ ID NO: 536957 - RNA, 64 nt, hsa; identical to SEQ ID NO: 53836

SEQ ID NO: 536958 - RNA, 64 nt, hsa; identical to SEQ ID NO: 53837

SEQ ID NO: 536959 - RNA, 64 nt, hsa; identical to SEQ ID NO: 53838

SEQ ID NO: 536960 - RNA, 64 nt, hsa; identical to SEQ ID NO: 53839

SEQ ID NO: 536961 - RNA, 64 nt, hsa; identical to SEQ ID NO: 53840

SEQ ID NO: 536962 - RNA, 64 nt, hsa; identical to SEQ ID NO: 53841

SEQ ID NO: 536963 - RNA, 64 nt, hsa; identical to SEQ ID NO: 99500

SEQ ID NO: 536964 - RNA, 64 nt, hsa; identical to SEQ ID NO: 99501

SEQ ID NO: 536965 - RNA, 64 nt, hsa; identical to SEQ ID NO: 99502

SEQ ID NO: 536966 - RNA, 64 nt, hsa; identical to SEQ ID NO: 99503

SEQ ID NO: 536967 - RNA, 64 nt, hsa; identical to SEQ ID NO: 99504

SEQ ID NO: 536968 - RNA, 64 nt, hsa; identical to SEQ ID NO: 99505

SEQ ID NO: 536969 - RNA, 64 nt, hsa; identical to SEQ ID NO: 99506

SEQ ID NO: 536970 - RNA, 64 nt, hsa; identical to SEQ ID NO: 99507

SEQ ID NO: 536971 - RNA, 64 nt, hsa; identical to SEQ ID NO: 99508

SEQ ID NO: 536972 - RNA, 64 nt, hsa; identical to SEQ ID NO: 99509

SEQ ID NO: 536973 - RNA, 64 nt, hsa; identical to SEQ ID NO: 99510

SEQ ID NO: 536974 - RNA, 64 nt, hsa; identical to SEQ ID NO: 99511

SEQ ID NO: 536975 - RNA, 64 nt, hsa; identical to SEQ ID NO: 99512

SEQ ID NO: 536976 - RNA, 64 nt, hsa; identical to SEQ ID NO: 99513

SEQ ID NO: 536977 - RNA, 64 nt, hsa; identical to SEQ ID NO: 99514

SEQ ID NO: 536978 - RNA, 64 nt, hsa; identical to SEQ ID NO: 99515

SEQ ID NO: 536979 - RNA, 64 nt, hsa; identical to SEQ ID NO: 99516

SEQ ID NO: 536980 - RNA, 64 nt, hsa; identical to SEQ ID NO: 99517

SEQ ID NO: 536981 - RNA, 64 nt, hsa; identical to SEQ ID NO: 99518

SEQ ID NO: 536982 - RNA, 64 nt, hsa; identical to SEQ ID NO: 99519

SEQ ID NO: 536983 - RNA, 64 nt, hsa; identical to SEQ ID NO: 99508

SEQ ID NO: 536984 - RNA, 64 nt, hsa; identical to SEQ ID NO: 99521

SEQ ID NO: 536985 - RNA, 64 nt, hsa; identical to SEQ ID NO: 99522

SEQ ID NO: 536986 - RNA, 64 nt, hsa; identical to SEQ ID NO: 99523

SEQ ID NO: 536987 - RNA, 64 nt, hsa; identical to SEQ ID NO: 99524

SEQ ID NO: 536988 - RNA, 64 nt, hsa; identical to SEQ ID NO: 99525

SEQ ID NO: 536989 - RNA, 64 nt, hsa; identical to SEQ ID NO: 99526

SEQ ID NO: 536990 - RNA, 64 nt, hsa; identical to SEQ ID NO: 99527

SEQ ID NO: 536991 - RNA, 64 nt, hsa; identical to SEQ ID NO: 99528

SEQ ID NO: 536992 - RNA, 64 nt, hsa; identical to SEQ ID NO: 99529

SEQ ID NO: 536993 - RNA, 64 nt, hsa; identical to SEQ ID NO: 99530

SEQ ID NO: 536994 - RNA, 64 nt, hsa; identical to SEQ ID NO: 99531

SEQ ID NO: 536995 - RNA, 64 nt, hsa; identical to SEQ ID NO: 99532

SEQ ID NO: 536996 - RNA, 64 nt, hsa; identical to SEQ ID NO: 99533

SEQ ID NO: 536997 - RNA, 64 nt, hsa; identical to SEQ ID NO: 99534

SEQ ID NO: 536998 - RNA, 64 nt, hsa; identical to SEQ ID NO: 99535

SEQ ID NO: 536999 - RNA, 64 nt, hsa; identical to SEQ ID NO: 99536

SEQ ID NO: 537000 - RNA, 64 nt, hsa; identical to SEQ ID NO: 99537

SEQ ID NO: 537001 - RNA, 64 nt, hsa; identical to SEQ ID NO: 99538

SEQ ID NO: 537002 - RNA, 64 nt, hsa; identical to SEQ ID NO: 99539

SEQ ID NO: 537003 - RNA, 64 nt, hsa; identical to SEQ ID NO: 99540

SEQ ID NO: 537004 - RNA, 64 nt, hsa; identical to SEQ ID NO: 99541

SEQ ID NO: 537005 - RNA, 64 nt, hsa; identical to SEQ ID NO: 99542

SEQ ID NO: 537006 - RNA, 64 nt, hsa; identical to SEQ ID NO: 99543

SEQ ID NO: 537007 - RNA, 64 nt, hsa; identical to SEQ ID NO: 99544

SEQ ID NO: 537008 - RNA, 64 nt, hsa; identical to SEQ ID NO: 99545

SEQ ID NO: 537009 - RNA, 64 nt, hsa; identical to SEQ ID NO: 99546

SEQ ID NO: 537010 - RNA, 64 nt, hsa; identical to SEQ ID NO: 99547

SEQ ID NO: 537011 - RNA, 64 nt, hsa; identical to SEQ ID NO: 99548

SEQ ID NO: 537012 - RNA, 64 nt, hsa; identical to SEQ ID NO: 99549

SEQ ID NO: 537013 - RNA, 64 nt, hsa; identical to SEQ ID NO: 99550

SEQ ID NO: 537014 - RNA, 64 nt, hsa; identical to SEQ ID NO: 99551

SEQ ID NO: 537015 - RNA, 64 nt, hsa; identical to SEQ ID NO: 99552

SEQ ID NO: 537016 - RNA, 64 nt, hsa; identical to SEQ ID NO: 99553

SEQ ID NO: 537017 - RNA, 64 nt, hsa; identical to SEQ ID NO: 99554

SEQ ID NO: 537018 - RNA, 64 nt, hsa; identical to SEQ ID NO: 99555

SEQ ID NO: 537019 - RNA, 64 nt, hsa; identical to SEQ ID NO: 99556

SEQ ID NO: 537020 - RNA, 64 nt, hsa; identical to SEQ ID NO: 99557

SEQ ID NO: 537021 - RNA, 64 nt, hsa; identical to SEQ ID NO: 99558

SEQ ID NO: 537022 - RNA, 64 nt, hsa
acgacuacucgcugcacgggggcugccuggucacgcgcggcaccaaguggauugccaacaacug

SEQ ID NO: 537023 - RNA, 64 nt, hsa
ugccaacaacuggauuaauguggaccccagccgagcgcggcaagcgcuguuccaacaggagaug

SEQ ID NO: 537024 - RNA, 64 nt, hsa
ucuaaaaugcagguuuuucuucuucaauuuagcucagugguaggucaaauuguuugcuuuugcu

SEQ ID NO: 537025 - RNA, 64 nt, hsa
ugagaugaagucucacugcacucaggcuggagugcagugguacgaucuuggcucacugcaaccu

SEQ ID NO: 537026 - RNA, 64 nt, hsa
aauuguuagaauggaaaaauuccuucugaucuagcagugguaaccccugcuguugcugccacug

SEQ ID NO: 537027 - RNA, 64 nt, hsa
uaaacaugguaauuuugauacaguuauacuuuuacagugguacauaauccaaggacuaguauag

SEQ ID NO: 537028 - RNA, 63 nt, hsa
auuaagcucuguugucaugaacaacuggaauguaaaccacaguauuuuggagugcagaacauu

SEQ ID NO: 537029 - RNA, 63 nt, hsa
gguguuguaaagagcugcuaguagguucgcuuuaaaccacaugagcuuaaccaagaauauguu

SEQ ID NO: 537030 - RNA, 63 nt, hsa
aagcaauuuaaucaauugcaaagcaauuauauaaaaccacaaagaauguacugaaccuacuaa

SEQ ID NO: 537031 - RNA, 63 nt, hsa
aaagugguuuuuuaaaauuacauaacuaaaaauaaaccacacuguggauacaucuuauaaaac

SEQ ID NO: 537032 - RNA, 63 nt, hsa
aagaauauuccauuuuccuuuccuugugguugaaaaccacagucaguggagagauguuuggaa

SEQ ID NO: 537033 - RNA, 63 nt, hsa
guugaaaaccacagucaguggagagauguuuggaaaccacagucaguggagccugggugguac

SEQ ID NO: 537034 - RNA, 63 nt, hsa
caguauauguucuaagaccccuaguagauucgcaaaccacagauaguaccaaacuccauucau

SEQ ID NO: 537035 - RNA, 63 nt, hsa
accaagcucucccuuaucaagugaauaucaucaaaaccacagcauccuugaucagagaagggg

SEQ ID NO: 537036 - RNA, 63 nt, hsa
ugacagcccacuugucaaauauguaauucaccgaaaccacaccaaguccugcuacuguagagu

SEQ ID NO: 537037 - RNA, 63 nt, hsa
cucugaaauguggcuagguguagaaugauguugaaaccacaggcuaaaauguagaucuggaag

SEQ ID NO: 537038 - RNA, 63 nt, hsa
cugcagaaguggcuccuuuucauaaacuccccuaaaccacacacaggagagagcgacgggccu

SEQ ID NO: 537039 - RNA, 63 nt, hsa
aaauaaauaagaauaacucagaaacucaaaaggaaaccacaaauucagcuaauaauagcauuu

SEQ ID NO: 537040 - RNA, 63 nt, hsa
uugccaggcaggcaccugggcuuucuggaauccaaaccacagucuuaggggcuugguaguuug

SEQ ID NO: 537041 - RNA, 63 nt, hsa
cugguugugauuuauauuuuaaagcuuggugcuaaaccacaauauguauagcauauggagugc

SEQ ID NO: 537042 - RNA, 63 nt, hsa
auugaaucucuuaugccaguuuucauaaaacccaaaccacauaugaaaaaauccauuaagggu

SEQ ID NO: 537043 - RNA, 63 nt, hsa
ccaguuguugagggguauacuagaagcagaaugaaaccacauuuuuugguuugauaauaugca

SEQ ID NO: 537044 - RNA, 63 nt, hsa
uccauuccaggaccuucauuugcauaagguaucaaaccacaucagccucugauuggccauggg

SEQ ID NO: 537045 - RNA, 63 nt, hsa
uucauuccaggacauucauuugcauaaggagucaaaccacaccagucuuggauuggcugugag

SEQ ID NO: 537046 - RNA, 63 nt, hsa
ggacagauccugucauuguuuaagcugagcaaaaaaccacacaaaaguuguguaagagaugag

SEQ ID NO: 537047 - RNA, 63 nt, hsa
aagagggaacuuucuggaguuuuugagaaugccaaaccacauuuuuaucacacuucuuuggaa

SEQ ID NO: 537048 - RNA, 63 nt, hsa
aaauaaggaaauaggggaaaaaaagagcacuauaaaccacauguuuucauuucuagugcuucg

SEQ ID NO: 537049 - RNA, 63 nt, hsa
gugugaucacaagacuaaagauaauuaaaaagaaaaccacagaucaugacuuuuugacugugc

SEQ ID NO: 537050 - RNA, 63 nt, hsa
auuauuacaaaacaaaaugaacacuugaccaaaaaaccacauuaauuuaaauggagccuuuca

SEQ ID NO: 537051 - RNA, 63 nt, hsa
uaauacuaauggaauguuucaaagguuuuauucaaaccacaaauuauagaauccacccaagaa

SEQ ID NO: 537052 - RNA, 63 nt, hsa
guagaaaagugcuugucaguuguugaauaaaaaaaaccacauuugauagagauucaaaagacu

SEQ ID NO: 537053 - RNA, 63 nt, hsa
ugcuucccucccaucagucugguugacaggaagaaaccacaccaucaacaccaacaaguuucu

SEQ ID NO: 537054 - RNA, 63 nt, hsa
auuguuuaaaaccaucacuuuuuugucuuugggaaaccacaggaacaauuucucuggagacaa

SEQ ID NO: 537055 - RNA, 63 nt, hsa
agaaauacacguaugguuaauguucaguccaacaaaccacacacaguaaauguuuauuaauag

SEQ ID NO: 537056 - RNA, 63 nt, hsa
uugucauuugggcuuucuguugaaugaaucaacaaaccacaauacuuccugggaccuuuugua

SEQ ID NO: 537057 - RNA, 63 nt, hsa
cgaaggcauuuuccacuaguuuuuggacuauguaaaccacauuguacuuuuuuuuacuuuggc

SEQ ID NO: 537058 - RNA, 63 nt, hsa
agcacaacauuaugauuuaauaugcuuuuguugaaaccacagcuuuugugcccauuguuuuaa

SEQ ID NO: 537059 - RNA, 63 nt, hsa
agauguuguuuucagguuaauggacacgcaaagaaaccacagcacauacuucuuuucuuucau

SEQ ID NO: 537060 - RNA, 64 nt, hsa
uuugagagaaauuauucagauuuuauuuuuguaucugugguaacaaaacauuaaccaaaagauu

SEQ ID NO: 537061 - RNA, 64 nt, hsa
gcggacgccggcuguucuucccgccacgaucuuucugugguagcggccagcagaagacauggcc

SEQ ID NO: 537062 - RNA, 64 nt, hsa
uaggcaccugcuguucuuucaggaaacagcuuggcugugguaaugcucuacugggcccuucaga

SEQ ID NO: 537063 - RNA, 64 nt, hsa
agaaggugagagacaaaaauggaaagauccuggccugugguagugguagcaguuuucucaaaua

SEQ ID NO: 537064 - RNA, 64 nt, hsa
ggacagacuucaauuugccauuuugagauuugaccugugguagcaucugggccuaauguuggcu

SEQ ID NO: 537065 - RNA, 64 nt, hsa
gauagagaucccaacuugaaacaacagccagugccugugguaacuuaaugucuugucaaauacu

SEQ ID NO: 537066 - RNA, 64 nt, hsa
ccaggcccuaauaauagaaguuguaccaaaaugccugugguacuugauggccuguuggucaaau

SEQ ID NO: 537067 - RNA, 64 nt, hsa
cuaccuaagucagucacuuugcuaaauucuucaccugugguaacucauuuugauuguuauaaca

SEQ ID NO: 537068 - RNA, 64 nt, hsa; identical to SEQ ID NO: 194985

SEQ ID NO: 537069 - RNA, 64 nt, hsa; identical to SEQ ID NO: 194986

SEQ ID NO: 537070 - RNA, 64 nt, hsa; identical to SEQ ID NO: 194987

SEQ ID NO: 537071 - RNA, 64 nt, hsa; identical to SEQ ID NO: 194988

SEQ ID NO: 537072 - RNA, 64 nt, hsa; identical to SEQ ID NO: 194989

SEQ ID NO: 537073 - RNA, 64 nt, hsa; identical to SEQ ID NO: 194990

SEQ ID NO: 537074 - RNA, 64 nt, hsa; identical to SEQ ID NO: 194991

SEQ ID NO: 537075 - RNA, 64 nt, hsa; identical to SEQ ID NO: 194992

SEQ ID NO: 537076 - RNA, 64 nt, hsa; identical to SEQ ID NO: 194993

SEQ ID NO: 537077 - RNA, 64 nt, hsa; identical to SEQ ID NO: 194994

SEQ ID NO: 537078 - RNA, 64 nt, hsa; identical to SEQ ID NO: 194995

SEQ ID NO: 537079 - RNA, 64 nt, hsa; identical to SEQ ID NO: 194996

SEQ ID NO: 537080 - RNA, 64 nt, hsa; identical to SEQ ID NO: 194997

SEQ ID NO: 537081 - RNA, 64 nt, hsa; identical to SEQ ID NO: 194998

SEQ ID NO: 537082 - RNA, 64 nt, hsa; identical to SEQ ID NO: 194999

SEQ ID NO: 537083 - RNA, 64 nt, hsa; identical to SEQ ID NO: 195000

SEQ ID NO: 537084 - RNA, 64 nt, hsa; identical to SEQ ID NO: 195001

SEQ ID NO: 537085 - RNA, 64 nt, hsa; identical to SEQ ID NO: 195002

SEQ ID NO: 537086 - RNA, 64 nt, hsa; identical to SEQ ID NO: 195003

SEQ ID NO: 537087 - RNA, 64 nt, hsa; identical to SEQ ID NO: 195004

SEQ ID NO: 537088 - RNA, 64 nt, hsa; identical to SEQ ID NO: 195005

SEQ ID NO: 537089 - RNA, 64 nt, hsa; identical to SEQ ID NO: 195006

SEQ ID NO: 537090 - RNA, 64 nt, hsa; identical to SEQ ID NO: 195007

SEQ ID NO: 537091 - RNA, 64 nt, hsa; identical to SEQ ID NO: 195008

SEQ ID NO: 537092 - RNA, 64 nt, hsa; identical to SEQ ID NO: 195009

SEQ ID NO: 537093 - RNA, 64 nt, hsa; identical to SEQ ID NO: 195010

SEQ ID NO: 537094 - RNA, 64 nt, hsa; identical to SEQ ID NO: 195011

SEQ ID NO: 537095 - RNA, 64 nt, hsa; identical to SEQ ID NO: 195012

SEQ ID NO: 537096 - RNA, 64 nt, hsa; identical to SEQ ID NO: 195013

SEQ ID NO: 537097 - RNA, 64 nt, hsa; identical to SEQ ID NO: 195014

SEQ ID NO: 537098 - RNA, 64 nt, hsa; identical to SEQ ID NO: 195015

SEQ ID NO: 537099 - RNA, 64 nt, hsa; identical to SEQ ID NO: 195016

SEQ ID NO: 537100 - RNA, 64 nt, hsa; identical to SEQ ID NO: 195017

SEQ ID NO: 537101 - RNA, 64 nt, hsa; identical to SEQ ID NO: 195018

SEQ ID NO: 537102 - RNA, 64 nt, hsa; identical to SEQ ID NO: 195019

SEQ ID NO: 537103 - RNA, 64 nt, hsa; identical to SEQ ID NO: 195020

SEQ ID NO: 537104 - RNA, 64 nt, hsa; identical to SEQ ID NO: 195021

SEQ ID NO: 537105 - RNA, 64 nt, hsa; identical to SEQ ID NO: 195022

SEQ ID NO: 537106 - RNA, 64 nt, hsa; identical to SEQ ID NO: 195023

SEQ ID NO: 537107 - RNA, 64 nt, hsa; identical to SEQ ID NO: 195024

SEQ ID NO: 537108 - RNA, 64 nt, hsa; identical to SEQ ID NO: 195025

SEQ ID NO: 537109 - RNA, 64 nt, hsa; identical to SEQ ID NO: 195026

SEQ ID NO: 537110 - RNA, 64 nt, hsa; identical to SEQ ID NO: 166184

SEQ ID NO: 537111 - RNA, 64 nt, hsa; identical to SEQ ID NO: 166185

SEQ ID NO: 537112 - RNA, 64 nt, hsa; identical to SEQ ID NO: 166186

SEQ ID NO: 537113 - RNA, 64 nt, hsa; identical to SEQ ID NO: 166187

SEQ ID NO: 537114 - RNA, 64 nt, hsa; identical to SEQ ID NO: 166188

SEQ ID NO: 537115 - RNA, 64 nt, hsa; identical to SEQ ID NO: 166189

SEQ ID NO: 537116 - RNA, 64 nt, hsa; identical to SEQ ID NO: 166190

SEQ ID NO: 537117 - RNA, 64 nt, hsa; identical to SEQ ID NO: 166191

SEQ ID NO: 537118 - RNA, 64 nt, hsa; identical to SEQ ID NO: 166192

SEQ ID NO: 537119 - RNA, 64 nt, hsa; identical to SEQ ID NO: 166193

SEQ ID NO: 537120 - RNA, 64 nt, hsa; identical to SEQ ID NO: 166194

SEQ ID NO: 537121 - RNA, 64 nt, hsa; identical to SEQ ID NO: 166195

SEQ ID NO: 537122 - RNA, 64 nt, hsa; identical to SEQ ID NO: 166196

SEQ ID NO: 537123 - RNA, 64 nt, hsa; identical to SEQ ID NO: 166197

SEQ ID NO: 537124 - RNA, 64 nt, hsa; identical to SEQ ID NO: 166198

SEQ ID NO: 537125 - RNA, 64 nt, hsa; identical to SEQ ID NO: 166199

SEQ ID NO: 537126 - RNA, 64 nt, hsa; identical to SEQ ID NO: 166200

SEQ ID NO: 537127 - RNA, 64 nt, hsa; identical to SEQ ID NO: 166201

SEQ ID NO: 537128 - RNA, 64 nt, hsa; identical to SEQ ID NO: 166202

SEQ ID NO: 537129 - RNA, 64 nt, hsa; identical to SEQ ID NO: 166203

SEQ ID NO: 537130 - RNA, 64 nt, hsa; identical to SEQ ID NO: 166204

SEQ ID NO: 537131 - RNA, 64 nt, hsa; identical to SEQ ID NO: 166205

SEQ ID NO: 537132 - RNA, 64 nt, hsa; identical to SEQ ID NO: 166206

SEQ ID NO: 537133 - RNA, 64 nt, hsa; identical to SEQ ID NO: 166207

SEQ ID NO: 537134 - RNA, 64 nt, hsa; identical to SEQ ID NO: 166208

SEQ ID NO: 537135 - RNA, 64 nt, hsa; identical to SEQ ID NO: 166209

SEQ ID NO: 537136 - RNA, 64 nt, hsa; identical to SEQ ID NO: 166210

SEQ ID NO: 537137 - RNA, 64 nt, hsa; identical to SEQ ID NO: 166211

SEQ ID NO: 537138 - RNA, 64 nt, hsa; identical to SEQ ID NO: 166212

SEQ ID NO: 537139 - RNA, 64 nt, hsa; identical to SEQ ID NO: 166213

SEQ ID NO: 537140 - RNA, 64 nt, hsa; identical to SEQ ID NO: 166214

SEQ ID NO: 537141 - RNA, 64 nt, hsa; identical to SEQ ID NO: 166215

SEQ ID NO: 537142 - RNA, 64 nt, hsa; identical to SEQ ID NO: 166216

SEQ ID NO: 537143 - RNA, 64 nt, hsa; identical to SEQ ID NO: 166217

SEQ ID NO: 537144 - RNA, 64 nt, hsa; identical to SEQ ID NO: 166218

SEQ ID NO: 537145 - RNA, 64 nt, hsa; identical to SEQ ID NO: 166219

SEQ ID NO: 537146 - RNA, 64 nt, hsa; identical to SEQ ID NO: 166220

SEQ ID NO: 537147 - RNA, 64 nt, hsa; identical to SEQ ID NO: 166221

SEQ ID NO: 537148 - RNA, 64 nt, hsa; identical to SEQ ID NO: 166222

SEQ ID NO: 537149 - RNA, 64 nt, hsa; identical to SEQ ID NO: 166223

SEQ ID NO: 537150 - RNA, 64 nt, hsa; identical to SEQ ID NO: 166224

SEQ ID NO: 537151 - RNA, 58 nt, hsa; identical to SEQ ID NO: 96080

SEQ ID NO: 537152 - RNA, 64 nt, hsa; identical to SEQ ID NO: 166226

SEQ ID NO: 537153 - RNA, 64 nt, hsa; identical to SEQ ID NO: 166227

SEQ ID NO: 537154 - RNA, 64 nt, hsa; identical to SEQ ID NO: 166228

SEQ ID NO: 537155 - RNA, 64 nt, hsa; identical to SEQ ID NO: 166229

SEQ ID NO: 537156 - RNA, 64 nt, hsa; identical to SEQ ID NO: 166230

SEQ ID NO: 537157 - RNA, 64 nt, hsa; identical to SEQ ID NO: 166231

SEQ ID NO: 537158 - RNA, 64 nt, hsa; identical to SEQ ID NO: 166232

SEQ ID NO: 537159 - RNA, 64 nt, hsa; identical to SEQ ID NO: 166233

SEQ ID NO: 537160 - RNA, 64 nt, hsa; identical to SEQ ID NO: 166234

SEQ ID NO: 537161 - RNA, 64 nt, hsa; identical to SEQ ID NO: 166235

SEQ ID NO: 537162 - RNA, 64 nt, hsa; identical to SEQ ID NO: 166236

SEQ ID NO: 537163 - RNA, 64 nt, hsa; identical to SEQ ID NO: 166237

SEQ ID NO: 537164 - RNA, 64 nt, hsa; identical to SEQ ID NO: 166238

SEQ ID NO: 537165 - RNA, 64 nt, hsa; identical to SEQ ID NO: 166239

SEQ ID NO: 537166 - RNA, 64 nt, hsa; identical to SEQ ID NO: 166240

SEQ ID NO: 537167 - RNA, 64 nt, hsa; identical to SEQ ID NO: 166241

SEQ ID NO: 537168 - RNA, 64 nt, hsa; identical to SEQ ID NO: 166242

SEQ ID NO: 537169 - RNA, 64 nt, hsa; identical to SEQ ID NO: 166243

SEQ ID NO: 537170 - RNA, 64 nt, hsa; identical to SEQ ID NO: 166244

SEQ ID NO: 537171 - RNA, 64 nt, hsa; identical to SEQ ID NO: 166245

SEQ ID NO: 537172 - RNA, 64 nt, hsa; identical to SEQ ID NO: 166246

SEQ ID NO: 537173 - RNA, 64 nt, hsa; identical to SEQ ID NO: 166247

SEQ ID NO: 537174 - RNA, 64 nt, hsa; identical to SEQ ID NO: 166248

SEQ ID NO: 537175 - RNA, 64 nt, hsa; identical to SEQ ID NO: 166249

SEQ ID NO: 537176 - RNA, 64 nt, hsa; identical to SEQ ID NO: 166250

SEQ ID NO: 537177 - RNA, 64 nt, hsa; identical to SEQ ID NO: 166251

SEQ ID NO: 537178 - RNA, 64 nt, hsa; identical to SEQ ID NO: 166252

SEQ ID NO: 537179 - RNA, 64 nt, hsa; identical to SEQ ID NO: 166253

SEQ ID NO: 537180 - RNA, 64 nt, hsa; identical to SEQ ID NO: 166254

SEQ ID NO: 537181 - RNA, 64 nt, hsa; identical to SEQ ID NO: 166255

SEQ ID NO: 537182 - RNA, 64 nt, hsa; identical to SEQ ID NO: 166256

SEQ ID NO: 537183 - RNA, 64 nt, hsa; identical to SEQ ID NO: 166257

SEQ ID NO: 537184 - RNA, 64 nt, hsa; identical to SEQ ID NO: 166258

SEQ ID NO: 537185 - RNA, 64 nt, hsa; identical to SEQ ID NO: 166259

SEQ ID NO: 537186 - RNA, 64 nt, hsa; identical to SEQ ID NO: 166260

SEQ ID NO: 537187 - RNA, 64 nt, hsa; identical to SEQ ID NO: 166261

SEQ ID NO: 537188 - RNA, 64 nt, hsa; identical to SEQ ID NO: 166262

SEQ ID NO: 537189 - RNA, 64 nt, hsa; identical to SEQ ID NO: 166263

SEQ ID NO: 537190 - RNA, 64 nt, hsa; identical to SEQ ID NO: 166264

SEQ ID NO: 537191 - RNA, 64 nt, hsa; identical to SEQ ID NO: 166265

SEQ ID NO: 537192 - RNA, 64 nt, hsa; identical to SEQ ID NO: 166266

SEQ ID NO: 537193 - RNA, 64 nt, hsa; identical to SEQ ID NO: 166267

SEQ ID NO: 537194 - RNA, 64 nt, hsa; identical to SEQ ID NO: 166268

SEQ ID NO: 537195 - RNA, 64 nt, hsa; identical to SEQ ID NO: 166269

SEQ ID NO: 537196 - RNA, 64 nt, hsa; identical to SEQ ID NO: 166270

SEQ ID NO: 537197 - RNA, 64 nt, hsa; identical to SEQ ID NO: 166271

SEQ ID NO: 537198 - RNA, 64 nt, hsa; identical to SEQ ID NO: 166272

SEQ ID NO: 537199 - RNA, 64 nt, hsa; identical to SEQ ID NO: 166273

SEQ ID NO: 537200 - RNA, 64 nt, hsa; identical to SEQ ID NO: 166274

SEQ ID NO: 537201 - RNA, 64 nt, hsa; identical to SEQ ID NO: 166275

SEQ ID NO: 537202 - RNA, 64 nt, hsa; identical to SEQ ID NO: 166276

SEQ ID NO: 537203 - RNA, 64 nt, hsa; identical to SEQ ID NO: 166277

SEQ ID NO: 537204 - RNA, 64 nt, hsa; identical to SEQ ID NO: 166278

SEQ ID NO: 537205 - RNA, 64 nt, hsa; identical to SEQ ID NO: 166279

SEQ ID NO: 537206 - RNA, 64 nt, hsa; identical to SEQ ID NO: 166280

SEQ ID NO: 537207 - RNA, 64 nt, hsa; identical to SEQ ID NO: 166281

SEQ ID NO: 537208 - RNA, 64 nt, hsa; identical to SEQ ID NO: 166282

SEQ ID NO: 537209 - RNA, 64 nt, hsa; identical to SEQ ID NO: 166283

SEQ ID NO: 537210 - RNA, 64 nt, hsa; identical to SEQ ID NO: 166284

SEQ ID NO: 537211 - RNA, 64 nt, hsa; identical to SEQ ID NO: 166285

SEQ ID NO: 537212 - RNA, 64 nt, hsa; identical to SEQ ID NO: 166286

SEQ ID NO: 537213 - RNA, 64 nt, hsa; identical to SEQ ID NO: 166287

SEQ ID NO: 537214 - RNA, 64 nt, hsa; identical to SEQ ID NO: 166288

SEQ ID NO: 537215 - RNA, 64 nt, hsa; identical to SEQ ID NO: 166289

SEQ ID NO: 537216 - RNA, 64 nt, hsa; identical to SEQ ID NO: 166290

SEQ ID NO: 537217 - RNA, 64 nt, hsa; identical to SEQ ID NO: 166291

SEQ ID NO: 537218 - RNA, 64 nt, hsa; identical to SEQ ID NO: 166292

SEQ ID NO: 537219 - RNA, 64 nt, hsa; identical to SEQ ID NO: 166293

SEQ ID NO: 537220 - RNA, 64 nt, hsa; identical to SEQ ID NO: 166294

SEQ ID NO: 537221 - RNA, 64 nt, hsa; identical to SEQ ID NO: 166295

SEQ ID NO: 537222 - RNA, 64 nt, hsa; identical to SEQ ID NO: 166296

SEQ ID NO: 537223 - RNA, 64 nt, hsa; identical to SEQ ID NO: 166297

SEQ ID NO: 537224 - RNA, 64 nt, hsa; identical to SEQ ID NO: 166298

SEQ ID NO: 537225 - RNA, 64 nt, hsa; identical to SEQ ID NO: 166299

SEQ ID NO: 537226 - RNA, 64 nt, hsa; identical to SEQ ID NO: 166300

SEQ ID NO: 537227 - RNA, 64 nt, hsa; identical to SEQ ID NO: 166301

SEQ ID NO: 537228 - RNA, 64 nt, hsa; identical to SEQ ID NO: 166302

SEQ ID NO: 537229 - RNA, 64 nt, hsa; identical to SEQ ID NO: 166303

SEQ ID NO: 537230 - RNA, 64 nt, hsa; identical to SEQ ID NO: 166304

SEQ ID NO: 537231 - RNA, 64 nt, hsa; identical to SEQ ID NO: 166305

SEQ ID NO: 537232 - RNA, 64 nt, hsa; identical to SEQ ID NO: 166306

SEQ ID NO: 537233 - RNA, 64 nt, hsa; identical to SEQ ID NO: 166307

SEQ ID NO: 537234 - RNA, 64 nt, hsa; identical to SEQ ID NO: 166308

SEQ ID NO: 537235 - RNA, 64 nt, hsa; identical to SEQ ID NO: 166309

SEQ ID NO: 537236 - RNA, 64 nt, hsa; identical to SEQ ID NO: 166310

SEQ ID NO: 537237 - RNA, 64 nt, hsa; identical to SEQ ID NO: 166311

SEQ ID NO: 537238 - RNA, 64 nt, hsa; identical to SEQ ID NO: 166312

SEQ ID NO: 537239 - RNA, 64 nt, hsa; identical to SEQ ID NO: 166313

SEQ ID NO: 537240 - RNA, 64 nt, hsa; identical to SEQ ID NO: 166314

SEQ ID NO: 537241 - RNA, 64 nt, hsa; identical to SEQ ID NO: 166315

SEQ ID NO: 537242 - RNA, 64 nt, hsa; identical to SEQ ID NO: 284748

SEQ ID NO: 537243 - RNA, 64 nt, hsa; identical to SEQ ID NO: 284749

SEQ ID NO: 537244 - RNA, 64 nt, hsa; identical to SEQ ID NO: 284750

SEQ ID NO: 537245 - RNA, 64 nt, hsa; identical to SEQ ID NO: 284751

SEQ ID NO: 537246 - RNA, 64 nt, hsa; identical to SEQ ID NO: 284752

SEQ ID NO: 537247 - RNA, 64 nt, hsa; identical to SEQ ID NO: 284753

SEQ ID NO: 537248 - RNA, 64 nt, hsa; identical to SEQ ID NO: 284754

SEQ ID NO: 537249 - RNA, 64 nt, hsa; identical to SEQ ID NO: 284755

SEQ ID NO: 537250 - RNA, 64 nt, hsa; identical to SEQ ID NO: 284756

SEQ ID NO: 537251 - RNA, 64 nt, hsa; identical to SEQ ID NO: 284757

SEQ ID NO: 537252 - RNA, 64 nt, hsa; identical to SEQ ID NO: 284758

SEQ ID NO: 537253 - RNA, 64 nt, hsa; identical to SEQ ID NO: 284759

SEQ ID NO: 537254 - RNA, 64 nt, hsa; identical to SEQ ID NO: 284760

SEQ ID NO: 537255 - RNA, 64 nt, hsa; identical to SEQ ID NO: 284761

SEQ ID NO: 537256 - RNA, 64 nt, hsa; identical to SEQ ID NO: 284762

SEQ ID NO: 537257 - RNA, 64 nt, hsa; identical to SEQ ID NO: 284763

SEQ ID NO: 537258 - RNA, 64 nt, hsa; identical to SEQ ID NO: 284764

SEQ ID NO: 537259 - RNA, 64 nt, hsa; identical to SEQ ID NO: 284765

SEQ ID NO: 537260 - RNA, 64 nt, hsa; identical to SEQ ID NO: 284766

SEQ ID NO: 537261 - RNA, 64 nt, hsa; identical to SEQ ID NO: 284767

SEQ ID NO: 537262 - RNA, 64 nt, hsa; identical to SEQ ID NO: 284768

SEQ ID NO: 537263 - RNA, 64 nt, hsa; identical to SEQ ID NO: 284769

SEQ ID NO: 537264 - RNA, 64 nt, hsa; identical to SEQ ID NO: 284770

SEQ ID NO: 537265 - RNA, 64 nt, hsa; identical to SEQ ID NO: 284771

SEQ ID NO: 537266 - RNA, 64 nt, hsa; identical to SEQ ID NO: 284772

SEQ ID NO: 537267 - RNA, 64 nt, hsa; identical to SEQ ID NO: 284773

SEQ ID NO: 537268 - RNA, 64 nt, hsa; identical to SEQ ID NO: 284774

SEQ ID NO: 537269 - RNA, 64 nt, hsa; identical to SEQ ID NO: 284775

SEQ ID NO: 537270 - RNA, 64 nt, hsa; identical to SEQ ID NO: 284776

SEQ ID NO: 537271 - RNA, 64 nt, hsa; identical to SEQ ID NO: 284777

SEQ ID NO: 537272 - RNA, 64 nt, hsa; identical to SEQ ID NO: 284778

SEQ ID NO: 537273 - RNA, 64 nt, hsa; identical to SEQ ID NO: 284779

SEQ ID NO: 537274 - RNA, 64 nt, hsa; identical to SEQ ID NO: 284780

SEQ ID NO: 537275 - RNA, 64 nt, hsa; identical to SEQ ID NO: 284781

SEQ ID NO: 537276 - RNA, 64 nt, hsa; identical to SEQ ID NO: 284782

SEQ ID NO: 537277 - RNA, 64 nt, hsa; identical to SEQ ID NO: 284783

SEQ ID NO: 537278 - RNA, 64 nt, hsa; identical to SEQ ID NO: 284784

SEQ ID NO: 537279 - RNA, 64 nt, hsa; identical to SEQ ID NO: 284785

SEQ ID NO: 537280 - RNA, 64 nt, hsa; identical to SEQ ID NO: 284786

SEQ ID NO: 537281 - RNA, 64 nt, hsa; identical to SEQ ID NO: 284787

SEQ ID NO: 537282 - RNA, 64 nt, hsa; identical to SEQ ID NO: 284788

SEQ ID NO: 537283 - RNA, 64 nt, hsa; identical to SEQ ID NO: 284789

SEQ ID NO: 537284 - RNA, 64 nt, hsa; identical to SEQ ID NO: 284790

SEQ ID NO: 537285 - RNA, 64 nt, hsa; identical to SEQ ID NO: 284791

SEQ ID NO: 537286 - RNA, 64 nt, hsa; identical to SEQ ID NO: 284792

SEQ ID NO: 537287 - RNA, 64 nt, hsa; identical to SEQ ID NO: 284793

SEQ ID NO: 537288 - RNA, 64 nt, hsa; identical to SEQ ID NO: 284794

SEQ ID NO: 537289 - RNA, 64 nt, hsa; identical to SEQ ID NO: 284795

SEQ ID NO: 537290 - RNA, 64 nt, hsa; identical to SEQ ID NO: 284796

SEQ ID NO: 537291 - RNA, 64 nt, hsa; identical to SEQ ID NO: 284797

SEQ ID NO: 537292 - RNA, 64 nt, hsa; identical to SEQ ID NO: 284798

SEQ ID NO: 537293 - RNA, 64 nt, hsa; identical to SEQ ID NO: 284799

SEQ ID NO: 537294 - RNA, 64 nt, hsa; identical to SEQ ID NO: 284800

SEQ ID NO: 537295 - RNA, 64 nt, hsa; identical to SEQ ID NO: 284801

SEQ ID NO: 537296 - RNA, 64 nt, hsa; identical to SEQ ID NO: 284802

SEQ ID NO: 537297 - RNA, 64 nt, hsa; identical to SEQ ID NO: 284803

SEQ ID NO: 537298 - RNA, 64 nt, hsa; identical to SEQ ID NO: 284804

SEQ ID NO: 537299 - RNA, 64 nt, hsa; identical to SEQ ID NO: 284805

SEQ ID NO: 537300 - RNA, 64 nt, hsa; identical to SEQ ID NO: 284806

SEQ ID NO: 537301 - RNA, 64 nt, hsa; identical to SEQ ID NO: 284807

SEQ ID NO: 537302 - RNA, 64 nt, hsa; identical to SEQ ID NO: 284808

SEQ ID NO: 537303 - RNA, 64 nt, hsa; identical to SEQ ID NO: 284809

SEQ ID NO: 537304 - RNA, 64 nt, hsa; identical to SEQ ID NO: 284810

SEQ ID NO: 537305 - RNA, 64 nt, hsa; identical to SEQ ID NO: 284811

SEQ ID NO: 537306 - RNA, 64 nt, hsa; identical to SEQ ID NO: 284812

SEQ ID NO: 537307 - RNA, 64 nt, hsa; identical to SEQ ID NO: 284813

SEQ ID NO: 537308 - RNA, 64 nt, hsa; identical to SEQ ID NO: 284814

SEQ ID NO: 537309 - RNA, 64 nt, hsa; identical to SEQ ID NO: 284815

SEQ ID NO: 537310 - RNA, 64 nt, hsa; identical to SEQ ID NO: 284816

SEQ ID NO: 537311 - RNA, 64 nt, hsa; identical to SEQ ID NO: 284817

SEQ ID NO: 537312 - RNA, 64 nt, hsa; identical to SEQ ID NO: 284818

SEQ ID NO: 537313 - RNA, 64 nt, hsa; identical to SEQ ID NO: 284819

SEQ ID NO: 537314 - RNA, 64 nt, hsa; identical to SEQ ID NO: 284820

SEQ ID NO: 537315 - RNA, 64 nt, hsa; identical to SEQ ID NO: 284821

SEQ ID NO: 537316 - RNA, 64 nt, hsa; identical to SEQ ID NO: 284822

SEQ ID NO: 537317 - RNA, 64 nt, hsa; identical to SEQ ID NO: 284823

SEQ ID NO: 537318 - RNA, 64 nt, hsa; identical to SEQ ID NO: 284824

SEQ ID NO: 537319 - RNA, 57 nt, hsa; identical to SEQ ID NO: 284825

SEQ ID NO: 537320 - RNA, 52 nt, hsa; identical to SEQ ID NO: 284826

SEQ ID NO: 537321 - RNA, 64 nt, hsa; identical to SEQ ID NO: 284827

SEQ ID NO: 537322 - RNA, 64 nt, hsa; identical to SEQ ID NO: 284828

SEQ ID NO: 537323 - RNA, 64 nt, hsa; identical to SEQ ID NO: 284829

SEQ ID NO: 537324 - RNA, 64 nt, hsa; identical to SEQ ID NO: 284830

SEQ ID NO: 537325 - RNA, 64 nt, hsa; identical to SEQ ID NO: 284831

SEQ ID NO: 537326 - RNA, 64 nt, hsa; identical to SEQ ID NO: 284832

SEQ ID NO: 537327 - RNA, 64 nt, hsa; identical to SEQ ID NO: 284833

SEQ ID NO: 537328 - RNA, 64 nt, hsa; identical to SEQ ID NO: 284834

SEQ ID NO: 537329 - RNA, 64 nt, hsa; identical to SEQ ID NO: 284835

SEQ ID NO: 537330 - RNA, 64 nt, hsa; identical to SEQ ID NO: 284836

SEQ ID NO: 537331 - RNA, 64 nt, hsa; identical to SEQ ID NO: 284837

SEQ ID NO: 537332 - RNA, 64 nt, hsa; identical to SEQ ID NO: 284838

SEQ ID NO: 537333 - RNA, 64 nt, hsa; identical to SEQ ID NO: 284839

SEQ ID NO: 537334 - RNA, 64 nt, hsa; identical to SEQ ID NO: 284840

SEQ ID NO: 537335 - RNA, 64 nt, hsa; identical to SEQ ID NO: 22031

SEQ ID NO: 537336 - RNA, 64 nt, hsa; identical to SEQ ID NO: 22032

SEQ ID NO: 537337 - RNA, 64 nt, hsa; identical to SEQ ID NO: 22033

SEQ ID NO: 537338 - RNA, 64 nt, hsa; identical to SEQ ID NO: 22034

SEQ ID NO: 537339 - RNA, 64 nt, hsa; identical to SEQ ID NO: 22035

SEQ ID NO: 537340 - RNA, 64 nt, hsa; identical to SEQ ID NO: 22036

SEQ ID NO: 537341 - RNA, 64 nt, hsa; identical to SEQ ID NO: 22037

SEQ ID NO: 537342 - RNA, 64 nt, hsa; identical to SEQ ID NO: 22038

SEQ ID NO: 537343 - RNA, 64 nt, hsa; identical to SEQ ID NO: 22039

SEQ ID NO: 537344 - RNA, 64 nt, hsa; identical to SEQ ID NO: 22040

SEQ ID NO: 537345 - RNA, 64 nt, hsa; identical to SEQ ID NO: 22041

SEQ ID NO: 537346 - RNA, 64 nt, hsa; identical to SEQ ID NO: 22042

SEQ ID NO: 537347 - RNA, 64 nt, hsa; identical to SEQ ID NO: 22043

SEQ ID NO: 537348 - RNA, 64 nt, hsa; identical to SEQ ID NO: 22044

SEQ ID NO: 537349 - RNA, 64 nt, hsa; identical to SEQ ID NO: 22045

SEQ ID NO: 537350 - RNA, 64 nt, hsa; identical to SEQ ID NO: 22046

SEQ ID NO: 537351 - RNA, 64 nt, hsa; identical to SEQ ID NO: 22047

SEQ ID NO: 537352 - RNA, 64 nt, hsa; identical to SEQ ID NO: 22048

SEQ ID NO: 537353 - RNA, 64 nt, hsa; identical to SEQ ID NO: 22049

SEQ ID NO: 537354 - RNA, 64 nt, hsa; identical to SEQ ID NO: 22050

SEQ ID NO: 537355 - RNA, 64 nt, hsa; identical to SEQ ID NO: 22051

SEQ ID NO: 537356 - RNA, 64 nt, hsa; identical to SEQ ID NO: 22052

SEQ ID NO: 537357 - RNA, 64 nt, hsa; identical to SEQ ID NO: 22053

SEQ ID NO: 537358 - RNA, 64 nt, hsa; identical to SEQ ID NO: 22054

SEQ ID NO: 537359 - RNA, 64 nt, hsa; identical to SEQ ID NO: 22055

SEQ ID NO: 537360 - RNA, 64 nt, hsa; identical to SEQ ID NO: 22056

SEQ ID NO: 537361 - RNA, 64 nt, hsa; identical to SEQ ID NO: 22057

SEQ ID NO: 537362 - RNA, 64 nt, hsa; identical to SEQ ID NO: 22058

SEQ ID NO: 537363 - RNA, 64 nt, hsa; identical to SEQ ID NO: 22059

SEQ ID NO: 537364 - RNA, 64 nt, hsa; identical to SEQ ID NO: 22060

SEQ ID NO: 537365 - RNA, 64 nt, hsa; identical to SEQ ID NO: 22061

SEQ ID NO: 537366 - RNA, 64 nt, hsa; identical to SEQ ID NO: 22062

SEQ ID NO: 537367 - RNA, 64 nt, hsa; identical to SEQ ID NO: 22063

SEQ ID NO: 537368 - RNA, 64 nt, hsa; identical to SEQ ID NO: 22064

SEQ ID NO: 537369 - RNA, 64 nt, hsa; identical to SEQ ID NO: 22065

SEQ ID NO: 537370 - RNA, 64 nt, hsa; identical to SEQ ID NO: 22066

SEQ ID NO: 537371 - RNA, 64 nt, hsa; identical to SEQ ID NO: 22067

SEQ ID NO: 537372 - RNA, 52 nt, hsa; identical to SEQ ID NO: 22068

SEQ ID NO: 537373 - RNA, 64 nt, hsa; identical to SEQ ID NO: 22069

SEQ ID NO: 537374 - RNA, 64 nt, hsa; identical to SEQ ID NO: 22070

SEQ ID NO: 537375 - RNA, 64 nt, hsa; identical to SEQ ID NO: 22071

SEQ ID NO: 537376 - RNA, 64 nt, hsa; identical to SEQ ID NO: 22072

SEQ ID NO: 537377 - RNA, 64 nt, hsa; identical to SEQ ID NO: 22073

SEQ ID NO: 537378 - RNA, 64 nt, hsa; identical to SEQ ID NO: 22074

SEQ ID NO: 537379 - RNA, 64 nt, hsa; identical to SEQ ID NO: 22075

SEQ ID NO: 537380 - RNA, 64 nt, hsa; identical to SEQ ID NO: 22076

SEQ ID NO: 537381 - RNA, 64 nt, hsa; identical to SEQ ID NO: 22077

SEQ ID NO: 537382 - RNA, 64 nt, hsa; identical to SEQ ID NO: 22078

SEQ ID NO: 537383 - RNA, 64 nt, hsa; identical to SEQ ID NO: 22079

SEQ ID NO: 537384 - RNA, 64 nt, hsa; identical to SEQ ID NO: 22080

SEQ ID NO: 537385 - RNA, 64 nt, hsa; identical to SEQ ID NO: 22081

SEQ ID NO: 537386 - RNA, 64 nt, hsa; identical to SEQ ID NO: 22082

SEQ ID NO: 537387 - RNA, 53 nt, hsa; identical to SEQ ID NO: 22083

SEQ ID NO: 537388 - RNA, 64 nt, hsa; identical to SEQ ID NO: 22084

SEQ ID NO: 537389 - RNA, 64 nt, hsa; identical to SEQ ID NO: 22085

SEQ ID NO: 537390 - RNA, 64 nt, hsa; identical to SEQ ID NO: 22086

SEQ ID NO: 537391 - RNA, 64 nt, hsa; identical to SEQ ID NO: 22087

SEQ ID NO: 537392 - RNA, 64 nt, hsa; identical to SEQ ID NO: 22088

SEQ ID NO: 537393 - RNA, 64 nt, hsa; identical to SEQ ID NO: 22089

SEQ ID NO: 537394 - RNA, 64 nt, hsa; identical to SEQ ID NO: 22090

SEQ ID NO: 537395 - RNA, 64 nt, hsa; identical to SEQ ID NO: 22091

SEQ ID NO: 537396 - RNA, 64 nt, hsa
agccaccaccugugcggcgcuugcuccgaggggucagcaagagcaacugauggcugccacuucc

SEQ ID NO: 537397 - RNA, 64 nt, hsa
ccgcaaucugcuccagauucaagcaguaauauuucagcaagaggagguggucaugggaagccag

SEQ ID NO: 537398 - RNA, 64 nt, hsa
cgaaagaauuaagagaauaccuagaacauauccucagcaagaaacaaaaccaaacuggacucuc

SEQ ID NO: 537399 - RNA, 64 nt, hsa
aaucaccuucuuuauaaagcgucagucaugcuuccagcaagaggcagcaucagucauggcuuua

SEQ ID NO: 537400 - RNA, 64 nt, hsa
agcuaugaucagcugcaauccacccuggguaacacagcaagacucuaucucaaaaaaaagaaaa

SEQ ID NO: 537401 - RNA, 64 nt, hsa
aauauagaaacucacauaacuagcccagguaacacagcaagaccccaucucuacaaaaauauua

SEQ ID NO: 537402 - RNA, 64 nt, hsa
auggacuguguuacaguuugucucuaacaugaaacagcaagagguagcccccucucccguccuc

SEQ ID NO: 537403 - RNA, 64 nt, hsa
cugcucauuguagauggagaauucaacauaaauacagcaagaaaauguguuugggcuucugaag

SEQ ID NO: 537404 - RNA, 64 nt, hsa
gcucuuaaggagaauuguauuucuccagaagcugcagcaagagguacagcucaacaaaggaaaa

SEQ ID NO: 537405 - RNA, 64 nt, hsa
ccucagcucuguacacaugauaugcaacaaagggcagcaagaaaugcuggguccaccuaauuua

SEQ ID NO: 537406 - RNA, 64 nt, hsa
ucuucaaacugugaagcauuuacagaaacgcauccagcaagaauauugucccuuugagcagaaa

SEQ ID NO: 537407 - RNA, 64 nt, hsa
ucaguaugcugccccugucuugcugucaugaaaucagcaagagaggaugacacaucaaauaaua

SEQ ID NO: 537408 - RNA, 64 nt, hsa
uuaaacauaagccagaaauuaaaaugacuauagacagcaagaauugagcuaauaauauguuuua

SEQ ID NO: 537409 - RNA, 64 nt, hsa
aauugagcuaauaauauguuuuaacucuuaacaccagcaagaagucagucauuuauugaaguuu

SEQ ID NO: 537410 - RNA, 64 nt, hsa
gaaagaugauuugcaaugggauguaugaauacagcagcaagaaaaaaaaaugccauaauacaaa

SEQ ID NO: 537411 - RNA, 64 nt, hsa
uguuuauuagaugaauuauccuauuucaguacuucagcaagagagaaccuaacuguaucuugag

SEQ ID NO: 537412 - RNA, 64 nt, hsa
uggugggaggcaaaaagcacuucuuacauggcggcagcaagagaaaaugagaaagaagcaaaag

SEQ ID NO: 537413 - RNA, 64 nt, hsa
agggaaagaugcugccagucucuuugcuaaaacacagcaagagucaccuuuacuccaguuccca

SEQ ID NO: 537414 - RNA, 64 nt, hsa
uacaugucaggaaccuauggcuggcuuuccuuagcagcaagaacuugagagaaaaacacaucug

SEQ ID NO: 537415 - RNA, 64 nt, hsa
ccugaagacacaacuugacuuauaacauagugcacagcaagagcuacauccaaguguccuauua

SEQ ID NO: 537416 - RNA, 64 nt, hsa
ccuuggcccaggccaagauugagaagaucaagggcagcaagaaggccaucaagguaguccccau

SEQ ID NO: 537417 - RNA, 64 nt, hsa
cagaggagaagcuguuugaugcccccuuguccaucagcaagagagagcagcuggaacagcaggu

SEQ ID NO: 537418 - RNA, 64 nt, hsa
cuuaaaguucagcguguuaaccuaacauaaaacacagcaagaaucugguugucugaacuauuuu

SEQ ID NO: 537419 - RNA, 64 nt, hsa
aauauauaugggcuuaaucauuuaaaauuuguugcagcaagaacuuuccuaccuguaggcaaua

SEQ ID NO: 537420 - RNA, 64 nt, hsa
ugagcucagccuccaaggcuuuaaagccacauuucagcaagagaaagcgcugagagcucgcagg

SEQ ID NO: 537421 - RNA, 64 nt, hsa
ugagccuagacguuaaagaccagccugggcaacacagcaagacccaucucuacaagaaauuuaa

SEQ ID NO: 537422 - RNA, 64 nt, hsa
ugaagcuuugaaauuagacuaacaaagcuccagacagcaagagcccaggugcacugcucacacc

SEQ ID NO: 537423 - RNA, 64 nt, hsa
augagauuuuuuuuuggaggggggagggucuacacagcaagagaacagaaauacugugucucau

SEQ ID NO: 537424 - RNA, 64 nt, hsa; identical to SEQ ID NO: 392717

SEQ ID NO: 537425 - RNA, 64 nt, hsa; identical to SEQ ID NO: 392718

SEQ ID NO: 537426 - RNA, 64 nt, hsa; identical to SEQ ID NO: 392719

SEQ ID NO: 537427 - RNA, 64 nt, hsa; identical to SEQ ID NO: 392720

SEQ ID NO: 537428 - RNA, 64 nt, hsa; identical to SEQ ID NO: 392721

SEQ ID NO: 537429 - RNA, 64 nt, hsa; identical to SEQ ID NO: 392722

SEQ ID NO: 537430 - RNA, 64 nt, hsa; identical to SEQ ID NO: 392723

SEQ ID NO: 537431 - RNA, 64 nt, hsa; identical to SEQ ID NO: 392724

SEQ ID NO: 537432 - RNA, 64 nt, hsa; identical to SEQ ID NO: 392725

SEQ ID NO: 537433 - RNA, 64 nt, hsa; identical to SEQ ID NO: 392726

SEQ ID NO: 537434 - RNA, 64 nt, hsa; identical to SEQ ID NO: 297865

SEQ ID NO: 537435 - RNA, 64 nt, hsa; identical to SEQ ID NO: 297866

SEQ ID NO: 537436 - RNA, 64 nt, hsa; identical to SEQ ID NO: 297867

SEQ ID NO: 537437 - RNA, 64 nt, hsa; identical to SEQ ID NO: 297868

SEQ ID NO: 537438 - RNA, 64 nt, hsa; identical to SEQ ID NO: 297869

SEQ ID NO: 537439 - RNA, 64 nt, hsa; identical to SEQ ID NO: 297870

SEQ ID NO: 537440 - RNA, 64 nt, hsa; identical to SEQ ID NO: 297871

SEQ ID NO: 537441 - RNA, 64 nt, hsa; identical to SEQ ID NO: 297872

SEQ ID NO: 537442 - RNA, 64 nt, hsa; identical to SEQ ID NO: 297873

SEQ ID NO: 537443 - RNA, 64 nt, hsa; identical to SEQ ID NO: 297874

SEQ ID NO: 537444 - RNA, 64 nt, hsa; identical to SEQ ID NO: 297875

SEQ ID NO: 537445 - RNA, 64 nt, hsa; identical to SEQ ID NO: 297876

SEQ ID NO: 537446 - RNA, 64 nt, hsa; identical to SEQ ID NO: 297877

SEQ ID NO: 537447 - RNA, 64 nt, hsa; identical to SEQ ID NO: 297878

SEQ ID NO: 537448 - RNA, 64 nt, hsa; identical to SEQ ID NO: 297879

SEQ ID NO: 537449 - RNA, 64 nt, hsa; identical to SEQ ID NO: 297880

SEQ ID NO: 537450 - RNA, 64 nt, hsa; identical to SEQ ID NO: 297881

SEQ ID NO: 537451 - RNA, 64 nt, hsa; identical to SEQ ID NO: 297882

SEQ ID NO: 537452 - RNA, 64 nt, hsa; identical to SEQ ID NO: 297883

SEQ ID NO: 537453 - RNA, 64 nt, hsa; identical to SEQ ID NO: 297884

SEQ ID NO: 537454 - RNA, 64 nt, hsa; identical to SEQ ID NO: 297885

SEQ ID NO: 537455 - RNA, 64 nt, hsa; identical to SEQ ID NO: 297886

SEQ ID NO: 537456 - RNA, 64 nt, hsa; identical to SEQ ID NO: 297887

SEQ ID NO: 537457 - RNA, 64 nt, hsa; identical to SEQ ID NO: 297888

SEQ ID NO: 537458 - RNA, 64 nt, hsa
acuggauuaaacaaauucacauaaugccaaauacacaauguauuuauagcaacguauaauuugc

SEQ ID NO: 537459 - RNA, 64 nt, hsa
uaucaaggacaaccacccuagcuucuuagugaagacaauguacaguuauccguuagaucaagac

SEQ ID NO: 537460 - RNA, 64 nt, hsa
uaaaaacaaaacaauguagaguuuuauuuauugaacaauguagucacuugaagguuuuguguau

SEQ ID NO: 537461 - RNA, 64 nt, hsa
cugaguuauaagcucacuaggcuguaaaaacaaaacaauguagaguuuuauuuauugaacaaug

SEQ ID NO: 537462 - RNA, 64 nt, hsa
gaucuguuguacagcuuggugacuguaauuaacaacaauguauuuugaaagucacugaguaaau

SEQ ID NO: 537463 - RNA, 64 nt, hsa
uaaugcacguuaauuagcuauauugagccauuccacaauguauagauauuucaaaacauguuac

SEQ ID NO: 537464 - RNA, 64 nt, hsa
aaugaacguuacaucacucuaaccugaacagcucacaauguagcuguaaauauaaaaaaugaga

SEQ ID NO: 537465 - RNA, 64 nt, hsa
acuuagaagguuuuuuauuauaguccuacaaaagacaauguauaagcuguaacagaauuuugaa

SEQ ID NO: 537466 - RNA, 64 nt, hsa
uuguuggcaaagagugcuacaccguuucaaugaaacaauguauguuuguuuuaacugaacuaaa

SEQ ID NO: 537467 - RNA, 64 nt, hsa
aaaaugcucaccuacuggaagugugaauuacuugacaauguauggcuuaguuguguucauguuu

SEQ ID NO: 537468 - RNA, 64 nt, hsa
cagccagcuuaaacccauacaauguauguacaauacaauguacaauuaugucucuugagcauca

SEQ ID NO: 537469 - RNA, 64 nt, hsa
ugaaauauauaauauucagccagcuuaaacccauacaauguauguacaauacaauguacaauua

SEQ ID NO: 537470 - RNA, 64 nt, hsa
aaaagaaagguacaggcuuacgaaaaugaucuuuacaauguaucccagcuuucacccccacaug

SEQ ID NO: 537471 - RNA, 64 nt, hsa
aaaugcuacgccauuauaagccaguggaguaauuacaauguauuggaugaaaacauaaggcagu

SEQ ID NO: 537472 - RNA, 64 nt, hsa
aucacaaaagaagugaaaagggccgguuccugccuuaacugaugacauuccaccauugugauuu

SEQ ID NO: 537473 - RNA, 64 nt, hsa
acauuccaccauugugauuuguuccugccccaccuuaacugagcgauuaaccugugaacuuccu

SEQ ID NO: 537474 - RNA, 64 nt, hsa
guacuuuugaaacaauuacauugguucucuugguuuaacugagguuuaugaauauucaaaccuu

SEQ ID NO: 537475 - RNA, 64 nt, hsa
gaaguuauguuacaacugaucagcccuauaugaauuaacugaucagcccuauaugaaacauaag

SEQ ID NO: 537476 - RNA, 64 nt, hsa
uucuuauugauauuuuuguaacagaauauagcucuuaacugaaaauccagaaccagaaacauaa

SEQ ID NO: 537477 - RNA, 64 nt, hsa
aauugcucuggucaaaaccaagcacaccauagccuuaacugaauauuuaggaaaucugccuaau

SEQ ID NO: 537478 - RNA, 64 nt, hsa
guuugccauuguugcagaguuaucuguacuuuguuuaacugaaaaaaauguagaaauauaugua

SEQ ID NO: 537479 - RNA, 64 nt, hsa
gcucaaauucucuaccucuucagggcuaauacuuuuaacugagcugcugccuauagugucuuuu

SEQ ID NO: 537480 - RNA, 64 nt, hsa
gagguuuaccuagugacaccaaauuaucgguauuuuaacugaauuuacccauugacuaagaaug

SEQ ID NO: 537481 - RNA, 64 nt, hsa
aaucaagguugaggaguggggcuggggagaggacuuaacugacuuaagaaguaggaaaacaaaa

SEQ ID NO: 537482 - RNA, 64 nt, hsa
gucggugcuaauggauggaacuccugcacaaguuuuaacugaacaagaaaucccagcaaaaggc

SEQ ID NO: 537483 - RNA, 64 nt, hsa
aaauaaaaugacacaaggccaaaaacaaauggguuuaacugaccagagcgagagaacucugcac

SEQ ID NO: 537484 - RNA, 64 nt, hsa
uucccccaauuuuuuaaacuaacaaaauggaauguuaacugaauggaauuaaacauagcaauug

SEQ ID NO: 537485 - RNA, 64 nt, hsa
gaauguauuaauauauugcuauuagguuaaucuguuaacugaaugcuuugaucagcauugaggu

SEQ ID NO: 537486 - RNA, 64 nt, hsa
gaauccuacaaaugugaaaaauguggcaaauccuuuaacugauccucaacuuuuacuaaacaua

SEQ ID NO: 537487 - RNA, 64 nt, hsa
aaacccuacaaaugugaagucuguggcaaagcuuuuaacugauucucaacucuuacuacaugua

SEQ ID NO: 537488 - RNA, 64 nt, hsa
uacuugcacuuauuaucuuuugucuaauuuaaccuuaacugaauucuccguuucuccuggaggc

SEQ ID NO: 537489 - RNA, 64 nt, hsa
gacauagaaugugugcuuauucucagaagguucauuaacugaggugaugaguuaacaacuaguu

SEQ ID NO: 537490 - RNA, 64 nt, hsa
uuuaugaguauaagaaagguuaggcauauuuucauuaacugaauaaacgacuugauuuauauaa

SEQ ID NO: 537491 - RNA, 64 nt, hsa
acuaauaauguuuauuaucuuuccuaauaaugcauuaacugauuaaucagguguuuaaauuuuu

SEQ ID NO: 537492 - RNA, 64 nt, hsa
ucuggaaacuuucauaucaauaauugauuauguauuaacugaaacaaaagacuagagaaagaca

SEQ ID NO: 537493 - RNA, 64 nt, hsa
acuagagaaagacacagugggaauugauuauguauuaacugaggaauaaaagacugaagaaaga

SEQ ID NO: 537494 - RNA, 64 nt, hsa
cugcuuuaagauauauaccacuauguauauccaguuaacugagagaauuuugacucucuuaaua

SEQ ID NO: 537495 - RNA, 64 nt, hsa
aucacuauuuguagaaacugucaggucaaaauauuuaacugacuguugacauguauuuucuuuu

SEQ ID NO: 537496 - RNA, 64 nt, hsa
cauuuagggguuccuuugaugaugacuacugcuguuaacugaccucagcauuaaaaaaaaaaaa

SEQ ID NO: 537497 - RNA, 64 nt, hsa
aaugggaggguaauaaagaugaaagaccaacauuuuaacugauggaucccuuaagcuacagaau

SEQ ID NO: 537498 - RNA, 64 nt, hsa
cuucccaguugagcucccaagaccaggacccacuggggcauauaaaaaagucaaaaaucaaaau

SEQ ID NO: 537499 - RNA, 64 nt, hsa
cuucccaguugagcucccaagaccaggacccacuggggcauauaaaaucucugcuguauccuuu

SEQ ID NO: 537500 - RNA, 64 nt, hsa
ugaaaaaguugaugcccaagggagaaaugagaauuagcuuaauugcugccuuuaauguguuuuu

SEQ ID NO: 537501 - RNA, 64 nt, hsa
auuagaacuucuagcuaaugcucaggugagaucauagcuuaaauacauugaaaaaacuaaagua

SEQ ID NO: 537502 - RNA, 64 nt, hsa
cgugaaucccgagggagccgguggcauacaccguuagcuuaaccuuagcuuaaacuagcugaag

SEQ ID NO: 537503 - RNA, 64 nt, hsa
agggagccgguggcauacaccguuagcuuaaccuuagcuuaaacuagcugaaggcuccugugcc

SEQ ID NO: 537504 - RNA, 64 nt, hsa; identical to SEQ ID NO: 166430

SEQ ID NO: 537505 - RNA, 64 nt, hsa; identical to SEQ ID NO: 166431

SEQ ID NO: 537506 - RNA, 64 nt, hsa; identical to SEQ ID NO: 166432

SEQ ID NO: 537507 - RNA, 64 nt, hsa; identical to SEQ ID NO: 166433

SEQ ID NO: 537508 - RNA, 64 nt, hsa; identical to SEQ ID NO: 166434

SEQ ID NO: 537509 - RNA, 64 nt, hsa; identical to SEQ ID NO: 166435

SEQ ID NO: 537510 - RNA, 64 nt, hsa; identical to SEQ ID NO: 166436

SEQ ID NO: 537511 - RNA, 64 nt, hsa; identical to SEQ ID NO: 166437

SEQ ID NO: 537512 - RNA, 64 nt, hsa; identical to SEQ ID NO: 166438

SEQ ID NO: 537513 - RNA, 64 nt, hsa; identical to SEQ ID NO: 166439

SEQ ID NO: 537514 - RNA, 64 nt, hsa; identical to SEQ ID NO: 166440

SEQ ID NO: 537515 - RNA, 64 nt, hsa; identical to SEQ ID NO: 166441

SEQ ID NO: 537516 - RNA, 64 nt, hsa; identical to SEQ ID NO: 166442

SEQ ID NO: 537517 - RNA, 64 nt, hsa; identical to SEQ ID NO: 166443

SEQ ID NO: 537518 - RNA, 64 nt, hsa; identical to SEQ ID NO: 166444

SEQ ID NO: 537519 - RNA, 64 nt, hsa; identical to SEQ ID NO: 166445

SEQ ID NO: 537520 - RNA, 64 nt, hsa; identical to SEQ ID NO: 166446

SEQ ID NO: 537521 - RNA, 64 nt, hsa; identical to SEQ ID NO: 166447

SEQ ID NO: 537522 - RNA, 64 nt, hsa; identical to SEQ ID NO: 166448

SEQ ID NO: 537523 - RNA, 64 nt, hsa; identical to SEQ ID NO: 166449

SEQ ID NO: 537524 - RNA, 64 nt, hsa; identical to SEQ ID NO: 166450

SEQ ID NO: 537525 - RNA, 64 nt, hsa; identical to SEQ ID NO: 166451

SEQ ID NO: 537526 - RNA, 64 nt, hsa; identical to SEQ ID NO: 166452

SEQ ID NO: 537527 - RNA, 64 nt, hsa; identical to SEQ ID NO: 166453

SEQ ID NO: 537528 - RNA, 64 nt, hsa; identical to SEQ ID NO: 166454

SEQ ID NO: 537529 - RNA, 64 nt, hsa; identical to SEQ ID NO: 166455

SEQ ID NO: 537530 - RNA, 64 nt, hsa; identical to SEQ ID NO: 166456

SEQ ID NO: 537531 - RNA, 64 nt, hsa; identical to SEQ ID NO: 166457

SEQ ID NO: 537532 - RNA, 64 nt, hsa; identical to SEQ ID NO: 166458

SEQ ID NO: 537533 - RNA, 64 nt, hsa; identical to SEQ ID NO: 166459

SEQ ID NO: 537534 - RNA, 64 nt, hsa; identical to SEQ ID NO: 166460

SEQ ID NO: 537535 - RNA, 64 nt, hsa; identical to SEQ ID NO: 166461

SEQ ID NO: 537536 - RNA, 64 nt, hsa; identical to SEQ ID NO: 166462

SEQ ID NO: 537537 - RNA, 64 nt, hsa; identical to SEQ ID NO: 166463

SEQ ID NO: 537538 - RNA, 64 nt, hsa; identical to SEQ ID NO: 166464

SEQ ID NO: 537539 - RNA, 64 nt, hsa; identical to SEQ ID NO: 166465

SEQ ID NO: 537540 - RNA, 64 nt, hsa; identical to SEQ ID NO: 166466

SEQ ID NO: 537541 - RNA, 64 nt, hsa; identical to SEQ ID NO: 166467

SEQ ID NO: 537542 - RNA, 64 nt, hsa; identical to SEQ ID NO: 166468

SEQ ID NO: 537543 - RNA, 64 nt, hsa; identical to SEQ ID NO: 166469

SEQ ID NO: 537544 - RNA, 64 nt, hsa; identical to SEQ ID NO: 166470

SEQ ID NO: 537545 - RNA, 64 nt, hsa; identical to SEQ ID NO: 166471

SEQ ID NO: 537546 - RNA, 64 nt, hsa; identical to SEQ ID NO: 166472

SEQ ID NO: 537547 - RNA, 64 nt, hsa; identical to SEQ ID NO: 166473

SEQ ID NO: 537548 - RNA, 64 nt, hsa; identical to SEQ ID NO: 166474

SEQ ID NO: 537549 - RNA, 64 nt, hsa; identical to SEQ ID NO: 166475

SEQ ID NO: 537550 - RNA, 64 nt, hsa; identical to SEQ ID NO: 166476

SEQ ID NO: 537551 - RNA, 64 nt, hsa; identical to SEQ ID NO: 166477

SEQ ID NO: 537552 - RNA, 64 nt, hsa; identical to SEQ ID NO: 166478

SEQ ID NO: 537553 - RNA, 64 nt, hsa; identical to SEQ ID NO: 166479

SEQ ID NO: 537554 - RNA, 64 nt, hsa; identical to SEQ ID NO: 166480

SEQ ID NO: 537555 - RNA, 64 nt, hsa; identical to SEQ ID NO: 166481

SEQ ID NO: 537556 - RNA, 64 nt, hsa; identical to SEQ ID NO: 166482

SEQ ID NO: 537557 - RNA, 64 nt, hsa; identical to SEQ ID NO: 166483

SEQ ID NO: 537558 - RNA, 64 nt, hsa; identical to SEQ ID NO: 166484

SEQ ID NO: 537559 - RNA, 64 nt, hsa; identical to SEQ ID NO: 166485

SEQ ID NO: 537560 - RNA, 64 nt, hsa; identical to SEQ ID NO: 166486

SEQ ID NO: 537561 - RNA, 64 nt, hsa; identical to SEQ ID NO: 166487

SEQ ID NO: 537562 - RNA, 64 nt, hsa; identical to SEQ ID NO: 166488

SEQ ID NO: 537563 - RNA, 64 nt, hsa; identical to SEQ ID NO: 166489

SEQ ID NO: 537564 - RNA, 64 nt, hsa; identical to SEQ ID NO: 166490

SEQ ID NO: 537565 - RNA, 64 nt, hsa; identical to SEQ ID NO: 166491

SEQ ID NO: 537566 - RNA, 64 nt, hsa; identical to SEQ ID NO: 166492

SEQ ID NO: 537567 - RNA, 64 nt, hsa; identical to SEQ ID NO: 166493

SEQ ID NO: 537568 - RNA, 64 nt, hsa; identical to SEQ ID NO: 166494

SEQ ID NO: 537569 - RNA, 64 nt, hsa; identical to SEQ ID NO: 166495

SEQ ID NO: 537570 - RNA, 64 nt, hsa; identical to SEQ ID NO: 166496

SEQ ID NO: 537571 - RNA, 64 nt, hsa; identical to SEQ ID NO: 166497

SEQ ID NO: 537572 - RNA, 64 nt, hsa; identical to SEQ ID NO: 166498

SEQ ID NO: 537573 - RNA, 64 nt, hsa; identical to SEQ ID NO: 166499

SEQ ID NO: 537574 - RNA, 64 nt, hsa; identical to SEQ ID NO: 166500

SEQ ID NO: 537575 - RNA, 64 nt, hsa; identical to SEQ ID NO: 166501

SEQ ID NO: 537576 - RNA, 50 nt, hsa; identical to SEQ ID NO: 166502

SEQ ID NO: 537577 - RNA, 64 nt, hsa; identical to SEQ ID NO: 166503

SEQ ID NO: 537578 - RNA, 64 nt, hsa; identical to SEQ ID NO: 166504

SEQ ID NO: 537579 - RNA, 64 nt, hsa; identical to SEQ ID NO: 166505

SEQ ID NO: 537580 - RNA, 64 nt, hsa; identical to SEQ ID NO: 166506

SEQ ID NO: 537581 - RNA, 64 nt, hsa; identical to SEQ ID NO: 166507

SEQ ID NO: 537582 - RNA, 64 nt, hsa; identical to SEQ ID NO: 166508

SEQ ID NO: 537583 - RNA, 64 nt, hsa; identical to SEQ ID NO: 166509

SEQ ID NO: 537584 - RNA, 64 nt, hsa; identical to SEQ ID NO: 166510

SEQ ID NO: 537585 - RNA, 64 nt, hsa; identical to SEQ ID NO: 166511

SEQ ID NO: 537586 - RNA, 64 nt, hsa; identical to SEQ ID NO: 166512

SEQ ID NO: 537587 - RNA, 64 nt, hsa; identical to SEQ ID NO: 166513

SEQ ID NO: 537588 - RNA, 64 nt, hsa; identical to SEQ ID NO: 166514

SEQ ID NO: 537589 - RNA, 64 nt, hsa; identical to SEQ ID NO: 166515

SEQ ID NO: 537590 - RNA, 64 nt, hsa; identical to SEQ ID NO: 166516

SEQ ID NO: 537591 - RNA, 64 nt, hsa; identical to SEQ ID NO: 166517

SEQ ID NO: 537592 - RNA, 64 nt, hsa; identical to SEQ ID NO: 166518

SEQ ID NO: 537593 - RNA, 64 nt, hsa; identical to SEQ ID NO: 166519

SEQ ID NO: 537594 - RNA, 58 nt, hsa; identical to SEQ ID NO: 166520

SEQ ID NO: 537595 - RNA, 64 nt, hsa; identical to SEQ ID NO: 166521

SEQ ID NO: 537596 - RNA, 64 nt, hsa; identical to SEQ ID NO: 166522

SEQ ID NO: 537597 - RNA, 64 nt, hsa; identical to SEQ ID NO: 166523

SEQ ID NO: 537598 - RNA, 64 nt, hsa; identical to SEQ ID NO: 166524

SEQ ID NO: 537599 - RNA, 64 nt, hsa; identical to SEQ ID NO: 166525

SEQ ID NO: 537600 - RNA, 64 nt, hsa; identical to SEQ ID NO: 166526

SEQ ID NO: 537601 - RNA, 64 nt, hsa; identical to SEQ ID NO: 166527

SEQ ID NO: 537602 - RNA, 64 nt, hsa; identical to SEQ ID NO: 166528

SEQ ID NO: 537603 - RNA, 64 nt, hsa; identical to SEQ ID NO: 166529

SEQ ID NO: 537604 - RNA, 64 nt, hsa; identical to SEQ ID NO: 166530

SEQ ID NO: 537605 - RNA, 64 nt, hsa; identical to SEQ ID NO: 166531

SEQ ID NO: 537606 - RNA, 64 nt, hsa; identical to SEQ ID NO: 166532

SEQ ID NO: 537607 - RNA, 64 nt, hsa; identical to SEQ ID NO: 166533

SEQ ID NO: 537608 - RNA, 64 nt, hsa; identical to SEQ ID NO: 166534

SEQ ID NO: 537609 - RNA, 64 nt, hsa; identical to SEQ ID NO: 166535

SEQ ID NO: 537610 - RNA, 64 nt, hsa; identical to SEQ ID NO: 166536

SEQ ID NO: 537611 - RNA, 64 nt, hsa; identical to SEQ ID NO: 166537

SEQ ID NO: 537612 - RNA, 64 nt, hsa; identical to SEQ ID NO: 166538

SEQ ID NO: 537613 - RNA, 64 nt, hsa; identical to SEQ ID NO: 166539

SEQ ID NO: 537614 - RNA, 64 nt, hsa; identical to SEQ ID NO: 166540

SEQ ID NO: 537615 - RNA, 64 nt, hsa; identical to SEQ ID NO: 166541

SEQ ID NO: 537616 - RNA, 64 nt, hsa; identical to SEQ ID NO: 166542

SEQ ID NO: 537617 - RNA, 64 nt, hsa; identical to SEQ ID NO: 166543

SEQ ID NO: 537618 - RNA, 64 nt, hsa; identical to SEQ ID NO: 166544

SEQ ID NO: 537619 - RNA, 64 nt, hsa; identical to SEQ ID NO: 166545

SEQ ID NO: 537620 - RNA, 64 nt, hsa; identical to SEQ ID NO: 166546

SEQ ID NO: 537621 - RNA, 64 nt, hsa; identical to SEQ ID NO: 166547

SEQ ID NO: 537622 - RNA, 64 nt, hsa; identical to SEQ ID NO: 166548

SEQ ID NO: 537623 - RNA, 64 nt, hsa; identical to SEQ ID NO: 166549

SEQ ID NO: 537624 - RNA, 64 nt, hsa; identical to SEQ ID NO: 166550

SEQ ID NO: 537625 - RNA, 64 nt, hsa; identical to SEQ ID NO: 166551

SEQ ID NO: 537626 - RNA, 64 nt, hsa; identical to SEQ ID NO: 166552

SEQ ID NO: 537627 - RNA, 64 nt, hsa; identical to SEQ ID NO: 166553

SEQ ID NO: 537628 - RNA, 64 nt, hsa; identical to SEQ ID NO: 166554

SEQ ID NO: 537629 - RNA, 64 nt, hsa; identical to SEQ ID NO: 166555

SEQ ID NO: 537630 - RNA, 64 nt, hsa; identical to SEQ ID NO: 166556

SEQ ID NO: 537631 - RNA, 64 nt, hsa; identical to SEQ ID NO: 166557

SEQ ID NO: 537632 - RNA, 64 nt, hsa; identical to SEQ ID NO: 166558

SEQ ID NO: 537633 - RNA, 64 nt, hsa; identical to SEQ ID NO: 166559

SEQ ID NO: 537634 - RNA, 64 nt, hsa; identical to SEQ ID NO: 166560

SEQ ID NO: 537635 - RNA, 64 nt, hsa; identical to SEQ ID NO: 166561

SEQ ID NO: 537636 - RNA, 64 nt, hsa; identical to SEQ ID NO: 166562

SEQ ID NO: 537637 - RNA, 64 nt, hsa; identical to SEQ ID NO: 166563

SEQ ID NO: 537638 - RNA, 64 nt, hsa; identical to SEQ ID NO: 166564

SEQ ID NO: 537639 - RNA, 64 nt, hsa; identical to SEQ ID NO: 166565

SEQ ID NO: 537640 - RNA, 64 nt, hsa; identical to SEQ ID NO: 166566

SEQ ID NO: 537641 - RNA, 64 nt, hsa; identical to SEQ ID NO: 166567

SEQ ID NO: 537642 - RNA, 64 nt, hsa; identical to SEQ ID NO: 166568

SEQ ID NO: 537643 - RNA, 64 nt, hsa; identical to SEQ ID NO: 166569

SEQ ID NO: 537644 - RNA, 64 nt, hsa; identical to SEQ ID NO: 166570

SEQ ID NO: 537645 - RNA, 64 nt, hsa; identical to SEQ ID NO: 166571

SEQ ID NO: 537646 - RNA, 64 nt, hsa; identical to SEQ ID NO: 166572

SEQ ID NO: 537647 - RNA, 64 nt, hsa; identical to SEQ ID NO: 166573

SEQ ID NO: 537648 - RNA, 64 nt, hsa; identical to SEQ ID NO: 166574

SEQ ID NO: 537649 - RNA, 64 nt, hsa; identical to SEQ ID NO: 166575

SEQ ID NO: 537650 - RNA, 64 nt, hsa; identical to SEQ ID NO: 166576

SEQ ID NO: 537651 - RNA, 64 nt, hsa; identical to SEQ ID NO: 166577

SEQ ID NO: 537652 - RNA, 64 nt, hsa; identical to SEQ ID NO: 166578

SEQ ID NO: 537653 - RNA, 64 nt, hsa; identical to SEQ ID NO: 166579

SEQ ID NO: 537654 - RNA, 64 nt, hsa; identical to SEQ ID NO: 166580

SEQ ID NO: 537655 - RNA, 64 nt, hsa; identical to SEQ ID NO: 166581

SEQ ID NO: 537656 - RNA, 64 nt, hsa; identical to SEQ ID NO: 166582

SEQ ID NO: 537657 - RNA, 64 nt, hsa; identical to SEQ ID NO: 166583

SEQ ID NO: 537658 - RNA, 64 nt, hsa; identical to SEQ ID NO: 166584

SEQ ID NO: 537659 - RNA, 64 nt, hsa; identical to SEQ ID NO: 166585

SEQ ID NO: 537660 - RNA, 64 nt, hsa; identical to SEQ ID NO: 166586

SEQ ID NO: 537661 - RNA, 64 nt, hsa; identical to SEQ ID NO: 166587

SEQ ID NO: 537662 - RNA, 64 nt, hsa; identical to SEQ ID NO: 166588

SEQ ID NO: 537663 - RNA, 64 nt, hsa; identical to SEQ ID NO: 166589

SEQ ID NO: 537664 - RNA, 64 nt, hsa; identical to SEQ ID NO: 166590

SEQ ID NO: 537665 - RNA, 64 nt, hsa; identical to SEQ ID NO: 166591

SEQ ID NO: 537666 - RNA, 64 nt, hsa; identical to SEQ ID NO: 166592

SEQ ID NO: 537667 - RNA, 64 nt, hsa; identical to SEQ ID NO: 166593

SEQ ID NO: 537668 - RNA, 64 nt, hsa; identical to SEQ ID NO: 166594

SEQ ID NO: 537669 - RNA, 64 nt, hsa; identical to SEQ ID NO: 166595

SEQ ID NO: 537670 - RNA, 64 nt, hsa; identical to SEQ ID NO: 166596

SEQ ID NO: 537671 - RNA, 64 nt, hsa; identical to SEQ ID NO: 166597

SEQ ID NO: 537672 - RNA, 64 nt, hsa; identical to SEQ ID NO: 166598

SEQ ID NO: 537673 - RNA, 64 nt, hsa; identical to SEQ ID NO: 166599

SEQ ID NO: 537674 - RNA, 64 nt, hsa; identical to SEQ ID NO: 166600

SEQ ID NO: 537675 - RNA, 62 nt, hsa; identical to SEQ ID NO: 166601

SEQ ID NO: 537676 - RNA, 64 nt, hsa; identical to SEQ ID NO: 166602

SEQ ID NO: 537677 - RNA, 64 nt, hsa; identical to SEQ ID NO: 166603

SEQ ID NO: 537678 - RNA, 64 nt, hsa; identical to SEQ ID NO: 166604

SEQ ID NO: 537679 - RNA, 64 nt, hsa; identical to SEQ ID NO: 166605

SEQ ID NO: 537680 - RNA, 64 nt, hsa; identical to SEQ ID NO: 166606

SEQ ID NO: 537681 - RNA, 64 nt, hsa; identical to SEQ ID NO: 166607

SEQ ID NO: 537682 - RNA, 64 nt, hsa; identical to SEQ ID NO: 166608

SEQ ID NO: 537683 - RNA, 64 nt, hsa; identical to SEQ ID NO: 166609

SEQ ID NO: 537684 - RNA, 52 nt, hsa; identical to SEQ ID NO: 166610

SEQ ID NO: 537685 - RNA, 64 nt, hsa; identical to SEQ ID NO: 166611

SEQ ID NO: 537686 - RNA, 64 nt, hsa; identical to SEQ ID NO: 166612

SEQ ID NO: 537687 - RNA, 64 nt, hsa; identical to SEQ ID NO: 166613

SEQ ID NO: 537688 - RNA, 64 nt, hsa; identical to SEQ ID NO: 166614

SEQ ID NO: 537689 - RNA, 64 nt, hsa; identical to SEQ ID NO: 166615

SEQ ID NO: 537690 - RNA, 64 nt, hsa; identical to SEQ ID NO: 166616

SEQ ID NO: 537691 - RNA, 64 nt, hsa; identical to SEQ ID NO: 166617

SEQ ID NO: 537692 - RNA, 64 nt, hsa; identical to SEQ ID NO: 333348

SEQ ID NO: 537693 - RNA, 64 nt, hsa; identical to SEQ ID NO: 333349

SEQ ID NO: 537694 - RNA, 64 nt, hsa; identical to SEQ ID NO: 333350

SEQ ID NO: 537695 - RNA, 64 nt, hsa; identical to SEQ ID NO: 333351

SEQ ID NO: 537696 - RNA, 64 nt, hsa; identical to SEQ ID NO: 333352

SEQ ID NO: 537697 - RNA, 64 nt, hsa; identical to SEQ ID NO: 333353

SEQ ID NO: 537698 - RNA, 64 nt, hsa; identical to SEQ ID NO: 333354

SEQ ID NO: 537699 - RNA, 64 nt, hsa; identical to SEQ ID NO: 333355

SEQ ID NO: 537700 - RNA, 64 nt, hsa; identical to SEQ ID NO: 333356

SEQ ID NO: 537701 - RNA, 64 nt, hsa; identical to SEQ ID NO: 333357

SEQ ID NO: 537702 - RNA, 64 nt, hsa; identical to SEQ ID NO: 333358

SEQ ID NO: 537703 - RNA, 64 nt, hsa; identical to SEQ ID NO: 333359

SEQ ID NO: 537704 - RNA, 64 nt, hsa; identical to SEQ ID NO: 333360

SEQ ID NO: 537705 - RNA, 64 nt, hsa; identical to SEQ ID NO: 333361

SEQ ID NO: 537706 - RNA, 64 nt, hsa; identical to SEQ ID NO: 333362

SEQ ID NO: 537707 - RNA, 64 nt, hsa; identical to SEQ ID NO: 333363

SEQ ID NO: 537708 - RNA, 64 nt, hsa; identical to SEQ ID NO: 333364

SEQ ID NO: 537709 - RNA, 64 nt, hsa; identical to SEQ ID NO: 333365

SEQ ID NO: 537710 - RNA, 64 nt, hsa; identical to SEQ ID NO: 333366

SEQ ID NO: 537711 - RNA, 64 nt, hsa; identical to SEQ ID NO: 333367

SEQ ID NO: 537712 - RNA, 64 nt, hsa; identical to SEQ ID NO: 333368

SEQ ID NO: 537713 - RNA, 64 nt, hsa; identical to SEQ ID NO: 333369

SEQ ID NO: 537714 - RNA, 64 nt, hsa; identical to SEQ ID NO: 333370

SEQ ID NO: 537715 - RNA, 64 nt, hsa; identical to SEQ ID NO: 333371

SEQ ID NO: 537716 - RNA, 64 nt, hsa; identical to SEQ ID NO: 333372

SEQ ID NO: 537717 - RNA, 64 nt, hsa; identical to SEQ ID NO: 333373

SEQ ID NO: 537718 - RNA, 64 nt, hsa; identical to SEQ ID NO: 333374

SEQ ID NO: 537719 - RNA, 64 nt, hsa; identical to SEQ ID NO: 333375

SEQ ID NO: 537720 - RNA, 64 nt, hsa; identical to SEQ ID NO: 333376

SEQ ID NO: 537721 - RNA, 64 nt, hsa; identical to SEQ ID NO: 333377

SEQ ID NO: 537722 - RNA, 64 nt, hsa; identical to SEQ ID NO: 333378

SEQ ID NO: 537723 - RNA, 64 nt, hsa; identical to SEQ ID NO: 333379

SEQ ID NO: 537724 - RNA, 64 nt, hsa; identical to SEQ ID NO: 333380

SEQ ID NO: 537725 - RNA, 64 nt, hsa; identical to SEQ ID NO: 333381

SEQ ID NO: 537726 - RNA, 64 nt, hsa; identical to SEQ ID NO: 333382

SEQ ID NO: 537727 - RNA, 64 nt, hsa; identical to SEQ ID NO: 333383

SEQ ID NO: 537728 - RNA, 64 nt, hsa; identical to SEQ ID NO: 333384

SEQ ID NO: 537729 - RNA, 64 nt, hsa; identical to SEQ ID NO: 333385

SEQ ID NO: 537730 - RNA, 64 nt, hsa; identical to SEQ ID NO: 333386

SEQ ID NO: 537731 - RNA, 64 nt, hsa; identical to SEQ ID NO: 333387

SEQ ID NO: 537732 - RNA, 64 nt, hsa; identical to SEQ ID NO: 333388

SEQ ID NO: 537733 - RNA, 64 nt, hsa; identical to SEQ ID NO: 333389

SEQ ID NO: 537734 - RNA, 64 nt, hsa; identical to SEQ ID NO: 333390

SEQ ID NO: 537735 - RNA, 64 nt, hsa; identical to SEQ ID NO: 333391

SEQ ID NO: 537736 - RNA, 64 nt, hsa; identical to SEQ ID NO: 333392

SEQ ID NO: 537737 - RNA, 64 nt, hsa; identical to SEQ ID NO: 333393

SEQ ID NO: 537738 - RNA, 64 nt, hsa; identical to SEQ ID NO: 333394

SEQ ID NO: 537739 - RNA, 64 nt, hsa; identical to SEQ ID NO: 333395

SEQ ID NO: 537740 - RNA, 64 nt, hsa; identical to SEQ ID NO: 333396

SEQ ID NO: 537741 - RNA, 64 nt, hsa; identical to SEQ ID NO: 333397

SEQ ID NO: 537742 - RNA, 64 nt, hsa; identical to SEQ ID NO: 333398

SEQ ID NO: 537743 - RNA, 64 nt, hsa; identical to SEQ ID NO: 333399

SEQ ID NO: 537744 - RNA, 64 nt, hsa; identical to SEQ ID NO: 333400

SEQ ID NO: 537745 - RNA, 64 nt, hsa; identical to SEQ ID NO: 333401

SEQ ID NO: 537746 - RNA, 64 nt, hsa; identical to SEQ ID NO: 333402

SEQ ID NO: 537747 - RNA, 64 nt, hsa; identical to SEQ ID NO: 333403

SEQ ID NO: 537748 - RNA, 64 nt, hsa; identical to SEQ ID NO: 333404

SEQ ID NO: 537749 - RNA, 64 nt, hsa; identical to SEQ ID NO: 333405

SEQ ID NO: 537750 - RNA, 64 nt, hsa; identical to SEQ ID NO: 333406

SEQ ID NO: 537751 - RNA, 64 nt, hsa; identical to SEQ ID NO: 333407

SEQ ID NO: 537752 - RNA, 64 nt, hsa; identical to SEQ ID NO: 333408

SEQ ID NO: 537753 - RNA, 64 nt, hsa; identical to SEQ ID NO: 333409

SEQ ID NO: 537754 - RNA, 64 nt, hsa; identical to SEQ ID NO: 333410

SEQ ID NO: 537755 - RNA, 64 nt, hsa; identical to SEQ ID NO: 333411

SEQ ID NO: 537756 - RNA, 64 nt, hsa; identical to SEQ ID NO: 333412

SEQ ID NO: 537757 - RNA, 64 nt, hsa; identical to SEQ ID NO: 333413

SEQ ID NO: 537758 - RNA, 64 nt, hsa; identical to SEQ ID NO: 333414

SEQ ID NO: 537759 - RNA, 64 nt, hsa; identical to SEQ ID NO: 333415

SEQ ID NO: 537760 - RNA, 64 nt, hsa; identical to SEQ ID NO: 333416

SEQ ID NO: 537761 - RNA, 64 nt, hsa; identical to SEQ ID NO: 333417

SEQ ID NO: 537762 - RNA, 64 nt, hsa; identical to SEQ ID NO: 333418

SEQ ID NO: 537763 - RNA, 64 nt, hsa; identical to SEQ ID NO: 333419

SEQ ID NO: 537764 - RNA, 64 nt, hsa; identical to SEQ ID NO: 333420

SEQ ID NO: 537765 - RNA, 64 nt, hsa; identical to SEQ ID NO: 333421

SEQ ID NO: 537766 - RNA, 64 nt, hsa; identical to SEQ ID NO: 333422

SEQ ID NO: 537767 - RNA, 64 nt, hsa; identical to SEQ ID NO: 333423

SEQ ID NO: 537768 - RNA, 64 nt, hsa; identical to SEQ ID NO: 333424

SEQ ID NO: 537769 - RNA, 64 nt, hsa; identical to SEQ ID NO: 333425

SEQ ID NO: 537770 - RNA, 64 nt, hsa; identical to SEQ ID NO: 333426

SEQ ID NO: 537771 - RNA, 64 nt, hsa; identical to SEQ ID NO: 333427

SEQ ID NO: 537772 - RNA, 64 nt, hsa; identical to SEQ ID NO: 333428

SEQ ID NO: 537773 - RNA, 64 nt, hsa; identical to SEQ ID NO: 333429

SEQ ID NO: 537774 - RNA, 64 nt, hsa; identical to SEQ ID NO: 333430

SEQ ID NO: 537775 - RNA, 64 nt, hsa; identical to SEQ ID NO: 333431

SEQ ID NO: 537776 - RNA, 64 nt, hsa; identical to SEQ ID NO: 333432

SEQ ID NO: 537777 - RNA, 64 nt, hsa; identical to SEQ ID NO: 333433

SEQ ID NO: 537778 - RNA, 64 nt, hsa; identical to SEQ ID NO: 333434

SEQ ID NO: 537779 - RNA, 64 nt, hsa; identical to SEQ ID NO: 333435

SEQ ID NO: 537780 - RNA, 64 nt, hsa; identical to SEQ ID NO: 333436

SEQ ID NO: 537781 - RNA, 64 nt, hsa; identical to SEQ ID NO: 333437

SEQ ID NO: 537782 - RNA, 64 nt, hsa; identical to SEQ ID NO: 333438

SEQ ID NO: 537783 - RNA, 64 nt, hsa; identical to SEQ ID NO: 333439

SEQ ID NO: 537784 - RNA, 64 nt, hsa; identical to SEQ ID NO: 333440

SEQ ID NO: 537785 - RNA, 64 nt, hsa; identical to SEQ ID NO: 333441

SEQ ID NO: 537786 - RNA, 64 nt, hsa; identical to SEQ ID NO: 333442

SEQ ID NO: 537787 - RNA, 64 nt, hsa; identical to SEQ ID NO: 333443

SEQ ID NO: 537788 - RNA, 64 nt, hsa; identical to SEQ ID NO: 333444

SEQ ID NO: 537789 - RNA, 64 nt, hsa; identical to SEQ ID NO: 333445

SEQ ID NO: 537790 - RNA, 64 nt, hsa; identical to SEQ ID NO: 333446

SEQ ID NO: 537791 - RNA, 64 nt, hsa; identical to SEQ ID NO: 333447

SEQ ID NO: 537792 - RNA, 64 nt, hsa; identical to SEQ ID NO: 333448

SEQ ID NO: 537793 - RNA, 64 nt, hsa; identical to SEQ ID NO: 333449

SEQ ID NO: 537794 - RNA, 64 nt, hsa; identical to SEQ ID NO: 333450

SEQ ID NO: 537795 - RNA, 64 nt, hsa; identical to SEQ ID NO: 333451

SEQ ID NO: 537796 - RNA, 64 nt, hsa; identical to SEQ ID NO: 333452

SEQ ID NO: 537797 - RNA, 64 nt, hsa; identical to SEQ ID NO: 333453

SEQ ID NO: 537798 - RNA, 64 nt, hsa; identical to SEQ ID NO: 333454

SEQ ID NO: 537799 - RNA, 55 nt, hsa; identical to SEQ ID NO: 333455

SEQ ID NO: 537800 - RNA, 64 nt, hsa; identical to SEQ ID NO: 333456

SEQ ID NO: 537801 - RNA, 64 nt, hsa; identical to SEQ ID NO: 333457

SEQ ID NO: 537802 - RNA, 64 nt, hsa; identical to SEQ ID NO: 333458

SEQ ID NO: 537803 - RNA, 64 nt, hsa
uagcuaacccccuucccacuccugagucacugaauucgaggaggguggggcagggaaagggcug

SEQ ID NO: 537804 - RNA, 64 nt, hsa
aacaggcugcggugauugcaauuaccauccgguguucgaggaucauuggugaagucagcagaua

SEQ ID NO: 537805 - RNA, 64 nt, hsa
uuaaguaaaaguugggcacuaaucuggauuaacauucgaggaaaucaguugagcugaauuuaag

SEQ ID NO: 537806 - RNA, 64 nt, hsa
auugaaauuggaaauggucuugucaccuuucaacuucgaggacuggaauuccgagguaagaauu

SEQ ID NO: 537807 - RNA, 64 nt, hsa
cuagcacauuuaaacugugcaaauaugaaaauuuuucgaggauuacauuuuaucugaaggcugc

SEQ ID NO: 537808 - RNA, 64 nt, hsa
agugguguaccaagguugggggugagccuacccuuucgaggaggaguauuuuaaucaccaacau

SEQ ID NO: 537809 - RNA, 64 nt, hsa
ccgcggcgacuuggagagagggaagaggggcguuuucgaggaagaaccugucccaggucuucuc

SEQ ID NO: 537810 - RNA, 64 nt, hsa
cauuuugaauaccaugaucgaugaugucccaugcuucgaggaaaaccaaacacuuuccgccucu

SEQ ID NO: 537811 - RNA, 64 nt, hsa
aaacccaaaaggccaaaaaacaaaaaaguuagaguucgaggaauuaccaacuguaguuuuagcc

SEQ ID NO: 537812 - RNA, 64 nt, hsa
aaaacgccuggcgccgccaccgucgggggcuggcuucgaggacgcccgccugccucgcgggucg

SEQ ID NO: 537813 - RNA, 64 nt, hsa
gcugcaggaaacgauugccaacuauacgaauggcuucgaggagauaaacugaaauuugcuauau

SEQ ID NO: 537814 - RNA, 64 nt, hsa
aaaaaugaaacuucaaaauugaugaaaaacuaaauucgaggaauuaaaaucgaacaaaacauag

SEQ ID NO: 537815 - RNA, 64 nt, hsa
cccauggcucaagagggcugcaaggccaacacuauucgaggaggaggcuguuauuuugggccug

SEQ ID NO: 537816 - RNA, 64 nt, hsa
ccuuucugcucuugugaagaaaaaaaaaagcauuuucgaggaaagaauuaugcaauuucuuuug

SEQ ID NO: 537817 - RNA, 64 nt, hsa
gauugauugugguugaaaggaguggugauauuauuucgaggauccacuguguaagaagacuguu

SEQ ID NO: 537818 - RNA, 64 nt, hsa
aucuuaaguguauugcucuuucaucuuaaacacuuucgaggauuugcagugcgucuagcaccua

SEQ ID NO: 537819 - RNA, 64 nt, hsa
uuucuaucacuguuaagggggggggaaagugagguucgaggaugacguagguaacucuccccuc

SEQ ID NO: 537820 - RNA, 64 nt, hsa
gacaccauaacucaugcaauaaaacugauugucauucgaggagcaaacuuaagaguaguuuauu

SEQ ID NO: 537821 - RNA, 64 nt, hsa
ccuccucucccuaguguagagcaagccaguguccuucgaggaacccacccggcuggccgggaag

SEQ ID NO: 537822 - RNA, 64 nt, hsa
gucaucuccuucaaauacuuuaauaaagaaguauuucgaggagauaucuguccaaaaagguuug

SEQ ID NO: 537823 - RNA, 64 nt, hsa
guccuauauaucaaaccucuaacugacguuucuuuucgaggaaguggcuuggugggugcagccc

SEQ ID NO: 537824 - RNA, 64 nt, hsa
uuucuuuagcaugcuacaguuauuaaucuggacauucgaggaauuggccgcugucacugcuugu

SEQ ID NO: 537825 - RNA, 64 nt, hsa
ccagaucuccggauugucgggggacgcaggacucuucgaggaaaaccagccgaaugagaucaaa

SEQ ID NO: 537826 - RNA, 64 nt, hsa
aggcugaggugggaggaucuauugagcccuggaauucgaggaugcaauuaauugugguuguguc

SEQ ID NO: 537827 - RNA, 64 nt, hsa
uuuuaauucaaugaaaucugagguuaaugcgagguucgaggagagguuauagauaaaacuacca

SEQ ID NO: 537828 - RNA, 64 nt, hsa
ccauguguacagccuacccaugcagggacugggauucgaggacuuccaggcgcauaggguagaa

SEQ ID NO: 537829 - RNA, 64 nt, hsa
ccaggagccugaucagguguacgaggggaucaccuucgaggacuuccugaagguggguggccug

SEQ ID NO: 537830 - RNA, 64 nt, hsa
cagcaaaucugagagaaccguccuggggccucccuucgaggagcccucugaugugaggagggac

SEQ ID NO: 537831 - RNA, 64 nt, hsa
gaaccgaggaagcacgugaaacuuacuaauucuauucgaggauuuuauaauggcauauuuuuuc

SEQ ID NO: 537832 - RNA, 64 nt, hsa
cucaggucccgucacaugucucaaggguccagcguucgaggaagcacuguuguagaugacagag

SEQ ID NO: 537833 - RNA, 64 nt, hsa
auguuuggcauuuuaaaguaaaaacaagugugacuucgaggaccaaagaaauugucagcuauac

SEQ ID NO: 537834 - RNA, 64 nt, hsa
accacgcaguaacuaaagcuuuaggaugacuguauucgaggagugccguguguugcaugcagcu

SEQ ID NO: 537835 - RNA, 64 nt, hsa
ccuguacgagcagcgggccgagccacgcagcggcuucgaggagcuggugcguugccccaccugg

SEQ ID NO: 537836 - RNA, 64 nt, hsa
aaaacagacuagauugcaauaggagcuuggaugguucgaggaauaggcauuggaggugguuucu

SEQ ID NO: 537837 - RNA, 64 nt, hsa
gugggagggaccuagggccucuuuggaugcugucuucgaggacagcaaugcagagagggcauag

SEQ ID NO: 537838 - RNA, 64 nt, hsa
agagcagagaaagaaguccuuucucuuuauugaguucgaggacuacaaccaauuuacacugcca

SEQ ID NO: 537839 - RNA, 64 nt, hsa
ccuguguucugggcuggggccaccuuugugcagcuucgaggacaggaaaggccccaaucuugcc

SEQ ID NO: 537840 - RNA, 64 nt, hsa
aggaggggacuuucuauguucacgucccaccuucuucgaggacaugaccaagggacaggaucau

SEQ ID NO: 537841 - RNA, 64 nt, hsa
cucggacggccgugcauuuucucgucucacgcaguucgaggaggacccuagaaagccaggagcu

SEQ ID NO: 537842 - RNA, 64 nt, hsa
ggccgacuugggagccucaggcccacgcccacccuucgaggaaggugucaccuggaccccuuca

SEQ ID NO: 537843 - RNA, 64 nt, hsa
caguauaaugugcuauuaauggaaccaauaguaauucgaggacuaguugggagauucuggggua

SEQ ID NO: 537844 - RNA, 58 nt, hsa
gugucccccauggucgcugagacuccccuucgaggauugcacccgcccguccuaagcc

SEQ ID NO: 537845 - RNA, 64 nt, hsa
ugggcugggcccuccgcacggcccgccagcuggcuucgaggaaccuccaggagagaagugccug

SEQ ID NO: 537846 - RNA, 64 nt, hsa
uuuuuaugaugccaaaagcugccacugugugguauucgaggauuauugcaacaaagccaguagu

SEQ ID NO: 537847 - RNA, 64 nt, hsa
cagagaaccuguucagauacaggccaguuucuucuucgaggaaagccaagcuccucaaacaggg

SEQ ID NO: 537848 - RNA, 64 nt, hsa
auuaaaaauuagcaacccgaaaggauggguaaccuucgaggaagaagaggauuuuggugugaaa

SEQ ID NO: 537849 - RNA, 64 nt, hsa
cuccaucuacggccgcagagcggcuggcaguuucuucgaggaccucagcaaggugggggagggg

SEQ ID NO: 537850 - RNA, 64 nt, hsa
ccggaacccgucacuauucuagacuucccuggcauucgaggagcccuuugaacuuuccaaagug

SEQ ID NO: 537851 - RNA, 64 nt, hsa
acccccagcaguugccaugggguuuccuuccagauucgaggauccuugccacuugaagccugga

SEQ ID NO: 537852 - RNA, 64 nt, hsa; identical to SEQ ID NO: 74792

SEQ ID NO: 537853 - RNA, 64 nt, hsa; identical to SEQ ID NO: 74793

SEQ ID NO: 537854 - RNA, 64 nt, hsa; identical to SEQ ID NO: 74794

SEQ ID NO: 537855 - RNA, 64 nt, hsa; identical to SEQ ID NO: 74795

SEQ ID NO: 537856 - RNA, 64 nt, hsa; identical to SEQ ID NO: 74796

SEQ ID NO: 537857 - RNA, 64 nt, hsa; identical to SEQ ID NO: 74797

SEQ ID NO: 537858 - RNA, 64 nt, hsa; identical to SEQ ID NO: 74798

SEQ ID NO: 537859 - RNA, 64 nt, hsa; identical to SEQ ID NO: 74799

SEQ ID NO: 537860 - RNA, 64 nt, hsa; identical to SEQ ID NO: 74800

SEQ ID NO: 537861 - RNA, 64 nt, hsa; identical to SEQ ID NO: 74801

SEQ ID NO: 537862 - RNA, 64 nt, hsa; identical to SEQ ID NO: 74802

SEQ ID NO: 537863 - RNA, 64 nt, hsa; identical to SEQ ID NO: 74803

SEQ ID NO: 537864 - RNA, 64 nt, hsa; identical to SEQ ID NO: 74804

SEQ ID NO: 537865 - RNA, 64 nt, hsa; identical to SEQ ID NO: 74805

SEQ ID NO: 537866 - RNA, 64 nt, hsa; identical to SEQ ID NO: 74806

SEQ ID NO: 537867 - RNA, 64 nt, hsa; identical to SEQ ID NO: 74807

SEQ ID NO: 537868 - RNA, 62 nt, hsa
gacgaggacucguggcuggagagagccacacagcguguaaccugaagucaucuagauuaugg

SEQ ID NO: 537869 - RNA, 62 nt, hsa
ggagggggugugucugggugugccuauugagagcguguaauggcguuugggagcucgugugu

SEQ ID NO: 537870 - RNA, 62 nt, hsa
acauguuuguggugugaugcacacuuuugcaagcguguaagauguuaccugguuugucucuu

SEQ ID NO: 537871 - RNA, 62 nt, hsa
uagcugggcggggcucgaggcuggugccaggcgcguguaaaugguuuuguuuugcacguuug

SEQ ID NO: 537872 - RNA, 62 nt, hsa
gagggcggggauacugauucagaaauccuguagcguguaauaaaagaagaggaaauggcaug

SEQ ID NO: 537873 - RNA, 62 nt, hsa
cucguucgguuguuggaccucuuucacucccugcguguaagaaggugaaucacgugggaaaa

SEQ ID NO: 537874 - RNA, 62 nt, hsa
cacgcacuggccugcacagagagcaugggugagcguguaaaagcuuggcccugugcccuaca

SEQ ID NO: 537875 - RNA, 62 nt, hsa
gccuggaugccagcuguguccuucgggggcgugcguguaacuguaguguagucaggugcuca

SEQ ID NO: 537876 - RNA, 62 nt, hsa
cagaaagcaaggaaguaaacucaaacaaaagugcguguaauuaaauacuauuaaucauaggc

SEQ ID NO: 537877 - RNA, 62 nt, hsa
guauauuguuuuuuaucuuuaacucaaauaaagcguguaauaaauaaguuaucuaaauuucc

SEQ ID NO: 537878 - RNA, 62 nt, hsa
ggcggggaaccuaggcagggcuggcuuucuuagcguguaacuuguguagcagcacagggccc

SEQ ID NO: 537879 - RNA, 62 nt, hsa
auaguguaugcaaguuaauguacauuauacaugcguguaagggacauaaauggaggggugug

SEQ ID NO: 537880 - RNA, 62 nt, hsa
ggugcccgcucuucccuccugggcccacaacagcguguaaacacauguucugugccugcuca

SEQ ID NO: 537881 - RNA, 62 nt, hsa
aauugccuacauuuaucaugguccugaauguagcguguaagcuuguguuucuugggcagucu

SEQ ID NO: 537882 - RNA, 62 nt, hsa
ucacuggguugcgguuauuuuccugguaguuugcguguaagaaagggagaauauaguuuuag

SEQ ID NO: 537883 - RNA, 62 nt, hsa
uccuauuucacuuugccucccaucacacaacugcguguaaauggugucacuuguucaccucu

SEQ ID NO: 537884 - RNA, 62 nt, hsa
uuagaacagugccaaagaaccugggccuaucagcguguaagggggccugccccucaucugcg

SEQ ID NO: 537885 - RNA, 62 nt, hsa
ugauguugagugggagauuggcuuugccuuuagcguguaaauggaagcacugccauuagacu

SEQ ID NO: 537886 - RNA, 62 nt, hsa
uauuuccugaagcauauuuuucauagaauguagcguguaaauagcuuuuuaaauaacuucuu

SEQ ID NO: 537887 - RNA, 62 nt, hsa
aaauacaaaaguagccaggcaugguggcgcaugcguguaaucccagcuacuugggaggcuga

SEQ ID NO: 537888 - RNA, 62 nt, hsa
uauuugcugcuuuguugcaaguugauauaacugcguguaauuaugaauucauuuuauccuga

SEQ ID NO: 537889 - RNA, 62 nt, hsa
uaauccauuuagaucuuuaaugcuuuggaaaugcguguaacaguacugcaauaaucacagcu

SEQ ID NO: 537890 - RNA, 62 nt, hsa
auccacuagagauggguuugaggauuuuccaagcguguaauaaugauguuuuuccuaacaug

SEQ ID NO: 537891 - RNA, 62 nt, hsa
uucccaaguagcaaagagaccauggagaaggugcguguaaagagauauauuuuuguaagagg

SEQ ID NO: 537892 - RNA, 62 nt, hsa
acccaaauaccgcgaaugcaucagcuaaagcagcguguaaauaggagugacgagaaaguuaa

SEQ ID NO: 537893 - RNA, 62 nt, hsa
acccacaacccuuaucugguucugaccagugugcguguaacuuuaugaucugaggggaaaaa

SEQ ID NO: 537894 - RNA, 62 nt, hsa
ggcuugaccaaugaccuaugucacaagagguggcguguaaggaaugcagcccccugaagaca

SEQ ID NO: 537895 - RNA, 62 nt, hsa
gcguugaugcucagaaucgccuaccugugccugcguguaaaccacagccucagaccagcuau

SEQ ID NO: 537896 - RNA, 62 nt, hsa
gggggcucuccuaggauccccuuuccguaaaagcguguaacaaggguguaaauauuuauaau

SEQ ID NO: 537897 - RNA, 62 nt, hsa
cagcccugcccccauugcgucugcacaccccugcguguaacugcauuccaaccacuaauaaa

SEQ ID NO: 537898 - RNA, 62 nt, hsa
gggaggaggacccccgcaccgcccccuccccagcguguaaguggcucugcuauugugcgucc

SEQ ID NO: 537899 - RNA, 62 nt, hsa
aagugcuuucuuuuaaguggcauuggcaauuggcguguaaugauggcaguagaaucugaauc

SEQ ID NO: 537900 - RNA, 62 nt, hsa
ucuauaacuugagaucuuuccggggccuacaggcguguaagacagcuuggucuggucugugc

SEQ ID NO: 537901 - RNA, 62 nt, hsa
uguugacaugcaaaagcagcaauagacaauaugcguguaaaugaguguggcuguaauccaag

SEQ ID NO: 537902 - RNA, 64 nt, hsa
aggaauugcaaaaaauauuuuaaaaauuuauuacugaauuuaaaaauauuuuagaaguuuugua

SEQ ID NO: 537903 - RNA, 64 nt, hsa
ccuguuggcccugacaggaagggaggaagccuggugaauuuagugagcagcuggccugggucac

SEQ ID NO: 537904 - RNA, 64 nt, hsa
uguuauuuacuacauugugauuuaacuuuggaugugaauuuagucacccuuagcccuucagaua

SEQ ID NO: 537905 - RNA, 64 nt, hsa
gaauauuuuagggucaaaguguaauuauucauaaugaauuuacucuguugauauuaaaaagacg

SEQ ID NO: 537906 - RNA, 64 nt, hsa
ugauacucagaacaaaagaaagucauaaaacuccugaauuuaauuuccccaccuaagucgaaac

SEQ ID NO: 537907 - RNA, 62 nt, hsa
cuguuccccuuucuaggugaagcagacuguggugaauuuagcaacacuuaugaaguuucuua

SEQ ID NO: 537908 - RNA, 64 nt, hsa
augcauuauaucuggagacuugcacuuguauggaugaauuuauuacauucaacauauuuaauuu

SEQ ID NO: 537909 - RNA, 64 nt, hsa
gccaacauuugggccucugaauguaucuguuauuugaauuuaaguauuugaaaaggaaugguca

SEQ ID NO: 537910 - RNA, 64 nt, hsa
aaaugaauucauggguagaugauuugugcagaucugaauuuaagaacauuuccuuuuucugugg

SEQ ID NO: 537911 - RNA, 64 nt, hsa
uaaaaauguauuucaaacuauucuuacugugcugugaauuuauaucuucuucugcaagaccugg

SEQ ID NO: 537912 - RNA, 64 nt, hsa
aggauucuaaacagaugucccugaagucuugcauugaauuuagucauuauuauuacuuuuuaaa

SEQ ID NO: 537913 - RNA, 64 nt, hsa
gagaugaaaaccugcauuuuuaaaggacaaacagugaauuuaagcaugaguggccuuaauaaau

SEQ ID NO: 537914 - RNA, 64 nt, hsa
uuaauugaagggcauuaauuagaugucuucacccugaauuuagacuuugcucuguguucucccg

SEQ ID NO: 537915 - RNA, 64 nt, hsa
uaauuugcccaaauacauggagcacaaaauuuagugaauuuauaaaucuggauuugccuugugu

SEQ ID NO: 537916 - RNA, 64 nt, hsa
caguaggagcaaacuagccaacagguacugucuuugaauuuacuacuguaagacuaagcagugu

SEQ ID NO: 537917 - RNA, 64 nt, hsa
gaauauugugcuuuuuguuguuuguaaauagaauugaauuuaaauacaccaggauaaaucuuau

SEQ ID NO: 537918 - RNA, 64 nt, hsa
agaguauuuggaaguuaagaauugauuagacuagugaauuuaggaguauuugaggugggugggg

SEQ ID NO: 537919 - RNA, 64 nt, hsa
ccuacauguuucaauaccaguuauauggagugcuugaauuuaauaagcaguuuuuacggaguuu

SEQ ID NO: 537920 - RNA, 64 nt, hsa
gccauuucaaguucugaaaaauguuuugaguauuugaauuuagagaaacaacaugguuccaaga

SEQ ID NO: 537921 - RNA, 64 nt, hsa
uaaaaaggcucagguuuuugaccaaaauacaaugugaauuuauucugacauuccuaaaauagau

SEQ ID NO: 537922 - RNA, 64 nt, hsa
uugaugcagcuuuaagaugguggggaggauggggugaauuuaggaaaggaauuugugguuauaa

SEQ ID NO: 537923 - RNA, 64 nt, hsa
ucuuguccucguaauaccauuuggauuuuauuucugaauuuaaauaguaaaauauuuaugaugc

SEQ ID NO: 537924 - RNA, 64 nt, hsa
acaauugaccuauacauugcauucagcaagcuccugaauuuagaacugccgucaguguagugua

SEQ ID NO: 537925 - RNA, 64 nt, hsa
aaauacaaagacauuuuugcuagggccuacaaauugaauuuaaaaacucacugcacugauucau

SEQ ID NO: 537926 - RNA, 64 nt, hsa
gaugugcaugcauucuauuuagucuucagaaugcugaauuuacuuguuguaagucuauuuuaac

SEQ ID NO: 537927 - RNA, 64 nt, hsa
guggauuguaauacacacugaaauucugacuuucugaauuuaaauguagaauaaauuuuaccaa

SEQ ID NO: 537928 - RNA, 64 nt, hsa
ugaucaugaucuuacuggugaauuacagaccugaugaauuuauagaaugugaagacccagugga

SEQ ID NO: 537929 - RNA, 64 nt, hsa
auuguguaaaugaaucuuggaaggccaaagcuacugaauuuagcgaauuuguggaggcauugcc

SEQ ID NO: 537930 - RNA, 64 nt, hsa
aaagcaguaauaucuucucuggaggccuguugggugaauuuaauggaaucaaguuaaguaggug

SEQ ID NO: 537931 - RNA, 64 nt, hsa
auacuauaaaacacugagaguaucuaugucuuucugaauuuaaaaugaaaauucauguccauau

SEQ ID NO: 537932 - RNA, 64 nt, hsa
aauuuuaggagacuucauuaacuucauaacagcaugaauuuauuugaauuaauuaacauuugag

SEQ ID NO: 537933 - RNA, 64 nt, hsa
auguuuauauaccuaauauuuauuaugccauaucugaauuuauuaaaaacaacacagaaaucuc

SEQ ID NO: 537934 - RNA, 64 nt, hsa
agaaugagagucaugauguuuugauuuaugaaggugaauuuaaugcaaaaguggguaacacuac

SEQ ID NO: 537935 - RNA, 64 nt, hsa
gaccuugacuuuaaauuuuucaucacuacaaccuugaauuuaauuucaggucuucaacaugaug

SEQ ID NO: 537936 - RNA, 64 nt, hsa
aacgcuagugguuuguccuuagacaaucugucuuugaauuuaaagucuuuaucgcuaagaccuu

SEQ ID NO: 537937 - RNA, 64 nt, hsa
augauuuaugucuauacaaauaauuucucugaggugaauuuaauucauuuauuuucaaauaagc

SEQ ID NO: 537938 - RNA, 64 nt, hsa
aaauaagcauaauuugcucaauuaaguaugaguuugaauuuaguuugaaaucuggaauuggcca

SEQ ID NO: 537939 - RNA, 64 nt, hsa
ugguagggucuaccuucugcuucccuggaaaggaugaauuuacaucauuugacaagccuauuuu

SEQ ID NO: 537940 - RNA, 64 nt, hsa
gaggugaauaaaacgggauuuucagaaguuagccugaauuuaacuguauuuuuaaauuuaaccu

SEQ ID NO: 537941 - RNA, 64 nt, hsa
uugaugacuuggagaguaggaauuuugcaaaaucugaauuuaaggaaauucuuuaggauaacca

SEQ ID NO: 537942 - RNA, 64 nt, hsa
uuuuauaccaauauuauaugcagaaaucacaggaugaauuuagaauuaaaucucaauuaguuca

SEQ ID NO: 537943 - RNA, 64 nt, hsa
agacguaaggaaagugauuauuguuuaauaucugugaauuuaggaugugcaucucuuuucagag

SEQ ID NO: 537944 - RNA, 64 nt, hsa
auaauagcccagugagagcugaaugaaaagggacugaauuuaaauauuuguaagaacuuuguga

SEQ ID NO: 537945 - RNA, 64 nt, hsa
uuaaaauauucaauucugcuuuuuaauuuuuaagugaauuuaguuugaaaagcaugauuauaca

SEQ ID NO: 537946 - RNA, 64 nt, hsa
gacaguuccucuucauucuaaagguuuacuccauugaauuuaaggcauuuguucauuccagugu

SEQ ID NO: 537947 - RNA, 64 nt, hsa
agaaucucuauucaaaaucaaaaugcugcucaaaugaauuuaaccaacaucuaggugcuuaauu

SEQ ID NO: 537948 - RNA, 64 nt, hsa
cacauauuucacuacuuaaauuauucccaagauuugaauuuauuuuaaaauuuuaauagccacc

SEQ ID NO: 537949 - RNA, 64 nt, hsa
cccuuugaaaaaauauaacagauuuaaaauguuuugaauuuaacuuguuuagaaaaacuaaugc

SEQ ID NO: 537950 - RNA, 64 nt, hsa
guauauuucaguuuucuuuagggcaacauauauuugaauuuaaaagcacuuuauuuaaaaaaaa

SEQ ID NO: 537951 - RNA, 64 nt, hsa
caaaaaguaucaauguguauguggcuguuuguagugaauuuauuggagaaugagguuguccgug

SEQ ID NO: 537952 - RNA, 64 nt, hsa
aaccuggaauuaagaccaccuagauugcgagagcugaauuuagaaaccagacaacgucaugcag

SEQ ID NO: 537953 - RNA, 64 nt, hsa
acagcagcauaagaaauauacaaacaguauccuaugaauuuagugguuuuauguggauaugcca

SEQ ID NO: 537954 - RNA, 64 nt, hsa
aaaacacaagugguaugcuuuagaucugcacaugugaauuuagcauaaucacugggaauuugaa

SEQ ID NO: 537955 - RNA, 64 nt, hsa
ugcguaugaaucuaugacagagcaaugcuuuuaaugaauuuaaggcaaaaaagguggagaggga

SEQ ID NO: 537956 - RNA, 64 nt, hsa
gggcuagaucuaagauuauucccaugagaaauguugaauuuaugaagaauagauuuuaaggcuu

SEQ ID NO: 537957 - RNA, 64 nt, hsa
uauucucauucguuuuuuaaaaacugauauauucugaauuuauucuuccauugagaaaaaaaug

SEQ ID NO: 537958 - RNA, 64 nt, hsa
uuuccccaaguauuaaacucuaauguaccaaugaugaauuuaucagcguauuucaggguccaaa

SEQ ID NO: 537959 - RNA, 64 nt, hsa
uuuauuccaaauaauguacuucuaauuauacucuugaauuuauuggauaagaaggucugaggug

SEQ ID NO: 537960 - RNA, 64 nt, hsa
gaauaaugacugcugucugcagccagaaagaaucugaauuuaugaauuggaaagauauauauag

SEQ ID NO: 537961 - RNA, 64 nt, hsa
uuugaauuuagcaaccuagaaacacacauuucuuugaauuuaggugauaccuaaauccuucuua

SEQ ID NO: 537962 - RNA, 64 nt, hsa
uuuaaaugaaccaaaccaaaucauacuuuuucuuugaauuuagcaaccuagaaacacacauuuc

SEQ ID NO: 537963 - RNA, 64 nt, hsa
gacauaguuuccaggcugcaaugcugaaucuugcugaauuuaaagagaaguucugcaucuuuua

SEQ ID NO: 537964 - RNA, 64 nt, hsa
aaugcuaaaagaaaauguauucucugcuuuguauugaauuuauuacuguacauucuguggcuua

SEQ ID NO: 537965 - RNA, 64 nt, hsa
aaacuguuuugguaguuggauuucauuaucuuagugaauuuagucauuuuacaauauguuugua

SEQ ID NO: 537966 - RNA, 64 nt, hsa
uucccaaaaaaagggccauuugcuugcauuacuuugaauuuaauguugcgcuugugcacugugu

SEQ ID NO: 537967 - RNA, 64 nt, hsa
cuaaaaauuacggucugacuagugagcaaagucuugaauuuauucaaaaguccuaaauaccuuc

SEQ ID NO: 537968 - RNA, 64 nt, hsa
aucuuguuaugaguauguaaaaguaaaaugcaugugaauuuaucauauuugcacuaugaaggua

SEQ ID NO: 537969 - RNA, 64 nt, hsa
gguuucuuuuguuuuucauuuuguacaacuuucuugaauuuagaaauuacaucuuugcaguucu

SEQ ID NO: 537970 - RNA, 64 nt, hsa
ugaaacugaaauuacaugaguuucauuuuuucuuugaauuuauaggguuuagauuucugaaagc

SEQ ID NO: 537971 - RNA, 64 nt, hsa; identical to SEQ ID NO: 218432

SEQ ID NO: 537972 - RNA, 64 nt, hsa; identical to SEQ ID NO: 218433

SEQ ID NO: 537973 - RNA, 64 nt, hsa; identical to SEQ ID NO: 218434

SEQ ID NO: 537974 - RNA, 64 nt, hsa; identical to SEQ ID NO: 218435

SEQ ID NO: 537975 - RNA, 64 nt, hsa; identical to SEQ ID NO: 218436

SEQ ID NO: 537976 - RNA, 64 nt, hsa; identical to SEQ ID NO: 218437

SEQ ID NO: 537977 - RNA, 64 nt, hsa; identical to SEQ ID NO: 218438

SEQ ID NO: 537978 - RNA, 64 nt, hsa; identical to SEQ ID NO: 218439

SEQ ID NO: 537979 - RNA, 64 nt, hsa; identical to SEQ ID NO: 352829

SEQ ID NO: 537980 - RNA, 64 nt, hsa; identical to SEQ ID NO: 352830

SEQ ID NO: 537981 - RNA, 64 nt, hsa; identical to SEQ ID NO: 352831

SEQ ID NO: 537982 - RNA, 64 nt, hsa; identical to SEQ ID NO: 352832

SEQ ID NO: 537983 - RNA, 64 nt, hsa; identical to SEQ ID NO: 352833

SEQ ID NO: 537984 - RNA, 64 nt, hsa; identical to SEQ ID NO: 352834

SEQ ID NO: 537985 - RNA, 64 nt, hsa; identical to SEQ ID NO: 352835

SEQ ID NO: 537986 - RNA, 64 nt, hsa; identical to SEQ ID NO: 352836

SEQ ID NO: 537987 - RNA, 64 nt, hsa; identical to SEQ ID NO: 352837

SEQ ID NO: 537988 - RNA, 64 nt, hsa; identical to SEQ ID NO: 352838

SEQ ID NO: 537989 - RNA, 64 nt, hsa; identical to SEQ ID NO: 352839

SEQ ID NO: 537990 - RNA, 64 nt, hsa; identical to SEQ ID NO: 352840

SEQ ID NO: 537991 - RNA, 64 nt, hsa; identical to SEQ ID NO: 352841

SEQ ID NO: 537992 - RNA, 64 nt, hsa; identical to SEQ ID NO: 352842

SEQ ID NO: 537993 - RNA, 64 nt, hsa; identical to SEQ ID NO: 352843

SEQ ID NO: 537994 - RNA, 64 nt, hsa; identical to SEQ ID NO: 352844

SEQ ID NO: 537995 - RNA, 64 nt, hsa; identical to SEQ ID NO: 352845

SEQ ID NO: 537996 - RNA, 64 nt, hsa; identical to SEQ ID NO: 352846

SEQ ID NO: 537997 - RNA, 64 nt, hsa; identical to SEQ ID NO: 352847

SEQ ID NO: 537998 - RNA, 64 nt, hsa; identical to SEQ ID NO: 352848

SEQ ID NO: 537999 - RNA, 64 nt, hsa; identical to SEQ ID NO: 352849

SEQ ID NO: 538000 - RNA, 64 nt, hsa; identical to SEQ ID NO: 352850

SEQ ID NO: 538001 - RNA, 64 nt, hsa; identical to SEQ ID NO: 352851

SEQ ID NO: 538002 - RNA, 64 nt, hsa; identical to SEQ ID NO: 352852

SEQ ID NO: 538003 - RNA, 64 nt, hsa; identical to SEQ ID NO: 352853

SEQ ID NO: 538004 - RNA, 64 nt, hsa; identical to SEQ ID NO: 352854

SEQ ID NO: 538005 - RNA, 64 nt, hsa; identical to SEQ ID NO: 352855

SEQ ID NO: 538006 - RNA, 64 nt, hsa; identical to SEQ ID NO: 352856

SEQ ID NO: 538007 - RNA, 64 nt, hsa; identical to SEQ ID NO: 352857

SEQ ID NO: 538008 - RNA, 64 nt, hsa; identical to SEQ ID NO: 352858

SEQ ID NO: 538009 - RNA, 64 nt, hsa; identical to SEQ ID NO: 352859

SEQ ID NO: 538010 - RNA, 64 nt, hsa; identical to SEQ ID NO: 352860

SEQ ID NO: 538011 - RNA, 64 nt, hsa; identical to SEQ ID NO: 352861

SEQ ID NO: 538012 - RNA, 64 nt, hsa; identical to SEQ ID NO: 352862

SEQ ID NO: 538013 - RNA, 64 nt, hsa; identical to SEQ ID NO: 352863

SEQ ID NO: 538014 - RNA, 64 nt, hsa; identical to SEQ ID NO: 352864

SEQ ID NO: 538015 - RNA, 64 nt, hsa; identical to SEQ ID NO: 352865

SEQ ID NO: 538016 - RNA, 64 nt, hsa; identical to SEQ ID NO: 352866

SEQ ID NO: 538017 - RNA, 64 nt, hsa; identical to SEQ ID NO: 352867

SEQ ID NO: 538018 - RNA, 64 nt, hsa; identical to SEQ ID NO: 352868

SEQ ID NO: 538019 - RNA, 64 nt, hsa; identical to SEQ ID NO: 352869

SEQ ID NO: 538020 - RNA, 64 nt, hsa; identical to SEQ ID NO: 485963

SEQ ID NO: 538021 - RNA, 64 nt, hsa; identical to SEQ ID NO: 485964

SEQ ID NO: 538022 - RNA, 64 nt, hsa; identical to SEQ ID NO: 485965

SEQ ID NO: 538023 - RNA, 64 nt, hsa; identical to SEQ ID NO: 485966

SEQ ID NO: 538024 - RNA, 64 nt, hsa; identical to SEQ ID NO: 485967

SEQ ID NO: 538025 - RNA, 64 nt, hsa; identical to SEQ ID NO: 485968

SEQ ID NO: 538026 - RNA, 64 nt, hsa; identical to SEQ ID NO: 485969

SEQ ID NO: 538027 - RNA, 64 nt, hsa; identical to SEQ ID NO: 485970

SEQ ID NO: 538028 - RNA, 64 nt, hsa; identical to SEQ ID NO: 316995

SEQ ID NO: 538029 - RNA, 64 nt, hsa; identical to SEQ ID NO: 316996

SEQ ID NO: 538030 - RNA, 64 nt, hsa; identical to SEQ ID NO: 316997

SEQ ID NO: 538031 - RNA, 64 nt, hsa; identical to SEQ ID NO: 316998

SEQ ID NO: 538032 - RNA, 64 nt, hsa; identical to SEQ ID NO: 316999

SEQ ID NO: 538033 - RNA, 64 nt, hsa; identical to SEQ ID NO: 317000

SEQ ID NO: 538034 - RNA, 64 nt, hsa; identical to SEQ ID NO: 317001

SEQ ID NO: 538035 - RNA, 64 nt, hsa; identical to SEQ ID NO: 317002

SEQ ID NO: 538036 - RNA, 64 nt, hsa; identical to SEQ ID NO: 317003

SEQ ID NO: 538037 - RNA, 60 nt, hsa; identical to SEQ ID NO: 317004

SEQ ID NO: 538038 - RNA, 64 nt, hsa; identical to SEQ ID NO: 317005

SEQ ID NO: 538039 - RNA, 64 nt, hsa; identical to SEQ ID NO: 317006

SEQ ID NO: 538040 - RNA, 64 nt, hsa; identical to SEQ ID NO: 317007

SEQ ID NO: 538041 - RNA, 64 nt, hsa; identical to SEQ ID NO: 317008

SEQ ID NO: 538042 - RNA, 64 nt, hsa; identical to SEQ ID NO: 317009

SEQ ID NO: 538043 - RNA, 64 nt, hsa; identical to SEQ ID NO: 317010

SEQ ID NO: 538044 - RNA, 64 nt, hsa; identical to SEQ ID NO: 317011

SEQ ID NO: 538045 - RNA, 64 nt, hsa; identical to SEQ ID NO: 317012

SEQ ID NO: 538046 - RNA, 64 nt, hsa; identical to SEQ ID NO: 317013

SEQ ID NO: 538047 - RNA, 64 nt, hsa; identical to SEQ ID NO: 317014

SEQ ID NO: 538048 - RNA, 64 nt, hsa; identical to SEQ ID NO: 317015

SEQ ID NO: 538049 - RNA, 64 nt, hsa; identical to SEQ ID NO: 317016

SEQ ID NO: 538050 - RNA, 64 nt, hsa; identical to SEQ ID NO: 317017

SEQ ID NO: 538051 - RNA, 64 nt, hsa; identical to SEQ ID NO: 317018

SEQ ID NO: 538052 - RNA, 64 nt, hsa; identical to SEQ ID NO: 317019

SEQ ID NO: 538053 - RNA, 64 nt, hsa; identical to SEQ ID NO: 317020

SEQ ID NO: 538054 - RNA, 64 nt, hsa; identical to SEQ ID NO: 317021

SEQ ID NO: 538055 - RNA, 62 nt, hsa; identical to SEQ ID NO: 317022

SEQ ID NO: 538056 - RNA, 64 nt, hsa; identical to SEQ ID NO: 317023

SEQ ID NO: 538057 - RNA, 64 nt, hsa; identical to SEQ ID NO: 317024

SEQ ID NO: 538058 - RNA, 64 nt, hsa; identical to SEQ ID NO: 317025

SEQ ID NO: 538059 - RNA, 64 nt, hsa; identical to SEQ ID NO: 317026

SEQ ID NO: 538060 - RNA, 64 nt, hsa; identical to SEQ ID NO: 317027

SEQ ID NO: 538061 - RNA, 64 nt, hsa; identical to SEQ ID NO: 317028

SEQ ID NO: 538062 - RNA, 64 nt, hsa; identical to SEQ ID NO: 317029

SEQ ID NO: 538063 - RNA, 53 nt, hsa; identical to SEQ ID NO: 317030

SEQ ID NO: 538064 - RNA, 54 nt, hsa; identical to SEQ ID NO: 317031

SEQ ID NO: 538065 - RNA, 64 nt, hsa; identical to SEQ ID NO: 317032

SEQ ID NO: 538066 - RNA, 64 nt, hsa; identical to SEQ ID NO: 317033

SEQ ID NO: 538067 - RNA, 64 nt, hsa; identical to SEQ ID NO: 317034

SEQ ID NO: 538068 - RNA, 64 nt, hsa; identical to SEQ ID NO: 317035

SEQ ID NO: 538069 - RNA, 64 nt, hsa; identical to SEQ ID NO: 317036

SEQ ID NO: 538070 - RNA, 64 nt, hsa; identical to SEQ ID NO: 317037

SEQ ID NO: 538071 - RNA, 64 nt, hsa; identical to SEQ ID NO: 317038

SEQ ID NO: 538072 - RNA, 64 nt, hsa; identical to SEQ ID NO: 317039

SEQ ID NO: 538073 - RNA, 64 nt, hsa; identical to SEQ ID NO: 317040

SEQ ID NO: 538074 - RNA, 64 nt, hsa; identical to SEQ ID NO: 317041

SEQ ID NO: 538075 - RNA, 64 nt, hsa; identical to SEQ ID NO: 317042

SEQ ID NO: 538076 - RNA, 64 nt, hsa; identical to SEQ ID NO: 317043

SEQ ID NO: 538077 - RNA, 64 nt, hsa; identical to SEQ ID NO: 317044

SEQ ID NO: 538078 - RNA, 64 nt, hsa; identical to SEQ ID NO: 317045

SEQ ID NO: 538079 - RNA, 64 nt, hsa; identical to SEQ ID NO: 317046

SEQ ID NO: 538080 - RNA, 64 nt, hsa; identical to SEQ ID NO: 317047

SEQ ID NO: 538081 - RNA, 64 nt, hsa; identical to SEQ ID NO: 317048

SEQ ID NO: 538082 - RNA, 64 nt, hsa; identical to SEQ ID NO: 317049

SEQ ID NO: 538083 - RNA, 64 nt, hsa; identical to SEQ ID NO: 317050

SEQ ID NO: 538084 - RNA, 64 nt, hsa; identical to SEQ ID NO: 317051

SEQ ID NO: 538085 - RNA, 64 nt, hsa; identical to SEQ ID NO: 317052

SEQ ID NO: 538086 - RNA, 64 nt, hsa; identical to SEQ ID NO: 317053

SEQ ID NO: 538087 - RNA, 64 nt, hsa; identical to SEQ ID NO: 317054

SEQ ID NO: 538088 - RNA, 64 nt, hsa; identical to SEQ ID NO: 317055

SEQ ID NO: 538089 - RNA, 64 nt, hsa; identical to SEQ ID NO: 317056

SEQ ID NO: 538090 - RNA, 64 nt, hsa; identical to SEQ ID NO: 317057

SEQ ID NO: 538091 - RNA, 64 nt, hsa; identical to SEQ ID NO: 317058

SEQ ID NO: 538092 - RNA, 64 nt, hsa; identical to SEQ ID NO: 317059

SEQ ID NO: 538093 - RNA, 64 nt, hsa; identical to SEQ ID NO: 317060

SEQ ID NO: 538094 - RNA, 64 nt, hsa; identical to SEQ ID NO: 317061

SEQ ID NO: 538095 - RNA, 64 nt, hsa; identical to SEQ ID NO: 317062

SEQ ID NO: 538096 - RNA, 64 nt, hsa; identical to SEQ ID NO: 317063

SEQ ID NO: 538097 - RNA, 64 nt, hsa; identical to SEQ ID NO: 317064

SEQ ID NO: 538098 - RNA, 55 nt, hsa; identical to SEQ ID NO: 317065

SEQ ID NO: 538099 - RNA, 64 nt, hsa; identical to SEQ ID NO: 317066

SEQ ID NO: 538100 - RNA, 63 nt, hsa; identical to SEQ ID NO: 317067

SEQ ID NO: 538101 - RNA, 64 nt, hsa; identical to SEQ ID NO: 317068

SEQ ID NO: 538102 - RNA, 64 nt, hsa; identical to SEQ ID NO: 317069

SEQ ID NO: 538103 - RNA, 64 nt, hsa; identical to SEQ ID NO: 317070

SEQ ID NO: 538104 - RNA, 64 nt, hsa; identical to SEQ ID NO: 317071

SEQ ID NO: 538105 - RNA, 64 nt, hsa; identical to SEQ ID NO: 317072

SEQ ID NO: 538106 - RNA, 64 nt, hsa; identical to SEQ ID NO: 317073

SEQ ID NO: 538107 - RNA, 64 nt, hsa; identical to SEQ ID NO: 317074

SEQ ID NO: 538108 - RNA, 64 nt, hsa; identical to SEQ ID NO: 317075

SEQ ID NO: 538109 - RNA, 64 nt, hsa; identical to SEQ ID NO: 317076

SEQ ID NO: 538110 - RNA, 64 nt, hsa; identical to SEQ ID NO: 317077

SEQ ID NO: 538111 - RNA, 64 nt, hsa; identical to SEQ ID NO: 317078

SEQ ID NO: 538112 - RNA, 64 nt, hsa; identical to SEQ ID NO: 317079

SEQ ID NO: 538113 - RNA, 64 nt, hsa; identical to SEQ ID NO: 317080

SEQ ID NO: 538114 - RNA, 64 nt, hsa; identical to SEQ ID NO: 317081

SEQ ID NO: 538115 - RNA, 64 nt, hsa; identical to SEQ ID NO: 317082

SEQ ID NO: 538116 - RNA, 64 nt, hsa; identical to SEQ ID NO: 317083

SEQ ID NO: 538117 - RNA, 64 nt, hsa; identical to SEQ ID NO: 317084

SEQ ID NO: 538118 - RNA, 64 nt, hsa; identical to SEQ ID NO: 317085

SEQ ID NO: 538119 - RNA, 64 nt, hsa; identical to SEQ ID NO: 317086

SEQ ID NO: 538120 - RNA, 64 nt, hsa; identical to SEQ ID NO: 317087

SEQ ID NO: 538121 - RNA, 64 nt, hsa; identical to SEQ ID NO: 317088

SEQ ID NO: 538122 - RNA, 64 nt, hsa; identical to SEQ ID NO: 317089

SEQ ID NO: 538123 - RNA, 64 nt, hsa; identical to SEQ ID NO: 317090

SEQ ID NO: 538124 - RNA, 64 nt, hsa; identical to SEQ ID NO: 316995

SEQ ID NO: 538125 - RNA, 64 nt, hsa; identical to SEQ ID NO: 316996

SEQ ID NO: 538126 - RNA, 64 nt, hsa; identical to SEQ ID NO: 316997

SEQ ID NO: 538127 - RNA, 64 nt, hsa; identical to SEQ ID NO: 316998

SEQ ID NO: 538128 - RNA, 64 nt, hsa; identical to SEQ ID NO: 316999

SEQ ID NO: 538129 - RNA, 64 nt, hsa; identical to SEQ ID NO: 317000

SEQ ID NO: 538130 - RNA, 64 nt, hsa; identical to SEQ ID NO: 317001

SEQ ID NO: 538131 - RNA, 64 nt, hsa; identical to SEQ ID NO: 317002

SEQ ID NO: 538132 - RNA, 64 nt, hsa; identical to SEQ ID NO: 317003

SEQ ID NO: 538133 - RNA, 60 nt, hsa; identical to SEQ ID NO: 317004

SEQ ID NO: 538134 - RNA, 64 nt, hsa; identical to SEQ ID NO: 317005

SEQ ID NO: 538135 - RNA, 64 nt, hsa; identical to SEQ ID NO: 317006

SEQ ID NO: 538136 - RNA, 64 nt, hsa; identical to SEQ ID NO: 317007

SEQ ID NO: 538137 - RNA, 64 nt, hsa; identical to SEQ ID NO: 317008

SEQ ID NO: 538138 - RNA, 64 nt, hsa; identical to SEQ ID NO: 317009

SEQ ID NO: 538139 - RNA, 64 nt, hsa; identical to SEQ ID NO: 317010

SEQ ID NO: 538140 - RNA, 64 nt, hsa; identical to SEQ ID NO: 317011

SEQ ID NO: 538141 - RNA, 64 nt, hsa; identical to SEQ ID NO: 317012

SEQ ID NO: 538142 - RNA, 64 nt, hsa; identical to SEQ ID NO: 317013

SEQ ID NO: 538143 - RNA, 64 nt, hsa; identical to SEQ ID NO: 317014

SEQ ID NO: 538144 - RNA, 64 nt, hsa; identical to SEQ ID NO: 317015

SEQ ID NO: 538145 - RNA, 64 nt, hsa; identical to SEQ ID NO: 317016

SEQ ID NO: 538146 - RNA, 64 nt, hsa; identical to SEQ ID NO: 317017

SEQ ID NO: 538147 - RNA, 64 nt, hsa; identical to SEQ ID NO: 317018

SEQ ID NO: 538148 - RNA, 64 nt, hsa; identical to SEQ ID NO: 317019

SEQ ID NO: 538149 - RNA, 64 nt, hsa; identical to SEQ ID NO: 317020

SEQ ID NO: 538150 - RNA, 64 nt, hsa; identical to SEQ ID NO: 317021

SEQ ID NO: 538151 - RNA, 62 nt, hsa; identical to SEQ ID NO: 317022

SEQ ID NO: 538152 - RNA, 64 nt, hsa; identical to SEQ ID NO: 317023

SEQ ID NO: 538153 - RNA, 64 nt, hsa; identical to SEQ ID NO: 317024

SEQ ID NO: 538154 - RNA, 64 nt, hsa; identical to SEQ ID NO: 317025

SEQ ID NO: 538155 - RNA, 64 nt, hsa; identical to SEQ ID NO: 317026

SEQ ID NO: 538156 - RNA, 64 nt, hsa; identical to SEQ ID NO: 317027

SEQ ID NO: 538157 - RNA, 64 nt, hsa; identical to SEQ ID NO: 317028

SEQ ID NO: 538158 - RNA, 64 nt, hsa; identical to SEQ ID NO: 317029

SEQ ID NO: 538159 - RNA, 53 nt, hsa; identical to SEQ ID NO: 317030

SEQ ID NO: 538160 - RNA, 54 nt, hsa; identical to SEQ ID NO: 317031

SEQ ID NO: 538161 - RNA, 64 nt, hsa; identical to SEQ ID NO: 317032

SEQ ID NO: 538162 - RNA, 64 nt, hsa; identical to SEQ ID NO: 317033

SEQ ID NO: 538163 - RNA, 64 nt, hsa; identical to SEQ ID NO: 317034

SEQ ID NO: 538164 - RNA, 64 nt, hsa; identical to SEQ ID NO: 317035

SEQ ID NO: 538165 - RNA, 64 nt, hsa; identical to SEQ ID NO: 317036

SEQ ID NO: 538166 - RNA, 64 nt, hsa; identical to SEQ ID NO: 317037

SEQ ID NO: 538167 - RNA, 64 nt, hsa; identical to SEQ ID NO: 317038

SEQ ID NO: 538168 - RNA, 64 nt, hsa; identical to SEQ ID NO: 317039

SEQ ID NO: 538169 - RNA, 64 nt, hsa; identical to SEQ ID NO: 317040

SEQ ID NO: 538170 - RNA, 64 nt, hsa; identical to SEQ ID NO: 317041

SEQ ID NO: 538171 - RNA, 64 nt, hsa; identical to SEQ ID NO: 317042

SEQ ID NO: 538172 - RNA, 64 nt, hsa; identical to SEQ ID NO: 317043

SEQ ID NO: 538173 - RNA, 64 nt, hsa; identical to SEQ ID NO: 317044

SEQ ID NO: 538174 - RNA, 64 nt, hsa; identical to SEQ ID NO: 317045

SEQ ID NO: 538175 - RNA, 64 nt, hsa; identical to SEQ ID NO: 317046

SEQ ID NO: 538176 - RNA, 64 nt, hsa; identical to SEQ ID NO: 317047

SEQ ID NO: 538177 - RNA, 64 nt, hsa; identical to SEQ ID NO: 317048

SEQ ID NO: 538178 - RNA, 64 nt, hsa; identical to SEQ ID NO: 317049

SEQ ID NO: 538179 - RNA, 64 nt, hsa; identical to SEQ ID NO: 317050

SEQ ID NO: 538180 - RNA, 64 nt, hsa; identical to SEQ ID NO: 317051

SEQ ID NO: 538181 - RNA, 64 nt, hsa; identical to SEQ ID NO: 317052

SEQ ID NO: 538182 - RNA, 64 nt, hsa; identical to SEQ ID NO: 317053

SEQ ID NO: 538183 - RNA, 64 nt, hsa; identical to SEQ ID NO: 317054

SEQ ID NO: 538184 - RNA, 64 nt, hsa; identical to SEQ ID NO: 317055

SEQ ID NO: 538185 - RNA, 64 nt, hsa; identical to SEQ ID NO: 317056

SEQ ID NO: 538186 - RNA, 64 nt, hsa; identical to SEQ ID NO: 317057

SEQ ID NO: 538187 - RNA, 64 nt, hsa; identical to SEQ ID NO: 317058

SEQ ID NO: 538188 - RNA, 64 nt, hsa; identical to SEQ ID NO: 317059

SEQ ID NO: 538189 - RNA, 64 nt, hsa; identical to SEQ ID NO: 317060

SEQ ID NO: 538190 - RNA, 64 nt, hsa; identical to SEQ ID NO: 317061

SEQ ID NO: 538191 - RNA, 64 nt, hsa; identical to SEQ ID NO: 317062

SEQ ID NO: 538192 - RNA, 64 nt, hsa; identical to SEQ ID NO: 317063

SEQ ID NO: 538193 - RNA, 64 nt, hsa; identical to SEQ ID NO: 317064

SEQ ID NO: 538194 - RNA, 55 nt, hsa; identical to SEQ ID NO: 317065

SEQ ID NO: 538195 - RNA, 64 nt, hsa; identical to SEQ ID NO: 317066

SEQ ID NO: 538196 - RNA, 63 nt, hsa; identical to SEQ ID NO: 317067

SEQ ID NO: 538197 - RNA, 64 nt, hsa; identical to SEQ ID NO: 317068

SEQ ID NO: 538198 - RNA, 64 nt, hsa; identical to SEQ ID NO: 317069

SEQ ID NO: 538199 - RNA, 64 nt, hsa; identical to SEQ ID NO: 317070

SEQ ID NO: 538200 - RNA, 64 nt, hsa; identical to SEQ ID NO: 317071

SEQ ID NO: 538201 - RNA, 64 nt, hsa; identical to SEQ ID NO: 317072

SEQ ID NO: 538202 - RNA, 64 nt, hsa; identical to SEQ ID NO: 317073

SEQ ID NO: 538203 - RNA, 64 nt, hsa; identical to SEQ ID NO: 317074

SEQ ID NO: 538204 - RNA, 64 nt, hsa; identical to SEQ ID NO: 317075

SEQ ID NO: 538205 - RNA, 64 nt, hsa; identical to SEQ ID NO: 317076

SEQ ID NO: 538206 - RNA, 64 nt, hsa; identical to SEQ ID NO: 317077

SEQ ID NO: 538207 - RNA, 64 nt, hsa; identical to SEQ ID NO: 317078

SEQ ID NO: 538208 - RNA, 64 nt, hsa; identical to SEQ ID NO: 317079

SEQ ID NO: 538209 - RNA, 64 nt, hsa; identical to SEQ ID NO: 317080

SEQ ID NO: 538210 - RNA, 64 nt, hsa; identical to SEQ ID NO: 317081

SEQ ID NO: 538211 - RNA, 64 nt, hsa; identical to SEQ ID NO: 317082

SEQ ID NO: 538212 - RNA, 64 nt, hsa; identical to SEQ ID NO: 317083

SEQ ID NO: 538213 - RNA, 64 nt, hsa; identical to SEQ ID NO: 317084

SEQ ID NO: 538214 - RNA, 64 nt, hsa; identical to SEQ ID NO: 317085

SEQ ID NO: 538215 - RNA, 64 nt, hsa; identical to SEQ ID NO: 317086

SEQ ID NO: 538216 - RNA, 64 nt, hsa; identical to SEQ ID NO: 317087

SEQ ID NO: 538217 - RNA, 64 nt, hsa; identical to SEQ ID NO: 317088

SEQ ID NO: 538218 - RNA, 64 nt, hsa; identical to SEQ ID NO: 317089

SEQ ID NO: 538219 - RNA, 64 nt, hsa; identical to SEQ ID NO: 317090

SEQ ID NO: 538220 - RNA, 64 nt, hsa
uucuucuauaaauguuuuucccugcacaacaaaaacagugaaagaaaugcuuaucuguaauuuu

SEQ ID NO: 538221 - RNA, 64 nt, hsa
acaguguuacagauaacuucaaguuuauaaaaauacagugaaauuucuacaaagcucuaaaucu

SEQ ID NO: 538222 - RNA, 64 nt, hsa
uccuacugagcauuugcaccucuguucauuucacacagugaaacgcaauuuuaccuaguuugca

SEQ ID NO: 538223 - RNA, 64 nt, hsa
ugacgacauacaugcuacuuuuuuuuaguucaauacagugaaggucuuuguuaugacagugaau

SEQ ID NO: 538224 - RNA, 64 nt, hsa
uuuuuaguucaauacagugaaggucuuuguuaugacagugaauauugcuuuuauuauuauuauu

SEQ ID NO: 538225 - RNA, 64 nt, hsa
uauccuucuaagcagauucuuccuacugcaaaggacagugaauccagcaacucaguggauccaa

SEQ ID NO: 538226 - RNA, 64 nt, hsa
gggaccaggaugcuaaaugucaagguaguccuauacagugaagaauuguccugcucaagaugcc

SEQ ID NO: 538227 - RNA, 64 nt, hsa
gagucuauaucuauuuucacggagcgggcaaccaacagugaauguggagcugagagacaguaaa

SEQ ID NO: 538228 - RNA, 64 nt, hsa
uggccacuaaguauaugaaaaaagucguaucuuaacagugaacaacuguguuagucuguaucaa

SEQ ID NO: 538229 - RNA, 64 nt, hsa
uguuugcaguaagaagcugcuggcaugcacgggaacagugaaugccaaacacuuaaagcaauuc

SEQ ID NO: 538230 - RNA, 64 nt, hsa
agguuuguagauaaauguugccaccuuguuuguaacagugaaaaauugaaaacaaccuggaagu

SEQ ID NO: 538231 - RNA, 64 nt, hsa
ugcacacacuuucaugcagugcucuuuguagcuaacagugaagauuuaccucguucugcucaga

SEQ ID NO: 538232 - RNA, 64 nt, hsa
agacugugccauggugagaaaaauguaaaauccuacagugaaaugagcagcccuuacaguauug

SEQ ID NO: 538233 - RNA, 64 nt, hsa
uucuuugaaucuuucugugucuucacauuuuucuacagugaauuuaaucaaauaguaaaguugu

SEQ ID NO: 538234 - RNA, 64 nt, hsa
aacucugguacgguggcacccucaggaguggaggacagugaacuuccuugaagagggagugacu

SEQ ID NO: 538235 - RNA, 57 nt, hsa
gugcagaggagaacaacuaguuccaaaacagugaacguggaggaugaagaugcugcg

SEQ ID NO: 538236 - RNA, 64 nt, hsa
ucccaaaccaggcugccccagccccagcccagcaacagugaacucccuugggucaagacaguac

SEQ ID NO: 538237 - RNA, 64 nt, hsa
gguuaucaagaaagugcccugugcuaaugaugagacagugaauuuuuuuuuuuuuucgagaugg

SEQ ID NO: 538238 - RNA, 64 nt, hsa
acaaccucugccuuccagguucaagugauuagagacagugaaauuuuuauggaauacugcaccu

SEQ ID NO: 538239 - RNA, 64 nt, hsa
guacuguaauuugucaaaaugcagagaauggaaaacagugaacggaaaacacagaguaaacccu

SEQ ID NO: 538240 - RNA, 64 nt, hsa
ggaaaggagggauggcagguaggugauuuuuaggacagugaaaguacucuguaggguacuguaa

SEQ ID NO: 538241 - RNA, 64 nt, hsa
ugaaaugauuuuuauuuuuccuuugguauuugcuacagugaaaagaaguuuggaaaguagauac

SEQ ID NO: 538242 - RNA, 64 nt, hsa
aggaauuuaggcauuaccucagggaaaagccuugacagugaaaagaaacuacuuaaucgcuaau

SEQ ID NO: 538243 - RNA, 64 nt, hsa
accaaguauucauuucaugauguaaagaaacugaacagugaaguggcuugauugcuuaaacuau

SEQ ID NO: 538244 - RNA, 64 nt, hsa; identical to SEQ ID NO: 538243

SEQ ID NO: 538245 - RNA, 64 nt, hsa
caccaccauauugccauuaguggaaaaaaagaggacagugaaccugccuuccaccugccagagg

SEQ ID NO: 538246 - RNA, 64 nt, hsa
agggcugccugguugacucuccuucccauuguuuacagugaaggugucauucacaaaaacucaa

SEQ ID NO: 538247 - RNA, 64 nt, hsa
uuugcacugaaguugcaaaagaucugugcacugaacagugaagguggcuuccggcacacucccc

SEQ ID NO: 538248 - RNA, 64 nt, hsa
gguccugagcugcuguuuccaaucaugaagaaaaacagugaauccagugaacagggauucucca

SEQ ID NO: 538249 - RNA, 64 nt, hsa
uauuaaaggucuugggguagauggugugugugaaacagugaagucucaacagcagaaaagaaca

SEQ ID NO: 538250 - RNA, 64 nt, hsa
agugauacuuuauuuuauauaauauuuuuuauucacagugaaauuucauucauguucuuucagu

SEQ ID NO: 538251 - RNA, 64 nt, hsa
cuaaaauucugugauucagauuugucagggaagcacagugaagcuugcuuaaaggcacuggcca

SEQ ID NO: 538252 - RNA, 64 nt, hsa
agcagcuaaaaaagaguggaccaaaacacugcacacagugaaguguuccaguuuccacugggca

SEQ ID NO: 538253 - RNA, 64 nt, hsa
ucaugaggucaggagaucgcgaccauccuggcuaacagugaaacccugucuccacuaaaaauac

SEQ ID NO: 538254 - RNA, 64 nt, hsa
acaaggucaggaaauugagaccauccuggcuaauacagugaaaccccaugucugcuaaaauuac

SEQ ID NO: 538255 - RNA, 64 nt, hsa
gucuuguuggacgagaaaacaauaacgauaaaagacagugaaagaaaauaacgauaaaagacag

SEQ ID NO: 538256 - RNA, 64 nt, hsa
gauaaaagacagugaaagaaaauaacgauaaaagacagugaaagaaaauaacaauaaaagacaa

SEQ ID NO: 538257 - RNA, 64 nt, hsa
gaccccaucucuauauaaaaaaaaagauguuaaaacagugaaauuacagaaacagaacauagcc

SEQ ID NO: 538258 - RNA, 64 nt, hsa
auugaagagaacguccaccuuaaggcuuuaaaagacagugaagcugggugcgguggugcacucc

SEQ ID NO: 538259 - RNA, 64 nt, hsa
uaugaagagaacguccacuuuaaggcuuuaaaagacagugaagcugguuguagggcucacuuuu

SEQ ID NO: 538260 - RNA, 64 nt, hsa; identical to SEQ ID NO: 538257

SEQ ID NO: 538261 - RNA, 64 nt, hsa
gugcaacaagaaacuucucccucacccccuccuuuacccucagauuuggagaugguaaccaaag

SEQ ID NO: 538262 - RNA, 64 nt, hsa
uuuugcccaucuggagacugcaggcucccuuccuuacccucagagagugcuuaugguggguguu

SEQ ID NO: 538263 - RNA, 64 nt, hsa
cagaacugaacuagacuccccuaccuuagacugguacccucaaacacaggacugaagcuuaauu

SEQ ID NO: 538264 - RNA, 64 nt, hsa
ucaccaaucaguuuuuguucuuuuuuccuggaucuacccucauggucguuuucaacauagcggg

SEQ ID NO: 538265 - RNA, 64 nt, hsa
acuucuucucccccgcgaguuuuccccacuuacuuacccucaccugucaggccugacggggagg

SEQ ID NO: 538266 - RNA, 64 nt, hsa
ugcucauccccaccugucuucaacagcuccccauuacccucaggacaaugucugaacucuccag

SEQ ID NO: 538267 - RNA, 64 nt, hsa; identical to SEQ ID NO: 180322

SEQ ID NO: 538268 - RNA, 64 nt, hsa; identical to SEQ ID NO: 180323

SEQ ID NO: 538269 - RNA, 64 nt, hsa; identical to SEQ ID NO: 180324

SEQ ID NO: 538270 - RNA, 64 nt, hsa; identical to SEQ ID NO: 180325

SEQ ID NO: 538271 - RNA, 64 nt, hsa; identical to SEQ ID NO: 180326

SEQ ID NO: 538272 - RNA, 64 nt, hsa; identical to SEQ ID NO: 180327

SEQ ID NO: 538273 - RNA, 64 nt, hsa; identical to SEQ ID NO: 180328

SEQ ID NO: 538274 - RNA, 64 nt, hsa; identical to SEQ ID NO: 180329

SEQ ID NO: 538275 - RNA, 64 nt, hsa; identical to SEQ ID NO: 180330

SEQ ID NO: 538276 - RNA, 64 nt, hsa; identical to SEQ ID NO: 180331

SEQ ID NO: 538277 - RNA, 64 nt, hsa; identical to SEQ ID NO: 180332

SEQ ID NO: 538278 - RNA, 64 nt, hsa; identical to SEQ ID NO: 180333

SEQ ID NO: 538279 - RNA, 64 nt, hsa; identical to SEQ ID NO: 180334

SEQ ID NO: 538280 - RNA, 64 nt, hsa; identical to SEQ ID NO: 180335

SEQ ID NO: 538281 - RNA, 64 nt, hsa; identical to SEQ ID NO: 180336

SEQ ID NO: 538282 - RNA, 64 nt, hsa; identical to SEQ ID NO: 180337

SEQ ID NO: 538283 - RNA, 64 nt, hsa; identical to SEQ ID NO: 180338

SEQ ID NO: 538284 - RNA, 64 nt, hsa; identical to SEQ ID NO: 180339

SEQ ID NO: 538285 - RNA, 64 nt, hsa
cuaauaaaccuccaguguuagcuaauuuguuauucuaggagaauuuuagaugucgguucuuuga

SEQ ID NO: 538286 - RNA, 64 nt, hsa
uuuauaaaacaacagaacagccaggaaaauggugcuaggagagacaguggagaggccagagaag

SEQ ID NO: 538287 - RNA, 64 nt, hsa
uaaaucuuacaacucaagagguggcagccacccucuaggagacaaaacuacccccacugacaag

SEQ ID NO: 538288 - RNA, 64 nt, hsa
aagcccauguaucugaccuuacgugccuuuugaacuaggagaaucgggcuaauuuauuaaugau

SEQ ID NO: 538289 - RNA, 64 nt, hsa
auuuuaagguugagacuccaagucuccuaaaauucuaggagagaaauaaagagucuguuuuugc

SEQ ID NO: 538290 - RNA, 64 nt, hsa
agcacuucuauaugcaaggugaauauguacugagcuaggagacuucccugcaaaaucucuguuc

SEQ ID NO: 538291 - RNA, 64 nt, hsa; identical to SEQ ID NO: 84248

SEQ ID NO: 538292 - RNA, 64 nt, hsa; identical to SEQ ID NO: 84249

SEQ ID NO: 538293 - RNA, 64 nt, hsa; identical to SEQ ID NO: 84250

SEQ ID NO: 538294 - RNA, 64 nt, hsa; identical to SEQ ID NO: 84251

SEQ ID NO: 538295 - RNA, 64 nt, hsa; identical to SEQ ID NO: 84252

SEQ ID NO: 538296 - RNA, 64 nt, hsa; identical to SEQ ID NO: 84253

SEQ ID NO: 538297 - RNA, 64 nt, hsa; identical to SEQ ID NO: 84254

SEQ ID NO: 538298 - RNA, 64 nt, hsa; identical to SEQ ID NO: 84255

SEQ ID NO: 538299 - RNA, 64 nt, hsa; identical to SEQ ID NO: 84256

SEQ ID NO: 538300 - RNA, 64 nt, hsa; identical to SEQ ID NO: 84257

SEQ ID NO: 538301 - RNA, 64 nt, hsa; identical to SEQ ID NO: 84258

SEQ ID NO: 538302 - RNA, 64 nt, hsa; identical to SEQ ID NO: 84259

SEQ ID NO: 538303 - RNA, 64 nt, hsa; identical to SEQ ID NO: 84260

SEQ ID NO: 538304 - RNA, 55 nt, hsa; identical to SEQ ID NO: 84261

SEQ ID NO: 538305 - RNA, 64 nt, hsa; identical to SEQ ID NO: 84262

SEQ ID NO: 538306 - RNA, 64 nt, hsa; identical to SEQ ID NO: 84263

SEQ ID NO: 538307 - RNA, 64 nt, hsa; identical to SEQ ID NO: 84264

SEQ ID NO: 538308 - RNA, 64 nt, hsa; identical to SEQ ID NO: 84265

SEQ ID NO: 538309 - RNA, 64 nt, hsa; identical to SEQ ID NO: 84266

SEQ ID NO: 538310 - RNA, 64 nt, hsa; identical to SEQ ID NO: 84267

SEQ ID NO: 538311 - RNA, 64 nt, hsa; identical to SEQ ID NO: 84268

SEQ ID NO: 538312 - RNA, 64 nt, hsa; identical to SEQ ID NO: 414052

SEQ ID NO: 538313 - RNA, 64 nt, hsa; identical to SEQ ID NO: 414053

SEQ ID NO: 538314 - RNA, 64 nt, hsa; identical to SEQ ID NO: 414054

SEQ ID NO: 538315 - RNA, 64 nt, hsa; identical to SEQ ID NO: 414055

SEQ ID NO: 538316 - RNA, 64 nt, hsa; identical to SEQ ID NO: 414056

SEQ ID NO: 538317 - RNA, 64 nt, hsa; identical to SEQ ID NO: 414057

SEQ ID NO: 538318 - RNA, 64 nt, hsa; identical to SEQ ID NO: 414058

SEQ ID NO: 538319 - RNA, 64 nt, hsa; identical to SEQ ID NO: 414059

SEQ ID NO: 538320 - RNA, 64 nt, hsa
uggcuacacugcaacuuccguccagugcugugaugcccaugacaccugcaaaauaaguucugcc

SEQ ID NO: 538321 - RNA, 64 nt, hsa
auagggcaagaccuuugugcuuuugaucauucuggcccaugaaagcaacuuuggucuccuuucc

SEQ ID NO: 538322 - RNA, 64 nt, hsa
uauuugcccagaguuugcucaauuccaagacagugcccaugaaugggacaccuguaauguaacc

SEQ ID NO: 538323 - RNA, 64 nt, hsa
uauuaaaauauauuuaauauguuuugccuuuguggcccaugaaagucuuacugggcccugggga

SEQ ID NO: 538324 - RNA, 64 nt, hsa
uguguagcuucuuguagcuuagaaagcgcuuuaugcccaugaugucauuucaggcucaaccaaa

SEQ ID NO: 538325 - RNA, 64 nt, hsa
uucaagggccaagcugccccuuucccuccucuccgcccaugaaaaugccuccaaacugagaugc

SEQ ID NO: 538326 - RNA, 64 nt, hsa; identical to SEQ ID NO: 524971

SEQ ID NO: 538327 - RNA, 64 nt, hsa; identical to SEQ ID NO: 524972

SEQ ID NO: 538328 - RNA, 64 nt, hsa; identical to SEQ ID NO: 524973

SEQ ID NO: 538329 - RNA, 64 nt, hsa; identical to SEQ ID NO: 524974

SEQ ID NO: 538330 - RNA, 64 nt, hsa; identical to SEQ ID NO: 524975

SEQ ID NO: 538331 - RNA, 64 nt, hsa; identical to SEQ ID NO: 524976

SEQ ID NO: 538332 - RNA, 64 nt, hsa; identical to SEQ ID NO: 524977

SEQ ID NO: 538333 - RNA, 64 nt, hsa; identical to SEQ ID NO: 524978

SEQ ID NO: 538334 - RNA, 64 nt, hsa; identical to SEQ ID NO: 524979

SEQ ID NO: 538335 - RNA, 64 nt, hsa; identical to SEQ ID NO: 524980

SEQ ID NO: 538336 - RNA, 64 nt, hsa; identical to SEQ ID NO: 524981

SEQ ID NO: 538337 - RNA, 64 nt, hsa; identical to SEQ ID NO: 524982

SEQ ID NO: 538338 - RNA, 64 nt, hsa; identical to SEQ ID NO: 524983

SEQ ID NO: 538339 - RNA, 64 nt, hsa; identical to SEQ ID NO: 524984

SEQ ID NO: 538340 - RNA, 64 nt, hsa; identical to SEQ ID NO: 524985

SEQ ID NO: 538341 - RNA, 64 nt, hsa; identical to SEQ ID NO: 524986

SEQ ID NO: 538342 - RNA, 64 nt, hsa; identical to SEQ ID NO: 524987

SEQ ID NO: 538343 - RNA, 64 nt, hsa; identical to SEQ ID NO: 524988

SEQ ID NO: 538344 - RNA, 64 nt, hsa; identical to SEQ ID NO: 524989

SEQ ID NO: 538345 - RNA, 64 nt, hsa; identical to SEQ ID NO: 524990

SEQ ID NO: 538346 - RNA, 64 nt, hsa; identical to SEQ ID NO: 524991

SEQ ID NO: 538347 - RNA, 64 nt, hsa; identical to SEQ ID NO: 524992

SEQ ID NO: 538348 - RNA, 64 nt, hsa; identical to SEQ ID NO: 524993

SEQ ID NO: 538349 - RNA, 64 nt, hsa; identical to SEQ ID NO: 524994

SEQ ID NO: 538350 - RNA, 64 nt, hsa; identical to SEQ ID NO: 524995

SEQ ID NO: 538351 - RNA, 64 nt, hsa; identical to SEQ ID NO: 524996

SEQ ID NO: 538352 - RNA, 64 nt, hsa; identical to SEQ ID NO: 524997

SEQ ID NO: 538353 - RNA, 64 nt, hsa; identical to SEQ ID NO: 524998

SEQ ID NO: 538354 - RNA, 64 nt, hsa; identical to SEQ ID NO: 524999

SEQ ID NO: 538355 - RNA, 64 nt, hsa; identical to SEQ ID NO: 525000

SEQ ID NO: 538356 - RNA, 64 nt, hsa; identical to SEQ ID NO: 525001

SEQ ID NO: 538357 - RNA, 64 nt, hsa; identical to SEQ ID NO: 525002

SEQ ID NO: 538358 - RNA, 64 nt, hsa; identical to SEQ ID NO: 525003

SEQ ID NO: 538359 - RNA, 64 nt, hsa; identical to SEQ ID NO: 525004

SEQ ID NO: 538360 - RNA, 64 nt, hsa; identical to SEQ ID NO: 525005

SEQ ID NO: 538361 - RNA, 64 nt, hsa; identical to SEQ ID NO: 525006

SEQ ID NO: 538362 - RNA, 64 nt, hsa; identical to SEQ ID NO: 525007

SEQ ID NO: 538363 - RNA, 64 nt, hsa; identical to SEQ ID NO: 525008

SEQ ID NO: 538364 - RNA, 64 nt, hsa; identical to SEQ ID NO: 525009

SEQ ID NO: 538365 - RNA, 64 nt, hsa; identical to SEQ ID NO: 525010

SEQ ID NO: 538366 - RNA, 64 nt, hsa; identical to SEQ ID NO: 525011

SEQ ID NO: 538367 - RNA, 64 nt, hsa; identical to SEQ ID NO: 525012

SEQ ID NO: 538368 - RNA, 64 nt, hsa; identical to SEQ ID NO: 525013

SEQ ID NO: 538369 - RNA, 64 nt, hsa; identical to SEQ ID NO: 525014

SEQ ID NO: 538370 - RNA, 64 nt, hsa; identical to SEQ ID NO: 414866

SEQ ID NO: 538371 - RNA, 64 nt, hsa; identical to SEQ ID NO: 414867

SEQ ID NO: 538372 - RNA, 64 nt, hsa; identical to SEQ ID NO: 414868

SEQ ID NO: 538373 - RNA, 64 nt, hsa; identical to SEQ ID NO: 414869

SEQ ID NO: 538374 - RNA, 64 nt, hsa; identical to SEQ ID NO: 414870

SEQ ID NO: 538375 - RNA, 64 nt, hsa; identical to SEQ ID NO: 414871

SEQ ID NO: 538376 - RNA, 64 nt, hsa; identical to SEQ ID NO: 414872

SEQ ID NO: 538377 - RNA, 64 nt, hsa; identical to SEQ ID NO: 414873

SEQ ID NO: 538378 - RNA, 64 nt, hsa; identical to SEQ ID NO: 300837

SEQ ID NO: 538379 - RNA, 64 nt, hsa; identical to SEQ ID NO: 300838

SEQ ID NO: 538380 - RNA, 64 nt, hsa; identical to SEQ ID NO: 300839

SEQ ID NO: 538381 - RNA, 64 nt, hsa; identical to SEQ ID NO: 300840

SEQ ID NO: 538382 - RNA, 64 nt, hsa; identical to SEQ ID NO: 300841

SEQ ID NO: 538383 - RNA, 64 nt, hsa; identical to SEQ ID NO: 300842

SEQ ID NO: 538384 - RNA, 64 nt, hsa; identical to SEQ ID NO: 300843

SEQ ID NO: 538385 - RNA, 64 nt, hsa; identical to SEQ ID NO: 300844

SEQ ID NO: 538386 - RNA, 64 nt, hsa; identical to SEQ ID NO: 300845

SEQ ID NO: 538387 - RNA, 64 nt, hsa; identical to SEQ ID NO: 300846

SEQ ID NO: 538388 - RNA, 64 nt, hsa; identical to SEQ ID NO: 300847

SEQ ID NO: 538389 - RNA, 64 nt, hsa; identical to SEQ ID NO: 300848

SEQ ID NO: 538390 - RNA, 64 nt, hsa; identical to SEQ ID NO: 300849

SEQ ID NO: 538391 - RNA, 64 nt, hsa; identical to SEQ ID NO: 300850

SEQ ID NO: 538392 - RNA, 64 nt, hsa; identical to SEQ ID NO: 300851

SEQ ID NO: 538393 - RNA, 64 nt, hsa; identical to SEQ ID NO: 300852

SEQ ID NO: 538394 - RNA, 64 nt, hsa; identical to SEQ ID NO: 300853

SEQ ID NO: 538395 - RNA, 64 nt, hsa; identical to SEQ ID NO: 300854

SEQ ID NO: 538396 - RNA, 64 nt, hsa; identical to SEQ ID NO: 511547

SEQ ID NO: 538397 - RNA, 64 nt, hsa; identical to SEQ ID NO: 511548

SEQ ID NO: 538398 - RNA, 64 nt, hsa; identical to SEQ ID NO: 511549

SEQ ID NO: 538399 - RNA, 64 nt, hsa; identical to SEQ ID NO: 511550

SEQ ID NO: 538400 - RNA, 64 nt, hsa; identical to SEQ ID NO: 511551

SEQ ID NO: 538401 - RNA, 64 nt, hsa; identical to SEQ ID NO: 511552

SEQ ID NO: 538402 - RNA, 64 nt, hsa; identical to SEQ ID NO: 511553

SEQ ID NO: 538403 - RNA, 64 nt, hsa; identical to SEQ ID NO: 511554

SEQ ID NO: 538404 - RNA, 64 nt, hsa; identical to SEQ ID NO: 511555

SEQ ID NO: 538405 - RNA, 64 nt, hsa; identical to SEQ ID NO: 511556

SEQ ID NO: 538406 - RNA, 64 nt, hsa; identical to SEQ ID NO: 511557

SEQ ID NO: 538407 - RNA, 64 nt, hsa; identical to SEQ ID NO: 511558

SEQ ID NO: 538408 - RNA, 64 nt, hsa; identical to SEQ ID NO: 511559

SEQ ID NO: 538409 - RNA, 64 nt, hsa; identical to SEQ ID NO: 511560

SEQ ID NO: 538410 - RNA, 64 nt, hsa; identical to SEQ ID NO: 511561

SEQ ID NO: 538411 - RNA, 64 nt, hsa; identical to SEQ ID NO: 511562

SEQ ID NO: 538412 - RNA, 64 nt, hsa; identical to SEQ ID NO: 511563

SEQ ID NO: 538413 - RNA, 64 nt, hsa; identical to SEQ ID NO: 511564

SEQ ID NO: 538414 - RNA, 64 nt, hsa; identical to SEQ ID NO: 511565

SEQ ID NO: 538415 - RNA, 64 nt, hsa; identical to SEQ ID NO: 511566

SEQ ID NO: 538416 - RNA, 64 nt, hsa; identical to SEQ ID NO: 318834

SEQ ID NO: 538417 - RNA, 64 nt, hsa; identical to SEQ ID NO: 318835

SEQ ID NO: 538418 - RNA, 62 nt, hsa; identical to SEQ ID NO: 318836

SEQ ID NO: 538419 - RNA, 64 nt, hsa; identical to SEQ ID NO: 318837

SEQ ID NO: 538420 - RNA, 64 nt, hsa; identical to SEQ ID NO: 318838

SEQ ID NO: 538421 - RNA, 64 nt, hsa; identical to SEQ ID NO: 318839

SEQ ID NO: 538422 - RNA, 64 nt, hsa; identical to SEQ ID NO: 318840

SEQ ID NO: 538423 - RNA, 64 nt, hsa; identical to SEQ ID NO: 318841

SEQ ID NO: 538424 - RNA, 64 nt, hsa; identical to SEQ ID NO: 318842

SEQ ID NO: 538425 - RNA, 64 nt, hsa; identical to SEQ ID NO: 318843

SEQ ID NO: 538426 - RNA, 64 nt, hsa; identical to SEQ ID NO: 318844

SEQ ID NO: 538427 - RNA, 64 nt, hsa; identical to SEQ ID NO: 318845

SEQ ID NO: 538428 - RNA, 64 nt, hsa; identical to SEQ ID NO: 318846

SEQ ID NO: 538429 - RNA, 64 nt, hsa; identical to SEQ ID NO: 318847

SEQ ID NO: 538430 - RNA, 64 nt, hsa; identical to SEQ ID NO: 318848

SEQ ID NO: 538431 - RNA, 64 nt, hsa; identical to SEQ ID NO: 318849

SEQ ID NO: 538432 - RNA, 64 nt, hsa; identical to SEQ ID NO: 318850

SEQ ID NO: 538433 - RNA, 64 nt, hsa; identical to SEQ ID NO: 318851

SEQ ID NO: 538434 - RNA, 64 nt, hsa; identical to SEQ ID NO: 318852

SEQ ID NO: 538435 - RNA, 64 nt, hsa; identical to SEQ ID NO: 318853

SEQ ID NO: 538436 - RNA, 64 nt, hsa; identical to SEQ ID NO: 318854

SEQ ID NO: 538437 - RNA, 64 nt, hsa; identical to SEQ ID NO: 318855

SEQ ID NO: 538438 - RNA, 64 nt, hsa; identical to SEQ ID NO: 318856

SEQ ID NO: 538439 - RNA, 64 nt, hsa; identical to SEQ ID NO: 318857

SEQ ID NO: 538440 - RNA, 64 nt, hsa; identical to SEQ ID NO: 318858

SEQ ID NO: 538441 - RNA, 64 nt, hsa; identical to SEQ ID NO: 318859

SEQ ID NO: 538442 - RNA, 64 nt, hsa; identical to SEQ ID NO: 318860

SEQ ID NO: 538443 - RNA, 64 nt, hsa; identical to SEQ ID NO: 318861

SEQ ID NO: 538444 - RNA, 64 nt, hsa; identical to SEQ ID NO: 318862

SEQ ID NO: 538445 - RNA, 64 nt, hsa; identical to SEQ ID NO: 318863

SEQ ID NO: 538446 - RNA, 64 nt, hsa; identical to SEQ ID NO: 318864

SEQ ID NO: 538447 - RNA, 64 nt, hsa; identical to SEQ ID NO: 318865

SEQ ID NO: 538448 - RNA, 64 nt, hsa; identical to SEQ ID NO: 318866

SEQ ID NO: 538449 - RNA, 64 nt, hsa; identical to SEQ ID NO: 318867

SEQ ID NO: 538450 - RNA, 64 nt, hsa; identical to SEQ ID NO: 318868

SEQ ID NO: 538451 - RNA, 64 nt, hsa; identical to SEQ ID NO: 318869

SEQ ID NO: 538452 - RNA, 64 nt, hsa; identical to SEQ ID NO: 318870

SEQ ID NO: 538453 - RNA, 64 nt, hsa; identical to SEQ ID NO: 318871

SEQ ID NO: 538454 - RNA, 64 nt, hsa; identical to SEQ ID NO: 318872

SEQ ID NO: 538455 - RNA, 64 nt, hsa; identical to SEQ ID NO: 318873

SEQ ID NO: 538456 - RNA, 64 nt, hsa; identical to SEQ ID NO: 318874

SEQ ID NO: 538457 - RNA, 64 nt, hsa; identical to SEQ ID NO: 318875

SEQ ID NO: 538458 - RNA, 64 nt, hsa; identical to SEQ ID NO: 318876

SEQ ID NO: 538459 - RNA, 64 nt, hsa; identical to SEQ ID NO: 318877

SEQ ID NO: 538460 - RNA, 64 nt, hsa; identical to SEQ ID NO: 318878

SEQ ID NO: 538461 - RNA, 64 nt, hsa; identical to SEQ ID NO: 318879

SEQ ID NO: 538462 - RNA, 64 nt, hsa; identical to SEQ ID NO: 318880

SEQ ID NO: 538463 - RNA, 64 nt, hsa; identical to SEQ ID NO: 318881

SEQ ID NO: 538464 - RNA, 64 nt, hsa; identical to SEQ ID NO: 318882

SEQ ID NO: 538465 - RNA, 64 nt, hsa; identical to SEQ ID NO: 318883

SEQ ID NO: 538466 - RNA, 64 nt, hsa; identical to SEQ ID NO: 318884

SEQ ID NO: 538467 - RNA, 64 nt, hsa; identical to SEQ ID NO: 318885

SEQ ID NO: 538468 - RNA, 64 nt, hsa; identical to SEQ ID NO: 318886

SEQ ID NO: 538469 - RNA, 64 nt, hsa; identical to SEQ ID NO: 318887

SEQ ID NO: 538470 - RNA, 64 nt, hsa; identical to SEQ ID NO: 318888

SEQ ID NO: 538471 - RNA, 64 nt, hsa; identical to SEQ ID NO: 318889

SEQ ID NO: 538472 - RNA, 64 nt, hsa; identical to SEQ ID NO: 318890

SEQ ID NO: 538473 - RNA, 64 nt, hsa; identical to SEQ ID NO: 318891

SEQ ID NO: 538474 - RNA, 64 nt, hsa; identical to SEQ ID NO: 318892

SEQ ID NO: 538475 - RNA, 64 nt, hsa; identical to SEQ ID NO: 318893

SEQ ID NO: 538476 - RNA, 64 nt, hsa; identical to SEQ ID NO: 318894

SEQ ID NO: 538477 - RNA, 64 nt, hsa; identical to SEQ ID NO: 318895

SEQ ID NO: 538478 - RNA, 64 nt, hsa; identical to SEQ ID NO: 318896

SEQ ID NO: 538479 - RNA, 64 nt, hsa; identical to SEQ ID NO: 318897

SEQ ID NO: 538480 - RNA, 64 nt, hsa; identical to SEQ ID NO: 318898

SEQ ID NO: 538481 - RNA, 64 nt, hsa; identical to SEQ ID NO: 318899

SEQ ID NO: 538482 - RNA, 64 nt, hsa; identical to SEQ ID NO: 318900

SEQ ID NO: 538483 - RNA, 64 nt, hsa; identical to SEQ ID NO: 318901

SEQ ID NO: 538484 - RNA, 64 nt, hsa; identical to SEQ ID NO: 318902

SEQ ID NO: 538485 - RNA, 64 nt, hsa; identical to SEQ ID NO: 318903

SEQ ID NO: 538486 - RNA, 64 nt, hsa; identical to SEQ ID NO: 318904

SEQ ID NO: 538487 - RNA, 64 nt, hsa; identical to SEQ ID NO: 318905

SEQ ID NO: 538488 - RNA, 64 nt, hsa; identical to SEQ ID NO: 318906

SEQ ID NO: 538489 - RNA, 64 nt, hsa; identical to SEQ ID NO: 318907

SEQ ID NO: 538490 - RNA, 64 nt, hsa; identical to SEQ ID NO: 318908

SEQ ID NO: 538491 - RNA, 64 nt, hsa; identical to SEQ ID NO: 318909

SEQ ID NO: 538492 - RNA, 64 nt, hsa; identical to SEQ ID NO: 318910

SEQ ID NO: 538493 - RNA, 64 nt, hsa; identical to SEQ ID NO: 318911

SEQ ID NO: 538494 - RNA, 64 nt, hsa; identical to SEQ ID NO: 318912

SEQ ID NO: 538495 - RNA, 64 nt, hsa; identical to SEQ ID NO: 318913

SEQ ID NO: 538496 - RNA, 64 nt, hsa; identical to SEQ ID NO: 318914

SEQ ID NO: 538497 - RNA, 64 nt, hsa; identical to SEQ ID NO: 318915

SEQ ID NO: 538498 - RNA, 64 nt, hsa; identical to SEQ ID NO: 318916

SEQ ID NO: 538499 - RNA, 58 nt, hsa; identical to SEQ ID NO: 318917

SEQ ID NO: 538500 - RNA, 64 nt, hsa; identical to SEQ ID NO: 318918

SEQ ID NO: 538501 - RNA, 64 nt, hsa; identical to SEQ ID NO: 318919

SEQ ID NO: 538502 - RNA, 64 nt, hsa; identical to SEQ ID NO: 318920

SEQ ID NO: 538503 - RNA, 64 nt, hsa
agagggcaggucagggauugggcgguguaaauugacucagaaaccugcgguuucagcuuuucug

SEQ ID NO: 538504 - RNA, 64 nt, hsa
acaaaaccucauggcaaucuuguccucacuggagacucagaaggggaagcauugggaaaccaug

SEQ ID NO: 538505 - RNA, 64 nt, hsa
agaaagagaacauggucacccaaaagcaacuguaacucagaaauuaaguuacucagaaauuaag

SEQ ID NO: 538506 - RNA, 64 nt, hsa
cacccaaaagcaacuguaacucagaaauuaaguuacucagaaauuaaguagcucagaaauuaag

SEQ ID NO: 538507 - RNA, 64 nt, hsa
uucaaaaguugaaauuaaccauagauguagauaaacucagaaauuuaauucauguuucuuaaau

SEQ ID NO: 538508 - RNA, 64 nt, hsa
ugcaaccuguugauagcaagugaauuuuucucuaacucagaaacaucaguuacucugaagggca

SEQ ID NO: 538509 - RNA, 64 nt, hsa
cuggaaagaccuuaucugaaggucagaaacauugacucagaaaaaagguaugaagucuuuccau

SEQ ID NO: 538510 - RNA, 64 nt, hsa
agaaacagaaaaaucuaucuucccaucuccuaaaacucagaaugcacaguaauacuuaaggcuu

SEQ ID NO: 538511 - RNA, 64 nt, hsa
cuguaaaguaguuacaagagaacaguugcccaagacucagaauuuuuaaaaaaaaaaauggagc

SEQ ID NO: 538512 - RNA, 64 nt, hsa
uauuuacagguacaacagaauaucucgggaauggacucagaaguaugccaugugaugcuaccuu

SEQ ID NO: 538513 - RNA, 64 nt, hsa
aucagagaaagggaaacuuacuccuaauaaacagacucagaacagaagggacauaugcauaaau

SEQ ID NO: 538514 - RNA, 64 nt, hsa
gaguaguauggaauauuaagauuauguuccuuauacucagaauacuuuuuaugagcucucuugu

SEQ ID NO: 538515 - RNA, 64 nt, hsa
uaacacaaagcucauguuaagaaaacaguugaggacucagaagucaguucgaaaaugcacuuuc

SEQ ID NO: 538516 - RNA, 64 nt, hsa
agcaccucacgcugggggaaucaaucccugagggacucagaaucuucuccgugcaaccuggaaa

SEQ ID NO: 538517 - RNA, 64 nt, hsa
gugccuucaaugaaacaagccugaauaauuuucaacucagaagcuugcacugcuaagagugguu

SEQ ID NO: 538518 - RNA, 64 nt, hsa
cuuuggcuguuacccuuccuugaaaauaacccgaacucagaauuauuuaaagcauucauguuuc

SEQ ID NO: 538519 - RNA, 64 nt, hsa
cuucaccagaagacccugcaggccaugaagagccacucagaaaaggcccauggccauggagcuu

SEQ ID NO: 538520 - RNA, 64 nt, hsa
ggcuaccuuaccaguauaaagagcugauaacaguacucagaagaaucugugaacaaauacuuga

SEQ ID NO: 538521 - RNA, 64 nt, hsa
cugcaaucaccaagcugagacuucucuuugauuuacucagaaggacuggaaaauguuguccugc

SEQ ID NO: 538522 - RNA, 64 nt, hsa
aaaaagaaacuuccuauuacuauccuaaauggaaacucagaaucacuugcuauaauuagaaagu

SEQ ID NO: 538523 - RNA, 64 nt, hsa
uuaagacgcacuggaaaucacacaauggaacaacacucagaaaugcggaauacccuacagcaaa

SEQ ID NO: 538524 - RNA, 64 nt, hsa
gacugcagaagguaugaauaccaggaaacagauaacucagaagcaucugggaaauuugccaugg

SEQ ID NO: 538525 - RNA, 64 nt, hsa
ugcacuccagccugggcaacagagcgagacuccaacucagaaaaagcaaaacaaaacaaacaaa

SEQ ID NO: 538526 - RNA, 64 nt, hsa
caaccucaggaaccaaaggucaccgacacugaguacucagaaaucaagauacacaagugaggaa

SEQ ID NO: 538527 - RNA, 64 nt, hsa
gaacccaaggcuguccacaucuggcuuuugugggacucagaaagggaagcagaacugagggcug

SEQ ID NO: 538528 - RNA, 64 nt, hsa
gucuagagguugugggcagcauggacagucccccacucagaagugcaagaguuccaaagagccu

SEQ ID NO: 538529 - RNA, 64 nt, hsa; identical to SEQ ID NO: 77016

SEQ ID NO: 538530 - RNA, 64 nt, hsa; identical to SEQ ID NO: 77017

SEQ ID NO: 538531 - RNA, 64 nt, hsa; identical to SEQ ID NO: 77018

SEQ ID NO: 538532 - RNA, 64 nt, hsa; identical to SEQ ID NO: 77019

SEQ ID NO: 538533 - RNA, 64 nt, hsa
aguacucaguaacagugaaguacucaguaauacaguacaguauucaguaaggcagugaaguacu

SEQ ID NO: 538534 - RNA, 64 nt, hsa
uacucaguaacacagugcaguacucaguaauacaguacaguacucaguaaggcaguaugguacu

SEQ ID NO: 538535 - RNA, 64 nt, hsa
gauucuaacauuuauguaucuuuauuuucauauuguacaguaauuuuacuuuaaauuauuuaaa

SEQ ID NO: 538536 - RNA, 64 nt, hsa
gagcagcagcaguuaugugaugcaacacuugaugguacaguaaauuuacuggcauuuuucuccu

SEQ ID NO: 538537 - RNA, 64 nt, hsa
uuauauuaucuuaagcauguguaaugcuggauguguacaguacaguacugaacuuguaauuuga

SEQ ID NO: 538538 - RNA, 64 nt, hsa
uuaucuuaagcauguguaaugcuggauguguacaguacaguacugaacuuguaauuugaaucua

SEQ ID NO: 538539 - RNA, 64 nt, hsa
aaacuacucuucuagugguuaaugcacuugacauguacaguauguuucccaugccguugugauu

SEQ ID NO: 538540 - RNA, 64 nt, hsa
caguauguuucccaugccguugugauuuugacauguacaguauguuuucaugccguugugaauu

SEQ ID NO: 538541 - RNA, 64 nt, hsa
uauaacuaaacuaacaagauuaaauauccagccaguacaguauuuuuuaaggcaaauaaagaug

SEQ ID NO: 538542 - RNA, 64 nt, hsa
caggggaagguuguaugugucauuuauaacuucuguacaguaagaccaccugccaaaagcugga

SEQ ID NO: 538543 - RNA, 64 nt, hsa
gaucggagaauacucuuguuucaccauuauguugguacaguauaguaccauuauuuuauguugu

SEQ ID NO: 538544 - RNA, 64 nt, hsa
uuuuaagaaucugcagauggcauccauagauacaguacaguauuuacugucaaugcaaaagaau

SEQ ID NO: 538545 - RNA, 64 nt, hsa
aagugagugaacagcaaggaagaguguuugcacaguacaguaacauuugguuguucuuaaggcu

SEQ ID NO: 538546 - RNA, 64 nt, hsa
uuuuguuuuuguuuuuguuuuccuugcagauacuguacaguaauggucaacuuugccacuugca

SEQ ID NO: 538547 - RNA, 64 nt, hsa
aaagaagcaaaucauuugcacucuauaauuugugguacaguauugcuuauugugacuuuggcau

SEQ ID NO: 538548 - RNA, 64 nt, hsa
uaaacaaacccaauaugaugcauuuuaagguggaguacaguaagauguguggguuuuucuguau

SEQ ID NO: 538549 - RNA, 64 nt, hsa
auuguaaaguuucaauuguagaaacaacugguauguacaguaccauaauuuaauuacauuuuac

SEQ ID NO: 538550 - RNA, 64 nt, hsa
ucaggccaaggugggaguauagugcauaauaauuguacaguagcaauuuuuauccuaauuaacc

SEQ ID NO: 538551 - RNA, 64 nt, hsa
ucagaaguaaagcaaagaagcuauaacauguuauguacaguacacucugaaaagaaaucugaaa

SEQ ID NO: 538552 - RNA, 64 nt, hsa
acugugucucacaucaccauguagaagaaugggcguacaguauauaccgugacauccugaaccc

SEQ ID NO: 538553 - RNA, 64 nt, hsa
guucauuuaaaaaaauaacuacaguauagcgcugguacaguacacuaaaagacuuugauaaaaa

SEQ ID NO: 538554 - RNA, 64 nt, hsa
uugugacuuuauuuuuuuaauucacaaggaccagguacaguagcugaaacccaauucagaucca

SEQ ID NO: 538555 - RNA, 64 nt, hsa
auucuaucuauagauuuauauauguauacauucuguacaguaguuccaucaaaauauguaauaa

SEQ ID NO: 538556 - RNA, 64 nt, hsa
uuacucaggacuuaauguagcauugcacuucuguguacaguaaaacugcuuuguuuuacuaaag

SEQ ID NO: 538557 - RNA, 64 nt, hsa
aaaagaaaaggaauuuaacaauuugcauccccuuguacaguaaggcuuaucaugacagagcgca

SEQ ID NO: 538558 - RNA, 64 nt, hsa
aaggcuuaucaugacagagcgcacuauuucugauguacaguauuuuuuguuguuuuuaucauca

SEQ ID NO: 538559 - RNA, 64 nt, hsa
aaaagaaaaggaauuuaacaauuugcauccccuuguacaguaaggcuuaucaugacagagcgua

SEQ ID NO: 538560 - RNA, 64 nt, hsa
aaggcuuaucaugacagagcguacuauuucugauguacaguauuuuuuguuguuuuuaucauca

SEQ ID NO: 538561 - RNA, 64 nt, hsa
acaggguuucuucauguuggucaggcuggucucaaacuccuaaccucgugauccgccugccucg

SEQ ID NO: 538562 - RNA, 64 nt, hsa
auggggucuugcuguguugcccaggcuggucucaaacuccuaggcuuaagcaguccuccagccu

SEQ ID NO: 538563 - RNA, 64 nt, hsa
auauacauauauauacacauauguauguauaccuaacuccuaaaguggaacaguaagagucauu

SEQ ID NO: 538564 - RNA, 64 nt, hsa
ggaaagaauuucuguauuccucaccccaccugugaacuccuaccagagagaaaccuuuuguaug

SEQ ID NO: 538565 - RNA, 64 nt, hsa
cacuggacauucucccuuugccucucugggcagcaacuccuaggccagccgaccugcugugucg

SEQ ID NO: 538566 - RNA, 64 nt, hsa
auagggacuugcuauguugccuaggcugaucuugaacuccuaaccucaagcaauccucccaccu

SEQ ID NO: 538567 - RNA, 64 nt, hsa
uauaaucuccaaagaaagaauaagucuccaaggagcacaaaaaaaucauauguaccaaggaugu

SEQ ID NO: 538568 - RNA, 64 nt, hsa
agcaggagguggacagagucucucauggaugccggcacaaaacugccuuaaaauauucauaguu

SEQ ID NO: 538569 - RNA, 64 nt, hsa
aucuacagaccuggcuccucggaucugaagcccagcacaaaauaaucuccccguccaaggagcu

SEQ ID NO: 538570 - RNA, 64 nt, hsa
uccccacucaguguaucugaccauguguguaagugcacaaaaaugugguuguagauguugcucu

SEQ ID NO: 538571 - RNA, 64 nt, hsa
acauuauaauguaauauauaaacuaaaauuuauggcacaaaagauaaauauggcuuugaaauua

SEQ ID NO: 538572 - RNA, 64 nt, hsa
agagggauggaccagacugccacagcagcucauagcacaaaaaaagguuaagaaguccuaguug

SEQ ID NO: 538573 - RNA, 64 nt, hsa
uuuacucccuuucuacugacaaaucaugauaagggcacaaaagcuguacagauuuuuuuuuuua

SEQ ID NO: 538574 - RNA, 64 nt, hsa
ugguagugcccacaagaaagaggacacaaguuuugcacaaaauugcaagucacuuccuauuccu

SEQ ID NO: 538575 - RNA, 64 nt, hsa
cuaaauaaucauugaugaaguaugucaguuacaagcacaaaagaauauaacugcuuuuauaaau

SEQ ID NO: 538576 - RNA, 64 nt, hsa
aaaucagcuuuuuaauguagguuaccacuuauaagcacaaaagaaacauguauaagaaaccaga

SEQ ID NO: 538577 - RNA, 64 nt, hsa
ccugcuguguguguuaauuccaggcagggaauuagcacaaaagguuuaggaaggaaucuuuuuu
